United States Patent 9,061,059 (MODIFIED POLYNUCLEOTIDES FOR TREATING PROTEIN DEFICIENCY) - sequence listing, part 105

SEQ ID NO: 204984 - DNA, 2892 bp, Artificial Sequence
  Description of Artificial Sequence: Synthetic coding sequence
atggccgcccagcggatccgggccgccaacagcaacggcctgccccggtgcaaatcagaaggcacactgatcgatctgagcgaggggtttagcgagacaagcttcaatgacataaaggtgcctagtccttcagctctcctagtggacaaccccaccccattcggcaatgccaaagaggtgattgccatcaaggattactgcccaacaaattttactaccttaaaattttctaagggcgaccacctatatgtcttggacacttccgggggtgaatggtggtacgcccataataccaccgaaatggggtacatcccctcttcttatgttcagccactgaactaccgcaactctacattaagtgactcgggcatgatagacaaccttcccgactctccggatgaagtggcgaaggaactggaattgctggggggctggaccgacgacaagaaggttccaggaagaatgtactccaataatccgttctggaacggggtgcagacaaacccctttttgaacggaaacgtgcctgtgatgccctctctggacgagctgaacccaaaaagcacggtggatctgctcctgttcgatgccggaacctcctcattcactgagagcagttctgccactactaacagcactggtaacatattcgacgagttgcccgtgaccaacggcctgcatgcagagcctcctgtgcgcagggataacccgttttttagatccaagcggagttattctttgtccgaattatcagtgctgcaggctaaatcagacgccccgacatcttcaagcttttttacaggcctaaagagcccggccccggaacagtttcagagtcgggaagactttagaaccgcttggctcaaccaccgcaaattagcgcgcagctgtcatgacttggaccttctggggcagagtcctggctgggggcagactcaggctgtggagaccaatattgtctgtaaactggactcctctgggggcgccgtgcaactccccgatacttctatttccatacatgtgcctgagggccacgttgcccctggcgagactcagcagatttctatgaaagctctgctcgaccctccactggagctgaattcagacaggtcttgttccatttcgcctgtattggaagtcaagttatcgaacctggaagttaaaacaagtattatccttgaaatgaaggtcagcgctgaaattaagaatgacctattcagcaagagtacagtgggcctgcaatgcttgcgaagcgactccaaagagggtccatacgtttcagtgcctttaaactgttcttgcggggacaccgttcaggcccaacttcataacctcgaaccctgcatgtatgtcgcagtcgtggcgcatggtcccagtatcctctatccctccacagtctgggattttatcaacaagaaggtaacagtcgggctctacgggccgaagcacatccatccctctttcaagacagtagtgacaatcttcggtcatgactgcgctcctaagaccctgcttgtaagcgaagtcaccaggcaggcccccaatcccgccccagttgccttgcagctctgggggaaacatcaatttgttctgtcccgccctcaggatttgaaagtgtgtatgttctcgaacatgacgaactatgaggttaaggctagtgagcaggccaaggtggtccggggctttcagctcaagttgggcaaagtaagccgacttatctttccaattacctcacagaatccgaatgaacttagtgacttcactttaagagttcaagtgaaggacgatcaagaagctattcttactcaattctgtgtgcagacgccgcagcccccccccaaaagtgccatcaagccctccggccaaagacgatttctgaagaagaacgaagtcgggaagataattctaagccccttcgccaccactacaaagtacccgaccttccaagatcgacctgtctcgtctttaaaatttggcaagctgctgaagaccgtagtccggcagaataagaatcattacctgctggaatacaaaaaaggcgatgggatcgccctcctctccgaggaacgcgtccgcctgcgagggcagctgtggacaaaggagtggtatattgggtactaccagggtcgagttggactggtacataccaaaaatgtgttggtggtgggaagagcccggccctccctgtgcagcggtcccgagttgagcacatccgtcctgctggagcaaattttgaggccctgcaaattcttgacctatatttacgcctctgtcagaaccttgcttatggagaatatcagcagttggagaagttttgccgatgcacttggttacgtgaatcttcccttgacatttttctgccgggccgaattggactccgaacccgagcgggtggcttccgtgttagagaaattaaaggaagattgcaataatacagagaataaggaacggaaatcttttcagaaagaactggttatggcacttcttaagatggattgccagggcctggtcgtcaggctgattcaggacttcgttctgctcaccaccgctgtggaggtggcacagagatggcgggagctcgccgaaaagttagctaaggtgtcgaaacagcagatggatgcatacgagtctccgcaccgagacaggaacggcgtggtcgattcagaagcgatgtggaagccggcctacgactttcttctcacctggagtcatcagattggggatagctatcgcgacgtgattcaagagcttcaccttggcctggataagatgaaaaaccccataacgaagcggtggaaacatttgacaggcacattgattctcgtcaattctcttgacgtcttgagggcagccgccttcagccccgcagaccaggacgatttcgttatctag

SEQ ID NO: 204985 - DNA, 2892 bp, Artificial Sequence
  Description of Artificial Sequence: Synthetic coding sequence
atggccgcccagcggatccgggccgccaacagcaacggcctgcccaggtgtaagtcagagggaaccctgatcgacctctccgaaggattttccgagacctcatttaacgacattaaagtgccctcaccatctgcattgctagtggacaatccaacaccctttggaaacgctaaagaggtgatagctattaaagattattgccctactaacttcaccacactcaagttctccaaaggcgatcacttgtacgttctggatacctccggaggagagtggtggtatgcccacaacacaacggaaatggggtatattcctagctcttacgtccagcccctgaactacagaaactccactctgtctgattctggtatgatcgataacttgcctgacagcccggacgaagtcgccaaagagctcgagctgctggggggatggaccgacgataagaaggtgcctggcagaatgtattctaacaacccattctggaatggggttcagacaaacccattcctgaacgggaatgtgcctgtgatgccatccctcgatgagctgaatccaaagagcacggtggacctgctgttgttcgatgccggcaccagctcatttacagagtcttcttctgcaaccacgaatagtaccggcaacatttttgatgagctgcccgtcaccaacggcctccatgccgagcctccagtgcgtcgcgataaccccttctttcggagcaagagatcctattccctctcagagttgagcgtcttgcaggcaaaaagtgatgcacccacatcaagttctttctttacaggccttaagtcacctgcgccggagcagttccagagccgggaggatttccgtacggcttggctcaaccaccgtaaacttgcacggagctgccacgatctggacctgctcggacagtctcctggttggggccaaacgcaggctgtcgaaaccaacatagtatgcaagttggattccagcgggggagccgtccagctgccagacacctcaatctcgattcacgtgcctgaaggtcatgttgcaccaggagaaacgcagcaaattagcatgaaggcattactggacccacctttagaactaaattctgacaggtcctgtagcatcagccccgtcctagaggtgaaactcagcaacctggaagttaagaccagcatcatcctcgagatgaaggtgtcagcggagattaaaaacgatttattctctaaatctacagtcggtctgcagtgcctcaggtccgacagtaaggaaggcccctatgtctccgtgcccctgaactgcagttgtggagatacagttcaggcccaacttcataacctagagccctgcatgtatgtagccgtagttgcccacggcccatctatcttgtacccttcaactgtgtgggacttcatcaacaagaaggtgaccgtgggactgtatggccccaagcatatccacccgtccttcaagaccgtggtgaccatcttcgggcacgactgcgctccgaaaacactgctggtatctgaggtgacgcgacaagcccctaatcccgcccctgtggccttacaactgtggggtaaacaccagttcgtgctttcacggccccaggatctgaaggtctgtatgtttagcaacatgacaaactatgaggtcaaggccagtgaacaagcgaaagtggtcagaggctttcagctgaaactgggaaaagttagccgtctgatcttcccaattaccagccagaatcccaacgaactttcagactttaccctccgggtccaagtgaaggacgatcaagaggctattctgacccagttctgcgtgcagactccacaacctcccccgaaatctgcgatcaaaccctcaggacagcggcgtttcttgaaaaaaaacgaagtcggaaagataatcttgtctccttttgcaacgactaccaagtatcctacattccaggataggccagtctcttccctaaagtttgggaagctgctgaagaccgttgtgcggcagaacaaaaatcattatctgttagagtacaagaaaggcgatggcatcgcactactcagtgaggaacgtgttaggttgcgggggcagctctggaccaaagaatggtacatcggctattatcaaggcagagtcggcctagtccatactaaaaacgtcttggtggtgggtagagctaggccttctctctgtagcgggcccgagcttagtacatctgtgctgctggaacagattctgcgcccatgcaaatttcttacatatatttatgcgtctgttcgcacgctcctgatggaaaatatttcctcttggagatcatttgctgatgccctcggatatgtcaacctgcctctgacattcttctgtagagccgaactggactcagagccggagagagtcgcctcagttctggaaaagctaaaggaggattgcaacaatacagagaacaaggagcgcaagtcctttcagaaagagctggtcatggctctcctcaagatggattgccagggcctggtggttcgacttatccaagatttcgtgcttctcaccaccgccgttgaggtagcccagcggtggcgcgaactggcggaaaagttggccaaagtgtccaagcaacagatggacgcttatgagtccccccatcgcgatagaaacggcgtggtggactcggaagcgatgtggaaacccgcatacgatttcctgttaacgtggtcccaccagataggggatagttatagagacgtgatccaagaactgcatttaggactggataagatgaaaaatccaataactaaaaggtggaagcacctgacaggtaccctaatcctcgtgaactcactcgacgtgcttcgtgcagccgcattttccccagccgatcaggacgacttcgtgatctag

SEQ ID NO: 204986 - DNA, 369 bp, Artificial Sequence
  Description of Artificial Sequence: Synthetic coding sequence
atggccgcccagcggatccgggccgccaacagcaacggcctgcccagatgtaaatcagagggaactctgattgacctcagtgaaggattttcagaaacatcctttaacgatatcaaagttcccagtccctcagccttgctggtggacaacccaactccattcggcaatgccaaggaggttattgccataaaggattattgcccaacgaatttcactactcttaagttttcaaagggcgaccacctgtacgtgcttgacacatcaggtggggagtggtggtacgcgcataatactacagaaatgggatatattccttcttcctacgttcaacctctcaactaccggaattccaccctttccgattcctag

SEQ ID NO: 204987 - DNA, 1662 bp, Artificial Sequence
  Description of Artificial Sequence: Synthetic coding sequence
atggccgcccagcggatccgggccgccaacagcaacggcctgccccgatgcaagtctgaaggaacactgattgacctgagcgagggcttctctgagacctctttcaacgatatcaaggtgccttctccctcggccttgctggtggacaatccaaccccattcggcaacgctaaagaagtgatcgccatcaaggactactgtcctactaacttcaccactctcaaattttctaaaggggatcacctgtacgttttggataccagtggaggcgagtggtggtatgcccacaacacgactgaaatgggatatatccctagcagctacgtccaacctctaaactatcggaactccaccctaagcgatagcggcatgatcgataatctgccggactcgcccgacgaagtcgcaaaagagctcgagttactcggtggctggacagacgacaagaaagtgcccggccggatgtacagcaataacccgttctggaatggagtccagacaaatcctttcctcaacggcaacgtgcccgtgatgcccagtctggatgaacttaatcccaaatctacagtggatctactgttgttcgatgctggtacctcgagttttaccgaatcctccagcgccactaccaattcaacaggtaacatctttgacgagttaccagtgactaatggcctgcacgcggagccgccagtgcggagagacaatcccttctttcggagcaagcgctcttactctctttccgaactttctgtgttgcaagcaaagtcagatgccccaacaagttcatccttttttactggcctcaaaagcccggcccccgagcagtttcagagtagggaggatttccgaacagcctggctgaatcaccggaagctggccagatcatgccatgatctggatctgttgggtcaatcccccgggtggggccagacacaagccgtggaaaccaacatcgtgtgcaagctagacagttccggcggcgcagtgcagctgcctgacacttctatttcaattcatgtgccagaaggccatgttgctccgggcgagacacagcaaataagcatgaaagccttactagacccccccctggagctgaactctgacagatcctgttctatcagcccagtactagaggtaaagctgagtaacctggaagtgaagaccagtattatcctggagatgaaggtgagtgcagagattaagaatgacttatttagcaagtctacagtagggctgcagtgtctaagatctgattccaaagaaggaccctacgtgtccgtcccgctcaattgttcttgcggggacacagtccaggctcagcttcacaacttggaaccctgcatgtatgttgccgttgtagctcatggtccatctattctttatcccagcaccgtgtgggattttatcaacaagaaggtcactgtgggcctgtatggcccaaagcatattcatccaagctttaaaactgtcgtgacaattttcggccatgattgtgctccgaagactctgctcgtttccgaggttaccaggcaagcacccaacccaccaattaccaagagatggaagcacctgaccgggacgttaatcctggtgaactcactggacgtgctgagagctgccgcgttctcccccgctgaccaggatgattttgttatttag

SEQ ID NO: 204988 - DNA, 171 bp, Artificial Sequence
  Description of Artificial Sequence: Synthetic coding sequence
atggccgcccagcggatccgggccgccaacagcaacggcctgccccgatgtaaatccgagggaactctcatagatctgagcgaggggttctccgagacctcttttaacgacatcaaggtcccatctcctagcgccctcctggtggataaccccaccccattcgggaactag

SEQ ID NO: 204989 - DNA, 522 bp, Artificial Sequence
  Description of Artificial Sequence: Synthetic coding sequence
atggccgcccagcggatccgggccgccaacagcaacggcctgcccagatgtaaatctgagggcaccttgatcgatctttcagagggcttttctgagacttcgtttaacgatatcaaagttccatcccctagcgcgctccttgtcgacaacccaaccccatttggtaacgcaaaggaagtcattgccatcaaggattattgtcccactaacttcaccacgctgaagtttagtaaaggagatcacctctacgtgctggacactagtggaggggagtggtggtacgcccataatactactgagatgggctacatcccttcatcttatgtgcaacctctgaattatcggaattccaccctgagcgactctggtatgatcgataatctgcctgattccccagacgaagtggcaaaagagctggagcttttgggcggctggaccgatgacaagaaagtgccaggacgcatgtattcaaataatcccttttggaatggcgtgcaaacaaacccttttctgaacgggtag

SEQ ID NO: 204990 - DNA, 174 bp, Artificial Sequence
  Description of Artificial Sequence: Synthetic coding sequence
atggccgcccagcggatccgggccgccaacagcaacggcctgccccgctgcaaatccgaggggactcttatcgatctgagtgaaggctttagtgagactagctttaacgacattaaagttccgagcccctctgcactgctcgtggacaacccgaccccgttcggtaatgcctag

SEQ ID NO: 204991 - DNA, 606 bp, Artificial Sequence
  Description of Artificial Sequence: Synthetic coding sequence
atggagaacatcagcagctggcggagcttcgccgacgccctgggctacgtgaacctgccactgacattcttttgccgggccgaactggacagtgagccagagagagttgcaagcgtgctggaaaagctaaaggaagactgcaataatacagaaaataaggagcgtaagtcctttcaaaaggagctggtcatggcactcctgaaaatggattgccagggtctagtggtgagactgatccaggattttgtcctgctgacaaccgcagtggaagtcgcccagaggtggagagagctggccgagaaactggctaaggtgagcaagcagcagatggatgcctacgaatctccccacagggacaggaatggcgtcgtcgattcagaggcgatgtggaaaccagcatatgacttcctgctcacctggtctcaccagattggcgattcttatagagacgtgatccaggagcttcacttgggcctcgataagatgaagaacccgatcacaaaacgctggaagcacttgaccggcacattaatactggtaaatagcctcgacgttctgagggccgccgctttttcacccgctgaccaggacgatttcgtcatttag

SEQ ID NO: 204992 - DNA, 897 bp, Artificial Sequence
  Description of Artificial Sequence: Synthetic coding sequence
atgctgaaccacgccacccagcgggtgatggaggccgagcagaccaagactcgaagcgagctggttcacaaggaaacagccgctcgatacaatgccgcaatgggcaggatgaggcagctggagaagaagcttaagcgggcaattaacaaaagcaagccatactttgagctgaaggcgaagtactatgtgcagttggagcagttgaaaaaaacagtcgatgatctgcaagcaaaacttaccctggccaaaggcgaatacaagatggccctgaagaacttagagatgattagcgacgaaattcatgaaaggcgccgcagctccgccatggggcccagagggtgcggcgtgggcgccgaaggctcctcgactagtgtggaggatctccccggctccaaaccagagcctgatgctatctccgtcgctagtgaggcatttgaggacgatagctgctctaatttcgtaagtgaagacgattccgagactcagagcgtgagtagcttctcatccggacctacttctccttctgaaatgccagatcagttcccagccgttgtgcgtcctgggtccctggacctacccagtccagtgagtctttctgagtttggtatgatgttcccggtattgggacccaggtccgaatgcagcggggccagttcaccagaatgtgaggtggagcggggtgatagagccgaaggcgccgagaacaagacttctgataaggctaacaataatcgcgggttgagcagcagctctggatctggaggtagttctaagtctcaaagctctacatcaccggagggtcaggccctggagaatagaatgaagcaactctctttacagtgttcaaaaggtagagatggcatcatcgccgacatcaagatggtgcagattggatag

SEQ ID NO: 204993 - DNA, 387 bp, Artificial Sequence
  Description of Artificial Sequence: Synthetic coding sequence
atgctgaaccacgccacccagcgggtgatggaggccgagcagaccaaaacccgatcggagctggtccataaagagactgcagcccgttataatgctgctatgggcagaatgaggcaacttgaaaaaaagcttaaaagagctattaacaaatcgaagccttattttgagctcaaggctaagtattatgttcaactggagcagctgaagaaaactgtcgatgacttacaggctaagctgacgctcgccaagggcgagtataagatggctctgaagaacctggagatgattagtgacgagattcacgaacggagaagaagcagcgctatgggaccacgcgggtgtggtgtgggtgccgagggcagttccacctcagtggaagatctttag

SEQ ID NO: 204994 - DNA, 1368 bp, Artificial Sequence
  Description of Artificial Sequence: Synthetic coding sequence
atggacgccgccctgaagcggagccggagcgaggagcccgccgagatattaccgcccgcccgcgacgaagaggaagaggaggaggaggggatggagcagggattggaagaggaggaagaggtcgacccaagaatacagggcgagctcgagaagctgaaccagtccaccgacgatattaatagacgcgagaccgagctggaggacgcaaggcagaaatttaggagtgttctcgtggaggccaccgtgaagcttgatgaattggtgaagaagataggtaaagctgtagaagatagcaaaccctactgggaagcccggcgcgttgccaggcaggcccagctggaagcccagaaggctactcaggactttcagcgcgcaactgaagtcttgagggctgcaaaggaaacaatctctttggccgagcagcgcctcctggaggatgacaaacgacaattcgacagtgcttggcaggaaatgctcaaccacgccacacagagagttatggaagctgagcagaccaaaacccgatccgagctggtccacaaagagacagctgcccggtataatgccgcaatggggcgtatgcgtcaactagagaagaaattgaaacgtgccatcaacaagtctaagccttacttcgagctgaaagctaagtactacgtccagctcgagcagttgaagaagaccgtcgacgacttacaggctaaactgaccctcgccaaaggggagtataaaatggccctgaaaaacttagagatgatctccgacgaaatacacgagcgccgcagaagcagtgctatgggcccgaggggatgcggcgttggagctgagggcagctctacttcggtggaggatctgccaggatcaaaaccagaacctgacgcaattagcgtggctagcgaagccttcgaggatgacagctgctccaattttgtctccgaagacgactcagaaacccagtccgtgagctctttcagctctgggccaacttctccatcagaaatgcctgatcaattcccggccgtcgtaagaccagggagcctggatctgcccagccctgtgagcctgtccgagtttgggatgatgttccctgttctcgggcctcgatcagaatgtagtggcgccagcagccccgagtgtgaggtagagcgcggcgaccgcgccgaaggagcagaaaacaagacaagcgacaaggcaaataacaaccgcggcctgagttcctcctctggatccggcgggtcttctaaatcacagtcatccacgagtccggaaggacaggcactggaaaatagaatgaaacagctatccctccagtgcagtaagggtagggacggcataattgctgacatcaagatggtacagattggctag

SEQ ID NO: 204995 - DNA, 897 bp, Artificial Sequence
  Description of Artificial Sequence: Synthetic coding sequence
atgctgaaccacgccacccagcgggtgatggaggccgagcagaccaagactaggtcagagctcgtgcacaaagagaccgccgctcgctacaacgccgcaatgggccgtatgcggcaattggagaagaagttaaagcgagcgattaataaatcaaagccttactttgaactgaaggctaaatattacgtgcaactggaacagctgaaaaaaactgtagacgacctgcaggctaaacttacactggccaagggggagtacaagatggcgttgaagaacctggaaatgattagtgacgaaatccatgagcggaggaggtcgagcgcaatgggccccagaggctgtggcgtgggagccgagggtagctccactagcgttgaagatctgcctggttccaaacccgagcccgatgccatttctgtcgcatcagaagcatttgaggacgattcttgtagcaacttcgtgagtgaggatgactctgagacccagtccgtcagctcattcagctccggtcctactagccccagcgagatgcccgaccagttccccgcagtggtaagacccgggagcctggacttgccctctcccgtgtccttgagcgaattcgggatgatgtttcctgtgctcggacctagatccgaatgctcaggtgcgtcaagtccagaatgtgaagtcgaaagaggggacagagcggagggagcagaaaataagacctctgacaaggccaataacaaccgcggtttatcatcctccagcgggtccggaggttcttcaaagtcccaatcttctacctccccagaaggccaggcattagaaaatagaatgaagcagttaagcctgcagtgctcaaagggcagggatggaattattgctgatattaaaatggtacagatcggatag

SEQ ID NO: 204996 - DNA, 156 bp, Artificial Sequence
  Description of Artificial Sequence: Synthetic coding sequence
atgctgaaccacgccacccagcgggtgatggaggccgagcagaccaaaacacgcagcgagctggtgcacaaagaaaccgcggctcgctataatgctgccatgggcaggatgcgccagctggaaaagaaactgaaaagggcgattaacaaaagttag

SEQ ID NO: 204997 - DNA, 897 bp, Artificial Sequence
  Description of Artificial Sequence: Synthetic coding sequence
atgctgaaccacgccacccagcgggtgatggaggccgagcagaccaagactagatctgaacttgtccacaaggaaaccgccgcccgatataatgcggctatgggccgcatgagacagctagaaaagaagctgaagcgggcaatcaataagtccaagccatattttgagctcaaggccaagtattacgtacagttggaacagctcaagaaaacagtggacgacctgcaggcaaaactcactctcgcaaaaggcgaatacaagatggctcttaaaaatttggagatgatctcagatgagattcatgaaaggcgtcggtccagtgctatgggccctagagggtgcggagtgggcgccgaagggtcctccacttccgtggaggatctgcccggcagcaagcctgagcctgacgcgattagcgtggcaagcgaagcctttgaggatgatagttgttccaatttcgtgtcggaggatgattcagaaacccagagcgttagctctttctcgagcggccccacgagcccttccgagatgcctgaccaattccccgccgtggtacgtccaggctcgctggatctgcctagtccagtctccctctctgaattcgggatgatgtttcctgtcctaggaccaagaagcgaatgttcaggcgcaagtagtccagaatgtgaagtagagaggggggatcgcgccgagggcgcggaaaacaaaacatctgataaagccaataataatcgaggcctgtcatcttccagtgggtcgggcggcagctccaaaagccagtctagcacttcgccagagggacaggcactggagaatcgaatgaagcaactcagcctgcagtgctccaaggggcgggatggtatcatagcggacatcaagatggtccagattgggtag

SEQ ID NO: 204998 - DNA, 2580 bp, Artificial Sequence
  Description of Artificial Sequence: Synthetic coding sequence
atgatggagggcctgaagaagcggacccggaaggccttcggcatcaggaagaaggagaaggacacggacagtaccggaagtcctgaccgcgacggcatacagggcaaaaagaagacacagaagacccaactgttgctaacgagttgcttctggcttagggctctcagcctcacacttagccagaagaagagtaacggagctccgaacggtttctatgccgaaatcgattgggagcggtataactcccccgaattagatgaagaagggtacagtattcggcccgaagaaccgggctccacaaaggggaaacatttctactcttcctcagaatcagaggaagaggaagagagccataagaagtttaatatcaagatcaagcccctgcagtcaaaggacatcctgaaaaatgctgccaccgttgatgagctaaaagctagtattggcaacatcgcgctgtctcccagtcccgtgcgcaagagcccacgcaggtctcccggtgccattaagagaaatctctccagtgaagaagttgcacggccccgtcgcagtactcctacccccgaactgatttcaaaaaagccgcccgacgacactaccgcccttgcaccactctttggtccgccactggagagcgcatttgatgagcaaaagaccgaggtcctgctggaccaaccggagatatggggctccggacaacctattaatccatctatggaatcccccaaactgacgaggcctttccctactggtacgccacctccacttcccccaaagaatgtaccggccacacctccccgaacaggtagcccccttaccatcgggcccggaaatgatcagtccgctacagaagtcaaaattgaaaagctccctagcattaacgaccttgattccatcttcgggccagtgctcagccccaagtcagtggctgttaacgcagaagaaaaatgggtgcacttttccgatacatcccctgagcatgtgacaccagagctgaccccgcgcgagaaggtcgtctccccacctgccaccccggataatcctgcagatagccctgcccccggccccctgggccctccgggtcccactggaccgccagggcctccaggacccccccgaaacgtgttatcgcccctaaaccttgaggaagttcagaagaaagtagcggaacaaacttttatcaaagatgactatctcgagaccatcagctctcctaaggactttggtctcggccagcgcgccacacctccacccccaccaccgccaacatataggaccgtagtttcttcacccggccctggctccggcccgggaccaggcactacctcagacggcaagacagaagcccagcgatatcaggtgatatgtcccagcttgcaagccggtggaaatgaactggattcctatagcggggcgagctctccggccagaccagccacccctcttgtgccatgtcgcagtaccactcccccccccccgccgccacggccaccatcacgaccgaaactccctcccggcaagccaggagtgggtgacgttagcagaccctttagccccccaattcacagcagctctcccccaccaatcgcacctttagctagagctgaatccacctcctctatcagctcgaccaattccctgagtgcagcgactacacctaccgtggagaatgagcagcccagtctggtgtggtttgaccgtgggaagttctatctgacttttgaaggcagtagcagaggccccagtccgcttactatgggagctcaggacaccctgccggtcgcggctgcttttaccgaaacagtgaacgcgtactttaagggcgccgatcctagtaagtgtattgtgaagatcacaggcgagatggtgctctcgtttcccgctggaattacacgccatttcgctaacaatccgtctccggcagctctgacattccgcgtgatcaacttttcaaggttagagcacgtcctgcccaacccacagttgttatgttgcgacaatactcagaatgatgccaacacgaaagaattttgggtaaacatgccgaatctgatgactcatcttaagaaagtgagtgagcagaaaccacaggctacctactataatgtggacatgctgaaatatcaggtgtctgctcagggcattcagtccactcccctaaacctcgccgtgaattggcggtgtgagccctcaagcacagatctgcgcatcgactacaagtataatactgacgcaatgacaaccgcggtcgctctgaacaatgtgcagttcctcgtgccgatcgacggtggagttaccaaactgcaagcggttttgccgccagccgtttggaacgccgagcagcagagaattctgtggaagattcctgatatctcccagaaatctgaaaatggcggagtcggaagtcttcttgccagatttcagctgagtgaaggcccctccaagccttctcccctggtcgtccagtttacaagcgaagggtccacgctttccggatgcgacatcgagctggttggcgcaggttatcggttcagccttatcaaaaagcggtttgcagcaggcaaatacctggccgataattag

SEQ ID NO: 204999 - DNA, 1857 bp, Artificial Sequence
  Description of Artificial Sequence: Synthetic coding sequence
atgatggagggcctgaagaagcggacccggaaggccttcggcatccgaaaaaaagaaaaggacaccgacagcactggttcccctgacagagacggcataaactcccccgaactcgacgaagaagggtattctatccgcccagaggaaccagggtcgaccaagggtaagcatttttactccagcagtgagagtgaagaggaagaggagagccataagaagtttaacattaagatcaagcctctccagagtaaggacattcttaaaaatgcagcgacagttgatgaacttaaggcaagcataggcaatattgcgctcagtccttcccctgtgcggaaaagtcctcgtaggagcccaggcgctatcaagcgaaatttatcttcagaagaggtggcccggccccggaggtctactcccacgcccgagttgatatctaagaagcccccagacgacaccaccgccttggctcccctttttggccccccactggagtctgcttttgacgagcagaagactgaggtacttctagatcaacccgaaatctggggttctggacaacctatcaacccaagtatggagagccccaagcttacccgtcctttccctaccggcacgccgccccccctcccacctaaaaatgtgcccgccacccctcctcgcacgggaagccccctgacaatcgggccaggggcttcctctcccgcacgcccagccacaccactcgtgccatgccgatctaccaccccaccacctcctcctcctcggccccccagtcgcccgaagctgccccctggtaaaccaggggtaggggatgtctccaggccattctcaccaccgattcactccagctcgccaccccccatcgcacctctggccagggcggagtccacttcgtcaataagcagcacgaactcgctttccgccgccactaccccgaccgtagagaatgagcagccaagtctagtgtggttcgaccgcggaaagttctatttgaccttcgaggggtcgtcacgcgggcccagtcccttgaccatgggcgcccaagatactttgcccgtggcggcagcatttactgagacggtgaacgcctatttcaagggggcggatcccagtaaatgtatcgttaagattaccggcgagatggtgctaagtttccctgcaggaatcactagacacttcgctaataacccctcccctgcggcactgacatttagggttatcaatttcagtagacttgagcacgtgctaccaaacccccagctgctatgctgcgacaatacccagaacgatgccaacaccaaggaattctgggtaaacatgcctaacctgatgacccacctcaaaaaagtgtcagagcagaaacctcaagctacatattacaacgtagatatgctgaagtaccaggtgtccgcacagggaattcaatccacgcctctcaatctcgcagtgaattggagatgtgagccctccagcacagatttaagaatcgattacaaatacaacaccgatgccatgacgacggccgtagcgctgaataacgtgcagtttctagtgcccatcgatggcggggtcactaaactacaggccgtcctgcctccggctgtgtggaacgctgagcaacagagaatcctgtggaaaatcccagatatttcccagaaatcagagaatggcggcgtgggttccctgctggcaagatttcagctgtccgaaggcccgtctaaaccttcacctcttgtggtacaattcacgtccgaaggctctactctgtccgggtgtgatatcgaactcgtcggggctggatacagattttccttgattaagaaacgtttcgccgccggaaagtatcttgccgacaattag

SEQ ID NO: 205000 - DNA, 1893 bp, Artificial Sequence
  Description of Artificial Sequence: Synthetic coding sequence
atggagggcctgaagaagcggacccggaaggccttcggcatccggaaaaaggagaaggacacagactctacaggtagccctgatcgcgatggtataaagaagagcaatggtgcaccgaatggattttacgctgaaatcgattgggagcgctataattccccagagctcgacgaggaaggatatagcattcgccccgaggaacctgggtctaccaaggggaagcacttttattcatctagtgaaagtgaggaggaagaagaatcacacaagaagttcaatatcaagataaaaccactgcaatccaaagacatcttgaaaaatgctgctacagtggacgaactcaaggcgtctatcggaaacattgccctttcaccctcaccagtaggtgccatcaagaggaaccttagttcggaagaggtggcgcgccccagacgatccaccccaaccccagagttgatttccaagaaaccacctgacgacaccaccgccttggcgccactgttcggcccaccattggaatccgctttcgatgagcagaagacagaagtgctgctggatcaacccgagatttgggggtcaggccagcctataaacccttctatggagagtcctaagctgacaagaccgttccctacaggaacccctcctccattaccacccaagaatgtcccagcgacaccccctcgcacggggagcccactgactataggaccgggagcctcgtcccccgccaggcctgccaccccccttgtgccttgtcggtcaactacaccacccccacctccccccagaccccctagccggcctaagctcccaccaggcaaacccggcgtcggcgatgtgagcaggccattttctccccctattcacagctcttccccaccccccatcgcaccccttgcaagagctgagtctacttcaagtatcagcagcacaaatagtctgtcggcggctaccacccccactgtcgtaagtgaggacgacgtgttttatgacaaactacctagtttcgaacgtcgctgtgaaacaccggccggcagcagtaggggcccctcccccctgactatgggagctcaggacaccctgccagtagcagcagcctttacggagacagtcaacgcttactttaagggagccgacccttccaagtgcatcgtgaagataactggagagatggtactttcttttcccgccggtatcactagacacttcgctaacaatccatctccagccgctctgacatttagggtgattaatttctcacggttggaacatgtgcttccaaatccccagcttttgtgctgtgacaatacccagaacgatgccaacaccaaggagttctgggtgaacatgccgaacctgatgacccacctcaagaaggtgagcgagcagaagccgcaggctacctactataacgtggacatgctgaaatatcaggtatccgctcaaggtatacagtccactcccctgaatctggcagtgaactggcgttgtgaacccagctccaccgatctcaggattgattacaagtacaatacagacgctatgaccactgctgtcgcactgaacaatgtacaattcctggtgcccatcgacggcggggtgaccaagctccaggctgtgctgcctccggctgtgtggaatgccgaacagcagcgtatcctgtggaagatccctgacattagccagaagtctgagaatggcggggtaggtagtttgctagcacggtttcagctgtcagagggacctagtaagcccagccctttggtggtgcaatttacgagcgaagggtctaccttaagtggatgcgacattgagttggtgggcgctggatataggttttcattaatcaaaaagagatttgcggccggtaagtaccttgccgataactag

SEQ ID NO: 205001 - DNA, 2487 bp, Artificial Sequence
  Description of Artificial Sequence: Synthetic coding sequence
atgatggagggcctgaagaagcggacccggaaggccttcggcatccgtaagaaagaaaaagacactgatagcaccggtagcccagacagagatgggatccaaccgagcccgcatgagccaccttataatagcaaggcggagtgcgcgagggaaggagggaagaaagtgtcaaagaagtcaaatggagcacccaatggcttctacgcggagatagactgggaaaggtacaactctcctgaactggacgaagaggggtactctattcgacctgaagagccaggctctacaaaagggaagcatttctattcctccagtgagagtgaggaagaggaggagtcccataagaaatttaacatcaaaataaaacctctccagtcaaaagatatcctgaagaacgcagcaacggtcgacgagttgaaggccagtattggcaacatcgcgctgtcacctagccctgtgcggaagagcccacggagaagcccaggggctattaagcgaaacctttcttctgaggaggtcgctcgaccgaggcgctcgaccccaacacccgaactgatctccaagaagccaccagacgacaccacagcgttagcaccgctatttggtccacctttagaatctgcattcgacgagcagaaaactgaagtgctactcgatcagcctgagatttggggatctgggcagccgatcaatccatctatggagtcccctaagctgactcggccttttcccaccgggaccccaccaccactgccccccaaaaatgtacccgctacccctccgagaacgggctcaccattgacaataggtccaggcaacgaccaaagcgctactgaagtcaagatcgaaaagctaccctcgattaacgacctggactcgatatttggacccgtattgtctcctaagtccgtggccgtcaacgcagaggaaaaatgggtccactttagtgacactagccctgaacacgtgacacccgagttaacaccacgggagaaggtcgtaagccctccagctacccccgacaatccagctgactccccagcccccggccccctgggtccacctggcccgacaggacctccaggaccccccgggccgcccagaaatgtgctgtctcccttgaacctggaagaggtgcagaagaaagtggccgagcaaaccttcataaaggatgattatcttgagaccatcagctcacctaaggactttggattgggacagcgggccaccccacctccacctccgcctcccacttataggaccgttgtttcttctcctgggccaggaagcggccctgggccaggtacgactagcggtgcttcgtcccccgcgaggcctgcgactcccctcgtgccttgccgaagtactaccccgcccccaccgccacctaggcctccaagtagaccgaagcttcctcccggcaagcccggagtgggcgatgtgagcagacctttctcccccccaatccactctagttctccacctcccatagccccactggcacgtgccgaatcaactagttcgatctcctcgaccaactcactgtctgctgctactactcctacagttgagaacgagcagccatcgcttgtgtggttcgatagaggaaagttctatctaacatttgaagggagtagcagaggtccgtcgcccctgacgatgggcgctcaggataccctacccgtggcagcggcattcacggagactgtgaatgcttactttaagggcgctgacccatcaaaatgcattgtaaagattactggggagatggttctctcatttcctgctggtatcacgcgccacttcgcaaataatccatcccctgccgccctaacattccgggtgataaacttctccagactggaacatgttttgccaaatccccagctcctgtgttgtgataacactcagaatgatgctaacactaaggagttctgggtgaacatgccgaatctgatgacacacctcaaaaaagtctccgagcaaaagccacaggctacttactataatgttgacatgttgaaatatcaggtctctgcccagggcattcaatccacaccactgaacctagctgtgaattggcggtgtgagcccagcagcacagacttgcggattgactacaaatacaacaccgatgctatgactaccgctgtagctttaaataatgtccaatttctggtccccattgacggaggggtaacgaaactccaggcagtccttccacccgccgtttggaatgccgagcagcagagaattttgtggaagatcccagatattagccaaaagagtgagaacggcggagtgggaagcctgctcgccagatttcagctgtccgagggaccatccaagcccagccctctcgttgtgcagtttacttccgagggctctaccttatccggctgtgacatagagctggtaggggcaggctacaggtttagcctgatcaagaagcggttcgctgcaggtaagtacctagccgacaactag

SEQ ID NO: 205002 - DNA, 2577 bp, Artificial Sequence
  Description of Artificial Sequence: Synthetic coding sequence
atggagggcctgaagaagcggacccggaaggccttcggcatccggaagaaagagaaagataccgacagtacgggctcgcccgatcgagatggaatccaaggtaagaaaaaaacccagaagacccaactcctgctgacttcttgcttctggctgagggcccttagtttgacactttcccagaaaaaatccaacggggccccgaacgggttctacgctgaaattgactgggagagatacaactctcccgagcttgatgaggaaggctacagcatacgtcctgaagagcccggatcaacaaaggggaagcatttctactcatcatcagagtcggaagaggaggaagagagccacaaaaagtttaacatcaaaattaagccactgcagtccaaggatatacttaagaacgccgccactgttgacgagctcaaggcatctatcgggaacattgcactctcaccgtcccctgtgaggaagaaagagcggcgggaaaaaggcgctatcaagcgcaatttatccagcgaggaggtcgcgaggccccgccgttccacccccacacctgaactcattagtaagaagcctccagacgacaccacagccttggctcctctgttcggcccacccctggagtccgccttcgatgagcagaagacagaggtgctgcttgatcagcccgagatttggggctccggacaaccgataaatcccagcatggagagcccaaagctaaccagacccttccccacgggcacccccccaccccttcccccaaagaatgtaccagctactccgcctaggactggaagccctttgacaatcggacccggtaatgatcagagcgcaacggaagtcaaaattgagaaactgccttcaatcaatgatttagacagcattttcggacctgtcctttcaccaaagagtgtggccgtcaacgcagaggaaaagtgggtacacttctctgatacttcgcccgaacatgtcactcctgagctcactcctagagaaaaagtggtttctccccccgctactcctgataacccagcagactcccccgcccctggtccgttagggcctcctggaccgaccggcccccctggccctcctggccccccccgtaatgtattgtctccgctcaacctggaagaagttcagaagaaagtggccgagcagaccttcattaaagatgattacttggaaactattagttctcccaaggatttcggacttggccagcgggccacgcctccaccaccacctcctcctacctacagaacagtggtttcctctcccggacctgggtccggtccagggcctggcactacgtccgatgggaagaccgaggcacagaggtaccaagtcatttgcccatcattgcaggctggtggaaacgagctggatagctatagcggagctagcagtcccgcccgtccggcaacaccactcgttccttgtaggagcacgactcctcctccccctcccccccgccccccatcaaggccaaaactcccgcccggaaaacccggagtgggagacgtttcacgcccctttagccccccaattcactcctcaagccccccccccattgctcccttggcaagggcggagagtacgagctccatctcctcaaccaacagcctgtctgctgccaccaccccaaccgttgaaaacgagcaaccttcacttgtctggttcgaccgaggtaaattctacctaacattcgaaggatcaagtcgggggcccagcccactcaccatgggcgcccaagataccctccctgtcgcagccgcctttacagaaaccgtcaacgcgtactttaagggcgcggatccgtccaaatgcatcgtgaaaattacaggagaaatggtgctctctttccctgccggcattacgaggcatttcgcaaacaatccatctccagccgctttgacttttcgagtcatcaacttctccaggctggagcatgtgttgcctaaccctcagttgctatgctgtgataacactcagaatgacgctaataccaaggaattttgggtaaatatgccaaaccttatgacccacctaaaaaaggtatccgagcagaagccccaggctacatactacaacgtggatatgttgaaatatcaggtttctgctcagggtattcagtccacacccctgaacctcgcagtaaattggagatgtgagcctagctccacggatctgcggattgactataaatacaacacagatgccatgaccaccgcagtggccttaaataacgtccagttcttggtcccaattgacggtggagttacaaaattgcaagccgtcttacccccggctgtttggaacgcagaacagcagaggattctgtggaaaattcccgacatcagccagaaaagcgagaacggaggtgtgggctcactgctcgcaagatttcagctgagtgaaggaccctcgaaaccatccccactggtcgtacaatttacatccgagggttctactctgtctgggtgcgatattgagctggtgggtgccggctatcgtttcagcctgattaagaagcgatttgccgcaggtaagtacctcgctgataactag

SEQ ID NO: 205003 - DNA, 1896 bp, Artificial Sequence
  Description of Artificial Sequence: Synthetic coding sequence
atgatggagggcctgaagaagcggacccggaaggccttcggcatccgcaaaaaagaaaaggatactgactccactggtagtccagatcgcgacgggattaagaagtccaatggagcacccaatgggttttatgccgaaatcgactgggagaggtacaatagcccagaactggatgaggaggggtacagcattcggccagaagaacctggcagcactaagggtaagcacttctactcttcttcggagtctgaagaggaggaagagagccacaaaaaatttaacatcaaaataaaacctcttcagtctaaggatattctgaagaatgctgctacagtggacgagctgaaggcatctattggcaatatcgctctctcaccgtcccctgtcggcgctattaagagaaatttgagcagtgaggaggttgccagaccgaggaggagcacaccaacaccagagttgatttcaaagaagccccccgacgacaccactgccttagcccctctgtttggccctccactggagtccgcttttgatgaacaaaaaacagaggtactgcttgaccagcctgaaatctggggctccgggcagccaatcaacccgtccatggagagccccaaactgacacgaccgttccctacagggaccccgccccccctgcctccgaaaaatgtccccgccacccctccaagaaccgggtcaccattgactataggacccggagccagcagccctgctaggcccgcaacacctttggtgccctgccgaagcaccacacccccaccacctccgcccaggcctccatcaagaccaaaactcccaccagggaaacccggcgtgggggacgtgtcccgcccttttagcccgcccattcacagcagttcaccgccccccattgccccattggccagggcagaatccacctccagtatctcgtccactaactctttgtctgctgccacaacaccaaccgtcgtgtctgaggatgacgtgttctacgacaagctgcccagttttgagcgtcggtgcgagacaccagctggatcctctcggggaccttctccacttactatgggtgcacaagacactttgcctgttgctgccgccttcactgaaacagttaacgcatacttcaagggggccgatcctagtaagtgcatcgtgaaaattaccggagaaatggtactgtccttccctgcaggcatcacacgccactttgctaacaacccatcacccgccgcccttacattccgagtaataaacttctccaggctagagcacgtgctgcccaatccccagctactatgctgtgacaatacccagaacgatgccaacacaaaagagttttgggtcaacatgcccaaccttatgacacatctgaaaaaagtgtccgagcagaagcctcaggctacatattataacgtggatatgctgaagtaccaagttagcgcccaggggatccaatccactccgctgaacctagccgtgaactggcgatgtgagcccagctcaactgaccttcgcatcgattacaaatataacacagacgcgatgaccacggccgtggccctgaacaacgtgcagtttcttgtgcctatagacggcggcgtcactaagttgcaggctgtgttaccacccgctgtctggaatgctgagcaacagagaatcctgtggaagatacccgacatttctcagaagtccgaaaatggcggcgtagggtcccttctagctagatttcagctctcagaaggaccctctaagccttccccactggtcgtacagttcacttcagaggggtcaaccctgagcggatgcgatatcgagctagtgggcgctggctaccggttttcactgataaagaaacggttcgcggctgggaagtatttggctgacaactag

SEQ ID NO: 205004 - DNA, 2496 bp, Artificial Sequence
  Description of Artificial Sequence: Synthetic coding sequence
atggagggcctgaagaagcggacccggaaggccttcggcatccggaagaaagaaaaggacacggattccacgggctcccccgatagggacggcatccaggggaaaaaaaaaacccagaagactcagctgttgttaacgtcctgcttctggctgcgagctctcagccttactttgtctcaaaaaaagtcaaatggcgcccctaatggcttctatgctgaaatcgactgggaacgttataacagtcctgaattagatgaggagggatactccattcgtcctgaggagcccggctccaccaaaggcaagcacttttactcctctagcgaaagcgaggaagaggaggagtctcacaaaaagtttaatatcaaaatcaaacctcttcagagcaaagacatactgaaaaacgccgcaactgtggacgaacttaaagccagcattggaaacattgccctgtctccctcaccggtgcgcaaaaaggagagacgggagaaaggagccattaaacggaacctgtcatctgaagaagtggcaaggccccgaaggtccacacccacaccagaactgatctcaaagaagccacctgacgatacaaccgccttggctcccctctttgggccccctttggaatcagccttcgacgaacagaagacagaggtgctgctcgatcagccggagatctggggatcgggtcagcccattaaccccagcatggagtcgcctaaactaacgcggccctttccaacgggtaccccgcctccattgccacccaaaaacgtaccagccacccccccccgcaccggcagtccactgaccataggtcccggaaacgatcagtcagccaccgaagtgaagattgaaaagctgccatcgattaatgatttggatagcatcttcggaccagtgctctcccctaagtcagttgctgtcaatgcagaggagaagtgggtccatttttcagacacttcacctgaacatgttacccccgagcttacccccagagaaaaagtggttagccctcccgccaccccagacaacccggcagatagtccagcccctgggccgctcgggccccctgggcctaccggtcccccaggccccccaggccctcctcggaatgtgctttcacccctgaacctcgaggaggtacagaagaaagtggcagagcagacttttatcaaggacgattacctagagacaatctcatcacccaaggatttcggcctggggcagcgggccacccctcctccaccaccacctcccacttataggaccgtggtctcttcccctggacccggttccggacctggccctggtactacatccggagcttcatcccctgccagaccagctacccctctggtgccgtgccggtctacaactcctcctcctcctcccccaaggcctccaagccgacctaagctccccccgggcaagccaggtgtcggcgacgtgtctcgccctttctctcccccgattcacagttcctcaccacctcccatcgctccattggcccgggctgagtctacgagttccatttcgagcaccaatagtctgagtgcagctacgacacctacggtagagaacgaacagccgagcctggtttggttcgatcggggcaaattctatttgacatttgagggatcaagcagaggtccctcccccctgacaatgggagcacaagacaccttgcctgtggctgcagctttcactgagactgttaacgcttacttcaagggcgccgatccttccaaatgtatcgtcaaaattactggagagatggttctgagctttcctgccggaatcacaaggcacttcgcaaacaacccaagtcctgcggctctgactttccgggtcatcaactttagccgcctggaacacgttttgcccaatccacagctactctgttgtgacaacacccagaacgacgccaacactaaggagttttgggtgaatatgccaaaccttatgacacacctgaaaaaagtttcagaacagaagccacaggcaacctactataatgtcgatatgttgaaatatcaggtctccgctcagggaattcagtcaacccctctgaatctcgcagtgaattggaggtgcgagccttcctctaccgatttgcgcattgactacaaatacaacactgatgcaatgactaccgccgtagcccttaataacgttcagtttctggtgcctatcgatggcggcgtgactaagctgcaggctgtgctgcctccagccgtctggaacgctgagcagcagagaattctctggaagataccagatatcagccagaagtccgagaacgggggggtagggtccctgttagcccgcttccaactttctgagggcccgtcaaagccctcacccttagtggtccaattcacgtccgagggctcaaccttgtccggatgtgacattgagcttgttggcgctgggtaccggttctccctgattaaaaagcgatttgccgcgggaaagtatctggcagacaactag

SEQ ID NO: 205005 - DNA, 783 bp, Artificial Sequence
  Description of Artificial Sequence: Synthetic coding sequence
atgatggagggcctgaagaagcggacccggaaggccttcggcatcagaaagaaggagaaggacactgattcaacagggtctccggatcgcgatgggatccaaccgagtcctcacgagcccccgtacaactccaaggcggaatgcgctagagaaggaggcaagaaggtgtctaagaagtcaaacggcgctccaaatgggttctacgccgagatcgattgggaacgttataactcaccagagcttgacgaggagggctatagcatccgcccagaagaacccggatccactaaaggcaaacacttctactcatcgtctgagtccgaggaggaagaagaaagccacaagaaattcaatattaaaatcaagcccctgcagtctaaagacatcctgaagaatgctgcaaccgtcgatgagttaaaagcatctattggtaacatcgcactgagtcctagcccagtcggcgctattaaaagaaatctcagcagcgaggaggtcgccaggccccgccgaagcacccccacccccgaactgatcagcaaaaaaccaccggatgataccaccgccttagcgcccctgttcggtccaccccttgagtccgccttcgatgaacaaaaaaccgaagttttactcgatcagcccgaaatttggggctcagggcaaccgatcaacccctcgatggaatcacctaaactcacaaggccctttccaactggaacgccgcctcccctccctcccaaaaacgtacccgcgacccccccgagaacagggtccccactgacctag

SEQ ID NO: 205006 - DNA, 1002 bp, Artificial Sequence
  Description of Artificial Sequence: Synthetic coding sequence
atgacctgcagcgtgacccacatcgtgagcttcagcctgcccttcctgaatccttcccaccctgccagtacccccgggcatacagagaacgagcaaccgtctctcgtatggtttgaccgaggcaagttctacctcacctttgaagggtctagccgggggccttctccattaacaatgggcgcccaagacactctccctgtagcagccgcgttcacggaaactgtgaacgcatatttcaagggagctgaccctagcaaatgcattgtgaagattacgggggaaatggtactgagcttccccgccggcattacccggcatttcgccaacaacccctctcctgctgccctaacatttagagttattaactttagcagattggaacacgtgctgcccaacccacagctcctttgctgcgacaatacacaaaacgatgcaaacaccaaggagttctgggtgaacatgcctaacctcatgacccatttgaagaaagttagcgaacagaaaccccaggcgacttattacaacgttgacatgctgaagtatcaagttagcgcccaagggatccagtctacacctttgaatcttgcagtgaactggagatgcgagccttcttcaacagatctgcgcatcgattacaagtataacacagatgccatgaccactgcggtggccttgaataatgtgcagtttctggtaccgattgatggaggtgtaacaaagctgcaagcagtactgccaccagccgtatggaatgccgaacaacaacgaattctatggaagatccccgacattagccaaaagtccgaaaatggaggggtgggaagtcttttagctcggttccagctgagcgaaggtccttccaagcctagtccacttgttgttcagtttacatccgagggaagtaccctgagcggttgcgacattgaattagtcggtgccggataccggtttagcctcattaagaagaggttcgcggccggaaagtaccttgcagacaattag

SEQ ID NO: 205007 - DNA, 1107 bp, Artificial Sequence
  Description of Artificial Sequence: Synthetic coding sequence
atgagcgtggccggcctgaagaagcagttctacaaggccagccagctggtttctgaaaaagtcgggggcgcagagggcaccaagcttgatgatgatttcaaggaaatggaaaagaaggtcgacgttacctctaaggcagtgaccgaggtcttagctcgcacgattgaatatttgcagccaaacccggcaagtagagctaagctgaccatgctcaacaccgttagcaagatccgcggccaggtgaaaaatcccggttacccccaatctgaagggcttcttggggagtgcatgatcaggcacggtaaggagctggggggagaaagcaacttcggcgatgcactgctagatgccggcgagagtatgaagaggctcgccgaggtcaaagacagcctcgacattgaggtgaaacagaatttcatagatcctctacaaaacctctgtgagaaagacctgaaggagatccagcatcatttaaagaaacttgagggtcgaaggctggactttgactacaaaaaaaagcgacaggggaagatcccagacgaggagctaagacaggcgctggagaagtttgaagaaagcaaggaggtcgccgagacctcaatgcacaacctcctggaaaccgacatagagcaggtatcccaactctctgcactggtggatgcacagctcgattatcataggcaagctgttcagattcttgatgagctggccgagaagctcaagcggcgcatgcgcgaggccagctctaggcctaagcgcgagtataagcccaaaccccgggaaccgtttgacctaggggagcctgagcagtccaatggcggctttccatgtaccacagcccccaagatcgctgccagttcaagcttccgaagctcagacaaacccattcggacaccctcccgctctatgccgcccttagaccagccatcatgtaaggccttatacgacttcgaacctgagaacgacggcgaacttggattccatgaaggcgacgtaattaccctgactaaccagatcgatgaaaattggtatgaagggatgctggatggccagagcgggttcttccctctgagctacgtggaagtcctggtccccctgccacaatag

SEQ ID NO: 205008 - DNA, 963 bp, Artificial Sequence
  Description of Artificial Sequence: Synthetic coding sequence
atgagcgtggccggcctgaagaagcagttctacaaggccagccagctggtctcagaaaaggtggggggtgctgaaggcacaaaactggacgatgacttcaaggagatggagaaaaaagtcgatgtgacctccaaagccgtgaccgaggttctggcgagaacaatagaatacttgcagccaaaccctggggatgcactattggatgcaggcgaatccatgaagagactggccgaggttaaagatagcctggacatcgaagtcaagcagaattttatcgaccctcttcagaatttatgcgagaaggacctgaaagaaattcagcaccatctaaagaagttggaaggacgccgtctcgattttgactataagaagaaaagacagggcaaaattcccgatgaagaacttagacaggcactggaaaaatttgaggagtccaaagaagtggccgaaacatcaatgcacaacctgttggagacagacatcgagcaggtgtcacagttatcggctctcgttgatgcgcaattggattaccacagacaagcggtgcagattcttgatgaactggccgaaaagttaaagaggcgaatgcgtgaggcctcatctcgccctaaacgcgagtataagccgaaaccacgagaaccctttgacctgggcgaacccgagcagtcgaacgggggtttcccctgtactaccgcccccaagatcgcggcttcctcctcatttagatcttcggacaaacctatacggaccccatcaaggtctatgcccccactggatcaaccctcctgcaaagcattgtatgatttcgaacccgagaacgacggcgaactcgggtttcacgagggtgacgtcatcacccttaccaatcagatcgacgaaaattggtatgagggcatgctggacggccaatcgggattttttcccctcagctacgtggaagtgcttgtccctctccctcagtag

SEQ ID NO: 205009 - DNA, 915 bp, Artificial Sequence
  Description of Artificial Sequence: Synthetic coding sequence
atgagcgtggccggcctgaagaagcagttctacaaggccagccagctggtttccgagaaggtgggcggagcagagggcacaaagctcgatgacgactttaaggagatggagaaaaaagtggatgttacttccaaggctgtcaccgaggtgttagctcgtacaattgagtacctccagccaaacccagcaagcagggctaagctgaccatgctgaacactgtgagcaaaattcgaggacagaacttatgcgagaaagaccttaaggagattcagcatcatctgaagaagttggaagggcgacgactggacttcgactacaagaagaagcgccagggtaaaatacctgacgaagaactgcgccaggcattggagaaattcgaagagtcgaaagaagtagccgagaccagcatgcataacttactggagacagacatcgaacaggtttcgcagctcagcgcacttgtcgatgcccagctcgactaccaccggcaagctgtgcagattctggatgagcttgcagagaaacttaaacggaggatgcgggaagcatcctctaggcccaaacgcgaatataagccaaaacctagagaaccttttgacctgggagaacctgaacagagtaacgggggcttcccgtgtacaactgcacccaaaattgccgcgagctcttcgtttcggtcttcagacaagcccatccggaccccttccagatctatgcccccccttgaccaaccgtcatgcaaagccttatatgactttgaacccgaaaacgatggggaacttggctttcatgagggagatgtgattactttaaccaatcagattgatgagaattggtacgaaggtatgctggacggacagtcaggatttttccccctgtcatacgtcgaagtgcttgtgccactgcctcagtag

SEQ ID NO: 205010 - DNA, 1059 bp, Artificial Sequence
  Description of Artificial Sequence: Synthetic coding sequence
atgagcgtggccggcctgaagaagcagttccacaaggccacccagaaagtgtcggaaaaagtcggaggggccgagggcacgaagctagatgacgactttaaagaaatggagaggaaggtcgatgtcacttccagagcagtgatggaaatcatgactaagaccatcgaatatctccagccaaatccagcctctcgagctaaactaagcatgatcaacactatgagtaaaatcagaggccaagagaaaggcccagggtacccccaagcagaagctctgctggccgaagccatgcttaaatttggaagagagcttggggacgattgtaacttcggaccagccctcggcgaggtgggcgaggctatgagggaactgagtgaggtcaaggattctctggacatcgaagttaagcagaacttcatcgatccgttacagaatctgcatgacaaggacctgcgcgaaattcagcaccatctgaagaagttggaggggcgaaggctggattttgactacaagaagaaaagacagggtaagatccctgatgaagaactccgccaggctctggagaagtttgacgaaagtaaagaaattgcagagagctctatgttcaatctgctggagatggacatcgagcaagtttcccaactgtccgcgttagtgcaggcccagctggagtaccacaaacaagccgtgcagattttgcagcaggtcactgtgagactggaggagcggatacgtcaggcgtcaagccagcctagacgggagtatcaacccaaacctaggatgtctttagagtttcccaccggggatagtactcagcctaacggggggctgagccacactgggacacctaagccttcaggcgtgcagatggatcagccctgttgtagagccctttacgacttcgagcctgaaaatgaaggtgaactggggttcaaggagggcgatatcatcaccttgactaatcagatagatgaaaattggtacgagggaatgctacacggtcatagtgggtttttccccatcaactacgtcgaaatacttgtcgccttgccacactag

SEQ ID NO: 205011 - DNA, 678 bp, Artificial Sequence
  Description of Artificial Sequence: Synthetic coding sequence
atgagcgtggccggcctgaagaagcagttccacaaggccacccagaaggtgtcggagaaggtcgggggggcagaagggaccaagctggacgatgactttaaggaaatggagagaaaggtagatgtaaccagccgggcagttatggagattatgaccaagaccatcgagtatctgcagcctaatccgggcagtctggaagccgaggccctccttgccgaagccatgctgaagttcggtagagagctcggtgacgattgcaattttggccccgccctgggggaggtcggcgaagcaatgagggaattgagcgaggtcaaagactcactggacattgaagtgaaacaaaacttcatcgatcccctgcaaaacctgcatgacaaggacttaagggagattcagcatcacctgaagaaactcgaaggtcggaggttggattttgactataaaaaaaaaaggcagggcaaaatccccgatgaagagcttagacaggccctagagaaattcgacgagtctaaggagatcgcagaaagtagcatgtttaacctcctggaaatggatatcgagcaagtgtcccagctgagcgcgcttgtgcaggcccaactggaatatcataaacaggctgttcaaattctgcagcaggtgactgtaagacttgaggaacgtatcaggcaggcatag

SEQ ID NO: 205012 - DNA, 918 bp, Artificial Sequence
  Description of Artificial Sequence: Synthetic coding sequence
atggagatcatgaccaagaccatcgagtacctgcagcccaaccccgcgtcccgggccaaattgtcaatgatcaatacgatgtcaaagatccgcggacaggagaaggggccgggttatccacaggcagaagctttattggctgaggctatgctgaaattcggcagagaacttggagatgattgcaactttggccccgctctgggcgaggttggcgaggcgatgagagaactgagcgaagttaaggattcactagatatcgaggtcaagcagaacttcattgaccctctgcagaacctccacgacaaggatctgagagagattcagcatcatctgaagaaactggaggggcggcgcctggactttgactacaagaaaaaacgccagggtaaaatccccgacgaggagctcaggcaggcgctggagaaattcgacgaatccaaagagatcgcggagtcttccatgtttaatctattggaaatggatattgaacaagtaagccagctttcagcattggtccaagcacagctagaatatcacaagcaagcggttcaaattctgcagcaggtgaccgtgagactggaagaacgcatacgtcaagcgtcatcccagccgagaagagagtaccagccaaagccaaggatgtctttagaattccccaccggcgacagcacccaacccaatgggggccttagtcacactggaacccccaagccgtcgggggtccagatggaccagccgtgctgtcgggctctgtatgacttcgagcctgagaatgagggagagctgggtttcaaggagggcgatatcataaccctcacaaatcagatcgacgaaaactggtatgagggcatgcttcatggccactccgggttctttccaattaattatgtagaaatcctcgttgccctgccacattag

SEQ ID NO: 205013 - DNA, 546 bp, Artificial Sequence
  Description of Artificial Sequence: Synthetic coding sequence
atgagcgtggccggcctgaagaagcagttccacaaggccacccagaaggtttctgagaaagtcgggggcgcggaggggacaaaactggatgacgacttcaaagaaatggagatcgagcaagttagccagttgagcgccttggtccaagcccagctggagtatcataagcaggctgtgcagatcctccaacaagtgactgtccgcctcgaagaaaggattcgtcaggcctctagccaaccaagaagagagtatcagcccaagccacgtatgtcgcttgagtttcctacaggggattcaacacaacctaatggcggtttaagtcacaccggaacaccaaagccctctggcgtacaaatggaccagccttgttgtcgggcattgtatgactttgagcctgagaacgaaggcgaactcgggttcaaggaaggggacatcataacccttaccaatcaaatcgacgagaactggtatgaggggatgttacatggtcactcagggtttttcccaatcaattacgtagagatcttagtggctctgccccattag

SEQ ID NO: 205014 - DNA, 1068 bp, Artificial Sequence
  Description of Artificial Sequence: Synthetic coding sequence
atggacggcatcttcgccggcatcatctgcaaccaggccaaccggtgcttaacatggaccagccagcagttgttcagtgagaagatcagtggcgcagagggtacaaaactcgacgatgagttcttggatatggagcgcaagattgacgtcaccaacaaggtggtggctgagattctgtcaaagacaaccgagtacctccaacccaatcccgcatatagggcaaaactcgggatgttgaatacagtaagcaaaatccgcggccaggtgaaaaccacgggctacccacaaaccgagggtctgttaggcgattgcatgctcaaatacgggaaggaactcggggaagatagcactttcggaaacgctttgattgaggtgggagaaagcatgaagctgatggccgaggtgaaagactctctcgacatcaacgtgaaacagaccttcatcgatcccctccagcttctgcaagataaagacttgaaggaaatcggccaccacctcaagaagctggaagggcgacgtctggattacgattataagaagaaacgcgtgggaaagattcccgacgaagaggtgaggcaggcagttgagaagtttgaggagtctaaagagctggctgaaaggtctatgtttaattttctcgagaatgacgtggagcaagtgtcacagctcgctgtctttatcgaggccgccctcgactaccacaggcagtccacagagatcctccaggaactgcagagcaagttgcaaatgagaatctcagccgcatcttcggtccctcgccgcgaatacaaacccaggcccgtaaagcggtcttcctccgagctgaacggagttagcacgaccagcgtcgtcaagaccaccggctccaacattccaatggatcagccctgctgtagagggctttacgattttgaacccgagaatcagggggaactcggtttcaaagagggcgatattattacactcaccaatcagatcgatgagaattggtacgaaggtatgattcatggcgaatccgggtttttccccattaactacgtggaggtcatcgtgcccctcccccagtag

SEQ ID NO: 205015 - DNA, 1044 bp, Artificial Sequence
  Description of Artificial Sequence: Synthetic coding sequence
atgagcgtggccggcctgaagaagcagttccacaaggccagccagttgttttcagaaaaaatcagtggcgccgaaggaactaagctggacgacgaattcctggacatggaaagaaaaatcgatgtgacaaacaaagtggtcgcagaaatcctgtccaagactaccgagtacctccagcctaatccggcttacagagccaaattgggaatgctgaacactgtgtctaagattcgaggccaggttaaaacaacgggctaccctcaaacagaaggactgctgggtgattgcatgcttaaatatggtaaggagttaggagaggattccacgtttggaaatgccctgatagaagtgggtgagtccatgaaacttatggccgaagttaaggactccctagatatcaacgtcaaacaaacattcattgatcctttgcagctgctgcaggacaaagacttgaaggagatcgggcaccatctgaaaaagctcgaggggaggcgtctcgactacgactacaagaagaaacgagtgggtaaaatccctgacgaggaagtgaggcaagctgtggaaaagtttgaagaatctaaagaactcgcagagcggagcatgttcaattttctggagaacgatgtcgagcaggtatctcagcttgctgtgttcattgaagcggcccttgattatcatcggcaatccacagaaatcctccaggaactccagtccaaactccagatgaggatcagcgctgcgagctcggtgcccagacgggagtacaaaccccgcccagtgaaaaggagctcgagcgaactcaatggagtctccaccaccagcgtggtgaagacaacagggtcaaacattccaatggaccagccttgttgtagagggctgtatgacttcgagccggagaatcagggggagctggggttcaaagagggcgacattatcactcttacaaaccaaatagacgagaactggtatgaaggtatgattcatggagagtctgggttcttccccattaattacgtggaagtgatagtacctctgccccagtag

SEQ ID NO: 205016 - DNA, 1068 bp, Artificial Sequence
  Description of Artificial Sequence: Synthetic coding sequence
atggacggcatcttcgccggcatcatctgcaaccaggccaaccggtgtttgacgtggacatcccaacaactgttctccgaaaagatcagtggtgccgaaggaaccaagctggacgatgagttcctggatatggaaagaaagattgacgtgaccaataaggtggtggcggaaatcctgagcaagacaaccgagtacctgcagcctaatcctgcttatagggctaagctgggcatgctgaatacggtctccaaaataaggggccaagtgaagaccacaggctacccacagactgaggggctgcttggcgattgcatgctgaagtacgggaaagagctcggcgaagattcaacgttcggcaatgcacttattgaggtgggagaaagcatgaaattgatggctgaagtgaaagacagcctggatatcaacgtgaaacagacatttatcgatcccctgcagttgctgcaggataaggatttgaaggagatcggacatcacctgaagaaactcgaggggagaaggctcgactatgattataaaaagaagagggtgggcaagatccccgacgaggaagtgcggcaagcagtcgaaaagtttgaggaaagcaaagagctcgctgagaggtcgatgtttaacttcctggagaatgacgttgagcaggtgtctcaactcgccgtgtttattgaagccgcactagactatcaccgacagtctaccgagattcttcaggagctacagtcgaagctgcagatgcgcattagcgctgctagctccgtccctaggcgcgagtacaagccacgacccgtgaagcgcagtagctcggagttaaacggagtttccacaacctctgtggtaaagacaacggggagtaacatccccatggaccagccatgttgcagaggactttatgacttcgagcccgagaatcagggcgagttgggcttcaaagaaggcgatattatcaccctcacaaaccagatcgacgagaattggtatgaggggatgattcatggtgaaagcggatttttcccgattaattacgtcgaggtgatcgtcccattaccccagtag

SEQ ID NO: 205017 - DNA, 867 bp, Artificial Sequence
  Description of Artificial Sequence: Synthetic coding sequence
atgagcgtggccggcctgaagaagcagttccacaaggccagccagctgttcagcgagaagatcagtggggcagaggggaccaaactggatgatgagttcctggatatggagcgaaaaattgacgttactaacaaggttgtggctgagattctgagcaagaccactgagtatctccagcccaacccagcctatcgtgcgaagctaggtatgttgaatactgtcagtaagatccgtggccaagttaagactactggataccctcagactgagggactgcttggagattgcatgcttaaatatggaaaagagcttggggaagattctacattcggaaacgctctgatcgaggtgggcgaaagtatgaaacttatggcagaggtgaaagattccttggacattaatgtcaaacagaccttcatcgatcccctacagttgttgcaggataaagacctgaaggaaattggacatcatctcaaaaaactggagggacgtaggctggactatgattataagaaaaaacgtgtcggcaagattcccgacgaagaagtacgccaggctgtggagaagttcgaggagtctaaagaacttgcagagcgatctatgtttaattttctcgagaatgacgtcgaacaggtgtctcaactggcagtatttattgaagcggccctcgactatcacagacagtctacagaaattcttcaagagctgcagtccaagttacagatgcggatcagtgctgcaagttccgtcccccgacgcgaatataagccgcgccctgtgaagagatccagcagcgaactgaatggcgtcagtaccacttccgtggtcaagaccacggcctacagcagattggaacctgccgattag

SEQ ID NO: 205018 - DNA, 1662 bp, Artificial Sequence
  Description of Artificial Sequence: Synthetic coding sequence
atggtggaggccatcgtggagttcgactaccaggcccagcacgacgacgaactcaccatctctgtgggcgaaatcattactaacatccgcaaggaggacggagggtggtgggagggacagattaacggcagacggggcctgttcccagataacttcgtgagagaaattaaaaaagagatgaagaaggatccactcaccaacaaagctccggagaaaccacttcatgaggtgccctccgggaatagtctgctctccagtgaaactatcctgcggaccaacaagaggggagagagacgtagaagacggtgccaagttgcattctcatacctcccccaaaatgacgacgaattggagctgaaggtgggtgatatcattgaggtggttggcgaagtggaggaaggatggtgggagggggtactgaacggtaaaaccgggatgttcccaagtaacttcattaaggagttgtcaggtgagagtgatgagttggggatatcacaggatgagcagctgagcaagtcacgacccgaaggactcccgcccgcctcactactgccgtttcccgcacatggggctaaagggaagactacctttgaggggacaatcctgtatagagccgcccctggaaaaacagagggccaccgcagatattactccttgagggaaaccaccggtagcgagagtgacggcggcgattcctcatcgacaaaatcggaaggtgccaatggcacggtcgctacagctgccatacaaccaaaaaaagtgaagggcgtgggcttcggtgacatctttaaagacaaacccatcaaattgagacccagatctattgaggtggagaatgatttcctgcctgtggagaagacaattggcaagaaattacctgccaccactgcaaccccagactcatcgaaaaccgaaatggatagccgcaccaagagcaaagattactgcaaggtgatcttcccatacgaagcgcaaaatgatgacgagcttaccatcaaagaaggggacattgtaactttgataaataaagactgcatcgatgttggttggtgggagggtgagctgaatggcaggaggggtgtgttccctgataattttgttaaactgctgccgcccgattttgagaaggagggcaacaggcctaagaagcctcctcccccatccgcccctgtcatcaaacaaggggctggcacgaccgagaggaagcatgagattaaaaaaatccccccggaacgaccggagatgcttcccaatcgcaccgaggagaaggagagacctgagagagagcctaagctagacctgcagaagccctccgtccccgcgattcctccaaagaagcccagaccccccaagactaactccctatcaaggccgggagccttgccaccccgacggcccgaacgtcctgttggcccactcacccatacccgctattgctgtgccttaacctcaggggcaggcgtcggctggctctggaaggaacatagaaggggaaccgattgccaccggccttgggaagagggcagaggagaggggggcgcccaggccagtctgctccatcccccagctaaactgtccgaggatacaggacacttttgtccctgcagctgtacccaggctggagtctcagtgagacttagaggggccgtttgggtcagctag

SEQ ID NO: 205019 - DNA, 1887 bp, Artificial Sequence
  Description of Artificial Sequence: Synthetic coding sequence
atggaggtgagcgccgccaaggcccccagcgccgccgacctgagcgaaatagagataaagaaagaaatgaagaaggatccccttactaacaaggcaccagagaagccactacacgaggtgccaagtggcaactctctgctcagttccgagacaatcctccgcactaacaagcggggagaaaggaggcgaaggaggtgccaggtcgccttctcctacttgccacaaaacgacgacgagttggaactcaaagtgggtgacattatcgaggtagtgggcgaagtggaggaaggatggtgggaaggagtgctgaatggcaaaaccgggatgttcccctccaattttatcaaggagctcagtggcgaatccgacgaacttggaatctcccaggatgaacagctgagcaagtcatcactgcgggaaaccactgggtccgaatccgacgggggggactcttcatcgacgaaaagcgagggcgcaaatggaaccgtggcaacagcagcgattcaaccaaagaaagtgaaaggtgttggtttcggcgacatcttcaaggataagccaattaaactgcggcccagaagcattgaggttgagaacgattttctaccagtagagaagacaatcggcaaaaaattgcctgcaacaacggccacacctgattcctctaagactgaaatggactcgcgaaccaagtcaaaagactattgtaaagttattttcccatacgaagcgcagaatgacgacgagcttactatcaaggagggtgatatcgtgactcttatcaataaagactgcatagacgtgggctggtgggagggagagcttaacggacgccgtggagtcttcccagacaatttcgttaaattgctccctccagactttgaaaaggagggtaatcggccaaagaagccaccccccccaagcgccccggtaatcaagcaaggcgccggcactactgagaggaaacacgaaatcaagaaaatcccacctgaaaggccggagatgctgccaaaccgcaccgaggaaaaggagcgacctgagagagaaccgaaactggacctccagaagccctctgtccccgccatcccccccaagaagccacgaccacccaaaaccaactctctgagccggccaggtgccctgccgccacgtaggcctgaacggcctgttgggcctctgacccacaccagaggggattcccctaagatagatcttgccggctcctccctctccgggattctcgataaggacttgagtgataggagcaacgacattgatcttgagggctttgatagtgttgtatcttctactgaaaagctaagtcatcctacaacttcccggccaaaggccactggcagaagaccgcctagccagtcactgacatcctcttccttgtcatcaccagacattttcgacagcccatctcctgaagaagataaggaagaacatataagcctcgcgcaccgtggtgtggatgcctccaaaaagacttcaaaaactgtgacaatttcccaggttagtgataacaaggcaagtctaccaccaaagccagggacaatggctgccgggggtggggggcctgctcccctctcgtcagctgccccaagtcctctctcgagcagcctgggcaccgccggccacagagcaaacagtccaagcctgtttgggactgaaggcaaacccaaaatggagccagccgcgtcgtcacaagccgccgtggaggaactcaggacccaggtgcgagagttgcggagtataatcgaaactatgaaggaccagcagaagagagaaataaagcagttgctctccgaacttgacgaggagaaaaaaattcgcctgagactccaaatggaggttaacgacatcaaaaaggccttacaatccaagtag

SEQ ID NO: 205020 - DNA, 1953 bp, Artificial Sequence
  Description of Artificial Sequence: Synthetic coding sequence
atgaagaaggaccccctgaccaacaaggcccccgagaagcccctgcacgaggttccatccgggaactctctcctctcaagtgagaccatactccggaccaataagcgaggagaaaggagacgtcgcagatgccaagtggcctttagttacctaccacagaacgacgacgagctagagttgaaggtgggcgacataatcgaggtggtaggcgaggtggaggaaggatggtgggagggcgttctgaacggcaagacgggcatgtttccctctaactttatcaaggaactttccggggagtctgacgagctgggaattagtcaggatgaacaactgagcaagtcgaggcctgaggggctgcctccggcgtctttgctgccatttcccgcacacggtgctaaaggcaagaccacctttgagggcacaatcctgtaccgcgccgctcctgggaaaaccgagggacaccggagatactactccctgcgcgagactactggctctgagtccgatggtggggacagctcttcaaccaagagcgaaggtgctaacggtaccgtggcaacagcggccatacaacctaagaaagtcaagggcgtcgggttcggagatatatttaaagataagcccattaaactgagacctcgatctatcgaggttgagaatgacttcctccctgtggaaaaaacaatcgggaaaaagcttcccgctaccaccgcgacacctgattcttccaagactgagatggacagcaggactaagtcgaaagattactgtaaggtcatattcccctacgaggctcagaacgacgatgaactcactattaaggagggtgacatcgtgaccctgatcaacaaagattgtatagatgtcggctggtgggagggggagctcaatggaagacgcggcgtgttccccgacaatttcgttaaactcttacctccagattttgaaaaggaaggcaacagacccaaaaagcccccccccccttcagcacccgttatcaaacagggagctggaactactgagcgcaagcacgagattaagaaaattccacctgagcgccctgaaatgctgccgaaccgcactgaagagaaagaacgacctgaacgggagcccaaactggacctgcaaaagccttctgtacctgccatcccccccaaaaagccaaggcctccgaagactaacagcctgtccaggcccggtgcactgccacctagacgccctgaaaggccagtgggaccattaacccacacaagaggcgactcaccaaaaattgatctagccggatcgtcactgtcaggcattctcgacaaagacctgtctgataggtcgaacgacatagacctcgagggatttgatagcgttgtgagctctacagaaaagttatctcatccaaccacaagtcgaccaaaggccaccggacgcaggccaccaagccagagcttgacctcaagttctctaagctcgccagatatttttgacagtccctccccggaggaggataaggaggagcatatctctctggcccatcgaggtgtcgacgcctctaaaaaaacgtccaaaactgtgaccatctcacaggtgtccgacaacaaggcttcccttccacccaaaccgggtacaatggcggccggcgggggaggtcctgcacccctctcatccgccgcgccttcacccctcagctcctcactcggcacagccgggcacagagccaacagtcctagcttatttgggacggaaggcaagccaaaaatggagccagcggccagctcacaagccgctgtagaggaactgcgtactcaggtgcgtgaactgaggagtatcatcgagaccatgaaagatcagcagaaacgggagattaagcagctcttaagtgagttagacgaggaaaagaagataaggctacgcctccagatggaagtaaatgacataaaaaaggcacttcagtccaagtag

SEQ ID NO: 205021 - DNA, 1284 bp, Artificial Sequence
  Description of Artificial Sequence: Synthetic coding sequence
atgggcgaggagaccatcggcaagaagctgcccgccaccaccgccacgccagactcaagcaagacggaaatggacagtcggaccaaatcgaaggattattgcaaggttatctttccttatgaagctcagaatgatgacgagcttactataaaggaaggagacatcgttaccttaattaataaagactgcattgatgtcggatggtgggaaggggagctcaacggcaggcgcggcgtcttcccagataatttcgtaaagctgctacccccggactttgagaaggaaggtaaccgaccaaagaaaccccctccccctagtgcacccgtcattaaacagggcgccgggactaccgagcgtaaacacgaaattaaaaaaattccacccgaaaggcccgagatgctgcccaatcgtaccgaagaaaaagaaaggccggaaagagagcctaagctggatctgcagaaaccctccgtcccagcaatccctcctaagaaacctagaccccccaaaacaaacagcctgagcaggcctggggccctacccccacgacggccggaacgacctgtcggacctctaactcacacgagaggggattcaccgaaaatcgacttggctgggagcagtttaagcggaatcctggataaggatctatccgatcgcagcaacgatatcgacctagaaggtttcgactccgtcgtgtccagtacagagaaactgtcgcaccctacaacttccaggcctaaggctaccgggcgtaggcctccatcacagtcactgacgagctcgagcctgagctcacccgatatttttgactccccaagcccagaagaggataaagaggaacacatctccttggcccatagaggggtcgatgcaagtaaaaagacatcaaagacagtgaccataagccaggtctccgataacaaagctagcctgccccccaagcccggaacaatggcagccggagggggcggccctgcacctttgagttcggccgccccctcccctttgagttcaagcttaggaactgccggacaccgcgctaacagccccagtctatttgggaccgaagggaaacccaagatggaaccagcagcttcttcccaggcagccgtggaggagctgcgaactcaggtgcgcgaactgagaagcatcatcgagactatgaaggaccagcagaagcgggaaatcaaacagcttctgtctgagttggacgaggaaaagaaaatccggctgagactccagatggaagttaatgatatcaagaaagctcttcagtccaaatag

SEQ ID NO: 205022 - DNA, 1938 bp, Artificial Sequence
  Description of Artificial Sequence: Synthetic coding sequence
ctgaccaacaaggcccccgagaagcccctgcacgaggtgcccagcggtaatagcctgctgagtagtgagaccattttgagaaccaataagcggggagaaagacgaagacggagatgccaggtggcattcagttacctgccccaaaatgacgacgaactggaactgaaggtcggagacattatcgaagtagtaggcgaggtagaagaaggatggtgggaaggagtactgaatggcaagactggaatgtttccatccaactttataaaggagctgagtggtgagagtgacgagctcgggatttcccaagatgagcagctgtccaaaagccgtccagagggcctccctccagctagtctgctcccattccctgcccatggggctaaagggaagacgacctttgaaggtacaattctgtatcgggccgcccctggcaagacggagggccataggcgctactacagcctcagagagacgacaggtagcgagagcgacgggggcgactcgtcctccaccaaatctgaaggtgcgaacgggaccgttgccacagctgcaatccagccaaaaaaagtcaagggggtggggtttggtgatattttcaaagacaagcctatcaagctgaggcccagaagcattgaagtagagaacgatttcctccctgtcgagaaaaccattggcaaaaaattacccgccacaactgcgacacctgactcctcaaagaccgagatggactccaggaccaagagcaaggattattgtaaagtgatcttcccgtacgaagcccagaatgatgacgaactcactattaaggagggagacatcgtaactttgatcaataaagattgtatagatgtcggctggtgggagggtgagcttaatgggcgtcgcggggtattcccggacaatttcgtgaagttactacctccagatttcgagaaagaaggcaataggccaaaaaagcctccccctcctagcgctccggtgatcaagcagggagctggcactactgaacgcaaacatgaaatcaagaagattccaccggagagaccagagatgttgcccaataggaccgaagagaaggagaggcctgagagggagcccaagttagacctgcagaaaccatcggtgccagctattccaccaaagaagcctagaccacccaaaactaactccctatccaggcccggcgcactgcccccacgaaggccagagcgcccagtgggccctctaactcatacccgcggcgatagccccaaaatcgatctagcgggatcaagcctatctggcattcttgataaggatctgagtgatagatctaacgacatcgatctggagggctttgactccgtggtcagttccaccgagaagctgagtcatccaacaactagccgaccgaaagccaccggcagacggcctccttctcagagcctcacatcttcttccttatccagcccagacatcttcgactctccatcccccgaggaggataaggaagagcacatttccttagcccaccgcggagttgacgcatcaaaaaaaacaagtaagactgtcactatttctcaagtgagcgacaacaaagccagcctgcctccaaagcccggaaccatggccgcagggggtggcgggccagcacccctttctagcgcagcccccagcccgctttcttcgagtctcggcacagctggtcatcgcgccaacagtccaagcttgttcgggaccgagggaaagcccaagatggagcctgcggcctcatcgcaggccgctgtcgaggaactccgcactcaggtgcgcgagctacgatcaattattgaaaccatgaaggaccagcagaagagggagatcaaacagctgctgtcggagctcgatgaggagaagaagatacgactgaggttgcaaatggaagtcaacgacataaagaaggccctgcagtctaagtag

SEQ ID NO: 205023 - DNA, 450 bp, Artificial Sequence
  Description of Artificial Sequence: Synthetic coding sequence
ttcgagaccagcgagcggcggcggcggcggtgccaggtggccttctcctacttaccccagaatgatgacgagctcgaactcaaggttggagacattatcgaagtggtaggcgaggttgaggaaggctggtgggaaggagtattaaatggaaaaacgggtatgtttccatcaaatttcatcaaagagctgtccggtgagagtgatgagctgggaatatcacaggacgagcagctgagcaaatcaagcctgcgcgagaccacgggaagcgaaagtgatgggggcgatagctcctcaaccaagagcgaaggggccaacggaacagtcgcaactgcagcgatccagccaaagaaagtcaaaggggttgggtttggtgacatcttcaaagataaacccattaaactccgcccgagatccatcgaagtggagaatgattttctcccagttgagtag

SEQ ID NO: 205024 - DNA, 1998 bp, Artificial Sequence
  Description of Artificial Sequence: Synthetic coding sequence
atggtggaggccatcgtggagttcgactaccaggcccagcacgacgatgaattgaccatttctgtaggggagataattacaaacatccggaaagaagacggtggctggtgggaaggacagatcaacggtcgaaggggacttttccccgataacttcgtcagggaaattaagaaggaaatgaagaaagacccattgactaataaggccccagaaaaacctctgcacgaggtgccgtctgggaatagcctgctcagcagtgagacaattttgcgcactaacaagcggggtgagaggaggcggcgccgatgccaagtggcattttcctatctgcctcagaacgacgacgaactcgagcttaaagtgggcgatataattgaagtcgttggcgaggttgaagaagggtggtgggaaggggttttgaacggcaaaaccggaatgtttcctagcaattttatcaaggagctatcaggagagtctgacgagctggggatcagtcaggacgagcagttgagcaagagctctctcagagagactacagggagtgagtcagatggtggagattcctcgagtacaaaatcagagggggctaatggcacggtagctaccgccgccatccaacccaagaaagtgaaaggcgtaggatttggcgacatctttaaggacaagccaatcaaactgcgtcctcggtccatcgaagttgagaatgacttcctgcccgtagaaaagaccattggcaagaagctgcccgcaaccacagcgacaccagacagcagtaaaacagagatggactcccggactaaatcaaaagattactgtaaggttatcttcccatatgaggcgcaaaatgacgatgagctgactatcaaagaaggagacattgtgaccttaatcaacaaagactgtattgatgtgggttggtgggagggcgagttaaacggaagaagaggtgtttttcctgataacttcgtgaaacttcttccccctgactttgaaaaagaaggcaataggcctaaaaagccaccccccccgtccgctccggtgataaaacagggcgctggaaccaccgagcgaaaacatgagattaaaaagatacctcccgaaaggccagagatgttgccaaatagaacagaggagaaggaaagacctgaaagagagcctaagctggatctccagaagccgagtgttcccgctatccctcccaaaaagccacggcccccaaaaacaaacagcctgtcacggcccggagctctgccacctcggcgaccagaacgacccgtgggtcctcttacgcatacccgaggcgattctcctaagatcgacctggctggcagcagcctgtccgggatccttgataaagatcttagtgatagatcgaacgacatcgatctggagggctttgatagcgtggtctccagtaccgagaaactgtcccacccgacaacgtctcgccctaaagccaccggccggcggcctccctcacagagcttaacttccagctctttgagtagtcccgacatcttcgattcccctagtcccgaagaagacaaagaagagcacatttcccttgcccaccgcggcgtggacgcctcaaaaaagaccagtaagaccgtgacaatttcacaggtctccgacaacaaggccagcctgccccccaagccaggcactatggccgctggagggggcggacctgcgcccttatcatcagccgccccgagtccattgtcttccagcctcggcactgcgggccatagagccaattctcccagtttattcggtaccgaaggaaaaccaaagatggagcccgcggccagctcccaagctgccgttgaagaactcaggacgcaggtccgtgaactgcggagcatcattgaaacaatgaaggaccagcaaaagagagagattaagcagctgctgtctgaattggatgaggaaaaaaaaattcgccttagactccagatggaagtcaacgacattaaaaaggctcttcagagcaaatag

SEQ ID NO: 205025 - DNA, 450 bp, Artificial Sequence
  Description of Artificial Sequence: Synthetic coding sequence
atggagcggagcgagcggcggcggcggcggtgccaggtggccttctcctatttgccacagaacgatgatgagttggagctgaaggttggtgacattatagaagtggtaggtgaggtcgaggaaggctggtgggagggagttctgaacggtaagacaggcatgttcccaagcaatttcattaaggagttatctggtgaatctgatgaactggggattagtcaggatgagcagcttagcaaaagttctcttcgggagaccaccggcagcgagtccgacggaggggatagttcgagcactaaaagtgagggcgccaacggcacggtagccacggccgccatccagcccaagaaggtgaagggcgtgggatttggtgatatcttcaaagacaaacctatcaagctgaggcccaggagtatcgaggtggagaacgatttcctgccagtagaatag

SEQ ID NO: 205026 - DNA, 627 bp, Artificial Sequence
  Description of Artificial Sequence: Synthetic coding sequence
atggagatcaagaaggagatgaagaaggaccccctgaccaacaaggcacccgaaaaaccattgcatgaagtaccctccggcaactctctcctctcatcagagactatcctccgaacaaacaagagaggagagcgtaggcggcgaagatgccaggtggctttctcttatctgccccagaatgacgatgaactggagctcaaggtgggtgatattatcgaagtggtgggcgaggtggaggagggatggtgggaaggtgttctgaacggcaaaactgggatgtttccatcaaacttcattaaggagctgtccggagaaagcgacgagctaggtattagccaggatgagcaattatcgaaaagttccttgagagaaaccaccggaagcgaaagtgacgggggagactccagctccactaaatccgagggagccaatggaacagtagctactgctgccatccagccaaaaaaggttaagggtgttgggtttggggacatttttaaagataaaccaattaagctcaggccccgatccattgaggtagagaatgacttccttccagtcgagaagacaatcgggaagaagctgcctgctaccacagcaactcccgattcctccaagaccgagtag

SEQ ID NO: 205027 - DNA, 1215 bp, Artificial Sequence
  Description of Artificial Sequence: Synthetic coding sequence
atggacagccggaccaagagcaaggactactgcaaggtgatcttcccttatgaggcccagaacgatgacgagcttactatcaaggaaggcgacatcgtgactctgattaacaaagactgtatcgacgtaggttggtgggaaggtgaactcaatggccggcgcggagtttttccggacaacttcgtgaaactgctgcctccggattttgagaaagaaggcaaccggcccaaaaaacccccccccccatcagccccagtgatcaaacagggcgctgggacgacagaaaggaaacatgagatcaagaaaattccaccagagcgcccagagatgctacccaatagaacagaagagaaggagcggcctgaacgcgagcccaagctggatctccagaaaccttccgtccctgccattccacccaaaaagccaagacctccaaaaactaattctctgagccgtcccggagcactccctccgaggaggcccgagcgccccgtgggtcccctgacacacacccgcggggattcgcctaaaattgacttagctggttcctcactatcaggaatccttgataaagatcttagcgaccgttcaaatgacatcgacctggaaggattcgattcagtcgtcagctctacagaaaaactttcccaccctaccacatcacgtcccaaggccaccggaaggcgcccgccatctcaatccctaacaagttcaagcctatctagccccgacatcttcgactcaccttctccagaagaggataaagaggaacacataagtctcgcccaccggggcgtggatgcctccaagaaaacaagcaagacagttacaatctcccaggtttctgataataaggcctccctgccaccaaaaccaggtaccatggcagccggcggggggggacccgcacctctctccagcgcagcgccaagtccactatcttcttcactgggcacggccgggcatcgggcaaactcgccatccctattcggtacggagggaaagcccaaaatggagcctgcggccagctctcaagccgctgtagaagaactgagaacccaggtacgagaattaagatccattattgagacaatgaaggatcagcagaagcgagaaattaaacagctgctgagcgagctcgacgaggaaaaaaagatcagactccggctccagatggaagtgaatgacatcaagaaggctctgcagagcaagtag

SEQ ID NO: 205028 - DNA, 456 bp, Artificial Sequence
  Description of Artificial Sequence: Synthetic coding sequence
atgaactgggcccccgccacctgctgggccctgctgctggccgccgccttcctctgtgacagcggggcagcgaagggcggtcggggcggagccagaggatcagccagagggggggtcagaggaggggcacgcggggcaagccgagtgagagtgcgacccgcccagagatatggtgccccaggttctagcctccgcgtagcagccgccggcgccgccgccggggctgcagccggtgcagccgcgggtctggcagcaggtagtggttggcggcgcgctgctggtccaggcgaaagagggcttgaggatgaggaagacggcgtgcccggcggcaacgggaccggaccggggatttactcatatagggcgtggacctccggcgctggtcctacccgcgggcccagattatgtctggttctcggcggggccctgggcgccctcggcttacttagaccatag

SEQ ID NO: 205029 - DNA, 456 bp, Artificial Sequence
  Description of Artificial Sequence: Synthetic coding sequence
atgaactgggcccccgccacctgctgggccctgctgctggccgccgcatttctgtgcgattcaggggcggcaaagggaggaagaggcggcgctcggggttcagcacgaggcggcgttagggggggtgccaggggcgctagccgtgtgcgcgtaagacctgcccaaagatacggggctccaggtagcagtctgcgggtggctgctgcaggcgctgccgcaggggcggccgctggggccgcagctggacttgctgcgggttccggctggcgaagagcagccggtcctggggagaggggcctggaggacgaggaagacggtgtgccaggaggaaatggaacaggtccgggaatatattcttaccgggcctggactagcggcgccgggccaacaagaggaccccggctgtgcctagtgctcggaggagcactgggcgctctgggactgctaaggccatag

SEQ ID NO: 205030 - DNA, 981 bp, Artificial Sequence
  Description of Artificial Sequence: Synthetic coding sequence
atggccccccccgccggcggcgccgccgccgccgccagcgacctggggagcgcagctgttctcctggcggtacacgccgccgttcggcctttaggcgcagggccagacgccgaagctcagcttcgtaggttacagctcagcgcagaccccgagagacccgggagattcagactcgaactgctgggggccggacccggggctgtaaacttggaatggcctctcgaatccgtctcctatacaattcgcggtccaacgcagcatgaactgcaaccgccacctggcgggcccggaaccctttcgcttcactttttgaacccacaggaggctcaaagatgggccgttcttgtacgcggggccaccgtggaggggcagaacggatctaagtccaatagcccccccgcgttagggcctgaagcatgtcccgtgtcgctccctagcccacccgaagcttctactttgaagggaccaccccctgaagcagacttgcctcgctctcctggtaatcttacagaacgcgaagagcttgcagggagtctggcacgggccatagccggcggagacgagaagggggctgcacaggtcgctgcagtgctggctcagcatagagtcgcactatcagtgcagctgcaggaggcttgctttcccccaggacctataaggcttcaggtgactctcgaggacgcagcaagcgcggcttcagccgcctcatctgcacatgttgccttgcaggtgcacccacactgcacagttgctgcccttcaagagcaagttttttcagagctgggatttccccccgcggtgcaaaggtgggtgattggccgatgcttgtgcgtacccgagaggtccttagctagctacggggtgagacaggatggggacccggcattcctgtacctcttatctgctcccagggaggctcctgctcaactggtcctgagtttcctacacctgcaccagtgccctaggcccccttggctctag

SEQ ID NO: 205031 - DNA, 1164 bp, Artificial Sequence
  Description of Artificial Sequence: Synthetic coding sequence
atggccccccccgccggcggcgccgccgccgccgccagcgacctgggttctgcagccgttttgttggcagtgcatgccgccgttcggcctttaggtgcaggccctgacgctgaagctcagttgcgccgcctgcagctgtcagccgatcctgagaggcccggccgattcaggctggaactgctgggggcaggtccgggcgctgtgaacctggagtggcccttagaatcagtttcctacaccatccgcggccccacacagcacgagctgcagcccccgcctggaggcccaggaaccttaagtctccactttctaaaccctcaagaggctcaaaggtgggcggtgctggtccggggcgccaccgtcgagggacagaacgggagcaagagcaatagccctcctgcgcttggacctgaggcttgtccagtttcattaccctcccctcccgaggcttcaacgctgaaggggccacctcccgaggccgatttaccgaggagtcccggcaatttgaccgaaagagaagagctggccgggagcctcgcccgcgccattgcaggcggtgatgaaaagggggccgcacaggtggccgctgtgcttgcacaacacagggtggctctgtccgttcagttgcaggaagcgtgcttccctccgggccctatcaggctgcaagtcaccttggaagatgccgcttctgctgctagcgctgcttcaagcgctcacgtggcccttcaggttcacccccattgcaccgtggcagcccttcaggagcaggtttttagcgaactgggattcccccctgcagtccaaaggtgggttatcgggcgatgtctgtgtgtccccgagagatctctggctagttacggtgtacgtcaggacggcgatcctgcattcctgtacttgttaagcgccccccgggaggctccggcgacaggccccagcccgcagcacccacagaagatggatggagagcttgggcgactgtttccccctagtctcggattgcctcccgggccacagcccgctgccagcagtctgcccagccccttgcagccctcctggtcgtgtccatcctgtacttttataaatgctcctgaccgcccaggctgtgagatgtgctccacacagagaccgtgcacatgggacccactggccgcggctagcacttag

SEQ ID NO: 205032 - DNA, 2019 bp, Artificial Sequence
  Description of Artificial Sequence: Synthetic coding sequence
atggccgacggcagcctgaccggcggcggcctggaggccgccgccatggcgccagaaaggatggggtgggccgtggaacaagagttggcttcactggagaaggggctattccaggatgaagacagttgctcagactgctcgtatagggacaaacctggttcctccctccaaagcttcatgcctgaaggcaagactttcttcccagaaatcttccagaccaaccagctcctgttctacgagcgctttcgggcctaccaagactacatactggcggactgcaaagctagtgaagttcaggagttcacagcagagtttctcgaaaaggtgttagaaccttctggctggcgggccgtgtggcatactaatgttttcaaggtgctagtggaaataacagacgtagactttgcagctttaaaggcggtggtcagactggccgagccatatctctgtgattcccaggtctctacttttacgatggagtgtatgaaagaactacttgatctcaaggaacatcgcctgcctttgcaagagctgtgggtggtattcgatgacagcggcgtgttcgaccagacagcactggccatcgagcacgtcaggtttttctaccagaacatatggagatcatgggacgaggaggaggaagacgagtacgactattttgtaagatgcgtcgagccaaggctgcgcctgcactacgatatcttggaagacagggtcccaagcggcttaatcgtcgactaccacaaccttctgtctcaatgcgaagagtcctacagaaaattcctcaatctgaggtcctctttgagtaattgtaactccgatagtgaacaggagaatatctcaatggtggaaggattgaagctgtatagtgagatggagcagctcaagcagaaactgaagctgatcgagaaccctttgctgcgatacgtgtttggctaccagaaaaatagcaacatccaggcaaaaggagtcaggtcctctggccaaaaaataactcatgtggtcagttcgacaatgatggctgggctgttgaggagcctgttgacggaccgtctgtgtcaggaacctggggaagaggagagggagattcaattccactccgatcctctgtcggccatcaatgcttgctttgagggggacaccgtcatcgtgtgccccggacactatgtcgtacatggtaccttttcaattgccgactcaattgagctggagggctacggtttacctgatgatatcgtgatcgagaaaagagggaagggcgacacctttgtcgactgtactggagccgacataaaaattagtggcataaagtttgtgcaacacgatgccgtggagggtattctcatcgtgcacaggggcaagaccactctcgagaactgcgtgttgcaatgcgagaccaccggggtgacagtacgaacttcagccgaatttctgatgaaaaattcagatctctatggagccaagggagctggcattgagatatatccgggaagtcaatgcacgctgagcgataacggaatccatcactgtaaggaggggattctcatcaaggactttctggatgagcattatgatattcccaaaattagcatggtcaataatatcatccataacaatgagggatacggggtcgtcctcgtgaagccgactatcttttcagaccttcaggagaacgccgaagacgggaccgaagagaacaaggcgttgaagattcagacgtctggcgagcccgatgtggcagaaagggtggacctggaggagctcattgagtgcgctaccgggaagatggaactttgcgcacggacagatcccagtgagcaagtagaggggaattgtgagatcgtaaatgagctgattgctgcgagcacccaaaaaggtcagatcaagaaaaagaggctatccgagttgggcattacacaggccgacgacaacctcatgtctcaggagatgttcgttggcatagtgggcaaccagtttaagtggaatggaaaaggtagctttgggacatttctcttttag

SEQ ID NO: 205033 - DNA, 723 bp, Artificial Sequence
  Description of Artificial Sequence: Synthetic coding sequence
atgaccgcccccgtgcccgccccccggatcctgctgcccctgctgctgcttttactgcttaccccccctcccggggctcgcggggaggtgtgtatggcctctcgggggctctccctcttccccgaatcctgccccgacttttgttgcgggacctgcgatgaccaatattgttgtagtgatgtactcaaaaaatttgtgtggtccgaggaacggtgtgccgtcccagaggcctctgttcctgcatctgtggagcctgttgaacagctcggatctgctctgcggtttagacccggttacaatgatccaatgagtggctttggcgccactttagccgtcgggctgacaatctttgttctgagcgtcgttactatcatcatttgctttacctgtagctgttgctgtctctataaaacttgccggcgcccgagacctgtggtgacaacaaccacaagcaccaccgtggtgcatgctccttatcctcagccacccagtgtcccacctagttaccccggcccatcttatcagggctaccataccatgcctccccagcctgggatgccagccgccccttatcctatgcagtatcctcctccttatcctgcgcaacccatggggccaccagcctaccacgagacactcgctggtggggctgccgccccgtatccagcctcccagcctccctataatcctgcttatatggatgcccccaaagctgcactctag

SEQ ID NO: 205034 - DNA, 339 bp, Artificial Sequence
  Description of Artificial Sequence: Synthetic coding sequence
atggccagccggggcctgagcctgttccccgagagctgccccgacttctgttgcggcacttgtgacgatcagtactgctgctcagacgttctgaaaaaattcgtatggtccgaggaaaggtgcgcagtgccggaggcctcagtgccggcctcagtcgaaccggttgagcaactgggcagcgctctgcgatttcggcccgggtacaacgaccctatgtccggtttcggggccaccttggctgttggcttaaccattttcgtgctgagcgttgttaccataatcatttgcttcacgtgtagttgttgctgcttgtataagacctgtcgcaggccacgctag

SEQ ID NO: 205035 - DNA, 414 bp, Artificial Sequence
  Description of Artificial Sequence: Synthetic coding sequence
atgggcttcggcgccaccctggccgtgggcctgaccatcttcgtgctttcggtggttaccattattatctgttttacttgcagctgttgttgcttatacaaaacctgtcgccgtccacgccccgtggtgactacaaccacttctaccactgtggtgcatgccccataccctcagcccccttccgtgccccccagctacccaggccccagctatcaaggctatcacacaatgccaccccaacccggtatgccggcagccccctatcccatgcagtacccccccccatacccggctcagcctatgggccctcctgcataccacgagacacttgcaggcggcgcagcagctccctatccggcttcacagccaccttacaatccagcctacatggacgccccaaaggctgcactgtag

SEQ ID NO: 205036 - DNA, 630 bp, Artificial Sequence
  Description of Artificial Sequence: Synthetic coding sequence
atggccagccggggcctgagcctgttccccgagagctgccccgacttctgttgcgggacgtgtgacgatcaatactgttgttccgatgtgctgaaaaaattcgtctggtctgaggagagatgtgcggttcctgaggccagcgtccctgcttcagtcgaacccgtggagcaattgggatccgccctccgctttcggcctggatataatgaccccatgtcagggttcggggcaaccctcgcagtgggcctgacaattttcgtcctatccgtagtgactattattatatgttttacttgctcgtgctgctgcctctataaaacatgtcgtcgcccccgccccgtcgtgacgaccactactagtaccactgtcgtccacgctccatacccacagccccctagcgtgcccccatcctaccccggaccctcctatcagggttaccatacaatgccgccccagcctgggatgccggccgctccctatccaatgcagtaccctcctccctacccagcccagccgatgggccctcctgcgtaccacgagacgctggccggtggggccgctgccccgtaccctgcgtcacagccgccctataatcccgcctatatggatgctccaaaggcagctctttag

SEQ ID NO: 205037 - DNA, 630 bp, Artificial Sequence
  Description of Artificial Sequence: Synthetic coding sequence
atggccagccggggcctgagcctgttccccgagagctgccccgacttttgctgcggaacttgtgacgatcagtattgctgctccgatgtgcttaagaaattcgtgtggtctgaggagagatgtgccgtacctgaagcaagcgttcccgcttccgttgaacctgtagaacagctgggctcagccctgcggtttcggcccggctacaatgacccaatgtctgggtttggtgctaccttagcagtgggtctcacaatctttgtgctgagcgttgtaaccataatcatttgctttacttgctcgtgctgctgcctatacaaaacgtgtcgaagaccgaggccagtcgtgacaaccacaacttctaccactgtcgtccacgctccttacccacagccccccagtgtgccgccttcatatcctgggccatcttatcaggggtatcatacaatgcccccacagcctgggatgcctgccgcaccctaccccatgcagtatcctcccccatatcctgctcaacccatgggtcctcccgcctatcatgagactctagccggcggggccgccgccccttacccagcctcacaacctccttacaacccagcatatatggacgcacctaaggccgccctctag

SEQ ID NO: 205038 - DNA, 513 bp, Artificial Sequence
  Description of Artificial Sequence: Synthetic coding sequence
atgcccccccagcccggctgccagcagcaccccacccagtgcagcactcaccacctcacccagccctccccatgggcccataggcctaccacacggccgtggttagaggagcagcctaggccaactcctccggcatccctcttaacaacacgtccgacctggatgccccggggcgggcccttgtccatcccatggcccctctggcttccactcggctatgtagtctgtgttcgcgagtggtgtgccggggccgtgccatacgccccctgcgtcctgtgtgtcagctgcctctacatgtggctaccccttatgctcactcgttggggcactatcttggcccgcgtgggctgggaccagaccctgttttccagcagcccggagatcatgctgccaaaaatctcgtctcagacacaacgaatgggctggtggggggctccctgtgaagtggccccagaacgctggggcccccttcaagggacatctggggtactcctacagctgacactcggctag

SEQ ID NO: 205039 - DNA, 666 bp, Artificial Sequence
  Description of Artificial Sequence: Synthetic coding sequence
atgcggcgggtgctgcggctgctgctgggctgcttcctgaccgagttgtgcgccagggtgtgccgcgctcaggagagggccggtcacgggcagctcgctcagctcgggggtgtactgttgctggcaggaggtaataggtccggcgccgcatctggcgaggcctcggagggtgctgaagcgtccgacgctccgccgacccgggcccctactccggacttctgccgtggatactttgatgttatgggacagtgggacccaccttttaattgctccagcggagattttatcttttgttgtggaacctgcgggtttcgcttctgctgtacatttaaaaagcgtagattaaatcagtcaacgtgcactaactatgacactcccctgtggctcaatacaggcaagccaccggcacgcaaggacgaccctctgcatgatcctactaaggataagactaacctaattgtgtatatcatttgcggagttgttgcagttatggtactggtgggaatctttacaaagctggggttggagaaggctcatcgcccacagcgagagcatatgtccagactctacgataatctactctttatggaagcccagatttccttccaggaggacgagcctgctcctggcgaatggagtgtggggcttcagacctggacagtatag

SEQ ID NO: 205040 - DNA, 1275 bp, Artificial Sequence
  Description of Artificial Sequence: Synthetic coding sequence
atgcggcgggtgctgcggctgctgctgggctgcttcctgaccgagctgtgcgctcgggtttgcagagcacaagaacgggcaggccacgggcagttggcccagctggggggagtcctcctcctggccgggggtaatcgctccggggccgccagtggggaagctagcgaaggtgccgaggcttctgatgcaccgccaacgcgagcacctaccccagacttttgtcgcggttacttcgacgtaatgggacagtgggatcccccctttaactgttcatcgggggacttcattttctgctgcggtacctgcgggtttagattctgctgcacttttaaaaagcgccggctgaatcaaagcacatgcacaaactacgacaccccactgtggctgaatacaggaaaacctccagcccggaaggacgatcccctgcacgatcccacgaaggataagaccaatctcattgtctatatcatctgcggagttgtggcggtcatggtcctggtggggatcttcaccaagttgggactggagaaggcacaccggccccaaagagaacatatgtctagagctctggcagacgtgatgcgcccgcagggacactgtaataccgatcacatggaaagggacctgaacatcgtggtgcacgtccagcactacgaaaacatggatacgcgcacaccgatcaacaaccttcacgccacacagatgaacaatgccgtccctacttccccccttctgcagcagatgggccacccacactcctatcccaacctgggccagataagtaatccctatgaacagcagccaccggggaaggagcttaataaatatgcatcactgaaagctgtggggtcaagcgacggagattgggcagtgtcaactctgaagagcccgaaagctgacaaggtcaacgacgacttctacaccaaacgcagacatctcgccgaacttgccgctaaggggaacctcccccttcaccctgtgagagttgaagacgaacctcgagccttctctccagagcatggtccagctaagcagaatgggcaaaaatcccggaccaataagatgcccccccatcccctggcttacacgtctaccacgaacttcaaagggtgggacccaaatgagcagagtttgaggcgtcaggcttactcaaacaaaggaaagttgggcacggccgagaccggctcgtcggatcctctgggcacgagacctcagcattaccctcctcctcaaccctactttatcactaacagtaagaccgaagtaacagtatag

SEQ ID NO: 205041 - DNA, 789 bp, Artificial Sequence
  Description of Artificial Sequence: Synthetic coding sequence
atgtgcggcccccggcggctggccgcccccggcagcagcctgggctccttcggaagggctagccggggaggccgaaggggctcttcaggcggtcgggcagcagagcccgggctgggagataccatgaggcgagtgttaagactgctgctggggtgctttctgacagaactctgcgcccgcgtgtgcagagcccaggagcgtgctggtcatggccaattagctcagcttgggggagtgctgctgcttgctggtggtaatcgctcaggagctgccagcggtgaggcctctgagggcgccgaagcctctgacgccccacctacaagagccccaacccctgacttctgccgaggctatttcgacgtgatgggccagtgggacccaccctttaactgttcgagcggagatttcatattctgttgcggtacctgcggattcaggttctgctgcaccttcaaaaagcgacgtcttaaccagtcgacttgcacgaattatgatacacctttgtggctcaatacgggcaaaccgcccgcaaggaaggacgaccccctccatgaccccacaaaagacaaaaccaatctcatcgtgtatatcatttgtggggtggttgcagtgatggtcctcgtcggtatctttacgaagctgggcctggaaaaagcccacaggcctcagagggaacatatgtcaaggctgtacgataatctgttatttatggaggcccagatttctttccaggaggacgaaccggcacccggtgaatggtccgttggtctccagacatggaccgtgtag

SEQ ID NO: 205042 - DNA, 1398 bp, Artificial Sequence
  Description of Artificial Sequence: Synthetic coding sequence
atgtgcggcccccggcggctggccgcccccggcagcagcctgggcagctttggccgggcgagcaggggcggaaggcgcggctcgagcggaggccgcgccgccgaaccaggattaggtgatacgatgagacgagtgcttagacttctgctgggttgctttctgacggagctgtgtgcacgggtgtgtagagcacaggaacgggcaggtcacgggcagctcgcgcagcttggtggtgtcttgctgctggcgggagggaaccgcagcggggcggccagcggcgaggcaagtgagggcgcagaggccagtgacgcccccccaacgcgcgctcctacacctgacttttgcagaggttattttgacgtcatgggacaatgggatcccccatttaactgtagttctggagattttatattctgctgtggtacctgtggattccgcttctgctgtactttcaaaaagcggcgcctgaatcagtctacatgtactaactacgacacacccctgtggctgaacactggtaagcccccagcccgtaaggatgacccgcttcatgatccaaccaaggacaaaaccaacctgattgtttatattatttgtggagttgtagccgttatggtgctcgtcggaatctttactaagctggggcttgagaaagcgcaccgcccccaacgcgagcacatgagcagggcgctcgcagacgtgatgaggccccaaggacattgcaacaccgatcatatggagcgcgacctgaatatagtggtccatgtgcagcactatgagaacatggacaccagaacaccaattaacaacctccatgccacgcaaatgaataatgcagtgccaacctccccacttctccagcaaatggggcacccacacagctaccccaacctcggccagatcagcaatccatatgagcagcaaccaccaggaaaagaactcaacaagtacgcctctctcaaagctgttggctcctccgacggagattgggcagtttccaccctgaaaagcccaaaggccgataaggtcaatgacgatttctacactaagcgccggcaccttgccgaactcgcggctaagggcaacctcccactgcatcctgtcagagtagaggacgaaccgcgagctttctccccagagcacggcccagccaagcagaacgggcagaagtctcgcaccaacaaaatgcctccccacccactcgcttacaccagtaccaccaattttaagggatgggatcccaacgagcaaagtttgagacgacaggcatacagtaataaaggaaagcttgggacagcggaaaccggttcttctgaccctctggggaccaggccccagcactaccctcctccacagccgtacttcattaccaattcaaagactgaggttactgtctag

SEQ ID NO: 205043 - DNA, 678 bp, Artificial Sequence
  Description of Artificial Sequence: Synthetic coding sequence
atggaggagctgaccgccttcgtgagcaagagcttcgaccagaagagcaaggatgggaacgggggtggcggcggaggaggggggaaaaaggatagcatcacctacagagaagtcctcgagagtggcctggcacgcagtagggaattgggtaccagtgactcctccctccaggacattacggaggggggaggccactgccctgtccatctgtttaaggaccatgtcgacaacgataaggagaagctgaaggaattcggcaccgccagagtggcggagggaatatacgagtgtaaggaaaagagagaagatgtgaaaagcgaggacgaggacgggcaaaccaagctaaaacagcgaaggagcagaaccaacttcacacttgaacagttgaacgaactcgagaggctttttgatgagacgcactaccctgatgccttcatgagagaagagctgtctcaacgcctggggctaagtgaggcccgcgtacaggtatggttccagaacagacgggctaagtgtagaaagcaggaaaaccaaatgcacaagggcgtaatcctggggaccgccaatcatctggatgcttgtcgtgtagccccctacgtgaatatgggggctctgcggatgcctttccagcaaatggagttttgcagttgccggcctggctggtcaattatggcctag

SEQ ID NO: 205044 - DNA, 678 bp, Artificial Sequence
  Description of Artificial Sequence: Synthetic coding sequence
atggaggagctgaccgccttcgtgagcaagagcttcgaccagaagagcaaggatgggaacggggggggtggaggtggcggaggaaaaaaagattcaattacctaccgggaggtattagaatctggattagcaaggagccgtgagctgggcacttcagatagctccctccaggacatcactgaagggggtggccactgccccgtgcacctgtttaaagaccatgtggacaatgacaaggaaaagcttaaggagttcgggaccgctcgcgtcgccgaaggcatatacgagtgtaaagaaaagcgagaggatgtgaaatctgaagatgaagatggccagactaagctgaagcaacggaggtcccggaccaatttcacattggagcagttgaacgagctcgagcgactattcgatgaaacacattatccggatgcctttatgagggaggaattgtctcagcgcctggggctgagtgaggctagggttcaggtgtggtttcagaacagacgggccaaatgtcgcaagcaggaaaaccagatgcacaagggcgtgatcctgggcaccgcaaatcatctggacgcttgtcgggtcgctccttacgtaaatatgggggccctgcggatgcctttccagcagatggagttttgctcttgtcgcccaggctggtctatcatggcatag

SEQ ID NO: 205045 - DNA, 879 bp, Artificial Sequence
  Description of Artificial Sequence: Synthetic coding sequence
atggaggagctgaccgccttcgtgagcaagagcttcgaccagaagtccaaagacggaaatggcggaggcggcggcggcggtggcaaaaaagactcaattacctatcgagaggtcctggagtccggcctggccaggtccagggagctggggacgtccgactctagcctccaagacattaccgagggggggggtcattgtccagttcatctgtttaaggaccatgtcgataacgataaggaaaaactgaaggaattcggcacggctagagtggccgaagggatttatgaatgcaaagaaaaacgggaagatgtgaagtcggaggacgaggatggacagacaaagctcaaacagagaagatctcgtacaaatttcacactagaacagctgaacgagctggaacggctatttgacgaaacccattatcctgacgcattcatgagggaggaactgagccaacgcttggggctctctgaggctcgggtgcaggtctggtttcagaacagaagagccaagtgcaggaaacaggaaaaccagatgcataagggggtaattctcgggaccgccaaccacttagacgcctgcagagtggctccctacgtgaatatgggcgccctgcggatgcccttccaacaggtgcaggcccagttgcagttggagggggttgcgcacgcacatccccatctccatccccacttagctgcccacgccccatacctcatgtttccccctcccccattcgggctgcccatcgcatcgcttgctgagagtgcctccgctgcggctgtggtcgcagccgccgcgaagagtaactcaaagaacagctcgatcgccgatcttcgccttaaagcccgaaagcatgccgaggccctcggactctag

SEQ ID NO: 205046 - DNA, 879 bp, Artificial Sequence
  Description of Artificial Sequence: Synthetic coding sequence
atggaggagctgaccgccttcgtgagcaagagcttcgaccagaagtctaaggatggtaacgggggcggaggcggtggtgggggtaagaaggatagcataacgtatagggaagtcctcgaatccggcctggccaggagccgcgagctgggtacatccgattcttccctgcaggacattacagagggagggggacactgccccgtgcacttattcaaggaccatgtagacaacgataaggagaaactgaaagagtttggcacagcacgagtagcagaaggcatttacgaatgcaaagagaaacgagaagacgtcaaaagcgaggacgaggacgggcagactaagctgaaacaacgccggtctagaaccaattttactctggagcagttaaacgagctcgaaaggctgttcgacgaaacccactatcctgacgccttcatgcgggaggagctgtctcaacggctcggattgtccgaagccagggttcaggtgtggttccagaaccgccgcgccaaatgtagaaagcaggagaaccagatgcataaaggggtcatcctgggcacggcgaaccacttggatgcctgcagagtcgccccttacgtgaatatgggggcactgcgcatgcctttccaacaggtccaagcccagttacagcttgagggagtagcgcacgctcacccccatctgcaccctcatctggctgctcatgcaccatatctcatgttccctcctcccccctttggacttccaatagcctcactggcagaatctgcttccgccgctgctgtggtggccgcggccgccaagtccaacagcaaaaactccagcatcgccgacctgaggctgaaggctcggaaacacgccgaagcacttgggctctag

SEQ ID NO: 205047 - DNA, 573 bp, Artificial Sequence
  Description of Artificial Sequence: Synthetic coding sequence
atggaggacgagggccagaccaagatcaagcagcggcggagccggactaatttcactctcgagcaattgaatgaactagaacggcttttcgatgaaacacactacccagacgcctttatgagggaagagctctctcagcgtttaggtctgtctgaggcgcgcgtgcaggtatggttccagaataggagggccaagtgccggaagcaggaaaatcagctccacaaaggggtgcttattggtgccgcctcacagttcgaagcctgccgcgtggctccatacgtgaatgtgggagctttgcgcatgccattccaacaggtgcaggcccaactgcagcttgattccgcagtggctcatgcgcaccatcatttacatccacatttagctgcccacgcaccctatatgatgttcccggcaccgccttttgggctgcctctggccacgttggccgctgactcagcaagtgccgccagtgtcgttgccgcagccgctgctgcaaagactactagcaagaactccagtattgcagacctgagactgaaagcaaaaaagcacgccgccgcgctggggctctag

SEQ ID NO: 205048 - DNA, 996 bp, Artificial Sequence
  Description of Artificial Sequence: Synthetic coding sequence
atggaggagctgaccgccttcgtgagcaagagcttcgaccagaaggtaaaggagaagaaggaggcaattacgtaccgcgaggttctggagtctggccccctacgaggggccaaggagccaaccggttgcaccgaagccggtagggacgacagaagttcacccgccgttagagcagcgggcggtggagggggagggggtggtggtggtggcggaggtggcggggggggcggagtgggcggaggcggggccggtggcggggccggaggcgggcggtcaccggtgcgggaactcgatatgggggcggctgagcggagtagagaaccaggttcccctagactgacagaggtatctcctgagctgaaggacagaaaagaggatgcaaagggcatggaagacgagggacagactaaaattaagcagcgcagaagccgcacgaatttcaccctcgaacagctgaacgaactggagcgtctgttcgatgagacgcactatccagacgcgtttatgcgggaagagctttcacaacgtcttggcctcagcgaagctcgggtacaggtctggtttcagaaccggagagcaaagtgtcgcaaacaagagaaccagcttcataagggcgtactaataggggcggcctcccagtttgaggcctgtcgggtggctccgtatgtgaacgtgggagccctgaggatgccattccagcaggattcacattgcaatgttacacctctgagctttcaggtccaggcccagcttcagcttgattctgcagtggcgcatgcccatcatcatctgcacccacatcttgccgctcacgcaccctatatgatgttccccgccccgcctttcgggctgcccttagctaccctagcagcagatagtgcttctgccgcatcggtggtggcggctgccgctgctgccaagaccacatctaaaaatagttctatagccgacttgaggctgaaggcgaagaagcatgctgcagcactggggctgtag

SEQ ID NO: 205049 - DNA, 1068 bp, Artificial Sequence
  Description of Artificial Sequence: Synthetic coding sequence
atggaggagctgaccgccttcgtgagcaagagcttcgaccagaaggtgaaagaaaagaaggaagctatcacttaccgtgaggtcctggagtctggccccctgaggggagccaaggaaccaactggctgcaccgaggccggcagggatgaccggagcagccctgctgtgagggccgctggtggaggcggtggcggagggggcggggggggcgggggaggtggaggaggaggggtgggcggcgggggagctggaggtggcgcaggaggaggccgcagtccagtgcgtgaactcgacatgggtgcggcggaacgaagccgcgagcctggaagccccaggcttaccgaaggcagaaggaaaccaaccaaggccgaagtgcaggccactctgttactcccaggcgaagcttttcgcttcctggtctcccctgaacttaaggaccgaaaggaggatgcaaaggggatggaggatgaggggcagactaagatcaagcagaggagaagtcggacaaattttaccctcgaacaactgaatgaattagagcgcctgtttgacgagacacattacccggacgcattcatgcgagaagaattgtcacaaagactgggactatccgaagcccgcgtacaagtctggtttcagaataggagagccaaatgtagaaaacaagaaaaccagttacacaagggcgtgctcattggcgcagcctcgcagtttgaggcctgtagagtcgccccctacgtgaacgtcggagctctgcggatgccattccagcaggattcacactgcaacgtgacacctctgtcctttcaggtccaggctcagctgcaattagatagtgctgtggcacatgcacatcatcacctgcacccacacctggccgcccacgcaccgtacatgatgttccctgcgcccccattcggactgcctctggctacgctcgcagcagactctgcaagtgctgcatccgtcgtggctgccgccgccgccgcaaaaactacatcgaagaactcttcaatcgccgacttgagactgaaggcaaaaaaacacgccgctgccctcggtctgtag

SEQ ID NO: 205050 - DNA, 573 bp, Artificial Sequence
  Description of Artificial Sequence: Synthetic coding sequence
atggaggacgagggccagaccaagatcaagcagcggcggagccggactaactttacactcgagcagttaaatgaactggagcgactgtttgatgaaacacattaccctgacgcttttatgcgagaagaactgagccagaggctgggcctgagtgaggcacgcgtgcaagtgtggttccagaaccgtagggctaagtgtcggaaacaggagaatcagcttcataagggcgtgctgatcggcgcagcctcacagttcgaggcttgtcgggtcgcaccttatgtgaatgtcggagcactccggatgccttttcagcaggttcaggcacaactccagctagactctgccgtggcccacgcgcaccaccacctgcatcctcacctcgcggcccacgctccctatatgatgttcccagcacccccgtttggcttgccactagctacccttgcagctgatagtgccagcgccgcctcagtggtggctgccgccgcggcggccaagacaacgtctaagaactctagtatagcggatctcagattaaaggccaagaagcatgccgccgccctggggctctag

SEQ ID NO: 205051 - DNA, 573 bp, Artificial Sequence
  Description of Artificial Sequence: Synthetic coding sequence
atggaggacgagggccagaccaagatcaagcagcggcggagccggactaactttaccctcgagcagctgaacgagcttgagcgtctgttcgacgagacacactatccagacgcttttatgagagaagaactgtcgcaacgcctcggcttaagcgaggctcgagttcaggtttggtttcagaaccggcgagcaaagtgtagaaaacaggaaaaccagctccacaagggcgttctaatcggcgcagcctctcagtttgaggcatgcagagtcgctccctacgtgaatgtcggcgcactgagaatgccttttcagcaagtccaagctcagctgcagctcgattcagctgtggcccacgctcatcaccacctgcacccacatcttgccgcgcatgctccatatatgatgttcccggcccccccattcggattgcccctggccaccctggcggcggatagcgctagcgccgcgtctgtggtggctgccgctgcagcagctaagactacaagcaaaaatagctctatcgcggatttgcggctgaaggcaaagaaacacgctgcagcattgggactgtag

SEQ ID NO: 205052 - DNA, 1734 bp, Artificial Sequence
  Description of Artificial Sequence: Synthetic coding sequence
atgctgacccccgccttcgacctgagccaggaccccgacttcctgacgatcgccataagggtgccctacgctagagtctcagagtttgatgtgtacttcgaagggtcagacttcaagttttacgcaaagccttattttcttcgcctgaccctgcctggtagaattgttgaaaatggttccgagcaggggtcctatgatgctgataagggtatcttcaccattaggctccctaaggagactcccggtcagcacttcgagggattaaacatgctgaccgcgctcctggccccaagaaagtctaggacagcaaaacctctggtggaagagattggcgctagcgagattcccgaagaagtcgtagacgatgaagaatttgactgggaaattgaacagactccctgtgaagaggtctcagagtccgctttaaacccacagtgtcattatggctttggcaatcttaggtccggggtgcttcagaggttgcaggatgaactgtcagatgttatcgacattaaggacccagactttacacctgcagcggagcggcgacagaagaggttggctgcagagcttgccaagtttgaccctgatcactacctggccgacttcttcgaggacgaagccatcgagcagatattgaagtataatccttggtggactgacaaatacagtaaaatgatggcgttcctagagaaaagccaggagcaggagaaccacgccaccttggtgtcattttccgaggaagagaaatatcaacttagaaagtttgtgaataagagttatctgcttgataagagggcctgcaggcaggtctgttactccttaatcgacatcctgctggcctattgttatgaaactagggtgacagagggagagaagaatgttgaatcagcctggaacatcaggaaattaagcccaactctgtgctggtttgagacctggactaatgtccatgatatcatggtgtctttcgggcgaagagtgttgtgctatcctctgtataggcatttcaagctcgttatgaaggcctatagggacacaattaaaatcctacagttgggaaagagcgccgtgctcaagtgcctgctggatattcacaaaatcttccaagagaatgatcctgcttacattctgaatgacttatatatttccgattactgcgtctggattcaaaaagtgaagtctaaaaagctggcagctctcgctgaggccctgaaagaggtgtccctgactaaagcccagctgggacttgaacttgaggagctggaggctgccgctctcctggttcaggaagaggagacggccctcaaggctgctcacagcgtcagtggtcaacaaacgctatgctctagcagcgaagctagtgattcagaagactcggattccagcgtctcgagtgggaatgaggatagtggctccgattccgagcaggatgagctgaaagactcaccgtccgagaccgttagctccctccagggcccttttctggaggagagctccgctttcctgatagtcgacggtggcgtacgccgaaataccgccatccaagaatcagacgcttctcagggtaagccccttgctagcagctggcctcttggagttagcggccctctgatcgaggaactgggggagcaactgaagacaacggttcaggttagcgagcctaagggcacaactgccgttaataggtctaatattcaagaaagggatggctgccaaaccccaaacaactag

SEQ ID NO: 205053 - DNA, 4851 bp, Artificial Sequence
  Description of Artificial Sequence: Synthetic coding sequence
atggagggcgccgagccccgggcccggcccgagcggctggccgaggctgagacgcgcgccgctgacgggggccggctggtggaggtgcagttgtctggaggtgctccctggggttttactctgaaaggcggacgggagcacggagaaccgctggtaatcaccaagatcgaggaagggagcaaggcggccgcggtcgataagttattggcaggcgacgagatcgtggggataaacgatataggcctgagcggtttccgtcaagaggctatttgcctggtgaaaggaagccacaaaaccctgaaactggtagtcaaacggcggtctgagctcggttggagaccacattcctggcacgccaccaaattttcagactctcatcctgaattggcggccagtccattcaccagcacatccggatgcccatcttggtctgggaggcatcatgcgagcagctcttcgcacgatctgtcatctagctgggaacagacaaatttacagaggacacttgaccacttctccagcctcggaagcgtggacagtctggaccacccctccagcagactgtcggtagccaaaagcaactccagcatcgaccacctgggaagccatagcaaacgggatagtgcgtatggaagcttttcaacctcatcaagcacccctgaccacacattgtctaaggcagacacctcgagcgccgaaaatatcttatacactgtcgggctgtgggaggcaccacgacagggggggcgccaggctcaggcggcgggggacccacaggggtccgaagagaagctcagctgctttccacccagagtgcccggggactccggtaaaggaccacgccctgagtataacgcggagcctaagcttgcggctccaggtcgctccaacttcgggcccgtttggtatgtacccgacaagaaaaaggccccaagcagccctccaccccctcccccgccacttagatcagattcatttgccgccactaagagtcatgagaaggcccaggggccggtgtttagtgaggccgctgccgctcagcatttcactgcgttggcccaggctcaaccaagaggggaccgccggcccgaactcaccgaccggccctggcggagcgcccacccaggaagcttgggtaagggctctggggggccaggctgcccccaggaggctcacgccgatggtagctggcctccgtctaaggacggtgcgagcagccgacttcaagcgtcgctcagtagcagcgatgtgcgcttcccacaaagcccacactctggccgtcatcctcctttgtacagtgatcacagcccgctgtgcgcggactccctcggacaagaacctggtgctgcgagcttccagaatgactcccctccccaggtccggggactaagctcatgtgaccaaaaattggggagtggttggcagggcccaagaccttgcgtccagggtgatttgcaggcggcccagctctgggctgggtgttggccatctgataccgcactgggagcactggaaagcctgccccctcctacagtcggacagtccccccgccaccacctgcctcagcctgaaggaccgcccgacgctcgcgagactggtagatgctatcccctggataagggcgctgaagggtgtagcgctggcgcccaggagccccctcgtgccagtcgagccgagaaagcatctcagcgacttgccgcctccattacctgggccgacggcgagtcatcacgcatttgcccacaggagacccccttactccatagcctgacccaggaaggaaaacggcgccccgagtctagtcccgaagattccgccacacgtcctcctcccttcgatgctcacgtcggaaagcccacgcgccgcagtgaccggtttgctacgactcttagaaatgaaattcaaatgcaccgcgccaagctgcagaagtctagatctacagtcgccctgacagccgcgggtgaggcagaagacggaactgggcgctggagggccgggctgggtgggggcacacaggagggccctcttgccggaacctacaaagatcatctaaaagaagctcaagctcgggtacttcgagcaacgagctttaagcgccgtgatcttgaccccaatcctggtgacctttacccggagagtttggaacacaggatgggcgaccctgataccgtgccacatttctgggaagcagggcttgcacagccaccatcatcaacaagcggcggccctcacccaccacgcatcggaggacgacggcggtttacagccgaacagaagctaaaaagctactccgaacccgaaaagatgaacgaggtcggcctgactcgtgggtacagtccccaccaacaccctaggacgagtgaagatacagttgggacattcgcagaccggtggaaattcttcgaggaaacctccaagcccgtgccacaacgcccagctcaaaagcaggccctgcatggtattcctcgcgataagcctgagagaccccggactgcgggaaggacctgcgaggggacagaaccgtggagcagaactaccagtttgggcgattcattaaatgcacactccgcagccgagaaggccgggacctctgatcttcctagaagactgggaacattcgcagaatatcaggcctcctggaaagagcagagaaagccactcgaggctcgctcaagcggcagatgccattcggctgacgacatcttggatgtgtcccttgatccacaagagagaccccagcacgtgcacggcaggagccggtcatcccctagtacggatcactacaagcaggaggcaagtgttgagctacgacgccaggctggagaccccggcgagccccgcgaggaactgcctagtgctgtaagggcagaggagggccagtcgacccccaggcaagctgacgcccagtgtcgtgaggggtctcctggatcccaacagcacccaccttcacagaaggcccctaatccgcctaccttttctgagctgagccattgcaggggagcacctgagctgcctcgcgagggacgagggcgagctggcaccctgccacgcgattatcggtactccgaggaatcaaccccagcggatctcggacctagggcccagtctcctggttctcccctgcatgcccggggccaagattcatggcctgtgtcaagtgcattgttgagcaaacgtccggctccacagagaccccctcccccaaagcgagaacccagacggtaccgagccactgacggggcaccagcggatgctcccgtgggtgtgctggggcgccccttcccaacaccatcccctgcttctctggacgtttacgtagccagactgtcactgtcgcactctccctctgttttcagtagcgcacagccacaagacacaccgaaggcgaccgtatgcgaacgcggctcccaacacgtttctggtgatgcctcccgacctttacctgaagccctgctcccccctaaacaacagcatcttaggcttcaaaccgccactatggagacctcacggtcccctagcccacagttcgccccacagaagctcacagataagccgcccctcctcatccaggacgaggattctactcggattgagcgcgtgatggacaataataccacagtgaaaatggtgccaatcaaaatcgtccattcagaaagtcagccagaaaaagaaagtcggcaatccctggcgtgccctgccgagcccccagctctccctcacggtctagaaaaggaccaaatcaagacactctcaacctccgaacagttttattctcggttctgtctgtatacaagacaaggagctgagccggaggccccccacagagcccagcccgctgagcctcagccacttggtacacaggtgcctcccgagaaagaccgctgtacatcccctcctggcttaagctacatgaaagctaaggagaaaactgtggaagacctcaagagtgaggaattggctagagagatcgtgggaaaggacaaaagcctggccgacatcttagacccttctgtgaaaatcaaaaccaccatggacctgatggagggaatctttccaaaggacgagcacctgctggaggaggcgcagcagcgtcgaaagcttctgcctaaaataccttctccccggagcacggaggaacggaaggaagagcccagcgttcccgccgccgtatcattagcaacgaacagcacttattactccacaagtgccccaaaggcggagcttctgattaagatgaaagacctgcaggagcagcaggagcatgaagaggattctggtagcgatctggatcacgatctgtctgtgaagaagcaggagctgatcgagagcatctctcgcaagttgcaggtactgagagaggctagggagagtctactggaagacgtgcaagcaaacaccgttttgggtgccgaggtggaggcaattgtcaagggcgtctgcaaaccttctgagttcgacaaattcaggatgtttatcggtgatctggacaaagtggtaaatctgcttctgtccctcagtggaagattggcacgtgttgagaatgcactgaataacctggacgatggcgcaagtccaggagaccggcaatctctgctcgagaagcaacgcgtgctcatccagcaacacgaagatgcaaaggagctcaaggagaatctggatcgtcgcgagagaatagtgttcgatatattagcaaattacctgtccgaggaatcactagcagactatgagcatttcgtcaaaatgaagagtgcgctgataatcgaacagcgggagctcgaggataagatccacctgggcgaggagcagctcaagtgtctccttgactccttacagcctgagcgtggcaagtag

SEQ ID NO: 205054 - DNA, 1356 bp, Artificial Sequence
  Description of Artificial Sequence: Synthetic coding sequence
atggagaccagccggagccccagcccccagttcgccccccagaagttaactgacaaacctcctttgctgattcaggatgaagactcaacgaggatcgaaagggtaatggacaataacacaacagtgaagatggtgcccatcaaaattgttcactctgaatcccagccggagaaggagagtcgacagagtctagcctgccctgcggagccgccagccctgccacacggcctcgagaaagatcagataaaaaccttatcaacttcggagcaattttattcgcgtttttgtctctacaccaggcagggcgctgagcccgaggcgccacacagagcccagcccgccgaacctcagcctttaggcacacaggttcctcccgagaaagacaggtgcactagccctccaggtctgtcctatatgaaagctaaggaaaaaaccgtggaagatctcaagtccgaggagctggctcgggagatcgtgggtaaggacaaatctcttgctgatattctggacccttctgtgaagattaaaaccacaatggaccttatggagggtatttttcctaaggacgagcatcttttggaggaggcccagcagaggcgaaagctgctccctaagattccgagcccgcgatccactgaggaaaggaaggaagaaccttctgtgcccgccgctgtatcactggccacaaactccacctactatagcacttcagcccccaaggccgagctgctcatcaaaatgaaagatctccaggaacagcaggaacacgaagaagactccggcagcgatctggatcatgacctaagcgttaagaagcaggaattgatcgaatcaatcagtcgaaagctgcaggtcttaagagaagcaagggagtccctcctcgaggacgtccaggccaataccgttctcggagcagaggtcgaggccattgtgaagggggtgtgtaaaccctctgaatttgacaagtttcgcatgtttattggggatctcgataaggtggtgaacctcctcctgtcactgtccgggagacttgctcgggtggagaatgcgctgaataatctcgacgacggcgcatcacctggagacagacagagcctcctggagaagcagcgggtcctgatccaacagcacgaggacgctaaagagcttaaggaaaacctagaccgcagggagaggattgtgttcgatatcctggccaactacctcagcgaggaaagcctcgccgattacgaacactttgttaagatgaaaagcgccctgattatcgagcagcgggagctggaagataagatacatcttggggaagagcagctgaaatgcttgctggactcattacagcccgagcgcggaaagtag

SEQ ID NO: 205055 - DNA, 1128 bp, Artificial Sequence
  Description of Artificial Sequence: Synthetic coding sequence
atggagaccagccggagccccagcccccagttcgccccccagaagcttacagacaagccccctctgctgatccaggacgaagatagcactcgcattgagagggtcatggacaacaatacaacagtgaagatggtgcctattaagattgtgcatagtgagtcgcagcccgagaaagagtctagacagagcctggcctgcccagccgaaccccctgcactgccccacggcctggagaaagatcaaataaagaccctgtctacttcagagcagttctattccagattttgtctgtacacccggcagggagcagagcccgaggcaccccaccgggcacaacccgccgaaccccagcccctcggtacccaggtcccgcccgagaaggacagatgtacctctccgccagggctgtcatacatgaaagcaaaggagaagactgtggaggatctgaagagcgaggagttggcgcgcgaaatcgttgggaaggataagtctctggccgatattttagatccttctgtcaaaatcaagacaaccatggatctcatggagggtatcttcccaaaagacgaacacctgctcgaggaggctcagcagagaagaaaactattacccaagataccatccccacgatctactgaggagcgcaaggaagagccctccgtgccagcagcagtctcacttgcaaccaattcaacctattacagcacttctgcgccaaaagccgaactgctcatcaagatgaaggatcttcaggaacaacaggagcacgaggaggactcaggctcagacctggatcacgacttgtcagtcaaaaaacaggagctgatagagagcatatcccggaaacttcaggtcttaagggaagcgagagaaagtctgctggaagatgtgcaggcaaacacagttcttggtgccgaggtcgaagcaatcgtgaaaggagtttgcaagccatccgaattcgataaatttcgaatgtttattggggacctggataaagtcgtgaacttgctcctttcactgtcggggaggctggccagagttgagaatgctctgaacaacttggacgatggcgccagcccaggggacagacagagtctcctagagaaacaaagagtgttgatacaatag

SEQ ID NO: 205056 - DNA, 1203 bp, Artificial Sequence
  Description of Artificial Sequence: Synthetic coding sequence
atggagaccagccggagccccagcccccagttcgccccccagaagctgaccgataagccccctctcctgatccaggacgaagattccacaagaatcgaaagagtcatggataacaataccactgtgaagatggtgcccatcaaaatagtgcactctgagtcgcagccagagaaggaaagtcgccagtctctagcttgcccggctgagccacccgccctaccgcacggactggagaaagatcaaattaaaacactatcaacgtccgagcagttttacagccgcttctgcctctacacaaggcagggggctgagcccgaggcccctcacagggcccagccagcagaaccacagcccctgggcactcaggtgccacctgaaaaggatcgctgtacttctcctcccggattaagctatatgaaagcgaaggaaaagacggtggaggatctgaaatccgaagaacttgccagagaaattgttggcaaggataagtcactggctgatatactagatcctagcgtcaaaatcaaaacaacaatggatttgatggagggcatctttcccaaggatgagcacctgttagaagaggcacagcaaaggaggaagctcttgccaaaaatcccctcacctaggtccacagaagagagaaaagaggaaccttctgtaccagccgccgtgtcactggccaccaattccacttactacagtacctccgcccctaaggccgaactgctcattaagatgaaagacttacaggagcagcaggagcatgaggaggatagtggcagcgacttagaccatgatctcagcgttaagaagcaggaactcatcgagagtatctccagaaagctgcaggttttgagagaggcgagggagagcctactggaggatgtgcaggcaaatacggtgctaggagctgaagtggaggccatagtgaaaggtgtgtgtaaaccttccgaatttgataagtttcgaatgtttattggcgacctggacaaggttgtcaacctgctgctcagtttgtctggacgcctcgctagggtggaaaacgccctgaataacctcgatgacggagcctcccccggggaccgtcagtcattgcttgaaaagcagcgggtgctcattcagcagatgtgcgtagattttatgctcgatacgtatcatagcccgatcaacagaagctcgtgtctgaccgttacaaaatag

SEQ ID NO: 205057 - DNA, 777 bp, Artificial Sequence
  Description of Artificial Sequence: Synthetic coding sequence
atgcgggagcgggccccccccccccccccccccagccaggagacccccgtatacagtatggatgattttccacctcctcctccgcatacagtgtgcgaggcacagctagattctgaggatccagaaggacctcgaccctcgtttaataagctctctaaggttaccatcgctagagaaaggcatatgccgggagccgcccacgtggttggaagccaaacactcgccagtcgtcttcagactagcatcaaaggctccgaagcggaaagcaccccccctagtttcatgtctgtgcacgcccaactggccgggtcattgggggggcaacctgcccctatccagacacaatcactgagtcacgaccccgtgtctggaacccagggcttggaaaagaaggtaagtcccgatcctcaaaaatcaagtgaagatattcgcaccgaagctctggcaaaggagatcgtacatcaggacaagtcacttgccgatatcctggatccagatagccggttgaaaactacaatggacctcatggagggcctgttcccccgcgacgtgaatctgcttaaagagaacagcgtgaaaaggaaggcaatccaacgcacagtgagctcttctggttgtgagggtaagcggaacgaggacaaagaggcagtgtccatgttagtgaactgccctcagatatccttccctaggctagggccttggctgtgcccccagacctcacgcgtctcacccttcttgctaggggcggttctatctgtagtgttctcacagcactag

SEQ ID NO: 205058 - DNA, 5991 bp, Artificial Sequence
  Description of Artificial Sequence: Synthetic coding sequence
atgatgcggaccaccgaggacttccacaagcccagcgccaccctgaacagtaatacagccacgaaggggcgttacatctacctcgaggctttccttgagggcggcgcgccgtgggggttcacactcaagggcggtctggaacatggcgagccattgatcatctcaaaagtagaggagggcggcaaagccgacactctgtcttccaaactgcaggcaggcgatgaagttgtgcacattaacgaagtaactctctcaagctcccgaaaggaggctgtcagcctcgtgaagggttcctataaaacacttagactggtggttaggagggacgtgtgtacagaccccgggcacgctgacacgggcgcttcaaacttcgtttcgccggagcaccttacatccgggccacagcacaggaaagctgcatggagcggaggggtgaagctgcggctgaaacaccgaagatctgagcctgccgggcggcctcactcctggcacaccacaaaatccggagagaagcagccagatgctagcatgatgcagatctctcagggcatgataggtccaccctggcatcagagttatcacagcagttcctccacctcagacctgtctaactacgaccatgcatatctccgtcgctctccagatcaatgtagctcccagggctctatggaatctttggagccatctggcgcttacccaccctgccatctctcccctgccaaatccaccggcagtattgatcagctgtcccatttccacaacaagagggactcggcttattcatcattttccactagcagcagtatcttggaatatccccacccaggtatttcaggacgcgaacgctccggctctatggataacacatccgccagaggaggtctcctggaaggaatgagacaggctgacataagatacgtcaaaaccgtgtacgacacacgccgaggggtatccgccgaatatgaagtaaactcctcagcccttttattgcagggcagggaggctcgagcaagcgcaaacggccagggctatgacaagtggagtaatattcctcgaggcaaaggggttccgcctcccagctggagtcagcagtgcccaagctctttagaaactgccaccgataacctgcctcctaaagtcggtgctcctttgccgccagcgaggtccgatagttacgctgcatttcggcatcgggagcgccccagcagctggagtagcctggaccagaaacgcctctgccggccccaggccaattctttgggtagcctgaagtctccctttattgaggaacaattgcataccgtgctcgaaaagagtcctgagaactctccccccgtgaaacccaagcataattatacacagaaagcccaacccggccagccgctactgcctacctctatctaccccgtgccgtctctcgagccacattttgcacaggttccgcagccctccgtgtccagcaacggtatgctttaccccgccctggccaaagagtccggctacatcgccccccaaggcgcctgcaacaagatggccaccatcgatgaaaatggcaaccaaaatggatcagggcgtccaggcttcgccttttgtcaacctctggagcacgacctgttatccccagtggagaaaaaacccgaggcaaccgccaagtacgtgcccagtaaggtgcatttctgttcagtgcccgaaaatgaagaagacgccagcctgaaaaggcatctaacccctcctcagggcaatagcccacatagcaacgagcgcaaatcaacgcattcaaataagcccagcagtcacccccactcactgaagtgccctcaagcccaggcttggcaggcaggagaagacaagcgaagctcacgattgtctgagccttgggaaggggactttcaggaggaccacaatgccaatctttggcgcagattggagcgggaggggcttggacagtccctgtctggtaatttcgggaagaccaaaagtgccttcagctcccttcagaacatccccgaatcacttcgtcgacactcaagtctggaactgggccgcggcactcaggaaggctatcctggcggaaggccaacatgtgcagtcaacaccaaggctgaagatcccggccggaaggctgcgccagacttggggtcgcacctggaccgccaggtgtcgtatcctagaccagaggggcgcacaggcgccagtgcatccttcaattctacggaccctagcccggaggagccacccgccccctctcacccccacacgtcaagtttgggacggagaggccccgggcccggctccgcctcagcgttacagggatttcagtatggtaagccacattgctcagtactggagaaagtgtcaaaattcgaacagcgggagcaaggctcacagaggccgtctgtaggcggctccggattcggccacaattaccgcccccaccgaacagtcagcacttccagcacctccgggaacgactttgaagaaacaaaagcccacatcaggttttctgagtcagcagaacccttaggaaatggcgagcagcactttaaaaacggcgaacttaagctggaggaggccagccgacagccttgcggacaacaactctcagggggagcgagtgatagtggcaggggcccacagagacccgacgcgcggctgttgcgctcccaatcaaccttccagttgagttcagaaccagaaagggagcctgagtggcgggaccgcccaggttcacccgaaagtcccctgctcgatgctcccttttctcgtgcttataggaattctatcaaggacgcccaaagtcgggtgctgggcgcgacaagctttcggcgcagggacttggagctgggcgcaccagtggcctccaggtcgtggcggcctaggccctccagtgctcacgtgggcctgagatcccccgaggctagcgcctcggcttccccacatacacccagggaacggcacagtgtgacacccgctgagggcgatttggctcgtcccgtcccacctgccgctcgccgaggtgcccggcgccgcctcacacccgaacagaaaaagagatcatattcagagccagagaaaatgaacgaggtaggcatcgttgaggaagccgaacctgctcccctcgggccccagagaaatgggatgcgctttcccgaaagtagtgtagcagaccgccgccgcctgtttgaacgtgacgggaaagcctgctctactttgagtttgtcgggccccgaattgaagcagttccagcagagtgccctcgctgattatattcagagaaagaccgggaaacgtcctaccagtgcagcaggctgcagtctacaggagcccggacccctaagggagagagcccagtctgcctatctgcagcccggccccgcggctctcgaaggctcaggactagcatctgcttccagcctgtcatcactccgtgaaccatcccttcagcccaggcgcgaggccaccctcctgccagccaccgtagctgaaacacagcaggcaccacgagatcgcagttcctcatttgccggagggcgccgcctaggggagaggcgacgcggggacctcctgtcaggcgcaaacggagggacaagaggcactcagcggggggatgaaactccccgggagccaagcagttggggtgcccgcgctggaaagagcatgtctgctgaagatttgcttgaacggtcagatgtgcttgcaggcccagtacacgtgagaagtcgatcatccccggctaccgccgataagcgccaggacgtgctgctcgggcaggatagtggctttggcctggtcaaggacccatgttatctcgcagggcccggcagcaggtccctctcatgttccgagcgtggccaggaagaaatgttgccgctgttccaccatctgacccccagatgggggggctcggggtgcaaggctattggggactcttcagtgccctccgaatgccccgggactctggatcaccagagacaggctagtcgtactccctgtccccggccgccacttgcaggcacacagggtcttgtcactgatacgagagcagctccgctaacacctatcggcacccccctgccaagtgcaattcccagcggatactgctcccaagatgggcaaaccggccgtcagccccttcccccatacaccccagctatgatgcatcgctccaatggccatacactgacacagcccccgggtccacggggctgcgaaggagatggcccagaacacggggtcgaagagggtacccgcaaaagagtgagtctgccccagtggccccccccgagtagagctaaatgggctcatgctgccagagaggacagcctgcccgaagagtccagcgcaccagacttcgccaatctgaagcattatcagaaacagcagtccctgccatcattgtgttcaacctctgatccagatacccccctcggtgcgcccagcacaccaggccgaatctcactacggatcagtgagtccgtcctcagggactcaccaccgccacacgaagactacgaggatgaagttttcgtccgggatccacaccccaaggctacatcttcacctacatttgagcctctcccccctcctccacccccacccccttcacaggaaacccctgtatactcaatggacgatttccccccacctccccctcacacagtgtgtgaagcccagctggatagcgaggatcctgaaggcccccgcccaagttttaacaagttatccaaggtcaccatcgctcgggaacgacacatgcctggtgccgcccacgtggtgggttctcagactctggcctctaggctccagacaagcatcaaaggaagtgaagctgagtctacaccccccagttttatgtccgttcacgcgcagcttgccgggtcgctaggggggcagcccgcgcccatccaaacacaatctttgagccatgatccagtttcaggcacccaagggctcgagaaaaaggttagtcctgacccacagaaatcttccgaggatatacgcacggaggcactggctaaagagatcgtgcatcaggataagtcgttggctgatatcctggatcccgattcccgcctcaaaaccacaatggacctgatggaagggctgtttccacgcgatgttaacctgttgaaggagaacagcgtgaagcgcaaagccatccaacgaaccgtctcatcttctggatgcgaggggaaaagaaatgaggacaaagaggctgtgtccatgctggtgaattgccctgcgtattactccgtctcagctcccaaagcggagcttttaaataagataaaggagatgcccgctgaggtcaatgaggaggaggagcaggctgatgtgaacgagaagaaggctgagttgatcgggtcactgacacacaaactggagacactgcaggaggccaaaggctctcttctgaccgatattaaacttaataacgctctgggcgaggaggttgaggcacttatcagtgagttgtgtaaacccaacgaattcgacaagtacagaatgtttataggggacctcgataaggtggtcaatttgctgttgtcccttagcggcagattggcacgcgttgaaaatgtactgagcggcttgggggaggacgccagtaatgaggagcggagtagtctgtatgagaaaagaaaaatcctggcagggcaacacgaagatgctcgcgagttgaaggagaatttagatcgccgggaacgagtcgtgctaggcatattggccaattatttaagcgaagagcaacttcaggattaccaacattttgtcaaaatgaagtccactctcttaattgagcagcgcaagttggacgacaagattaagctcggccaggaacaggtcaaatgcctcctggagtctctgccttccgacttcatcccaaaagctggggccctggcactgcctccaaacctgacctctgaacccatcccggcaggaggatgcacttttagcggaatttttcctacacttacatctccgctgtag

SEQ ID NO: 205059 - DNA, 561 bp, Artificial Sequence
  Description of Artificial Sequence: Synthetic coding sequence
atggccttctacagcaccaccgagtacgacatccagctggcccgggggctcttatcaggcatgttcctgttcgccactagacgatctgagcccgccgggcgaccacacagttggcatacaacaaagtcgggcgagaagcagccggatgccagtatgatgcagatttctcagggcatgatcgggccaccgtggcaccaaagctaccacagtagcagcagtacttccgacctgagcaactatgatcacgcctatctaagacgtagtcctgatcagtgtagttcccagggatctatggagagtctcgagccctccggagcttaccccccatgccacctcagtcccgccaaatccactggcagtatcgaccagctcagccactttcacaacaagcgtgactcggcatactctagcttctctacaagctcctccatcctcgaatacccccaccccggaaagagggtgaaaaccagagacttacctggctcacagtcccccggacgcgccatcagccgcaaaaccaccatgcccacgagcgggggaggatggcgggaaaaggcctag

SEQ ID NO: 205060 - DNA, 4482 bp, Artificial Sequence
  Description of Artificial Sequence: Synthetic coding sequence
atggagaaccggcccggcagcttccagtacgtgcccgtgcagctgcaaggaggagccccctggggatttacgctcaagggaggcctggagcactgcgaaccccttaccgtctcaaaaattgaagacgggggcaaagctgcgctaagtcagaaaatgcggacaggtgatgaactggtcaacattaacggcactcccctgtatggatctaggcaagaagcacttatattaattaaaggttcattccgcatccttaagctaatcgtccgtaggaggaatgccccggtgtctcgtccccactcatggcacgtggctaaactcctggaaggttgccctgaagcagcaactacgatgcattttcccagtgaagcctttagcttaagttggcatagtggatgcaatacgtctgacgtttgcgtgcagtggtgtcctctgtccagacattgctccacagagaaaagtagttctatcggcagtatggagagcctggaacagcctgggcaagcaacgtatgaatctcacctcctgccaatagaccaaaacatgtaccctaaccaaagggattcagcctactcgtccttcagcgcctcatcaaatgcctctgattgcgccctctcactgcgacctgaggagcctgcctctactgattgcatcatgcaaggcccagggccaactaaggcccctagcggtaggcctaatgtggccgagacaagcggcggtagcaggcgtacaaacggtgggcacttaaccccatcctcccagatgtcaagccgccctcaagagggctatcagtcgggacccgccaaggccgttcggggccctccccagcccccagtgaggcgagatagtcttcaggcatctagggctcaactcctgaacggagagcaacgcagggcctccgagcctgttgtgccattacctcagaaggagaaactctcactggagcccgttttgcccgccagaaaccctaatcggttctgctgtttgtctgggcacgatcaggtgactagcgaggggcatcagaactgcgagtttagccaaccaccagagagctcccagcaaggttctgagcatttacttatgcaggctagcacaaaggccgtcggctcccctaaagcctgtgaccgagcttcctcagtcgactccaaccctctgaatgaggcatccgccgagcttgccaaggcctctttcggcaggcctccccatctgattggccccacaggccacaggcacagtgcacctgagcaactgttagcgtcccatcttcaacacgtgcatcttgatactcgcggcagcaaagggatggagctgccacccgtacaggacgggcaccaatggactctctcacccctccacagctctcacaaaggaaaaaagagtccctgtccccctaccggaggtacacacgatcagagctctaaagaaagaaagacccgccaggtagacgatagaagtctggttctgggccaccagtcacagtcctcgcccccacacggcgaggcggacgggcatcccagtgagaaaggattcctggaccctaaccggacaagccgcgcggcatctgaactggcaaaccagcagccttcagcctccggatctctggtacagcaggccactgattgctccagcaccacaaaagcagcatctggcaccgaggccggagaggaaggagactcagaacccaaagagtgtagtcgcatggggggcagacgctcaggcggaacacggggccgtagtatacaaaacagaagaaagtccgaacgattcgccaccaaccttagaaacgagattcagagacgcaaggctcagctgcaaaagtcaaaaggaccattaagccaactgtgtgacaccaaggaacctgtcgaagaaactcaagagccccccgagtccccccctttaacagcatccaacacttcactgctttcctcctgcaagaagcccccgtcaccgagggataaactattcaataagtccatgatgctccgggccaggtcatcagaatgtctcagtcaggccccggagtcccacgagagtcgaacgggtcttgagggacggatatccccaggacagcgacctggtcagtcctctctgggacttaacacctggtggaaagctccagatccatcttcttctgatcccgagaaagcccatgcacactgtggcgtgagggggggccactggaggtggtctcctgagcacaattcccagcctctagtcgccgcggccatggagggcccttctaacccgggtgacaataaggagctgaaagcttctactgcgcaagcaggcgaggatgcgattctcctcccttttgccgatagacggaagttttttgaagagtcctccaagtctctctctacttcccatctccctggcctgactacccatagtaacaaaaccttcactcaacggcccaaacctattgaccagaacttccagcctatgagctcctcttgccgcgagctcagaaggcaccccatggatcagtcttaccattcagcagaccaaccgtatcatgccaccgaccagtcttaccattccatgagccctcttcagagcgagacgccaacatactccgagtgttttgctagtaagggcctcgagaactccatgtgctgtaagcctctacattgtggagacttcgactaccatagaacctgctcctactcctgcagtgtgcagggtgccctggtacacgatccttgcatatattgtagcggtgagatttgcccagcacttcttaagcggaatatgatgccaaactgctataattgtcgctgccatcaccatcagtgcattagatgttccgtgtgctaccacaatccacagcattccgcactcgaggacagttccctggctccaggcaacacttggaagcctagaaagctgaccgttcaggagttccctggcgataaatggaatcctataacaggcaatagaaaaacatcacagagtggtcgggagatggcgcactctaagacttcattctcttgggccactccttttcatccctgtctcgagaatcctgctctcgatctgagcagttacagggctatctctagtctggatctgttaggggattttaaacacgctttaaaaaagtcagaagagacgtccgtgtacgaggagggctccagtcttgcctccatgccccacccacttcggagccgcgccttctcggaatctcacatctcattggcaccacaatcgacccgagcttgggggcagcaccgccgagaactcttcagcaagggcgacgagactcagtctgacttacttggggctaggaaaaaggcattcccccctccccggcctccacctcccaactgggagaaataccggctctttcgagccgctcagcagcagaaacagcaacagcaacagcaaaaacagcaagaagaagaagaagaggaagaggaggaggaggaggaggaagaagaggaagaggaagaagaggctgaagaagaagaggaagagctccctcctcaatacttttcttctgagacttcaggcagctgtgcattgaaccccgaagaagtgctggagcagcctcaacccctctctttcggacacctcgaaggtagccggcaaggcagccaatccgtgccagcagaacaagaatcattcgctctgcattcatcagacttcctgccaccaatacgtggtcacctcggcagtcaacccgagcaagcccagcctccatgttactacggtatcgggggtctctggaggactagcggtcaagaggcaactgagtccgctaaacaggagttccagcacttctcaccaccaagtggggcaccgggcattcctacctcatacagcgcctattacaatatcagcgtggccaaggcagagttgttgaataagttaaaggatcagccagaaatggctgagattggacttggggaggaggaagtcgatcacgagctggcccagaaaaaaattcagctgatcgagtccatttcacgcaagctgagcgtgctgagagaggcccagaggggactgctggaggacattaacgctaatagtgcactgggtgaggaagtcgaggcaaacttgaaagcggtctgtaaatccaatgaatttgagaagtaccatcttttcgtgggcgaccttgataaagtggtaaacctgctgttatcactttctggcaggctcgctagggtcgagaatgcgttaaatagcattgacagcgaggcaaaccaggagaagcttgtactgatcgagaagaagcagcagttgacggggcagctcgctgatgccaaagagctaaaggaacatgttgaccgcagagagaagttagtttttggcatggtgtcacggtatttgccgcaggaccaacttcaggattatcagcactttgtcaagatgaagagtgcgttaatcattgagcagcgggagctcgaggagaaaataaagttaggagaggagcagctgaagtgtctgagagaatccttgctgcttggaccaagcaatttctag

SEQ ID NO: 205061 - DNA, 4482 bp, Artificial Sequence
  Description of Artificial Sequence: Synthetic coding sequence
atggagaaccggcccggcagcttccagtacgtgcccgtgcagctgcaagggggagcaccctggggatttactttaaaagggggcctggagcactgtgaacctctgacagtttccaaaattgaggacggcgggaaagccgcgttatctcagaagatgcgaaccggcgatgaactggtcaatattaatggcactccgctgtacgggagccggcaggaggctctcatcctgatcaagggtagcttcagaatcctgaaactcatcgttcggagaagaaatgcaccagtgagcaggccacattcttggcatgttgctaagctgctggagggttgtccagaggccgccaccactatgcacttcccatcggaggctttctccttgtcctggcacagtggctgtaatacaagtgatgtctgtgtgcagtggtgtcccctcagtcggcactgcagtaccgagaagtccagtagcataggcagcatggaatccctggaacaacccggccaggctacttacgaaagccacctgctaccaatagaccagaatatgtaccctaaccagcgggatagcgcctattcctctttcagtgcaagctctaacgccagcgactgcgccctcagccttcggcccgaggaacctgcatccactgattgcatcatgcaaggccctggccccaccaaggccccaagcgggaggcccaacgtggcggaaacttctggtggttcaagacggaccaacgggggacatctgactcccagtagtcaaatgtcatcccgcccccaggagggctaccaatccgggcccgcaaaggcggttcgcggcccaccacaaccacccgtcagacgagactcacttcaggccagccgagcccaattactgaacggtgaacagagacgagcctcggagccagtggtccctctgccacagaaggaaaagctaagtctggagccagtcctacctgccagaaaccccaatcgcttctgttgcctgtcaggccacgatcaggtcacatcagaaggacatcagaattgcgagttctcccagccacctgagtcttcacagcagggcagcgaacatctgcttatgcaggcaagtactaaggcagtaggctcccctaaggcttgtgatagagcctcatcagtagactccaatccgctgaacgaagcgagtgccgagctggcaaaggcctcctttggccggccacctcacctgatagggcccaccggacatcggcatagcgccccggagcagctcctggcctcccacctccaacatgtgcacctcgatactcggggctccaagggaatggagttgcctcccgtgcaggatggtcatcagtggaccttgagccctcttcactcctcacataagggcaaaaagagtccatgcccccccacaggggggacacacgatcaatctagcaaggaacgaaagacccgacaagtggacgatagatcccttgttctgggccatcagtctcagtccagcccccctcatggagaggctgatggccatccttcggaaaaggggttccttgatcctaatcgcactagtagggctgcctcagaactggctaatcagcagccaagcgccagcgggtccctggtgcagcaggcaaccgactgctccagcacaactaaggccgcatctgggaccgaagcaggcgaggaaggcgactcggagccaaaagagtgctctaggatgggcgggcggagaagcggaggaacgcgggggagaagcatccagaaccggcggaaaagcgagcgttttgccacaaatctcaggaacgagatacaacgccgcaaagctcagctgcaaaaatctaaaggacctctctcacagctgtgtgatactaaagagccagtagaagagacccaggaaccacctgagtctccgcccctaaccgcttcaaatacctcactgcttagctcatgcaaaaagcccccatccccaagagacaaactctttaataagtcaatgatgctacgggcccgtagtagtgagtgcctatctcaagccccggaatctcatgagtcccgtacaggactggaagggcgcatttctcctggccaaagacccggccagagctcactgggattgaacacatggtggaaagccccagatccatcttcctctgatcccgaaaaggctcatgcccactgcggcgtccggggcggacattggcgctggtcacccgagcataactctcagcctctagtggcagcagctatggaaggcccctcaaatcccggagacaacaaggaactcaaggctagtactgctcaagctggggaggatgctatcttactgcccttcgcagataggagaaagttcttcgaagaaagctctaaaagtctaagtactagccacctaccgggtttgaccacccatagcaataagacatttactcagaggcccaagcccattgatcagaactttcagcctatgagcagttcctgccgcgaattaagacggcatcccatggaccagtcttatcattcggctgatcagccttatcatgcgaccgaccagagctaccacagtatgagcccactgcagtccgagacccccacctactccgagtgcttcgcttccaaagggctcgaaaatagcatgtgttgcaagccactgcactgcggcgacttcgattaccaccgaacttgttcctactcttgttcggtgcagggcgccttggttcacgacccctgtatatattgcagtggggagatatgcccagccctcctaaagcggaatatgatgcccaattgctacaactgcagatgtcaccaccaccaatgcatccggtgctccgtgtgctatcacaatcctcaacatagtgcgctggaagactcctctttagcacctggaaacacatggaaacccagaaagctgacagtgcaggaatttcctggggacaagtggaacccaattacagggaatcggaagacaagtcagtcagggcgggagatggcacattctaagacctcatttagttgggcaacccccttccacccctgcctcgagaaccctgctctcgatctgagctcttatagggctatatcctcactggacttgttaggagattttaagcatgctcttaagaagtctgaagagacttcagtgtacgaggaaggcagttccctggctagcatgccgcacccactccgtagtagggctttcagtgaaagtcatattagcttggccccccaatcaactcgagcctggggccaacatagacgggagctgttctccaaaggggacgaaacacagagcgaccttctgggcgcccgcaagaaagcctttcctccccctcgcccaccaccgccaaactgggagaaataccgcctattcagagccgcccagcagcaaaagcaacaacagcagcagcagaagcagcaggaggaggaggaggaggaggaagaggaagaagaagaggaagaggaagaggaagaagaggaggctgaggaagaagaggaggaactgccgcctcaatattttagttccgagacttccggctcatgcgcactcaatccagaggaggtgctggagcaaccccagccgctgtccttcggccatctggaggggagccgacaagggagccagagcgtgcccgcagagcaggaaagctttgccctgcactctagcgatttcctgcctccaattcggggacacttgggaagtcagcccgaacaagcacagcctccatgctattatggcatcggcggactctggaggactagcggccaagaagccacggagagtgcaaaacaggagttccagcactttagcccaccttccggtgctcccggcattcctacgtcctatagtgcctactataatatctctgtcgccaaagcggagttactcaataagctgaaagaccagccagagatggcggagatcggcctgggtgaggaggaagtggatcacgagctggcacagaaaaagatccagttaatagaatctataagccgcaagctcagtgtcctccgcgaggcccaacggggtctgttggaagatataaacgcaaattcggctctcggagaagaggtggaggcaaatcttaaggctgtgtgtaagtctaatgagttcgaaaaataccatctattcgtaggagatcttgacaaagtggttaacctgttattatccctgtctggacgacttgccagggttgagaatgcccttaattctattgacagcgaggctaaccaggagaagcttgtgctgatcgaaaaaaagcagcagctcactgggcagctggcggatgccaaagaactgaaggaacatgtggaccgccgcgaaaaattggtgttcggaatggtaagcaggtatctcccgcaagatcagttgcaagactatcagcattttgtgaagatgaaatctgctttgattattgaacagcgagaattggaggagaaaattaagctgggagaagagcagctgaaatgcctccgcgaatccctgctgctggggcccagtaatttttag

SEQ ID NO: 205062 - DNA, 4134 bp, Artificial Sequence
  Description of Artificial Sequence: Synthetic coding sequence
atgcacttccccagcgaggccttcagcctgagctggcacagcggctgcaatacctccgatgtttgtgtgcagtggtgccctctcagtcgccattgctccacggaaaaatcatcctccatcgggtcgatggagtccctggaacaacccggacaagctacatatgaaagccatctgctgcctattgaccagaatatgtaccctaatcagagagacagtgcgtatagtagttttagcgcttccagcaatgcttcagattgcgccttgtcgctgcgtcccgaggagccagctagcaccgattgtattatgcaaggtccaggtccaactaaggccccaagtggccggcccaacgtggccgaaacatcaggaggatccaggcgcactaacggaggccacctgactccttcatcccaaatgagttctcgccctcaagaaggatatcagtccgggccggcaaaggccgtgcggggtccaccgcagcctccagtgcgcagagacagtctccaggcgtcgcgcgcacagttactaaatggcgagcagagacgcgcatctgagccagtggtacctctgccccagaaggaaaaactctccttagagccagtcttgcccgcaaggaatcccaaccgcttttgctgcctaagtggtcacgaccaggtgacttccgagggacaccagaactgtgagttcagtcagccacctgagtcatcacaacaggggagcgagcacctgctgatgcaggccagtaccaaggccgtgggctcaccaaaagcctgtgacagagcctcctccgttgacagtaatcctctgaacgaggcttccgccgaattggccaaggcaagttttgggcggcctccccacctcatcgggcccaccggccatcgccatagtgctccagaacagttgctagcatctcatctgcagcatgtgcatctggacaccaggggcagtaaaggtatggaactgccccctgtccaggatggccaccaatggacattgtctcctttacattcatcccacaagggaaaaaagagcccatgtccgccgactgggggcacacatgatcaatctagcaaagagaggaagactcggcaggtagatgatcgcagcctcgtattgggacaccaatcccaaagctcacctccgcacggggaggcagacgggcatccatcagagaagggtttcctcgatcccaacagaactagcagggcagccagcgagctggccaatcagcaacctagcgcgtcaggctcgttagtacagcaagccaccgactgcagctcaactacgaaggccgcctctgggacggaggccggtgaggagggcgatagcgagccgaaggaatgtagcaggatgggcgggcggcgcagcggagggacccgtggacggagcattcagaaccgtaggaaatctgagcgctttgctactaacctcagaaacgagatccagagaagaaaggcgcagctccaaaagtcaaagggaccattgtcacaactgtgcgacaccaaggagccagtcgaagagacacaggagcccccggagagcccaccactgactgcttccaatacgtccctgctgtcgtcttgtaaaaaaccaccctcaccacgcgacaagcttttcaacaagtctatgatgctgcgagcaagatcatcagagtgtctcagccaggctcctgaaagccatgagagccggacaggactcgaaggtcggatttcgcctggacagaggcccggacagtcctctttaggccttaacacctggtggaaggcacccgatcctagcagtagtgaccctgagaaggcacatgcccactgtggcgtgaggggcgggcactggcggtggagcccggagcacaactcccagccattggtcgctgctgccatggaaggtcctagcaaccccggggacaacaaggaacttaaagcgagtactgcacaagctggtgaggatgctatcctgttgcccttcgctgaccgtcggaaatttttcgaggaaagcagtaaaagtctctctactagtcacctgcccgggctaactacacacagcaataagactttcactcagcggccaaaacccattgatcagaatttccagccaatgtcgtctagttgtcgggagctacgcaggcatcccatggaccagagctatcactcagccgaccagccctaccatgcaaccgatcaatcgtaccactccatgagtcccctccagtccgagacaccaacatactctgaatgtttcgcctcaaaaggactggaaaactcgatgtgttgcaaaccgctgcattgtggagactttgactaccatagaacgtgtagttattcatgttcggtgcagggagctctcgtgcatgacccttgtatttactgtagcggagaaatctgccccgcactcctcaagaggaacatgatgccaaattgttacaattgtagatgccaccaccatcaatgcatcaggtgctcagtgtgctaccacaacccacagcactcagccctggaagattcgtcactcgccccagggaacacatggaaaccccggaaactgaccgttcaggaattcccaggagataaatggaaccccatcactggcaatagaaagaccagtcagagcggtagggagatggcacatagcaaaacctctttttcatgggccacccccttccatccctgcctggagaatcctgccctggaccttagcagctatcgggccatcagcagcctggacttactgggggatttcaaacacgccttgaagaagagcgaagagacatcagtgtacgaagaaggctccagtctggcttctatgccccatcctcttcggagcagagcattttcagagagccatatctctctggcaccacaatcaacacgcgcctgggggcagcacaggagagaactgttctcaaagggcgacgaaacccaatcagatcttctgggtgccagaaagaaagccttccctcctcctcggccaccgccccctaactgggaaaaatatagactatttcgggctgcccagcagcaaaagcagcagcagcagcaacagaaacagcaggaggaagaagaagaagaggaagaagaggaagaagaagaggaggaagaagaagaagaggaagctgaggaggaagaggaggagcttccaccccagtacttctcctcagagaccagcgggagttgcgcactgaacccggaggaagttttagaacaacctcagcccttgagttttggccatttagagggcagcaggcagggtagccagagcgtcccagccgagcaggagagctttgccctccacagctcagattttttgccacccattcgtgggcatctcggctcacagccggagcaggcccagcccccgtgttattatggcattggcggactctggaggaccagcggccaagaagcaactgaaagcgcaaaacaggaatttcaacattttagcccgccctctggcgcaccaggtatccctacatcctattctgcctattacaatatttcagtagcaaaggccgaactcctgaacaagctaaaagaccagccagaaatggcagagatcggcctgggcgaagaggaagtcgatcatgaattagctcagaagaagattcagctgatcgagtcgatctctaggaagttgtctgttcttagagaagctcagcgtggcttgctcgaggacattaatgctaactcagctctcggtgaggaagtggaagccaaccttaaggctgtctgcaaatccaacgagttcgagaaataccatctgtttgtcggtgatctggacaaggtcgtgaacctcctgctttctctctccggacgcctagcccgggtggagaacgccctaaacagcatcgacagcgaagctaatcaggagaagctcgttcttatcgagaagaagcaacaactcactggacaactggccgacgccaaggaactgaaggaacatgttgatagacgggagaagttggtgtttgggatggtctccaggtacttgccccaagatcagctgcaggattatcagcacttcgtaaaaatgaaatcggcactgatcatcgagcagcgggaactcgaggaaaaaatcaagctcggggaggagcaactgaaatgcctccgtgagagtctgctgctcggaccaagtaatttttag

SEQ ID NO: 205063 - DNA, 1686 bp, Artificial Sequence
  Description of Artificial Sequence: Synthetic coding sequence
atggccaaggagcggtgcctgaagaagagcttccaggacagcctggaggatattaagaaaaggatgaaagaaaaacggaacaagaatttagctgaaatcggcaagcgtcggtcattcatcgccgccccctgccaaatcattaccaacacttctacgctcctgaaaaactaccaggacaacaataagatgcttgtgttagccctggaaaacgagaaatcaaaagttaaagaagcgcaggatatcatcctgcagctgcggaaggaatgttattacttaacctgccaactatacgccctgaaggggaaactcacaagccagcagaccgtggagcccgcccagaatcaggaaatttgttcatctgggatggacccgaactctgacgattcatccaggaatctgtttgtgaaagacctgccccaaattcctctagaggaaacagagttgcctggccagggggagtctttccaaatagaagatcagattcccactattccccaggataccctgggggtcgatttcgactcaggggaagctaagagcactgacaatgtgctgcctagaaccgtctctgtgcgcagctcacttaagaaacactgcaactcaatctgccagtttgacagtctggacgacttcgagacgagccacctcgccggaaagtcttttgagtttgagcgcgtcggtttcctagacccgttggtgaacatgcacataccggaaaacgttcagcacaacgcctgtcagtggtctaaagaccaggtgaatctttccccaaaactcatccagcccggaacctttaccaagactaaagaagatatcctcgaatctaagtccgagcagaccaagtctaagcagcgcgacacccaagaacggaaaagagaggagaaaagaaaagctaaccgtcgcaaatcaaaaagaatgtccaagtacaaggagaataaaagcgaaaataaaaagactgtgccgcagaaaaagatgcacaagagtgtatccagtaacgacgcgtacaacttcaatctcgaagagggcgtccatctgactccctttaggcagaaagtctctaatgattccaacagggaggagaacaatgaatcagaagtgagcctctgcgagagtagtggtagcggggatgattccgatgatctgtacttgcccacctgcaagtacattcagaatccaacctccaactccgaccggcctgtgacaagacccttggctaagagagccctcaaatacaccgacgaaaaagagaccgagggaagtaagcctaccaaaactcccacaacaacgcccccagagacgcagcaaagcccccatctcagcctaaaggacatcaccaatgtgagcctgtaccctgtcgtgaaaattcggcggctgtccctttctcccaagaagaacaaggcctcacctgcagtggcacttccaaaaaggagatgtacagcctccgtgaattacaaggagccaaccttggctagtaagctgagacggggggacccatttacagatctatgcttcctgaattctccgattttcaaacagaagaaagatctgcgccgttctaaaaaacgagcactcgaagtcagtccagccaaagaggcaattttcatcctgtattatgtgcgcgagttcgtgagccggtttcccgattgcaggaagtgcaagttggagacccacatctgcctccggtag

SEQ ID NO: 205064 - DNA, 879 bp, Artificial Sequence
  Description of Artificial Sequence: Synthetic coding sequence
atggccaaggagcggtgcctgaagaagagcttccaggacagcctggaggatatcaagaagcggatgaaggagaaacggaataagaatttagctgaaattgggaagcgtcggagcttcatcgccgcaccttgccagattataactaacacttcaactttgcttaagaattatcaggacaacaacaagatgttagtgctggcccttgagaatgagaaatctaaggtgaaggaggcacaggacatcatcctgcagctcaggaaggagtgttactatctcacatgccagctctacgctctgaaaggtaaacttaccagccaacaaacagtcgaacccgctcaaaatcaggagatctgctcatccggaatggacccaaacagtgatgatagttcacgcaacctgtttgtcaaagacctgccccagatcccactcgaggagaccgagttacctggacagggcgagtcatttcaaatcgaagccacacctcccgaaacgcagcaaagtccccatctgagcttgaaggacatcaccaatgtttctctatacccagtcgtgaaaattaggaggctgtcccttagtccaaaaaaaaacaaagcatctccggctgttgccttgccaaaaaggcgttgcactgcgagtgtgaattacaaggaacctactctggcctcgaagcttcgaagaggtgatcccttcacagacttgtgttttcttaactccccaatttttaaacagaagaaagacctgcggaggtccaaaaaacgcgctcttgaggtgtccccagccaaagaggctatttttattctgtattacgtgagggaattcgtgagtcgcttccccgactgtagaaagtgtaagctcgaaacacacatttgcctgcgctag

SEQ ID NO: 205065 - DNA, 648 bp, Artificial Sequence
  Description of Artificial Sequence: Synthetic coding sequence
atggccaaggagcggtgcctgaagaagagcttccaggacagcctggaagatattaagaaacgcatgaaggagaagagaaacaagaacctggctgaaattggcaaacggaggagttttatcgctgctccctgtcagatcataaccaacacctctactctgctgaaaaactaccaggacaacaataaaatgctggtcctggccctggaaaatgagaagtccaaagtgaaagaggcccaagatatcatattacagttgcggaaggaatgttactaccttacatgtcaactttatgctctcaagggcaaactaaccagtcagcagaccgttgagccagcccagaaccaggaaatctgctcctccggaatggaccctaactccgatgactctagcaggaacctctttgtgaaagatctgccacagattccactcgaggagactgagcttcccggacagggcgaatctttccaaatcgaggatcagattcctacaatacctcaggacactcttggtgtggactttgattctggcgcccttgaggtgtcacccgctaaggaggcgatctttattctgtattacgtgagagagtttgtcagccgctttcccgattgtaggaaatgcaagctagaaacccatatctgcctccgctag

SEQ ID NO: 205066 - DNA, 1584 bp, Artificial Sequence
  Description of Artificial Sequence: Synthetic coding sequence
atggccaaggagcggtgcctgaagaagagcttccaggacagcctggaagacatcaagaaaaggatgaaggagaagagaaataagaaccttgccgaaatagggaaaaggcgttcttttatcgcagcgccttgtcaaataatcactaacaccagcaccctgctgaaaaactaccaggacaataataagatgttggtcttagcactggagaacgagaagtccaaagttaaagaagcgcaggatattatcctccagttacggaaggagtgttactacctgacctgccagctttatgcactgaaggggaaattaacctctcagcaaaccgtggagcctgctcaaaatcaggaaatctgctcctctggcatggatcctaattcagacgattccagccgcaacctgtttgttaaagacttaccacaaattcctctcgaagaaactgagctgccagggcagggagagtcttttcagatagaagatcagattccaaccataccacaggatactctgggggtggactttgactccggagaggccaagtcaactgacaacgtgctgccccgcaccgtgtcggtgagatcctcccttaagaagcactgtaacagcatttgccagtttgactccctcgacgatttcgaaacttctcatcttgcaggaaagtctttcgagttcgagcgagtgggattcctggaccctcttgtcaacatgcatatccccgaaaacgttcagcacaacgcctgtcaatggagcaaagatcaggtgaatcttagccctaaactgatccaacccggcacattcactaagaccaaggaggacatcctggaaagtaaaagtgaacaaactaagagcaagcagcgagacacacaggagcggaaacgcgaggagaagcggaaggcaaacaggaggaaaagcaagcggatgtccaagtataaagagaataaatcagaaaacaaaaagaccgtgccacaaaaaaagatgcacaagtccgtatctagcaacgacgcctataatttcaacctggaggagggggtgcacttaacacccttcagacagaaggtaagcaatgattcaaaccgggaagagaataatgagtccgaggtttctctgtgtgagtctagcggttccggcgacgatagtgatgacctgtacctgccgacctgtaaatatatccaaaatcccacatcaaattcagaccgcccagtaacccgaccactagcaaaacgtgccctcaagtatacagatgagaaggaaactgagggtagtaagcctacaaagaccccaactaccactcctccagagacgcaacagagcccgcacctcagcctcaaagatattaccaacgtgagtctgtatccggtagtgaaaatccggcgtctatctctgtcccctaaaaaaaacaaagctagcccggctgtcgctttgcctaagagacgctgtaccgcaagcgtgaactataaggagccaacacttgccagtaagctccgtaggggtgacccattcactgatctgtgcttcctaaactcaccaatttttaagcagaagaaggatttacggagaagcaaaaaatctatgaagcagatccagtag

SEQ ID NO: 205067 - DNA, 1584 bp, Artificial Sequence
  Description of Artificial Sequence: Synthetic coding sequence
atggccaaggagcggtgcctgaagaagagcttccaggacagcctggaggacattaagaaacgcatgaaagagaaacgtaacaagaatctggccgaaatcggaaaaaggcgttctttcatcgctgccccttgccaaattataaccaacacttccactctcctgaagaactaccaagacaacaacaagatgttggttctcgctttggaaaatgaaaagtcgaaagtcaaagaagcccaggacattatcttgcagctgcggaaggagtgttattacctcacgtgccagctgtacgccctgaagggcaagctgacgtcacagcagacggttgaacccgcccagaatcaagagatttgcagctctggtatggaccctaatagtgacgactccagtcggaacctgtttgtgaaggacctgcctcaaatcccactggaggagacagaacttccaggacaaggcgagagcttccagattgaagaccagatacctaccatccctcaggacacccttggcgtggacttcgattctggggaggccaagtcgacagacaacgtgcttccaagaacggtctccgtgcggtcaagcttgaagaagcactgtaacagtatctgccagtttgattcattggatgattttgagaccagccatctagcggggaaatccttcgaattcgagagagtgggcttcctcgatcccctggtgaatatgcacattcccgaaaacgttcagcacaatgcctgtcaatggtctaaagatcaggtgaatctgagtcctaaattgatccagcctggaacctttaccaaaactaaggaagacatcttagagagcaaatcggagcagacaaagagcaagcagcgagatacacaggaacgaaagagggaagagaagagaaaagcgaaccgtaggaaatctaagcggatgagcaagtataaggagaataagagtgaaaacaagaaaactgtgccacaaaagaaaatgcataaatccgtgtcgagcaacgacgcttacaacttcaacctcgaggagggagtgcatttgacccctttccgccagaaggtatccaacgactcaaaccgcgaagagaataacgagtccgaggtgagcctgtgcgagtcttccggtagcggggatgactccgacgacctgtacctccccacctgcaagtacatccagaatccgaccagcaattcagatcgccccgtcacccgtccccttgctaagagggcattgaaatacaccgatgagaaggaaactgaaggctcaaagccgacgaagaccccgacaaccacccctccagagacccagcagagcccacacctgtccctgaaagatatcacaaacgtgagtctataccctgtggtgaagatccgacgcttgtcactgtctccaaaaaaaaataaagcttccccggctgtggccctcccaaagcgaaggtgcacagctagcgtaaactacaaagagcccacccttgcttccaaactgagaagaggagatcccttcacagatctgtgcttcctaaactcgccgattttcaagcagaagaaggatcttcgtaggtcaaaaaaatctatgaaacagatccagtag

SEQ ID NO: 205068 - DNA, 828 bp, Artificial Sequence
  Description of Artificial Sequence: Synthetic coding sequence
atggccaaggagcggtgcctgaagaagagcttccaggacagcctggaagatattaagaaacgcatgaaggagaaaaggaataaaaacctggcagagatcgggaagcggcggtcctttatcgcagcaccttgtcagataataactaacacctcgaccctgctaaagaattatcaggacaataataagatgcttgttctcgctctcgagaacgagaaatcaaaagtcaaggaggctcaggacattatcctccaactgcgaaaggagtgttactatctcacctgtcaactgtacgcactcaaaggcaaactaacctctcagcagacagttgagcccgcccagaatcaggaaatatgttcgtccgggatggaccccaactcggatgatagtagccgaaatcttttcgtgaaagatttgcctcagatccctctggaagaaacagagctgccaggccagggtgagtcttttcagatcgaggaccagatccccaccatcccacaggacacactgggcgtcgacttcgattcagcgactccccctgaaacacaacagtctccccatctttcacttaaagacatcacaaacgtgagcctctatcctgtggtcaaaatacggcggctgagcctgagccccaagaagaacaaggcgtcccccgccgtggctctgcctaagcggaggtgcaccgcctctgtgaactataaagaacccactctcgcgtctaaactgaggcgcggagatccgtttaccgacctgtgtttcctcaattctccaatcttcaagcagaagaaggacttacgacgcagtaagaagtcgatgaagcagatacagtag

SEQ ID NO: 205069 - DNA, 930 bp, Artificial Sequence
  Description of Artificial Sequence: Synthetic coding sequence
atggccaaggagcggtgcctgaagaagagcttccaggacagcctggaggacattaagaagagaatgaaggagaaacgaaataagaacctggccgaaataggaaaacgccggagctttatagctgccccatgtcagatcatcactaatacttccactctgctgaaaaactaccaagacaacaacaaaatgctggtcctagctttagaaaacgagaaatctaaagtgaaggaagcacaggacatcatcctacagctcaggaaggagtgttactacctgacctgccaactttacgccctgaagggcaagcttacttctcagcaaaccgtggaaccggcccagaatcaagaaatatgttcctcaggaatggatcccaacagcgacgatagttcacgaaatctgttcgtgaaggacctgccgcaaattcccctggaagaaacagagctgcctggccagggtgagtctttccagatcgaagatcagattcccacaatcccacaggataccctgggcgtcgatttcgactccgctacaccacccgaaactcaacaaagtccacatctgtctttgaaggatatcaccaatgtgtcactgtaccccgtggtgaaaatcagaagactgtccttaagtccaaagaaaaacaaagccagcccagccgtcgccttacctaagagacgatgtaccgcgtcagtgaattataaagaaccgaccctagcaagtaaattaaggaggggggaccccttcactgacttatgttttctgaatagccctatctttaaacagaagaaagacctgagacgcagcaagaaacgcgccctggaggtatcgcctgccaaggaggctatctttatcctctactacgtgagagagttcgtgtcacgattccccgattgccgaaagtgcaagctggaaactcacatttgtctgcggtag

SEQ ID NO: 205070 - DNA, 1686 bp, Artificial Sequence
  Description of Artificial Sequence: Synthetic coding sequence
atggccaaggagcggtgcctgaagaagagcttccaggacagcctggaagatataaagaagcggatgaaggagaagcggaacaaaaatctggctgaaataggcaagcggaggtccttcatcgccgcgccttgccagatcattaccaacaccagcacgctgctgaagaattaccaggataacaacaaaatgctcgtcctcgccttggaaaatgagaagagcaaggtaaaggaggcacaagatattatcttgcagctccgcaaagagtgctattatctcacatgccagctgtacgctttgaaaggaaagcttacttcccagcagacagtagagccggcccagaatcaagagatttgtagtagtggtatggatcccaactctgatgactcctccagaaacctgttcgtgaaggaccttccccagattcccttggaagagacggaattgccaggacagggggagtcctttcaaatcgaggatcaaatacctactatcccgcaggatacccttggagtggacttcgattcgggcgaggccaagagtacagataacgttctgccccggactgtcagtgtccgcagcagcctgaagaagcactgcaatagcatctgccaattcgactcacttgatgactttgagacgtcccacctagccggcaagagtttcgagtttgagcgggtgggcttcctcgaccctctggtgaacatgcacatccctgagaatgtgcagcacaacgcctgtcagtggagcaaggaccaggtcaatttatctccgaaactgatccaaccagggacattcaccaaaacgaaggaagacatcctagagagtaagagcgagcagaccaaatccaagcaacgtgatacccaggagcggaaaagggaggagaagcgtaaggctaacaggcggaagagcaaaagaatgtctaagtacaaggaaaataaatctgagaacaagaagactgtcccccagaaaaaaatgcacaaatcagtctcttccaacgacgcttacaacttcaatctagaagagggggtgcatctcacgccatttcgtcagaaagttagcaatgacagtaatagagaggaaaataacgaatccgaagtcagcctttgtgagtcatctgggagcggggatgatagcgatgatctgtacctgcccacatgcaaatatattcaaaaccctacttccaactccgatcgcccagtgactcgaccgcttgccaaacgggcgctgaagtacaccgacgagaaggagactgaaggatcgaagccaacaaagacacccacaactacaccccctgaaactcaacagtcaccccacctgtccctgaaggacatcaccaacgtgagcctgtacccagtcgtgaagatacgccgcttgagcctgtctcctaagaaaaataaagcctcccctgcagtcgccctgcctaaacgcagatgcaccgcctccgttaactataaagagcccaccctagcgtctaaactgaggcgaggtgatcccttcaccgacctgtgttttctgaacagcccaatattcaagcagaagaaggacctccgaagatctaaaaagagagccttggaagtatcgccagccaaagaagcaatatttatcctatattacgtgagagagtttgtaagtcggttccctgactgtcgcaagtgtaagctcgaaacccatatatgtttgcggtag

SEQ ID NO: 205071 - DNA, 930 bp, Artificial Sequence
  Description of Artificial Sequence: Synthetic coding sequence
atggccaaggagcggtgcctgaagaagagcttccaggacagcctggaggacatcaagaaacggatgaaagagaagagaaataagaacctggccgaaattggtaaaaggaggtcctttatcgccgccccgtgccaaataataactaacacttcaactttactaaaaaactatcaggataataacaaaatgctggttctggccttggagaatgagaaaagcaaagtcaaggaggctcaagatattattctccagcttaggaaagaatgttactacctgacatgtcaactgtatgcacttaagggtaagctgacttcccaacaaactgtagagccagctcaaaaccaagagatttgcagcagcggaatggaccccaattcggatgactcttctcgcaatctgtttgttaaagacctgcctcaaatccccctggaggagacggagctgccagggcaaggtgaatcttttcagatcgaggaccagatccccaccatcccccaggacacgctcggtgtagactttgacagcgctacaccacctgagacacaacagagtccacacttatccttaaaggacattacaaatgtcagcctctaccctgtcgttaaaatacgccgcttgtcattatcacccaaaaagaacaaggccagtcccgctgtggctctgcccaaacgcaggtgcacggctagtgtcaactacaaagaacctactttggcatccaagctgcgccgcggcgatccgtttacagatctgtgttttctcaactccccgatcttcaagcagaagaaagacttgcgccggagtaaaaaacgcgccctcgaggtgtcaccagctaaagaggcaatcttcatcctgtattatgtacgtgaattcgtatctaggtttcctgactgccggaagtgtaaactggagactcatatatgcctgaggtag

SEQ ID NO: 205072 - DNA, 777 bp, Artificial Sequence
  Description of Artificial Sequence: Synthetic coding sequence
atggccaaggagcggtgcctgaagaagagcttccaggacagcctggaggatattaagaaacgcatgaaggaaaagcggaacaagaacctggctgaaattggcaagcggcgctcgtttattgccgcaccatgtcagatcatcaccaacacctctactctgttaaaaaactaccaggataataataaaatgttagtgttggccttagagaacgagaagtccaaggtgaaggaagcgcaggatattatcctgcagttacgcaaggaatgctactatctaacttgccagctgtatgctcttaaaggcaagcttacctcacagcagacggtagagccagcccagaaccaggaaatctgcagctccggcatggaccccaacagcgatgatagctctcgtaacctgtttgttaaggatcttccccagatcccactggaggaaacagagctgccaggccagggcgaatcattccagattgaggctaccccccccgagactcagcagtcgcctcatttatccttgaaggacataactaatgtgagcctgtaccccgtagtgaagatcagaagactgtccttgagccccaaaaaaaataaagcctcaccagccgtcgcattacctaagcgtcggtgcacagcctccgttaactataaagagcctacactggcttcaaaactgaggaggggagatccgtttaccgacctctgcttcctgaacagcccgatttttaagcagaagaaagacctgaggagatcgaagaagtccatgaaacagattcagtag

SEQ ID NO: 205073 - DNA, 828 bp, Artificial Sequence
  Description of Artificial Sequence: Synthetic coding sequence
atggccaaggagcggtgcctgaagaagagcttccaggacagcctggaggacatcaagaagcgaatgaaggagaagagaaacaagaacttagccgaaattggaaagagacggagcttcatcgccgctccgtgtcaaatcataaccaacactagtaccctccttaagaactaccaggacaacaacaaaatgctcgtgctcgctttagagaacgagaagtcgaaggtcaaggaggctcaggatatcatccttcagctgcggaaggagtgctattatctcacatgccagctctacgccctgaaaggcaagctgactagccagcaaaccgtggaacctgctcagaatcaagagatatgcagttctgggatggaccccaactctgacgatagctctcgcaatctgttcgtgaaagacttaccccagattcctctggaggaaacagaattgcctggccaaggagagagcttccagattgaggaccagatccctaccatccctcaggacacgttaggcgttgattttgatagcgccacaccacccgaaactcaacaatctccacacctcagcctgaaagatatcacaaatgtcagtctttacccagttgtcaaaatccggcgcctcagtttatcacctaaaaagaacaaagccagcccagcagtagcacttcctaaaaggcggtgcaccgccagcgttaattataaagagcccactctggcctccaaacttagaaggggtgacccgtttactgacctgtgcttcctcaacagcccaattttcaagcagaagaaggacttgaggcgcagcaagaagagtatgaaacagatccagtag

SEQ ID NO: 205074 - DNA, 777 bp, Artificial Sequence
  Description of Artificial Sequence: Synthetic coding sequence
atggccaaggagcggtgcctgaagaagagcttccaggacagcctggaggatattaaaaagcggatgaaggagaaaagaaacaagaacctcgcagagataggcaagcgccgcagcttcatcgccgcgccatgtcagatcattactaacacatctactctcctcaagaactatcaagataataacaaaatgttggtactggccttggaaaacgagaaaagtaaggtcaaagaggcgcaggacatcatcctgcagctccggaaggagtgctactatctgacctgccagctgtacgcactgaagggaaaattaacttcacagcagacagttgaacccgcacaaaatcaggaaatctgctccagtggaatggatccaaattctgacgatagttcacgcaatctgtttgttaaggacttaccccagatacctctcgaggaaaccgaactgccaggccagggcgaatcctttcagattgaagcaacaccccctgagacacagcagagcccacacctgtctctgaaggacattactaacgtcagcctgtaccccgtggtgaaaattaggagactgtcgctgtcaccaaagaagaacaaagcttcccccgccgtggctttgcccaaaaggcgctgtacagccagcgtgaattacaaagagcccaccttagcaagtaaattgaggaggggcgatccgtttacagatctttgttttttgaatagccccatctttaaacagaaaaaggacctgaggagaagtaagaaatcaatgaaacagatccaatag

SEQ ID NO: 205075 - DNA, 879 bp, Artificial Sequence
  Description of Artificial Sequence: Synthetic coding sequence
atggccaaggagcggtgcctgaagaagagcttccaggacagcctggaggacatcaagaaaagaatgaaagaaaagagaaacaagaatctggctgagatcggcaaaagaaggtccttcatcgcagctccctgtcaaatcatcacgaacacctcaacactgctgaaaaattaccaagacaataacaagatgctcgtgctggctctcgaaaatgagaagagcaaagttaaagaggcacaggacatcatccttcagttacgaaaggagtgctattacctgacctgccagctctacgcactgaagggaaagctgacctctcagcagacagtggaaccagcccaaaatcaagagatctgcagctctggtatggaccctaacagtgatgattccagcagaaacctctttgtcaaggatttgccgcagatccccctggaggagacagagttaccaggccagggagagtctttccagattgaagcaacgcctccagagacacaacagagtccacacctcagcttaaaggacataaccaatgtgagtctgtatccagtcgtgaaaataaggcgactgagtctgtcccctaagaaaaacaaagcttctccagccgttgccctgccgaagcggaggtgcactgcttctgtgaattataaagagcctaccctggctagtaaactcaggcgcggggatccctttactgacctgtgctttttaaactcaccgatatttaaacagaaaaaagatctgaggcgtagtaagaaacgggccctggaggtctcaccagccaaggaggccatcttcatcctttactatgttagagaatttgtcagtcgcttccctgactgcaggaaatgtaaactggagacacatatctgcctgagatag

SEQ ID NO: 205076 - DNA, 3798 bp, Artificial Sequence
  Description of Artificial Sequence: Synthetic coding sequence
atggagtgccccgtgatggagaccggcagcctgttcaccagcggcattaaaaggcacttgaaggataagaggattagcaaaacgacgaaactgaatgtctcccttgctagcaaaatcaagaccaaaatattaaataacagttctattttcaaaatcagtctgaagcataataaccgggccctggcgcaggcactgtctcgggagaaagagaattcaagaaggatcactaccgaaaagatgttgctacagaaggaggtggagaagttgaactttgaaaacacctttttaagactgaagcttaacaacttaaataagaagctgatcgacatcgaagcccttatgaacaacaatttgatcaccgccatcgagatgagcagcttatcagaatttcaccaatcctctttcctgctgtccgcttcaaagaagaagcgcatctcaaagcagtgtaagctgatgagactcccttttgcccgggtccctcttacttctaatgatgacgaggatgaggataaggagaaaatgcaatgcgataacaatataaaaagcaagactctccccgatattcccagctccggctctaccacgcaaccacttagtacccaggataatagcgaggtgctgtttctcaaggagaacaaccagaatgtgtatggcctcgacgactcagagcatatctcgagtatagtggacgttccgccaagagagagccacagccattccgatcagtcttctaagacgtccctcatgtcagaaatgaggaatgcccagtctattggccgccggtgggaaaagccctcaccttctaatgttacagagcggaaaaaacgcgggtcatcctgggagagcaacaatctcagcgctgacactccatgtgccaccgtgctggacaagcagcacatctcttcacccgaactgaactgcaacaacgagatcaacggacatacgaacgagacaaacactgagatgcaacgcaataagcaagacctgcccggactgtcttccgagtccgcgcgcgaacccaatgcagagtgtatgaatcagattgaggataacgacgacttccagctccaaaagaccgtgtacgatgccgatatggacctgaccgccagtgaggttagtaaaatcgtgacagtgtccaccgggattaagaagaagtcgaacaagaagaccaacgagcacggaatgaagacttttcgaaaggtcaaagactcctcaagtgaaaagaagcgggaacggtcgaagcggcagtttaaaaactcaagcgacgtggacattggagaaaagattgaaaaccgcacggagaggagcgatgtcctggatggcaaaaggggagccgaggatccaggctttatttttaacaatgaacaactggcgcaaatgaatgagcagctggcccaggtgaacgaacttaaaaagatgactctgcagaccgggtttgaacagggcgacagggaaaatgtgctgtgcaataagaaggagaaaaggattacgaatgaacaggaggagacgtactcactcagccagtcctctgggaagtttcaccaggagagcaaattcgacaagggacagaactccctgacatgtaacaagtcaaaagcgagcagacaaacttttgttatacataaactggagaaggataaccttctcccaaatcagaaggacaaggttaccatctatgagaaccttgatgtaaccaacgagttccacactgccaacctatcaaccaaggacaatggcaacctctgtgactacggcacacacaatatactggatctaaaaaaatatgtcacggacattcagcccagtgagcagaacgaatccaatataaataagctacgcaaaaaagtgaaccgcaaaactgagatcatttctgggatgaatcacatgtacgaggacaacgacaaagatgtagtgcatgggctcaagaagggaaattttttttttaagactcaggaagacaaagagcccatttcagagaatatagaagtatccaaagaactgcaaatccccgccttatccactagggacaatgagaaccaatgcgactatcgcactcagaatgtcctggggctacagaagcagatcactaacatgtatcccgttcagcagaatgagtccaaggtgaacaagaaattacggcaaaaggtgaatcggaaaacagaaatcatttcagaggtgaaccacctggacaacgacaaaagcatcgaatatacagtgaagtcgcacagcttgttcctgactcagaaggataaggagatcatccctggaaacttagaagatccaagcgagttcgagacgcctgccctgagtactaaagattctggaaacctctatgattcggaaatacagaacgtcctgggtgtgaaacacggacacgacatgcagcccgcatgtcagaatgacagtaaaattggcaagaagccgagactgaacgtctgccagaaatccgaaatcatccctgaaactaaccaaatctatgagaatgataataaaggcgtgcatgaccttgaaaaggataactttttttcattgacccctaaagataaagaaacaatcagtgagaatttacaagtgactaacgaatttcagacagtggacctactgattaaagataacggaaacctgtgcgactacgacacccagaacattcttgagctcaagaagtatgttacagacagaaagtcagccgaacagaatgaaagcaaaattaataagctcaggaataaggtgaactggaaaacagaaattatcagcgagatgaaccaaatttacgaggacaatgacaaagatgcacatgttcaggagtcctacactaaggacctagattttaaggtgaacaaaagtaaacagaaactggaatgtcaggacatcattaacaagcattatatggaggtgaattccaacgagaaagaatcttgcgaccaaatacttgattcctacaaagttgtgaaaaaaagaaaaaaggagagctcttgcaaggccaaaaatatcctaacaaaagccaaaaataaactcgcttctcaacttaccgagtcttcccagacatcaataagtctggagtcagatctcaaacatatcacttcagaggcggattcggacccaggcaacccggtggagttgtgcaaaacccaaaaacagagcacgaccaccttaaacaaaaaagatctgccattcgtggaagagattaaagaaggtgaatgccaagtaaagaaagtcaataagatgacctcaaaaagtaagaagcgcaaaaccagcattgacccctctccagagtctcacgaagtgatggagaggatcctggattccgtgcagggcaaatccaccgtgagcgaacaggctgataaagagaacaatctggagaatgagaagatggtcaaaaacaaaccggatttttatacaaaagccttcaggtcgttatcagagatccatagccctaatatccaagactcctcgtttgattccgttcgggaggggctcgtgcccctgtccgtctctagtgggaaaaacgtcatcataaaagagaatttcgctctggaatgctcaccagcttttcaagtcagtgacgacgagcacgaaaaaatgaacaagatgaagtttaaggtcaaccgacgcacccagaagtccggtatcggcgaccgccctctgcaggacctttcgaacacgtcattcgtgtcaaataataccgcagagagcgaaaataagtctgaggacctgtcctcagagcgcacgtctagaagacggcgctgcaccccattttattttaaggagccttctcttcgggataagatgagacggtag

SEQ ID NO: 205077 - DNA, 744 bp, Artificial Sequence
  Description of Artificial Sequence: Synthetic coding sequence
atggagtgccccgtgatggagaccggcagcctgttcaccagcggcattaagaggcacctgaaagacaaacggatcagcaaaactaccaaactgaatgtctcgctggcaagtaagattaaaacaaaaattctgaacaattcgtcaatatttaaaatatccctgaaacataacaatagggctctggcacaagcactgtctagagagaaagagaactcaagacgcatcaccacagaaaaaatgcttctgcagaaagaagttgaaaaactgaatttcgaaaacaccttcctgcgcctgaagctgaacaatctcaataaaaagcttattgatatcgaggctctgatgaataataacttaatcaccgctatcgagatgagctccctctcagagtttcaccagtcatcgtttctgctgtccgcctctaagaaaaagcgaatttccaaacagtgtaaactgatgaggctgccatttgcacgcgtgccactgacgagtaatgacgatgaggacgaagataaagaaaagatgcaatgcgacaacaacataaaaagtaagaccttacccgatatcccttcttctggaagcactacacagcctctcagcacacaggataactctgaggttctgtttttgaaggagaataaccagaacgtttacgggctggacgactctgagcacatctcttccattgtcgatgtgccaccccggggcgagatcgtactgaaaatccacttcgagtacctgtactag

SEQ ID NO: 205078 - DNA, 264 bp, Artificial Sequence
  Description of Artificial Sequence: Synthetic coding sequence
atggagtgccccgtgatggagaccggcagcctgttcaccagcggcatcaagagacacctcaaggacaagcggatatccaaaacaaccaaattgaacgtgagcttagccagtaaaatcaaaaccaaaatacttaataatagctccatcttcaaaatttccctcaaacacaacaatagggcactggcgcaagccctgagcagagagaaggaaaactctcgcagaatcaccaccgagaagatgctgctgcagaaggaagtggaatag

SEQ ID NO: 205079 - DNA, 753 bp, Artificial Sequence
  Description of Artificial Sequence: Synthetic coding sequence
atgagcatcttcacccccaccaaccagatccggctgaccaacgtggccgtggtgaggatgaagcgggcgggcaaaaggtttgagatcgcttgttacaagaataaggtcgtgggatggaggtccggcgttgagaaagacctcgatgaagtcctccagactcactccgtctttgtcaatgtgtcgaagggacaggttgcaaagaaggaggacctgatttctgcattcgggactgacgaccagacagaaatatgtaaacagattctcacaaaaggagaagtccaggtctctgacaaagagcgacacacacagctagaacagatgtttagagatattgctaccattgtggccgacaaatgcgtgaatcccgagaccaagcgcccctataccgtcatcttgattgagcgtgcaatgaaagatattcactattccgtcaaaaccaataagagcaccaagcagcaagcactggaggtgatcaagcagcttaaagagaaaatgaagattgagcgtgcccacatgagactccgattcatccttcctgtcaacgaaggaaaaaaactgaaagaaaagctcaagcccctgattaaagtcatcgaatcggaggactatgggcagcagctggagattgtctgcctgatcgatccggggtgctttagagagatagatgagcttattaagaaggaaaccaagggaaagggatccttggaggtgttaaatctgaaggatgtagaggagggcgatgagaaatttgagtag

SEQ ID NO: 205080 - DNA, 1572 bp, Artificial Sequence
  Description of Artificial Sequence: Synthetic coding sequence
atggtggcccccggcctggtgctgggcctggtgctgcccctgatcctctgggcagacagatctgccgggatcgggttccgcttcgcatcttacattaacaatgacatggtccttcagaaagagcccgcaggggccgtgatttggggctttggaacccccggcgcgaccgttacggtcactctgaggcagggccaggagaccataatgaaaaaggtaactagcgttaaggctcacagtgacacatggatggttgtcctcgatcccatgaaaccaggcggcccttttgaagtgatggcgcagcagactctggaaaagattaacttcaccctgcgagtgcacgacgtgctgttcggcgacgtttggctctgcagcggtcaatccaatatgcaaatgacggttctgcagatcttcaacgccacccgcgaactaagtaatacggccgcttaccagagtgtccggattttgtccgtgagccccattcaggcagagcaagaactcgaagatctcgtggccgttgatctccagtggagcaaacctaccagtgaaaacctcggacatggctattttaaatatatgagcgctgtgtgctggctcttcggccgacacctatatgatacactacagtaccccataggtctgattgcaagctcatggggcgggacccctattgaggcctggtcatcaggccgttccctgaaggcgtgtggagtccccaagcagggcagcatcccgtacgactccgtcaccgggccttccaagcacagcgtgctgtggaacgctatgatccaccccctgtgcaatatgactttaaagggggtcgtgtggtaccagggtgagtcaaatattaactataacaccgacctctacaactgtacttttcccgccctgatcgaggattggcgggagacctttcacagaggctcacagggacagactgaaagatttttcccctttggacttgtgcagctgagctctgacttgtccaagaagagttccgatgatggcttcccccagatccgctggcaccagacagcagattttggctacgtgcccaatcctaagatgcctaatacgtttatggctgtggcaatggatttgtgtgaccgagactctcctttcggctcaatccatccacgcgataaacaaaccgtggcctatcgcctccacctaggcgctcgcgccctggcttacggggaaaaaaatcttacatttgaagggcctctgccagaaaagatcgaactgcttgctcataaggggctgcttaatctcacgtactaccagcagatccaagttcagaagaaagacaacaaaattttcgaaatctcatgttgctctgaccatcgctgtaaatggctacctgcctcaatgaataccgtgagcacacaatccctcactctggcaatcgatagctgccatggaactgtggttgcgctacgctatgcctggacgacatggccatgcgaatacaagcagtgccccctttatcacccttccagcgcactgcctgcccctcctttcatcgcctttatcaccgaccaagggccaggccaccagagcaacgttgcgaaatag

SEQ ID NO: 205081 - DNA, 1467 bp, Artificial Sequence
  Description of Artificial Sequence: Synthetic coding sequence
atggtgctgcagaaggagcccgccggcgccgtgatctggggcttcgggacgccaggagctacagtgacagtaacactgcggcagggccaagagacaatcatgaagaaggtcacatcggtcaaggcacactccgatacatggatggttgtgctggacccaatgaaacccggggggccgtttgaggtgatggcccagcagacacttgaaaagattaatttcacgctgcgtgtgcacgatgtcctcttcggagacgtgtggctgtgttccggacagtcaaatatgcagatgactgtgctgcagatatttaacgcaacccgagaactgagcaataccgccgcatatcaaagcgtccggattctgtccgtctcgcccatccaagccgaacaggaattagaagatcttgtagctgtcgaccttcagtggtcaaaacccaccagcgaaaacctaggccacggatatttcaagtatatgagtgcagtctgctggctgttcggcaggcatctctacgacacactccagtacccaattggccttatcgctagctcttggggtggtacgcctatagaggcctggagctctgggaggtccttaaaggcctgtggagtacctaagcaagggagtatcccgtacgactcagtcacaggcccctccaagcactccgtgttgtggaacgcgatgattcatcccttgtgtaatatgacactgaagggcgtcgtatggtatcagggtgagagtaacattaattataacaccgatctatataattgtacctttcctgcactgatagaggattggcgggagaccttccaccggggctcccaagggcagacagagagattttttcccttcggcctggtgcagttgagttctgatctgtctaaaaagtcaagtgacgacgggtttccccagatcaggtggcatcagaccgccgattttggctacgtccccaatcctaagatgcctaatacctttatggctgtggccatggacctgtgtgacagagattctcccttcggcagcattcaccctcgggataagcagactgttgcctacagactgcatctgggagctagagcgctggcatacggggagaagaatctgaccttcgagggtcccttgccagaaaaaatcgagctactggctcacaagggccttctcaatttgacgtattatcagcaaatccaggttcagaagaaggataataagatcttcgaaatcagctgttgtagtgaccaccggtgtaaatggctgcccgctagtatgaacaccgttagcacgcaatcgctcacacttgcgattgacagctgtcatgggactgttgtggcgctccggtatgcttggactacatggccctgtgagtataagcaatgtccgctgtaccacccaagctctgcactcccagcgcctccctttattgcttttatcaccgatcaaggcccaggccatcagtccaacgtggcgaagtag

SEQ ID NO: 205082 - DNA, 2094 bp, Artificial Sequence
  Description of Artificial Sequence: Synthetic coding sequence
atgctgctgcccctgctgctgagcagcctgctgggcggcagccaggcgatggacgggcgcttttggatccgggtgcaggaaagtgtcatggtacccgaagggttgtgtatttcagtcccctgttccttcagttaccccagacaggattggacaggctctacaccggcctatggatactggttcaaagctgttaccgagacaactaagggagcccccgttgcaaccaatcaccagtcccgggaggttgaaatgagtacgcgaggtagatttcagctgactggcgatcctgcaaagggaaactgctcccttgtgataagagacgcccagatgcaggacgagagccaatacttcttcagagtcgaaaggggctcctacgtaaggtataattttatgaatgatggctttttcttaaaggtgacagcactcactcagaagccggacgtgtacatacctgagaccctggagcctggccagcctgtaaccgttatttgtgtcttcaattgggcttttgaggagtgccctccaccttcattttcttggacaggcgccgcactgtcttcccaaggaacaaagccaaccacatcacacttctctgtgctgagcttcactccacggccacaggatcacaatactgacctgacttgtcacgtcgatttttcaaggaaaggagttagtgctcagagaactgtgcggctgcgtgtggcttatgccccaagagatttggtgatcagcatatcacgagacaatacacccgcattggaacctcagccgcaaggaaacgttccctatctcgaagctcagaaaggacagttcctgcggctgctttgtgctgccgattcccagccaccagctaccctttcgtgggttctacagaatagagtgctgagctcttcccacccctggggaccgaggccactgggccttgagctgccgggcgtcaaagctggagactcaggaagatacacatgcagggccgaaaatcggctaggatctcagcagcgggctctggatctgagcgtccaatacccgccggagaaccttcgggtgatggtgagccaagccaataggacagttttggaaaatctcggcaacggcacttccctgcctgttctagaagggcagtctctgtgtctggtttgcgtcacccattcttcaccaccagctaggctgtcgtggacccagaggggccaggttcttagtccttcgcaaccttccgatcctggcgtattggaactaccacgcgtgcaagtggaacatgagggcgagtttacatgtcacgcccgacaccccttgggatctcagcacgtgtcactgagcctatccgtgcactacagccccaagttgcttgggcccagttgctcctgggaggcagagggtcttcattgtagttgctcatcacaggctagccccgcccctagtctcaggtggtggctgggcgaagaactgttagaggggaattcctcccaagactcatttgaggtcacaccctcctcggctggcccatgggccaacagctccctcagtctacatgggggcctgagcagcggcttgcgccttcgatgtgaggcctggaacgtacacggtgctcagtctggcagtatcttgcagctacccgacaaaaagggcctgatcagcactgctttcagtaatggggcttttttgggcattgggatcactgccctcctctttctctgtctggccctgattattatgaagattttgcccaagcgccgcacccagactgagacacctcgaccacgtttttctaggcatagtacaatactagactacataaatgtggtgcccaccgcagggcccctcgcccagaagcggaatcaaaaagccacgcccaactcccccaggacaccattgcctcctggcgcccctagcccagagtcgaaaaagaatcagaagaagcagtaccaactgccgtccttccctgagcccaagtcctccactcaggctcccgaaagccaggagtcacaggaagagctgcattacgcaaccctgaattttcccggcgtgcgccccagacccgaagctcgcatgcctaagggtacccaggccgattacgccgaggtcaagttccaatag

SEQ ID NO: 205083 - DNA, 1809 bp, Artificial Sequence
  Description of Artificial Sequence: Synthetic coding sequence
atgctgctgcccctgctgctgagcagcctgctgggcggcagccaggcaatggacggaagattttggataagagtgcaagaaagtgtcatggtgcctgagggtctctgcatctcagtcccttgctctttttcttaccccaggcaagattggactggcagcacccccgcttatggttattggttcaaagcggtgacggaaactaccaagggcgcccccgtggccacgaatcaccagagtcgcgaagtcgaaatgtccaccagaggccgctttcagctgacaggggatcctgctaaaggtaattgcagtctcgtcattcgtgatgcgcagatgcaggatgaaagccaatacttcttccgggtggaaagaggaagctatgtccgttataatttcatgaacgatgggttcttcctcaaagtgacggctttgactcagaaacccgatgtgtacatccccgaaacacttgaacccggacagccagtcacggtgatctgtgtattcaactgggccttcgaagagtgccccccgcccagtttttcatggacaggagccgccttgtcaagtcagggaacgaagccaacaactagtcactttagcgttttgagcttcacaccccggcctcaggatcataatacagacctgacttgccatgtcgactttagccgcaagggcgtgtccgctcagcgtacggtcaggttacgagtcgcatacgcccccagagatctggtcatatccatcagtcgcgataacacacctgccctggagccacagccacagggcaacgttccatacctggaggcccaaaagggccaatttctcagattgctgtgcgctgccgactcacagccaccagcgactctctcctgggtccttcaaaatagggtgttatctagcagccatccgtggggaccaagacccctaggtctcgagcttccaggggtgaaggcaggggacagcggcaggtatacatgcagggccgaaaatcgacttggcagccaacagcgcgcgttggacctctctgtacagtatcctccagaaaacttgagggtcatggtttcacaagccaaccgaaccgtcttggagaacctgggaaatggcactagcctgcccgtgctcgaggggcaaagcttatgcctggtgtgcgtgacacactccagcccgccggcgagactaagctggacacagcgcggccaggtgctgagccctagtcagccttcagatccaggcgtgctggagttgcctcgcgtgcaggttgaacatgagggcgaattcacgtgccacgcaagacaccccttggggtctcagcatgtgtcgctgtccctgagcgtgcactataagaagggcctgatctccaccgcgttttctaacggagcttttctcggcatcggcatcaccgcactcctctttctgtgtttagcgctgattatcatgaaaatacttcctaagcggagaacacaaacagagaccccacgcccacgcttttcgcgtcactccacaatcctggattatattaatgtagtgccaacggcaggacctctggcacaaaagcggaaccaaaaggcaacccccaacagtcctagaacacccctcccgccaggcgcaccatcaccagagtccaagaaaaaccagaaaaaacagtaccagctcccaagctttcctgaacctaagagctctacacaggctcctgagtcccaagaatcccaggaggagttacattacgcaacactgaattttccaggcgtgcgaccgcgccctgaagcacgtatgcccaaagggactcaagctgattatgccgaagtaaaattccagtag

SEQ ID NO: 205084 - DNA, 2094 bp, Artificial Sequence
  Description of Artificial Sequence: Synthetic coding sequence
atgctgctgcccctgctgctgagcagcctgctgggcggcagccaggcgatggacggacgcttctggattcgtgtgcaggagagtgtgatggtaccagagggattatgcatctccgtgccttgctctttctcatatccaaggcaggattggaccgggtcaacaccagcctatggctactggtttaaggccgtaactgagaccacaaaaggcgcaccagtagccacaaaccatcagtcccgggaggtggaaatgtccacacgcggaagattccaactcaccggagatccagcgaaaggaaattgctcacttgtgatccgagatgcccagatgcaggatgagtcccagtacttttttcgggtcgagcgtgggtcgtacgttaggtataatttcatgaatgacggctttttcctgaaggtgacagccctcacacaaaagccagacgtttatatccctgagaccctggaacctggccagccagtaactgtcatttgcgtatttaattgggcatttgaagagtgtccacctcccagcttcagctggacaggggctgcacttagtagccagggaaccaaacctaccacttcacacttctcagtcctttcctttacaccccggccgcaggatcataatacagacctcacatgccacgtagacttttctcggaaaggagtttccgcacaacgcacggtccggctcagagtagcatacgccccaagagacctggtcattagcatttctagagataatacacctgctctggagccccagccccagggaaatgttccttacctggaggcccaaaagggccaatttctcagattgctgtgcgccgccgacagtcaaccacctgctaccctctcttgggtgttgcagaatcgagtcctgtcctcttcacacccatggggaccacgacccctcggcctagagctcccaggcgtgaaagcaggagatagtggccggtacacttgcagagccgaaaacagactgggttcccagcaaagagccctcgatctgagtgtgcagtaccctccggaaaacctgcgtgtcatggtgtctcaggccaacagaaccgtgttggaaaacctgggcaacgggacgagccttccagtcttggagggacaatctctctgcctcgtgtgcgtaactcactcctccccacccgcccgcttatcttggacccagaggggacaggtgctatccccctctcagcctagtgaccctggagtgcttgagctccctagagtgcaggtagaacacgagggagagttcacctgccacgcgcgccatccactgggatcgcagcatgtgagtctgtctctatccgtgcattacagccccaagctgctgggtcccagctgcagctgggaggctgaaggcctccactgtagttgctcttctcaggcctccccagctccttccctgcgttggtggctcggtgaagagctcctggaaggcaactcttcccaagacagcttcgaggtgactccttctagcgcaggaccttgggccaacagctccctgagcctgcacggcggtctgtcctcggggctacggctccgatgcgaggcttggaatgtacatggcgcccagtcaggatccatcctgcagcttccggacaagaaggggctgatctcgacagcgttcagcaacggtgcttttttaggaatcggtatcacagccctgctcttcctgtgcctggccctaattattatgaagattctgcctaagaggagaacacaaacagagaccccgcggccccgattttctaggcatagcaccatcctggattatattaacgtggttccaaccgcggggcctctggcgcagaagcggaatcagaaggctactccaaacagccctcggactcctctgcctcctggggctccctctcctgagagtaagaagaaccagaaaaaacagtaccagctgcccagttttcccgaaccgaagtcctcaacccaggcccctgaaagtcaggaatcccaggaggagctgcattacgctacactgaactttccaggggtccggcctcggccggaggctagaatgccaaaggggacacaagcggattacgccgaagtgaagttccagtag

SEQ ID NO: 205085 - DNA, 1560 bp, Artificial Sequence
  Description of Artificial Sequence: Synthetic coding sequence
atgctgctgcccctgctgctgagcagcctgctgggcggcagccaggcaatggatggcagattctggattcgcgttcaggagtcggttatggtgcctgaaggcctctgtatctcagtgccctgctcctttagttacccccgccaggactggacggggtctacgcccgcatacgggtactggtttaaagcagtgaccgagacaactaaaggcgcaccagtggctaccaaccaccagagccgggaagtcgagatgtctacccgtgggcggttccagctgactggagatcctgccaaaggaaattgttccctcgtgattagggatgcccagatgcaggatgaatcccaatactttttcagggtggaacgcggcagctacgtacgatataatttcatgaacgacgggttctttctcaaagttacggcccttacacagaaaactgtgagactcagggtggcttacgcaccaagagacctcgtgatcagcatcagtagggacaatacaccggcgctcgagccacaaccgcaaggcaatgtaccttatttggaagcacagaagggacagttcttaagattgctttgcgccgcagactcccagccacctgctacactgtcttgggtgctccagaaccgcgtccttagctctagccatccatggggaccccggccccttggcctcgagcttcccggggtgaaagcgggagacagcggtaggtacacctgccgggccgagaacagactcggctcccaacagagggctctcgacctttcagtccaataccctcccgaaaacctgagggttatggtcagtcaggcaaaccgaaccgttctagagaacctcggcaacggaacatccctcccggtgcttgagggccagtccctgtgcttggtgtgtgtgacacactcttcacccccagcaaggctgtcctggactcaaaggggacaggtgctgtcaccttcacagccatcagaccccggtgttctggaattaccacgagtgcaagtcgaacatgaaggtgaattcacctgtcatgcgagacaccccctcggcagtcagcacgtgagtctctccttatctgtgcattacaagaaggggcttatctccactgccttcagtaacggggccttcctcggcatcggaatcacggccctacttttcctctgtctagctctaataattatgaagattcttcccaaaaggcggacccaaactgagactccaaggccccggttttcccggcattcaaccatcttggattacatcaatgtggtacctaccgcgggacccctggctcagaaaagaaaccagaaggcgaccccaaatagtcctcggaccccactccctcctggggccccttcccctgagtcaaaaaagaaccagaagaaacagtatcaactcccttcattccccgagcctaagtcctctacccaggcgcctgagagtcaggaatcacaagaggaacttcattatgcaactttgaacttccctggtgtccgcccacggccagaagcccgaatgccaaagggaactcaagcggactatgccgaagtcaaatttcagtag

SEQ ID NO: 205086 - DNA, 1920 bp, Artificial Sequence
  Description of Artificial Sequence: Synthetic coding sequence
atgctgctgcccctgctgctgagcagcctgctgggcggcagccaggcaatggacgggagattctggattcgtgttcaggaatctgtgatggtaccagaggggctgtgcatcagtgtcccctgtagcttttcatatcctagacaggattggaccggttctactccagcttacggctactggttcaaagcagtgactgagacaaccaaaggcgcgccggtcgcgactaatcatcagtctcgcgaggtggagatgtcaacacgcggtcgtttccagctcacgggcgatccggccaagggcaattgtagcctggtaattagggatgcacagatgcaggatgagtctcagtacttttttagggtggagaggggctcttatgtcaggtataactttatgaatgatgggttctttctgaaagtgacagtcttaagtttcacaccgagaccacaggaccacaacacggacttaacctgtcatgtggacttctcacgcaagggcgtctccgcacagaggactgtaagactgagagtggcatatgctcctagagacctggtcatctcgatctcacgcgataatacccccgctttggaaccacagccccagggcaacgtaccctatttggaagcccagaaggggcaatttctgcggttgctatgcgctgccgattcacaaccaccggccactctgtcgtgggtgctgcagaacagagtcctgagttcttctcacccctggggtcctagaccattggggctggaacttccaggcgtgaaggctggcgactctgggaggtacacttgtcgggcagaaaatcgcctgggtagtcagcagcgggcactggatctctctgtgcagtatccccctgagaatctgcgagttatggtctctcaggccaacagaaccgtactggagaatctcggcaatggcacctccctcccggtcctggagggccagtcgctgtgcttggtgtgtgtcacccactcttcccctccagctcgtctatcttggacccagagggggcaggtactttccccttcccaaccctccgaccctggggtcctggaactccctcgcgttcaggtcgaacacgagggcgaatttacatgccatgctaggcatcctctaggatcacaacacgtgtctttgtctctctcggtgcattacagccccaagctgctggggccgtcatgctcttgggaagcagaagggcttcattgttcatgctcgagccaagcctcgcctgccccgtctcttagatggtggctgggggaggagctgctggagggtaacagttctcaagattcatttgaagtaactccaagttctgctggcccttgggcgaatagctctctgtctctacatggaggcttatcttcaggacttcgcctgaggtgtgaagcctggaacgtccatggtgcccagagtggctcaatcctacagctccccgacaagaagggcctcatctctacagcctttagcaacggcgccttcctgggcatagggattacagcactcctcttcttatgcttggcactgattatcatgaagatattaccgaaaagaaggacccagacggagacccctcggcctaggttctcccggcatagtacaattctggactacattaatgtcgtgcctaccgccgggcccctggctcagaaacgcaatcagaaagcgaccccaaattcgccgcggaccccactgcccccaggcgctccgtcacccgagtctaagaagaatcagaagaagcaatatcagcttccatcctttcccgagcctaagtcatccacacaggcaccagaatctcaggagtcacaagaagagttacattacgccacgctgaactttccaggcgtccgaccacgacccgaggcaaggatgccaaagggcactcaggctgactatgccgaagtcaaatttcaatag

SEQ ID NO: 205087 - DNA, 1635 bp, Artificial Sequence
  Description of Artificial Sequence: Synthetic coding sequence
atgctgctgcccctgctgctgagcagcctgctgggcggcagccaggcgatggacggccgattttggataagggtccaggagtctgtcatggtgcctgaaggtctctgcatcagcgttccatgctcattttcttacccgcggcaggattggacagggagtactcccgcttatggctactggttcaaggctgtcaccgagaccaccaaaggggcgcctgtggctaccaaccatcaatccagagaggtggagatgagtaccagaggccgctttcaactgaccggcgatccagcgaaggggaattgctctttagtaatccgagatgcccagatgcaagatgagagtcagtatttctttcgtgtggaacgcggcagttacgtgagatataattttatgaatgatggattctttctgaaggtgaccgtcctcagtttcacacctcggccccaggatcataatacagacttgacttgccacgtggatttcagtagaaagggcgtgtcagctcagcggacagtcagactgagggtagcttatgcaccacgggacctagtgatctccatcagccgcgacaatacacctgcgttggagcctcagccccaaggcaacgtgccatatctggaagctcaaaaaggccagtttctgcgattgctctgtgctgcggattcccaacccccagccaccctctcatgggttctccagaatcgggtcctgagctcctcacacccatggggcccacgaccgttgggtctggagctgcccggagtgaaagcgggcgatagcggacggtacacctgcagagccgagaacaggttaggctctcagcagagggctcttgacctctctgtgcagtatcctccagaaaatctgagggtaatggtgagccaggccaatcggacggttctggagaatttgggcaacggaacctccctgccagtcctcgagggccagtccctgtgcctggtatgtgtgacccattcaagccctcccgctcgcctttcatggactcagcgtggccaggttctaagcccatcgcagccctcagatccaggtgtactggagctgcccagggtgcaggtggaacacgagggcgaattcacttgtcacgcaaggcaccccctgggctcccaacacgtgagtctcagcctgtcagttcactataagaaagggctgattagcactgctttctcaaatggagccttccttggtatcggcattaccgcattgctcttcttatgcctggccctgatcatcatgaagattctgccgaaaaggcggacacagaccgagacaccccgcccgcgctttagccgccattccaccatcctggactatatcaacgtagtccccaccgcagggcccttagcgcaaaaacggaatcagaaagccacacctaatagtccaaggacccctctgcctcctggagctccctccccggaatccaagaaaaatcagaagaagcaatatcaactgccaagctttccagaacccaaatcctcaactcaggcaccagaatctcaggaatcccaagaggaactacattacgccaccctcaattttcccggcgtgcgcccccgccctgaggcccgcatgcccaaggggacccaggctgattatgccgaggtgaaatttcagtag

SEQ ID NO: 205088 - DNA, 1365 bp, Artificial Sequence
  Description of Artificial Sequence: Synthetic coding sequence
atgctgctgcccctgctgctgagcagcctgctgggcggcagccaggcaatggacggcagattttggatccgcgtccaagagagtgtgatggtgcctgaaggattgtgtataagcgtcccgtgttcgttttcctaccccaggcaggattggaccgggtcaacacctgcttatgggtactggttcaaggcagtgactgagactacgaaaggagcgcccgtggccaccaatcaccaaagcagggaagtagagatgagcacaagaggtcgcttccaacttacaggagacccagcaaagggcaattgttctctggtcattcgagacgcacaaatgcaggacgaatcccagtattttttcagggtcgagaggggctcttacgtgcggtacaacttcatgaacgacgggttcttcctcaaggttacagttctctcctttacgccacggcctcaggaccataacacagatctgacttgccatgtggatttctcgaggaaaggtgtgtcagctcagcgtaccgtgcgccttcgagtggcgtacgccccccgggatctcgtcatctccatcagccgggacaatacccccgaccctcctgagaatctgagagtcatggtgagtcaggcgaaccggacagtcttggagaacctgggcaatggcacaagtctaccagttttagagggtcagagcttgtgtctggtctgcgttacccattccagtcccccagcccgtctgtcttggactcagcgtgggcaagttctgtctccttcccagcccagcgatcccggcgtgttggaacttcctagggtccaagtggaacacgagggtgagtttacatgtcatgcacggcaccccctgggctcacaacacgtcagtctctccttgtccgtgcattacaagaagggcttaatctctaccgcttttagtaatggcgctttccttgggataggaatcactgccctgttgttcctgtgtctggcccttatcatcatgaagattctccccaaaagaaggacacagactgaaactccacgccctaggttctctagacactctacaatcctggattacatcaatgtggtccccaccgccggcccactcgcgcaaaagagaaatcagaaggccacacccaatagcccaagaactccactgcccccgggcgccccctctccagagagcaagaagaaccagaaaaagcagtaccagctgccctcctttcccgaacctaaatcctcgacacaggcacccgaatcgcaggaaagtcaggaggaacttcactatgcaactttaaactttccgggtgtcaggccgcggcctgaggccaggatgcctaagggaacccaggccgattatgctgaggtaaaattccagtag

SEQ ID NO: 205089 - DNA, 1665 bp, Artificial Sequence
  Description of Artificial Sequence: Synthetic coding sequence
atgctgctgcccctgctgctgagcagcctgctgggcggcagccaggcaatggacggacgtttctggatccgggttcaagagtccgtgatggtgcctgaggggctttgtatttctgtaccatgttcattctcctatcccaggcaggactggacaggcagcacccccgcctatggatattggttcaaggccgtcacagagaccacgaaaggcgcacccgtcgccactaatcaccagtctagggaagtggagatgagtacccggggtaggtttcagctcactggggaccctgccaaagggaattgcagcttggtgatccgcgacgcccagatgcaggacgaatcacagtatttcttccgtgtagagagggggtcttacgtgcgctacaacttcatgaatgatggctttttcctgaaagtcactggcaccaaaccgaccacttcacacttctctgttctttcttttacaccaagacctcaggaccacaatacagacctaacctgtcatgtggatttctcccgtaagggggtgtccgcccaacggaccgtcaggctgcgagtcgcttatgcccctcgtgatttagtgatttcaatttcgagagataatacaccagcgctggagcctcaacctcagggcaacgtgccatacctagaggcccagaaaggccagttcctccgactgttgtgcgcagctgattctcagcccccagctaccctgtcctgggtattgcagaatcgcgtgctctcgagtagtcacccttggggacctaggccccttggcctggaactgccgggtgtcaaggcaggggattccggcaggtacacctgtcgtgccgaaaacaggttgggatcccagcaaagggccttagacctctcagtgcaataccctccagagaatctgcgggtaatggtttcccaagcgaatagaactgtgctggaaaatttggggaatgggacctcattaccagtcctggaaggtcaaagcctgtgtctggtttgtgtaacccacagctcaccccctgccagactgagctggacccaaaggggacaggtgctctcccctagccagcctagtgatccaggggtgctagaacttcctagggtgcaggttgagcatgagggcgaattcacttgccatgcacgtcatccactcggcagccagcatgtgagcttgtccctgagcgtccactacaagaaaggactgatatccaccgcatttagtaatggggcctttctgggcatcggtatcaccgctctgctcttcctgtgtctggctctaatcatcatgaaaatcctgccgaaacggcggactcagacggagaccccaagaccacgattcagtaggcactctaccattctggattacataaatgtggtgcccactgcagggccactcgcccagaagcgcaaccagaaagccacacccaactccccgcgaacccccctgcctccgggtgccccatcccccgaatctaagaagaatcaaaaaaaacaatatcagcttccatcctttccggagccgaagtctagtactcaagcccccgaatcacaggagtctcaggaggagctgcactatgcgacattaaactttcccggcgtgaggccaaggcctgaagcacgcatgcccaaggggacccaagcagattacgctgaggtcaagttccagtag

SEQ ID NO: 205090 - DNA, 2097 bp, Artificial Sequence
  Description of Artificial Sequence: Synthetic coding sequence
atggtgcccggccaggcccagccccagagccccgagatgctgctgctacctctcctcctcccggtgctaggtgcaggaagcctgaacaaggacccttcatactcacttcaagtccaacggcaggtcccggtaccggaaggcctttgtgtgatagtttcttgtaatctgagctacccccgcgatggatgggacgagagtacagctgcgtatggatactggttcaaggggcgcacatcccccaaaacaggggcccccgttgctacaaataatcagtctcgcgaggtggagatgtcaacacgggaccggtttcagcttacgggagacccaggaaagggaagttgcagtttggtgattcgcgatgcccagcgggaggacgaagcgtggtatttcttcagggtggagcggggttcaagggtcagacactcgtttttgagcaatgccttcttccttaaggtgactgcactcacaaagaaacctgatgtgtatatcccagagacactggagcctggccaaccggtcaccgtgatttgtgtgttcaactgggcttttaagaagtgtcccgcaccatcattcagttggaccggcgccgcactcagtccaaggagaacaagaccttctacttcccacttcagcgtcctgtccttcacaccctctccccaggatcatgatactgacctcacttgccacgtcgactttagcaggaagggggtgagcgcacagcgcacagtcaggctccgcgttgcatacgctccaaaggatctgattatttctatttcccacgataacacctccgcgttggaactccagggcaatgtgatctacctcgaagtgcaaaagggtcagttcctacggctgctgtgtgccgcagattcccaacctccggctacactatcctgggttctgcaggacagggttttatctagcagtcatccatggggtccacggactttgggcctcgagctccgcggtgtgagggcaggagatagcggtcgctacacttgccgggctgagaacaggctgggaagtcagcagcaagcgctggatttatccgttcagtacccccccgagaacctccgggttatggtatcacaagccaatcggaccgtgctggagaacttgggaaacggcacatctcttccggtcctggaaggacaaagcttacggctcgtttgcgtaacccactctagcccccctgctaggctcagctggacccgctgggggcagacagtcggtccgtcccagcctagtgatcctggagtgctggagcttcctccaatacaaatggagcacgagggggagtttacttgtcacgcgcagcatccgctggggagtcaacacgtctcactatcgctgtccgtgcattatccacctcagctgctcgggcccagttgcagctgggaagccgagggcctgcactgtagctgttcctcccaagctagccctgcccctagtttaaggtggtggttgggagaggagttgctggaaggaaattcatctcaggggtcctttgaagtcacgccgtctagcgccggaccctgggccaacagcagcttgagtcttcacggcggactgagttccggcctccggctcaggtgcaaggcctggaacgtgcatggcgctcagagcggatctgtgttccagctgctgccagggaagcttgagcacggtggaggcttgggactaggggccgctctcggagccggcgtggcagcactgttggccttttgttcatgcctggtggtcttcagggtcaagatttgcaggaaagaggcaagaaagcgtgctgcagccgagcaggacgtgccatccaccctgggacctatcagccagggacatcagcacgaatgctctgccgggagttcccaagatcaccccccacccggagcggctacctatacaccaggaaaaggcgaagaacaggaattgcactatgcaagcctctcattccagggacttagactctgggagcctgccgaccaagaggccccatctacaacggaatattctgaaatcaaaattcacacaggccaacccctcagggggccaggctttggactgcagctggaaagagagatgagcgggatggtgcctaagtag

SEQ ID NO: 205091 - DNA, 1809 bp, Artificial Sequence
  Description of Artificial Sequence: Synthetic coding sequence
atggtgcccggccaggcccagccccagagccccgagatgctgctgctgcccctgctgttgccagtgctgggcgccggaagcctcaacaaggacccatcatattccctccaggtacagcgccaagttccagtgccagaagggttgtgtgtgattgtcagctgtaacttaagttaccctagagatggttgggacgagtctactgccgcctacggatactggttcaaaggacgcacttcgccgaaaactggagcacctgtcgcaactaacaatcagagccgcgaggtcgagatgagtactagggacaggttccagctgaccggcgaccccggaaagggttcttgttcacttgtcatacgggacgcgcagcgggaagacgaagcttggtatttctttagggtcgagagggggagcagggtgagacatagctttctgagcaacgctttcttccttaaagtcacggcgctgacgaagaagccagacgtttacattccagagactctcgagcctggccagccagtgaccgtgatctgcgtgtttaactgggccttcaagaaatgccccgccccttccttttcatggacgggcgccgccttgagtcctcggcgtactcgtccttctacaagccatttcagtgtgttgagcttcactccttctcctcaggatcatgatacggatctgacatgccacgtcgacttctcccggaagggagtcagcgctcagcggaccgtcaggttgcgcgtggcttacgccccgaaggacctgataatttccatctcccacgataataccagcgcactggaactgcaaggaaatgtgatttacctggaagtgcagaaaggtcagtttctgcggcttctttgtgccgccgactcacagcccccagccactctgtcatgggtgctgcaagatagggtgcttagcagtagccacccatggggccccagaaccctgggcctggaattgcgaggcgtccgagcgggtgactccggcaggtatacgtgtagagccgagaatcggctggggtcgcagcagcaagcactagatctctctgtccaataccccccagagaatctgcgcgtgatggtgtcacaagccaaccggactgttctcgagaaccttggaaacggaacgtctcttcctgtgttggaaggccaatccctgcggttagtatgtgtgacacatagttcacctcccgctcgcctctcctggacaagatgggggcagacagtgggtccaagccagccatcagaccccggagtgctcgaacttccacccatccagatggaacatgaaggtgaattcacttgccacgcacagcacccattagggtctcagcatgtgtccctttctctgagtgtccactggaaactggagcatggaggaggcttgggcttaggcgccgctttgggtgcaggggtagctgcactgctggccttctgcagttgcttagtggtgtttcgcgtcaaaatttgtcgcaaggaggcgcgaaagcgggccgccgccgaacaggatgtacccagcactctcggacccatttcccaaggacaccagcatgaatgtagtgccggcagtagtcaagatcacccccctccgggcgctgcgacttacacaccaggcaaaggtgaggaacaggaactccattatgcctcattgagctttcagggactgagactgtgggagccggcagaccaggaagcgccttcgacgaccgagtacagcgagattaaaatccacaccgggcagcccctgagagggcccggctttggcctgcagctggagagagagatgtcggggatggtcccaaaatag

SEQ ID NO: 205092 - DNA, 1809 bp, Artificial Sequence
  Description of Artificial Sequence: Synthetic coding sequence
atggtgcccggccaggcccagccccagagccccgagatgctgctgttgcctctactactgcccgtgctcggagcaggctctctgaacaaagatccaagttattctctccaggtacagcgtcaggtgcctgtacccgaagggctgtgtgttattgtctcctgcaacctctcctacccacgtgatggctgggacgagagcaccgccgcctatggctactggtttaaaggccggacctcacctaagaccggcgctcctgtggccaccaataaccagtccagggaggttgagatgtcgactcgggacaggtttcaactgaccggcgacccagggaagggctcttgtagtctggtgatccgtgacgcccagagggaggacgaggcatggtatttcttcagggtagaacgaggctcacgagtcagacactcttttctatccaacgctttctttttaaaggtgacagctttaaccaagaaaccagatgtgtacatcccagaaacactggagcctgggcaacctgtcaccgtgatatgcgtctttaactgggctttcaagaaatgccctgccccatctttttcctggaccggtgccgcgttaagtccacggagaacccgcccaagtacctctcacttctctgttctgagttttactcccagtccccaggaccatgatacagacctgacctgccacgtggacttttcccgcaaaggcgtaagcgcgcagcgcacagtgagactgagagtcgcatatgctcccaaggacctgatcattagcattagccacgacaacacatcagccttggaactccagggcaatgttatctatcttgaggttcagaagggccagttccttaggctcctctgcgctgctgactcccagcctcccgccacgctgtcctgggtgctccaggatagagtgctttcatcaagccacccatggggaccccgtacattgggactggaactgaggggcgtgcgcgctggggattcagggagatacacatgcagagccgaaaatcgattaggatcccaacaacaggcactcgacctatccgttcagtatccgccagaaaacctgcgtgtcatggtctcacaagccaatcggactgtcctggaaaatctggggaacggcaccagcctcccagtcctggagggacagagcctccgactcgtgtgcgtgacacattcctctccaccggcccggctgagttggaccaggtggggccagacagtggggcccagccagccctctgaccccggagttctggaactgcctccgatacagatggagcacgagggcgagttcacctgccacgcacaacaccccctgggatcccaacacgtcagtctgtcactgagcgtgcactggaagctggaacacggaggaggcctgggcctgggggccgccttgggggcaggcgtcgcagccctattagccttttgtagctgcctcgtagtctttcgagtcaagatctgcaggaaagaagcccgtaagcgtgcggcagcggaacaggacgtgccatctaccctgggtccaatctcacaaggacaccagcacgaatgttcagcaggctcatcccaggaccacccaccacccggcgctgccacttacacccccggcaagggggaagagcaggaacttcactacgccagtttgagctttcagggcctgcggctctgggagccagctgatcaggaggcccccagcactaccgagtattctgaaatcaagatccatacaggacagcccctgagaggccctggtttcgggctacagcttgagcgcgaaatgtctgggatggtccccaaatag

SEQ ID NO: 205093 - DNA, 1788 bp, Artificial Sequence
  Description of Artificial Sequence: Synthetic coding sequence
atgctgctgctgctgctgctgctgccccccctgctgtgcggccgggtcggtgctaaggaacagaaagactacctcttgacaatgcagaaatctgtgactgtacaagaggggttgtgcgtcagcgtattgtgtagcttttcatacccccaaaacggatggactgccagcgatccagtgcacgggtactggttccgtgcaggcgatcatgtttccagaaatatcccagtagccacaaataatcccgccagagccgttcaggaggaaacccgggatagatttcacctgttgggcgacccccagaacaaggactgcacactgtcaatcagggacacacgtgaatcagacgccggcacatacgtgttttgcgtggagcgcggtaatatgaaatggaattataagtacgatcagctgtctgtcaatgtgaccgcgtctcaagatctgttaagccggtataggctggaagtgcccgaatccgtcaccgtccaggagggactatgcgtctctgtgccttgttcagtcctgtatccgcactataactggaccgccagtagtcccgtgtacggaagttggttcaaggagggcgccgacattccttgggatataccagtcgcaactaatacaccaagcggaaaagtccaggaagacactcacgggcggtttctgctgcttggggacccccagaccaacaactgcagtttgtctatccgggatgctagaaagggggatagcggcaaatactattttcaggtggagcgtggcagccggaagtggaactacatatacgacaagctctcagtgcatgtgaccgcactgactcacatgcctacattcagcatacccgggacactggagtcaggacaccctagaaatctgacgtgcagcgtcccttgggcctgtgagcaggggacccctcccaccattacctggatgggcgcttcagtttctagtttagaccccaccatcaccaggagcagtatgctgtctctgattccacaacctcaggaccatggcacaagtctcacttgccaggtgacactaccgggcgctggcgtaacgatgactcgggctgtgagactgaacatctcttaccctccccagaacctgacgatgaccgttttccagggggacggcactgcaagtaccacacttcggaacggtagtgcgctgagcgtgctagagggccagtccctccatctcgtttgtgcggtggacagcaaccctccagcgagactctcctggacctgggggtctctgaccctgagcccaagccagagctctaatctcggggtcctggagctcccccgtgtccatgttaaagacgaaggggaattcacatgcagagctcagaacccgttggggtcacagcacattagcttgtccctgtcactgcagaacgagtataccggcaaaatgagacccatttccggggtgaccttgggtgcattcgggggagccggggcgaccgcattggtgtttttatacttctgcatcattttcgttgttgtgagatcttgtcgcaagaaatctgctcgacccgcagttggggtcggcgatactggcatggaggacgctaatgccgtccgcggcagcgcaagccaaggcccgttaatagaatcgcccgcggatgactcacccccacatcatgccccgcccgccctcgccactccaagccctgaggaaggtgaaatccagtacgcttctctgtcatttcataaggccagaccccaatatccacaggagcaggaggcgatcggctacgagtatagcgagattaacattcctaagtag

SEQ ID NO: 205094 - DNA, 1290 bp, Artificial Sequence
  Description of Artificial Sequence: Synthetic coding sequence
atgcccctgtgccggcccgagcacctgatgccccgggccagccgggtccccgtcgctgcaagcctaccactctcccacgccgtcatcccgacccaactgcccagccgacctggtcaccgcccacccggtagaccaagacgttgcccgaaggcctcttgcctgcccccgcctgtggggccctcctccactcagacagctaagcgcgttactatgggatggcccagaccaggaagagcattggtggcagtgaaggcactcctggtgctctctctgctgcaggtgccagcgcaggcggtggtcagagcggtactggaggataatagctccagcgtggactttgcagacctacccgccctgtttggagtgcctttggcaccggaggggatccgaggttaccttatggaggtcaaacctgcgaacgcttgtcatccaatagaagcccccagattaggaaatcgaagcctcggagccatcgtcctgatccgccgatacgactgtacttttgacctgaaagtactgaacgcacagagggctggctttgaagctgcaattgtgcacaatgtacactctgatgatcttgtctcaatgactcatgtgtacgaggatcttagagggcaaatagcaatcccatccgtctttgtttcagaagccgcatcacaggaccttcgggttatcctgggatgcaataagagtgcacacgctctgctgctgccggacgaccctccttgtcatgatctgggctgtcatcctgttctgacagtctcatgggtgctcggatgtacacttgctttggttgtaagcgccttctttgtgctgaatcacctgtggctgtgggcacaggcatgctgttctcaccgaagacccgtcaaaaccagcacttgtcagaaagcccaggtgagaactttcacatggcacaatgatctgtgtgctatttgcctggatgaatacgaggagggagatcagcttaagatcctgccctgttctcacacttaccactgtaaatgtatagacccatggttttctcaggcccctcggagaagttgccccgtgtgcaagcagagtgtggctgcaacagaggacagtttcgactccactacgtactcctttcgtgacgaggatccaagcttgcctggccataggcctccgatttgggcaatacaagtacagctaaggtccaggcgtcttgaactgttagggcgggcgagcccccattgtcactgctcaaccacctctctcgaggctgagtacaccacggtcagctcagctccccctgaggctcctgggcagtag

SEQ ID NO: 205095 - DNA, 1656 bp, Artificial Sequence
  Description of Artificial Sequence: Synthetic coding sequence
atgctgcccctgctgctgctgcccctgctgtggggcggcagcctgcaggaaaaaccagtgtacgagctgcaggtgcaaaaaagtgttaccgtacaggagggcttatgtgttcttgtgccgtgttccttctcttacccatggcggagttggtactcatcccctcctctgtatgtctattggttccgcgatggggagattccatactatgcagaagtcgtcgccacaaacaacccggacaggagggtgaaaccagagactcaggggcgattcagactactcggcgacgtgcaaaaaaagaattgtagtttatcaattggcgacgccaggatggaagacactgggtcttactttttcagagtggagcgaggaagagacgtcaagtactcctatcagcagaataagctgaacctggaggtaacagctctgattgaaaagcccgatattcatttcctcgaacctctcgagagcggaaggcccacacggttaagttgtagcctccccggttcttgtgaagccgggccgccattgaccttttcttggaccggcaatgctctcagccctctcgacccggagactactcgaagtagtgaattaactctaacaccacggcccgaggaccacggaaccaatctgacttgtcagatgaaaaggcagggagctcaggttaccaccgagcgtaccgttcaacttaacgtatcctatgccccacagaccataactatatttcggaatggtatagcgcttgagattctccagaacactagctacttgcccgttctcgagggccaagctttaagactgctctgtgatgcgccatccaatcctccagcccacctgtcatggttccaaggttcacccgcccttaatgcaacccctatctctaacaccgggattctcgaactgcggcgagtacgttccgctgaggagggtggctttacctgtcgcgcacagcatcccctagggtttctgcagatctttctgaacctgagcgtgtacagcctgccacagttgcttggaccaagctgtagttgggaagctgaggggttacattgcagatgttcctttagggcccgcccggcaccatcactgtgttggaggctagaggaaaagccactagagggcaatagctcgcaggggtcttttaaggtgaattccagcagcgccggaccatgggcgaactcgagtctcattctgcatggaggtctgtcaagcgacctaaaagtgagttgtaaggcttggaacatctacgggtcacagtcgggttcagtcctgctgctgcaggggcgctcaaatttaggtactggggtggtgccagccgctctcggcggtgctggcgtgatggccttgctgtgcatttgtctatgtctgattttcttccttatcgttaaggctagacgaaagcaggcggcaggcaggccggaaaagatggatgatgaagatcctatcatgggtaccatcactagcggtagccggaagaagccctggcccgattcacccggcgaccaggcttctccacctggcgatgcgccaccgctggaggagcaaaaggaactgcactacgcaagtctctctttttctgagatgaaaagtcgggaacccaaggatcaagaggcccccagtacaactgaatattctgaaatcaaaactagcaaatag

SEQ ID NO: 205096 - DNA, 1062 bp, Artificial Sequence
  Description of Artificial Sequence: Synthetic coding sequence
atgcagggcgcccaggaggccagcgccagcgagatgctgcccctgttgctcccactgctctgggccggcgctttggctcaggagagacggttccaactggaaggccctgaatctctcaccgtgcaagaaggcctgtgcgtgttggtgccctgcaggcttccaactacgttacctgcaagctattacgggtatgggtactggttcctggagggcgctgatgtgccggtcgcaactaatgatcctgatgaggaggttcaggaggaaactagaggaagatttcacttgttgtgggacccacgacgtaagaactgtagtctctcgattcgtgacgctcggcggcgtgataatgctgcatacttttttcggctaaagagcaaatggatgaaatatggctacacaagtagtaagctatctgtcagggttatggccctcacccaccggcctaacattagtattccaggcacacttgagagcggacatccctccaatctcacctgctcagttccttgggtgtgcgagcaagggacgccccctatatttagctggatgagcgctgccccgacctccctagggcctcgcacaactcagtctagtgtcctgacgattactccacgcccccaggaccattctaccaacctcacttgtcaggtcacatttcctggagctggagtaacaatggagcggacaatccagcttaacgtttcttatgcccctcagaaggtcgcgatttcgatctttcaggggaattccgccgcttttaaaattcttcagaatacctcgagcctgcctgtcctggaaggccaggccctaagactgttatgtgatgcggacgggaatccgccagcacacctctcttggttccagggattcccagcattgaacgccactccaattagcaacacaggggtgctcgagttgccccaggtgggcagtgccgaggagggcgattttacgtgccgcgcccaacaccccctgggcagtctgcagatttcactgagtctgttcgtccattggagtagcgctcctgttcccgaccgacactctttccggccaccctgctag

SEQ ID NO: 205097 - DNA, 1281 bp, Artificial Sequence
  Description of Artificial Sequence: Synthetic coding sequence
atgctgcccctgctgctgcccctgctgtgggccggcgccctggcccaagaaaggaggtttcagctggaggggccggagagcttgacagtccaagagggactgtgcgtgttggtgccatgtcgcctacctaccaccttaccggcctcgtactatggatacggatactggtttctggagggcgcagatgtgcctgtggctacaaatgatccagatgaggaggttcaggaagagacacgtggaaggttccacctgctctgggatccacgcaggaagaattgctccttatcaattcgggacgctagacggagagataacgcagcatattttttcagattaaaaagcaagtggatgaagtacggatacacttcttctaagctatccgtaagggtcatggctctgacacatcgacctaatatatcgattccggggaccctagagagtggccacccttcaaacttaacgtgttctgtgccttgggtgtgtgaacagggaaccccacctatcttcagttggatgtccgccgcccccacctcgctgggacccaggacaacacagtcatctgtgctgactataactcctaggccacaagatcacagcaccaatctaacctgccaggtcacttttcctggggctggggtgactatggaaagaacaattcagctgaatgtatcctcgtttaaaatccttcagaacacgtcaagcctgcccgtcctggagggtcaggcacttcgtctcctctgcgatgctgatggaaatcccccagctcatctgagctggtttcaggggttccccgcccttaatgccacccccatctccaacactggcgtgctagagctgccacaggtcggtagtgccgaggagggggatttcacttgtagagcacagcaccctttagggtctctgcaaatctctctctcattatttgttcactggaaacccgaaggccgggctggcggggtccttggggccgtctggggcgcctctatcaccaccctggtgtttctgtgcgtgtgctttatttttagagtcaaaacaaggcgtaagaaagcggctcagcctgtacagaacactgatgatgtaaatccagtcatggtttccggtagtcgaggacatcaacatcaatttcagaccggcatcgtttcagaccacccagctgaggccggccctatctctgaagatgaacaggaattacactacgccgttctgcacttccataaggtacagccgcaggaacctaaggtcactgataccgagtacagtgaaatcaaaatccacaagtag

SEQ ID NO: 205098 - DNA, 1314 bp, Artificial Sequence
  Description of Artificial Sequence: Synthetic coding sequence
atgcagggcgcccaggaggccagcgccagcgagatgctgcccctgcttctaccacttctgtgggcgggcgcattggcccaggagcgcagattccagctagagggccctgaaagcttgactgtgcaggaggggctctgcgtgctcgttccatgtagattgcctacaacactcccagcgagctactacggctatgggtattggttcttggagggggccgacgtgcctgtggcaacaaatgatccagacgaggaggtgcaggaagaaacacgggggcgatttcacctgctttgggacccccgaaggaagaattgcagcctgtccattcgtgacgcaagacgacgtgacaacgccgcttattttttcagactgaagtcgaagtggatgaaatatgggtacacctcctcaaagttgagtgtcagggtcatggctctgacccatagaccaaatatatccattcccggtaccctggagagtgggcacccttccaacctcacatgcagtgttccgtgggtgtgcgaacagggaacccctcccattttttcatggatgtccgccgctcccacctccctaggcccccggaccactcagtcttctgtgctgactatcacaccgcgcccccaggaccactccactaacctgacctgtcaagtaacatttcctggtgcaggagtgacaatggagaggaccatccagcttaacgtgagtagctttaaaattcttcagaacacgagctctctgccagttcttgagggccaggcactgcgcctgctctgtgacgctgatggtaacccgcctgcccatttgagttggtttcagggcttcccagcgctgaacgctacacccatttcgaacactggggttttagagttaccccaggtcgggagtgccgaggaaggtgacttcacatgtcgcgcgcagcacccactgggatctttacagatatctctgtcgctgtttgtgcattggaagccagagggcagggcaggaggcgtgttgggcgcagtgtggggggccagcatcaccaccctggtgttcttatgcgtgtgcttcatcttcagagtgaaaacccgcaggaagaaggcggcacagcccgttcagaatacggatgatgtgaaccctgttatggtgagcggctcacgcgggcaccaacaccagttccagaccggcattgtgagcgatcaccccgccgaagccggacctatatccgaggacgaacaagagcttcattacgcagtcctgcacttccacaaggtgcagcctcaagagcctaaagtgactgatacagagtacagcgaaatcaagattcacaaatag

SEQ ID NO: 205099 - DNA, 1362 bp, Artificial Sequence
  Description of Artificial Sequence: Synthetic coding sequence
atgcagggcgcccaggaggccagcgccagcgagatgctgcccctgctcctcccactcctctgggccggtgcgctggcacaggaaaggcgtttccagctagaggggccagaatctctgaccgtccaagagggcctctgcgtgttggtcccctgccgtctgcctacgactcttccagcgtcgtactatggctacgggtactggtttcttgaaggcgccgacgtcccagtcgccaccaacgaccccgacgaggaggtgcaggaagaaaccagggggcgatttcaccttctgtgggacccacgcagaaagaactgttcgctgtcaatccgagacgctagacggagggataacgccgcctacttcttccggctcaaatcaaaatggatgaaatatggttatacttcttcaaagctgtccgttagagtgatggctctgacacacagacctaatatatcaatacccgggacgctggaatcagggcacccatcaaatttgacgtgcagtgtgccctgggtgtgcgaacagggaactccgccaatctttagctggatgagtgcggccccaacgtcattgggcccccgcaccacccagtcctccgtgctgacaataacacctagacctcaggatcattccactaacttgacatgccaggtgacatttccgggggcaggcgtgactatggaaaggacaatccagttgaatgtctcctacgcgccccaaaaggtcgccatctcgatattccagggaaactccgctgcctttaagatcctgcaaaatacaagctccctgcccgtcctagagggtcaggcccttcggctcctatgtgacgcagacggaaacccacctgcacacctgtcgtggtttcagggattcccagcactgaatgccacccccatctccaacactggagttcttgagctcccccaggtagggtccgcagaagaaggggattttacctgtcgcgcccagcatccactcggatccctgcagatcagcctgagcctgttcgtacattggaagcccgagggcagggccggcggagtcctgggcgccgtgtggggggcctcaatcacaacgttagtctttctgtgtgtctgtttcatttttcgggtgaaaacgagacgcaaaaaagcagctcaaccagtgcagaacaccgacgacgtcaatcccgtgatggtgagtggaagcaggggacaccagcatcagttccagacgggcattgtcagcgaccaccctgcagaagcaggcccgatctcggaagatgaacaagaactgcactacgctgtgttgcacttccataaagttcaacctcaggaacctaaagtcactgatacggagtactccgaaatcaagatccataagtag

SEQ ID NO: 205100 - DNA, 1170 bp, Artificial Sequence
  Description of Artificial Sequence: Synthetic coding sequence
atgcagggcgcccaggaggccagcgccagcgagatgctgcccctgctgttgcccctgctttgggccggcgccttagcccaggagcgaaggttccagttagaaggcccggagtcactgacggttcaggaagggctctgcgttctcgtcccatgtaggctgcccaccacattgccagctagttattatggttacgggtattggttcctcgagggagctgatgttcccgtggccaccaacgatcctgatgaagaagtacaggaagaaaccagaggacggttccacctgctgtgggacccaaggcggaaaaattgcagccttagcatcagagacgcgcggcggcgtgataacgcggcctattttttccgtctcaaatcaaaatggatgaaatatggctataccagctcaaagctgagcgttagggtcatggcactcacccatagaccaaatattagcatacctggtaccctagagagcggccatccctcaaacttgacatgttccgtcccttgggtgtgtgagcaaggaacaccaccgatttttagctggatgtcagctgccccgacctccctcggaccacggacgacgcagagtagtgtgctgaccatcacccctaggcctcaggatcactccaccaacttgacgtgtcaagtcacattccccggcgccggtgtcacgatggagagaacgatccagttgaatgtgtcatggatgctccgcagaccacccttgtccacccctgacgcaccgcagaaggtagctatttctatttttcaaggtaactccgccgcgtttaaaatattgcaaaacacgagcagcctccccgtactagaaggtcaagctctgcgcctgctgtgcgacgcggatggaaatcctccggcgcacctctcatggttccaagggtttcccgcattgaatgccacacctatttctaacaccggggtgctcgagctccctcaggtaggaagtgctgaggagggcgattttacctgtcgggctcagcacccacttggatctctgcaaatttctttgtccctgttcgttcattggaaacctgagggaagggccgggggggtattaggagccgtgtggggggccagtatcacgacacttgtctttttatgcgtgtgcttcattttccgcgtcatttcaacttctagccgccaggcttag

SEQ ID NO: 205101 - DNA, 1206 bp, Artificial Sequence
  Description of Artificial Sequence: Synthetic coding sequence
atgcagggcgcccaggaggccagcgccagcgagatgctgcccctgctcctgcccctgctatgggctgcctcatattatggatatggttactggttcctggaaggcgccgatgtgcctgtggctacaaatgatcctgatgaagaggtccaggaggagacccggggtcgcttccaccttctctgggaccccaggcgcaaaaactgttctctgtctatcagagacgctcggcgcagggacaacgcagcttactttttcagactaaagtctaagtggatgaagtacggctacacctcctctaaactgtcagttcgggtgatggccctgactcatcgtccaaacatttctatcccaggcaccctggagtcaggccatcctagtaacttgacctgtagcgttccttgggtttgcgagcaggggacacctccaatctttagctggatgagtgccgcccctacttctctggggccacgcaccacacaatcttctgtgctgacaattaccccacggcctcaagatcattccacgaacctgacgtgtcaggtgactttcccaggggcaggtgtcacaatggagcgcacaatacagctgaacgtgtcgtcctttaagatcctgcaaaatacgagctctttgcccgtcctggagggacaggcactgaggctgttgtgcgacgccgatggcaatccccccgcccacctgtcatggttccagggtttccctgctctgaacgcaacacccattagcaataccggcgtgctggaattgcctcaggtaggctcggccgaggagggtgacttcacctgcagagcacagcaccccctcggcagtctgcagatttcactttccttattcgtgcactggaagcccgagggccgcgcaggcggagtgctgggtgcagtctggggggccagtatcaccactctggtttttctgtgcgtctgttttatattcagggtgaaaacgcgacggaaaaaagccgcgcagcccgtgcaaaacaccgacgacgtcaacccagtgatggtctccggtagtaggggtcaccagcaccaattccagaccggcattgtatctgaccaccctgcagaggctggtcccatctcagaggatgagcaggagctacattacgcagtgctgcattttcataaggtgcagccacaggagcctaaagtgacagatacagagtattccgagattaagatccacaagtag

SEQ ID NO: 205102 - DNA, 1125 bp, Artificial Sequence
  Description of Artificial Sequence: Synthetic coding sequence
atgctgctgctgctgctgctgcccctgctgtggggccgggagcgggtggagggtcagaagtctaaccgcaaggactacagcctaacgatgcagagttcagtgacagtgcaggaaggtatgtgcgtgcatgtcagatgttctttttcctaccccgtggactcacagacagacagcgacccagtacacgggtattggtttcgcgctgggaacgacatatcctggaaagcccccgttgctacgaataacccggcttgggccgtgcaggaggaaacacgggaccgcttccatctgctgggtgacccacagaccaagaattgcaccctgtccatcagagatgcgcgcatgtccgatgctgggcgctatttcttccgtatggagaaaggtaatattaaatggaattacaaatatgatcagttgtcagtaaacgtgactgacccaccgcagaacctgaccgttaccgtcttccaaggtgagggaacagcatccaccgcactaggtaacagctcttctctgtccgtcctcgaagggcagtctctacgactggtttgcgcagtcgactccaaccctcctgcccgcttatcttggacgtggcgaagcctgacgctgtatccttcgcagcccagcaaccccctggttctggagctccaggtccacctcggcgatgagggcgaatttacttgtcgggcccagaactctctgggctcccaacacgtatctctgaatcttagtctccaacaggagtatactggcaagatgaggccagtttcaggagtcctcctcggcgccgtgggcggggccggcgcaactgctcttgtctttctgagcttctgtgtaatctttatcgtggtacgatcctgtcggaaaaaaagcgctcggcctgctgcagatgttggcgacataggcatgaaggatgctaacacaatcaggggatcagcgagccagggtaatctaaccgagagctgggcagacgataatccaaggcatcacggcctggccgcccatagttccggggaggaacgcgagatccagtacgcccccctgtcattccacaagggtgagccacaggatctatcaggtcaggaagccaccaataatgaatacagtgaaattaagattcctaagtag

SEQ ID NO: 205103 - DNA, 1404 bp, Artificial Sequence
  Description of Artificial Sequence: Synthetic coding sequence
atgctgctgctgctgctgctgcccctgctgtggggccgggagcgggtggaaggacagaagtccaatcgcaaggattatagtctgaccatgcagtcctctgtaacggtgcaggaggggatgtgcgtgcacgtccgctgttcattctcataccccgtggatagtcagacggacagcgatcccgtacatggctactggttcagagccggaaatgatatcagctggaaagcccctgtagccacaaataatcccgcatgggccgtgcaggaagaaactagggatagatttcatctcttaggagaccctcagacgaaaaattgcacattgtccatccgcgatgccaggatgtccgacgccggccgctatttttttagaatggaaaaaggcaacatcaaatggaactataaatacgaccagcttagcgtcaacgtcactgcgttgacccaccggccaaacatactgattcctggaactctagaaagtggatgttttcagaatctgacgtgcagtgtgccgtgggcatgtgagcagggaacacctcctatgatttcatggatgggaacaagcgtcagcccactgcacccctctacaacaaggagcagtgttctgacactcatccctcagccacagcaccacggtacaagcttgacatgtcaggttacactcccgggtgcaggtgtcaccacgaacaggacaatccagctcaacgtgagttacccaccacaaaacctgactgttacagtttttcagggagaaggtacagcaagtacagccctcggtaatagctcctcgctgtctgtcctggaggggcagtccctgaggctggtgtgcgctgtggacagtaacccaccagctcggttgtcttggacatggaggagcctgacactataccccagccagcctagtaatcctttagtcctggagctgcaagtgcacctaggtgatgagggtgagtttacctgccgtgcgcagaatagcctggggtcccagcacgttagtttgaacctgtctctccagcaggaatacaccggaaagatgaggccagtctccggtgttttactgggagctgttgggggcgcgggagctaccgcactggtctttctgagcttttgtgtgattttcatcgtagttagatcatgccggaagaaaagtgcgcgtcccgcagccgatgtgggcgatatcggcatgaaggacgcgaatactatccggggatctgcctcgcagggaaatcttacagagtcttgggcggacgacaatccccgccatcatgggctcgccgcccactcttctggtgaggagagggaaattcagtacgcacctctcagttttcataagggtgagccccaggacctgtccggccaggaagctaccaacaacgaatattccgaaataaagatcccgaaatag

SEQ ID NO: 205104 - DNA, 438 bp, Artificial Sequence
  Description of Artificial Sequence: Synthetic coding sequence
atgctgctgctgctgctgctgcccctgctgtggggccgggagcgggttgaaggacagaagtccaacaggaaggactactccctgaccatgcagtcatctgtaactgtgcaggagggcatgtgtgtgcacgtgaggtgttccttctcgtatcctgtggacagtcagaccgactctgaccccgttcatgggtactggttccgcgcagggaacgatatctcttggaaagcccccgtcgctactaacaaccctgcctgggctgtccaggaagaaacccgggaccgcttccaccttctcggggacccccagacgaaaaattgcaccctgagcatacgcgatgctcgaatgtccgacgctggcaggtactttttcagaatggagaaagggaacatcaagtggaactataagtacgaccagttgtccgtgaacgttacagagtag

SEQ ID NO: 205105 - DNA, 1500 bp, Artificial Sequence
  Description of Artificial Sequence: Synthetic coding sequence
atgctgctgctgctgctgctgctgcccctgctgtggggcaccaaggggatggagggcgatcggcagtacggtgatgggtatctcctacaggtgcaggaactggtgactgtgcaagaaggcctgtgtgtgcatgtgccatgctcattttcatatcctcaggacggctggaccgatagcgatcctgtacacggctattggttcagggcgggtgatcgaccctatcaggacgcgccggtggctacaaataatccagacagagaggtgcaggcggaaacacagggacggttccaattgcttggggacatttggtccaatgactgcagcctgtccataagagatgcccgcaagcgcgataagggttcttacttctttcgcctggaaagggggagcatgaaatggagctacaagtcccagctcaactataaaaccaaacaactgagtgtgttcgtgacggcattgacccaccgacccgacattttgatcctcgggaccctggaatccggtcacagccgcaatctgacatgctcagttccttgggcatgtaagcagggaaccccacccatgatttcctggataggagcctcagtcagctctcccggccctactaccgcccgcagcagcgtgctgaccctcacaccaaagccacaagaccacggtacctccctcacgtgtcaggttaccctgcctggcaccggcgttacaacaacatctactgtcaggttggatgtgtcataccctccctggaatctcacaatgaccgtgtttcaaggcgatgctactgccagcactgccctgggcaatgggtctagtctgtccgttctggaaggccaatcattgcgtcttgtatgcgcggtaaacagcaatccccccgccaggctcagttggacacgcggctctctgaccctttgtccaagtagaagtagcaatcccgggctgttggaattgccgagggtacacgtgcgtgatgagggagagttcacttgtcgggcacaaaatgcccaaggatcacagcacatctccctgagcttgtctctgcagaatgaggggactggcacttcaaggcctgtgtcccaggtgaccctcgccgctgtgggcggggccggcgcaactgctttggcatttctcagcttttgtattatcttcataatcgttcgctcctgccggaagaagtctgccaggcccgccgctggcgttggcgacacaggcatggaagacgcgaaggccatccgaggaagcgcatcgcaggggcccctcacagagtcctggaaagacggaaacccactaaagaagccacctcctgcagtggcgcccagcagcggcgaggagggcgagctgcactatgctaccctctctttccacaaagttaaaccccaggatccccaggggcaggaggctaccgactctgaatattctgaaatcaaaatccacaaacgtgaaaccgctgaaacccaggcgtgtctgaggaaccacaatccaagcagcaaggaggtcagaggctag

SEQ ID NO: 205106 - DNA, 1221 bp, Artificial Sequence
  Description of Artificial Sequence: Synthetic coding sequence
atgctgctgctgctgctgctgctgcccctgctgtggggcaccaagggtatggagggagacaggcaatatggcgacgggtacctgcttcaggtccaggagttagtaactgttcaagaaggcctttgtgtgcatgtgccctgcagcttctcctacccacaagacggctggactgactcagatcctgtgcacggatattggtttagggcgggtgacagaccctatcaggatgcaccagtggccacaaacaaccccgatagagaggttcaggccgagacccagggaaggttccagctccttggggatatctggtccaacgattgtagtctgagcatcagagatgcccggaagcgagataaaggtagttacttcttccgtctcgagcgaggatctatgaagtggtcctataagtcacagctgaattataaaaccaaacaacttagcgtgtttgtgaccgatcccccgtggaatctgacaatgactgtttttcagggcgatgctaccgcctctaccgccttgggcaatgggtctagtctgtctgttctggagggccagagtttgcggctagtctgcgctgtcaatagtaatccgccagcacgtttgagctggacaaggggtagtttgacactgtgtccttccagaagctctaaccccgggctcttggagttgccacgcgtgcatgtgagagacgagggggaattcacatgtagagcccagaacgcgcagggctctcagcatatctccctcagtctgagcctgcagaacgagggcacaggcacctcgcgcccagtgtcacaggtgaccctcgccgccgtgggaggggccggcgccaccgctcttgcctttctctctttttgtattatattcatcattgtgcgttcatgccgaaagaagtccgcaagacctgccgccggggtaggtgatacagggatggaggacgccaaggcaattcgaggatcagcatcgcagggccccctgaccgaaagctggaaagacggcaatcctctcaagaaaccacctccggctgtcgctccgtcttccggcgaggaaggggagctgcactatgccacacttagttttcacaaggtgaaaccacaagacccccagggtcaagaggccaccgactcggaatatagcgaaatcaaaattcacaaaagagagacagctgagacacaggcctgtttacggaatcacaacccgtcctcaaaggaggttaggggctag

SEQ ID NO: 205107 - DNA, 1173 bp, Artificial Sequence
  Description of Artificial Sequence: Synthetic coding sequence
atgctgctgctgctgctgctgctgcccctgctgtggggcaccaagggcatggaaggcgatcgccagtatggggacgggtacctgctccaggtgcaagagctggtcactgtccaggagggcctttgcgtacatgtcccctgttcatttagctacccccaggatggatggacagactccgaccctgtccacggctattggttccgcgctggcgatcgcccatatcaagacgcaccggtagccacgaacaacccggaccgcgaggtgcaggccgaaacacaaggccgattccaactcctcggcgacatttggtccaatgactgttcgctgtccattcgggatgctcgtaagagagataagggctcatattttttccgacttgagcgcgggagtatgaaatggagctacaaatcccaattgaattacaagactaaacagctcagcgtcttcgtgacagctagcacagccctgggcaacggttctagcctttccgtgcttgaaggtcagagtttgcgactggtatgcgcagttaattctaatcctcctgcgagactgtcatggaccaggggctctctcactctttgtccttctagaagcagcaatccgggcctgctggaactccctcgggtacatgtgagggacgagggagaattcacctgtcgggcacagaatgctcagggcagccaacacatctcccttagtctgagcctgcagaacgaggggactggcacatcccggcccgtctctcaggtcactctggctgcggtgggtggggctggagcaaccgcattggccttcctgtccttttgcatcattttcattatagtgcgaagttgtagaaagaagagtgctcgccccgccgccggagttggggacaccggcatggaggacgctaaggctattcggggctcagcctcccagggcccccttaccgaatcatggaaggacgggaatcctctgaagaaaccgcccccagctgtggcaccatcctccggagaggagggggaactccactacgctacccttagctttcacaaggttaaaccccaggatccccaaggccaggaggccacggattccgaatattcagaaatcaaaatccataaacgagaaaccgcggagacacaagcctgcctgagaaaccataatccctcatcgaaagaggtgaggggctag

SEQ ID NO: 205108 - DNA, 1392 bp, Artificial Sequence
  Description of Artificial Sequence: Synthetic coding sequence
atgctgctgctgctgctgcccctgctgtggggccgggagcgggccgaaggtcagactagcaagctgctgacaatgcaaagcagcgtgacagttcaagaaggcctttgcgtgcacgtgccttgtagcttctcctaccccagccacgggtggatttatccgggccctgtggtgcacgggtactggtttcgagagggagccaatactgatcaggatgcaccggtggcaaccaacaatcctgctcgtgctgtttgggaggaaactagagaccggttccacctgctgggagacccccacactaagaactgcaccctttccatccgggatgctaggagaagcgacgcaggccgctatttttttagaatggagaagggctcgattaagtggaactataaacaccataggctctccgttaatgtcacagctctcactcacaggcctaatatcctgatccccgggacacttgagagcggttgtcctcagaatttaacgtgctctgtaccctgggcctgcgagcagggcacaccacctatgatttcttggatcggaacatcagtttccccactggaccctagcacgactagatcatcagttctgacattgataccccaaccgcaggatcacggcacttcgctgacgtgtcaggtgacctttcccggcgcctccgtgaccacaaataaaacagtccatctgaacgtgagctatccgcctcagaatctgaccatgaccgtgtttcagggcgacggcactgtgagcacagtcctgggcaatggcagcagccttagcttgcctgagggccagtcgctgagactggtttgtgccgtcgacgctgtggactcaaatcctcccgcccgcttgagtctgtcctggagaggccttactctctgtccgtcacaaccttcaaatccaggcgtattggagcttccctgggtgcacctgcgagatgctgctgagtttacttgtcgagcacaaaaccccctgggctctcagcaggtctatctgaacgtctcccttcagtccaaggccaccagtggcgttacccagggcgtggtggggggcgcaggagctacagccctggtgttcctgagtttttgcgtcatatttgtggtggtgaggtcctgtcggaagaagtctgctcggcccgcggccggggtgggcgacacggggatcgaagatgccaacgccgtgaggggatcagcctcacagggcccactgactgaaccttgggccgaagattcaccacctgatcagccgcctcctgcctccgcccggtcatcagttggagagggagagctgcagtacgcctcactgtccttccagatggtgaaaccttgggattccagaggccaagaggcgaccgacacagaatacagtgaaatcaaaattcaccgatag

SEQ ID NO: 205109 - DNA, 1440 bp, Artificial Sequence
  Description of Artificial Sequence: Synthetic coding sequence
atgctgctgctgctgctgcccctgctgtggggccgggagcgggccgagggccaaaccagcaagctgctgaccatgcaatcttccgtgacagtgcaagaagggctgtgcgtgcatgtaccatgctctttttcatatcccagtcacggctggatttaccccggacctgtggtgcacggctactggttccgggagggcgccaacaccgaccaggatgcacctgttgctactaacaaccctgctcgggccgtgtgggaggaaacccgggaccgcttccacctcctgggcgatccccataccaaaaattgcacgctgagtattcgggacgctcgcagatccgacgctggcaggtacttcttcaggatggaaaagggcagtattaagtggaattacaagcatcaccgcctgtccgtgaacgtgaccgctttaacgcaccgacctaacatactcatccccggaacgctggagtcagggtgtccccagaatctcacatgctctgtcccttgggcatgtgagcagggcacacctcctatgatcagctggatagggacctctgtgagcccccttgacccttccacgacaagatcatctgtgctgacactgattccacaacctcaagatcacggcacgagtctcacctgtcaagtcacctttcctggggcatcggtcacaaccaacaaaactgtacatctgaatgttagctaccccccccagaatctgacgatgactgttttccagggcgatggaacggtgtcaaccgtgctggggaacggaagcagcttatccctgccagaaggccagagtctgcgacttgtctgcgccgtggatgcggtcgatagtaatccccctgcacgcctctcactgagctggagaggattgacattgtgtcccagccagcccagcaatccgggcgtgctggagctcccgtgggtgcacctgagagatgcggccgagttcacatgtagggctcagaaccccctgggatcacagcaggtctacttgaacgtatccttacagtcaaaagctacttctggtgtaacgcagggagtagtgggcggtgccggcgctactgccttggtgttcctgagcttttgcgtgatcttcgtggtggtgcggagctgtcggaaaaaatctgccaggcctgccgcgggcgtaggagatacaggcatagaggacgccaatgcagtgcgcggttcagccagtcagattctgaatcactttataggttttccgaccttcctcggattggggttcgaatttctgctgaacttaagagacctctgttgccatcctgattctgaattttacgtgtatcatttttcacatttccgtttaatcaagaatatcgcgggggaaatcgtttggtctcttgagggcaagattctgtggctgctcgatgtgtctgacttttttcactggttctttttgatttgcgttggctag

SEQ ID NO: 205110 - DNA, 735 bp, Artificial Sequence
  Description of Artificial Sequence: Synthetic coding sequence
atggccgccgccgccagccccgccttcctgctgtgcctgcccctgctgcaccttttgtccggctggagtagggctggttgggtcgatacccactgcctttgttacgattttattattacgcccaaaagccgcccagagccccagtggtgtgaggttcaggggctcgttgacgaacgacctttccttcattacgactgcgtgaatcacaaggccaaagccttcgccagcctgggtaaaaaggtaaacgttactaagacatgggaggaacagactgaaacactgcgcgacgtcgttgatttcttaaagggccaactgctagatatccaggttgagaacctgattccgatcgaaccactgactttgcaagccaggatgtcttgtgaacacgaagcccatggacatggcaggggatcctggcagttcctgttcaacgggcagaaattcctcctgtttgactcgaataaccgtaaatggacggcactccatcccggcgccaaaaagatgactgagaagtgggagaagaatcgcgatgtgacaatgttcttccagaaaatttctctgggagattgtaaaatgtggctcgaggaattcctgatgtactgggaacagatgctcgaccccacgaaacctccgtcccttgccccggggactacgcagccaaaggccatggccactactctatccccctggtccctgctcatcatattcttatgtttcatactcgccgggcggtag

SEQ ID NO: 205111 - DNA, 1248 bp, Artificial Sequence
  Description of Artificial Sequence: Synthetic coding sequence
atgaccggcgagcggcccagcaccgccctgcccgaccggcggtggggaccgaggattcttgggttttgggggggctgccgggtctgggtgttcgctgctattttcctgctgttaagtttagcagcctcctggtcaaaggccgaaaatgactttgggttagtgcaacctctagtgacaatggagcagttgctctgggtgtcaggtcgtcaaattgggtccgtggacaccttcaggatccctttgatcactgcaacccctagagggaccctgctggccttcgcagaggcccgcaaaatgtcaagcagtgatgagggagcgaaattcatcgccctgaggcggtcaatggaccaaggctccacctggtccccaacagcgttcattgtaaatgacggtgacgtgcccgatgggcttaacctcggggcagttgtctccgacgttgaaactggcgttgtctttttgttctactctctgtgtgctcataaggcgggatgtcaggtcgcctctaccatgctggtctggagtaaggatgatggcgtgtcttggtccactcctcgaaatttatcactggacatcgggacggaagtgttcgcccccggaccagggagcggcatacagaagcagagagagcctaggaaagggaggctgatagtttgtggacatggtactctcgagcgggatggtgtattctgtctgctgagcgacgatcatggagccagctggcggtatggttctggtgtaagcggcatcccgtatggccaacctaagcaggagaatgactttaaccccgatgagtgccagccttatgagctccccgacggatccgtggttattaatgcccgcaaccagaataactatcactgtcactgtcggatagtgctacgctcatatgatgcatgtgatactctccgaccccgagacgtaactttcgaccccgaactcgttgatccagttgtggcagcgggggctgtcgtcactagcagtggcatcgtcttcttcagtaacccagctcatcccgagttccgcgtgaatttgacattaagatggtccttttcaaacggtacttcatggaggaaggagactgtacagttatggccaggcccaagcggatattcttctctcgccacactggagggctcgatggacggtgaggaacaagcgccacagctgtatgtgctctacgaaaaggggagaaaccattatactgagtccatctccgtggctaagatcagcgtgtacggtaccctttag

SEQ ID NO: 205112 - DNA, 1248 bp, Artificial Sequence
  Description of Artificial Sequence: Synthetic coding sequence
atgaccggcgagcggcccagcaccgccctgcccgaccggcggtggggaccacgcatcctggggttttggggcgggtgtcgtgtctgggttttcgcggctatctttcttctgctgtctctagccgcaagctggtcaaaggcggaaaatgactttggcctcgtgcagccattggtcacgatggagcagctactgtgggtatctgggcggcagatcggcagcgtggatacctttcgaatcccgctgataacggccactccacggggtaccttactggcttttgctgaggcccgaaagatgtcatcatccgacgagggagcaaaattcattgccctccggcgatcaatggatcagggttcaacatggtctccaaccgcattcatagttaatgacggcgacgtgccagacgggttaaacctcggtgccgtcgtcagcgatgtcgaaactggggtggtcttcctgttctactctctttgcgcgcataaggctgggtgccaggtggcctctaccatgctggtgtggtcaaaggacgacggcgtttcttggtctacaccaagaaacttgagtctggacataggcacagaggtgtttgcacctgggccagggagcggtattcagaaacaaagggaaccaagaaagggaagactgattgtgtgcggccacggcaccttggagcgcgacggtgttttttgtctactctcagatgaccacggagcaagctggcggtacgggagcggggtgagtggaatcccttatggccagccaaagcaggaaaatgacttcaaccccgacgagtgccaaccatacgagctaccagatgggagcgtggtaattaacgcacgcaaccaaaacaactaccactgtcactgccgcatagtcttaagatcttacgatgcctgcgacaccctcagaccaagagacgtcactttcgacccagaactggtcgaccccgtcgtagctgccggtgcagtcgttacaagttccggaattgtattcttctctaatcccgcacatccagagtttagggtgaatctgaccttgcgatggagtttctctaacggcacaagctggaggaaggaaaccgtgcagctgtggcccggtccctcaggctattcctcactggccacgctggaggggagcatggacggtgaggaacaggcaccgcagttatacgtgctgtatgaaaagggaagaaaccactatacagaaagtatttccgttgcaaaaatatcagtttacggtaccctctag

SEQ ID NO: 205113 - DNA, 1248 bp, Artificial Sequence
  Description of Artificial Sequence: Synthetic coding sequence
atgaccggcgagcggcccagcaccgccctgcccgaccggcggtggggacctcgcattctaggcttctggggtgggtgtcgtgtatgggtcttcgcagccattttcctgctgcttagcctcgctgccagttggtcaaaggccgagaatgatttcgggctggtgcagcctttggttactatggagcagctcctgtgggtgagcggtcgtcagattggatccgtggatacctttcggattcctctgattactgcaacacccagggggaccctgctcgcttttgccgaagcacgcaaaatgtcatcttccgatgaaggcgccaagtttattgctctgaggagatcgatggaccaggggagcacctggtccccgactgcttttatcgttaatgatggggacgtgcccgatggcctgaacttgggcgcagtcgttagtgatgtggagacaggagtcgtcttccttttttattccctgtgcgctcacaaagccggctgccaggtggccagcaccatgctggtgtggagcaaagatgacggagtcagttggtcaactccccgaaatctgagcctggacatcgggacagaggtcttcgcgccaggacctggttcgggcattcaaaaacagcgtgagcctagaaagggccggctgattgtgtgcggccacggcacactggagcgggatggtgtgttttgtttacttagtgacgatcatggggcatcttggcgctacgggtccggcgtgagcgggattccttatggccagccgaaacaagaaaatgacttcaatcccgacgagtgtcagccttatgagctgcctgacggctctgtggttatcaatgcacgcaatcaaaataattatcattgccactgccgtatagtgcttcggtcttacgatgcgtgcgacaccctccgtcccagagatgtgacttttgaccccgaactcgtggaccccgtggttgctgcaggcgctgttgtgacaagctcaggcatagtcttcttctctaacccggctcaccctgagtttagagtcaatctgacactgagatggtcgttttcaaatggaacatcctggcgaaaggagactgttcaattatggcccggcccaagcggatacagtagcctcgcgacactggagggttcgatggacggagaggagcaggcacctcaactctatgttctgtacgaaaaaggccgcaaccactacacagaaagtatatcagtagctaaaatttcagtatatggtactctttag

SEQ ID NO: 205114 - DNA, 1248 bp, Artificial Sequence
  Description of Artificial Sequence: Synthetic coding sequence
atgaccggcgagcggcccagcaccgccctgcccgaccggcggtggggcccccggatcctcggcttctgggggggttgtcgtgtgtgggtgttcgcagcgatttttctgctgctgtccctggccgccagctggtctaaagcagagaacgattttggcctggttcagccactcgtgactatggagcagctgctctgggtgtccggtagacagatcgggtcggttgatacctttcgcattccactgataacagcgactcccaggggcaccctgcttgcattcgctgaggctcgtaaaatgtcctccagcgacgaaggggcaaagtttatcgcactacgccgctcaatggatcagggctccacctggtctccgactgccttcatcgtgaacgacggggacgttcccgatgggctcaacctcggtgctgtcgtgagtgacgtcgaaaccggcgtggtcttcctcttttattctctttgtgctcataaggcagggtgccaggtggctagcacaatgcttgtctggagcaaggatgatggtgtgtcatggagcacccctcggaacctttccctcgacataggcaccgaagtatttgctcctgggcctgggtctggtatacagaagcaacgggagccgcgcaagggacggctgattgtgtgcggccacggaaccctggagcgcgatggagtgttttgcctattgagcgatgaccacggcgcgagttggagatacggctctggggttagtggtataccatatggccagcctaagcaggaaaacgactttaatccagacgaatgccagccgtatgagctgcctgacggtagcgtggtcataaatgctcgcaatcagaataactaccactgccactgcaggatcgtcctgcggtcttatgacgcgtgtgacacactccgcccccgggacgtgacgttcgacccagaactcgtggatcccgtggtggcagccggggctgttgttacgagcagtggtatcgttttcttctctaatcccgctcacccagagtttcgagttaacttgacacttcgatggtccttctcgaacggaacctcctggagaaaggaaactgtgcagttatggccaggcccttccggctacagctccctggccacacttgagggatccatggacggagaggaacaggcaccccagttgtacgtgctgtatgagaaaggccggaaccattacacagagtctatctcagtcgccaaaatctcagtctatggtactctgtag

SEQ ID NO: 205115 - DNA, 1248 bp, Artificial Sequence
  Description of Artificial Sequence: Synthetic coding sequence
atgaccggcgagcggcccagcaccgccctgcccgaccggcggtgggggcctcggatcctaggtttttggggcggttgccgcgtgtgggtgtttgcagccattttcctgctgctatcgctggctgcgtcctggagcaaggcggaaaatgacttcgggctcgtacagcctctggtgaccatggaacagcttctgtgggtgagcgggcgtcagatcgggtctgtggacacctttcgtattccattgattaccgccactcctcggggaaccttgcttgccttcgcggaagccaggaaaatgtctagcagtgatgagggcgcgaagtttattgcactgaggcggagtatggaccaggggtctacatggtcccctaccgcgtttatcgttaacgacggagacgtgccagatggcttgaacctgggagcagtcgtgtcagatgtagaaactggagtggtcttcctattttacagcctctgcgcccataaggcaggttgtcaagtcgcatccacaatgctggtctggtccaaggatgacggggtgagctggtccacaccaaggaacctcagcttagatatcggaactgaagttttcgccccaggtcccggctcaggcatccagaagcagagggagccccgcaaaggtagattgattgtgtgcgggcatggaactctagagagggacggtgtcttttgtttattgtccgatgaccatggcgcgtcctggaggtatggttccggcgtgtccggtataccatatgggcagccgaaacaggaaaatgattttaaccctgatgaatgtcaaccttacgagctccctgacggatcagtcgtaattaatgcacgcaaccagaataattaccattgccattgccgcatcgtgctgagaagctacgacgcctgcgataccctgcggcccagggacgttactttcgaccccgaactggtcgacccagttgttgccgccggcgcagtcgtgacatctagtggaattgtgtttttctccaatccagcccatccagaattccgcgttaatctcactcttagatggagcttcagcaatgggacctcatggcggaaggagacagtgcaactgtggccaggaccctctggctactctagtctagccacgctggaaggaagtatggatggggaagagcaggcaccacagctatacgtcctttacgaaaaaggacgaaaccattatactgaaagtatcagtgtggctaagatctccgtatacgggaccctgtag

SEQ ID NO: 205116 - DNA, 1248 bp, Artificial Sequence
  Description of Artificial Sequence: Synthetic coding sequence
atgaccggcgagcggcccagcaccgccctgcccgaccggcggtgggggccccggatcttaggattttggggagggtgtcgggtatgggtgttcgctgccattttcctccttttatcgttagccgctagctggtccaaagcagaaaatgactttggacttgtgcaacctctcgttactatggagcagctgctgtgggtatctgggcgccagatcggatcagttgacactttcagaattccattaatcaccgccacgcccagaggtacactgttggcgtttgctgaggcacggaaaatgagctcaagcgatgaaggggctaagtttattgcactgaggcgctccatggatcagggtagtacttggtcacccactgcctttattgtgaatgatggtgacgtcccagatgggttgaacttgggggcagtagtgagtgatgttgaaaccggcgtcgtcttcctgttttactccctgtgtgcccataaggctggatgtcaggtcgcctcgactatgctggtgtggagtaaagatgatggggtgtcttggagtacacctcggaatctaagtttagatattggaacggaggtgttcgcccccggccccggatccggcatacaaaagcagcgtgaaccgagaaaggggagattaattgtgtgtggccacggcacactggagcgcgatggcgttttttgtttgctatcagacgaccacggagcttcttggagatatggttctggggtcagcggtattccctatggccagcccaaacaggagaacgattttaaccctgacgagtgccagccatatgagctgccggatgggtctgtggtcatcaacgctcgaaaccagaacaattatcattgccactgcagaatcgttctccggtcttacgatgcgtgtgacaccctgcgtcctcgtgacgtcacattcgatcccgagcttgtggatcctgttgtggccgctggagctgttgttacttcatctgggatcgtatttttttctaaccccgctcaccctgaatttagggtgaatctgaccttaaggtggtcctttagcaacggtacatcctggcggaaagaaaccgtgcagctatggccgggcccaagtgggtattcgtccctcgctaccttagaaggtagtatggacggcgaggagcaggcacctcaattgtatgtattgtatgagaagggccgtaatcactacacggagagcatcagcgtggccaaaatctcagtctacggaacgctatag

SEQ ID NO: 205117 - DNA, 1248 bp, Artificial Sequence
  Description of Artificial Sequence: Synthetic coding sequence
atgaccggcgagcggcccagcaccgccctgcccgaccggcggtggggccctcgcattttgggcttttgggggggctgcagagtttgggtgttcgcagcaattttcctgctactgtctcttgctgccagctggtctaaggccgagaacgatttcggccttgtgcaacctctggtgaccatggagcagcttctctgggtctccgggaggcagatcggaagcgtcgatacgtttaggatccccctcatcacagccacccccaggggcacactgctggcctttgcagaagcgaggaaaatgtctagctctgatgagggcgctaaatttatcgccttaagaagatcaatggaccaggggtctacttggagtcctaccgcttttattgtcaacgatggagacgtgcccgacggcctaaacctgggagctgtggtctcagatgtggagaccggagtcgtctttctgttctattctctgtgcgcacacaaagctggttgtcaggtagcgtctactatgctcgtgtggtccaaagacgatggggttagctggtccacccctagaaatctcagcctggatatcggcaccgaagtgtttgcccctggcccaggtagtggaatccagaaacagcgggaaccacgcaaaggccgactgattgtttgtggtcacggcacactagagcgcgacggtgtgttctgcttgctatcagacgatcatggcgcaagttggaggtacggttccggggtgagcggcatcccatatggccaacctaagcaagagaacgattttaatccagacgaatgtcagccttacgaattgcccgacggctcagttgtgattaatgccaggaaccagaacaattaccactgccactgtcggatagttctacggagctatgacgcatgcgatacactgaggccacgggatgttacatttgatcccgaacttgttgacccagtggtggcggccggtgccgtagtgaccagcagcggcatcgtgtttttctctaacccggcccatccagaatttagggtgaaccttactctcagatggtcattcagtaatggtacaagttggcgcaaagagaccgtgcagctgtggcccggccccagtggttactcttcactcgctacgctggaaggaagcatggatggtgaagagcaggcccctcaactgtacgttttgtacgaaaagggcagaaatcattatactgaaagtatttcagtcgcaaagatcagcgtatacggaactctgtag

SEQ ID NO: 205118 - DNA, 2277 bp, Artificial Sequence
  Description of Artificial Sequence: Synthetic coding sequence
atggccgtgagcgccggcagcgcccggaccagccccagcagcgacaaagtgcagaaggacaaggccgagcttatttccgggcctagacaggactctcgtatcggaaagctcctgggcttcgagtggactgatcttagcagttggaggcggctggtaacacttttaaatcggcccacagatccagctagcctcgccgtcttccgttttctgttcggatttctgatggtcctggatatcccacaggagaggggattaagttccctcgaccgtaagtatttggacggcctagatgtatgtaggttccccctacttgacgctctcaggccactccctttggactggatgtatctcgtctacacgattatgtttctgggagccctgggaatgatgctaggcttatgctataggatcagctgcgttctatttcttctgccttattggtacgtgtttctgctcgataaaacctcctggaataaccactcttatctgtatggcctcctcgccttccagctcaccttcatggacgcaaatcactactggtcagtggatggtctactcaacgcccaccgacgcaacgcccatgtgccgttgtggaactacgctgtgcttcgtggccagattttcattgtgtactttatagctggagtcaagaagctagacgctgactgggttgaagggtactcaatggagtacctctcgcgacactggctattttctccatttaaactgttgcttagtgaggagttgaccagcctactggtggtgcactggggggggctcctgttagacctttctgctggttttctgctgttcttcgacgtctccagaagcataggccttttctttgtgtcctacttccactgtatgaatagtcaactgttttccatcggcatgttttcctacgtgatgttggcgagttctcctctgttttgttctcccgaatggcctcggaagttggttagttactgtcctaggagacttcagcagctgcttcctttgaaggcagcgccacagccttccgtaagctgtgtgtacaaaagatcacggggcaaatcaggccagaagcccggtttacgacatcagttaggcgctgctttcaccctgctctacctgcttgagcagctctttctcccatactctcatttccttactcagggctacaataattggacaaatggcctgtacggttactcctgggatatgatggtgcacagccgcagccatcaacacgtgaaaattacttaccgcgatgggcggactggagagctgggctacttgaaccccggcgtgttcacccagtctcgccgctggaaagaccacgccgacatgctcaagcagtatgctacgtgcctgtctcgcctcctacctaaatataatgtcaccgagcctcagatatatttcgacatttgggtgtctatcaatgatagattccaacaaaggattttcgatccacgcgtggacattgtccaggctgcatggtccccctttcagcgcacatcatgggtccagccgctgttaatggatttaagtccatggcgggcaaaactacaggagatcaagtcttcccttgacaatcacactgaagtagtgttcatcgctgatttccccgggctgcacctggaaaactttgtaagtgaggacctcggaaatacgagcattcagctgttacaaggggaagtaacagtcgagctcgtcgctgagcagaagaatcaaaccctgcgggagggggagaaaatgcagctgcccgccggagaatatcacaaagtgtacacaacatcgccgagtccctcgtgctatatgtacgtgtatgtcaacactaccgaactggcccttgaacaggatctggcttacctgcaggaactcaaagagaaagtggagaatggaagcgaaaccggcccgcttccccccgaacttcagcccctgctggagggggaggttaaggggggccctgaacctacgcctctcgttcagacgttcttacgcaggcagcagcgcctgcaagagatcgaaagaagacggaacactcccttccacgagcgatttttcagatttctgctgcggaagctgtatgtgttcaggcggagcttcctgatgacttgcatcagcttacggaatctgatattggggaggccctccttggagcagctcgcccaagaggttacctatgccaatctccgacccttcgaggctgtaggcgaacttaatccgtctaacactgactcctctcactctaacccaccagaaagcaaccctgaccctgtgcacagtgagttctag

SEQ ID NO: 205119 - DNA, 1386 bp, Artificial Sequence
  Description of Artificial Sequence: Synthetic coding sequence
atgcggcccgccgacctgcccccccggcccatggaggagagccccgcctcatcttctgccccgacagagaccgaggagcccgggtcaagtgccgaagtaatggaggaagttacaacatgttcctttaacagtcctctgtttcgacaggaagacgatagaggaatcacctataggataccagcgctgctctacatcccccccacccacactttcctcgcatttgccgaaaagagaagtaccaggagggatgaagacgcactccatcttgtgctcaggcgaggtctgcggattggacagttagtgcaatgggggcctctcaagccattgatggaggccaccttgcctggtcatcgcaccatgaacccttgccccgtctgggaacagaaatccggatgcgtatttttgttctttatctgtgtcaggggtcacgtgactgagagacagcagatcgtctcaggtaggaacgcagcgcggctctgtttcatatatagtcaggatgccgggtgcagctggtctgaagtgagggacttgactgaagaagtcattggatcagaactcaagcactgggccacctttgcagtcggccccggacacggaatacagctgcaatccgggaggctagtgataccggcatacacctattacatcccgtcgtggttcttttgcttccagctgccatgcaagaccaggccacatagtctaatgatctactctgacgacctgggggtcacttggcatcacggaagacttatccgacccatggtgacagtggagtgcgaagtagccgaggtgaccggtagagccggccacccagtgctgtactgctccgctaggacgccgaatagatgtcgagcagaagctctctcaactgaccacggggagggtttccagaggttggccttgagtcgacagctgtgtgagcccccgcatggatgtcagggcagcgtggtctcgtttaggccgctggaaattccacaccgatgccaggactcttcatctaaagacgcccccaccatccagcagtcgagccccgggtcgtctctcagattagaggaagaggcaggcacaccttcggagtcttggctcctgtattctcatccgacgtcgaggaagcaaagggttgatcttggtatttacctgaaccagacacccttggaggctgcgtgctggagccggccttggatcttgcattgtggcccatgtgggtatagtgatctagccgctctggaagaggagggcctcttcggctgcctcttcgagtgcgggaccaagcaggaatgtgagcagatcgccttcaggctcttcacccacagagaaattctctctcatctgcagggtgactgcacctccccaggaagaaaccctagccagttcaaaagcaactag

SEQ ID NO: 205120 - DNA, 1386 bp, Artificial Sequence
  Description of Artificial Sequence: Synthetic coding sequence
atgcggcccgccgacctgcccccccggcccatggaggagagccccgctagctctagtgcgcccacagagaccgaagaacccggatcgtcagcggaagtcatggaggaagttaccacctgttccttcaactctcccctgttcaggcaagaggacgatcgtgggataacctacagaatacctgcactgttgtacattcctccgacgcacactttcttagcgttcgcagaaaaacgctctacccggcgagatgaagatgccctacatctggtgctcagacgcggccttcggattggccagcttgtacagtggggccccctgaagccactcatggaagctacgctgcctggccaccgcacgatgaatccatgcccagtgtgggagcagaaatcagggtgcgtattcctgttctttatctgtgttcgaggacacgtgaccgaacgacagcagattgtatcagggaggaacgctgcccgtctgtgcttcatctatagccaggacgctgggtgctcttggtcagaggtgcgggacctgaccgaggaagtcatcggctcggagctgaagcactgggccactttcgctgttggccccggacatggcattcagcttcagagtgggcggctagttatacctgcctacacttattacatcccttcctggtttttttgtttccagctcccatgtaagaccaggccccactcactcatgatctatagtgacgacctcggtgtcacttggcatcatggtaggctgattaggcccatggtcactgtggagtgtgaggtcgccgaagtaaccggaagagccggccacccagtcttgtattgtagcgcgcggactcctaacaggtgccgagccgaagcactgagcacagaccacggcgagggatttcaacggcttgccctcagtcggcaactctgtgagcccccccatggctgccagggatcagtcgtgtctttccgccctctcgagatcccccacaggtgccaggattcgtcctctaaggacgcacctacaatccaacagagctcccccggtagtagcctgcggctggaagaagaggcaggaactccatccgaaagctggctcctgtacagccaccccacatccagaaagcagagagtggacctgggaatctacctgaatcagactcccttggaagcagcttgttggtctagaccttggatcctgcactgtgggccttgcggatactctgatctagccgcgttagaggaggaaggattgttcgggtgtctcttcgaatgcggcacaaagcaggagtgcgaacagattgcctttcgcctcttcactcacagggaaatcctcagccatctccagggcgactgcacctcgcccgggcgcaacccgtcgcaatttaaatctaactag

SEQ ID NO: 205121 - DNA, 1287 bp, Artificial Sequence
  Description of Artificial Sequence: Synthetic coding sequence
atggaggaggtgaccacctgcagcttcaacagccccctgttccggcaggaagacgacagaggaatcacgtaccgcatacctgcgttactctacatacctccaacccatacttttctggcattcgcagagaaacgctcaactaggagggacgaggatgccctgcacctggtattgagaagaggcctccgaattggacagctcgtgcagtggggccctctgaagccactgatggaggcaacactaccaggacacaggaccatgaacccgtgcccagtgtgggagcagaaaagtggctgcgtctttctgttcttcatctgtgtgcgaggacatgtgaccgaacgacagcagatcgttagtgggcggaacgcggctcgactgtgctttatttattctcaggacgctggatgctcttggtccgaagtcagggatcttacggaagaggtcatcggttccgagctgaaacattgggcgactttcgccgtgggcccaggccacggaatccagttacagagcggacgtctcgttattcccgcctatacatactatatcccaagttggtttttctgctttcagctcccatgcaaaaccaggccacacagcctcatgatttatagcgatgatctgggggtgacatggcatcatgggcgattgatcagacccatggttactgtcgaatgcgaggtagcagaagtaacaggacgggctggccaccccgtgctctattgctctgcccgtacccccaacaggtgcagggcagaggcactgagtaccgaccacggagaagggtttcagcgactggctttgagtcgccaactgtgtgaaccaccccatggatgccagggctctgtcgtgtcattccgacctttagagatcccacatagatgtcaggattctagtagcaaggatgcgccgactattcagcagtcatccccgggctcctctctgcggttagaggaagaggccggcacccccagcgaatcatggctgctgtacagccaccctacaagtcggaaacagcgtgttgacctcggtatctacctcaatcagacacctctcgaggccgcctgctggtcaaggccttggatattgcattgtgggccctgcggttattcagatctagccgccttggaggaagaaggtctcttcggatgtctctttgagtgtgggactaaacaagaatgtgaacagatagcatttaggctattcactcaccgggaaatactctctcacttgcagggtgattgtactagccccggacgaaaccctagccaattcaaaagcaactag

SEQ ID NO: 205122 - DNA, 1059 bp, Artificial Sequence
  Description of Artificial Sequence: Synthetic coding sequence
atggaggccaccctgcccggccaccggaccatgaacccctgccccgtctgggaacagaagtctggatgcgtatttctgttcttcatctgtgtgcggggacatgtcacagagcgacagcagatcgtgagcggcagaaatgccgctagactatgctttatatattcacaggacgctggctgctcctggtccgaggtgcgggacctcaccgaggaagtgattggtagtgaattaaagcattgggccaccttcgccgtagggccaggccatggcatccagctccaaagcggtagactggtcatccctgcgtatacctactatatcccttcctggttcttctgcttccagctgccctgtaagactcgcccccacagtttgatgatctactccgacgacctcggggtgacttggcaccacggcaggctgatccgtccgatggttacagtcgaatgtgaagtggccgaggtgacaggacgtgccggccaccctgttctttactgcagtgccaggaccccaaatcggtgtagagctgaagcgttatctacggaccacggggaggggtttcagagactcgcgctctctaggcagctgtgcgaaccacctcacggatgtcagggctctgtggtgtcctttcggcctcttgaaatcccacacaggtgccaggactccagcagtaaggacgcaccgactatacagcaatcgtcccccggaagtagcctgcggctcgaggaagaggccggcaccccctccgaatcatggttgttgtactcccaccccacctctaggaagcagcgggtggaccttggaatctatctgaatcagacacccctcgaagccgcctgctggagcaggccttggatcctgcactgcggaccctgtggatatagcgatcttgccgctctggaggaagagggcctctttggctgtctgtttgagtgtggaactaaacaggagtgcgagcagatagcgttccgcctgttcacacatcgagagattctgtcgcacttgcagggagattgtaccagccccggaagaaatccaagtcagtttaaatccaattag

SEQ ID NO: 205123 - DNA, 1203 bp, Artificial Sequence
  Description of Artificial Sequence: Synthetic coding sequence
atggccaccctgctgctgctgctgggcgtgctggtggtgagccccgacgcgctaggatcaaccaccgctgttcagacccccacaagtggagagcctctcgtaagtacctccgaacccctgtcaagtaagatgtataccacctctattactagcgacccaaaggctgacagtacaggggaccagacgtcagctcttcccccctctacaagcataaacgagggatccccgctctggacatctatcggcgcatctaccggttcaccacttcctgagcctactacctaccaagaagtatctatcaagatgagctccgtgccacaggaaacacctcatgccactagccacccagcagtccctatcaccgccaactccctagggtcacacaccgtgacggggggaacaatcactactaactctccagagactagtagccgcacctccggcgctccggtcacaaccgccgcgtcatcacttgaaacctccaggggcacctcggggccaccactgacaatggcgaccgtctcgttggaaacctctaagggaaccagtgggcctcccgttacaatggccactgattcactggaaactagcacaggcacaactgggccacctgtcacaatgacaaccggaagcctggagccctcatctggagcatccggcccacaagtgtccagtgtgaaactgtccactatgatgtcacccaccacaagcacaaatgcaagcacagtgccatttcggaatcctgatgaaaactcacgggggatgctgcctgtagcggttctcgtagccctcctcgctgtcattgttcttgtcgcactgctgttgctgtggaggcgccgacagaagcgacggaccggagccctcgtgttatcccgcggaggtaaaagaaacggcgtcgtggacgcttgggccggcccggcccaggtgcctgaagaaggcgctgtaaccgtcaccgtggggggatctggcggggataagggatccggattcccagacggcgagggtagtagtcggagaccaaccctaaccacttttttcggccgccgcaaaagtagacagggtagtctggcaatggaagaactgaagagtggttctggcccctcactgaagggagaagaagagccactcgttgctagcgaggacggcgcagtggatgctcctgcgcctgatgagccagaaggcggtgatggtgccgctccttag

SEQ ID NO: 205124 - DNA, 1203 bp, Artificial Sequence
  Description of Artificial Sequence: Synthetic coding sequence
atggccaccctgctgctgctgctgggcgtgctggtggtgagccccgacgccctgggctcgacgacagcggtccagacaccaactagtggtgaaccgctcgtgagcacaagtgaacccctatcttccaaaatgtataccaccagtatcacatcagatccaaaagccgactccacaggggaccaaacatccgcgcttcccccctcaacatctattaatgagggctcccccttatggacctccattggcgcatccacgggctctccccttcccgagcctactacataccaggaagtctccattaagatgtcatctgttccccaggagactccacacgctacaagccatccagctgttcctataaccgctaactcgctcgggtcccataccgtcacaggtgggactatcactactaacagcccagagacatcctcccgcacctctggggcccccgtgacaaccgccgcttcttcgctcgaaacttcaaggggaacatctggtccacctctcactatggccactgtcagcctggagacgtccaaaggcacgagtgggccaccagtgaccatggccacagattctctggagacaagcacagggactactggcccgccagtgacaatgacaaccggcagtttggagcccagtagcggtgccagcgggccccaggtgtcctccgtaaaactcagcaccatgatgagccctaccacaagtacaaatgcgtcaaccgtcccgttccgtaaccctgatgagaacagcaggggaatgctcccggtcgcagtgttagtcgccctgctggccgtgatagtcctcgtcgccctgctactgctgtggcgccgcagacaaaagagaaggaccggggcactggtgttgtcacgcggcggaaagagaaatggtgtggtggacgcctgggccggccctgcccaggtcccagaggagggtgcggttacagtgactgttggaggctcgggcggcgataaagggtccgggtttcccgacggggaggggtccagccgacgcccaacccttacaacattctttggtcgacgcaagagccgccagggttctctcgccatggaagaactgaaaagcggaagcgggccatccctaaaaggtgaggaggagcccctagttgccagcgaagacggggccgtggacgcaccagcgcccgacgaacctgaaggcggagacggcgcggcaccttag

SEQ ID NO: 205125 - DNA, 1068 bp, Artificial Sequence
  Description of Artificial Sequence: Synthetic coding sequence
atggccaccctgctgctgctgctgggcgtgctggtggtgagccccgacgctcttggttctaccaccgctgtccagacgccaactagcggagaaccacttgtcagcacatcagaaccactgtcatcgaaaatgtataccacctccatcacaagtgaccctaaagcagatagcaccggagatcagacgtcagccctccccccttcaacaagtatcaacgaagggtccccactctggacatcaattggcgccagcaccgggtctcctctgccagaaccaactacgtaccaggaagtgagcattaagatgagcagtgtccctcaggagacccctcacgccacttcccacccagctgtaccaataaccgcaaattcacttgggagccacaccgtgaccggcggaaccatcaccactaacagtcccgagaccagtagtaggaccagcggagcccctgtcacgaccgctgctagttctctagagactagccgcgggaccagcggcccaccgctcacaatggctacagtttcattggagacgagtaaagggacatctggccctcctgttaccatggccacagattcattagagaccagtaccgggacgactggaccacccgtcaccatgacaacgggaagcctggaaccctcctccggtgcatccggtccgcaagtcagttccgtcaaactcagtaccatgatgagtcccacaacctccaccaatgcatctaccgtgcctttcaggaacccagatgagaactctagaggtatgctgccagtggccgtgctggtcgccttattggcagtaatagtgctggtggcgctgcttctcttgtggaggcgtcgccagaagagacgaactggggcgttggtcctgtcaagaggtgggaaacgcaatggggtggtagacgcttgggcagggcctgctcaagtgcccgaggaaggcgccgtgaccgtcacagtcggcgggtctgggggtgataagggaagcggatttcctgatggggaagggtccagtagacggccaactctcacaacattcttcggtaggcgtaagagtcggcaagggagctag

SEQ ID NO: 205126 - DNA, 672 bp, Artificial Sequence
  Description of Artificial Sequence: Synthetic coding sequence
atgcagtgggccgtgggccggcggtgggcctgggccgccctgctgttggccgtggccgcagtgttaacacaggtggtgtggttatggctgggaactcaatcctttgtgttccaacgtgaggagatcgctcagctggccaggcagtacgcgggactcgatcacgaacttgcattttcacgtctgatcgtcgagcttaggcggctccacccaggccacgtccttccagacgaagaactacaatgggtgtttgtgaatgcgggcggttggatgggggcaatgtgcttacttcacgcctcactctcggagtatgtcctcctgttcgggacagctctggggtcccggggtcactcaggcagatattgggcagaaatctcagataccattatatcggggaccttccatcagtggcgggagggcacaaccaagtccgaggtgttttaccctggtgaaaccgtggtgcacggacccggggaagctaccgccgtggaatgggggcccaacacatggatggtggagtacggcaggggcgtgatccctagtacactggctttcgccttggcggatactgtcttttcgacgcaggattttctgactctcttctacacactaagaagctacgctagaggcctaaggttagagctgaccacatatctgttcggccaagatccctag

SEQ ID NO: 205127 - DNA, 570 bp, Artificial Sequence
  Description of Artificial Sequence: Synthetic coding sequence
atgcagtgggccgtgggccggcggtgggcctgggccgccctgctgttggcggtggctgcggtgctcacccaggtggtctggttgtggttgggcttggaccacgagcttgccttcagtcggctgatcgaggagcttcagtgggtcttcgtcaatgcgggaggatggatgggggccatgtgtttgctccacgcctcccttagcgaatacgttctgctatttggcacagcattgggaagcagaggccatagtggccggtactgggcagaaattagtgacacgataatttctggtaccttccatcaatggagagagggaactaccaaaagcgaggtgttctaccctggagagacagtggttcatgggcctggagaggccacagccgtggagtggggccctaatacatggatggtggaatatggtcggggggtgataccttctacgctcgcatttgccctggcagacacagttttttctacacaagactttctgaccctgttctacactctccggtcatatgctcgaggtctgaggctggaactcaccacctacctgtttggccaggacccctag

SEQ ID NO: 205128 - DNA, 405 bp, Artificial Sequence
  Description of Artificial Sequence: Synthetic coding sequence
atgggcgccatgtgcctgctgcacgccagcctgagcgagtacgtgctactctttggcaccgccctcggatctcgaggtcatagtggaaggtattgggctgagatatctgatacaattatatctggcactttccaccagtggcgggaaggtaccactaaatctgaggtattctaccctggcgagacagtggtccacggtcccggtgaagctacagctgtggagtggggccctaatacctggatggttgaatacggacgtggtgtgatcccttcaacactggccttcgcactggccgatacagttttttctacccaagacttcctgacgcttttctatacgctgcgttcctatgcacggggactacgcctcgaactgacaacctacctgtttggtcaagatccctag

SEQ ID NO: 205129 - DNA, 579 bp, Artificial Sequence
  Description of Artificial Sequence: Synthetic coding sequence
atgcagtgggccgtgggccggcggtgggcctgggccgccctgctgttagccgtggcagcagtgctgacccaggtagtttggctgtggctcggcacacaatctttcgttttccagcgggaggaaattgcacagctggcgagacagtatgctggtttggaccatgaattggccttcagccggctcattgtggaacttagacgtctacacccaggacatgtcctgcccgacgaagagctccagtgggtgttcgtcaacgccgggggctggatgggggcaatgtgtcttcttcacgcatctctgtcagaatacgtgcttttattcggcactgctttgggatcacgggggcactctggcgagaccgtggtgcatggccccggcgaggctacagctgtggaatggggcccaaatacctggatggtcgaatatggcaggggtgttatcccatctactctggccttcgccctggcagacactgtatttagtactcaggacttcctcaccctgttctatactctgaggtcctatgccagaggactccgcctcgaactgactacttaccttttcgggcaggatccatag

SEQ ID NO: 205130 - DNA, 2916 bp, Artificial Sequence
  Description of Artificial Sequence: Synthetic coding sequence
atgggcgtggccggccggaaccggcccggcgccgcctgggccgtgctgctgcttctcctgctccttccaccgcttctcctgctggcaggcgccgtcccccctggaaggggccgagctgccggcccacaggaagatgtggacgaatgcgcacagggacttgacgactgtcacgctgacgcactgtgccaaaatacacccacatcttataaatgttcatgtaagcctggctaccagggggagggaagacagtgtgaggatatcgatgagtgcggtaacgagctcaacggtggatgtgttcacgattgtctcaacatacccggcaattatcgatgtacgtgcttcgatggtttcatgttggcccatgatggacataactgcctggacgttgatgagtgtctcgaaaacaacggggggtgccaacacacctgcgtgaatgtgatggggtcatatgagtgctgttgcaaggaggggtttttcctgtctgataaccagcacacctgtatccatagaagcgaggaaggcctctcttgtatgaataaagatcatggatgctcccacatctgcaaggaggcccccaggggaagtgtggcctgcgagtgccgacctgggttcgaactcgctaagaatcagagggactgtatacttacttgtaaccacggcaacggcggttgccagcatagctgcgatgacacagctgatggccctgagtgtagttgtcatccccagtacaaaatgcacactgacgggcggtcgtgtctcgaaagagaagacactgtgctggaagtaaccgagtcaaacactacctctgtagtggacggagataaaagggttaagcggagactactgatggaaacctgtgctgtaaacaatggtggttgtgaccggacttgcaaggacactagcaccggcgtgcactgttcttgccctgtgggtttcacacttcagctggatggcaagacatgcaaggacatcgacgaatgtcaaactcgtaacgggggatgcgatcatttctgtaagaacattgtaggatcctttgactgcgggtgtaaaaaggggtttaaactgctgacggatgagaaaagctgccaggatgttgacgagtgtagcctcgatcgcacatgtgaccatagctgtataaaccatcccggcacgttcgcctgcgcctgcaacagagggtacacactgtatggattcacacattgcggggacaccaacgaatgtagcattaacaatgggggctgtcagcaggtgtgcgtgaacaccgttggtagctatgagtgtcaatgccaccctgggtataagctgcactggaataagaaggactgcgtggaggtgaaaggcctgctgcctacttcagtctcgcccagagtgtcacttcattgcggaaagtctggggggggagatggctgctttctacggtgccatagtggcatccacttatcctctggtctgcaaggcgcctatagcgtgacatgcgggtcctcatctcccctccgtaacaagcaacagaagagtaatgattcagccttcggtgacgtgacaaccattcgcacaagtgtcacctttaaactaaatgaaggaaagtgttcgctaaagaatgcggaattgtttccagaagggctgcgacccgcgcttcccgagaaacattcaagtgtgaaggagagcttccgttacgtcaacctcacatgtagtagtgggaaacaggtgcccggagctccgggtagacctagtactccaaaagaaatgtttattaccgtcgagttcgaactggagaccaaccagaaagaagttaccgctagctgcgatctgagctgcatcgtgaaacgcacggagaaacgtctgagaaaggccatcaggaccttgcgcaaggctgtccaccgggaacagtttcaccttcagctctcaggaatgaaccttgatgtggctaagaaaccaccacggaccagcgagagacaggcagagtcatgtggtgtgggccagggacatgccgagaaccaatgcgggctctgccagcccggcgagtacagcgcggacgggtttgctccctgtcatctatgcgccctgggcacgttccagcccgaagccggacggactagttgcttcccatgcggcgggggcctggccaccaagcaccagggcgccaccagtttccaggactgtgagacacgcgtccagtgttctcccgggcacttttacaacaccaccacacaccgctgtatcagatgtcccgtgggaacctatcagcccgagtttgggaagaacaattgtgtcagctgccctggcaatactaccaccgatttcgacggctccaccaacatcacccagtgtaaaaaccggagatgtggaggcgaacttggggacttcactggctacatcgaatctcctaattatccaggcaattatcccgctaacactgaatgcacctggacaataaatccgccgcctaagagacggatcctcatcgtggtgcctgagatcttcctccccatcgaagacgattgcggtgactacctcgtgatgcgcaaaacctcctcaagtaactcagtgaccacctatgaaacatgccagacatacgagcgccccatcgcattcacaagcaggtcaaagaagctgtggatacagttcaagtctaatgagggcaatagtgccaggggatttcaagtgccatacgtcacctacgatgaggattaccaagaactgattgaagatattgttcgggatggcagactttacgcctcagagaaccaccaggagatcttaaaggacaaaaagctgatcaaagccctgtttgatgtcctggcacaccctcagaactatttcaagtacacggcccaggaaagtcgcgagatgtttcctaggagctttattcgcctgcttagatctaaggtttcacgatttctgcggccatataagtag

SEQ ID NO: 205131 - DNA, 1044 bp, Artificial Sequence
  Description of Artificial Sequence: Synthetic coding sequence
atgggcgccgccgccgtgcggtggcacctgtgcgtgctgctggccctgggcaccaggggccggctggctggcggatcgggacttcctggcagtgtggatgtggacgaatgttctgaaggtacagacgattgtcatatcgacgccatctgtcaaaacacgccaaagtcatataaatgcttgtgtaagcccggctacaaaggggaaggaaaacaatgtgaagatatcgacgagtgcgaaaacgattactataacggcggatgcgtccatgagtgcataaacatcccaggcaactaccgctgcacctgtttcgacggctttatgttggctcacgatgggcataattgcctcgacgtggatgagtgccaggataataatggcggctgtcagcagatttgcgtcaacgccatgggctcctacgagtgccagtgtcactctggattctttctgagcgacaatcagcatacctgcattcaccgctcaaacgaaggaatgaactgtatgaataaagatcacggttgtgcgcacatttgtcgtgaaactcccaaaggcggagtggcctgcgattgccgccccgggtttgacttagctcagaaccagaaggattgcaccctcacctgtaattacggcaatgggggatgtcagcatagctgcgaagacactgacactgggcccacgtgtggctgccatcagaagtatgccctccactctgacggacgcacttgcatcgagaaagatgaggctgcaatcgagaggtcccagtttaatgctacgtccgtagccgatgtggacaaacgggtcaaaaggcgtctactgatggaaacctgcgctgtgaataatggcgggtgcgacaggacgtgtaaagacaccgccacgggcgtgcgctgttcctgtcccgtcgggtttaccctgcagcccgacggtaaaacttgtaaaggacagcacgtcgagctctgcggctgtccatgtctgtactggcccggccaggaacccccctgcgcgtgtattgctggcccgcgcgctggactgaatggaggacatgtttag

SEQ ID NO: 205132 - DNA, 2967 bp, Artificial Sequence
  Description of Artificial Sequence: Synthetic coding sequence
atgggcgccgccgccgtgcggtggcacctgtgcgtgctgctggccctgggcacacgtggacgcctagctggtgggagtgggttgcctggctcggtggatgtcgacgagtgtagcgaagggaccgatgactgccatatcgacgcaatatgccagaacactcctaaatcatacaaatgcctgtgcaaacctgggtacaaaggtgaaggaaaacagtgcgaagatatcgatgaatgcgagaatgattactacaacggcggctgtgtgcatgaatgtataaacatccccgggaattatagatgcacttgcttcgatggctttatgctcgctcatgacggacataactgccttgatgtggatgagtgtcaggacaacaacggtggatgccagcaaatctgcgtgaacgcaatgggcagttatgaatgccagtgtcatagtggatttttcctaagtgataaccagcatacctgcatccatcgaagtaacgagggtatgaactgcatgaacaaagatcatggctgcgctcacatctgccgcgagactcctaaaggtggggtggcctgcgattgccggcccgggttcgatctggctcaaaatcaaaaagactgcacactcacctgtaattatggcaatggcggttgtcagcactcttgcgaagacaccgataccggtccaacttgcggatgccatcagaagtatgcactccattcagacggcaggacctgcatcgaaacctgcgccgtgaataacggcggctgtgatcgcacatgcaaggataccgccaccggtgttagatgttcctgcccagtgggcttcacactgcagccagatgggaagacctgtaaagatattaacgaatgtctcgtgaacaatggagggtgcgaccacttctgtcgcaatacagtgggtagttttgagtgtggctgtaggaagggctacaaacttctgacagatgaacgaacttgccaggacattgatgagtgctccttcgagcgcacatgcgaccatatctgtatcaacagccctggctcatttcaatgcctgtgtcaccgcggctacatcttgtatggtactacccactgtggcgacgtagatgaatgtagcatgtcaaacgggtcttgcgatcaaggctgtgtgaatacgaaagggagctacgaatgcgtctgtccaccgggtaggcgcttgcattggaacggtaaagattgtgtggagactgggaagtgcctgtcgagagccaagacaagccctcgcgcgcagttgtcctgcagcaaggccggtggcgtagaatcatgttttctgtcctgcccagcgcacaccctgtttgtacctgactcagagaattcctacgtgctgtcctgtggagtgcccggaccgcagggtaaagctctgcagaagagaaacggcacatcttccggcttgggaccctcttgttcagatgctccgaccaccccgattaaacaaaaagcaaggtttaagatcagggacgccaaatgccatttgcgccctcactctcaagcacgggccaaagagacagcaagacagcccttgttagaccactgccatgtcacatttgtgactctgaagtgtgacagctcaaagaaaagacgccgggggcgaaaatctcctagcaaagaggtctctcacattacagcggaattcgagattgagacaaaaatggaagaagcttcagatacctgcgaggccgactgccttcgaaagcgagctgaacagtccctccaagctgcaattaaaacactgaggaaatccatcggaaggcagcagttttatgtgcaggtttccggcacagaatacgaagtcgcccagcgtcctgctaaggccttggagggtcagggagcttgcggggccggccaggtgttacaggattcaaagtgcgttgcatgcgggcccggcactcatttcgggggcgagctggggcaatgcgtgtcttgcatgcctggtacttaccaggacatggaggggcagctgtcttgcactccttgtccttccagcgatggactgggactcccaggagcccggaacgtgtcagaatgcggaggacaatgttctccagggttcttttcggcggacggttttaagccgtgccaggcctgtcctgtgggcacctatcaacccgagcctggtagaacagggtgcttcccgtgtgggggcggtctgctaaccaaacacgagggaaccacctctttccaggattgtgaggctaaggtccattgcagccctggccatcactacaataccactactcatcgttgtattaggtgccctgtgggtacctatcagccagagtttggacagaatcactgtattacctgccccggaaacacatctacagacttcgacggctctaccaatgtcacacactgtaaaaaccagcattgcgggggcgagttaggggactataccggctacattgagtcccccaattaccccggagactatccagcaaatgctgaatgcgtctggcatatcgccccacccccaaagaggcggatcttgattgtcgtccccgaaatcttccttccaatcgaggatgagtgcggcgacgttctagtgatgcgcaagtccgccagccctactagcatcacgacctacgaaacctgtcaaacctacgagaggccaattgcctttacctctcggagcaggaaactgtggatccagtttaagagcaacgaaggcaattctggaaaaggatttcaagttccctatgtcacctatgatgaggactatcagcagttgatcgaagacatcgtgagggacggccgattgtatgccagcgaaaaccaccaagaaattttgaaggacaaaaaattgatcaaagccctctttgacgtgctggcgcatccccagaactactttaagtatacggcgcaagaaagtaaggaaatgttcccgagatcttttatcaagctcttgcggtctaaggtgtcgcggttcctgaggccctataaatag

SEQ ID NO: 205133 - DNA, 1857 bp, Artificial Sequence
  Description of Artificial Sequence: Synthetic coding sequence
atggagaccgaggccgccagcaccgccgtgcggacccagacccaggctcctagagtcgtagccacacgtagcactccgagcacccagaccgtggctcgggcttcgcggagagctcagagcattaccgaggcggccaccggtcacgctcggactcaaccacttgcttgcgacgccgcggccccgcttgattcacactgcagcagaactggacgccacgctaaaacctctacatccgcttggtctacaacagaggccgcaacaacctctgcagcaacaccgtgggccgcatcctccgccgccgccggaagggctacgtcttgttcccctacatctgcccccgcccgtacgagcacttccgcaccttcttccggacccgtgactactagcgcctccactccacaggcgcgggcaaaagaaaccgccagacagcccctgctggaccactgtcatgtgactttcgtgacattgaagtgcgactctagcaagaagcgcaggcggggacgcaaatcgccgtctaaggaggttagtcatatcacagcagagttcgagatcgaaaccaagatggaagaggccagcgatacttgtgaagctgattgtcttaggaagcgcgctgaacagagcctgcaggctgccattaaaactctgcgaaaaagtatcggccggcaacagttttacgtgcaggtaagcggcactgagtacgaggtagcccagcgaccggcaaaggcactggaggggcaaggggcatgtggggccgggcaggtgttgcaggatagcaaatgtgtggcttgtggccctggaactcacttcggcggggagctcgggcaatgtgtgagttgcatgcctgggacataccaggatatggaaggacaactgtcgtgcaccccttgtccatctagtgacggactcggcctgccaggggcccgcaatgtaagcgagtgcggcgggcagtgcagccctggattctttagtgcggacggttttaagccgtgccaagcctgcccagttggaacgtaccaacctgaaccaggcagaaccgggtgctttccatgcggaggcggcctgctgacaaagcacgaagggaccacatcattccaggattgtgaagctaaggtgcattgctccccaggacaccactataacacgaccactcaccgttgcatacgttgccccgtaggcacataccagccagagtttggccagaatcattgtattacctgtccaggtaacaccagtactgatttcgatgggtctacaaacgtgacacactgtaaaaatcagcattgtggcggagaattgggtgactacaccgggtacatcgagagcccaaattaccctggcgattaccccgcaaatgctgaatgtgtttggcacatagctcccccacccaaacgacgcatcctgatcgtcgtccccgaaattttcctgcccatcgaggatgaatgtggagatgtgttggtcatgaggaagtcagccagccctaccagcattacaacctacgagacctgccagacttatgagagacccattgcttttacctcccgctctcgaaaactctggatccaattcaagagtaatgaaggaaacagcggaaagggcttccaggtgccctacgtcacatatgacgaagactaccagcagttgatcgaagacatcgtgagggatgggagactctacgcatctgaaaatcatcaggagattcttaaggacaagaagcttatcaaggccctgttcgatgtgttagcgcaccctcagaactattttaaatacactgcccaggagtccaaggagatgttcccgcgcagctttataaagctgttgaggtctaaggtgagtcgatttttaagaccttataaatag

SEQ ID NO: 205134 - DNA, 1092 bp, Artificial Sequence
  Description of Artificial Sequence: Synthetic coding sequence
atgggcgccgccgccgtgcggtggcacctgtgcgtgctgctggccctcgggaccaggggccgcctggccgggggtagcggactgcctggctcagttgacgtggacgagtgcagcgaaggtactgatgactgtcatatcgatgcgatctgtcaaaacacccctaaatcctataagtgtctctgcaagccgggatacaagggagagggaaagcaatgcgaagacatcgatgaatgcgagaatgattactataacggcgggtgcgtccatgagtgtatcaatatcccaggcaactaccgctgtacttgctttgacggttttatgctggcacacgatggccataattgtctcgatgtagatgagtgtcaggacaacaacggcggttgccagcagatatgtgtgaacgccatgggctcctatgaatgccagtgtcacagtgggtttttcttatcggacaaccagcacacctgtatacatcggagcaacgaagggatgaactgcatgaacaaggaccacggatgcgcacacatctgcagagaaaccccgaagggtggagtggcttgcgattgtaggcccggctttgacttggctcagaaccaaaaagactgcactcttacctgcaactatggtaatggcgggtgccagcattcttgcgaggataccgatactggccctacgtgcggatgccatcagaagtatgctctccactccgacgggcgcacctgcatcgagacctgcgccgtcaacaacggtggctgcgatcgtacctgcaaggataccgcaaccggcgtgagatgcagttgccccgttggttttacactgcagccagatggtaagacgtgtaaagatattaacgaatgtttggttaataatggaggttgcgatcacttctgtcggaatacagtcggcagcttcgagtgcggttgcagaaaaggctataaacttctgaccgacgagcggacctgccaggatatagacgagtgctcctttgaacgcacctgcgatcatatctgtatcaattcgcccgggtctttccagtgtctgataaagttgctcaggagtaaagtgagtcggtttctgcgcccttacaagtag

SEQ ID NO: 205135 - DNA, 528 bp, Artificial Sequence
  Description of Artificial Sequence: Synthetic coding sequence
tgacgggagacccccaagggcggcgtggcctgcgactgccggcccgggttcgacctggcccaaaatcaaaaagactgcaccctgacatgtaactacggtaacggcggatgtcagcatagttgcgaagatacagacaccggtcctacttgcggatgtcatcagaagtacgccctgcatagcgacggtcgcacctgtattgagaaagacgaggctgcaatagaacggtcccaattcaatgccaccagcgtcgccgacgtggataaaagggtcaagcgaaggctactgatggaaacatgtgctgtgaacaacggtggctgcgaccggacctgtaaggatactgcgaccggtgttcgttgctcttgtcccgtcgggttcaccttacagcccgacggtaagacatgtaaagacattaatgaatgtctggtgaacaacgggggatgcgaccatttctgtaggaatactgtgggttctttcgaatgtgggtgcaggaaagggtacaaattgctcaccgacgagcgtacatgttag

SEQ ID NO: 205136 - DNA, 3000 bp, Artificial Sequence
  Description of Artificial Sequence: Synthetic coding sequence
atgggcgtggccggccggaaccggcccggcgccgcctgggccgtgctgctgttgctgcttctgctgccaccactactgctactagctggcgcggtcccgcccgggaggggcagagctgcaggtcctcaggaggatgtcgatgagtgcgcccaggggctggatgattgccatgcggacgccctgtgtcaaaatacccctacatcgtacaaatgttcatgcaaaccaggttatcaaggagagggacgccagtgcgaggatatcgacgagtgcggtaacgagctgaatggcgggtgtgtgcacgactgcctcaatataccggggaattatagatgcacttgctttgacgggttcatgctggcccatgatggtcataactgcctagacgtggatgaatgcctggagaataacggcggctgccagcacacatgtgtcaatgttatgggcagctatgaatgctgttgtaaagaaggcttctttctttcggataaccaacacacatgtattcacaggtctgaagaggggctttcctgtatgaacaaagatcacggatgttctcacatttgcaaagaagctcctaggggatctgttgcatgcgagtgtcgacccgggtttgaactcgctaaaaaccagcgagactgcatattaacgtgcaaccacggcaatggcgggtgtcagcactcttgtgatgacactgccgacggaccggaatgttcctgtcaccctcagtacaaaatgcatacagatgggcggtcatgcctcgagcgcgaggacaccgtcttagaggtgaccgagtctaacacgacgagcgtggtagacggcgacaagcgagtcaaaagacgcctcctgatggaaacctgtgctgtgaacaacgggggatgcgatcgtacctgcaaggacaccagcaccggggtgcattgctcctgcccagtaggctttactttgcagctggatggaaaaacgtgcaaagacatcgatgagtgccaaacacggaacggaggatgcgaccatttttgtaaaaatatcgtcggtagcttcgactgcgggtgtaagaaaggatttaagctgctgaccgatgagaagagttgtcaggatgtcgacgagtgttcactggacaggacatgcgatcacagctgcatcaatcaccccggtacgtttgcatgtgcctgtaatagaggatacactttgtatgggtttacacattgcggggatactaacgagtgtagtataaacaacggtggctgtcaacaggtgtgcgtgaacacggtgggaagctatgaatgccagtgccaccctggatacaaactacattggaacaaaaaggactgtgttgaggtaaaggggcttctgcctacttcggttagcccgcgagtgtctctccactgtggtaagagcggcggaggcgatggctgcttcctccggtgtcatagcggaattcacctgtcctcggacgtcaccactattcggacaagcgtgacgttcaaacttaatgagggcaaatgctccctgaaaaatgcagaacttttccccgagggcttaaggccggctctgccagagaagcacagtagtgtcaaggaaagttttagatatgttaacctcacttgttctagtggaaagcaggtaccaggagcacccggccggccaagcactccgaaagagatgtttatcaccgtggagttcgaactggagacaaaccagaaggaggtcactgcatcctgcgatctctcttgcatcgtgaagagaactgagaaaaggcttcgaaaagccattaggacactcagaaaagcggtgcaccgcgaacaattccacctccagctcagtggcatgaaccttgatgtggccaaaaagcctccacggacctcagagaggcaggctgagagctgtggcgtgggccagggtcacgccgagaatcagtgtgtgtcatgtagagccgggacttactatgacggcgctcgagagagatgcatactctgccccaatggcactttccagaacgaggagggacaaatgacatgcgagccctgtcctcgacctggaaacagtggggcactgaagacgcctgaagcatggaatatgagcgagtgcggcggcctgtgccagccaggcgaatacagtgcagacggattcgcgccctgccatttatgcgccctcggaacgtttcagcccgaggcggggaggaccagctgcttcccctgcgggggagggttagctaccaaacatcagggagcaacctccttccaggactgcgagacccgcgtgcagtgctcgccgggtcacttttataacacgacaacacacagatgcattcgatgcccggtgggcacataccagcccgagttcgggaagaacaattgcgtgagttgtccgggaaataccactaccgacttcgacgggagcacgaatatcacccagtgtaagaaccgacgttgtggtggtgagctgggagacttcaccggttacattgagagtcctaactaccctggtaattaccccgcgaacactgaatgtacatggaccatcaatccgccacccaaacggcggatcctgattgtggttccggaaatctttttgccaatcgaagatgactgtggtgactacctggtgatgagaaaaacgagctccagtaatagtgtgactacatatgaaacttgtcaaacatatgagcggcctattgctttcacaagccggagtaagaagttatggatccagtttaagtccaatgagggtaacagcgcccgcggtttccaggtcccctacgtgacctacgatgaggactaccaagagctgattgaagacatcgtgagagatggacgactttacgctagtgaaaaccatcaagagattcttaaggataagaagctgatcaaagccctttttgatgtcctggcccacccacagaactacttcaagtataccgcccaggagtcacgcgaaatgtttccaaggtcgttcatcaggttactgcgtagcaaggtgagccggtttttgcggccttacaaatag

SEQ ID NO: 205137 - DNA, 2424 bp, Artificial Sequence
  Description of Artificial Sequence: Synthetic coding sequence
atgggcgtggccggccggaaccggcccggcgccgcctgggccgtgttgctcttgctgctcttactccctcctctactgctcctggcaggcgccgtaccacctggaagaggtcgggccgctggaccccaagaagacgtggatgaatgcgcacagggtttggacgattgccacgcggacgcattgtgtcaaaacactcctacttcctacaaatgttcctgtaagccgggatatcagggcgagggtaggcagtgtgaggatatagatgagtgtggaaatgagctcaacgggggctgcgtgcatgactgtctgaatatccccggcaattataggtgtacctgtttcgacggctttatgctggcgcatgatggccataactgtcttgacgtagacgagtgtttagaaaataatggcggctgccagcatacatgcgtaaacgtcatgggcagctatgagtgttgctgtaaggagggatttttcctgtccgataatcagcacacgtgtatacatcgctctgaagagggtcttagttgcatgaacaaagatcatgggtgttcacatatctgcaaggaggcacctaggggtagcgtggcctgcgagtgtaggcctgggtttgagctagcaaagaatcagcgcgactgcatcctgacctgcaatcatgggaacggcggatgccagcatagctgtgacgataccgcagacggccctgaatgctcctgtcacccacaatataagatgcacactgatggacgatcctgtctggagcgggaagacaccgtcttagaggtgactgagtcaaatactacatctgtcgtggacggtgacaagcgtgtcaaacgtcgccttctgatggaaacctgcgccgtgaacaacggcgggtgtgaccgcacatgcaaagatacatccaccggggttcattgctcatgtcctgttggcttcacactgcagctagatggcaaaacttgtaaagacattgacgagtgccagacaaggaatggtggatgcgaccatttctgcaagaatattgtggggagctttgactgcggctgcaagaaggggttcaagttactgacagacgaaaaaagttgtcaagatgtagatgagtgctcccttgacagaacttgtgaccatagctgcatcaatcatccaggaacctttgcctgcgcatgcaaccgggggtatacactgtacggtttcacccattgtggggacactaatgaatgtagtattaataacggcggatgccagcaggtatgcgtgaataccgtagggagctatgagtgccagtgccatccaggatacaagttacattggaacaaaaaagattgtgtggcctcatgcgatctgagttgcattgttaaaaggacggaaaagcgactgaggaaagcaataaggactctgcggaaggccgttcaccgggagcagtttcacctgcagctctcaggcatgaatttagacgtcgccaagaagccaccaaggacatccgagcgccaggccgagtcctgtggggtgggccagggacacgccgagaatcagtgtgtaagctgtagagctggcacctattatgacggagcgagggagcgctgtatactgtgccccaacggcacatttcagaatgaggagggtcagatgacttgtgagccatgcccaaggccggggaactcaggtgccctcaaaactcctgaagcctggaacatgtccgaatgcggggggctatgccagcctggtgaatacagcgccgacggattcgctccctgccatctgtgtgccctgggcacttttcagccagaggctggcagaaccagctgttttccctgcggcggtggactcgctaccaaacatcagggggctactagcttccaggattgtgaaaccagggtgcaatgttcgcctggccacttctacaatacaaccactcaccgttgtattagatgtccagtgggtacataccagccagaatttggcaagaacaattgtgtatcttgccccggaaacactactacagacttcgacggatcaaccaatatcacgcaatgcaaaacatccagcaatagcgtaacgacatacgaaacctgtcagacctacgagaggccgatagcttttacgtctcggagcaaaaagctgtggatccagttcaagtcaaacgaaggaaatagtgcaagaggatttcaggtcccatacgtgacttacgatgaagactatcaagaattaatcgaggatattgtcagagacggaagactttacgcttctgagaatcaccaggagattctaaaggataagaaattgatcaaagcactcttcgatgttctcgcccacccccagaattatttcaaatacaccgcccaggagtcccgtgagatgtttcctaggagctttattaggttgctgaggagcaaggtctctcgattcctcagaccttacaagtag

SEQ ID NO: 205138 - DNA, 3087 bp, Artificial Sequence
  Description of Artificial Sequence: Synthetic coding sequence
atgggcgtggccggccggaaccggcccggcgccgcctgggccgtgctactgttgttgctactgctcccccctctgctcttactggctggggcggttccccccggacggggacgggccgcaggtccccaggaggatgttgacgagtgcgcacagggactggatgactgccacgccgacgccctttgtcagaacacacccacatcctacaagtgctcgtgcaaaccaggctatcagggggaaggaagacagtgtgaggacatcgacgagtgtgggaacgagctcaacggcgggtgcgtgcatgattgtctgaatattcccggtaattacagatgcacatgcttcgacggcttcatgctcgcccacgatgggcacaattgcctcgacgtcgacgagtgcctagaaaataacggagggtgtcaacatacgtgcgttaatgtgatggggtcttacgagtgctgttgcaaagaagggtttttcctttcggacaaccagcatacatgcattcatcgatccgaagaggggctgtcctgtatgaataaggaccacggttgtagccatatctgcaaagaagctcctcggggttcagtggcctgcgaatgcaggcccggctttgaactagccaaaaaccagagagactgtatactgacttgtaaccacggcaacggggggtgccagcatagttgcgatgataccgctgacggccccgaatgctcttgccaccctcaatacaagatgcacactgacgggagatcttgcctcgaaagggaagatacagtcttagaagtcacagagtccaacaccacatccgtggtagatggggacaaacgtgtgaaacggaggctcctcatggaaacgtgcgccgttaacaatggcggatgtgaccggacgtgtaaagatacttctactggagtccattgctcttgccccgtcggatttacactgcagctcgatggaaagacctgcaaggacattgacgagtgccagacgcggaatggagggtgcgatcacttttgtaagaatatcgtaggcagcttcgattgcggatgcaaaaaggggtttaagctcttaaccgacgaaaagagttgtcaagacgtggacgaatgctccctagatagaacatgcgatcattcatgcatcaaccaccctgggacttttgcctgtgcttgtaaccgtggctatactctgtatggctttacccactgtggcgatacaaacgagtgttctatcaataatgggggttgccagcaggtttgtgtcaacacagttggctcgtacgaatgccaatgccatccaggctacaaattgcactggaacaagaaggactgtgtcgaggtaaagggactcctgccaacgtctgtatcgccgcgtgtgtcactccactgcggcaagtccggggggggagatgggtgctttctgaggtgtcacagcgggatacacctctccagcggtttacagggcgcgtactcagtgacgtgcggttcatcttctccactgcgaaacaagcagcagaagagcaacgatagtgcttttggagatgtgaccacaatccgaacttccgtgacattcaagttgaacgaagggaaatgctctcttaagaacgcagagctatttccggaaggcctgcgccccgccctgcctgaaaagcacagtagtgtcaaagagagctttagatatgtgaatctcacctgctccagtggaaagcaagtgcccggcgcccctgggagaccctctacgcctaaagagatgttcattactgtggagtttgaattggaaaccaaccagaaggaggtgacagcttcctgtgacttgagttgcattgtcaaacgtactgaaaagcggctgcgaaaagctattcgaaccctgcggaaagctgttcaccgagaacagttccacctccaactgtccggcatgaatctagacgtggcgaagaagcctccccgcacaagcgaacgacaagcagagtcttgtggggtgggtcaggggcacgcggagaatcagtgtgtctcttgccgcgctggaacctattatgatggcgccagggagaggtgcattctctgccctaacggcacctttcagaatgaggagggccagatgacgtgtgaaccttgtccgcggcccggcaattcaggagccctgaaaacccctgaggcctggaatatgagtgagtgcgggggcctctgtcagcccggagagtattccgcggatgggtttgctccctgtcacttatgtgccctgggaacgttccagcctgaagccgggcggacatcatgctttccttgcggagggggcctcgccactaaacatcagggtgccacatcatttcaggattgcgagacccgcgtacagtgttccccgggccatttttacaataccacaactcatagatgtattcggtgcccagtggggacctaccagccagagtttggtaagaataattgcgttagctgcccaggcaataccaccacggattttgacggcagcacaaatatcacacaatgcaagaaccggcgttgcggtggcgagcttggcgactttactggttatatcgagtcccccaattatcctgggaattatcctgcaaatactgaatgcacgtggacaataaatccacctccgaaaagacgcatcctcatcgttgtgcctgagattttccttcccatcgaggacgattgcggagattaccttgtcatgcggaagacctcctccagtaactcagtgaccacctacgagacctgccagacatatgagcgccctattgcgtttactagcagaagtaagaaactgtggattcagtttaaatcaaacgagggtaacagtgcccgcgggttccaagtgccatacgtgacctatgacgaggattaccaagagctgatcgaagacattgtccgtgacggcagactttatgcatccgagaaccatcaagaaatactgaaagacaagaaactcattaaagcattatttgacgtcctcgcccacccccagaattactttaagtacactgctcaggaatctagggagatgttccctagaagcttcatcagattgctcaggagtaaggtgagccgattcctccggccatacaagtag

SEQ ID NO: 205139 - DNA, 411 bp, Artificial Sequence
  Description of Artificial Sequence: Synthetic coding sequence
atggtgctgctggagagcgagcagttcctgaccgagctgacccggcttttccagaagtgccggacaagcggcagtgtatacataacactcaaaaagtacgacggaagaactaagcccattccgaaaaagggcacagttgaggggttcgagccggcagacaacaaatgcctcctgagggcgaccgatggcaaaaaaaaaatcagtactgtcgtttcctccaaggaggtgaacaagttccaaatggcttattctaacctgttaagagcgaatatggatgggctcaaaaaaagagataaaaagaacaaaactaaaaagactaaggcagcagctgccgcagccgccgcagctccggccgctgccgccactgccccaacaaccgctgctacaactgcagcgaccgccgcacagtag

SEQ ID NO: 205140 - DNA, 333 bp, Artificial Sequence
  Description of Artificial Sequence: Synthetic coding sequence
atggcctgcgccgccgcccggagccccgccgaccaggaccggttcatttgcatctaccccgcctacctgaataataagaaaacaattgcggagggtagacggattcccatctcaaaagccgtggaaaatccgaccgctactgaaatacaggatgtctgcagtgccgtcggactgaatgtatttctggagaagaataagatgtacagcagagagtggaaccgagacgttcagtacagaggcagagtgagggtgcaactgaaacaggaagacggcagcctgtgcctcgtgcagtttccatcccattatactttaagcctgacctccggatcttag

SEQ ID NO: 205141 - DNA, 435 bp, Artificial Sequence
  Description of Artificial Sequence: Synthetic coding sequence
atggcctgcgccgccgcccggagccccgccgaccaggaccggttcatctgcatatatccagcctacctcaataacaaaaaaactattgcagagggtcgccgaatccctatctcaaaggcagtcgagaaccccaccgccaccgaaatccaggacgtatgttctgctgtcggactgaacgtctttttggaaaaaaacaaaatgtacagccgcgagtggaaccgggacgtccagtaccggggtagggtcagggtgcagctgaagcaggaggatggcagtctatgccttgtacagtttccctcaagaaaaagtgtcatgttatatgccgccgaaatgatcccgaagctgaagacgaggactcagaagactggcggcgccgaccaatcactccaacaaggagagggttctaagaaaggcaagggtaaaaagaagaagtag

SEQ ID NO: 205142 - DNA, 237 bp, Artificial Sequence
  Description of Artificial Sequence: Synthetic coding sequence
atggcctgcgccgccgcccggagccccgccgaccaggaccggctgctcaagattttgcaactgcagcggtttaaaatgtacgtgcagcagctcgatttaacctatttcctgcgtaaaatcaagtgtactctggagaatgggatcgtgatgtctaatactgaggccgaatcaggtagctcttccaatagaaagatgggggcatctgccctgtatagtagtcatcatgtcagccagtag

SEQ ID NO: 205143 - DNA, 639 bp, Artificial Sequence
  Description of Artificial Sequence: Synthetic coding sequence
atggaggccaagaccctgggcaccgtgaccccccggaagcccgtgctgagcgtaagcgcacgaaaaatcaaggacaacgccgctgactggcacaatctgatcctgaaatgggagaccctcaatgacgcaggatttacgacagctaataatatcgcaaacctgaaaattagccttcttaacaaggacaaaattgagctggattcctcatccccagcaagtaaggagaacgaagagaaggtctgcctggagtacaacgaggaactcgagaagttgtgtgaggaattacaggccaccttggatggactgactaaaatccaggtgaaaatggaaaagctctcatccacgaccaaaggaatatgtgagctcgagaactatcactacggagaggagagtaagagacctccactatttcacacatggcctacgacccacttctacgaggtttctcataagttgttagaaatgtaccgcaaggagttgctgttgaaaagaacggtggccaaggaactcgcccacactggcgacccagatttgacccttagctacctgtctatgtggcttcaccaaccgtatgtcgagtcagatagcaggctgcacttggagagtatgctgctcgaaacaggtcacagggccctgtag

SEQ ID NO: 205144 - DNA, 1368 bp, Artificial Sequence
  Description of Artificial Sequence: Synthetic coding sequence
atgccccccctgagcatgaagcggagcgccatcgacctggaggagatggcttcaggcctgaataagaggaagatgatccagcatgcggtgttcaaggaattagtgaagctagtagacccaggtgtaaaagcttggactcccacaaagggcaagcaaaacgtcataatgttcgtcggcctgcagggatctggcaaaacaactacctgttcaaaactcgcctactattatcagcggaagggttggaaaacctgcctgatttgtgctgatacattccgggcaggggccttcgatcagttgaagcaaaacgccactaaggcaaggatccctttctacgggtcttataccgagatggatcccgttattatagccagtgaaggggtggagaagttcaagaacgaaaacttcgaaattatcatcgtggatacttcgggaagacacaagcaggaagactcattattcgaggaaatgcttcaggtagcaaatgcaatccagcccgataacatcgtgtacgtcatggatgccagcatcgggcaggcctgtgaggctcaggccaaagcctttaaggacaaggtggatgtggcgtcggtgatcgtaacgaagcttgacggacatgcaaaaggcggaggagctctgtctgccgtagccgcaacaaaaagccccatcatttttatcgggactggtgagcatatcgatgatttcgagccatttaaaacacaaccctttatctccaaactgcttgggatgggtgatatcgagggtcttatcgataaggtgaatgagttgaagttggacgataatgaggcattgatagaaaaactaaaacacggtcagttcacgctgcgggatatgtacgagcagtttcaaaatattatgaagatgggcccctttagccagatcttgggcatgattccaggcttcggaacagattttatgagcaaaggcaatgaacaggaatctatggctcgcctaaagaaattgatgacaattatggactccatgaatgatcaggaacttgatagcaccgatggcgctaaggtcttctctaaacagcccggtcgcatacaacgagtggcccgtggctccggcgtgtcaactagggatgtgcaggaactcctgacacaatacacaaaattcgcccagatggttaagaagatggggggcataaaaggactgttcaaaggaggtgacatgagtaaaaacgtgtcccagagccagatggcaaaactgaaccagcagatggctaagatgatggacccaagggtcctgcatcacatgggtggaatggcaggcctgcaaagcatgatgagacagttccagcaaggcgccgctggaaacatgaagggaatgatgggctttaacaatatgtag

SEQ ID NO: 205145 - DNA, 135 bp, Artificial Sequence
  Description of Artificial Sequence: Synthetic coding sequence
atggtgctggccgacctgggccggaagatcaccagcgccctgcggagcctgagcaacgcaacaataatcaacgaagaagtgctgaatgctatgctgaaagaggtgtgcacagccttgctcgaggccgacgtctag

SEQ ID NO: 205146 - DNA, 225 bp, Artificial Sequence
  Description of Artificial Sequence: Synthetic coding sequence
atggtgctggccgacctgggccggaagatcaccagcgccctgcggagcctgagcaacgctaccattattaatgaggaggtccttaacgccatgttaaaagaggtgtgcactgctctgctggaggccgatgtgaacattaagcttgtgaaacagttgcgagaaaacgtgaagagtgccattgatcttgaggaaatggcttcgggcctaaataaacggaagatgtag

SEQ ID NO: 205147 - DNA, 1515 bp, Artificial Sequence
  Description of Artificial Sequence: Synthetic coding sequence
atggtgctggccgacctgggccggaagatcaccagcgccctgcggtctctaagcaatgccaccataataaatgaggaagtcctgaacgccatgcttaaggaggtgtgtactgcactcttagaagccgacgtcaatatcaagcttgttaaacaactccgcgagaacgtaaaaagcgccattgatctcgaagagatggcctcagggcttaataagcggaagatgatccaacatgctgtattcaaggagctagtaaaactggtcgatcctggtgtcaaagcttggacgcctactaagggcaaacagaacgtgattatgtttgtgggcctgcagggcagtggaaagaccaccacctgttcaaaattggcttactattaccagaggaagggttggaaaacctgtctcatatgcgctgatactttccgggctggcgcattcgatcaactaaagcagaacgccactaaggcccggatccctttttatgggagctacaccgaaatggacccagtaatcattgcctctgagggagtggaaaaatttaagaacgagaacttcgagatcatcatcgtagacacgagcggcaggcacaaacaagaggatagtctcttcgaggagatgctgcaggtggcaaacgcgatacagcctgacaatatcgtgtacgtcatggacgcgagtatcggccaggcgtgtgaggctcaggctaaagcttttaaggataaagtggacgtggcgtccgtgatagtgactaaattagatgggcacgccaagggaggcggcgccctgagcgctgtcgccgctaccaagagtcctatcatcttcataggcacgggtgagcatattgacgatttcgagccttttaagacacagccattcatctctaaactcctcggcatgggagacatagagggcctcatcgataaggtgaacgagctcaagctggatgataacgaagccctgatcgagaaactgaaacatggccagtttacactcagggacatgtacgaacagtttcagaacattatgaagatgggtcctttctcacaaatactgggcatgatacccggattcggtaccgacttcatgtccaagggaaacgaacaggagagcatggcccgtctgaagaaactgatgacgataatggacagtatgaacgatcaggagctggacagcactgacggagccaaagtgttcagcaagcagccaggccgtattcagagagtggctcgcgggtctggagtgtctacacgggacgtccaggagctgctgacacagtatactaagtttgctcaaatggtgaaaaagatgggtgggattaagggactgttcaagggcggagacatgtctaagaatgtctcgcaatcccagatggctaaactgaatcagcagatggcaaaaatgatggatccccgggtccttcatcatatgggcgggatggcaggtctgcaatcgatgatgcggcagtttcagcagggagcagcaggcaatatgaagggaatgatgggcttcaacaacatgtag

SEQ ID NO: 205148 - DNA, 1791 bp, Artificial Sequence
  Description of Artificial Sequence: Synthetic coding sequence
atggccgccgagaagcaggtgcccggcggcggcggcggcggcggcagcggaggagggggaggatctgggggtggtggatccggagggggtagaggggcgggaggggaggagaacaaggaaaatgagcgccctagcgccggtagcaaggcaaacaaagaatttggcgactctttatccctggagatcttgcaaattataaaggaaagccaacaacagcacggcctgaggcacggggactttcagcgctacaggggatattgcagtcgcaggcagcggcgcctacggaagactctaaattttaaaatgggtaaccgtcacaagttcacaggcaaaaaggtaactgaggagctgctgaccgacaacagatatcttctgctggtgctgatggacgccgaacgcgcatggtcctacgctatgcagctgaagcaggaagccaacaccgaaccacgcaagcggttccacctactgagccggttacggaaggccgtaaaacatgcagaagagctcgagaggttgtgtgagagcaaccgagtagatgccaagactaaattggaggctcaggcctataccgcatatctgtctggcatgctcagattcgaacaccaagaatggaaagccgctatcgaggcgtttaataagtgcaagaccatatatgagaagctagcctccgctttcacagaagaacaagctgtgctttataatcagagagtggaggaaataagccctaatatccggtattgtgcctacaacattggcgagacccgcgcgaagcaggcagccaccatgagcgaggttgaatggcgtggaagaacagtccccgtgaagatagataaagttaggatctttttgctcggtttggcggataacgaagcagccatcgtgcaggccgaatcagaggagactaaggagcgactgtttgagtccatgctgtctgaatgtcgcgacgcaattcaggttgtgcgagaagagctcaagcctgaccagaagcagcgcgactatatcctggagggtgaacctggtaaggtatcaaacttgcagtatctgcattcgtacctgacttacatcaaactttccactgcaattaagagaaacgaaaacatggcaaaagggctgcagagagccttgttgcaacaacagccagaggatgattcaaagcgctctccccggccccaggatctgatcagactgtatgatatcattctgcagaacttagtggagctgttgcaactccctggtttggaggaggacaaagctttccagaaagaaatcggactgaagacgctcgtcttcaaagcatacagatgcttcttcatagctcagtcatacgtgctagtgaagaagtggagcgaggcccttgtcctctatgacagagtgctcaaatatgccaatgaagtcaacagtgatgcgggcgctttcaaaaatagcctcaaagaccttcccgacgtccaagaactgatcactcaggtgcgctcagaaaaatgcagcctgcaggccgcagccatccttgatgcgaatgatgcacaccagacggagacgtcaagcagccaagtgaaggacaataaacccctggtggaaagatttgagactttctgtttggatcccagcctggtaaccaaacaggcaaacttagtacacttcccacccgggtttcagcccatcccttgcaaacctctcttttttgatttggccctgaaccatgtagcctttccccctctggaggataagttagaacagaagacaaaatccgggctcaccggatacattaagggcatatttggcttccgctcttag

SEQ ID NO: 205149 - DNA, 1884 bp, Artificial Sequence
  Description of Artificial Sequence: Synthetic coding sequence
atggccgccgagaagcaggtgcccggcggcggcggcggcggcggctccggtggggggggaggtagcggcggtgggggcagcggtggtggtcgcggagctgggggtgaggagaataaagagaacgagcgcccaagtgctggctccaaagctaacaaggaattcggagatagtctttctctcgagatcctacaaatcataaaggagagtcagcagcagcatgggttaagacacggagactttcagaggtacaggggatactgttcccgtagacagcggcgccttcggaagacactgaacttcaagatgggaaatcggcataaattcaccggcaaaaaagtgaccgaggaactgttgaccgacaatcggtatctgctgctagtacttatggacgcagaaagagcgtggagttacgcaatgcagctgaagcaggaggcgaataccgagcccaggaagagattccacctcttgtcaagactcagaaaagcagtgaaacacgcagaggagctggagcgcctatgcgagagtaacagagtcgatgctaaaactaaactggaggcccaggcatacaccgcatatctctccggaatgctccggttcgaacaccaggaatggaaggctgctatcgaggcctttaacaaatgcaaaactatatatgaaaaactggcatcagctttcacggaggagcaggcagtgctctacaatcagcgcgtagaagaaatctcccctaatatccgttactgcgcatataatattggggatcaaagcgccattaatgaactgatgcagatgcggctgcgctccggcggcacagagggcctgttagctgagaaacttgaggctttaatcactcagactcgcgctaagcaggccgctacaatgtctgaagtggagtggcgcggcaggaccgtgcccgtgaagatcgacaaggtgcggatattcctgctgggactcgctgacaacgaggccgcgatagtgcaggccgagtcggaggaaacaaaggagcgtctttttgagtcaatgctctccgaatgtcgcgacgcaatccaggtcgtaagagaggagcttaaacctgaccagaagcaacgggactatattctggaaggtgagccagggaaagtgtccaacctccagtacctccatagctatctgacttacatcaaacttagcaccgcaattaagcgcaacgagaatatggctaagggactgcagcgcgcccttctccagcagcagcctgaagatgattcaaagaggtcgccacgccctcaggacctgattcgcctctatgatattattttacaaaacctggtggaactcctgcagcttcctggactggaagaggacaaggcctttcaaaaagagatcgggctcaagaccctggtctttaaggcttatcgctgttttttcatagctcagtcttacgttctcgtgaagaagtggtccgaagcactggtgctttatgatcgagtgctgaagtatgcaaacgaggttaatagcgacgctggcgcttttaaaaatagcctaaaagatctcccggacgtccaggaactgattacccaggtgagaagtgagaaatgctctctacaggctgccgctatcctcgatgccaatgatgcccaccagacggaaactagctcatcccaggtgaaggataacaagcccctggttgagagattcgaaacgttctgcctagaccctagcttagttactaagcaagcaaatttagtccatttccctcccggctttcagccaatcccttgcaagccactcttctttgacttggcccttaaccatgtggcctttccccccttagaagacaagctcgagcagaaaacaaagagtgggctgactgggtatatcaagggcatctttgggttccggtcgtag

SEQ ID NO: 205150 - DNA, 1581 bp, Artificial Sequence
  Description of Artificial Sequence: Synthetic coding sequence
atgggcaaccggcacaagttcaccggcaagaaggtgaccgaggagctgctgaccgataatcgatacttgttgctggtgctaatggatgctgaaagagcatggtcttacgccatgcagctaaaacaggaggccaacacagaacctcggaagcggttccatctactctccaggctgcgcaaggcagtgaagcacgcagaagagttagaacgcctctgcgaatctaacagagtggatgccaagaccaagctggaggcccaggcttacacagcttacctttccgggatgctaaggttcgagcatcaggaatggaaggcagccatcgaggcctttaacaaatgcaaaacaatctatgagaagttggccagcgcttttaccgaggagcaggccgttctatataaccagcgcgttgaagaaatatctccaaatatccggtattgcgcctacaacatcggggatcagagtgctatcaacgaattgatgcagatgaggctgcggtccgggggcactgagggattgctggccgagaaattggaggccttgatcactcagacccgcgctaagcaggcagcaaccatgtctgaggtcgaatggagaggtagaaccgttccggtcaaaattgataaggtgaggatcttccttctggggctggcagacaacgaagccgcaatagtccaggccgagagcgaggaaaccaaggaaaggcttttcgagtcaatgttgtcggaatgccgagacgcgattcaagtggtcagggaggagctgaaacccgaccagaaacagagggactatatcctcgaaggagaacctggaaaagtgagcaacctccaatatcttcattcgtacctgacatacatcaagctcagcacggccatcaagcgtaacgagaatatggcaaaagggctgcagagggcgctgctacagcagcagcccgaagatgattcaaagaggtctccccggcctcaggatctaattcggctatatgacataattctgcagaacttggtcgagctcttacagctccccggactcgaagaagataaggcttttcagaaagagatcggtctcaagactctggttttcaaggcctatagatgtttcttcatagcccaaagctacgtgcttgttaaaaagtggagtgaagcgctggtgctgtacgaccgcgtgctgaagtacgctaatgaggtgaatagcgacgcaggcgcctttaaaaatagcctgaaggatctccctgacgtgcaggagctgataacacaagttcggtccgagaaatgttcgctccaggccgcagccatactcgacgccaacgacgcccaccagacagagaccagctcctcacaagtgaaggacaataaacctctcgtggagcggtttgagactttctgcctcgacccttccctcgtgacaaagcaggctaaccttgtacatttcccccctggttttcagccaatcccctgcaaacctctatttttcgatcttgctttgaatcacgtcgcatttcctcccctggaggataagctggagcaaaaaacaaaaagtggcctcaccggctatatcaaaggcatattcggctttaggagttag

SEQ ID NO: 205151 - DNA, 984 bp, Artificial Sequence
  Description of Artificial Sequence: Synthetic coding sequence
atgcagatgcggctgcggagcggcggcaccgagggcctgctggccgagaaactggaagcccttattactcaaacacgagccaagcaggccgcaaccatgtccgaagtagagtggcgtggcagaacagtccctgttaaaattgataaggtgagaatattcctgctgggattggccgataacgaggccgcgattgttcaggctgaaagcgaggagaccaaggagcgattatttgaatctatgctttccgaatgcagagacgccattcaggtggttcgcgaagagctgaaacccgatcagaaacaacgtgactacatcctggagggcgagcctgggaaggtgtctaacctccagtacctgcacagctacttaacctacatcaagcttagcaccgcaatcaagagaaatgaaaacatggccaagggcctgcagcgtgccctcttgcagcagcagccagaagatgactccaagaggagtccacgaccgcaggacctcatccgcctctatgatattatccttcagaaccttgtggaactgctgcaactacccggattagaggaagacaaagcctttcagaaagagataggactgaaaactctagtgtttaaagcttaccggtgcttcttcatagcccagagttacgtactcgtgaagaaatggagcgaagctctggtactttatgatcgcgtgcttaagtacgccaatgaagttaattccgatgccggagctttcaaaaactctcttaaagatctgcccgacgtccaggagctcattactcaagtccggtccgaaaaatgcagcctccaggccgccgccatactcgacgccaatgacgcacatcagaccgagaccagtagctcccaggttaaagacaacaagcctctggtggagcgtttcgagtctacgccaggtactgatggcgcccttaagcgtttcgtgatgctcctccaataccacggatttgagatgaactcctccttgctgtag

SEQ ID NO: 205152 - DNA, 1770 bp, Artificial Sequence
  Description of Artificial Sequence: Synthetic coding sequence
atggccgccgagaagcaggtgcccggcggcggcggcggcggcggctctggtgggggaggaggcagcggcgggggcggcagcggtggcggaaggggtgcagggggcgaggaaaataaagaaaatgagagaccctctgcagggtccaaggccaacaaggagttcggagattctctgagcctcgagatactgcaaataatcaaggagagccagcagcagcacggcctcaggcacggcgacttccaacgctatcgttacctactgctcgtgctcatggacgccgaaagggcttggtcatatgccatgcagctcaagcaggaggccaataccgaacccaggaagcgcttccatctgctatccagattacgcaaggccgtcaagcacgcagaagaacttgagcggctatgtgagtcaaacagggtggatgctaagaccaaactggaggcccaggcctataccgcttatttgtccggcatgcttcgcttcgagcatcaggagtggaaagcagctatagaagcttttaacaagtgtaaaactatttacgaaaagcttgcctcagctttcacagaggagcaggctgttctctacaaccagcgcgtggaagagataagtccaaatataagatactgtgcatacaacatcggagaccagagtgccatcaacgagcttatgcagatgcgcctgaggtccggaggaactgagggcctcctggcagagaagctcgaagcattgataacccagaccagagcgaagcaggctgctacaatgtccgaagtggaatggagaggtcgaaccgtgcccgtgaaaattgacaaggtccgtattttcttattaggcttagccgacaacgaggctgctatcgtacaggccgaaagtgaagagaccaaggaacgactctttgaatcaatgctgtctgagtgtcgggacgcaatccaagttgtgcgggaagagctgaaacccgaccaaaaacagcgggattacatacttgaaggtgagcctggaaaagttagcaacctgcagtatctccattcctatctgacgtacatcaagctgagtaccgctatcaagaggaacgagaatatggccaaggggttacagagagcgttactgcagcaacagccagaagatgattccaagcgaagcccacgacctcaagatttaatccgactctatgacatcatcttacagaacttggtggagctgctgcaactccccgggctcgaagaggacaaagctttccagaaagagattggcttgaaaactttggtgtttaaagcttatagatgttttttcatcgcgcaaagttacgtcctggtaaaaaaatggtccgaggccctggtgctttacgatcgagtgctgaagtatgccaacgaagtgaacagcgacgcgggcgcattcaagaacagcctgaaggatctgcctgacgtccaagagctgatcacccaggtgcgaagcgagaaatgttctctccaggcagccgccatactggatgctaacgacgctcaccagactgaaacctcttcctcccaggtcaaagacaacaaacctttagtggaaaggttcgagactttctgtctcgacccttccctggtgactaagcaggctaacctcgttcactttccaccaggctttcagcccattccatgcaagcccctgtttttcgacctggctttaaatcacgtggcattcccccctttagaggataaattagagcagaaaacgaagtctggactcaccgggtacattaaaggcatcttcggcttccgcagttag

SEQ ID NO: 205153 - DNA, 1110 bp, Artificial Sequence
  Description of Artificial Sequence: Synthetic coding sequence
atggccgccgagaagcaggtgcccggcggcggcggcggcggcggctctggaggaggaggcgggtccggtggcgggggcagtgggggaggccggggagccggcggcgaagagaataaagagaacgaacgtccttccgccggatcaaaggcaaacaaagaattcggagattccctcagcctggagatcttacaaatcatcaaagaaagtcagcaacagcatggactgcggcacggagactttcagaggtacaggggttactgcagcagacgccagcggagactaagaaagacactgaatttcaaaatggggaacaggcacaagttcaccggaaagaaggtcactgaagagctgctcacagataatcggtatctgctgctcgtactgatggacgccgaaagagcctggtcctacgcgatgcaattgaagcaggaggcaaacacagagccacgtaagagattccatctgctcagtcgcctgagaaaggcggtgaagcatgccgaagaactggaacgactgtgtgaaagcaatcgggttgacgcaaaaacaaagcttgaggctcaggcgtacacagcttacttgagcggcatgctgagattcgagcatcaggagtggaaggcagctatagaggcatttaacaagtgtaagactatctacgagaagttggcctctgcgtttacggaagaacaggctgttctatacaaccagagagtggaggaaatctctcccaacatccgttattgtgcatacaatattggggaccagagtgcaattaatgaactcatgcagatgcgtctgagaagcggtggaaccgaggggctcttggccgagaagcttgaagccttgataacccaaacgcgcgctaagcaggcggccacaatgagcgaggtggaatggaggggtcgcactgttccagtaaaaattgacaaagtgcgaattttcctgttaggcctcgcggacaacgaggccgcaattgtccaggctgagtccgaggaaacaaaggagcgtttgttcgagtcaatgctttctgaatgccgggatgctatccaagtggtccgggaagagcttaagccagatcaacgggacctgctcctgcccagccagggccagtag

SEQ ID NO: 205154 - DNA, 867 bp, Artificial Sequence
  Description of Artificial Sequence: Synthetic coding sequence
atgctgagcgagtgccgggacgccatccaggtggtgcgggaggagctgaaacctgaccagaagcaacgcgactatattttggagggagagcctggaaaagtgtccaacctgcaataccttcattcctatttaacctatattaagctgtcaaccgccattaaaaggaatgagaacatggcaaaaggacttcagagggcactgctccaacaacagcctgaagacgactccaagagatcgccacgtccccaggacttaattcggctatacgatatcatattgcaaaatctcgtggagttattgcaacttcccggcctcgaggaggataaagccttccagaaggagattggactgaagacactcgtattcaaagcctaccgctgctttttcattgctcagtcatacgtgcttgtaaaaaagtggtccgaggcgttagttctatatgaccgagttttaaaatacgccaatgaagtgaacagtgatgccggggcctttaagaattccttgaaagatcttcccgatgtgcaggaactaattacacaggtaaggtcagagaaatgttcccttcaggccgccgcgatactggatgctaatgacgcacaccaaaccgaaacaagctcttctcaagtgaaagacaataagcccctagtggagcgattcgagacattctgtctcgaccctagcctggtgactaagcaggcaaacctggttcactttccaccagggttccagccaatcccatgcaaaccgcttttcttcgaccttgccctcaatcatgtagcctttcccccattggaggataaactcgagcagaaaacaaaatcaggcctcacagggtatataaaaggaatttttgggtttcggagctag

SEQ ID NO: 205155 - DNA, 2016 bp, Artificial Sequence
  Description of Artificial Sequence: Synthetic coding sequence
atggccagcggcggcagcggcggcgtgagcgtgcccgccctgtggtccgaggtaaatagatatggtcagaatggcgacttcacacgcgctttaaagactgtgaataagattctgcagatcaacaaggacgacgtcaccgccctgcactgcaaagtcgtctgtctgatccagaatggttccttcaaggaagcgctgaacgtcataaatacacacactaaagtgttggccaataactcactgtcttttgaaaaggcctactgtgagtacagactgaatcgtattgaaaacgcactgaagactattgagagcgccaaccagcagacagacaagctcaaggaactctacggtcaggttctgtaccgcctggaacgatacgatgagtgcctggccgtttaccgggatttggtcagaaattcccaggatgattatgacgaggaaagaaaaacaaacttatcagccgtcgtagctgcccagtccaattgggaaaaggtcgtcccggaaaatctgggactgcaggaaggaacccacgaactttgttacaacaccgcatgcgcccttataggacaaggacagctgaatcaggcaatgaagatcttacaaaaggccgaagacctctgtcgcaggagtctttctgaagatactgatggcaccgaagaggacccacaggccgagctggcgatcattcatgggcagatggcgtatatccttcagcttcaggggcgcaccgaggaagctctgcagctttataaccagatcattaagctcaagcccacagacgtggggctgttagcggtgatagctaacaatattattacaataaataaagatcaaaacgtatttgactccaaaaagaaagtcaaactcaccaatgcagaaggcgtggaattcaaactgagtaagaagcaactccaggcaatcgaatttaacaaggcccttctcgccatgtatacaaatcaagctgaacagtgcagaaagatctccgcatctctacagtcccagtcacctgaacacttgttgcccgttctaatccaagccgcacagctttgccgcgaaaagcagcacaccaaggcaatagagctgctgcaagaattttccgatcagcaccccgaaaacgccgctgagatcaagcttaccatggcacaactgaagatcagtcaaggcaacatttccaaagcgtgtcttatactgaggagcattgaagagctgaaacataaacctgggatggtaagcgcactagttaccatgtatagtcatgaagaggacattgacagcgcgatcgaggtgttcacccaggccatacagtggtaccagaatcatcagcccaagtctccagcacacctctcactgatccgcgaagcagctaacttcaagcttaaatacggacggaaaaaagaggccataagtgacctgcagcagctgtggaaacagaacccaaaagacatccacaccttggcccaacttatctctgcctactcactggtagaccctgagaaagctaaggcattgtctaagcaccttccttcaagcgatagtatgtccttgaaagtcgacgtagaggcactcgagaatagtgcaggtgccacgtatattaggaaaaagggtggcaaggtgactggagactcccagccaaaagaacaaggccagggcgatctgaaaaagaaaaagaagaaaaagaaaggcaagctcccaaagaactacgatcctaaggttacacctgaccccgaacgttggctcccaatgagggagagatcatactatcgcgggcgcaaaaaagggaaaaaaaaagaccagattgggaagggaactcagggagctaccgctggggcctcctcagagttagatgcatctaagaccgtatcatccccccctaccagtccaagacccggcagcgctgccacagtatcagctagcacctcaaatatcatcccacccaggcaccagaagccagccggagcgcccgccaccaaaaaaaagcagcagcaaaagaagaaaaagggcgggaaaggaggctggtag

SEQ ID NO: 205156 - DNA, 1878 bp, Artificial Sequence
  Description of Artificial Sequence: Synthetic coding sequence
cccctggtgagcagcaagatggccagcggcggcagcggcggcgtgtcagttccagccctgtggagcgaagtaaacaggtacggacagaatggcgactttacaagagccctgaaaaccgttaataagatcttacagattaacaaggatgatgtgaccgctctgcactgcaaagttgtctgcctcatccagaatggcagcttcaaggaggccctgaacgtgattaatacacataccaaggtgctggccaataactccttgtccttcgaaaaggcatattgcgaatatcgtctgaacaggatagagaacgcactgaagacaattgaatctgctaatcagcagaccgacaaactgaaagagttatatggacaagtgctgtataggctcgagcgctatgacgagtgcctagccgtgtacagggatttggttcggaacagccaagacgactatgacgaggagagaaagactaacctctctgctgtggttgccgcgcagtctaactgggagaaggtggttcctgagaacctcggtctgcaggaggggacgcatgagttgtgctataataccgcttgtgctctgatcggtcagggtcagctgaaccaggccatgaagattttacagaaggccgaagacctctgtagaagatccctgtcagaggatacggaccagaacgtctttgatagcaaaaagaaggtcaaactaacgaatgcagaaggagtcgagttcaaactgtcgaagaagcagctgcaggctattgaattcaacaaagccctgctggccatgtatactaaccaggcagaacagtgccggaaaatcagcgcatctctgcagtctcagtcccctgagcaccttttgcccgtgctgattcaggccgcccagctctgtcgggaaaaacagcataccaaggctatcgagttactccaagaattttccgaccaacatccagagaatgccgccgagataaaactgacaatggctcagctgaagatcagccaaggcaacattagtaaagcctgcttaatcctccgttcaattgaagagttgaaacataaaccaggaatggtgtcggccctggttactatgtactctcacgaggaagatattgattctgccattgaagtgtttacacaagccatacagtggtatcaaaaccaccagccaaagagccccgcccatcttagcctgatcagggaggccgcgaatttcaaactgaagtacggtcggaagaaggaggcgatcagcgatctgcaacagctgtggaaacaaaatccaaaggatatccacaccctcgctcagctcatttccgcatactctctcgtggaccctgaaaaagccaaggcgctgtctaagcatctcccttcaagtgactcaatgtcgctgaaggtggatgtggaggctctggagaattccgccggcgcaacctacattaggaaaaagggtgggaaggtgaccggcgattctcagccgaaggaacagggccaaggcgatctgaagaagaagaaaaaaaagaagaaagggaagctcccaaagaattacgatcctaaggtgacaccagatcctgaacgttggctcccaatgcgcgagcgctcatattatcggggccgcaaaaaggggaagaaaaaggaccagataggaaagggaacacagggcgcaacggctggtgccagcagcgaactcgacgcatccaaaaccgtcagctcaccacctacacaggatctggcggttctgcagcagtatctgcccctccaagttacgagttatccccaggatacacggaacttgcagggcctgcagcagcaaaagagaaactctaatcgcaagagaagaaaagtggaaaaggttgctggcgacgaaaatattcttgtggccgggtgtttttag

SEQ ID NO: 205157 - DNA, 1833 bp, Artificial Sequence
  Description of Artificial Sequence: Synthetic coding sequence
atggccagcggcggcagcggcggcgtgagcgtgcccgccctgtggtctgaggtgaaccgctatggacagaacggcgacttcacacgggctctgaaaaccgtgaataagatactccaaattaacaaagatgatgttacagcgttgcattgcaaggtggtttgcctaatccagaacggtagtttcaaggaggctctgaatgtaatcaacacccacaccaaagtgctggcgaacaattctctcagttttgagaaggcctactgcgagtataggctcaacaggatcgagaatgctctgaaaacaatcgagagcgccaaccagcagaccgataagttaaaggaattgtacggccaagtgctgtaccgcctggagcgttatgacgagtgcttagctgtgtacagagacctggtgcggaactctcaagatgactacgacgaggagcgtaagactaacctgtctgcagtggtggctgcacaaagcaactgggagaaggtcgtgccagagaacctgggcttgcaggaaggcacccatgaactatgttacaatacggcctgcgccctgatcggtcaggggcagctgaatcaggccatgaaaatcctgcaaaaggccgaagatctttgtcgtcgatccctgagcgaagataccgaccagaatgtttttgactctaagaagaaggtgaagctgacaaacgcagagggagtggaattcaagctatctaagaagcagctgcaagctattgaatttaataaagctctgctggccatgtataccaatcaggccgaacagtgtagaaagatcagcgcaagtctccaaagtcagagccctgaacacttgctaccagttttgattcaggccgctcagttatgtagggaaaaacagcataccaaggccatcgagctgctgcaggagtttagtgatcagcaccctgaaaatgcagctgaaattaagcttacaatggcgcagcttaaaatctcccaggggaatatctccaaggcatgccttatcctgagatccatagaggagctaaagcataaaccaggaatggtcagcgccctggtgacaatgtacagtcacgaggaggacatcgattctgcaattgaagtgtttacacaggccatccagtggtaccagaatcatcagcccaaatcaccagcccacctgagtctgattagggaggccgccaacttcaagctgaaatacggtagaaaaaaagaggcaatctccgatctccagcagctatggaagcagaatccaaaggatatccataccctagcccaactgatatccgcctattccctggtggatccagagaaagctaaagcgttatccaagcacctgccctcatcggattccatgagtctgaaagtggatgtagaagccctcgaaaactcggccggagctacatacattcgaaaaaagggcggaaaagtgacaggcgattctcagccaaaagagcaaggccagggggatctgaaaaagaaaaaaaagaaaaagaagggcaaactccctaaaaactatgatcctaaagttacccctgaccccgagcgctggttacctatgcgggagcggtcgtattaccggggcagaaaaaaaggcaaaaaaaaggaccagattgggaagggcacacaaggtgccacggccggggccagctcggagctggatgcctcaaagaccgtgagttcacctcccacttcccctcggccgggctcagccgcgaccgtgtccgcgtccaccagtaatattattcctcctagacatcagaaaccggccggagccccggcaacaaagaagaagcagcagcagaaaaagaagaaaggaggtaagggcggctggtag

SEQ ID NO: 205158 - DNA, 1917 bp, Artificial Sequence
  Description of Artificial Sequence: Synthetic coding sequence
atgctggacttcttcaccatcttcagcaagggcggcctggtgctgtggtgctttcaaggcgtgtcggatagctgcacagggccagtgaacgccctgatcagatcagtgctgctgcaagagcgagggggaaataattcctttacccatgaggcacttacgctcaaatataagctagacaatcagtttgagcttgtcttcgttgtgggatttcagaaaattctgactttaacctacgtagacaagctgatcgatgacgttcaccggctgttcagagacaagtacagaaccgagatccagcagcaatcggctctcagcctgctcaacggcacctttgacttccagaatgacttcctgaggctcttgagagaagcagaggagtcctccaagatcagggcccctacaaccatgaaaaagtttgaggacagtgagaaagctaaaaagccagtgcgcagtatgatcgagactcggggggagaaaccaaaagaaaaagcaaaaaactccaagaagaagggtgccaaaaaagaggggagcgacggccccttggcaaccagcaaacccgtgccagccgagaagtccgggcttccggtcggccctgaaaatggagtggagctttcgaaggaggaactgatcagaagaaagcgcgaagagttcattcaaaagcacggaagaggcatggagaagagtaataagtctaccaaatctgatgcccctaaggagaagggcaaaaaggctcccagggtatgggagctgggaggttgcgctaataaggaggtcttggactatagcacacccaccacgaatggaacgccagaggctgcactgagcgaggacatcaatctcatccgggggaccggatccggcggacagctgcaggacttggattgctcatcatctgatgatgagggagctgcacaaaatagtaccaagccttcagcgacaaaagggaccctaggcggaatgtttgggatgttaaaaggtctcgtgggtagtaagtccttgagtcgggaagacatggagagcgtgctggacaaaatgcgggatcatcttatcgccaaaaatgttgcagctgacatcgctgtccagttgtgtgagtcggtggcaaataaactggaaggcaaggtaatgggaacattttcgactgtcacgagcaccgtcaaacaggcgctgcaggaaagcttggttcagatccttcagccacagagacgggtcgacatgttacgggatatcatggatgcccaacggcgccaaagaccatacgtggttacattttgcggtgtaaatggggtggggaagagcacaaatctcgccaagattagcttttggctccttgagaatgggtttagcgtgcttatcgctgcctgtgataccttccgggctggcgccgtcgaacagctgcgaacccatacccggaggctgtccgctctgcatccccctgagaagcatggaggacggacgatggtacagctgtttgagaaaggatatgggaaagatgcagcaggaattgctatggaggccatagccttcgctaggaaccaggggtttgacgtggttctggtggatacagctgggcgcatgcaggataatgctcccctcatgacagcactggctaagctcatcacggtgaatactcccgacctcgtcctgtttgttggggaggctctcgtgggcaatgaggctgtggaccagttggtgaagttcaacagagcactcgccgatcatagcatggcgcagacccccagactgatcgacggcatcgtactgaccaagtttgacactatcgacgataaggtaggcgccgcaattagcatgacctacattacaagtaaacccattgtgttcgtgggcactggacaaacctactgcgacctgcggagcctgaacgctaaggctgtcgtcgccgccctcatgaaggcctag

SEQ ID NO: 205159 - DNA, 552 bp, Artificial Sequence
  Description of Artificial Sequence: Synthetic coding sequence
atgcggctgctgagcttcgtggtgctggccctgttcgccgtgacccaggccgaggaaggagcaaggttgctggcaagcaagtctctgctgaaccgctatgccgtcgaaggcagagacctgacattgcagtacaacatctacaacgtagggagcagcgccgctctggacgtcgagcttagtgacgattcttttccacctgaggacttcgggattgtatcaggaatgctgaacgtaaaatgggacagaatcgcacctgccagcaacgtgtctcataccgtagtgctgagacctttgaaggcagggtactttaacttcaccagcgccactatcacctatcttgcacaggaagacggaccagtggtgatcgggagcacatcagcacccgggcagggtggaatcctcgctcagagagaattcgacaggcgctttagtccccattttctggattgggccgcatttggggtgatgaccctgccaagtatcggcatcccactgcttctttggtattcttctaaaaggaaatatgataccccaaagaccaagaagaactag

SEQ ID NO: 205160 - DNA, 552 bp, Artificial Sequence
  Description of Artificial Sequence: Synthetic coding sequence
atgcggctgctgagcttcgtggtgctggccctgttcgccgtgacccaggctgaggagggggcccgtctgttggcctccaagagtctcctgaaccgatatgctgtggaaggccgagaccttaccctgcagtacaatatctacaatgtcggctcttctgctgccctggatgtagaactatcagatgatagtttccctccggaagatttcggcattgtctccggcatgctgaacgttaagtgggaccgcatcgcacctgcctcgaatgtaagccacactgtagttctccggcccctgaaggcaggatatttcaattttacctctgccacgatcacctatctggcccaagaagatgggccggttgtgatcggatcaacaagtgcacccgggcaaggaggcattctcgcccagcgtgaatttgacaggcgcttttcgccccatttccttgactgggccgcatttggcgtgatgaccctgccatctatcggaatacctttgttgctgtggtattcttcaaagagaaagtatgacactccgaagacaaaaaagaactag

SEQ ID NO: 205161 - DNA, 258 bp, Artificial Sequence
  Description of Artificial Sequence: Synthetic coding sequence
atgcggctgctgagcttcgtggtgctggccctgttcgccgtgacccaggccgaggaaggagctagacttcttgcctccaaaagcctcttaaaccggtacgccgtcgaaggccgggatctaacccttcagtacaacatttataacgtgggctcatcagctgctctggacgtggaactgtccgacgactcattccctcctgaggacttcggaatagtgtccgggatgctcaatgtcaagtgggaccgtatcgccccatag

SEQ ID NO: 205162 - DNA, 444 bp, Artificial Sequence
  Description of Artificial Sequence: Synthetic coding sequence
atgcggctgctgagcttcgtggtgctggccctgttcgccgtgacccaggcagaggaaggcgcaaggctattggcttctaagagtctgctgaaccgatacgctgtggagggcagagacttaacacttcagtacaatatctacaacgtggggagtagcgccgctttagatgttgagctgagcgacgacagtttccctcccgaagattttggaattgtttccggaatgttaaatgttaagtgggacaggattgcaccagctagcaacgtgagccataccgtagtcctcaggccactaaaggctgggtattttaattttacatccgcaaccatcacctaccttgcccaagaggatggccccgtcgtaattggaagtacatccgcccctgggcagggtggtattcttgcccagagagaatttgaccgccgctttagcccacacttttag

SEQ ID NO: 205163 - DNA, 522 bp, Artificial Sequence
  Description of Artificial Sequence: Synthetic coding sequence
atggccgccatggccagcctgggcgccctggccctgctgctgctgagctctctatctagatgttccgctgaagcctgcctggagccacagattacccccagttactacaccacatctgacgctgtcatttctaccgagacggtgtttattgtggaaatcagtctcacatgtaaaaatagggtacagaacatggccctgtatgcagatgttggtgggaaacaatttccagttactcgcggccaggatgtaggccgatatcaggtgagctggagcctggatcataagagcgctcatgctggcacatacgaggtgcgtttctttgacgaggaaagttactctttgctgcgcaaagcccagcgcaacaatgaggatatttctatcatcccacccctgtttacagtctccgttgatcaccgcggaacttggaacggaccatgggtttccaccgaggtgctcgctgccgctatcggattggtgatctattacttggctttctctgccaagagtcatattcaagcgtag

SEQ ID NO: 205164 - DNA, 447 bp, Artificial Sequence
  Description of Artificial Sequence: Synthetic coding sequence
atggccgccatggccagcctgggcgccctggccctgctgctgctgtcaagtctctcgaggtgtagtgccgaagcctgcctcgaacctcagattacgcctagctattacacaaccagcgacgccgtcatcagcactgaaacagtgtttatcgtagagattagtctgacatgtaaaaaccgggttcaagtttcatggtcactagaccataaatcagcgcacgctggaacctacgaggtgcggtttttcgacgaggagtcctacagcctcctgaggaaggcccagagaaataatgaggacatctctataatcccgcctctcttcactgtctctgtagaccatcgagggacatggaatggtccctgggtgtctaccgaggtgctggccgctgccattggtttggtgatctactacctagctttcagtgctaagtcccacatccaggcatag

SEQ ID NO: 205165 - DNA, 522 bp, Artificial Sequence
  Description of Artificial Sequence: Synthetic coding sequence
atggccgccatggccagcctgggcgccctggccctgctgctgctgtcctcactctccaggtgctcggctgaggcatgcttggagccacagatcactcctagttattacaccacaagtgatgcagtcatatccaccgaaacggtgtttattgtcgagataagcctgacttgcaagaacagggtgcagaacatggccctgtatgccgatgtgggcggcaagcagtttcctgtcacgcgagggcaggatgtcggccgctaccaggtgtcctggtccctggaccacaaatcggcgcacgcgggcacttacgaagtgaggttcttcgatgaggaatcttattccttactcagaaaagcacagagaaacaacgaagacatctcaatcatcccaccgctgttcaccgtatctgtggatcaccgcggaacgtggaatgggccgtgggtatctaccgaggtgctggccgccgccatcggcctggtcatctattacctcgcttttagtgccaaaagccatatacaggcctag

SEQ ID NO: 205166 - DNA, 522 bp, Artificial Sequence
  Description of Artificial Sequence: Synthetic coding sequence
atggccgccatggccagcctgggcgccctggccctgctgctgctgagtagtcttagtcgatgttccgcagaggcctgtctggagccccagatcacaccttcatactacacgacttctgatgctgtcatcagcacggagacagttttcatcgttgagatctctttgacctgtaagaaccgtgtgcagaatatggctttatacgccgatgtcggggggaagcaatttccggtgaccaggggtcaggatgtgggcagatatcaggtatcctggtccctggaccacaaatccgctcatgctggcacttatgaggtgcgcttttttgatgaagaaagctatagtctgctacggaaggctcaacgaaataacgaggatatctccattatcccccccctcttcactgtgtctgtagatcaccgtgggacatggaacggtccctgggtgagcactgaagtgctggctgccgccataggactcgtgatttattatctagccttcagcgccaaatcccacatccaagcatag

SEQ ID NO: 205167 - DNA, 363 bp, Artificial Sequence
  Description of Artificial Sequence: Synthetic coding sequence
tgagtgggcagcggctgccggagcgccgccgtgagcgccctggtggtgcgagtggccccaccctgtcccctgtgtcctcatagtgctcagcatcccactcaggtgagctggagtctggatcataagtcggcacacgccggcacttatgaagtgcggttctttgacgaggagtcctactctcttctgcggaaggcccaacggaacaacgaggacatctccattattcccccattgtttacggtttcagtggatcaccgcgggacatggaacggaccttgggtgtcaactgaagtcctggccgccgcgataggcctggtgatatactacctggctttttccgccaaaagccacattcaggcttag

SEQ ID NO: 205168 - DNA, 2544 bp, Artificial Sequence
  Description of Artificial Sequence: Synthetic coding sequence
atgagcctgtggggcctggtgagcaagatgccccccgagaaggtgcaacggttgtatgttgattttccacaacacttgcggcatctgctcggggattggctcgaaagccagccttgggagtttctagttggctcagatgctttttgctgcaacttggcctcggcattgttgtccgacactgtccagcacctgcaagcaagtgtgggcgagcaaggcgagggcagcactatactccagcatatctcgaccctggaaagtatctaccagcgcgatccgctgaagcttgtggcaaccttccggcagatcctgcagggcgaaaagaaggccgtcatggagcagttcaggcatctgccaatgccgtttcactggaagcaggaggagctgaagtttaagacaggcctgcggcggctgcagcacagggttggcgaaatccacttgctacgcgaagccctgcagaaaggagcagaggcaggccaggtgtcactccacagcctgatcgaaaccccggccaacggcacgggcccttctgaggccctggctatgctcctccaggagaccacaggtgagttagaggcggctaaagctcttgtgttgaaacgcattcagatctggaagcgacagcaacagctggctggaaatggcgcaccatttgaagagtctttggccccactgcaggagaggtgtgagtccttggtggacatttattcccaactgcaacaggaggtgggggccgcagggggggagttagaacctaagacgcgcgcaagtctgacaggcagactagacgaagtgctcagaacgctggtcacatcctgcttcctggttgagaaacaaccacctcaagtgttaaagactcagaccaagtttcaggctggtgtaaggttccttctggggctgaggtttctgggagctcctgccaagccccccttagttagggccgatatggtaactgaaaaacaggctagggagctctccgtgcctcagggtcctggcgcgggagcagagtccactggtgaaattattaacaataccgtgcctctcgagaactctattcctggaaactgctgctccgcactctttaagaatcttctgctgaagaagatcaagcgctgcgagaggaagggcaccgagagcgtgactgaggagaaatgtgccgtgctcttttcggcatcctttacactggggccgggaaagctgccaatccagctgcaggctttgtctctgcctctggtggtcattgtgcacggaaaccaggataacaacgctaaagcgactatcctctgggataatgcattttctgagatggatagggtgccctttgtggttgccgagcgtgtcccatgggaaaagatgtgtgaaactctcaaccttaaatttatggctgaggtaggcacaaataggggactcttgcccgaacattttctgttccttgcgcagaagatctttaatgataattctctgtctatggaggcctttcagcatagatccgtttcatggtcgcagttcaacaaggagattttgctggggcgtgggtttactttttggcagtggttcgatggggtcttagatctgacgaaacgatgtttgagaagctattggtcagacaggctgatcatcggatttatttcaaagcagtatgtaacctccttgctccttaacgaacccgacgggacatttctgctccgattctcagattccgaaattggagggataacaattgcccacgtgatcaggggccaggatggaagcccccaaatcgaaaacatacagccgttctccgctaaggacctctctatacggtctcttggggaccgcatcagggatctcgctcagttgaagaatctataccctaagaagccaaaagatgaagcattcaggtcacactataagcctgaacagatggggaaggacggtaggggctacgtccccgctactataaaaatgactgtggaaagggaccagcccctacctacccctgagttacagatgcccacaatggttccaagctatgacctgggcatggcccctgatagcagcatgtctatgcagttgggccctgatatggtaccccaggtctatccccctcatagtcatagtattcccccttaccagggtctatcgcccgaggagtcggtcaatgtcctgtcagctttccaagagcctcacctgcaaatgccccccagcctagggcagatgagcctgccatttgaccagccccaccctcaaggactgttgccttgccaaccacaggagcacgcagtgtcttccccagacccactgctgtgttctgacgtaacaatggtggaagactcatgtctgtctcaaccagttacagctttcccccaaggcacatggatcggagaggacattttcccccccctgctgcctcccacagagcaggacctgacaaaactgctcctggagggccagggagaaagtggcggaggcagcctgggggctcagccactgcttcagccatcacactatggccagagcggcataagtatgagccacatggacctgagggctaacccgagctggtag

SEQ ID NO: 205169 - DNA, 2544 bp, Artificial Sequence
  Description of Artificial Sequence: Synthetic coding sequence
atgagcctgtggggcctggtgagcaagatgccccccgagaaggtgcagaggctgtacgtggatttcccccagcatctgcgccatctgcttggggattggctggaatctcagccttgggagtttctggtggggtctgacgcattctgctgcaacctggcttctgccctcctgtctgataccgtgcagcatctgcaagctagtgtcggagaacagggcgaagggtcaacgattctgcagcacatatcaacattggagagcatctaccagagagatccactgaagttggtggccacatttagacagatcctccaaggcgagaaaaaggccgtgatggaacagttccggcatctacccatgcctttccattggaaacaggaggaacttaagttcaagacgggtttgcgccgacttcaacacagggtgggcgagatccacctcctgagggaggcgttacagaagggtgccgaagctgggcaggtgtctctccactcactcatagagacacctgccaatgggaccggccccagcgaggcgcttgcaatgctacttcaggagacaacaggggaactggaagctgctaaagccctcgtcctgaagcgcatccagatttggaagcgtcagcagcagctcgctggcaacggagcacccttcgaagaaagcctggcgcctttgcaggagcgatgtgagtccctagtggatatttacagccaactgcagcaggaagttggcgccgccggcggcgagctcgagcccaagactcgggcatcgctgactggaaggctcgatgaggtcctgaggacactcgtaaccagttgctttttagtcgagaaacagccaccgcaggtgttgaagacccagaccaagtttcaggccggcgtccgtttccttcttggactgcgcttcctcggagcgcctgccaaacccccgctagtcagggccgacatggtcacggaaaagcaggcacgggagttgtccgtaccccagggtcctggggctggtgcggaaagcaccggtgagatcattaataatactgtcccgcttgaaaacagtatccccggtaactgctgctcagccctgttcaagaacctcctgctgaagaagattaagaggtgcgagcggaagggaacagaatccgtcaccgaggaaaagtgcgctgtgctctttagcgccagctttaccctgggccccggcaaattacctattcaattacaggccctgagcctgccactcgtggtaattgttcacggcaatcaggataacaacgctaaggccaccatactgtgggataacgcattctccgaaatggatcgtgtgcctttcgtagtcgcagagcgggtgccatgggagaaaatgtgtgagacgctgaatcttaagttcatggccgaggtgggtaccaacagggggttgctccccgaacacttcctcttccttgcccagaagatttttaatgataactcccttagcatggaggccttccaacacagatcagtgtcttggtctcagttcaacaaggagatattgttggggaggggcttcactttttggcagtggttcgatggagtgctggatctgacaaaaagatgcctgcgttcttactggtctgacagactaatcataggattcatatcaaagcagtacgttaccagcttgctgctgaatgagcctgatggcacttttctccttagattctcagacagcgaaatcgggggtattaccatcgcccacgtcatacggggccaagacggctcccctcagattgagaacatccagcctttttctgcaaaggatttgtctataagatccctgggcgaccgcattagagacctcgcccagcttaagaacttgtaccccaagaaaccaaaagacgaggcttttcgaagtcattataaacccgaacagatgggtaaagacggcagaggctacgtgcccgcaaccatcaagatgacggtggaacgggatcagccgctgccaacaccggagctccagatgcccaccatggtgccatcgtatgatttgggcatggcaccagactcctccatgtccatgcagctcggtccagacatggtgccccaggtgtatcccccccacagccactccattcccccctatcagggtttgagtccggaagaatcagtcaatgtattgagcgctttccaggagccacatctccagatgcctcccagcctggggcagatgtcgctcccctttgaccagccgcacccccagggccttctgccatgccagccacaggagcatgcggtgagttcaccagatcctctcctgtgtagtgacgtgacaatggtcgaagatagctgtctttcacaacctgtaactgcctttcctcaggggacatggataggtgaagatatttttcctcctttactgccccccacagagcaggacctgacaaaactactactggagggccagggtgaatccggcgggggctcactcggagcccagccacttctgcagccctcccattatggacagtccggcatttccatgtctcatatggacctacgggccaatccgtcctggtag

SEQ ID NO: 205170 - DNA, 2214 bp, Artificial Sequence
  Description of Artificial Sequence: Synthetic coding sequence
atggagcagttccggcacctgcccatgcccttccactggaagcaggaggaactgaagtttaaaactggacttcgacgattacagcaccgggtgggagagatccatctgctgagggaggccctccagaaaggcgccgaggccggacaagtctcactgcactcccttattgagacccctgctaacggcacagggccttcagaggccttggctatgctcttgcaagaaaccacaggcgagttagaggccgcaaaagcactggttctgaaaagaattcaaatttggaaacgtcagcagcagcttgccggtaatggcgccccgttcgaggagagtctggcccccctacaggagcggtgtgagtctttggtagacatttattcccagctgcagcaagaggtcggggcagctggcggtgaactcgagcccaaaactagggcttccttgacaggaagattggacgaggtgctccggacactcgttacgtcttgttttctcgtggagaagcaacccccacaggtcttgaagacccagactaagtttcaggcgggagtgaggttcctgctcggattacgcttcctgggcgccccagcaaagccccctctcgtgcgtgccgacatggtcaccgaaaagcaagctagagagctgagcgtgccgcaaggccctggggctggggccgaatctacgggcgagattatcaacaatacagtgccactggagaactcaattcctgggaattgctgcagtgcgctgtttaaaaacctgctcttgaaaaagattaaaaggtgtgaaagaaagggtacagagtcagtaactgaggaaaagtgcgctgtgctgttttctgcctcttttaccttaggcccaggcaagctgcccattcaactgcaagccctatcactgccactggttgtcatcgtccatggaaatcaggacaataatgcaaaagctacgattctgtgggacaacgcgttctccgaaatggacagagtgcctttcgtcgttgctgagagggtaccctgggagaagatgtgcgagactctcaatctgaagttcatggccgaagttgggactaatcgcgggctgttgccagagcacttcctgtttttggcacagaagatcttcaatgataacagtctatcaatggaggcttttcagcacaggtctgtgtcttggtcccagtttaacaaggagattctgctcggaaggggtttcaccttctggcagtggtttgatggggtgctggatcttactaagcggtgtctgcggtcatattggtctgacagactgattatcggctttatttctaaacagtacgtcacctctctattgttaaatgagcccgatggcacttttcttttacgcttcagtgactccgagatcggagggatcaccatagcccatgtgattcgcggccaggacggctccccgcagatcgaaaacatacagcctttctctgcgaaagacctgtccatccgtagtctgggcgaccgaattcgcgatctagcacaactgaaaaatctgtacccaaagaagccaaaggatgaggctttccggagccactataagcccgagcagatgggaaaggacggccgcggttacgtcccagctacgattaagatgaccgtggaacgggaccagccgctgcccactccagagctccaaatgccgactatggtgcccagctatgaccttggcatggctcctgattctagtatgagcatgcaactggggcctgatatggtgccacaggtttaccccccacattcgcattcaattcctccttatcaagggttgagcccagaagaatccgtcaacgtgctgagcgcgttccaggagcctcatctgcagatgcctccatcactaggccagatgtcactcccattcgatcagccacacccacagggacttcttccctgtcagccacaagaacacgctgtctcttctcctgatcccctgctctgctctgatgtcacgatggtggaagacagctgcttatcgcagccggtaaccgcctttccacaggggacctggataggagaggatatatttccacctctgttgcctcccaccgaacaggacctaaccaagctgctgctggaggggcagggggaaagcgggggtgggtccctgggggcccagcccctcctgcagcccagtcattacggccagagcgggatttctatgtctcacatggacttgagggcaaatcccagctggtag

SEQ ID NO: 205171 - DNA, 2214 bp, Artificial Sequence
  Description of Artificial Sequence: Synthetic coding sequence
atggagcagttccggcacctgcccatgcccttccactggaagcaggaagagctgaagtttaagaccggcctaaggcgcctccaacaccgcgtcggcgaaatccacctgctgcgcgaggctcttcaaaaaggcgcagaagccggacaggtgtctctacactcactgattgaaacccccgccaatggcacagggcctagcgaagcattagctatgctgctgcaggagacaaccggagagctcgaggcagccaaggcgcttgtgttaaagcgtatccagatttggaagcggcagcagcagctcgccggtaacggcgccccattcgaggagagcctggcaccactccaggaaaggtgtgagtctctggttgacatctatagccaattacagcaggaggtgggcgcggccggcggtgaacttgaacctaagactcgcgccagtctgactggtagactcgacgaggtcctgagaactctagtcacatcgtgttttcttgtagagaaacagccgccacaggtgttaaaaacacagacaaaattccaagctggagtgcgttttctgcttggcttgcgcttcctcggcgccccggctaaacctccgctggtgcgcgccgatatggtcaccgaaaagcaggcccgggagcttagtgtgccgcaaggtcccggagccggcgccgaatccaccggagaaattataaacaatacagtgcctctagaaaatagcatccctggaaattgttgttctgcattatttaagaatcttctattaaagaagatcaaaagatgcgagcgaaaagggaccgaatcggtcactgaagaaaagtgcgctgttctgttctccgcaagctttaccctcggacccggaaagcttccaatccaactgcaagccttgtctttgcctctagtggtgatcgttcacggtaatcaggataacaatgcaaaagctactatcttatgggacaatgctttctctgagatggaccgtgtaccttttgtggtcgccgagcgtgttccgtgggagaagatgtgcgaaaccctcaatcttaagttcatggctgaagttggcactaacaggggcctgcttcccgagcactttttgttcctggcccagaagattttcaacgataacagtctgagcatggaagctttccagcatcggagcgtttcttggtctcagtttaacaaagagattctcttgggaaggggatttacattttggcagtggtttgacggcgtcctcgacctaacaaagcggtgtctcaggtcatattggtccgatcggctgatcatcgggtttatctccaaacagtatgtgacctcactgttgctcaatgaacccgacggcacctttctcctccgcttttcggacagtgagattggcggcattaccatagcacacgtcataagaggccaggatgggagtcctcaaatcgagaacatccagccattcagcgctaaagacctatctattaggagcctgggtgacagaatcagggacctggcccaactaaagaatctttaccccaagaagcctaaggacgaagcttttcgttcccactacaagcccgagcaaatgggcaaagacggaagggggtatgttccagccacaattaagatgacagtggagagagaccaaccgctgccaacacccgagcttcagatgcctacaatggttccatcatatgatcttggcatggccccagattctagtatgtctatgcagttggggcctgatatggttccccaggtctaccccccacactctcacagtatccctccatatcagggactgtcacccgaggaatcagtcaacgtcctttccgctttccaggagccacatctccagatgccaccatcactgggccagatgagcctgcccttcgatcaaccccacccacaaggcctcctgccatgtcagcctcaagaacacgcggtgtcctcacccgacccactgctctgttcggacgtgactatggttgaagatagctgtctttcccaacctgtgaccgcgtttccgcagggtacatggattggcgaggacattttcccgcctttgctgcccccaactgagcaggacctaactaagctgttattagaaggacagggagagtctggcggcggatcactgggcgcccagcctctgctccaaccatcccattacggacagtccgggatttcaatgtcccacatggatctgcgggccaacccctcgtggtag

SEQ ID NO: 205172 - DNA, 2214 bp, Artificial Sequence
  Description of Artificial Sequence: Synthetic coding sequence
atggagcagttccggcacctgcccatgcccttccactggaagcaggaagagctgaaatttaaaacgggcctgaggcggctccaacaccgcgttggcgagatccatctgctgcgagaagcactgcaaaagggggccgaggccggccaagtaagcctccactcactcatagaaacaccagctaacggtaccggaccatccgaagccctggctatgttacttcaggaaaccactggcgagctcgaggccgcaaaggccctcgtgttgaaaaggatccagatttggaagagacagcagcagctcgccggcaacggcgcaccatttgaagagtctctggccccccttcaagaacggtgcgagtctctggttgatatctattctcagctgcaacaggaagtaggcgccgccgggggagaactggagccgaagaccagggcttctctgaccgggcgcttggatgaagtccttcggaccctggtgaccagctgctttttagtggaaaagcagccacctcaggtcctcaagacccagacgaagttccaggcaggcgttcgatttcttttgggtttgcgtttcctgggtgcgccagccaaacccccactggttagagcagacatggtcaccgaaaagcaggcgcgggaactcagtgtgccacagggcccaggcgcgggtgctgagtccacgggggagatcataaataataccgtccctcttgaaaattcaattcccggcaattgctgttctgcactgttcaaaaacctgctcctcaagaaaattaaacgctgcgaacgcaaaggaacagagagtgtgaccgaagagaagtgtgccgtgctgttcagtgcttcctttacactgggccccgggaaactgcctatccagttacaggctttgagcctcccactggtggttatagtgcacggtaaccaggacaacaacgcaaaggccacaattctctgggacaacgcctttagcgaaatggatcgcgtgccctttgtggtcgcggaaagagtcccctgggaaaagatgtgtgaaacacttaacctcaaattcatggccgaggtgggcacaaatcgagggctgttaccagaacattttctctttttggcgcagaagatcttcaacgacaattccttatccatggaagcttttcagcaccgttccgtcagctggtctcagttcaacaaggaaattctgctcggccgggggtttacattctggcagtggttcgacggggtgttggacctcaccaaaaggtgcctgagatcctattggtcggacaggctgatcattgggtttatcagcaaacagtacgttacaagtttgctcctgaatgaaccagatggaacttttctgctgaggttcagcgactcagagatcggaggtatcacgattgctcatgtaattcgcgggcaggatggatccccacagatcgagaatatacaacctttctctgccaaagatctgagcattcggagcctcggggatcgcattagggacttggctcagcttaagaacctctatccaaagaagccaaaggacgaggcattccggagccactataagccagagcagatgggcaaggacggtagggggtatgtcccagcaacaattaagatgacagttgaacgtgatcagcctctgcctacccctgagctgcagatgcctacaatggtgccatcgtacgacctgggaatggcccccgactcttctatgagtatgcagcttggcccggacatggtgccccaggtgtatcctcctcattcccattctatccccccatatcagggactctcaccagaagagtctgtgaatgtcttatcggcattccaggagccacacctccagatgcctccctctctgggccagatgtctctgccgtttgatcagccccacccacagggactgttaccatgccaaccgcaggagcacgcagtttccagcccggatcccctgctctgttctgatgtcacaatggtggaagacagttgccttagccagccagttaccgctttcccccagggcacttggattggtgaagacatcttccctcccctgttgccacccacagagcaagacctgacaaagctgttactggaaggacagggcgagtccgggggagggtctcttggagcgcagcccctactccaaccctcacactatggacagagtgggatctctatgagtcatatggatctgagagcaaatccgtcatggtag

SEQ ID NO: 205173 - DNA, 2040 bp, Artificial Sequence
  Description of Artificial Sequence: Synthetic coding sequence
atgagcctgtggggcctggtgagcaagatgccccccgagaaggtgcagaggttgtatgtcgatttcccccagcaccttcggcatctgctcggggactggttagagtctcagccatgggaatttctggtgggttcagacgccttctgctgcaacctcgcttccgccttgctcagcgatacagtccaacacctgcaagcgtctgtgggtgagcagggtgaaggcagcacgattctccagcacattagtaccttagagtctatctaccagcgcgatccactaaagcttgtcgcgacgtttaggcaaattctgcagggcgaaaagaaagcagttatggagcagttccgccacctgccaatgccatttcattggaagcaagaggagctcaagtttaagaccggccttagaagactgcagcacagggtgggtgagatacatctgttgcgagaagccttacaaaaaggcgccgaagccggccaggtgagtctgcattcactcattgagactcctgctaatgggactgggccttctgaagctctggctatgttactgcaagagaccacaggggagcttgaagctgccaaagccttggtactaaaacgcattcaaatttggaaacgtcaacagcagctggccggcaatggggccccattcgaggagtctcttgctccactgcaggaacgctgcgagtccctagtggacatatacagccaattgcagcaagaggtcggcgccgctggaggcgagctggagcccaagacaagagcctcgttgacgggccgccttgatgaggtgctgcgcaccctggttacatcttgctttcttgtggaaaaacagccccctcaggtactgaaaacccagacgaaattccaggcaggagtcaggtttctgcttggcctgaggtttttaggcgcacctgctaaaccccccctcgtgagagctgatatggtgactgagaagcaggccagggagttgtcagtgccccagggacccggggcaggcgccgaaagcacaggtgaaatcataaacaataccgtcccgctcgaaaactctattccaggtaactgctgcagtgccctattcaagaacctcctattaaaaaagattaagcgttgtgaaagaaaggggaccgagagcgttactgaagagaagtgcgctgtgctattcagtgcaagcttcactctcggacccggtaaacttcccatacagctgcaggccttgtcgttaccgctggttgttattgtccacgggaaccaggacaataatgctaaagccacaatcctctgggacaacgcattcagcgagatggatcgggtgcctttcgtcgtggctgagcgagtgccgtgggagaaaatgtgcgaaaccctgaatctaaagtttatggcagaggtgggcactaacaggggcctattgccagaacattttctgtttcttgcccagaaaattttcaatgacaactcactcagcatggaagccttccaacaccggtctgtgagctggtcccaatttaataaagagatcttgttgggtcgcggctttacattttggcagtggttcgacggtgtgttggatctaacaaagaggtgcctgagatcctactggtctgataggctgataataggattcatatccaagcagtacgtcacttcattactccttaatgagcctgatggcactttcctgcttcgcttttcagactctgagatcggtggtattaccatcgcgcatgtgatcagaggccaggatggctcgccgcaaatagagaacatccaacctttttccgcaaaggacctctcaattcggagcctcggcgacaggatcagggatcttgctcagctaaagaacttgtacccaaagaaaccaaaagacgaagcctttcggtcacattacaagcccgagcagatgggcaaggacgggcgggggtacgtgcctgcgacaatcaaaatgaccgtggagcgtgaccagcccctgcctacgccagaactgcagatgcctaccatggtaccatcatatgacctcggtatggccctcatccctccatag

SEQ ID NO: 205174 - DNA, 2193 bp, Artificial Sequence
  Description of Artificial Sequence: Synthetic coding sequence
atggagcagttccggcacctgcccatgcccttccactggaagcaggaagagctgaagtttaaaacaggcttgcgaaggttgcagcaccgggtaggtgaaatccatctgctcagagaggcactccagaaaggcgccgaagccggacaggtgagcctgcactcattgatagagacacctgcaaatggaaccgggcctagcgaggcgcttgccatgttgttgcaagagaccacaggagaactagaagccgctaaggccttggttctgaaaagaatccagatctggaagcggcagcagcaactcgccggcaacggcgccccttttgaagagtcgctcgcgcctttgcaggagcgctgcgagtctttggttgatatatattcccagctacagcaggaagtcggcgcggccggcggagaactcgaacctaaaacaagagcttctttgacgggccgtctggacgaagtccttcgcaccctggtgacctcatgtttcttggttgagaagcaacctccacaggtgttgaaaactcagaccaaatttcaggcgggagtaagattcctgctggggctgcggttcctgggcgcgccggcaaagcctccactcgtgcgggctgacatggtcactgaaaagcaggcgagggaactctccgtcccccagggccccggtgctggagcagagagtacgggcgagattatcaataataccgtgccactggaaaattctatcccaggaaattgctgctcggccctcttcaaaaatctcctcctaaaaaaaataaagaggtgcgaacgcaagggcacagagagtgtgactgaagaaaagtgcgccgttctgttttctgcctcatttacactcggcccaggaaagctcccaatacagttacaggccctgagcctccccctagttgtgatcgtccatggcaaccaggacaataatgcaaaagccaccatcctctgggacaatgctttttctgaaatggatagggtgccatttgtggtggcagaacgggtcccctgggagaaaatgtgcgaaactttgaatctcaagtttatggccgaggtggggacaaaccgcggactcttgcccgaacattttctttttcttgcccagaagatctttaacgataactcattatctatggaggccttccaacatcgctcagtgtcctggagtcagttcaacaaagaaatccttctggggcggggctttaccttctggcagtggtttgacggagtgctggacctgaccaaaaggtgtctgagatcatactggagcgacagacttatcataggatttataagtaaacagtatgtgactagcctactgctcaacgaacctgatggaacttttcttttacggttctcggatagcgagattggtgggatcacgattgctcatgttatcagaggacaggatgggagccctcagatagagaatatacagcccttttcggccaaagatctgagtatcagatccctaggggacagaattagagatctcgcccagcttaagaatctgtatcctaagaagccaaaggacgaagcttttcgatcccactacaagcccgagcaaatgggaaaagacggtagaggctatgttccagccactattaagatgaccgtagaacgggaccagcctttgccaactcccgaactgcagatgccaacaatggtgcccagctacgacttggggatggcccccgattcgtcaatgtcaatgcaacttggccccgacatggttccccaggtctacccaccacattctcactctattcctccataccagggcctatccccagaagagagcgtgaatgtcctctcagcgttccaggagccccacctgcagatgccccccagtctgggacagatgagtctgccttttgatcagcctcacccccaagggcttcttccatgccaacctcaagaacacgcggtctcctcccccgatcctctgctgtgcagcgacgtgactatggttgaggacagttgtctaagccaacccgtgacagctttcccgcagggaacttggatcggtgaagatatcttcccacctttgctgcctccaaccgagcaagacctgacaaagctgctcctcgaaggccagggcgagtctggaggcgggtccttgggccacagcccaagctgctcgcctccgacaatgggcaatctagggagtcaatgtcctacatggacatag

SEQ ID NO: 205175 - DNA, 2544 bp, Artificial Sequence
  Description of Artificial Sequence: Synthetic coding sequence
atgagcctgtggggcctggtgagcaagatgccccccgagaaggtgcaacgactttatgtagacttcccacagcatctcaggcacctcctgggggattggctcgagagccagccatgggaattcttagtaggcagcgacgccttctgctgtaacttagcatctgccttgctttccgataccgtacagcatctgcaagcatctgtgggcgagcagggtgaggggtcaaccatcctgcagcatatttccacgctggagtcaatctatcagagggaccctctcaagctcgtggccacctttcggcagatcttgcagggagagaagaaggccgtaatggagcagttccggcaccttccgatgccatttcactggaagcaggaggaactgaaatttaaaacaggccttaggcggctccaacaccgagtgggcgagatccacctgcttcgcgaagccctacagaaaggagccgaggccggacaggtgagtttgcactctcttatcgagaccccagccaatggtaccgggccatcagaagctctggccatgctgttacaggagaccacaggcgagttggaagccgcaaaagctcttgttcttaaacgtattcagatctggaagcgtcagcagcagctggcggggaacggtgcacccttcgaggaatctctggcccccctgcaggagcgctgtgagagtctcgttgacatttacagtcagctccagcaggaggtgggtgccgctggaggagaactggaaccaaaaactcgagcttcactcaccgggagacttgacgaagtgctccgcacactggtgacgagctgcttcctggtcgagaagcaaccgccccaggtacttaagactcagacaaagtttcaggccggggtgcgttttctcctcggtcttaggttcctgggcgcacccgctaaacccccactggtgcgcgctgatatggtcaccgagaagcaggctcgtgagctgagcgtgccccagggacctggtgccggcgctgaatcaaccggcgagattatcaataacaccgtcccattagagaattctatccccggcaattgctgtagcgccctcttcaagaacctcttactgaaaaagattaaacgctgcgagaggaagggaacagaatctgtcactgaagagaagtgtgctgtgctgttctccgcaagctttactctcgggcctggaaagctccctattcagttacaggctctgtccctgccattagtggtgatcgtccacgggaaccaggataacaacgccaaagcgacaatcctttgggataatgctttctctgagatggaccgcgttccatttgtagttgccgaacgcgtaccctgggagaagatgtgcgaaacactgaacctgaaattcatggctgaagtgggcactaataggggcctgctgcctgagcatttcctatttctggcccagaaaattttcaacgataactccctctccatggaggctttccagcaccgttctgtgagttggtctcagttcaataaagagattctccttgggcgcggtttcaccttctggcagtggtttgacggagtcttagacttgaccaagagatgcttaagatcctactggtccgacagattgatcatcgggttcattagcaagcagtacgtcacgtcactcctcttgaacgagccagacggtacttttcttctgcgtttcagcgactccgaaatcggcggaatcaccattgctcacgtgattcgcggacaggacggctcccctcagatcgagaacatccagcccttttccgcgaaggatctatctataagatctctgggcgatagaatcagggacctggcgcaactgaagaatctttaccctaaaaaacctaaggacgaggccttcagaagccattataagccggagcagatggggaaggatggcagaggctacgtgccagccaccatcaaaatgactgtcgaacgagatcagccactgcccactcccgaattgcaaatgcccactatggtcccaagctatgatctggggatggcccctgatagctcgatgtccatgcagctgggtccagacatggtgcctcaagtgtatccgcctcattctcattccatcccaccgtaccaagggctctccccggaagagtccgtcaatgtgctcagcgcctttcaggaaccacacttgcagatgcccccgtctctcggacagatgtcactgccatttgatcagcctcacccacaggggctgcttccttgccagccacaggaacacgcggtctctagtcctgatccgctgttatgttctgacgttacaatggtggaggactcgtgtctctcccagcccgtgaccgcttttcctcagggcacttggatcggtgaagatatatttccccctttgctacctcctaccgagcaggacctgactaagctgctcctcgaaggccagggtgagtctggaggcggatctctgggagctcagccactacttcaaccctcacactacgggcagagtgggatctccatgtcgcacatggatctaagagctaaccctagttggtag

SEQ ID NO: 205176 - DNA, 195 bp, Artificial Sequence
  Description of Artificial Sequence: Synthetic coding sequence
atgagcctgtggggcctggtgagcaagatgccccccgagaaggtgcagaggctgtacgtagatttccctcagcacctacgacacctcctgggcgattggcttgaaagtcagccctgggaatttctggtgggatctgatgctttctgctgtaatttagcctctgccctgttatctgatacggttcagcatttgtag

SEQ ID NO: 205177 - DNA, 435 bp, Artificial Sequence
  Description of Artificial Sequence: Synthetic coding sequence
atgagcctgtggggcctggtgagcaagatgccccccgagaaggtgcagaggctatacgtcgatttcccccagcatttgcgacacctgctaggcgactggctcgagtctcagccctgggagtttctggtgggctctgacgccttttgttgcaacctagctagtgcccttctgagcgacaccgtgcagcacctccaggcctctgtgggcgagcagggagaaggttctacaatcctgcagcacatctccacacttgagtctatttatcagagggaccctctcaaacttgtagctactttcagacagattctgcaaggtgagaagaaagctgttatggagcagttccggcatctccctatgccctttcattggaaacaggaagagcttaaattcaaaacaggactgaggagactccaacatcgggttggagaaatatag

SEQ ID NO: 205178 - DNA, 465 bp, Artificial Sequence
  Description of Artificial Sequence: Synthetic coding sequence
atgagcctgtggggcctggtgagcaagatgccccccgagaaggtgcagaggctctacgtggacttcccccagcacctgcgccatttgctgggcgattggctggagagtcagccatgggaatttctggtcggcagcgacgccttctgttgtaacctcgcctccgcgctgctgagcgataccgtacagcatctgcaggccagcgtcggtgagcagggagaaggatcaactatcttacagcatatttccacccttgaatccatctaccagcgtgatcccctcaaactggtagcgaccttccgacagatcttgcagggtgaaaaaaaggcagtaatggagcaattcaggcatcttccaatgcccttccactggaagcaagaggagctaaaattcaagactggacttaggagattgcagcatcgcgttggggagattcacttgttgagggaggccctgcagaaaggttag

SEQ ID NO: 205179 - DNA, 318 bp, Artificial Sequence
  Description of Artificial Sequence: Synthetic coding sequence
atgagcctgtggggcctggtgagcaagatgccccccgagaaggtgcagcgcctgtacgtggacttcccacagcatttgcgccacttgctcggcgattggttagagtcccagccctgggagtttctcgtcggctccgacgcgttctgttgtaacctggcctccgcccttctgagtgataccgtccagcacctacaggcctctgtgggtgagcagggagaaggttctaccatcttacagcatattagtacactcgaatctatttaccagcgcgatcccctgaaactggtggccacctttcgtcaaattctccagggatag

SEQ ID NO: 205180 - DNA, 312 bp, Artificial Sequence
  Description of Artificial Sequence: Synthetic coding sequence
atgagcctgtggggcctggtgagcaagatgccccccgagaaggtgcaacgactttatgtggattttccgcagcacctgaggcacctcctcggtgattggttggagtcacagccctgggaatttctcgtgggatcagatgccttctgctgtaacctggcatccgctctgctgtctgatactgtccaacatctgcaggcctccgtgggagaacagggcgaggggtcaaccattctgcagcacatttcgactctggagagcatatatcagagagacccattaaagttagtggccacattcagacagattttgtag

SEQ ID NO: 205181 - DNA, 480 bp, Artificial Sequence
  Description of Artificial Sequence: Synthetic coding sequence
atgagcctgtggggcctggtgagcaagatgccccccgagaaggtgcagcggttatacgtggacttccctcaacatttaagacacctcctgggcgattggctggagtctcagccatgggagtttctggtggggtctgacgccttttgttgcaatctggccagtgccctccttagcgataccgtgcaacatcttcaggcaagcgtgggagagcagggagagggtagcaccatcttgcagcacatcagcacactggagagcatatatcagagggaccccctcaagctggtggctacgtttcggcagatacttcaaggcgaaaagaaggcggtcatggagcaatttcgacatcttcctatgccctttcactggaaacaagaggagctgaagttcaagactgggctgagacggctgcagcacagggtgggggagatccacctgctccgtgaggccctccagaaaggagccgaggccggacagtag

SEQ ID NO: 205182 - DNA, 2544 bp, Artificial Sequence
  Description of Artificial Sequence: Synthetic coding sequence
atgagcctgtggggcctggtgagcaagatgccccccgagaaggtgcagcgcctttatgtcgacttcccacagcatctgcggcacctgctcggagattggttggagagccagccttgggaatttcttgtaggttcagatgcattctgctgtaacttagcatccgccctgttatccgatacagtgcagcatcttcaggcgagtgttggcgagcagggcgaggggtccacaatcctgcagcacatttctaccctcgaatcaatctatcagcgcgaccccctgaaactggtggctactttccgccaaatcctccagggagaaaaaaaagccgtgatggagcaatttcggcacctccccatgcccttccactggaagcaggaagaactcaagttcaagaccggcctgcgcagacttcagcatagggtaggggaaatacatttattacgcgaggcgctgcagaagggtgccgaggctgggcaagtcagcctgcatagcctcatcgaaacacctgccaatggcaccgggccatcagaggcactggccatgttactgcaggagacaacgggagaactagaagccgctaaagcactggtactgaaacgcattcagatatggaagcggcaacagcagctagccggaaatggcgccccgtttgaagaatctctcgctcccctgcaagaacgttgtgagagccttgtggacatctactctcagctgcagcaggaagtgggggcagctggtggcgaactcgagccaaagacaagagccagtctaactgggcgcctggatgaggtgctgagaactcttgttacttcctgcttcctggtggagaagcagccaccacaagttcttaaaacacagaccaagttccaagccggagttcgctttctgctcggtctcagattcctgggggccccggccaagcctcctttagtcagagccgatatggttactgaaaaacaagctcgcgaactttccgtgccgcagggtcccggagccggggcagagagcactggagagatcataaacaacaccgtaccactcgaaaattctatacccggcaattgttgtagcgccttgtttaagaaccttctgcttaaaaaaattaaaaggtgtgagcggaaagggaccgagtccgtcacagaggagaaatgtgctgtgctgttcagtgcatcctttaccctcggtcctggaaaactccccattcagctgcaggcccttagtctaccacttgtggtaatcgtccatggcaatcaagacaacaatgcaaaggcaaccatcctctgggacaatgcattttctgaaatggaccgcgtgcctttcgtagtagcagagagagtgccatgggagaaaatgtgcgagaccctgaacctcaagttcatggcggaggttggcaccaataggggattgctgccagaacattttctgtttctcgctcagaagatctttaacgataattcactatctatggaagcattccagcacagatccgtctcctggagccagtttaacaaagaaatattactaggcagaggctttacgttttggcagtggtttgatggggtcctggatctgactaaacgttgcctgagatcttattggagcgatcgtctgataatcggattcattagtaagcaatatgtgacaagtctgctattaaacgaacccgatggaacatttctgctacggttctctgacagtgagatcggggggatcacaattgcgcatgtgatccgcgggcaggacgggagcccccagatcgagaacatccaaccattcagcgctaaagacctatcaatcaggtcactgggcgataggatcagagacctggctcagctgaagaacctgtaccctaagaaacctaaggatgaagccttccggtctcattacaaaccagagcagatgggaaaagacggtagaggctatgtccccgcgacaattaagatgacagttgaacgggatcagcctctccccacaccagaactgcaaatgcctactatggtgccatcatatgacctgggaatggcccccgattcatctatgagtatgcaactgggtcccgatatggtcccccaggtctaccccccgcactcccactcgatacccccataccaggggctgtctccagaagagtctgtgaacgttctgagcgccttccaggagccccacctgcagatgccaccatccctggggcagatgtcactgccctttgaccagccacacccacaaggcttactgccatgccaaccacaggagcatgcagtttcaagccccgaccccctgctgtgttccgacgttacgatggtggaggactcttgcctgagccaacctgtcactgccttccctcaggggacctggatcggcgaggatatctttcctcccctgctgccaccaactgagcaggacctaaccaagttacttctggaggggcagggcgaaagtggaggagggagcctcggagctcagcccctgttgcagcccagccactacggtcaaagcgggatatccatgtcccatatggatctgcgcgctaacccctcctggtag

SEQ ID NO: 205183 - DNA, 225 bp, Artificial Sequence
  Description of Artificial Sequence: Synthetic coding sequence
atgagcctgtggggcctggtgagcaagatgccccccgagaaggtgcagcggctctatgtcgactttccccaacatctgcggcacttactcggcgactggctcgagtcccagccatgggaatttttggttggatcagatgcattctgctgcaatctggcaagtgctcttctcagcgacaccgtgcagcatctccaagcaagcgtgggggagcagggcgagggatag

SEQ ID NO: 205184 - DNA, 564 bp, Artificial Sequence
  Description of Artificial Sequence: Synthetic coding sequence
atgctgggccaccccaaggtgtgcgagaagctgaaggccctgatggtggagtggacagatgagttcaagaacgatccgcagctgagtttaatttcagccatgatcaagaaccttaaggagcagggcgtgacattccccgccatcgggagtcaagccgctgagcaagcgaaggccagccctgctctggtggcaaaggatcctgggacagtggcaaataaaaaggaagaggaggaccttgctaaggcgatagagctctccctgaaggaacagcgccagcagtctactaccctgtccactctgtatcccagcaccagtagtttgctgacaaatcaccaacacgagggcagaaaggttcgtgccatttacgatttcgaagctgccgaggacaacgagcttacttttaaagcaggagaaataatcacagtgctggacgactctgacccgaactggtggaaaggggagacccaccagggaatcgggctttttccttctaacttcgtgaccgccgacttgacagctgagcctgaaatgattaaaacagaaaagaagacagtgcagttctag

SEQ ID NO: 205185 - DNA, 1623 bp, Artificial Sequence
  Description of Artificial Sequence: Synthetic coding sequence
atgcccctgttcgccaccaaccccttcgaccaggacgtggagaaggctacctccgagatgaacaccgctgaggattggggattaatccttgatatatgcgacaaggtgggacaatccaggacaggaccaaaggattgtctgcgatccatcatgcggcgcgtgaaccataaggaccctcacgtggcaatgcaagctcttacccttctcggcgcctgcgtaagcaattgcgggaaaatttttcacctggaggtgtgctcaagggatttcgcgtcagaggtgtcaaatgtcctcaataaaggtcacccaaaagtgtgtgagaagcttaaggctctgatggtggagtggaccgacgagttcaagaatgacccacagctcagccttatctcagccatgattaaaaacttaaaggagcagggtgtaacttttccagcaattggctctcaagccgctgaacaggcaaaagcatccccagctctcgtagcaaaagaccctgggaccgtggccaataagaaggaagaggaagatctcgccaaagccattgagctgagcctcaaggagcagcggcagcagagcaccactcttagtacgctataccccagtacatcttcattgcttactaatcaccagcatgagggccggaaggtgcgtgccatttatgacttcgaagccgcagaggataatgagttgacatttaaagccggtgaaattatcactgtgcttgacgattccgacccaaactggtggaagggagagactcaccagggcattggcctgttcccttcgaactttgtgaccgccgatctcactgccgagcccgaaatgatcaagacagaaaagaagacagttcagttctcggacgacgttcaggtggagactatagagccagaacctgagcccgcgttcatcgacgaggacaaaatggatcagctgctccaaatgcttcagagcaccgacccttccgatgaccagcccgacctgccagagctccttcatctagaggcgatgtgtcatcaaatggggccattgatcgacgaaaaacttgaggatattgataggaaacattctgagttgtcggaactgaatgtgaaagtgatggaggcgctttctctctacaccaagttgatgaacgaggatccgatgtattccatgtacgcaaaacttcagaatcaaccctattatatgcagtcaagcggcgtgagcgggtcccaggtctatgctggcccgccgcccagtggcgcatacctggtcgctgggaatgctcagatgtcccatttacaaagctattctctgccccctgaacagctgtctagcctgagtcaggctgtggtccccccctccgctaaccctgcgttgccttctcagcagacccaggccgcctatcctaatactatggtgtcttctgttcaaggaaacacctatccctcccaagctccggtgtactctccacctccagccgctacagcagccgctgctacagctgatgtgaccctgtaccagaatgctggccctaacatgcctcaggttcctaattataatcttacttcttctacattgccccagcccggtggatctcagcagccacctcagccgcagcagccatatagccaaaaggccctactgtag

SEQ ID NO: 205186 - DNA, 357 bp, Artificial Sequence
  Description of Artificial Sequence: Synthetic coding sequence
atgcggcgggtgaaccacaaggacccccacgtggccatgcaggccttgacactactcggggcctgcgttagcaattgcggcaaaatctttcacctagaggtctgctcccgcgacttcgctagcgaagttagtaatgttttaaataagggacaccccaaggtatgcgaaaaactgaaggcactgatggtcgagtggaccgatgaattcaagaacgacccacagctcagtctcattagtgctatgatcaagaatctgaaagaacaaggtgttactttcccagctatcgggagccaggcagctgaacaagccaaggcctctccagcactggtggcaaaagacccagggactgtagcctag

SEQ ID NO: 205187 - DNA, 1290 bp, Artificial Sequence
  Description of Artificial Sequence: Synthetic coding sequence
atggtggagtggaccgacgagttcaagaacgacccccagctgagcctgatcagcgctatgataaagaacttgaaggaacaaggggttacattcccggccatcggttctcaagcagcggagcaggctaaggcatcccccgccctggtcgccaaggaccctgggactgttgctaataaaaaggaggaagaggaccttgcaaaagcaatcgagctgtccctgaaggagcaacgccagcaatctactactctctctacactgtacccttccacctcctctctgctgacgaaccaccagcacgagggaagaaaggtgcgtgcgatttatgacttcgaagctgccgaggataacgaactgacctttaaggccggagagataatcactgtgctggacgactctgaccctaattggtggaaaggggaaacacatcaagggatcggcctgtttccgtcaaacttcgtgacagctgacctgacggctgagccagagatgattaagacagaaaaaaaaacggtccagttctccgatgacgtccaggtggaaactatagagcctgagccagaacccgcttttattgacgaggataaaatggaccaattgcttcaaatgctccaatctacagacccctctgacgaccagcctgacttaccggagcttctgcacctcgaggccatgtgtcatcagatgggacccttgatcgacgagaagctcgaggacatagaccgcaagcacagtgaacttagcgagctcaatgtgaaggtgatggaagccttgagtttgtacaccaaactcatgaatgaggaccctatgtatagtatgtatgcaaagctccagaatcaaccctactatatgcagtctagtggcgtgtccggcagccaggtgtatgctgggccacctcccagtggcgcatacctggtagctggcaacgctcagatgtcacacctccaatcatattctttaccccctgagcagctgtcttcattaagccaggctgtggtcccccccagtgctaatcccgcattaccaagtcagcagacgcaggccgcctacccgaacactatggtgtcaagtgtacaaggtaacacgtatccttctcaggccccagtctacagtccccctccggccgctactgcagctgctgcaacggccgacgtgaccctgtaccagaatgcaggccccaatatgccacaggtacccaattacaacctgacttcgagtacattaccccaacccggaggctcccagcagcccccacaaccacagcagccttatagccaaaaggcgctgctgtag

SEQ ID NO: 205188 - DNA, 1578 bp, Artificial Sequence
  Description of Artificial Sequence: Synthetic coding sequence
atgcccctgttcaccgccaaccccttcgagcaggacgtggagaaggcaacgaatgagtacaacacaaccgaagattggtctctgatcatggacatctgcgataaagtcggttctaccccaaacggggccaaggattgtcttaaagcgatcatgaaacgggtcaatcacaaagtgccccacgtcgcactccaagctctcaccctgctgggggcctgtgtagccaactgtgggaaaattttccacttagaagtctgcagtagagattttgctactgaagtccgtgccgtgattaaaaataaagcccatccaaaggtctgtgaaaagctcaaaagcctgatggttgagtggtctgaggaattccagaaagacccccagttttccctaatcagcgcaacaataaaatcgatgaaagaggaggggatcacatttcctcccgcaggatcccaaacagtgtccgcagccgccaaaaacggtacatcctctaataaaaacaaggaagacgaagatattgctaaagctatcgagctgagcctgcaggaacagaagcagcagcacactgagactaagagcctgtacccttcaagtgaaattcaactgaacaacaaggttgcgagaaaagttagagctttatacgactttgaggcagtcgaagataacgaactgacttttaagcacggggagatcattattgtgttggacgactcagacgcaaattggtggaagggggaaaatcaccggggaatcggtcttttcccaagtaacttcgtcaccactaatctcaatatcgagactgaggccgcagccgttgacaaactgaacgtgattgacgatgacgttgaggaaattaaaaagagcgagccagagccagtctacattgacgaggataagatggacagggctctgcaggtgttacaatcaatcgaccccactgatagcaaacctgatagccaggatcttcttgacctggaggatatctgtcagcagatgggacctatgatagacgagaaactcgaggaaatagataggaagcacagcgagctgagcgagcttaatgttaaggtgttggaagccctggagttgtacaacaaactggtaaatgaagctcccgtgtactcagtttatagtaagcttcacccccccgcccattatccccccgccagtagtggagtgcctatgcaaacgtaccctgtacagtcccatgggggaaattatatgggccagtccatccatcaggttactgttgctcagtcatatagcctcggtcctgatcagattggacctctgagaagcctgcctccaaatgtcaattcctccgtgacagcccagccggcccagacctcttatctttccaccgggcaggatacagtgtctaacccgacatatatgaatcagaatagcaaccttcaatctgctaccggaaccactgcctacacccagcagatgggtatgtccgtggatatgtcttcataccagaacactacttcaaatctcccacagctggctggcttcccggttacggttccagcacacccagtcgcacagcagcatacaaactatcaccagcaaccgctgctgtag

SEQ ID NO: 205189 - DNA, 3129 bp, Artificial Sequence
  Description of Artificial Sequence: Synthetic coding sequence
atgcccatgtgggccggcggcgtgggcagcccccggcggggcatggccccggcgtctactgacgacctttttgcacgcaagcttcggcagccagctagacctcctctgaccccccacacgttcgagcccaggcccgttagagggcccctgctgcggtccggaagcgatgcaggcgaagcacggccccccacccccgcctccccccgggctagggcgcattcccacgaggaggccagccggcccgcagcgacttcgaccagattgtttactgatcccctcgcactgctgggactcccagccgaagagcccgagcccgccttcccccctgttctcgagcctcgatggtttgcacattacgacgtgcaatccctcctatttgattgggccccccgttcccagggaatgggatcacacagcgaagcctccagtgggacactggctagtgccgaggaccaagccgccagtagcgatctcctccatggggcaccggggttcgtttgcgagctcggtggggagggagagttagggttgggcggacccgcctccccccctgtcccccccgcactacccaatgctgccgtctcaatccttgaagaaccccagaacaggacttcagcctattcccttgagcacgctgatcttggcgccggatactataggaaatacttttatgggaaggagcaccagaacttcttcgggatggatgaatccctcggccctgttgcagtaagtcttcggcgcgaggagaaggagggtagcggcggcggtacccttcatagttaccgggtcatcgtcagaacaactcaactgaggactttgcgcggtaccatcagcgaagacgccttacccccaggccctccacgtgggctttcaccacgcaaacttttggagcacgtcgcaccgcaattgagcccttcttgtctgcgactcggctcagcttcgcccaaagtcccccggacattattgacactggacgagcaggttttatccttccagagaaaagtgggcatactctactgtagagctgggcaaggctctgaggaagagatgtataacaaccaagaagcgggccctgcctttatgcagtttctgacgcttctcggagacgtggtgagactgaagggctttgagtcttatagagcacagttagatactaagaccgactctacaggcacccattcactttatacaacatatcaagatcatgagatcatgtttcacgtcagtaccatgttgccatacacgcccaacaaccagcaacagctgttgagaaagaggcatataggaaacgacatcgtgactatcgtgtttcaggagcccggctccaagccattttgcccaactaccatccggtcacactttcagcacgtattccttgtagtcagagctcatacgccgtgtacccctcacacaacctaccgagtagctgtgtctaggacccaagacacgccagccttcgggcccgcccttccagcaggagggggcccctttgctgccaatgctgactttagggcatttctattagcaaaagctctgaatggagagcaggcggctggccatgctaggcagtttcacgccatggcaacacgcaccaggcaacaatacctgcaggatctggctaccaatgaggtgacaactacgtccctcgacagcgcctcccgctttggactgccaagcttgggcgggagacggagagcagcacctagagggccaggggccgaacttcaggctgccggcagcctcgtttggggtgttcgggccgctcccggcgcccgggtcgctgctggggcacaagcgtctggcccagaaggaatcgaggtgccctgtctgcttggcatttctgcagaggccctggtgcttgtcgcacctagagacggaagggtggtctttaactgtgcttgtcgcgatgtgttggcgtggacattctctgaacaacaactggacttgtatcatggtagaggagaggccatcacactgaggtttgatgggagccctggccaggcagtcggcgaggtggtggcgaggctgcagctggtttcccgcggttgcgaaacgagagagctcgcactgcccagggacggacagggtcgactcggtttcgaagtagacgccgagggatttgttacacacgttgaacggttcacgttcgctgagacagctggcctgcgcccaggggctcgactgctgcgagtttgcggccagaccctgccaagcttgcgaccagaggcagctgctcaactactgcgttccgcaccaaaggtctgtgtaaccgtgttacctcctgacgaatcaggtcgcccacggcggtccttcagtgagctgtacactttatccttgcaagagccttcgcggcgcggcgcgcctgatccagttcaagacgaggtacagggcgtcacactccttccaacaacgaagcagcttttgcatctgtgccttcaggatggagggtccccacctggaccaggcgacctggctgaggaaaggactgagttcctgcactcgcagaatagcctgtccccaagaagcagcctgagtgatgaagctcccgtgctgccaaacacaacaccagatctgctgttagccactactgccaaaccttccgttcctagcgcagacagcgagacccctctgacacaggacagaccggggagccccagcggctcagaggataaaggaaaccctgcgccggagctgagagcctcatttctcccacgcaccctctctttaaggaactcgatctctcggattatgtcggaagctggatctgggacactcgaggatgaatggcaggccatctccgagatagccagcacctgtaacactatcctggagagtctcagcagagagggtcaacctattccggaatctggagaccctaaggggactccaaagtcagatgcagaacccgagccaggtaacctctcagagaaggtttcccaccttgaaagcatgttgagaaagctgcaagaggatttacagaaagagaaagccgacagggctgccctcgaagaggaggtgcgcagtctacgtcataataatcgccgcctgcaggcagagtccgagagtgctgccacgcggctcttattagcatcaaagcagctagggtcacctaccgcagacttggcttag

SEQ ID NO: 205190 - DNA, 2823 bp, Artificial Sequence
  Description of Artificial Sequence: Synthetic coding sequence
atgcccatgtgggccggcggcgtgggcagcccccggcggggcatggcgcctgcgagcaccgatgacttgtttgccaggaaattgcggcagcccgcccgcccccccttaacaccccatacctttgaaccacgaccggtccgcgggccattgcttcgctcaggtagcgatgcgggggaagcacgaccaccaacccccgcatcacctagggcccgagcccatagtcacgaagaggcgagcagacccgccgcaacaagcacaaggctgttcactgaccccttagccctcctggggctgcccgccgaagagccagaacccgcctttccacctgtattggaacccaggtggttcgctcactatgatgtgcagtctctgttgttcgattgggcacctagatctcaaggtatgggtagtcactcagaggctagttccggaaccctggctagcgccgaagatcaggccgcgagctctgacctgttacatggggcaccaggtttcgtgtgcgaattaggcggggaaggtgaactcggtcttggagggccagctagtccccccgtaccacccgccctacctaatgctgctgtatcaattttggaggaacctcagaaccggactagcgcgtactcgctggagcatgccgatctgggagcagggtattatcgaaaatacttttatggcaaggagcatcagaactttttcgggatggacgagtccctggggcccgtggcggtgtctctccggagagaggaaaaggaaggaagtggcggaggcaccttgcattcctaccgcgtgattgttcgaactactcaactgagaactctgcgcggaacaatctctgaggacgccctcccacctggcccaccacggggcctgagtcctagaaaacttctggagcacgtagctcctcagctatccccatcgtgcttgcggttggggagcgccagtcccaaggtgccccgcacactgttaaccttagatgaacaggtgctgtctttccaacgaaaggtgggtatactctattgcagagccggccaaggctcagaggaagagatgtataacaatcaggaggccggcccggccttcatgcagttcctgaccctcctcggggatgtcgtaaggctcaaaggcttcgaatcttaccgggctcagctcgatacaaaaaccgattcaacagggacacacagcctgtatactacttatcaagaccacgagataatgttccatgtgtcgacaatgcttccttacacccctaataaccaacagcaactgcttcggaaacgccacatcggcaatgatattgtcacaatcgtatttcaggagccaggaagcaaacccttttgtcccactacaatcagaagccactttcaacatgtctttcttgttgtgcgggctcacacaccatgcaccccacacacaacatatcgggtggccgtgtcccggacacaagatactcccgcttttggccctgctctgcccgctgggggtggaccatttgctgccaatgcagacttcagagccttcctgctggcaaaagcactaaacggggaacaagcggccgggcacgcccgccaatttcatgctatggccaccaggacccggcagcaatacctccaagacctcgcgaccaacgagcagctggatctgtaccatggcagaggggaagcaatcactcttaggttcgatggatcacctgggcaggccgtaggggaggtggtagcccgactgcagctggtgtctcgagggtgcgaaacccgggagctggccctgcctcgagatggacaaggcagattgggattcgaggtggatgccgagggcttcgttactcacgtggagaggtttacattcgcagagactgcaggattacgccccggtgcgcgtctgttacgggtttgtggacagaccctccctagcctgcgccctgaggccgctgcccagctgctacggtccgcccctaaggtctgcgtaaccgtccttcctcccgacgaatcaggccggccccgacgatccttttcagagttgtataccttatctctgcaggagccaagcaggcgaggagcacccgatcctgtgcaggacgaggtgcagggtgtgacattactgcctaccactaagcagttgctccatctatgtctccaggatggcggttcccctccagggccaggtgaccttgccgaggaaagaaccgagttcctgcacagccagaattccttgtcgccacgttcctctctgtctgacgaagcaccagtcctgccgaataccactccagatctgctactagccactaccgcaaaaccgtccgtacccagcgctgacagcgagacacccctcacacaggaccggcccggtagcccaagcggctcggaggacaaaggaaatcctgcccccgagctgagggccagctttctccctagaaccctctcgttacggaactctatctccagaatcatgtctgaagccgggtctggtacactcgaagatgagtggcaggccatcagcgagattgcatctacctgcaatacgattctggagtccctcagcagggagggtcagccaatccctgaatcaggcgatcctaagggcacgccgaaatctgatgcagaaccggagcccggaaatttaagtgaaaaagtaagccacttggagtccatgctgcgtaaacttcaggaggacctccaaaaggaaaaggctgatcgggccgcactggaggaggaggttcggtccctgcggcataataaccgcagactgcaggcagagtccgagagcgccgcaactcgacttcttctcgcttctaagcagctcggatctccgaccgccgatttggcctag

SEQ ID NO: 205191 - DNA, 21 bp, Artificial Sequence
  Description of Artificial Sequence: Synthetic coding sequence
atgcccatgtgggccggctag

SEQ ID NO: 205192 - DNA, 312 bp, Artificial Sequence
  Description of Artificial Sequence: Synthetic coding sequence
atgcccatgtgggccggcggcgtgggcagcccccggcggggcatggctcctgctagcacagatgacctgtttgctcgaaaacttcgtcagccagctcggcctccactgacacctcacacattcgaacctaggccagtgaggggtcccctgctcaggagcgggtctgatgctggagaggcccggccccctacacccgctagtccccgtgccagagcccacagccacgaagaagctagtcggcccgccgccacaagcacacgcctctttaccgatccccttgcccttctggggctgccggccgaagaaccatag

SEQ ID NO: 205193 - DNA, 3129 bp, Artificial Sequence
  Description of Artificial Sequence: Synthetic coding sequence
atgcccatgtgggccggcggcgtgggcagcccccggcggggcatggcgccagcctcaacggacgatctctttgctcgcaagctgcggcagccagccaggcccccgcttacacctcatacattcgagccccgtccggtgcgtggccctctactgagatcagggagtgacgcgggggaggctcgtcccccgactccagcctccccaagggccagggctcacagccacgaagaggctagcaggcctgcagcgacaagcaccaggctctttactgatcccctcgccctgctggggctccccgccgaggaacctgagcccgcctttcctcccgtcctcgaacccagatggtttgcccactatgacgtgcagagtctgctgttcgattgggccccacgctcccaaggaatgggtagtcactcagaggcctctagtggcaccctggcatctgctgaagatcaggcagcttcgtctgacctcctgcacggcgccccggggtttgtctgtgaacttggtggagaaggtgaactagggctgggaggtcctgcaagtccccctgtcccccccgccttgccaaacgccgccgttagtattcttgaggagccccagaacagaacctctgcttatagcctggaacatgcagatctgggtgccggctattatcggaaatatttctatggcaaagaacatcagaatttcttcggcatggacgagtctctgggcccagtggccgtgtctctacgacgagaggagaaggaaggatccggaggcggtacgcttcactcataccgagtcatcgtgcgcactacacagctgagaacgcttcgaggtaccatatccgaggatgccttgcccccgggtcccccccgaggtctctcaccccgcaaactcctcgagcatgttgcaccccagctgtctccgagttgcttgcgtctgggcagtgccagccccaaggtccctcggacactcctgactttggatgagcaggtgctgagcttccaacggaaggtcggtatactatactgccgggccggccagggcagcgaggaagaaatgtataataatcaggaagccggcccggctttcatgcaattcctgaccctgctcggagatgtagtgagacttaagggcttcgagagttaccgcgcccaattagacactaaaacagattcgaccgggacacacagcctctacaccacctatcaggaccacgagattatgttccacgtatctactatgctaccctatacccccaacaaccagcaacaattgttaagaaaaaggcatattggtaatgacatcgtaacaatcgtttttcaggaacccgggagcaaaccattttgcccaactaccatccgtagccatttccagcatgtgttcttagtcgttcgggctcacaccccgtgtactccacacactacttatagggtggccgtctcccggacacaggatacacctgcttttggccccgccctgcccgccgggggaggcccttttgctgccaatgctgactttagagccttcctgctggccaaggccctaaacggagaacaagccgcaggtcacgcccgacaatttcacgccatggccaccagaacccggcagcagtatttacaggatctcgctactaacgaagtgaccactaccagtctcgattcggcctccagattcggcctgccaagcctgggtggaaggcggcgggccgctcccaggggccctggagcagaattgcaggccgctgggtcactcgtgtggggcgtaagggccgctcccggggcccgcgtcgccgccggcgcccaagccagcggacccgaagggatcgaggtgccttgcctgctgggaatctccgccgaggcgcttgtcttagtggctccaagggatggacgggtggtatttaactgtgcctgcagagacgtcttagcttggacgttcagtgaacagcagctggacctctaccatggccgaggagaggctataacgctgcgtttcgacggaagtccaggccaagctgtgggtgaggtggtggccaggctccagttagtgtcacggggctgcgaaacgagagagttagcccttcctagggacggacagggaagactgggcttcgaagtcgatgctgagggatttgtgacccacgtggagcgctttacgtttgctgagacggctgggcttcgccctggggcccgtttgcttagggtttgcggacagaccctgcctagtttaagacccgaggccgccgcccagctgctccgcagcgctcctaaggtatgtgtcacggtgctgcctcccgacgagtcaggcagaccccgaaggtctttttccgaattgtatacccttagcctccaggaacccagtcgcagaggggcaccggatcctgtccaggacgaggtccagggtgtgacactgttgccaacaaccaagcagttgctccatttgtgcctgcaggacggtggcagcccacctggtcctggcgatcttgcggaagagcgaactgaatttcttcactcgcagaattccttaagcccaaggtcaagtctgtcagatgaggccccagtgttacctaacaccacgcccgacctgctcctcgctaccaccgccaaaccctctgtgcccagcgccgacagcgagacaccacttacccaggaccgccctggctctccatccggaagtgaggacaagggcaaccccgcacccgaacttcgcgctagtttcctacctcgtactctgtctctgaggaatagtatctccaggataatgtccgaagctggctccggtacccttgaggatgagtggcaggccatcagcgagatcgccagtacctgtaacacaattctggagagccttagcagagagggccagcccattcccgaatccggcgatcctaaaggtacgccaaagagtgacgccgaaccagagccaggcaatctgtctgaaaaagtgtcccatttggaatcaatgctgcgcaagctacaggaggatctgcagaaggagaaggccgatagagccgctcttgaggaagaggtcagaagcctccgccacaataaccgaaggctgcaggctgagtctgaatctgctgctacccgcctgttgttggcttcgaagcaactcggatcccctacggccgacctggcttag

SEQ ID NO: 205194 - DNA, 5169 bp, Artificial Sequence
  Description of Artificial Sequence: Synthetic coding sequence
atgagcgacccccggcagagccaggaggagaagcacaagctgggcagagcctcgtctaaatttaaggatccgccccgcattatgcagtctgatgattacttcgcacgtaagtttaaggcaattaacgggaatatgggaccaactacgtccttaaatgcctcaaactccaacgagacagggggcggcggacccgcgaacggcacaccagccgtgcctaagatgggcgtgagggcaagggtgtcagagtggccaccgaaaaaggactgttccaaggagctcacctgtaaagcactgtgggagagcaggagtcaaacctcatacgagagcatcactagcgtgctacaaaatggtcagtcggatcagagcgagggacaacaggatgagcagctggacctggacttcgtggaagcaaagtatactattggagatatctttgtccattctccccagcgtggccttcaccctatccggcaaaggtccaacagcgacgtaactattagcgacattgacgcagaagacgtcctggaccagaacgctgttaatcccaacactggtgcggctcttcaccgggagtacgggagcaccagcagcatcgatcgccagggcctgagtggagaaaatttctttgccatgctccgcggctatcgggtcgagaattatgaccataaagctatggtccccttcggttttccggagttttttagatgcgatcccgcaatttcaccatccctccacgcagccgcccagatatctaggggagaatttgtgagaattagtgggctcgactacgtcgactctgcgctcctgatgggtcgagaccgggataaaccttttaagcggagactaaagtccgagtctgtagagacatctctgtttagaaagctgcggacagttaagagcgaacacgagactttcaagttcacctcagagctggaggagagtcggctggagcgtggtatcaggccatggaattgccagcgttgctttgcacactatgacgtgcagtctattctttttaacataaatgaggccatggcaacgagagccaatgtgggaaaaagaaagaacattaccaccggcgccagtgctgcatcccagacgcagatgccgactggacagaccgggaactgtgagtccccactgggatctaaggaggacctaaactccaaagagaatcttgatgccgacgagggggacggaaagagcaacgatctggtcctgagttgcccttattttcgtaatgaaacgggaggggaaggagacagaaggatcgcgttatcgcgggcgaattcaagtagcttctccagtggtgagagctgctctttcgaatcatccttaagcagccattgtacaaacgccggagtttccgtgctggaagttcccagggagaaccagcctattcatcgggaaaaggtgaaaagatatattattgagcacatagacttaggcgcatactactatcgaaaatttttttatggcaaggaacaccagaactactttggcattgacgagaatctcgggcccgtggccgtgagtattcggagagaaaaggtggaggacgcgaaggagaaagaggggtcccagttcaattaccgggtcgcatttcggacgagcgagctgaccactttgagaggtgcaattctcgaggacgcaatccctagcactgccagacacggaacagcccgtggactgccgcttaaggaggttctggagtacgtgatacccgaactcagcattcagtgtctgagacaagcctctaattccccaaaggtgtccgagcaactgcttaagctagatgaacagggtctgagtttccagcacaagattggaatcttgtactgcaaagcggggcagtctacagaggaggagatgtataacaacgagactgcaggtccagccttcgaggaattccttgatttgctgggccaacgagttcgcctcaagggattcagcaagtaccgtgcccagttagataacaaaacagattccaccggtacccattcactgtacaccacctacaaggactacgagctcatgttccatgtttcaaccctgttgccctacatgccgaacaatagacagcagcttctccgcaagcgccatataggtaacgatatcgtgactatcgtctttcaggagccaggggccctcccatttactcctaagtcaatccgttcacacttccaacatgttttcgtaatagtgaaggtgcacaatccctgcacagagaacgtgtgttatagtgttggcgtctcccgatcgaaagacgtgcctccttttggccctcccatcccgaagggggttacttttccgaaatccgccgtgtttcgcgatttcctgctggccaaagttataaacgcggaaaacgccgcgcacaagtcggaaaagtttagagcgatggcaacgagaacccgccaggagtacttaaaggacctcgctgagaactttgtaaccactgcgaccgttgacacaagcgtcaagttctcattcataactctcggggctaagaagaaagagaaggtgaagccgcggaaggatgcacacttgttttcaattggtgctattatgtggcatgtgattgccagagattttgggcagtctgccgatattgaatgcctccttgggattagcaatgaatttatcatgttgattgagaaagacagcaagaacgtggtgttcaactgtagctgtagagacgtgattggatggacctccggtcttgtcagcatcaaagtcttttacgagcgtggcgaatgcgtgctgttgtcttctgtggacaattgcgctgaagacatcagggagatagttcagcgtctagtaatcgttacccgcgggtgtgaaacagtggaaatgaccctgcggcggaatgggctgggtcaactgggctttcatgttaactttgaagggattgtagcagacgtggagcctttcggattcgcctggaaagccggcctcagacagggctcacgtctcgtggagatttgtaaagtggcagtggccactctgacgcacgagcagatgattgatctgctcaggacctctgtaaccgtgaaagtcgttattatacagccgcacgatgacggttctcctagaagggggtgcagcgaactctgtcggattcctatggtagaatacaagcttgactctgaagggaccccttgcgagtacaagacccctttccgccgcaatacgacatggcatagggtgcccacgcctgcgctgcaacccctctcacgggcatcacctatccccggaacacctgaccgcctaccctgtcagcaactcctgcaacaggctcaggcagccataccacggtccaccagcttcgaccgcaaattacccgacggaactcgctccagccccagtaatcagtcgtcaagctctgatccgggtcctggcggatccgggccctggcgaccccaagtcgggtacgacggatgccagagccccctactgcttgagcaccaaggttccggccccttggagtgcgacggcgccagggagagggaagacacaatggaagcatcacgtcatcctgaaacaaaatggcacgggccccctagtaaggtgttaggctcttacaaggaacgcgccctccagaaggatgggtcctgtaaagactccccgaacaagctgtcacatatcggagacaaatcatgtagttcccactcatctagcaacaccctcagcagtaacacttcatccaactctgacgataaacacttcggcagcggcgacttaatggaccccgagctgttgggactcacatatataaagggcgcttccacagacagcgggattgataccgcaccgtgcatgcctgccactattttggggcctgtgcatttagcggggtccagaagcttgatacactcaagagctgagcagtgggcagatgctgctgacgtttcaggtcctgacgatgagccggctaagctttacagtgtgcatggatacgctagcacaatttctgcaggaagcgcagccgagggatcaatgggggacctctcagaaatctccagtcacagctccggcagccaccacagcggcagcccatctgctcattgttccaagtcctctggcagcctggactccagcaaagtgtatatcgtgagtcactctagcgggcagcaagtgccaggaagcatgagcaaaccatatcacaggcagggagctgtgaataagtacgtgataggctggaagaaaagcgagggcagtcctccaccagaggagccagaggtgaccgaatgtcccggaatgtactcggaaatggatgtaatgtccactgccacacagcatcaaaccgtggtcggggacgcggtggctgagacacagcacgtgctgtccaaggaggacttcctgaaactcatgctgccggattccccactggttgaggagggacgccgtaaattcagtttctatggaaacttatctcctagaaggtcactgtatcggaccttgtctgacgagtctatttgcagcaatagacgcggaagcagctttgggagctccagaagctccgtcttagatcaagcgctgcccaatgacatcctgttctctactaccccaccctatcattctacgctccccccccgagcccatccagcgccaagcatgggcagcctgagaaacgagttttggttcagtgatgggagcctcagcgacaagtcaaaatgtgccgacccgggtctcatgccactgcctgacacagcaacaggattagattggacgcaccttgtggacgctgctagggcgtttgaaggtctggactcagacgaggagttaggacttctttgtcatcacacctcatacctggaccaacgagtggcttccttttgtacactaaccgacatgcagcacggacaggacttggaaggggcgcaggaactgcccctctgtgtcgacccaggtagcggtaaagagttcatggatactactggagaacgcagtccatctccacttactgggaaggttaatcagctggagttaatactgcggcagctccagaccgacctccgcaaggaaaagcaagacaaagcagtcctgcaggccgaggttcagcacctgcggcaagacaacatgcgcctccaagaggaaagccagaccgctaccgcgcaattacgcaaatttacagagtggtttttcaccaccatcgacaagaagtcttag

SEQ ID NO: 205195 - DNA, 2337 bp, Artificial Sequence
  Description of Artificial Sequence: Synthetic coding sequence
atgagcccctgcttcagcttcatcggctgcaagctgtgcagcatcgtgacaagaggctgtgaaactgtggagatgaccctcaggaggaacggattaggccaacttggattccacgtgaattttgaagggattgtagccgacgtggagcctttcggcttcgcttggaaggcggggttacgccaaggttccagactggtcgagatctgtaaggtggcagttgctacattaactcacgagcagatgattgacctgctgagaacttccgtgaccgttaaggtagtaataatccaaccacacgatgatggtagcccccggagaggctgttcagaactgtgccggatccccatggtggaatacaaactggatagcgaagggactccatgtgagtacaagactccctttagacggaatacaacatggcaccgcgtacctacccccgctcttcaacccttaagcagggcctcgcctattcccggtacaccggatcgcttaccttgccagcaactgctccagcaggctcaggccgctatccctcgaagcacgagctttgataggaagctgccagacgggacacgtagttctcctagcaatcaatcaagcagctccgatcctgggcccggagggtccggtccctggcgcccccaagtgggctacgacggttgccagtcccctctgctcctggaacatcagggttctggccctttggagtgcgatggtgcccgggaaagggaggacactatggaggcatcacggcatcccgaaacaaaatggcacgggccaccgtctaaggtattgggctcctacaaggaaagggctctgcaaaaggacggaagctgcaaagattccccaaacaaactttctcatataggagataaatcttgtagctcccacagttcttccaacacattatctagcaacacttccagcaactcggatgacaagcacttcggctcgggcgatctaatggatcccgaattgctggggctgacttacatcaagggggcatcaactgattcagggatcgacaccgctccatgtatgccagcaacgatcctgggccccgtacatcttgctgggagtaggtcacttatccattcgagagccgagcaatgggctgatgctgccgatgtcagtggtcctgacgatgagcctgctaaactgtacagcgtccatggctatgcatcaactatctctgcaggatccgctgccgaaggcagcatgggagatctgagcgagatcagcagccatagctccggcagccaccatagcggttccccaagcgcccattgtagcaagagctctggctccttggattcgagcaaagtctacatagtgagccactctagcgggcagcaggttcccggatccatgtccaagccctatcacaggcaaggcgccgtcaacaaatatgttatcggctggaaaaaatccgaggggtccccgcccccagaggagcccgaagtaaccgagtgccctgggatgtacagcgaaatggatgtaatgtccaccgcaacacagcatcagaccgttgtcggtgatgcagtggcggagactcagcatgtgctgagtaaggaggattttttaaaattgatgctgccagactccccgctggtggaggaggggcggcgcaagttttctttttatggaaacctgtcgccccgtcggtcactctaccggaccctctccgatgaatctatctgcagcaacaggagaggctcatccttcggcagctcccgttcctctgtgcttgaccaggccctgccgaacgatatcctgttcagtaccactccaccatatcactctacactgccaccccgcgcccacccggcgcccagcatgggaagcttgagaaatgaattttggttctctgacggctctctctctgacaagtccaaatgcgccgaccctgggctgatgccattgccagatacagccacagggctggattggacccatcttgtagacgcagctagagcatttgaagaccagcgggtagcctctttttgtacacttaccgacatgcagcatgggcaagacttagagggggctcaggaactgcctctgtgtgtcgatcccggatcagggaaggagttcatggacaccacaggagaaagatcgccaagtcctctgaccgggaaggttaaccaattggaattaatcttgcgtcaattacagaccgatcttagaaaggagaaacaggacaaagccgtgcttcaggctgaggtgcagcacctgcgccaagacaacatgcggcttcaagaggagtctcagaccgctactgctcagcttaggaagttcacagagtggtttttcacaacgatcgataagaagtcttag

SEQ ID NO: 205196 - DNA, 5169 bp, Artificial Sequence
  Description of Artificial Sequence: Synthetic coding sequence
atgagcgacccccggcagagccaggaggagaagcacaagctgggcagggctagtagtaagtttaaagaccccccaaggatcatgcagtctgacgactacttcgcccgcaagttcaaagccatcaacggaaacatgggccccacaacatcgctcaatgcctctaattccaacgagacgggggggggagggccagcaaacggtacccccgcagttccaaagatgggtgtgcgtgcccgggtgagtgagtggcctcctaagaaggactgttcaaaggagttaacttgcaaggccctgtgggaaagccgttcgcagacaagttatgaatccattacaagcgtgctgcagaacgggcagagcgaccaatccgaagggcagcaagacgagcaactcgaccttgacttcgtagaggccaagtacacaattggcgatatattcgtgcacagccctcagcgggggctccatcctatcagacagaggtccaatagtgacgttacaatctctgacatcgacgccgaagatgtcctggaccagaacgctgtcaatccgaacacaggagctgcccttcaccgtgaatacggctcaaccagcagtattgatcgccagggcctgtccggggagaattttttcgcgatgttaagaggctacagagtagagaactacgaccacaaagctatggtgccatttgggtttcccgaatttttcaggtgtgatcctgcaatttccccttcgctacacgcggccgcccaaatctcccgcggggagtttgttcgaatctcaggcctcgactacgtggactccgctcttctcatgggtcgagaccgggacaagccttttaagcgcagactaaaatcagagtcagtcgaaacttccctgtttcgcaagctcaggaccgtgaagtccgagcacgagacctttaaattcacaagcgaactggaagaaagccggctcgaacgggggataagaccctggaactgccagcggtgctttgcccactatgacgttcagtcaattctcttcaacattaacgaagcaatggctacacgggctaacgtaggcaagaggaagaatataaccaccggagcctcagccgcaagccaaacccagatgccaacaggacagaccggtaactgtgaatctcctctgggatctaaggaggacctgaactccaaggagaacctcgacgctgatgagggggacggaaagtctaatgatctcgtgctgtcttgcccctattttagaaatgaaaccggaggcgaaggtgatcggcggattgcccttagccgtgccaatagcagctcttttagcagcggggaatcatgttcgttcgagagcagtctcagttctcattgcaccaatgcaggtgtgagcgtcttggaggtgccccgagaaaaccagcccattcatagagaaaaagtcaaacggtatattattgaacacatagatctcggcgcatactattatagaaagtttttctacggtaaagaacatcagaattacttcggaatagacgagaatttgggccctgtcgcagtctccataaggcgcgaaaaggtcgaagatgctaaagagaaagaagggagtcagttcaactaccgtgtagctttccggacaagcgagcttaccactctcagaggggccatactggaagatgccattccgtctaccgcccggcacggtacagcgcggggactcccgttgaaggaagtgttggagtacgtgattcccgagttgtcaatccaatgcctccgccaggctagcaactcgcctaaagtgagcgaacagctgctgaaactggacgagcaaggactcagcttccagcacaaaatcggcatcctgtactgcaaagccggacagagcacagaggaggagatgtataacaacgagactgcaggcccagcttttgaggaatttttagatctgcttggtcagagggtacggctgaagggattctccaaatacagagcacaattggataacaagaccgatagcaccggtacacattccctgtacacgacgtacaaagattacgagctcatgttccatgtgtctactctgctgccatacatgcccaataatcgccaacaattgctgcgtaagcgacatatcgggaacgacatagttactatagtttttcaggaacccggtgcactgccttttacacctaaatcgatacgctcccactttcaacacgtgttcgtcattgtgaaggttcacaatccatgtacagagaatgtgtgctactccgtgggagtcagccgctcaaaagacgtgcccccctttggtcctcctattccaaaaggtgtgacctttccaaagtctgcggtgttccgggatttcttgctggcaaaagtgattaacgccgaaaacgccgctcataagtctgagaaatttcgtgctatggccacccgcacaaggcaggagtacttgaaagacctcgccgaaaacttcgttaccactgcaaccgtagatacgagcgtgaagtttagcttcattaccctgggcgcgaagaagaaagagaaagtcaagccgaggaaggatgcccacctattttcgattggagcgattatgtggcatgtgattgccagggacttcggtcaatcagctgatatcgaatgcctgttgggcataagtaatgaatttataatgctgatcgagaaggactcaaagaatgtggtgtttaactgtagctgccgagatgtgattggttggacatcaggacttgtttccatcaaagttttttacgagcgcggagagtgcgtgcttttgagctcagttgacaactgtgcggaagacatccgtgagatcgttcagaggctggttatagtgactcgcgggtgcgagactgtcgaaatgaccctgagaagaaacggactggggcaattgggctttcacgtaaatttcgaaggtattgtggccgatgtggaaccctttggatttgcttggaaggcaggtcttcgtcagggctctcgactggtggagatatgtaaagtggccgtggcaacgctcacacatgaacagatgatcgacttactgcggacttccgtcacagtgaaagtggtgatcattcagccccatgacgacggatctccacgcagaggctgttccgagttgtgcaggattcccatggtcgaatataaactcgactcggagggcactccttgtgaatacaaaacaccatttcgccgcaacacaacctggcacagggtgcctacccccgctctccagcccctgagccgtgcttcacccattccaggcactcctgaccgtctaccatgccagcagttgctacagcaggcccaagcagccataccccggtctaccagcttcgaccgtaaattaccagatggtacacggtcatctccaagcaaccagtcgagcagctctgacccaggtcccggtggcagcggcccttggaggccgcaggtgggttatgatggttgccaatcgcccttactgctggaacaccaaggcagcgggcctcttgagtgtgacggagccagagagagggaagacaccatggaggcatcccgccacccagagactaagtggcacggaccaccctctaaggtgctgggctcttacaaagaacgtgctctacagaaggatggctcttgtaaagacagccccaacaaactttctcacattggggacaaaagctgctcatcccactcctcttctaatacgctctcctcaaacacttcaagcaatagcgatgataagcactttggatcgggcgacttgatggacccggaactgctggggttaacttacatcaagggagcgagcactgattccggcatcgataccgccccgtgcatgcctgccacaattctggggcctgttcatctggccgggagcaggtcactgatacattcgcgtgccgaacagtgggcagacgcagccgacgtaagcgggccagacgacgagcccgctaaactgtattccgtgcatgggtacgcaagcacaatttcagcgggcagtgcagccgagggctctatgggggatttgtcagagatttcttcacattcatcaggaagtcaccattcaggcagcccctccgcacattgcagcaaaagtagcggctcccttgactcttccaaggtgtacattgtgtctcatagctctggccagcaggtccccgggtcgatgtccaaaccataccacagacagggagctgtgaataagtacgtaattggatggaagaaatcagagggtagtccaccgccagaggagccagaagttaccgaatgcccagggatgtactccgaaatggatgtcatgtcaacagccactcagcatcaaactgttgtaggtgacgccgtggctgagacacagcacgtactcagtaaagaagactttctgaagttaatgctgcccgactcaccgcttgttgaagagggccggaggaaattcagtttttacgggaacctttctccaagacggtcactctatcggactctctccgacgagtctatttgttccaacaggcgtggaagttccttcggttcttcgagatcatccgttctggaccaggcactgcctaacgatatactcttctcaactacaccaccataccattctactctgccccctcgcgctcaccccgcccccagcatggggtcattgcgcaacgaattttggttctcagatggcagtctttccgataagtcaaaatgcgcggatcccggtctgatgcctctccctgacaccgcgaccggactcgattggacacatctcgttgatgctgcacgggcctttgaggggcttgacagtgacgaggaactgggcttactttgccatcacacatcatacttggatcagcgggtagcctccttttgtaccctaactgatatgcagcacggccaggacctcgaaggcgcgcaagagttgcctctctgcgttgatcctggatcagggaaagagtttatggacacgactggggagagatcgccgagtcctctcactggtaaggtcaatcaactcgagctcattctgcgacagctgcagaccgacctacggaaagaaaagcaggacaaggcagttttgcaggcagaggtgcagcatctgcggcaagacaacatgcgactgcaggaggaatcccaaaccgcaacggcgcaattgcgaaagttcaccgagtggtttttcaccactatcgacaaaaagtcctag

SEQ ID NO: 205197 - DNA, 918 bp, Artificial Sequence
  Description of Artificial Sequence: Synthetic coding sequence
atggaccccaagggcctgctgagcctgaccttcgtgctgttcctgagcttggcctttggggcttcatatggaaccggcggccgaatgatgaattgtccgaaaattttaagacaactagggtctaaagtactgctgcctctgacttacgaaagaattaataagtcgatgaataagagtatccacatagtcgtcactatggcaaagagtttggagaactcagtcgaaaataaaatcgtctccctggacccgtcagaagcaggccctcctagatatctgggggaccgttacaaattctaccttgaaaacctaacacttggcattcgggagagccggaaggaagacgaggggtggtacctcatgaccttggagaaaaacgtctctgtccagagattttgccttcagctccgcctgtacgagcaggtttctactcccgagatcaaagtactcaacaagacccaggaaaatgggacatgcacgctgatcttaggttgcactgtcgaaaaaggcgaccacgttgcatatagttggtctgagaaggcaggcacccaccccttaaacccagccaattcttcccaccttctatcattaacactggggccacagcatgccgataacatctatatctgcaccgtatcaaatccgatatcaaacaacagtcagacctttagcccatggccagggtgtcggaccgacccatccggcaaaacaaatcattatcaaacgacagtggagaagaaatccctgactatttatgcacaggtacagaaacccggaccgcttcagaaaaagttggattcattcccggcccaggatccttgcaccactatatatgtcgcagccactgagccggtgcccgaaagcgttcaggagaccaatagcattaccgtgtatgcttcagtgactctcccggaatcctag

SEQ ID NO: 205198 - DNA, 1008 bp, Artificial Sequence
  Description of Artificial Sequence: Synthetic coding sequence
atggaccccaagggcctgctgagcctgaccttcgtgctgttcctgtccttggcatttggcgcaagctatggcactggggggcgcatgatgaattgcccgaagatcctccgccagctgggcagcaaggtcctcttgcctctcacctacgaacgaatcaacaagtcgatgaacaaatccatccatattgttgtcaccatggccaagtctctggagaattccgttgagaataagatcgtcagtcttgatccctccgaggcagggcctcctagatatctgggcgatagatacaagttttatctcgagaatcttacattgggcatcagagagtcccggaaggaagatgaaggatggtaccttatgacgcttgagaagaacgtatcagttcagcgcttctgtctccagctgcgactgtatgaacaggtgtccacaccagagattaaggtgctgaacaagacccaggagaatgggacatgtacccttatcctcgggtgtacagtggagaaaggcgaccatgtggcctactcctggtcagagaaggccgggactcaccccctcaaccctgccaactcttcccacctgctgtccctcactctgggcccccagcacgccgataatatctatatctgcactgtttcgaatcccatttctaataactcacagacgttcagcccttggccgggctgcagaaccgatccatcggagactaaaccctgggcagtttatgcagggcttctggggggtgtcattatgatcctcatcatggtagtaatactgcagctgagaaggagaggcaagactaaccattatcagactaccgttgagaagaagagtcttaccatttatgcacaagtgcagaaacccggacccctccaaaagaagctggattctttccctgcccaggatccatgtacaaccatctatgtggccgccaccgaacctgtgcccgaatcagtacaggaaacaaacagtatcactgtttatgcgtccgttacactgccagagtcttag

SEQ ID NO: 205199 - DNA, 897 bp, Artificial Sequence
  Description of Artificial Sequence: Synthetic coding sequence
atggaccccaagggcctgctgagcctgaccttcgtgctgttcctgagccttgctttcggggccagctatggaacggggggaagaatgatgaactgccctaagatactcagacagttgggctctaaggttctgctccctctgacttatgaaagaatcaataagtctatgaataagtccatacacatcgtcgtgacaatggcgaagtctctggagaattccgtcgagaacaaaatagttagtctcgaccccagtgaggccgggcctccccggtacctgggagaccgctacaaattctacttagagaatctgacacttggcatcagagagagccggaaagaagacgaaggatggtatctaatgacactggaaaaaaatgtgtcagtccaaagattttgcttacagcttcggctttacgagcaggttagtactcctgaaatcaaagtactgaacaagactcaggaaaatgggacgtgtacactcattctcgggtgcaccgtcgagaagggggaccacgtcgcttatagttggagtgaaaaggccggtactcaccccctcaaccccgctaacagctcccacctactgtccctgacgctcggcccccaacatgcagataacatttacatttgtaccgtgtccaaccctatatcaaacaactctcagactttcagtccctggcctggctgcagaacagaccctagcgaaactaagccgtgggctgtctatgccggtttgctggggggcgtcataatgatcctcatcatggtcgtgattctacaacttcggcggcgggggaagactaaccattatcagaccactgtggagaagaaaagcctgacaatctacgctcaagtgcagaagcccggcgacagccatcaccagacgagtgatttattttag

SEQ ID NO: 205200 - DNA, 435 bp, Artificial Sequence
  Description of Artificial Sequence: Synthetic coding sequence
atggaccccaagggcctgctgagcctgaccttcgtgctgttcctgagtttagccttcggcgcatcctatggaaccggaggcaggatgatgaactgccccaaaattctgcggcagctggggtccaaggttttactcccgctgacctatgaacgtatcaataagagcatgaataagtctatacacatagtcgtaaccatggccaagagccttgaaaactcggtggagaacaagattgtaagcctcgatccgtctgaagccggccctccccgctacctgggagatagatataagttctacctggagaacctgacgttgggaattagagagagtcgtaaggaagatgagggctggtacttgatgacattagagaaatcgctgcattttggttacctgtattttgtgttaggcgctgatcatgacaatctacagacatag

SEQ ID NO: 205201 - DNA, 810 bp, Artificial Sequence
  Description of Artificial Sequence: Synthetic coding sequence
atggaccccaagggcctgctgagcctgaccttcgtgctgttcctgtccttggccttcggtgcctcatacgggaccggggggcggatgatgaattgccccaaaatacttcgacaattgggctccaaggtgttgttgccactgacctatgaacgaattaataagtcaatgaacaagtctatccatatcgtcgttaccatggctaaaagcctcgagaacagcgtggagaacaagattgtgtcactggaccccagtgaggcagggcccccaaggtacctgggcgatagatataagttctacctcgagaacctcacgttagggattagagagagcagaaaggaagacgagggatggtacctgatgactcttgagaagaacgtatctgtgcagagattttgtttgcagctgagactgtatgaacaggttagcactcctgaaatcaaggtcttaaataaaactcaggaaaacggtacctgtacattgatcttagggtgtacggtggaaaagggggatcacgtcgcatactcttggagcgaaaaggccggtacgcatcccctaaacccagccaactcttctcatttactgtcactcacacttggaccccaacatgcagataacatatatatttgtaccgtatctaacccaatctccaacaactcccagaccttctcgccatggcccggatgcagaaccgatccttcagagacaaagccatgggctgtgtacgccggcctgttaggaggggtgattatgatactgatcatggtggtcattctgcagctgcggcggcgagcttcttctgaggagacatag

SEQ ID NO: 205202 - DNA, 1029 bp, Artificial Sequence
  Description of Artificial Sequence: Synthetic coding sequence
atgtgcagcaccatgagcgcccccacctgcctggcccacctgcccccatgctttctcctcctagcattggtactggtgcccagcgacgcatcggggcagtcgagccgaaatgactggcaagtgctgcaacctgaagggcccatgcttgttgcagagggcgagactctgctgttacggtgcatggtcgttggaagctgcactgatgggatgatcaaatgggtcaaagttagcacccaggatcagcaggaaatttataattttaaacggggaagtttcccaggtgtgatgcccatgatccagaggacaagtgagcctctgaattgcgattattctatttatatccataatgtgacaagggagcatacgggcacgtatcattgtgtgaggttcgatggcttgtctgagcactcagaaatgaagtccgacgaggggacctctgtcctcgtgaaaggagccggcgaccccgaacctgacctgtggatcatccagccacaagaactggtgctcgggactactggggatacagtgttcctaaattgcaccgtcctcggagatgggccccccggccctatccggtggttccagggcgccggccttagccgggaggccatatataatttcggaggtatatcacaccccaaggagacagcagttcaggcatccaacaacgacttcagcattctcttgcagaatgtctcctccgaggatgctgggacttattactgcgtaaaattccagcggaagcccaatcgtcagtatctgagtggacagggcacctccctcaaggtcaaggccaagtccacttcatctaaagaagccgaattcacctcagagccagcaaccgagatgtccccaaccggcctgctggtggtctttgctcccgtggtgctggggttgaaagctatcaccttagccgctctgttgctcgctctcgccacctctaggagatcccctggccaggaggatgttaaaacaactggcccggctggcgcgatgaatacactcgcctggagcaaaggccaggagtag

SEQ ID NO: 205203 - DNA, 624 bp, Artificial Sequence
  Description of Artificial Sequence: Synthetic coding sequence
atgtgcagcaccatgagcgcccccacctgcctggcccacctgcccccttgtttcctgttgctggcacttgtgctcgttccttcagatgccagtgggcaatcgtctcgcaacgattggcaagttcttcagcccgaaggcccaatgctggtggccgagggagccggagaccccgaacctgacttatggataatccagccgcaggaactcgttctcggcacaacgggcgacaccgtctttctcaactgtacagtgctcggtgatggcccacctgggccgattcgctggtttcaaggggctggactttctcgtgaagctatctataatttcggaggaatcagccaccccaaagagactgccgtgcaggctagtaacaacgacttcagcattttactccaaaacgtcagtagcgaggacgccggaacctactattgcgtgaagttccagaggaaaccaaaccggcagtacttgtccggccaggggacaagtcttaaggtgaaggaacagaacctgcctctccccaaacgtcaaaactccccagtcaatctgcagctgagatgtctccagcaagtatctgttccaacctctgtcgagtcaatgagccctccacaggctcgtggcccttag

SEQ ID NO: 205204 - DNA, 624 bp, Artificial Sequence
  Description of Artificial Sequence: Synthetic coding sequence
atgtgcagcaccatgagcgcccccacctgcctggcccacctgcccccatgctttcttctcctggcccttgtcttagtgccgtccgacgcctccggccagagcagccgtaatgactggcaagtactccagcctgagggtccaatgctggtggccgaaggagccggcgatccagagccagacctgtggatcatccagccacaagagcttgtgttgggcaccactggtgacacggtctttctcaactgcacagtgcttggtgacggcccgccgggaccaatccgctggtttcagggagccggtttgagtagagaggcaatttacaatttcggaggtatctcgcaccctaaagagaccgctgttcaagcctccaacaacgacttctcaatacttttgcaaaatgtctcttcagaggacgccgggacctattactgtgtaaaatttcagcgtaaacctaataggcagtatttgtcaggacaggggacgtcgctgaaagtaaaggagcagaacctccctttgcctaagaggcagaatagccctgtcaacctccagctgagatgtcttcagcaagtgtcagtccctacttctgtggagtccatgtctcctccacaggcccggggcccatag

SEQ ID NO: 205205 - DNA, 735 bp, Artificial Sequence
  Description of Artificial Sequence: Synthetic coding sequence
atgtgcagcaccatgagcgcccccacctgcctggcccacctgcccccatgcttcttgttgcttgccctggtgctggtcccctccgacgcaagcgggcagtccagccggaacgactggcaggtactccagcccgaaggcccgatgttggtagcggagggggcaggggacccagaacctgacctgtggatcatccaacctcaggagctggtactggggaccactggagataccgtctttttaaactgtaccgttcttggtgatgggcctcctggacctataaggtggtttcaaggagccggcctatctcgggaagccatatataacttcggcggcatctctcatcctaaggaaacagccgttcaagcatcgaacaacgacttcagcattctactacaaaacgtgagctcagaggatgctggcacctactactgcgtgaagttccagaggaaacccaatcggcagtatctgtcaggacaaggtacttcgctcaaagttaaagctaaatctacctcaagcaaggaggccgagtttacatccgagccagccaccgagatgtccccaacaggtttgctggtcgtctttgccccagtggtgttggggctgaaagccatcaccctcgccgcgctactgctggccctggctacttcaaggagatctccaggccaagaagatgtaaagaccacaggcccagccggggctatgaataccctcgcatggtccaaaggccaagagtag

SEQ ID NO: 205206 - DNA, 633 bp, Artificial Sequence
  Description of Artificial Sequence: Synthetic coding sequence
atgaagagcgacgagggcaccagcgtgctggtgaagggcgccggcgatccagaacccgacttgtggatcattcagcctcaggagcttgttctgggcactaccggggatactgtgtttttaaactgtactgtcttgggagatggccctcccggtcctattcggtggttccagggcgcaggcctctcacgtgaggctatctacaactttgggggaatctcccaccccaaggagacagctgtgcaagccagtaacaacgacttttccattctcctgcagaatgtgagctctgaagatgctggcacttactactgcgtcaaatttcaacgtaaacctaaccggcaatatctgtctggtcagggtacttctctgaaggtaaaagcgaagagtacaagtagtaaggaagctgagtttacatccgaacctgctacagagatgagtcctaccggcgagcggacacacctttccggcgtgaacgaaagccctacaggaaaaggggccatgaacggacttgtcatgggcagagagcagtcacaaactccaggcgccaacctgcccccacgtatgcttcccggtcttcacctcaattgtaggactagaacacccgagaatcatgtgattactgctcagctgtag

SEQ ID NO: 205207 - DNA, 2046 bp, Artificial Sequence
  Description of Artificial Sequence: Synthetic coding sequence
atgaacgccagcagcgagggcgagagcttcgccggcagcgtgcagatacccgggggcacaaccgtactggtggagctcaccccagacattcacatctgcggcatctgcaaacagcagttcaacaatcttgatgccttcgtggcccacaagcagtctggctgccaactgaccggaacctcggccgccgctccctccactgtgcaattcgtgtctgaagaaactgttcctgccacgcaaacccaaactactaccagaacaataacaagcgaaacccagacaattactgtgtctgcaccggagttcgtcttcgagcacgggtaccaaacttacttaccaaccgagtcaaacgagaaccaaaccgccacggtcatttcattaccggcaaaaagtaggaccaagaagcccaccacacctcctgcgcagaagcgcctcaactgctgctatcccggctgtcagttcaaaacagcctacgggatgaaggatatggaacggcatctgaaaatccataccggagacaaacctcacaagtgcgaggtttgcgggaagtgcttctccaggaaagataagctgaaaactcacatgcggtgccacacgggtgtgaagccctataaatgcaagacttgcgactacgctgcagccgattccagtagcctgaataagcacttaaggatccattccgatgaacgcccctttaagtgtcaaatatgcccctatgctagtaggaatagctcccagctgactgtgcatttgaggagtcatacaggagacgccccgttccagtgctggttgtgctcagcaaagttcaagatctcatccgacttgaagcggcatatgagggtgcactcaggagaaaagcccttcaaatgtgaattctgtaacgtgcgctgtaccatgaaaggaaacctgaaatcccacatccggatcaagcatagcggaaacaacttcaagtgcccacactgcgactttctgggtgattccaaggcgacactacgtaagcactcacgcgtgcatcaatctgaacatcctgaaaaatgttctgagtgtagttattcatgtagcagcaaggccgctctacgcatccacgagcggattcactgtactgaccggccatttaagtgtaactactgcagcttcgatacaaagcagccatcaaacttgagcaagcatatgaagaaatttcacggggacatggtcaaaactgaggctttagagcgcaaggatacaggacgacaaagctcgcgtcaggtggctaagctggatgccaaaaagtcattccactgtgatatctgtgatgccagtttcatgcgggaggacagtttgcgatctcataaacgccagcactctgaatattcagaaagcaagaactcagacgtgaccgtgttgcagttccagattgacccatccaaacagcctgctactccactgactgttggtcacctgcaggtccccttacagcccagtcaagttcctcaatttagtgagggcagagttaaaatcatagtgggtcatcaggttcctcaggccaataccattgtgcaggccgctgccgctgccgtgaacattgtgcctccagccctggtggctcagaacccagaagaattacccgggaatagcagactgcagatcctaaggcaggtctcccttattgcccccccacagagctcccgctgcccctcagaggcgggcgcgatgacacagccagccgtactcctaactacccatgaacagaccgatggagccaccctgcaccagacgctgatccccactgcatcagggggcccacaggagggaagcgggaatcaaacatttatcaccagttctggtattacctgcaccgattttgagggtcttaacgctctgatccaggagggaactgctgaagtcaccgtcgtaagtgatggcggccaaaatatcgcagtggcaacaaccgctcccccagtgtttagcagctcgagtcaacaagagcttcccaagcagacctactcaattattcagggagctgctcacccagctctcctctgcccagccgacagcatccctgactag

SEQ ID NO: 205208 - DNA, 1164 bp, Artificial Sequence
  Description of Artificial Sequence: Synthetic coding sequence
atgcccgtgcccgccagctggccccacccccccggccccttcctgctcctgactttactactgggcctaaccgaggttgcgggcgaggaggagctgcagatgattcagccagaaaagctcctgctcgtgactgttggcaaaaccgctaccctgcattgcaccgtcactagcctgctgcctgtgggaccggtcctgtggtttcgcggtgtcggacccggccgggaactgatttataatcagaaagagggccacttcccccgggttacgacagtgagtgatctgacaaagagaaataacatggatttcagcattcgcatatctagtatcacccccgcagacgtaggtacatactattgtgtcaagttccggaagggcagcccagaaaatgtcgaatttaagagtggccccggcactgagatggccctcggagccaagcccagtgccccagtggtgttagggcccgccgccaggacaactcctgagcatactgtgtcttttacctgcgagagccacgggttcagtccgagggacatcactttaaagtggttcaaaaacggaaacgagctcagcgacttccaaactaacgttgatccaacaggccaatccgttgcgtatagcatacggagcaccgcgcgcgtggtcctggatccatgggacgtgcgcagccaggttatctgcgaggtcgcccatgttaccttacagggggacccgctccggggaacggccaatctgagtgaggctattagggtcccaccaacacttgaggtaacacaacagcccatgcgcgtaggaaaccaagtgaacgtgacctgccaggttcgcaaattctacccgcagtccctacagttgacatggtctgaaaatggcaacgtgtgccagagagagacagccagtacactcaccgagaacaaggatgggacctataactggacctcctggttcctcgttaacatctccgaccagcgggatgatgtggttttgacctgccaagttaaacatgacggtcagctggccgtgtctaagcggcttgcacttgaagtcaccgtgcaccaaaaggatcagagctcagatgccactcctggacctgccagcagcctcaccgctcttctcctgatcgcggtgctgctgggtccgatctacgtcccatggaagcagaaaacctag

SEQ ID NO: 205209 - DNA, 513 bp, Artificial Sequence
  Description of Artificial Sequence: Synthetic coding sequence
atgcccgtgcccgccagctggccccacccccccggccccttcctgctgctcacccttctattgggacttaccgaggtggccggtgaagaggagctccaaatgatccagcctgagaaactgctcctggttactgtgggcaaaactgccactctccactgcacagtgacaagcttgctgcccgtgggccccgtcttgtggtttagaggcgtgggtccagggcgagaactgatttacaatcaaaaagaggggcatttccccagggttaccacagtttccgatctgaccaaacggaacaacatggacttttccatccgtatttccagcatcacacccgccgacgtcgggacttattactgtgtcaaatttagaaagggaagccctgagaacgtggaattcaaaagcggtccgggaaccgaaatggcccttggaggtccggcatccagtcttaccgccttgttactgattgcagtgctgttggggccaatctatgtcccatggaaacagaagacttag

SEQ ID NO: 205210 - DNA, 1065 bp, Artificial Sequence
  Description of Artificial Sequence: Synthetic coding sequence
atgatccagcccgagaagctgctgctggtgaccgtgggcaagaccgcaacgctgcattgcactgtcacgtctcttctgccagtgggtccagtgctgtggtttcgcggagtcggaccgggacgagaactgatttacaatcagaaggaggggcacttcccacgggtcaccacagtgagcgacctgacaaagagaaacaatatggattttagtataaggattagctccatcactccagccgatgtggggacatactactgtgtcaaatttagaaaaggatctcccgaaaacgtggaattcaaaagcggacctgggaccgaaatggcgctgggcgccaagcccagtgcccctgtcgtcctcggccccgccgcccgaacaacccctgaacataccgtttcatttacgtgtgaatcccacgggttcagtccacgggacatcaccttgaaatggttcaaaaatggaaatgaactctccgacttccagaccaatgtagacccaacaggccagtccgtggcctattccatcaggtccacagcacgggttgtcttggacccttgggacgtgagaagccaggtgatttgtgaggttgcacacgtgacgctgcagggtgacccactacgcggtaccgctaatctttcagaggcgatccgagtgccgcccacgttagaagtaactcagcaacctatgcgtgtgggcaatcaagtaaacgttacttgtcaggtgcgaaaattctacccccagtccctgcaattgacatggtcagaaaacggcaatgtgtgtcagagggaaacagctagtactttgaccgaaaataaggacggcacatataattggacttcttggttcttggtcaatatctccgaccagagagatgatgtggtccttacctgtcaggtgaagcatgatgggcaactcgcagtcagtaaacgcttggccctggaggtcaccgttcatcagaaggatcaatcctctgacgctacgccaggaccagcttcttccttgacggcacttctcctcatcgcagtcctattgggtcctatctatgtaccttggaagcagaaaacatag

SEQ ID NO: 205211 - DNA, 831 bp, Artificial Sequence
  Description of Artificial Sequence: Synthetic coding sequence
atgcccgtgcccgccagctggccccacccccccggccccttcctgttgctcacacttcttctggggctgacagaagttgccggggaggaggagctgcaaatgattcagcccgaaaagctgctgctagtgactgtcgggaaaacagccactctccactgcaccgtgaccagcctgctaccagtgggacctgtgctgtggttcaggggagtgggtcccggtcgtgagctcatttataaccaaaaggaaggtcatttccctagggtgacaacagtgtcagacctgacaaagcggaacaacatggatttctcaattcggatatcaagcattaccccagcagatgtaggcacttactattgtgtgaagtttcgtaaggggtcacctgaaaacgtggaatttaaatcgggacccggcactgagatggctctcggcgcaaaaccctctgcgcccgtcgtcttaggccctgctgccaggaccaccccagagcacactgtgagcttcacctgcgaaagccatgggttttctccgcgagatatcacactgaaatggtttaaaaacggcaacgagctgtccgattttcagaccaacgtggatccaacaggtcagtctgtcgcctacagcatccgcagcaccgccagagtggtgctggacccatgggatgttcgaagtcaggtgatctgcgaagtggctcacgtaactttacaaggcgacccattacgggggactgcgaatctatcagaggccataaggggccccgcaagctccctgacagccttactccttatcgccgtactcctggggccaatctacgtgccttggaaacagaagacatag

SEQ ID NO: 205212 - DNA, 1386 bp, Artificial Sequence
  Description of Artificial Sequence: Synthetic coding sequence
atggccccccagagcctgcccagcagccggatggcccccctgggcatgctcctggggctgttaatggctgcgtgctttactttttgtctaagccaccaaaatctcaaagagttcgctctaacgaatcccgaaaaatccagcacaaaagaaaccgagagaaaggagaccaaagcggaagaggaactggacgctgaagtgctggaggtcttccacccgacgcatgagtggcaagcgctacaaccaggccaggccgttccagccggcagccacgtcaggctgaacctgcagactggtgagagggaagcaaagttgcagtatgaggacaaattccggaacaatctgaaggggaagagactcgatattaacactaacacatatacgtcccaggatcttaagagtgcccttgccaaatttaaggagggagccgaaatggaaagctccaaggaggataaagctaggcaggccgaggtcaagagactcttccgcccaatcgaggaactgaagaaggattttgacgagctgaacgtggtgattgagactgacatgcagatcatggtgaggctgatcaataagttcaacagttctagcagttcactggaagagaaaatcgccgcgttgtttgatctggagtactatgtccatcagatggataatgcccaggacttattatcatttggaggactccaggtcgtgataaatggcctgaactccaccgagcccctcgtcaaggagtatgccgcatttgtgctgggagcagctttctcgtccaatcccaaggtccaggtggaggcgattgaggggggcgccctgcaaaaactgctcgtgatcttagctaccgagcaaccgctcaccgcaaagaagaaagtgctctttgcgctgtgttctctccttcgacattttccctacgcacagcgtcagttcctgaagctcggcgggcttcaagttctgcgaaccctggtccaggaaaagggtaccgaagtgctcgcggttagagtcgttactttactgtacgacctcgtgaccgagaagatgttcgcggaggaagaagcagagcttacccaggaaatgtcaccagagaaattgcagcagtaccgccaggtccatcttttacccggcctctgggagcaggggtggtgcgagattacggcgcatttacttgcgttacccgagcatgatgcccgagagaaagtgcttcagacgctgggagtcttgctgaccacatgtcgagacagatacaggcaggatccacagttgggccgcacactcgcaagcctccaggccgagtatcaggtgctggccagccttgaattgcaggatggagaggatgaaggctatttccaggagctactcggcagtgtgaactccctgttgaaggagctgagatag

SEQ ID NO: 205213 - DNA, 1386 bp, Artificial Sequence
  Description of Artificial Sequence: Synthetic coding sequence
atggccccccagagcctgcccagcagccggatggcccccctgggcatgctcctcggcctgctgatggccgcctgctttaccttctgcctgagccaccagaacctcaaggaattcgctctaaccaatccagaaaagtcctctaccaaggagaccgagcgaaaagagaccaaagccgaagaggagttggatgcagaagttctggaggtctttcaccccacacatgagtggcaggctctgcagccgggacaggctgtgcctgcaggctcccatgtccgccttaacctacagaccggagagagggaggccaaactgcagtatgaagacaaattcaggaacaaccttaaagggaaacgactcgacatcaacacgaatacatatacttctcaagatctgaaatctgccctggctaagttcaaggagggagcggaaatggaatcctctaaggaagataaagcccggcaggcagaggtgaagcgactcttcaggcccattgaagagctcaagaaagacttcgacgagcttaatgtcgtgatcgaaacagatatgcagattatggtgagactgataaacaagtttaatagctcctcatcatccttggaggaaaaaatcgccgccctcttcgacctagaatattacgtacaccagatggacaatgctcaggatctgctaagcttcggcggtctgcaggttgtaattaacggcctcaacagtaccgagcctcttgtcaaggaatacgcagcatttgtgctaggggctgccttcagttctaatccaaaagtgcaggtcgaggccatcgagggcggcgctctgcagaagctgcttgttattctggccactgaacagcctctgacagcgaagaagaaagttctgttcgctctgtgttcccttttgcggcactttccttatgcccaacggcaatttctgaagctggggggtctgcaggtcttgcggacccttgtgcaagagaaaggcaccgaagtattggctgtcagagttgtcaccctcctctacgatctggtgaccgagaaaatgttcgcagaggaggaagccgaactgactcaggagatgagcccagagaagctgcagcagtatcgccaggtccacctgttacctgggctctgggagcaaggatggtgtgagatcacagcacatctgcttgcgctccctgagcacgacgcccgcgagaaggtgctgcagacactaggagtgcttcttaccacttgtagggaccggtatcgccaagacccacagttaggccgcacattagcttcgctacaagccgagtaccaggtgttggcttcactggagctgcaggacggagaggacgagggctactttcaggaactcctaggaagtgtgaattcactgctgaaggagctccgctag

SEQ ID NO: 205214 - DNA, 288 bp, Artificial Sequence
  Description of Artificial Sequence: Synthetic coding sequence
atggccccccagagcctgcccagcagccggatggcccccctgggcatgctcctcggtctactgatggctgcctgtttcaccttttgtttgagccatcaaaatctcaaagaattcgctctgacgaatccagagaaatcttctaccaaagagaccgagaggaaggaaaccaaggccgaagaagaacttgatgccgaagtactagaagtgtttcatcccacacatgagtggcaagcccttcaacccggacaagcagtgccagctggtagccatgtccgtctaaatctgtag

SEQ ID NO: 205215 - DNA, 492 bp, Artificial Sequence
  Description of Artificial Sequence: Synthetic coding sequence
atggccccccagagcctgcccagcagccggatggcccccctgggcatgctgctgggactccttatggctgcctgttttaccttctgcctttctcaccagaacctgaaagagttcgctctcacaaaccccgagaagtctagtactaaagagactgaaagaaaagaaacaaaggcagaggaggaattagacgctgaggtgcttgaagtgttccacccaacccacgaatggcaggccctgcagcctgggcaggctgtgccggccggtagccacgtgagactgaaccttcagaccggcgaacgggaagccaagctccagtatgaggataaatttcgcaacaacttaaaagggaaacgacttgacataaatactaatacctacacgagccaggatttgaagtcagcacttgctaagtttaaggagggtgccgaaatggaatcttcaaaagaggacaaagcccgacaggccgaggtaaaaaggctgtttaggccctag

SEQ ID NO: 205216 - DNA, 372 bp, Artificial Sequence
  Description of Artificial Sequence: Synthetic coding sequence
atggccccccagagcctgcccagcagccggatggcccccctgggcatgctgctgggcttgcttatggccgcgtgttttacgttttgtctgagccatcagaatctgaaggaatttgccctaacaaacccggaaaaaagcagtacaaaggaaactgaacggaaggaaactaaggcagaagaggagttggatgcagaggtgctggaggtgttccatcctacccatgagtggcaggccttgcaacctggtcaggctgtccctgccggttcccatgttagactcaatctacagaccggggaacgcgaggcgaagctgcagtatgaagacaaattccggaacaacctgaagggcaagcgacttgacatcaatacctag

SEQ ID NO: 205217 - DNA, 579 bp, Artificial Sequence
  Description of Artificial Sequence: Synthetic coding sequence
atggccgcctgcttcaccttctgcctgagccaccagaacctgaaggagtttgccttgaccaatcccgagaagagctccactaaggaaactgagcggaaggagacaaaggccgaggaggagctagacgccgaagtccttgaggtttttcatcctactcacgagtggcaagcactccaacctgggcaggcggtccctgcaggaagtcacgtgaggctgaaccttcagactggcgaacgggaagctaaactacagtatgaggacaaattcagaaataacctgaaaggcaagcggctcgacatcaatactaatacttacacctcccaggatcttaagtctgccctggccaaatttaaagagggcgccgaaatggaatcttcaaaagaggacaagatggacaacgcccaggacctgctcagctttggcgggctccaagttgtcataaatggtcttaatagtacggaaccccttgtaaaagagtacgcagcattcgtgctaggcgccgcattctcctccaaccccaaagttcaggtagaagcgatagaggggggtgcgctacaaaagttattagtgattttgtag

SEQ ID NO: 205218 - DNA, 3822 bp, Artificial Sequence
  Description of Artificial Sequence: Synthetic coding sequence
atgaagcggcggctggacgaccaggagagccccgtgtacgccgcccagcaaaggcgtatccccggttcgacagaggcatttccgcaccagcaccgcgtcctggcgcccgctcccccagtttatgaggctgtatcggagaccatgcaatccgccacaggaatccaatacagcgtgaccccaagctatcaggtgagcgcgatgcctcagagctcaggttcacacggccctgctattgcagcagtacatagctcccaccatcatcctaccgcagtccagcctcatggcggtcaagtggtacagtctcatgcgcaccctgcacccccagttgccccagtacaaggccagcagcagttccagcgacttaaggttgaggacgccctatcatacctcgaccaggtgaaactccagttcggctcacagccacaggtctacaacgacttcctggatatcatgaaagaatttaagagccagtccatagatacccccggggtgattagcagggtgagtcagttgttcaaaggacatcctgacctcattatgggtttcaacacattccttcctccaggctataagatcgaagttcagaccaatgacatggtcaacgtcactacccccgggcaggtccaccagatccctactcacggaatacaaccacagccgcagcctcccccccagcatccttctcagccctcagctcaaagtgcccctgctccagcccagcctgccccacagccacctcctgcaaaagtttctaaaccttcccaactccaggcgcatacacccgcttctcagcaaacccctcccctgccgccgtatgccagtcctcgatcccctcccgtgcagccccacacaccggtgacaatcagtctggggactgcacccagcctgcaaaataatcagcctgtggaatttaaccacgccattaactacgtgaacaagatcaaaaatcgcttccagggtcagcccgatatttacaaagccttcttagagattctgcacacctatcagaaggaacagcgcaatgctaaggaagccggcgggaattacacaccagccctgaccgaacaagaagtgtatgcacaggtggctagactttttaagaaccaggaagacttactgagcgaattcgggcagttcctcccagatgccaatagctctgtattgctgtccaaaaccactgcagagaaggtagatagcgtccggaatgatcacgggggcacggtgaaaaaacctcagctcaacaacaagccgcagcggcccagccagaatggatgtcagatccgccgccatcccactggcacgactccaccggtcaaaaagaaacccaaactcctgaatctcaaagattcttccatggccgatgcttctaagcacgggggaggcaccgagagtctatttttcgacaaggtgcgaaaagcccttcgcagcgcagaggcatatgagaattttctgcgctgcctggtaatctttaaccaggaggtgatatctcgggcagaactcgtgcagctggtatccccattcctcggaaagtttcctgagctctttaattggttcaaaaactttctgggatacaaggaaagcgtgcacctggaaacataccccaaggagcgggcaactgaagggatagcaatggagatcgattacgcttcgtgcaagcggctcggctcaagctacagggctctccctaagtcttaccagcagcctaagtgcactggacggaccccgctctgtaaagaggtgctgaacgatacttgggtctcttttccctcctggtctgaggatagtaccttcgttagctctaaaaaaacccagtacgaggaacacatctaccgatgtgaggacgaacgtttcgaactggacgtggtactggagacaaacttggccactattagagtactagaggctattcagaagaagctcagtagactgagtgccgaagagcaagccaagtttaggctggacaacaccctgggaggcacaagcgaagtcatacaccgcaaagcactccaacggatctacgcagacaaagccgcagacataatcgacggcctgcgcaaaaacccatcgattgcagtgccaattgtcctgaaaaggctaaagatgaaggaggaggagtggagggaggcacagcggggttttaataaggtgtggagagagcaaaacgaaaaatactatctgaagtctctggatcatcagggtatcaatttcaaacagaatgatactaaggttctgcggtctaaatcactactgaatgagatagaatctatctatgatgagcgacaggagcaagccacagaagagaacgctggggtccccgttggaccccaccttagtctggcctacgaggacaaacagatcctggaagacgccgctgccctgatcatccatcacgtcaaacggcaaaccggtatccaaaaagaagataagtataagattaagcagatcatgcatcatttcatccccgacctgctttttgcacagcgaggagatcttagtgatgttgaggaggaagaggaggaagagatggacgtggacgaagccacaggcgcagtgaagaagcataacggggtgggtggctctccccctaagtccaagctcctcttctcaaatacagctgcgcagaaactaagagggatggatgaggtgtacaacctcttttacgtgaacaacaattggtacatcttcatgcggctacatcagatcctgtgcctgcgcctcctgcggatttgctctcaagccgaaagacagatcgaagaagaaaacagagaaagggagtgggagagagaggtgttgggcatcaagcgggataagagcgactctcccgcgatccaattgaggcttaaggagccgatggatgttgatgtggaagactattacccggcttttctggacatggtcaggtccctacttgacggtaacattgattcctcccaatatgaggattcattacgggaaatgttcaccattcacgcatacatcgccttcaccatggacaagttgatccaaagcatcgtgcgccagctgcagcacatcgtctctgacgaaatatgcgtgcaggtgactgatctatatctagccgaaaacaacaatggggcgactgggggacagttgaatacacagaattcacgctcattgttggagagtacctaccagcgaaaggcagagcagctgatgtcagacgaaaattgtttcaaattgatgtttattcaatcccagggccaggtgcagctgactattgaactgctggatactgaagaggagaatagcgacgatcctgtcgaagctgagaggtggagtgactatgtagaaagatatatgaattcagatacaacctcacccgaactcagggagcacctggcacagaaacccgtgttcctcccacgcaacctgcggcgcattcgcaaatgtcaaaggggccgggaacaacaagagaaagaagggaaggagggtaatagcaaaaagaccatggagaatgttgacagtcttgataagctggagtgcagatttaagttgaacagttacaagatggtgtacgtaatcaagagtgaggactatatgtacagacggaccgctttgttgcgggcgcatcaatcccatgaacgagtgtccaagagactgcatcagcggttccaggcctgggtcgacaagtggactaaagagcacgttccccgggagatggcggccgaaacgtcaaagtggctcatgggggagggacttgaggggttagtgccttgcactactacatgcgatactgaaacactccacttcgtttccatcaataagtacagggtcaagtatggcacagtgttcaaggccccctag

SEQ ID NO: 205219 - DNA, 3822 bp, Artificial Sequence
  Description of Artificial Sequence: Synthetic coding sequence
atgaagcggcggctggacgaccaggagagccccgtgtacgccgcccagcagaggcggattccaggtagcacggaggcctttccccatcagcacagagtgcttgcaccagccccccctgtgtacgaagcagtgtccgaaactatgcagtcagccaccggcattcagtattccgtgacacctagctatcaggtgagtgccatgcctcaatcatcagggtcccacggccccgccatcgccgccgtgcattccagccatcatcatcctacagccgtgcaaccacatggtggccaggtcgtacagtcgcatgcacacccagcgccaccagtggcaccagtacagggccagcaacagtttcagagattgaaagtggaggatgctctctcttacctggaccaggtaaagctgcagttcgggtcacaaccacaagtgtataacgacttcctggacatcatgaaggaatttaaaagccaatccatcgatactccgggggtgatatctagagtttctcagctattcaaaggccatcccgatctgatcatgggctttaacacgttcctgccgccgggctataaaattgaggtgcagactaatgacatggtcaatgttactacacccgggcaggtccatcagattccgacccatggcatccagccacagccccagccccccccccagcaccccagccagccatctgcacaatcggcccctgccccagcccagcccgcccctcagcctcccccagcaaaagtctctaaaccaagtcagttgcaagcccatactcccgccagtcagcagactccccccctgcccccttatgcctcgccacgctcgcccccggtgcagcctcacacacccgtgaccatttcccttgggaccgctccaagccttcagaataatcagccagtggagtttaatcacgccattaactacgtaaataagattaagaacagatttcaaggccagcctgacatttacaaggctttcttggaaatcctgcatacgtaccagaaagagcaacgtaacgctaaagaggctggcggcaactatacacctgcactaacagagcaggaggtatacgcccaggtggcccgtctctttaaaaaccaggaggacctactgtctgaattcggacaattcctcccagacgccaatagcagcgttctcctttcaaaaacaaccgccgaaaaggtcgattcagtacgcaacgaccatggaggtaccgttaagaagcctcagctcaataataagccccagcgccccagccagaacggatgccagattcggcggcaccctacgggaacaacacccccagttaaaaagaaaccgaagcttctaaatcttaaagattccagtatggctgatgcaagcaagcatggcgggggtactgaatccctgttcttcgataaggtcagaaaggctctgaggagcgcagaggcctacgagaactttctacgctgtcttgtgatctttaatcaggaagtaatcagtagggcggaactcgtgcagctcgtatcgccattccttggcaagttcccagagttgttcaactggttcaaaaatttcctgggctataaagaaagtgttcacttagaaacgtatcccaaggagcgggctactgaaggcattgcaatggaaattgattacgcatcctgcaagagactcggttcgagctatcgggcactgccaaagagttaccagcagcctaagtgtactggtcgaacccccttgtgcaaagaggtgctcaacgacacctgggtctcatttccttcgtggagcgaagactcaacctttgtgagctcaaagaagacccaatacgaggagcatatatatcgctgtgaggacgaacggttcgaactggacgtggttctggagacgaacttggctacaattcgggtgctggaagctattcagaaaaagctgagtagactctccgccgaagagcaagcaaagtttagactggacaataccctcgggggcacgagcgaagtcattcacagaaaggcgctgcagcggatatacgctgataaagccgctgacattatcgatggattgcgcaagaatccttcgatagccgtacctattgtgctgaagcgtcttaagatgaaggaagaagaatggcgggaagctcagcgcggatttaataaggtctggcgagagcaaaatgagaaatattacctcaagtcactcgaccatcaggggatcaactttaaacagaacgataccaaggtcctgcgcagcaagtctcttcttaacgaaattgaatcaatctatgatgagagacaggagcaagcaaccgaggaaaatgccggcgtcccagttggcccccacttgagccttgcttatgaagacaaacaaattcttgaagacgccgctgccctgatcatccaccacgtaaaacggcagaccgggatacagaaggaggataaatacaagattaaacagatcatgcaccatttcatcccagacctgctgttcgcccagcggggggatctgagtgatgtggaggaagaggaggaagaggaaatggatgtagacgaggccaccggggctgtcaaaaaacacaatggcgtcggcggttctccaccgaaaagtaaattactcttctcaaacactgctgcccagaagttacgagggatggacgaggtctacaacctcttctatgtcaataataactggtacatcttcatgagactccaccagattctgtgtctgcgtttgctccggatatgcagccaggcggagaggcagatagaggaagagaatcgggagcgcgaatgggaacgcgaagtgctaggcatcaaacgggataaatccgatagcccagcaattcagctccgcctgaaggagcccatggatgtcgacgtcgaggattactacccagctttcctagatatggtaagatctctgctggacggaaacatcgatagctcacagtatgaagattcgctgcgtgaaatgttcacaatccatgcctacatcgcctttacgatggacaagttgatccagagcatcgtgcgtcagctccagcacattgtcagtgatgagatttgcgtgcaggtgacagatttatatctggccgaaaacaacaacggagctaccggaggccagctgaacactcaaaattcgcggtcccttcttgagagcacatatcagcgtaaggcggagcagttaatgtccgatgagaactgctttaagctcatgttcattcagtcacaagggcaagtgcagctgacaattgaactgcttgatacagaggaggagaattccgacgatcccgttgaggcagaacggtggtctgattacgtggaaagatacatgaatagtgatacaacaagtcccgaattgcgcgagcacctggcccaaaaaccagtttttctccctcgtaatcttcggcggatcagaaagtgccagcggggacgtgagcagcaagagaaggaaggtaaagagggcaacagcaagaagactatggagaacgtggactccctggacaaactggagtgcagattcaaattaaactcctacaagatggtttatgtgatcaagagtgaggactatatgtatagaaggacagcgctgctaagagcacatcagtctcacgagcgggttagtaaaaggcttcaccagagatttcaggcttgggtggacaagtggactaaggagcatgtgcctagagaaatggcagctgaaacgagcaagtggctcatgggtgaagggctcgaagggctggtgccgtgcaccactacctgtgatactgaaaccctccactttgtgagcatcaataagtatcgcgttaagtatggaacggtcttcaaagccccatag

SEQ ID NO: 205220 - DNA, 3822 bp, Artificial Sequence
  Description of Artificial Sequence: Synthetic coding sequence
atgaagcggcggctggacgaccaggagagccccgtgtacgccgcccaacagcgccggattcctgggtcaaccgaggcatttccgcaccagcatcgggttctagctccagcaccacccgtgtacgaagccgtgagtgagaccatgcaatctgctactgggatccaatattcagtgaccccaagttatcaagtcagcgccatgccacagtcttccggtagtcatggtcctgcaattgctgccgtgcattctagccaccatcacccaacagctgtccagccccacggcggtcaggtggttcaatcacatgctcatccagctcctcctgtggcgcccgttcaggggcagcaacaatttcaacgcctcaaagtggaggacgctctgtcgtacttggaccaggtgaagctgcagtttggcagtcagccacaggtgtataatgacttcctcgacatcatgaaagagtttaagagccaatcgatcgacacaccaggcgtgatctcacgcgtgagccagttgttcaagggccaccccgatctgattatgggattcaacaccttccttccccccggatataagatcgaggtgcaaactaacgacatggttaatgtgaccactccggggcaagtccaccagatccctacacacggcatccaaccgcagcctcaaccccctccccagcatccaagtcaacccagcgcccagagtgcaccagcacctgcacagcccgctccccaacccccacctgccaaagtctctaagcccagccagctgcaggctcacacgcccgcatcgcagcaaacacctccgctcccaccctacgctagcccaagatccccccccgtgcagccacacacaccagttacaatctccctggggactgcccccagtctgcagaacaatcaacctgtcgagtttaatcatgcgatcaactacgttaataagatcaagaatcgattccagggccagcctgatatctataaggcttttctcgagattctgcatacataccagaaagagcagcgaaatgccaaagaggcaggcggcaattacactcctgctctgaccgaacaggaggtgtacgctcaggttgctaggttgtttaaaaatcaggaagacttgctgtcggagttcggtcagtttcttcctgacgctaacagttcggtactactgtcaaagaccacagctgaaaaggtcgattccgtgagaaacgaccatggaggaacggtgaaaaagcctcagctgaacaacaagccacagcggcccagtcaaaatggatgccaaatcagaaggcatccaacaggaactactcctccggtgaagaaaaagcctaaattgctcaatcttaaggactcttcaatggccgatgcatccaagcacggcggcggcaccgagtcactcttttttgacaaggtgcgcaaggcccttagatctgcagaagcttacgagaacttcctgaggtgtctggtcatcttcaaccaagaggtcataagtagagcagagctggtacaacttgtcagtccctttctaggcaagttccctgaattgttcaattggttcaagaacttcctaggctacaaggagtccgtgcatctggaaacctaccccaaagagcgcgctacagagggtattgctatggaaattgattacgcaagttgcaagagactcgggtcttcatatcgggccttgccaaaatcctatcaacagcccaaatgcacagggagaacgcctctatgtaaagaggtgctgaatgacacctgggtgtctttcccatcttggagcgaggattccacattcgtgtcgagtaaaaaaacacagtatgaggaacacatctatcggtgtgaggacgagagattcgagcttgatgtcgttctcgagacaaatctggccactattagagtccttgaggctattcagaaaaagctgagccggttgagtgctgaggaacaggctaaattcaggctggacaataccctgggtggaacctcggaggtgattcacaggaaagcactgcagagaatctacgctgataaagcagcagacatcattgacgggttaaggaaaaatcctagtatagcagtccccatcgtactgaaacgcctgaaaatgaaggaagaagaatggagagaagcacagaggggctttaacaaggtgtggcgggaacaaaacgagaagtattacctgaaaagcctggatcaccagggcatcaactttaagcaaaatgatacaaaagtgctcaggagcaagagccttttaaacgaaatcgaaagcatctacgatgagagacaggaacaggccaccgaggaaaatgctggggtgccagtcgggcctcatctttcactggcatacgaggataagcagatactggaggacgctgctgctctgataattcaccacgtgaaaagacagactggtattcagaaggaagataagtataaaatcaaacagatcatgcatcactttatccctgacttactattcgcacaacggggggacctctctgacgtggaggaggaagaagaggaagagatggatgtcgacgaagctactggcgccgtgaagaaacacaacggggttggcggttcacctcctaaaagcaagctcctgtttagcaacacggctgctcaaaaactgcgaggaatggacgaagtatataatctcttttacgtgaacaacaattggtatatcttcatgcgcctacaccagattctgtgcttgcgcttgctgcgtatctgcagccaggccgagcggcaaatcgaagaggaaaatagagagcgagaatgggagcgggaggtgctcggaatcaaaagggataagagtgacagtccagcgattcagttgcggctcaaggaacccatggatgtggatgtggaagactactaccccgctttcctcgatatggtaaggtctctcctggacggcaacattgacagctcacagtatgaagatagcctgagagaaatgtttacaattcatgcttatattgctttcacaatggacaaactgatccagtcaatcgtgaggcaactgcagcacatagtgagcgatgaaatctgcgtgcaagtgaccgatctctacctagccgagaacaataatggggccactggcggccagctgaacacgcaaaatagtaggagcctgttggaatccacctaccagaggaaagccgagcagttaatgtccgacgagaactgttttaagctgatgttcattcaatctcagggacaagtgcagctgacaattgaacttctggataccgaggaggaaaactccgacgaccctgtggaagccgagcgatggtccgattacgtcgagagatacatgaatagtgacactacttccccggagctcagagagcacctggcccaaaagcctgtgttcttgccacggaacctaagacggatcagaaaatgtcagcgcggccgagaacagcaggaaaaggaaggaaaagaagggaactcaaagaagaccatggagaatgtcgacagccttgataaattggagtgtcgatttaagctcaattcctataagatggtctatgtaattaaatctgaggactatatgtaccgccgcacagcattactaagagcgcatcagtctcacgagagggtgtctaagcgcttacaccagagatttcaagcatgggtggacaaatggacgaaggagcacgttcctagggaaatggccgccgagacttccaagtggctgatgggggaaggcctggagggcttagtgccctgcacgacaacatgtgatacagagacattacacttcgtgtccatcaataaatatcgcgtgaagtatgggaccgtctttaaagctccatag

SEQ ID NO: 205221 - DNA, 3393 bp, Artificial Sequence
  Description of Artificial Sequence: Synthetic coding sequence
atggcccacgccggcggcggcagcggcggcagcggcgccggcggccccgccggccgaggtctgtctggggcccgctggggacgctccggtagcgccggtcatgaaaagctgcccgtgcacgttgaagacgcgctcacatatctggatcaggtcaagattcggttcggcagcgaccccgcaacctataatgggtttttggagatcatgaaggagttcaagtcccagtcaatcgacactcctggagtgatccgacgggtatcccaattatttcatgagcatccagacttgattgtggggtttaatgcttttctgccactgggctacagaattgacattccaaaaaacggtaagctcaatattcagagtcctttaacttctcaagagaattcacacaatcatggcgacggagccgaagatttcaagcagcaagtcccatacaaagaagacaagccacaggtacctctcgagagcgatagcgtggagtttaataacgctatcagctatgtcaacaaaattaaaacacggttcctggatcatcccgagatttatagatcttttctggagatcctgcacacataccagaaagagcagctaaatactcggggacgcccctttaggggcatgtctgaagaggaggtgtttaccgaggtggccaatcttttcagaggtcaagaagacctgctgagcgagttcgggcaattcctgcctgaggccaagaggtccttgttcaccggtaatggaccatgcgaaatgcattcagtgcagaagaatgaacacgataaaacaccagagcatagtagaaaaagaagcagaccttctctccttagacccgtctcagcaccagcaaaaaaaaagatgaagctgcgaggcacaaaagatctgtccatcgccgccgttggtaagtacggaacacttcaggagttttctttctttgacaaagtacgcagagtcttgaagagccaggaggtgtacgagaatttccttagatgcattgcactttttaatcaagagctggtgtctggatccgaactgttacagcttgtatcgccgtttctgggcaaatttcccgaattgtttgcccagtttaaatccttcctcggcgtgaaggaactgtcgtttgctcctcctatgtctgaccggtctggcgacggtatctcccgcgaaatcgactacgccagttgtaaaaggatcggttcgagctatcgagcactaccgaagacctaccagcagccgaaatgttccggccgcactgccatttgcaaggaggtgctgaacgacacatgggtatcttttcccagttggagtgaggacagtacctttgtgtccagcaaaaagaccccatacgaagaacagctgcatcgatgtgaggacgagaggttcgagctcgacgtggtgcttgagactaacctggctactatccgtgtgctggagagtgtgcaaaaaaaactgagtaggatggctcccgaggatcaggagaagttccgactagacgactccctgggaggaactagtgaggtgatccagcggcgcgcaatttatagaatctacggagacaaagctccagaaatcattgagtcactcaagaagaatcccgtgacagccgtcccagtggttctcaagcgcctgaaggccaaggaggaagagtggcgggaagcgcaacaaggtttcaacaagatatggcgggagcagtacgaaaaagcctatctcaaatccctggatcatcaggcagtcaactttaagcagaacgatactaaggcattgcgctctaaatctctcctgaacgaaatcgagagtgtttacgatgaacatcaggaacagcactccgaaggacgttcggccccatccagcgaaccacatctgattttcgtgtacgaggacagacaaattctcgaggacgccgccgcactcatctcctattatgtcaagaggcagcccgcaattcaaaaggaagatcaaggcactatccaccagctattacatcagttcgtgcccagcctttttttctctcaacagctggatcttggggcgagcgaggagtctgcggacgaagatagagactcgcctcagggacagaccacggaccccagcgagcgtaaaaaaccagcacccggtccgcactcaagtccccccgaagagaaaggcgctttcggggacgcgccagccacagagcagcccccccttccacctccagctcctcacaagccacttgacgacgtgtattcactgttctttgccaataataattggtattttttcctgcgcttgcatcaaactctctgctctaggttactcaagatttaccggcaagctcagaagcagctcctggagtatcgtacagagaaagaacgggagaagctgctgtgtgaggggcgcagagagaagggctcggaccccgctatggagctacgactaaagcagccaagtgaggtggaacttgaggaatactatcctgcttttctggacatggtcaggtcactgctggagggttcaatcgaccctactcagtatgaggacaccctgcgcgaaatgtttacaattcatgcgtacgtgggttttaccatggataaactggttcagaatatagcccggcagttacatcacttggtgtcggacgacgtctgcttgaaggtcgtggaactctatctaaacgaaaagaaacggggagcagccggcggaaatctgtcttcacgctgcgtgcgggctgccagggagacctcttaccagtggaaggccgagagatgcatggcagacgaaaattgttttaaggtaatgttcctgcagcgaaaagggcaggtcattatgacaatagagctgctggacactgaggaggcccagaccgaggacccagttgaagtgcagcacttggcaaggtatgtcgagcagtacgtaggaaccgagggtgcttctagttcccctactgaggggtttttacttaagcccgtattccttcagagaaatctgaaaaaattcagaaggcggtggcagtcagaacaagcccgagctctccgaggcgaggcacgcagctcgtggaagaggctagtgggtgtagagtctgcatgcgatgttgactgcaggtttaagctgtccacccacaagatggttttcatcgtgaactcagaggattatatgtatcgtagagggacactctgtcgagctaagcaggtccagcctctggtgcttcttaggcatcatcagcactttgaggagtggcacagtcgttggctggaggacaatgtcaccgtagaggcagcgagtctggtgcaggactggcttatgggtgaggaggatgaagatatggttccatgcaaaactctctgtgagaccgtgcacgtccatggcctcccagtgacgcggtatagagtccagtattctcggagaccggcctccccatag

SEQ ID NO: 205222 - DNA, 3489 bp, Artificial Sequence
  Description of Artificial Sequence: Synthetic coding sequence
atggcccacgccggcggcggcagcggcggcagcggcgccggcggcccagcagggaggggcctgtccggtgcccgctggggcaggtccggcagtgccgggcatgaaaaattgccagtgcatgtcgaagatgccctgacttacttggaccaggtgaaaattagattcggcagcgatccggctacatataatggtttcttagagatcatgaaggaatttaagagtcagagcatcgacactccaggagtgatcagacgcgtcagccaactgtttcatgaacacccagacctcattgtcggcttcaatgccttccttcccctcgggtaccgcatcgacatcccgaagaacggtaaactgaacatccaaagcccactcacaagtcaggaaaatagccataatcacggggacggggctgaggattttaagcaacaggtgccttacaaagaggataaaccccaggtgccattggagagcgactctgtagaatttaacaatgcaatctcctatgtcaataaaatcaaaacccggttcttggaccatcctgaaatctataggtcgtttctggaaatcttgcacacataccagaaagagcagctgaatacacgcgggcgcccgttcagaggcatgagcgaagaggaagtgtttactgaggttgctaacctctttagaggccaggaggatttactgtctgagttcggccagtttcttccagaggctaagcgctctcttttcacagggaacgggccctgcgagatgcattctgttcagaagaatgaacacgataaaacacctgagcacagtcgaaaacggagccgtccctccctcttacgacccgtcagcgctccagccaagaaaaaaatgaagctgaggggtactaaggatctgtccatcgccgcagtcggaaaatatgggactctgcaggaattctcatttttcgacaaggttcggcgcgtactcaagagtcaggaggtctatgaaaactttctgaggtgtatcgcgctattcaaccaggaactggttagcggcagtgaactcctgcagcttgtctcccctttcctaggtaagttccctgagctgttcgcccaattcaaatctttcctcggggtcaaagagttgagcttcgccccacccatgagcgatcgctctggcgatggtatcagccgcgagatcgactatgcatcatgtaaacgtataggatcatcctaccgtgctctgcctaagacgtatcaacagccaaaatgttcaggccgtacagccatttgtaaggagttggaccattggacactgctccaaggaagttggactgacgattactgtatgtccaaattcaaaaatacatgctggatccctggttattcagcgggggtccttaacgacacatgggtctcattcccgagctggtctgaggacagtactttcgtatcttccaagaagaccccgtatgaggagcagctgcaccgctgcgaggatgagcgctttgaacttgatgtggtcttggagacaaacctggctactattcgggtactggagtccgtgcagaagaagcttagtcgcatggcacccgaagaccaagagaagttcagactggacgactctctaggcggtacgtctgaggtgatccagaggcgcgctatttaccgtatttacggggacaaggctcctgaaattatcgagtctctgaagaaaaaccccgttactgccgttcccgtggtgctaaagcgcttaaaggctaaggaagaagagtggagagaggcacagcagggtttcaacaagatctggagagagcagtacgaaaaagcctacctcaaaagcctcgatcaccaggccgtgaatttcaagcagaacgacactaaagctctgcgctcaaaaagcctgttaaacgaaattgagtccgtctacgatgagcaccaggagcagcacagcgagggcaggtccgccccttcctcggaaccacaccttatcttcgtctacgaggatagacagattctggaagacgcagctgccctgatctcctactacgtgaaaaggcagcctgccatccagaaagaagaccagggtacaatacatcaactgctgcaccagttcgtgccaagcttgtttttcagccaacagctggacttgggagccagcgaggaaagtgcggacgaagatcgcgacagccctcagggccagaccacagacccgagtgaaagaaagaagcctgcccctggcccccacagcagcccccctgaggaaaagggggccttcggcgatgcgcctgcaactgaacaaccgcctctccctcctcctgccccacataagcctctggatgacgtgtactcccttttcttcgcaaataataactggtactttttcctaaggctccaccaaaccctgtgctcccggttgcttaagatctatcgacaggcacagaagcaactactggagtaccggacagagaaggagcgcgagaaattgttgtgtgagggtcgcagggaaaaaggtagcgatcccgccatggagctgcgcctgaagcagcctagcgaggttgaactggaagagtactatccggcctttcttgacatggttcggagcctcctagagggaagtattgaccccacccagtacgaagacacactgagggagatgttcactatacatgcatacgtagggttcacaatggacaaactggtccaaaacattgcacgtcaattgcatcacctcgtgtctgacgacgtttgccttaaggtggttgaactgtatctcaatgagaagaaacgaggagccgcaggtggtaatctatccagccggtgcgtgcgggccgctcgggaaacgtcttatcagtggaaggctgagcgctgtatggcggacgaaaactgcttcaaagtgatgtttctgcagcgtaagggtcaggtaatcatgaccattgaactgcttgataccgaggaggcgcagactgaggaccctgtagaagtgcagcatctggcccgatacgtagagcagtacgtcgggactgaaggggcgagtagcagcccgacagaggggtttctcctcaaacccgtgttcctgcagcgaaatctaaagaagtttcgccggcgatggcaaagtgaacaggctcgggcactaaggggggaggccaggtctagttggaagcggttagtgggtgtggaatccgcttgcgacgtggattgccggttcaaactcagcactcacaaaatggtattcattgtcaatagtgaggactatatgtaccgacgcggcaccctctgccgcgccaagcaggtccagcccctcgtgctgctgaggcatcaccagcacttcgaagaatggcatagtaggtggctcgaggataacgtgaccgtggaagctgcgagtctggtgcaagattggctgatgggggaagaggacgaagacatggtcccctgtaagactctatgtgaaaccgtccatgtccatggcctccctgtaactcgctatagggtgcagtacagcagaaggcccgctagcccatag

SEQ ID NO: 205223 - DNA, 3171 bp, Artificial Sequence
  Description of Artificial Sequence: Synthetic coding sequence
atgagcagccagcagttcccccggctgggcgcccccagcaccggcctgtcccaggctccttctcagattgcgaattcagggagcgcagggcttatcaatcccgctgccacagtgaacgatgagagtgggagagatagcgaggtcagtgctcgcgaacacatgtccagcagcagctctcttcaatcgcgtgaagaaaaacaagagcccgtggtggttaggccatatccccaggtacagatgctcagcactcatcacgctgtcgcctctgctacccctgtggctgtcacagccccccccgcccatctgacacccgccgttcctctctcctttagcgagggactgatgaagcctcctcccaaaccaacaatgccatcccggccaattgcaccagcgcccccaagcaccctaagcctcccccctaaagtgccaggacaggtgacagtgaccatggagtcaagtatcccccaggctagcgccatccccgtggcaaccatcagtggccagcaaggtcaccccagcaatctccaccacataatgactaccaacgttcaaatgtccatcattcgaagcaacgctccggggcctcctctgcacataggcgcgagtcatctgccacggggcgctgccgcagccgctgtaatgagctcctcgaaggtgactactgtgcttagacctacatcacagttacccaatgctgcgacagctcagccagcagtccagcatataatccaccagcccatccagtccagaccgccagttaccaccagcaacgctattccgcctgcagtggtggccaccgtgagcgccacaagagctcagagccctgtaattacaaccactgcagctcacgctacagactcagccctgagcaggccaacactgtcaattcagcatcctccctcagcagcaatctccatccagaggccagcgcaaagcagggacgtgacaaccagaattacccttccctcccacccggctttgggaaccccgaaacagcaattacacacaatggcacagaagaccatctttagcacagggactccagtggcagctgcaaccgtagccccgatactggccactaatacaatcccatcagccaccactgctggcagtgtgtctcatacgcaagcccccacaagcacaatcgtcactatgactgtcccctctcactcatcccatgccactgcagttacaaccagcaacattccagtggcaaaggtcgtcccacagcagattacccacacttcaccccgtatccagccggactatcctgccgaaaggtcatccttgatacccattagcggccatcgggcgtcgccaaaccccgtcgcaatggagactcggagcgacaaccgaccatcggtacctgtacagttccagtactttctccctacctaccctccatcagcctatccgctggctgcccacacatacactcctatcacttcatctgtgtccactatccggcagtatcccgtgagtgcccaagccccgaacagcgccatcactgcgcaaacaggggttggagtcgcttctacagtccatctgaaccccatgcagctgatgaccgtggacgctagccacgcaaggcacatccagggaatccagccagctccaatttccacgcagggaattcagcccgctcccattggcacccctggaatccagcccgctcccctggggacgcaaggtatccattcagcgacccctattaacacacaagggctacaacctgcgccaatgggaacccaacagccgcaaccggagggcaagaccagcgtggtcctggctgatggcgcgaccatcgtagcgaatccgatatccaacccgttctccgctgctcctgcggctacaacagtggtacaaacccattcccagtcagcatcaacgaacgcccctgctcagggctcctcgcctcgtccatctatactaaggaagaagcccgcgaccgatggcatggctgtcagaaagaccctgatacctccacagcccccagatgtggcctcaccccgcgtcgagtcttctatgagatccacttcaggctctcctaggcctgccggcgccaagccaaagtccgaaatccacgtgtccatggcgaccccggtgacggtatcgatggagaccgtgagtaaccaaaacaacgaccagccaacaatcgcagtgccccccaccgcccagcagcccccaccaactatcccaaccatgatcgccgcagccagccccccctcacaaccagctgtcgctctgagcactatccctggcgctgtaccaatcaccccacctataactaccatcgccgccgccccgccaccctcagtgacggtcggagggtccctttcctctgttctgggaccccccgttccagaaatcaaggtaaaggaggaagtagaacctatggacatcatgcggccagtgtccgccgtgccgccactggccacaaacaccgtgtcacctagcctcgctctgctggccaacaacctatcaatgcctacctcagacttaccaccaggcgcctccccaagaaaaaagccgaggaaacaacagcatgttatctcaactgaggagggcgacatgatggagaccaattctaccgacgacgagaagagcacagcgaagtcactgcttgtcaaagctgaaaagcggaaatcgccccccaaagagtatatcgacgaggagggagtccgatacgtgccagtgcggcctcgcccaccaatcaccctgctgagacattataggaatccttggaaggctgcctatcaccattttcagcggtatagtgatgttcgcgtgaaagaagagaaaaaggccatgttgcaggaaatcgccaaccagaaaggagtcagctgtagggcccagggatggaaagtgcatctctgcgcagctcagctgctccagttgacaaatctagaacacgacgtctatgagagactgacaaaccttcaggagggaattatacccaaaaagaaggcggccaccgatgatgatttacatcgcatcaatgagttaatccaaggcaatatgcaacgctgtaagctggtaatggatcagatcagcgaagccagagactctatgctgaaagtccttgatcacaaggaccgtgtgctgaagctgcttaacaagaatggtacggttaagaaagtctcgaaacttaagcgcaaggagaaggtttag

SEQ ID NO: 205224 - DNA, 3147 bp, Artificial Sequence
  Description of Artificial Sequence: Synthetic coding sequence
atgggccccccccggcacccccaggccggcgagatcgaggccggcggagccggaggagggaggagattacaggtggagatgtcctcccagcagttccccaggctaggggcccccagtacagggctgagccaggcacccagccagatcgcaaatagcggctcggctggcctgattaaccccgccgcgacggtcaatgacgagtccggtcgggactcagaagtctctgccagggagcacatgagtagttcaagctctttgcaatcgagagaggaaaaacaggaacctgttgtggtccggccctacccccaggtgcagatgctgagcacacatcacgcagtggccagcgccacaccagttgccgtaactgcgccgccagctcacctcacaccggccgttccactgagtttttctgagggactaatgaaacctccccccaagccgacaatgcctagtaggccgatcgcgccagcgcctccaagcaccctgtcgctgccacctaaggtccctggtcaagtcaccgtgaccatggaatcatctatccctcaggcttctgcaatcccagtcgccacgatatcgggccaacagggccacccttcaaaccttcaccacatcatgaccactaacgtacagatgagcatcatcaggagcaacgcccccgggccccctttgcatattggcgcaagccatttacccagaggtgccgctgcagctgcagtgatgagctcctcaaaagtgactacagttctgagacctacctcgcaactgccaaatgcagctaccgcgcagcctgctgtccaacatattattcaccagcctatacagagcaggccacccgttaccacctccaacgctattccacctgccgtcgtggctactgtgagtgcaactagagcccagtctcctgtaatcacgaccacagcagcgcatgccactgatagcgccctttcgcggcccaccctctccatccagcacccgccgtctgccgctatctccatccagaggcctgctcaaagcagagacgtcaccacccggattacactgccctcgcatccagcattgggtacccctaaacagcagctgcataccatggcccagaagactatattcagcaccggcacacctgttgcagccgcaactgtggctccaattttagccaccaacacaatcccatcagccaccacggcaggtagcgtttcacacacacaagcgccaacaagtactatcgtgacgatgaccgtgccttcacacagcagccatgccactgcagtaaccacgtcaaacattccagtggccaaggtggtgccacagcagattacacacactagcccccgcatccagccagattatccagcagaaagatcgtctcttatacccattagcgggcaccgcgcttcgcctaaccccgttgctatggagaccagatcagataaccggccaagcgttcctgtgcagttccagtatttcttgcctacctaccctcccagcgcctatcctcttgccgcacatacatacacacccattacgagtagcgtgagcacgataaggcagtaccctgtttctgctcaggcccccaactctgcaatcaccgcacagaccggggtgggagtcgcgagcaccgtccatttgaatcctatgcagctaatgacagtggatgcttcacacgccagacatattcagggtatccagcctgcacctatctcaacacaaggaattcagcctgcacccatcggcactcccgggattcagccagcaccgttggggacccagggcatccattcggccacgcccatcaacacccaaggactgcaaccagcgcctatgggcacccagcagccgcagcccgaagggaaaacaagcgccgttgtattagccgatggtgccaccatcgtcgcaaatcccatttccaatccattttctgctgcccctgccgccactaccgtggtgcagactcattctcagtctgcaagcacaaacgcacccgcacaaggatcatccccacgccccagcatactccgcaaaaaacccgccacagatggcgcaaagccaaaaagcgaaattcacgtcagcatggccacgccagttactgtaagcatggaaaccgtctccaatcaaaataatgaccaaccaacgatagctgtgcctccaaccgcccagcagcctccccccacaattcccacaatgatagctgcagcatctccccccagccagcccgccgtcgctctctctacaattcctggagccgtgcctatcaccccaccaataaccactattgctgcggcgccaccaccttccgtgacagttggagggtccctatcaagcgtgcttgggccacccgtacccgagattaaagtcaaggaggaggtggaacccatggacatcatgcgtcccgtgtcagctgttcctcccctggcaaccaatacggtctctcccagcctggccctccttgctaataatctttctatgccaacttccgacttgcctcccggggcgagtccacgcaaaaaaccccggaagcagcagcacgtcatctcgactgaggaaggcgatatgatggagacaaatagcactgatgacgagaagagcacagctaagagccttttagtgaaggccgaaaaacgtaagtcccccccgaaggaatacatagacgaagagggcgtaagatacgtccctgtgagaccaaggcctcccatcaccctattgcgccactaccgcaacccatggaaggccgcctatcaccacttccaaaggtactccgatgtgagggtgaaggaagaaaagaaggccatgttgcaggaaattgccaaccagaaaggcgtgtcttgcagggctcaaggctggaaagtgcacctgtgcgccgcccagctgcttcagctgaccaacttagagcatgatgtttatgagcgcctgactaatctgcaagagggcataattcctaagaaaaaagctgctactgacgacgatctgcaccgtatcaacgagttaatccaggggaacatgcagaggtgtaagctcgtgatggaccagatctcagaggcaagggactccatgctgaaggtcttggatcacaaagacagagtgctcaagttgctgaataagaacggaaccgttaaaaaagtatcgaaacttaagcgaaaggaaaaggtgtag

SEQ ID NO: 205225 - DNA, 3252 bp, Artificial Sequence
  Description of Artificial Sequence: Synthetic coding sequence
atgggccccccccggcacccccaggccggcgagatcgaggccggcggcgccgggggcggccgcagactgcaggtcgagatgagcagtcagcagtttccccgcctgggcgctcccagcacagggcttagtcaggcaccctcccagattgccaattctggatcagccggtttaataaaccccgctgccacagttaatgacgagtcgggccgggacagtgaagtgtccgcccgggaacacatgtcatccagttctagtcttcaatctagagaggaaaagcaggagccagtcgtagtgcgcccctatccgcaggtgcagatgctgagcacacatcacgcagtggctagcgccacccccgtagccgtcaccgctccccccgcacacttgactcctgctgtgcctctgtctttctctgagggactcatgaagccacctcccaagccaaccatgccctcccgacctatagcgcctgccccaccctcaactttaagccttccacccaaggttcctgggcaggttacggtcacaatggagtcttctatccctcaggccagcgctattcctgttgccaccattagtggacagcaggggcacccctcaaatctgcatcacatcatgacaactaatgtgcagatgagcataatccgctccaacgcccccgggccgccactccacattggtgcaagccacctgcctaggggagcggctgctgccgccgtaatgtcttcgagtaaggtgacaaccgtgctccgccccacatcccagcttccaaacgccgccaccgctcaacccgccgtccagcacattatacaccagcctatccagtctcggcctcccgttacaaccagcaacgccataccccccgcagtggtcgctactgtgagcgcaaccagggcacaatcccctgtaattactactacagccgctcatgccactgattccgcgctctcgaggccgactctatcaatccagcatccaccttcagctgccatttcaatacagcggcctgcccagtctagagacgtaactacccgcatcaccctccctagccaccccgcactgggcacccccaagcagcaactgcatactatggcccagaaaaccatattctctacaggaacgcccgtggctgcagcaacggtggctccaatattggccaccaacacaatacctagcgcgactaccgcagggtccgtgagccatacacaagctccaacctctactatagtgaccatgacagtcccctcgcactcttcccacgccacggcagtaactacttcaaacatcccggtagcaaaagtggtcccacagcagataacccacacctcacccagaatacagccagactatccagctgaacggtcgtccctcattcccatttccggtcatagggcaagtccgaaccccgtggccatggaaactaggtccgataaccgacccagcgtgcccgtgcagtttcagtatttcctccctacctacccaccgagcgcctacccgctggccgcccacacttacactccaatcacatccagtgtctcgacgatccgccaataccctgtgagcgcccaggcacctaatagcgccataactgcccagacgggggtgggggttgcgtctaccgtccatctcaatccaatgcagctcatgaccgtagacgcctctcacgccaggcacatccaggggattcaaccagcccctatctccacacaggggatccagcccgcacccatcggaaccccgggtatccagccagctcctctgggaactcagggcatccattctgctacgccgatcaacacccagggtcttcagccagcgccaatggggacacaacagccccaaccggagggaaagacgagtgctgtggtactggcggacggtgctactatcgtggccaaccctatcagtaacccatttagcgctgccccggcagccaccaccgtggtgcaaactcactctcagtcggcctcaacaaatgcccccgcacagggcagttcacccagaccatcaatcctgagaaagaaaccagctactgacggcatggctgtgagaaagacccttattccccctcagccgcctgacgtcgcaagtccccgggtggagtcctcaatgcggtccacgtccggatctccccggccagcgggcgccaagcccaagagtgaaattcacgtctcaatggcaacgccagtcactgttagcatggaaacagtatctaaccagaacaatgaccaacctacaattgcagttccaccaacagcccaacaaccgccgccaacaatacccacaatgattgccgccgctagtcctccctcacagcccgccgtggccctttctaccattcctggcgccgtccctatcacccctccaatcaccaccattgccgccgctcccccaccatccgttacagtcggagggagtctttcttccgtattgggtccaccagtaccagaaattaaagtgaaggaagaggtggagcctatggacatcatgagacccgtttcagccgtgccccctctggccaccaatactgtttcaccaagtctggctctgctggccaataacctttccatgcccacctcagacctgccacccggggcctctccaaggaaaaaacccagaaaacagcagcacgtgattagcaccgaggaaggtgacatgatggagaccaattcgactgacgatgagaagtctaccgctaaaagcttgctggtgaaggctgaaaagaggaaaagcccacctaaagaatacattgatgaggaaggggtacggtacgttccagtaagacctagaccacctattaccctcttgagacactatagaaatccctggaaggctgcataccaccacttccagcggtacagcgatgtgcgggtcaaagaggagaagaaagccatgttacaggagatcgccaatcagaagggtgtgtcctgtagagctcaaggttggaaggtccatctgtgtgccgctcagttgctccagctgacaaatctggagcatgacgtgtacgagcggctgaccaacctgcaggaaggaataatccccaagaaaaaggccgctacagatgatgatctgcatcgaatcaacgaactcatccagggcaatatgcaacgctgtaaactcgtgatggaccaaatttctgaagctcgtgactccatgctgaaggtgctggaccacaaagaccgcgtgctgaaattgcttaataagaatggcaccgtaaaaaaagtgagcaaactgaagagaaaagaaaaggtgtag

SEQ ID NO: 205226 - DNA, 789 bp, Artificial Sequence
  Description of Artificial Sequence: Synthetic coding sequence
atgagcagccagcagttcccccggctgggcgcccccagcaccggcctgtcacaagctccaagccagattgccaactctgggtccgcgggcctgattaatcctgctgctactgtgaacgacgaaagcggacgcgattccgaggtgtccgctcgggaacacatgtcctccagctcctccttgcagagtcgcgaggagaaacaggaacctgtggtcgtgagaccatacccacaggtgcagatgctctccacacatcacgccgtggcgagtgccactccagtggctgtaaccgcaccgcccgcccatctcactccggccgttccactaagtttttcagaagggctaatgaagccacccccaaagccaaccatgccttcccgccctattgctccagcgccaccgtctaccctgtccctgccccccaaagttcctggccaagttactgtcaccatggagtcttccatcccccaggccagcgccatccctgtggccacgatatctgggcagcaggggcacccgagtaatctacatcacatcatgacaaccaacgtgcagatgtccattatacggtctaatgcacctggcccacccctgcacattggagccagccacctcccccggggggccgccgcagcagctgtaatgagcagttcgaaggtgacaaccgtcctcaggcccacttctcagctgccaaatgccgccaccgcacagccagcagtacagcatatcatacatcaacctatccagagcaggcctcccgtgactacgagcaatgcaatcccccccgcatag

SEQ ID NO: 205227 - DNA, 630 bp, Artificial Sequence
  Description of Artificial Sequence: Synthetic coding sequence
atgaaccccagcatgaagcagaagcaggaggagatcaaggagaacattaagaactcttcagtaccgcggcggacgttgaagatgattcagccaagtgcctccggatccctggtgggcagggaaaatgaactcagtgctgggttgtctaaaaggaaacacagaaacgaccacttgaccagtacgaccagctccccgggagtcattgtgcccgaatcctctgaaaacaagaatctgggcggtgtaacccaggagtcttttgatctgatgattaaggagaacccgtctagccagtactggaaggaggtcgctgaaaagagaagaaaagcgttgtacgaagcactgaaagagaacgagaaattacataaggaaatcgaacagaaggacaacgaaatcgcacggttaaagaaggagaacaaagagcttgctgaagtggcggagcacgtacagtacatggccgagctaatcgaaagactgaatggggagccactggacaattttgagagcctggataatcaagagtttgacagcgaggaagagactgttgaagattctctggtagaagatagcgagatcggaacttgtgccgagggaacggtgtcctctagcacagacgccaagccatgtatctag

SEQ ID NO: 205228 - DNA, 2622 bp, Artificial Sequence
  Description of Artificial Sequence: Synthetic coding sequence
atggccgagatggagaaggagggccggccccccgagaacaagcggagcaggaagcctgcccatccggtgaaaagagagataaacgaggagatgaagaacttcgcagagaacacaatgaatgagctgcttggatggtatggctatgacaaggtggaattaaaggacggggaagacatcgaatttcgatcgtatccaaccgacggcgagtcaagacagcacatctccgtgttgaaagagaactcattgcctaagcctaagctgcccgaagactccgtaattagcccatacaatatctcaacaggctacagtggactggctacgggaaatggtctgagtgacagccctgcgggttccaaggatcatggctctgtgccaatcattgtgcctcttatcccaccaccctttatcaagcctcctgcggaggacgatgtttcaaacgtccaaattatgtgcgcttggtgtcaaaaggtgggtatcaagcgctatagcctgagtatgggctccgaagttaagtcgttttgttcagaaaagtgtttcgctgcttgccggagagcctacttcaaacggaacaaagcccgcgacgaggatgggcatgccgaaaattttccacaacaacattacgcgaaagagacaccaaggctagccttcaaaaataactgtgaactcctggtgtgcgactggtgtaagcatattagacacacaaaagagtacttagacttcggagacggtgagcgtcgcctccaattttgcagtgccaagtgcctgaaccagtacaagatggatattttctacaaagaaacccaagctaatctcccagccgggttgtgtagtaccctgcacccacccatggagaacaaggcagagggtacaggcgtgcaacttctgactccagacagctggaatatccctctgaccgatgctaggcggaaagcacccagccccgtcgctacagccggacagtcccagggccccggaccctccgcttccaccactgttagtccgagcgatactgcaaattgctcggtaacaaagataccgacacccgtgcctaagagcataccaatctctgagactcccaatattccacctgtgagcgttcagccacccgcctccataggtccccccctgggtgtgccaccacggtcccctccaatggtgatgaccaatcgaggaccagtgccgctccccatattcatggaacagcaaattatgcagcagattcgccccccctttatccgcgggccgccccatcatgcaagcaaccccaattctcctctgtctaacccaatgttgccgggaattggcccgccccctggaggcccgcggaacctgggccctacaagctctccaatgcatcgccctatgttatctccgcatattcaccccccgagcactcccaccatgcccggaaaccctcccggcctcttaccgcctcctcctccaggcgcacctctgcctagccttcccttcccacccgtgtcaatgatgcccaatggcccaatgccagttcctcaaatgatgaattttggcctaccctccctggctccgctagtgcctcccccgaccctccttgttccatatcccgtaattgtaccactgcctgtccctatccctatccctattcccattccacatgtgtccgactccaaaccaccaaatggtttcagctctaacggcgagaactttattccaaacgcacccggggatagcgccgccgccggcgggaagccgtccggacattccctgagcccccgggatagcaagcagggctcgtctaagtctgccgatagtcccccaggctgctccggtcaagcattatctctggctcccacgccagctgagcacggcaggtctgaagtggtggatcttacccgccgcgcagggtccccgccgggacctcccggcgcaggtggacaattaggcttccctggtgtgctgcaaggcccacaagacggggtcatcgatcttacagtgggtcatagagccaggttgcataatgttattcaccgcgctctccatgcgcatgttaaggccgaacgagagccatccgcagcagagagacgtacctgcggtggctgccgcgatggacattgtagccctcccgccgccggagaccccggtccaggagccccagctggcccggaggctgccgcagcctgcaacgtaatcgtaaatggaacccgcggggccgcagctgagggagcaaaatcagccgagcccccgcccgaacaacctcccccaccaccacctccggccccccctaagaagttgctgtcaccagaggagcccgccgtgtcagaactagaaagcgtcaaagagaacaattgtgcgtcgaactgtcacctcgatggggaggccgccaaaaagctgatgggagaggaggctcttgcaggcggagataagtccgacccaaatcttaataaccctgccgacgaagatcacgcctatgccctaagaatgctgcctaagacagggtgtgtgattcaacctgtgccaaaacctgcagagaaggctgccatggctccctgtatcatttcttcgccaatgctctctgccggtccagaggatctcgagcctcccctgaaacgccgatgcctgcgcattagaaatcagaacaaatag

SEQ ID NO: 205229 - DNA, 1233 bp, Artificial Sequence
  Description of Artificial Sequence: Synthetic coding sequence
atgcccggcgtgtgcgaccgggcccccgacttcctgagccccagcgaggaccaggttctacgcccagccctgggatcctctgtggccctgaattgcacagcctgggtcgtctctggcccacactgttcactgccttcagtccaatggttgaaggacggcttgccactcggtatcgggggccattacagcctacacgaatactcatgggtgaaagctaacctgagtgaggttctcgtctctagcgtgcttggggtgaatgtaacaagcacagaagtctatggagccttcacctgcagtattcagaacatcagtttttctagcttcactctgcagcgagctggcccgacatcccacgtcgccgccgttctggccagtttactcgtgctcctcgctctgttattagctgcattactgtatgtcaaatgtcgactaaatgttttgctctggtaccaagacgcatacggcgaggttgaaatcaacgatggcaagctgtatgacgcgtatgtttcctactcagactgcccagaagatcgtaagttcgtgaacttcatcctcaagccacagttggaacgtcggcgggggtataagctctttcttgatgacagggacctgctcccccgggcagagccgtccgccgaccttctggttaatctatctcgctgcaggaggctgatcgttgtgttgagtgatgcattcctctcacgggcctggtgctctcactccttcagagaagggctttgcaggctccttgagctgacgcgccgtccaatctttattactttcgaagggcaaaggagggatcccgcccatcccgctttaagacttttgaggcagcaccggcatctcgttacattgcttctgtggcgtccagggtcggtgaccccgagctccgacttttggaaggaagtgcaactcgccctgcccagaaaagtgcaatacaggcctgtggagggcgacccccagactcagctgcaggatgataaggatcccatgctcattctgcgcggcagggtcccagaggggagggctttagactcagaggttgacccggatcccgagggtgacctcggagtgaggggccctgtattcggcgaaccctcagccccacctcatacctctggagtctctcttggcgagtcacggtcttccgaggtagacgtcagtgatctgggtagccgcaattactccgcacggaccgatttttactgcctggtttccaaagacgatatgtag

SEQ ID NO: 205230 - DNA, 1515 bp, Artificial Sequence
  Description of Artificial Sequence: Synthetic coding sequence
atgcccggcgtgtgcgaccgggcccccgacttcctgagccccagcgaggaccaagtcctgcgacccgctctgggttcctcagtggcactcaactgcacggcctgggtcgttagcggcccgcactgctctctccccagcgtgcagtggctcaaagatgggctgccgctcggtattgggggccattattctcttcacgagtacagttgggtgaaagctaacctctccgaggtgctcgtcagtagtgttcttggagtgaatgttacctctactgaggtttacggtgcattcacatgttcaatacaaaatatctcattcagcagtttcaccttacagcgtgccggccccacgtctcatgtggcagcggtgctcgcctccttacttgtcctcctagctctgctgttggcggcattgttatacgttaagtgtagattgaacgtgctgctttggtatcaggatgcttacggggaggtggagatcaatgatgggaagctatacgacgcatacgtgtcctactccgattgtcctgaagacagaaaattcgtcaactttatcctcaaaccacagctggaacgtagaagggggtacaagctgttcttagacgatagggatctgctgcctagagctgagccctccgccgacttattagttaacttgtctcgctgtcgccggctaatagtcgtcctgagtgacgcattcttgtcacgcgcctggtgcagccacagcttcagagaagggttgtgcagattgctggagcttacccgtcgtcctatctttattaccttcgaaggccagcgtcgagatcccgcccatcccgccctccggctcctaaggcagcacaggcacctcgtgactttattactctggcgtcccggcagcgtgaccccttcttctgatttctggaaggaggtgcagctcgcactgccacgcaaggtgcagtaccggcctgtggagggggatccgcagacacagctgcaggatgataaggaccctatgcttattctgcgtggacgcgtccccgagggacgggctctggatagtgaggttgaccctgatcccgagggtgacctggggatgcctgcccagccacattccccaaccggagaagcgcaacatagggccgagtggggccaggcccagggaacaggccccggtggcgctccgggcgtggaagattctagccgacacagagagccactgcatggcctatgtcccggcggcgctagaccaagcgtgtgtttgggcacatcctgggcatcacaggccatcaccgcgggtggcgaacaagggcagcctctcgccgttggcttggggcaggggtgcggatggcccccccaagcatcccggagccctcacccgaggtgtcctggcgcttgcctctggcgcgctataagtagcacggcacatcaatggggtctcgccggcagggaaccagaacagcgatccggccgcctcggttcaaggttggcaaagctccagtgcccccacaggttactcttgcctggggtccaggggtag

SEQ ID NO: 205231 - DNA, 1233 bp, Artificial Sequence
  Description of Artificial Sequence: Synthetic coding sequence
atgcccggcgtgtgcgaccgggcccccgacttcctgagccccagcgaagatcaggtcctacggccagctcttggttcgagcgtcgctcttaattgtaccgcctgggtggtgtccgggccacattgttcactgcctagcgtgcagtggctgaaggacggcctaccattgggaatcggaggacactatagcctacacgagtattcttgggtgaaagccaatttgtcggaagtcctcgtctcttccgtgctgggagtaaacgtgaccagtacagaagtgtacggcgccttcacgtgttctattcaaaacatcagcttttccagttttaccctccaacgggccggccccacctcccacgtggccgcggtgctcgcgtctctgctggtgctcctggccctcctcttggccgcgctgctctatgttaagtgccgcctaaatgtccttctttggtatcaggatgcttacggggaagtcgagatcaacgatggaaaactctacgatgcctatgtgtcttactcagattgccccgaagaccgtaagttcgtgaattttattctgaaaccacagctggaacggcggagagggtacaaactgtttctggacgaccgggatctgctgccccgggctgagcccagcgccgatttgctcgtcaatttatcacgctgccgaagactcatcgtggtgctttcggacgcgttcctatctcgtgcttggtgctcacactctttccgcgaaggactctgtcggctcctagaactcacacggcgaccgatttttataacgtttgaaggacaacgcagagaccctgcccacccagctctaagactgttacgacagcacaggcacctcgtcacgctgcttctttggcgtcctgggtcagtgaccccaagctctgatttctggaaagaagtgcagctagccttgccacgcaaggtccagtatcgacccgtagagggagacccccagacccagctgcaagacgacaaagatccgatgctcattctgagaggacgcgtgccggaaggaagagctctcgacagcgaagtagacccagacccagaaggtgacttgggtgtgcgaggtcctgttttcggagagccctcagctcctccccacacatctggtgtgagtttgggggaatcccgctcctccgaggttgacgtcagtgatcttgggtcccggaattatagcgcccgaacggacttttactgcctggtctcgaaggatgacatgtag

SEQ ID NO: 205232 - DNA, 1233 bp, Artificial Sequence
  Description of Artificial Sequence: Synthetic coding sequence
atgcccggcgtgtgcgaccgggcccccgacttcctgagccccagcgaagaccaggttttacggccggcgctaggcagcagtgtggccttgaattgtacggcatgggttgtgtccggcccacattgcagtctccctagcgtgcaatggttaaaggatgggctccccctcgggattggcgggcattactcactgcatgagtactcatgggtgaaggcaaacctctcagaggtgctggtgagtagtgtcctgggagttaacgtcacatcgaccgaggtttatggcgcattcacatgttccattcagaatatatctttcagttccttcacactgcagagggccggccccacatctcatgtggccgcagtgcttgcaagtctcctggtactgctcgcactgctgctggcggccctcctctacgtcaaatgtcggctgaatgtactgctgtggtatcaggatgcatatggagaggtggagattaacgatgggaaactatacgacgcatacgtgagctattcagattgcccggaagaccgaaaatttgtaaactttatcttgaagccacaattagaacgcagaagaggatataagttgtttctcgatgaccgggacctccttcctcgggctgaaccatcggcggacctcctagtgaacctttctagatgccgaaggcttattgtggtattgagtgacgcattcctgtcacgagcatggtgctcccacagctttcgcgagggcctgtgtcggctcctcgagctgacaagacgaccaatatttatcaccttcgagggccaaagaagggatcccgcacaccccgctctgaggcttctgaggcaacaccggcacctggtgaccctccttctatggcgccccggaagcgtgacaccttcttctgatttctggaaggaggtccagctggccctgccacgcaaagtgcagtacagacctgttgagggagacccacagacgcagttgcaggatgacaaagaccccatgctaatcttaagagggcgcgtgccggaaggtcgggcactggacagcgaggtggaccctgatcctgaaggagacttgggagtgcgagggccagtgtttggcgaacctagcgctcccccccatacaagcggcgtttccttgggtgagtctaggagttccgaggtagatgtttccgaccttggatccaggaattattctgctaggaccgatttttactgtctggtgtccaaggatgacatgtag

SEQ ID NO: 205233 - DNA, 1515 bp, Artificial Sequence
  Description of Artificial Sequence: Synthetic coding sequence
atgcccggcgtgtgcgaccgggcccccgacttcctgagccccagcgaggatcaagtgttgaggcctgcattgggttcatcagtcgctctgaattgcactgcctgggtcgtcagcggaccccattgttccctcccttcagtccagtggctgaaagacggtttaccactgggcataggagggcactactccctgcatgagtatagctgggtgaaggcgaatctgtctgaggtactagtgagctccgtgctgggggtaaacgtcaccagcacggaggtgtacggcgcgttcacttgttccattcagaatatatccttctctagtttcactctccagcgagccgggcctacttcacacgtagccgccgtgctggcaagcctgctggtcctacttgcgttattactcgctgccttgctctacgtaaaatgcagattgaacgtgctgctgtggtaccaagacgcctacggagaagttgagattaatgatggcaaactttatgatgcttatgtctcgtactctgactgtcctgaagaccgaaagtttgtgaatttcattctgaagccccagctggaaagaaggcgcggctacaagttgtttttagacgatagggatctgttgcctagagcagagccatccgcggatctcttggtcaatcttagcagatgcaggagactgattgtggtgttatccgatgcgttcctgtctcgtgcgtggtgctctcacagctttcgggagggcctctgccgattactcgagctgacccggaggcccatctttataacatttgagggtcaaagacgggatccagcacacccggctttgaggctgctccggcagcaccgccacctagtgaccctgctgctgtggcgtcctgggtcggtaacaccttcatccgatttttggaaggaggtgcagctggccttacctcgaaaggtgcaataccgaccagtggagggagaccctcaaacacaactacaagacgacaaagacccaatgctaatactgcggggaagggtgcctgaaggcagagctctggattcagaggtggatcccgatccagaaggtgatttaggcatgccagcccagccccactctcccactggagaagcccaacacagggccgagtggggtcaggctcagggtaccgggcccgggggagccccaggtgttgaagattcatcccgacaccgggaacccctgcacggattatgccctggcggggcccgcccaagcgtttgccttggcacttcctgggccagtcaagcaattaccgccggcggtgaacagggccagcctctcgccgtgggtttaggccagggatgtggctggcccccacaggcaagccggagtcctcaccctcgctgccctggcgcctgtctctggcgcgctattagtagcaccgctcaccagtggggcttagccgggagagagcccgagcagaggagcggcagattaggctctcgcttagcgaagttgcagtgcccccatcggctgcttcttcctggggttcaggggtag

SEQ ID NO: 205234 - DNA, 1107 bp, Artificial Sequence
  Description of Artificial Sequence: Synthetic coding sequence
atgttcgccaagggcaagggcagcgccgtgcccagcgacggccaggcaagggaaaagctggccctgtacgtgtacgagtatcttctgcacgtcggtgctcagaaaagtgctcaaacattcctgtcagagattcgatgggaaaaaaacatcacgctgggcgagccgcccggatttctgcacagctggtggtgcgtcttctgggatctatattgcgccgcgccagagagacgggacacatgcgagcacagctctgaggccaaagcttttcacgattacagcgccgcagcggcgcccagccccgtgttgggcaatattccgccaaatgatggcatgcctgggggcccaatcccacccgggttcttccagggccctcccggctcacaaccgtccccgcacgctcagcctccgccgcataaccccagctcaatgatgggccctcacagccaaccacccggaggagtgccaggcacccaacctctgctgcccaattcgatggaccctaccaggcagcagggacacccaaacatgggggggtctatgcagcgcatgaacccacctaggggaatggggcctatgggacctggcccacagaactacggcagtgggatgagaccccccccgaactcattgggacctgcaatgcctggcattaatatgggcccaggggcagggaggccttggcccaatcctaactctgccaactctatcccatacagttcatcgtcgccaggaacctacgtaggaccaccagggggcggtgggcccccaggaacacctattatgccgagtccagcagacagcaccaactcttctgataatatctacacgatgattaatccggtgccacctgggggtagccggtcaaactttccgatgggtccagggtctgatggccctatgggcggtatggggggcatggagccccaccatatgaatggatctctcggttctggagacatcgacggccttccgaaaaacagtcccaataatatttcaggtattagcaacccccccggtacaccccgagacgatggagaactaggagggaacttcctccattcgttccaaaacgacaactacagtccaagcatgacaatgagtgtgtag

SEQ ID NO: 205235 - DNA, 1086 bp, Artificial Sequence
  Description of Artificial Sequence: Synthetic coding sequence
atgttcgccaagggcaagggcagcgccgtgcccagcgacggccaggcaagagaaaaattggcgctttatgtgtacgaatacctgcttcatgtaggcgcacagaagtctgcccagaccttcctcagcgagatacgatgggagaagaatatcaccctaggagaaccgcctggatttctacacagctggtggtgcgtgttctgggacttatattgcgcagcacctgaacgtagggacacatgtgagcacagcagcgaagccaaagcgttccacgattactcagctgccgcggctccttcgccggtacttggaaacataccacccaatgacgggatgcctggaggtcccatcccccccgggttctttcagccatttatgtcaccacggtatgctggcggtcctaggccaccaatccgtatgggaaatcagccacctggcggcgtcccgggcactcagcccctcttgccgaattctatggaccccactcgacagcaaggccaccccaacatgggggggtcgatgcaaagaatgaatcccccccgcgggatgggcccaatgggcccaggcccgcagaactatggttccggaatgcgccctcccccgaacagcttaggtcctgcaatgccgggcattaacatgggacctggggctggaaggccctggcctaatccaaactctgctaatagcatcccttactcgtccagttcacctggtacttacgtcggcccaccaggtggcggagggccacctgggacccccatcatgccaagccccgctgatagcactaattcgagtgacaacatctataccatgattaatcccgttcctccaggaggatctcggtccaactttcccatgggccctggatccgacggccccatgggcggaatgggcgggatggaaccacaccacatgaatggctccctgggtagtggggatattgatggtctgcccaaaaacagtccaaataatattagtggaattagtaatccacctgggacgccaagagacgacggtgaactgggtggcaattttctgcattcatttcagaatgacaattactcacccagcatgaccatgtccgtttag

SEQ ID NO: 205236 - DNA, 1167 bp, Artificial Sequence
  Description of Artificial Sequence: Synthetic coding sequence
atgttcgccaagggcaagggcagcgccgtgcccagcgacggccaggctcgcgagaagttagccctatacgtatacgagtacttattgcacgtcggtgcacagaagtccgcacaaaccttcttatctgagattagatgggagaagaacattacattgggcgaacctcccgggtttcttcattcgtggtggtgcgtattttgggatttatattgtgccgccccagaacggcgcgacacgtgtgagcactcttctgaggctaaagccttccatgactattccgccgccgccgctccatcccctgtcctaggaaacatacccccaaatgatggaatgcccggaggcccaattccacctgggtttttccagggacctcccgggtcccagccgagtccccacgcacagccaccaccacataatccttcttctatgatgggcccacacagccagccgtttatgtcccctagatatgcaggtgggccccggccccctatcaggatggggaatcaacccccagggggtgttcccgggactcagcctctgcttccaaactccatggaccccactcgtcagcagggtcatcccaacatgggcggatccatgcagaggatgaacccgccccgcggcatgggacccatgggccccggaccccaaaactacggcagtggaatgcgcccaccgccgaactctcttggaccggctatgccggggatcaatatgggacctggagcagggaggccatggcctaaccccaatagtgcgaactctatcccatattcaagttcctcaccagggacctacgttggcccacccggcggaggcggcccaccgggaacccctattatgccttcaccagcagactctaccaatagctccgataacatctacacgatgatcaaccccgtacctcctggcgggtccagatcaaatttccccatgggccccgggagcgacgggcccatgggcggtatgggcggcatggagcctcaccacatgaatggcagtctcggatcaggagatatcgatggccttccaaagaactcccccaataatatctccggcatttcaaaccctccgggcacccctcgggatgacggagagctcgggggaaattttcttcacagtttccagaacgataattattcgccctctatgacaatgagtgtatag

SEQ ID NO: 205237 - DNA, 837 bp, Artificial Sequence
  Description of Artificial Sequence: Synthetic coding sequence
atgcccggcggccccatcccccccggcttcttccagggcccccccggatctcaacccagtcctcacgcccaacctcccccacacaatcctagcagcatgatgggcccacacagtcagccatttatgtcacctaggtatgccggaggccccagacccccaattaggatgggcaatcaacctccagggggagtgccgggaacccagcctttgctacctaattccatggaccctacccgtcagcagggccatcccaacatgggcggcagtatgcaacgcatgaacccgcccaggggcatggggccgatgggcccgggaccgcagaactacgggtctggcatgcgcccaccccccaattcacttggacctgccatgccagggattaatatgggcccgggcgccggtaggccctggccaaatcccaacagcgctaacagtattccctacagcagcagttcgccagggacctatgtggggcctcctggagggggcgggccgcctggcactccaatcatgccttctccagcggacagcacaaattccagtgataatatttatacaatgatcaatcccgttccccccggcggttctagatcaaatttccccatgggtcctggtagtgatgggcctatgggcggtatgggcggtatggaaccccaccatatgaacggcagcctcgggtccggtgatatagacgggttgccaaagaatagccccaacaacatcagcggcatttccaatcccccagggacgccaagagatgatggggaacttggcgggaatttcctccatagcttccagaatgataactacagtccctcgatgaccatgtctgtgtag

SEQ ID NO: 205238 - DNA, 471 bp, Artificial Sequence
  Description of Artificial Sequence: Synthetic coding sequence
ccccccggcggcgtgcccggcacccagcccctgctgcccaacagcatggacccaacccgacagcagggacacccaaacatgggcggaagtatgcagagaatgaatccaccgcgtgggatgggacccatgggacctgggccacaaaattacgggtcagggatgaggccaccacccaacagccttggtcccgctatgcccggaattaatatgggacctggcgctggtaggccatggcctaaccctaattccgctaattctattccttattccagctcctcacctggcacttacgtcggtcctccaggcgggggcggaccacctgggactcctatcatgccaagtccggcggactctactaattctagcgacaacatctacactatgatcaatccggtgccccctgggggtagcaggagcaatgtttccctgctaagcaataacctccacattcggcaccacaacaagtcatag

SEQ ID NO: 205239 - DNA, 1158 bp, Artificial Sequence
  Description of Artificial Sequence: Synthetic coding sequence
atgtacgccaagggcggcaagggcagcgccgtgcccagcgacagccaggctcgggagaaactggccctgtacgtgtacgaatatctgctgcacatcggagctcaaaaaagtgcccaaactttcctgtccgagattcgttgggaaaaaaacatcacgctgggagagccccctggcttcttgcacagctggtggtgcgtgttctgggatctttactgcgccgcgcccgaccgcagagaagcatgtgagcacagcggggaggcaaaggcctttcaggactattccgcggctgccgccccaagcccagtgatgggctctatggctcctggtgacacaatggccgctggatctatggccgcaggtttcttccagggtcctcctgggtctcagccttcacctcataaccctaacgcgcccatgatgggtccgcatggtcagcctttcatgtctccaagattccccggcggacccagacccacccttcgcatgcccagccagcctccggctggactccctggctcccagccacttctgccaggcgccatggaaccaagcccgcgggcgcaagggcaccccagtatggggggccccatgcagcgtgtgactccgcctcggggcatggcgtccgtgggcccccagtcctacgggggcgggatgcgcccccctccaaactccttggccggacccggactgccggccatgaatatggggccaggggtacgggggccctgggcgagcccctccggtaatagtattccctactcttcatcatctcctggcagctacactggaccgccggggggcggggggccccctggcaccccaattatgccctcaccaggggacagtactaactcctctgagaatatgtacacgatcatgaacccgatcggtcaaggcgccggacgtgccaactttcctctggggcctggccctgaagggcctatggcagccatgagtgccatggagcctcaccacgttaacggctcattgggaagcggcgacatggacggccttcctaagtcgagtccaggagccgtcgctggactgtcaaacgcacctggcacacctagggatgacggagagatggccgcggctggaacattcctccatcctttcccaagtgaatcttattctcccggcatgaccatgagtgtttag

SEQ ID NO: 205240 - DNA, 1092 bp, Artificial Sequence
  Description of Artificial Sequence: Synthetic coding sequence
atgtacgccaagggcggcaagggcagcgccgtgcccagcgacagccaggctagggaaaaactggcactgtacgtctacgaatacctgctgcacatcggggcccagaagtccgctcagacattcttatcagagatcaggtgggaaaagaacattactcttggagaaccccctgggttcctacacagttggtggtgcgtgttttgggatctgtactgcgctgctcccgatcgtagagaagcctgtgagcattccggtgaagccaaggcatttcaagattacagcgccgctgcagccccctcgccagtgatgggcagcatggccccaggagacaccatggctgcgggtagcatggctgccgggtttttccagcccttcatgagcccccggttcccaggcggtccgagaccaacactgagaatgccctcccagcctcctgccggacttccaggctctcagccactgcttccaggagcgatggaaccatcccccagagcacagggacatccgtctatgggaggacccatgcagagggttaccccgccacggggcatggcctccgtgggcccccagtcgtatggaggaggcatgaggccaccgcctaactcactagctgggcctgggctgcctgctatgaacatgggtccaggtgtacggggtccctgggcgtctccatcaggtaactctataccctattcttctagctcacccggatcttataccggaccaccagggggtggcgggcctcccggaacaccgattatgccgtcacctggggacagcacaaatagctccgaaaacatgtacaccattatgaaccccattggtcagggagcggggcgtgctaatttccctttgggccctgggcccgagggccctatggctgctatgtcggctatggagcctcaccatgtcaatgggagccttgggtcaggcgacatggacggcctgcccaaatcatctcccggcgcagtggctggactgagtaacgcacctggaacacctagggatgacggtgaaatggccgcggctggaacatttctgcatccatttccaagtgagtcttactctcctggcatgactatgagtgtttag

SEQ ID NO: 205241 - DNA, 2301 bp, Artificial Sequence
  Description of Artificial Sequence: Synthetic coding sequence
atgaaggagaagagcaagaacgccgcccggacccggcgggagaaggaaaatagcgagttctacgaactggctaaactgttaccattgcccagcgcaattaccagtcaactggataaggccagcatcatacggctgacaacgagttacctgaagatgcgggtcgtatttcccgaggggctgggagaggcttggggccatagctcaagaacctcgcccctcgacaatgttggccgtgaactgggaagccacttactgcagacattggacggctttatttttgtcgtggcaccagacggcaaaatcatgtacattagcgagacagcctcagttcaccttggtctgtcccaggtagagctgaccggcaactctatttatgagtatattcatcctgctgatcatgacgagatgactgcggtgcttactgcccaccagccgtatcattctcacttcgtacaagagtacgagatagagaggagtttcttcctacgaatgaagtgcgtgctggctaagaggaacgcgggcctcacatgtggcggatacaaggtgattcactgctccggttatctcaaaatcagacagtattcgttggatatgtcgcccttcgacggttgttaccaaaacgtgggcctggtggcagtcggccacagtctgcctccttctgcagtcaccgaaatcaagctacattctaacatgttcatgttcagggccagcctggacatgaaactgatttttctggacagtagagttgcagaactgacggggtatgaaccccaggatctgatcgagaaaaccctgtatcaccacgtgcatggctgtgatacctttcatttacgctgcgctcatcatctcttgctcgtgaaaggtcaagtgacaaccaagtactaccggttcttggccaagcacgggggctgggtttgggttcagtcctatgcaacaattgtgcataactcacggtcctctcgtcctcattgcattgtgtcagtgaactatgtactgacagacactgaatataagggccttcaattgtccctggatcaaataagtgctagcaagcctgctttctcgtatacctctagttcgaccccaactatgacagacaaccgcaaaggagcaaagagtaggttgtcaagcagcaaatcaaagtccagaacctccccctatccacagtactcaggctttcataccgagcgctcagaaagcgaccacgacagtcagtggggtggttccccactgacggacaccgcatcacctcagctcctcgatcccgccgacagacccggaagtcagcacgacgcatcatgtgcctatcggcagttcagcgatcgatcctcactgtgctatgggttcgctctggaccactcccggctcgtagaggagcgtcacttccatacccaagcatgtgaaggtgggcggtgcgaagccggtcggtactttttaggtacaccccaagccggccgggagccatggtgggggtctagagcagcgctcccacttacaaaagctagcccagagtcaagggaggcgtacgagaacagcatgcctcatatagctagcgtccaccgcatccatggtagaggtcactgggatgaggattcagtggtcagttctcccgatcctggctccgcgagtgagagtggagaccggtatagaaccgaacagtaccagtcctctccccatgagcccagtaaaatcgagacgctcataagagcgacacagcaaatgatcaaggaggaggaaaataggctgcagcttcgcaaggctcccagtgatcagctcgcgtccattaacggagcaggtaagaaacactcgctgtgctttgccaactatcagcaaccaccaccaaccggagaagtctgccacggtagtgctcttgctaacacatctccatgtgatcacattcagcagcgcgagggtaaaatgctttcgcctcacgagaatgactacgataattcaccgacagccctgagcaggatatcatcccccaactcagaccggatcagcaagtcaagtttaatacttgccaaagactacctgcacagcgacattagcccgcatcagacggccggcgaccaccccactgtgagccctaattgttttggttcccatcgccagtatttcgataagcatgcgtacacactgaccgggtatgcccttgaacacctctatgacagcgaaaccattagaaattattctcttggttgcaacggatctcacttcgacgttacgagtcacctgcggatgcagccagatccggctcaggggcataagggaacctccgtcatcattacaaatggctcctag

SEQ ID NO: 205242 - DNA, 2301 bp, Artificial Sequence
  Description of Artificial Sequence: Synthetic coding sequence
atgaaggagaagagcaagaacgccgcccggacccggcgggagaaggaaaactctgaattctatgaactcgccaaattgctgcccctgcctagcgctatcacctctcagcttgataaagcaagtattattaggctgactacttcatacctgaagatgcgggttgtgtttcctgagggcctcggtgaggcctggggccactcctccaggacatccccactagataacgtgggaagggaactagggagtcacctgcttcaaaccctggacgggttcatattcgtggtggcaccagatggcaaaatcatgtatatctcagagaccgcctcagtgcacctggggctctctcaggtggaacttacgggtaactccatttacgagtacatccacccggctgaccatgatgagatgactgctgtcctgacggcccatcagccatatcactcccattttgtccaagagtacgagatcgaaagatctttttttctccgaatgaaatgcgtgctagccaaaaggaacgctggactgacctgcggaggttataaagttatccattgttccggctatctaaagatacgccagtactcactggatatgtccccgtttgacggttgctaccagaacgtcggtctcgttgccgtgggccactccctcccgccttcagccgtgacagagataaagttgcactccaacatgttcatgttccgcgcaagtcttgatatgaagctgattttccttgactctcgggtcgcagagctgaccggttatgaaccacaagacctgatcgaaaaaaccctgtatcaccacgtgcacgggtgtgacaccttccatttacgctgcgcccatcacctgttgctggttaaaggacaggtcacaacaaagtactatcgatttctggccaagcatggaggatgggtctgggtacagagctacgcaactatcgtacataattcccggtccagtcgcccccactgcatcgtcagcgtgaactatgttctgacagatactgaatacaaggggctccaacttagcctcgaccagatatctgcatcaaagccagcattcagttatacttcctcttctacaccaacgatgacagataataggaagggggccaaatccagactttcaagctcaaaatccaagtcaaggaccagtccttacccgcaatatagtggttttcacaccgaaagatcagagtctgatcatgattcacagtgggggggaagtccactgacggatacagcatcaccccagcttctggaccccgctgatcgccccgggtcccagcatgatgcatcgtgcgcctaccgccagttcagcgacagaagctcattatgttacggatttgctctggaccactcgcgcctagttgaagagcggcactttcacacgcaggcatgcgaagggggacggtgcgaagccggacggtattttctgggtacgccacaggccgggcgggagccatggtggggatcaagagccgcactccccctgacaaaagcctccccggagtcccgcgaagcctatgagaactctatgccccacatcgccagcgttcataggatccatggccgaggacactgggatgaagattccgtggtgtcgtctccagatcctggaagcgcttcagaaagtggcgaccgttaccgcacagagcagtaccaatcctccccccacgagcccagcaaaatcgagaccctaatcagagctacgcagcagatgataaaggaggaggaaaaccggttgcagctgcggaaggccccctccgatcagctggcatccattaatggcgccggaaagaaacattccctgtgcttcgctaactaccagcagccccctcctacaggcgaagtgtgtcacggctccgcccttgcaaatacctccccttgtgaccatatccagcagcgcgaaggcaagatgctgtccccccacgaaaatgactacgataactctcccactgctctgagccggatttcctcaccaaattcagataggattagtaagtcatcactgatcctcgccaaggattacctacattccgatatttccccgcatcagactgcaggtgaccacccgaccgtgagtccaaattgtttcggaagccaccgacagtacttcgataagcatgcttacacgctaactggctatgcacttgagcacctctacgacagcgaaaccatacggaactacagcctgggatgcaatggctcccacttcgatgtgacttcacacctgcgcatgcagcccgatccagcccaggggcacaagggaacaagcgtcattatcaccaacggcagctag

SEQ ID NO: 205243 - DNA, 2004 bp, Artificial Sequence
  Description of Artificial Sequence: Synthetic coding sequence
atgaaggagaagagcaagaacgccgccaagacccggcgggagaaggagaatggggagttctacgaattagctaagctgttgccactgccaagcgctatcacctcccagttagacaaggcatctattataaggttgacaacttcctacctgaagatgcgtgccgtgttccccgagggcctgggggacgcctggggacagcccagcagggccgggccactggacggggtggccaaggaacttgggtcccacttactgcagacactggatggttttgtgtttgtcgtggccagcgatggcaagatcatgtacatatccgaaacagcctcagtgcacttagggttgtcacaggtagagctgactggcaactctatctatgagtatattcacccaagcgatcatgacgaaatgaccgccgtgctgaccgcccatcagcctctacatcaccatctcttacaggagtatgagattgagaggagtttttttctccgaatgaagtgcgtgctggcaaagaggaatgcgggccttacttgttcaggttataaagttatccattgttcaggctatttaaagatccgccagtatatgctggacatgtcactgtatgacagctgttaccagatcgtggggctggtggccgtgggccaatcgctcccccccagtgcaatcacagagatcaaactatacagtaatatgtttatgtttagagctagtctggacttgaaactgatctttttggactcccgggtcaccgaagtgacaggctacgagccccaggatcttatagaaaagaccctgtaccaccacgttcacggatgtgacgttttccacctgagatacgcacaccatctcctactcgtgaaaggccaagtgaccactaagtattaccgattgttaagtaagagggggggttgggtgtgggtgcaatcgtatgccacagtcgtgcataactctagaagctcccgacctcattgcatcgtgagtgtgaactacgtattgacagaaatcgaatacaaagagcttcagctctctctggagcaagtgagtacagctaagtcccaggacagttggcggacagccctgtccacatcacaagaaacaaggaagctcgtcaagccaaagaatacgaaaatgaaaaccaagctgcgcacaaacccgtatcccccccagcagtactcttccttccagatggacaaattagaatgtggtcagctcggcaactggcgcgcctctccgcccgcatctgcagccgcccctccagagctgcagccccacagtgagtcttccgacctgctgtacaccccaagctattcacttccattctcatatcactatggccatttccccctggacagccacgtcttctcaagtaagaaaccaatgctccccgctaaatttgggcaacctcaagggtctccttgtgaagtagctaggtttttcctgagcacccttcccgcaagcggagagtgccagtggcactatgcgaacccgttggtgccttcctcaagcagcccggccaaaaaccctccagaaccgcctgcgaacacagcaagacacagcctcgtaccatcctacgaggcaccggccgcggccgtccgcagattcggagaggatacagcccctccatcttttccgtcctgtggtcactatagggaggagccggcgctcggccctgccaaggcagctagacaggccgcgagagacggagctcgcctcgctctcgccagggcggcccccgaatgctgcgctccccccacacctgaagcgcctggcgcaccagcccagctaccctttgtcctgctgaattaccatagagtattagcacgacgtggaccactggggggggcagctccagcagcatctggcctggcatgtgcccccggtgggcccgaggccgctacaggtgccttaagactgagacacccatccccagcagccactagcccacccggtgctcctttgccacattacctgggagcctccgtaatcatcacaaatggacgctag

SEQ ID NO: 205244 - DNA, 1713 bp, Artificial Sequence
  Description of Artificial Sequence: Synthetic coding sequence
atgaaggagaagagcaagaacgccgccaagacccggcgggagaaggagaacggggagttttacgagttggctaaactgctccccctcccatctgctatcaccagccaactcgacaaggcttccattattcggctcaccacaagctaccttaagatgagagcagtctttccagagggcttaggtgatgcttggggacagccgagccgggccgggccactggatggtgtggcgaaggaactgggaagccaccttttacagacccttgatgggttcgtctttgtggttgcgagtgacggtaaaattatgtacatcagtgagacggcgtccgtgcacttaggcctgtctcaggtggagctgaccggaaacagcatctacgaatacattcacccaagcgatcatgatgagatgacagcggtcctcaccgcgcatcagcctcttcatcaccatctgctccaggaatacgagatagaacgaagcttctttctgaggatgaaatgtgtgttggccaagagaaacgcaggtctgacatgttctgggtacaaggtgattcactgttccgggtacttgaaaatccgacagtacatgctggatatgtccctttacgatagctgttatcagatcgttggcctcgtggcagtgggccagtctctgccaccaagcgccattaccgaaattaagctctactccaacatgttcatgttccgggcatctctggatctcaagttgatctttctagattctcgggtgaccgaggtgactggatacgagccacaagatttaatcgaaaaaactttataccaccatgtgcatggctgcgatgtgttccatctgcggtacgcccaccaccttctccttgtgaaaggacaggtaacaaccaaatactataggctcctctcaaagcgtggtggatgggtctgggtgcagtcttacgccacggtcgtgcataatagtcgctcttccaggccccactgtatcgtgtcagttaactatgtgttgaccgaaattgagtataaagagctacagcttagcctcgagcaggtgagtaccgctaaatcccaggattcttggagaacagcactctctacatcccaggaaactcggaagctggtgaagccgaagaacacaaagatgaagacaaagttgcggacaaacccttatcctccccaacaatactcaagttttcagatggataaactcgaatgcggccagctcggcaattggcgtgccagccccccagcctccgcagccgcacccccagagttgcaacctcacagcgaaagttccgacctgctctatactcccagctattcactcccattctcttaccattacggccacttccctctggactcccacgtatttagttctaaaaaacctatgctgcctgctaagttcgggcagccccagggttccccttgcgaagtagctaggttcttcctgtcgaccctgccagcctcaggggaatgtcagtggcactatgctaatccacttgtcccctctagcagtagccctgcaaagaaccccccggagcccccagccaacaccgcacgacactcactggtccctagttatgagggaggcagtggcctcctggtgggaaaagtagggggtctgaggaccgctggctcgcggagttcacatgggggaggatggcagatggagactgaaccaagtaggtttgggcagacctgtcccttgtcggccagcaagtag

SEQ ID NO: 205245 - DNA, 447 bp, Artificial Sequence
  Description of Artificial Sequence: Synthetic coding sequence
atgttccggcggcccgtgctgcaggtgctgcggcagttcgtgcggcacgaatccgaaaccacaacctcattagtcctggaacgcagtctcaacagggtgcacttactggggcgggtcggccaggaccccgtgctccgccaagttgagggcaaaaatcccgtgacgatattctccttagccaccaacgagatgtggcgcagcggcgatagtgaagtttatcaactcggcgatgttagccagaagacgacttggcacagaatctccgtgtttagaccaggcctacgggacgtcgcgtatcagtacgtgaagaaagggagccggatctacttagagggcaaaatcgactacggagaatatatggataagaacaatgtgcgcaggcaagctaccacaataattgcagataacataattttcctgtcagaccagactaaggaaaaggaatag

SEQ ID NO: 205246 - DNA, 366 bp, Artificial Sequence
  Description of Artificial Sequence: Synthetic coding sequence
atgttccggcggcccgtgctgcaggtgctgcggcagttcgtgcggcacgagtcagagaccacaacatccttggttctggagcgttctctcaatcgcgtgcacctgctagggagggtaggccaggaccccgtgctgcgtcaagtggagggcaagaatccggtgaccattttctccctggcaactaatgagatgtggcggagtggagatagcgaagtttaccagctgggagacgtgagtcaaaagacgacctggcaccgaataagtgtgttccgccccgggctgcgtgatgtggcatatcagtatgtcaaaaaaggctcccgcatttatctggaggggaaaatcgattacggagagtacatggattag

SEQ ID NO: 205247 - DNA, 447 bp, Artificial Sequence
  Description of Artificial Sequence: Synthetic coding sequence
atgttccggcggcccgtgctgcaggtgctgcggcagttcgtgcggcatgaatcggaaacaaccacaagcctcgtgctagagaggagcctgaatcgcgtgcacctgctcgggagagtgggccaggatcccgtgctccgtcaggtggagggcaaaaatcccgtcactattttctccctcgccaccaacgaaatgtggcggtcaggcgattcagaagtttatcagctgggagatgtgtcccagaagacaacgtggcatcgaatttctgttttccgccctgggttgagggatgtcgcttatcagtacgtgaaaaaaggatccaggatttatctggagggaaaaatagattatggagagtatatggataagaacaacgttcggaggcaagcaacgaccatcatcgccgataatattatatttctgtcagaccaaactaaggagaaggaatag

SEQ ID NO: 205248 - DNA, 408 bp, Artificial Sequence
  Description of Artificial Sequence: Synthetic coding sequence
atgttccggcggcccgtgctgcaggtgctgcggcagttcgtgcggcatgagtctgagactacgacttctctggtcctggagaggagtctgaatagggtgcatctgctgggccgtgtagggcaggaccccgttttacgacaggttgagggcaagaatcccgttaccatcttcagcctggccaccaacgaaatgtggcggagtggagattcagaggtgtatcagcttggcgatgttagtcagaaaaccacatggcatagaatctctgtgtttcgccccgggctgcgggatgttgcctaccaatatgtgaaaaaaggatccagaatttacttggaggggaagatcgattatggagagtacatggacaagaataacgtgcgtagacaagctaccacgatcatcgccgattag

SEQ ID NO: 205249 - DNA, 87 bp, Artificial Sequence
  Description of Artificial Sequence: Synthetic coding sequence
atgttccggcggcccgtgctgcaggtgctgcggcagttcgtgcggcacgagagcgaaacgaccacatccctggttttggagagatag

SEQ ID NO: 205250 - DNA, 447 bp, Artificial Sequence
  Description of Artificial Sequence: Synthetic coding sequence
atgttccggcggcccgtgctgcaggtgctgcggcagttcgtgcggcacgagtcggaaacaacaacgagtcttgtgctggagagatcccttaatcgggttcaccttctgggccgcgttggccaggaccccgtcctgcgccaggttgaggggaaaaatcctgtcaccatcttctcactagccaccaatgagatgtggcgatctggagattccgaggtttaccaattaggagacgtgtctcagaagaccacctggcacaggattagcgtgttccgccccggactaagggacgtggcgtatcagtatgtgaagaaagggtctaggatatacctggagggcaagatcgattatggtgaatatatggacaagaataacgtaagacgtcaagccaccactataatagctgacaacatcattttcctgtcagaccagacaaaggaaaaagaatag

SEQ ID NO: 205251 - DNA, 447 bp, Artificial Sequence
  Description of Artificial Sequence: Synthetic coding sequence
atgttccggcggcccgtgctgcaggtgctgcggcagttcgtgcggcacgaaagcgagactacaaccagcctcgtgctggagcgatccctgaacagagtgcacttgctcggaagggttggccaggaccctgtgctcagacaagtcgagggtaaaaaccccgtcaccatcttttctctggctaccaacgaaatgtggcgaagcggagacagtgaggtgtaccagctaggagacgtgtcacagaagaccacatggcacagaataagtgtattccgccccgggttacgggatgtggcctatcaatacgtcaaaaagggctctcgcatctatctggaggggaaaattgattatggagaatatatggataagaacaatgtacggcgccaggccaccacaataatagcggataacattatctttctgagcgaccagactaaagaaaaggagtag

SEQ ID NO: 205252 - DNA, 447 bp, Artificial Sequence
  Description of Artificial Sequence: Synthetic coding sequence
atgttccggcggcccgtgctgcaggtgctgcggcagttcgtgcggcacgaatccgaaacaactacttccctcgtcttagaaaggagtctgaaccgtgtccatctgctgggtagagtcgggcaagatccagtgttgagacaggtcgaagggaagaatccagtgaccattttctccctagctacaaacgagatgtggcggagcggcgactccgaggtttaccaactcggcgatgtgtcccagaagactacctggcaccgcatatctgtgtttcgaccaggcctgcgggacgttgcctatcaatacgtgaaaaaggggtcgcgcatctacctcgaggggaagatcgattatggagagtatatggacaaaaataacgtgcgcaggcaagctactactataatcgcggacaatatcattttcctgagcgatcaaactaaggaaaaggaatag

SEQ ID NO: 205253 - DNA, 1086 bp, Artificial Sequence
  Description of Artificial Sequence: Synthetic coding sequence
atgtacggcaagggcaagagcaacagcagcgccgtgcccagcgactctcaggcacgcgaaaagctggcactgtacgtgtatgagtatttgttgcacgtgggtgcacagaagtcagcccagacctttctttcagagatccggtgggaaaaaaatattacgctgggcgaacctcctggattcctgcattcctggtggtgtgtgttctgggacctttactgcgccgctccagagaggcgcgaaacttgcgagcatagttctgaggcgaaagcatttcatgactactctgccgctgccgctcctagcccagttctaggcaacatcccacccggcgatggcatgcccgttggacccgtgccaccaggctttttccagccattcatgagcccccggtacccaggtggtccaagacccccactgagaatcccgaatcaggcactgggaggtgttccaggaagccagccactgctgccatccggcatggaccccactaggcagcaggggcatcctaacatgggcggaccgatgcagcggatgactccccccagaggtatggttccactgggcccccagaattatgggggagctatgcgtccgccactgaatgctctggggggcccagggatgcctggtatgaacatgggcccgggaggtggccgtccctggccgaatccgaccaacgccaattctatcccatacagttcagcgtctcccggtaattacgttggtccccccgggggaggggggccgccaggcacacccattatgccctccccagccgactcaacgaactcaggcgataatatgtacactctcatgaatgccgttcccccaggccccaaccgacccaactttccgatgggacctggcagtgatggtcccatgggcggactcgggggcatggagtcacaccatatgaatggcagtctcggaagcggagatatggatagcattagtaaaaactctccaaacaacatgagtctgagcaatcaaccaggcacccctcgagatgatggtgagatgggggggaattttttaaacccctttcagtccgagtcctactcacccagtatgactatgtctgtgtag

SEQ ID NO: 205254 - DNA, 945 bp, Artificial Sequence
  Description of Artificial Sequence: Synthetic coding sequence
atgggcaagaacatcaccctgggcgagccccccggcttcctgcactcctggtggtgtgtgttttgggacctctactgcgctgcacctgaacgccgggagacatgcgaacatagttctgaagcgaaggcatttcacgattactccgcagctgccgcaccatcccctgtgctgggcaacattcctcctggagatggcatgcctgtaggacccgttcctcccggattttttcagcctttcatgtcccctcgttatcccggcggtccgcgcccacctcttcgcatccccaaccaggccctcgggggtgttccaggcagtcaaccactcctgccttccggaatggacccaacgcgccaacaggggcatcctaatatgggcggacctatgcagagaatgaccccaccccgagggatggttcctctggggccacagaattacggaggagctatgcggcctccattgaatgcacttggcggtcctggcatgccaggcatgaatatgggtccagggggaggtaggccatggccaaaccctacaaacgctaacagcataccttattcaagtgcctcccccggaaactacgtgggaccccccggcggcggcggacccccgggaacacccattatgcccagtcctgctgacagcactaatagcggcgataacatgtacactctaatgaatgccgtgccccccggaccaaataggccaaactttccgatgggccccgggtctgacggcccgatgggtgggttgggggggatggagagccaccacatgaacggctcactaggcagcggggacatggattctattagcaagaatagccccaataatatgagcctgtctaatcaaccaggcacaccccgggacgatggggaaatgggcgggaatttcctgaacccttttcagtctgaatcttattcaccttctatgacgatgtctgtttag

SEQ ID NO: 205255 - DNA, 1026 bp, Artificial Sequence
  Description of Artificial Sequence: Synthetic coding sequence
atgtacggcaagggcaagagcaacagcagcgccgtgcccagcgactcccaggctagagagaagctggccctgtacgtgtacgaatatctgctacatgttggtgctcagaaatccgctcagacattccttagcgaaattagatgggagaagaatataaccttaggcgagccacctgggtttctccattcttggtggtgcgtgttctgggacctttattgcgccgcccccgaacggagggagacttgtgaacactcctccgaggctaaggcgtttcacgactactctgcagccgccgctccatctcccgtgctgggtaacatccctcctggcgacgggatgccagtgggccccgtgcccccaggcttttttcaggcccttggaggcgtgcctgggagtcagcccctgctccccagcggaatggaccccacacgacagcaggggcaccctaatatggggggacccatgcagagaatgacaccaccccgcggaatggttccactcggccctcagaactatgggggtgcgatgaggcctcctctgaacgccctgggcggtcccggtatgccaggcatgaacatgggcccaggcggcggacggccttggccaaatcccacgaatgctaatagtatcccttacagctctgcttctcctgggaattatgttggacccccaggggggggcggaccccctggcacgccaattatgccttcacccgccgattccactaacagcggagacaatatgtataccctaatgaacgccgtgccgccgggacctaatagacccaattttcctatggggcctggaagtgatggccctatgggcggtctcggcgggatggaaagccatcatatgaatggatctctgggctccggagatatggattcaatctctaaaaacagtccaaataacatgtctctttccaaccagcccgggactccccgtgacgatggggagatgggaggcaacttcctcaatccatttcagagcgaatcttattctccaagtatgaccatgtcagtttag

SEQ ID NO: 205256 - DNA, 1200 bp, Artificial Sequence
  Description of Artificial Sequence: Synthetic coding sequence
atggccttctggggctggcgggccgccgccgccctgcggctgtggggtcgggtagtggagcgcgttgaggccggaggcggtgtggggccctttcaagcgtgcggatgtaggctcgtgcttggggggcgggacgacgtgtcagcaggactgaggggaagccacggggctcgcggcgagcctttggatccggcgagacccctgcaaagacctccccgcccggaagtaccacgcgcatttcgacgtcagccaagagccgctgccccttcattcttcttttctagcattaaggggggtcgccggtccattagttttagcgttggggcatcatcagtagtcggttctgggggatcctccgataaaggtaaattatccctccaggacgtggcagaactgatacgggccagggcctgtcagcgcgttgtggttatggtgggcgctggaatcagcacgccgtctgggatccctgattttcggagccccgggagtggcctgtatagtaacctgcagcaatacgatttgccctaccccgaggctatcttcgaactgccattcttttttcataacccaaagccctttttcaccctcgctaaagagttatacccagggaattataaacctaacgtgacacactacttcttgcggttgctacatgacaagggcctcctcctaaggttgtacacccaaaacatcgatggcctggagcgcgtgtctggaatccctgcatcaaagctggtagaagcccatggcacatttgccagcgctacatgcacggtttgtcaacgccccttccccggagaagatatccgcgccgacgtaatggccgaccgtgtaccaaggtgccccgtatgtacgggcgtcgttaaacctgatattgtgttctttggtgagcccctgccacagcgatttttgttacacgtagtagatttcccaatggcagacctactgctgatcctcgggaccagcctggaggtagagccgttcgccagtcttaccgaagccgtgagatcctcagtgcccagattgctcatcaaccgagatctcgttggtccactcgcctggcaccccagatcacgagacgtggcgcagctcggcgatgtggtccatggcgtagagagtctggtggagctgctcggttggaccgaggaaatgcgggacctggtccagcgggaaacgggaaagttggatgggcccgacaaatag

SEQ ID NO: 205257 - DNA, 957 bp, Artificial Sequence
  Description of Artificial Sequence: Synthetic coding sequence
atggccttctggggctggcgggccgccgccgccctgcggctgtggggtagagttgtcgagagagtggaggctggtggtggggtcggccccttccaggcctgcgggtgtagacttgtgttgggcggccgtgatgatgacgtggccgaactgatccgagcacgagcttgccagcgcgtagtggtgatggtgggagccggtatttctactccatctggcatccctgatttcaggtcgcctggaagcgggttatacagcaacctgcagcagtacgatctaccctatcctgaagctattttcgagctgccattctttttccacaatcccaaacctttttttacccttgcaaaggagctgtatcctgggaactacaaacctaatgtgactcactattttctgcgtctcctgcatgataaggggttgctgctgcgcctttatacccagaatattgatggtcttgagcgggtgtcggggattcccgccagcaagttggtagaggcccacggaacattcgcgtccgccacttgcacagtctgtcaacggcctttccccggcgaggatataagagcagatgttatggcagatcgcgtcccacggtgccccgtgtgcactggcgtggtcaaacctgacatcgtgttttttggcgagccccttcctcagcggtttctcctacacgttgtggatttcccaatggccgacttgctgctcatacttgggacttctctagaagtggagccttttgcatctctcaccgaagcagtcagatcaagcgtgccccgactgcttattaatagagacctggtgggcccactggcatggcacccacggtctcgggacgtggcccagttaggcgatgtggtccacggggttgagtccctggtcgagctgctggggtggacggaggaaatgcgagacttggtgcagcgcgagaccggtaagttagacggcccagataagtag

SEQ ID NO: 205258 - DNA, 774 bp, Artificial Sequence
  Description of Artificial Sequence: Synthetic coding sequence
atggtgggcgccggcatcagcacccccagcggcatccccgacttccggagcccaggctccggactctacagtaacttacagcagtacgatttgccctaccccgaggccatctttgaactcccattcttttttcataaccccaaaccattcttcacacttgctaaagagctataccctggcaactataagccaaacgttacacactactttcttaggctcctgcatgacaagggcctccttctgcgtctgtatacccagaacattgacggcctggaaagggtatcgggcattccagcctcaaaactagtggaggcacatggcacatttgcaagcgccacatgcacagtgtgtcagagacccttccccggagaggatatcagggcagatgtcatggccgatagagtgccacggtgtcctgtatgtaccggagtcgttaaacctgacatcgtcttttttggggagcccctgccacagagattccttctgcatgtagtggactttcctatggctgacctgctgctgatcctaggtaccagcctagaagtggaaccattcgcctctctgactgaggctgttaggagcagcgtgccccggctgttgatcaacagagacctcgtggggcccctggcttggcatcctcgcagcagggacgtagcacagctcggtgatgtagtgcatggagtggaaagcctggtcgaactgctgggatggactgaagaaatgagagacctcgtccagagggagacaggtaaactcgatggccctgataagtag

SEQ ID NO: 205259 - DNA, 945 bp, Artificial Sequence
  Description of Artificial Sequence: Synthetic coding sequence
atgaagatgagcttcgccctgaccttccggagcgccaagggccggtggattgcaaacccttcacagccctgtagtaaagcaagcatcgggctctttgtacctgcgtccccgcccctcgacccagagaaagtgaaggaactgcagcggttcatcacactgtccaaacgcctcttggttatgacaggagccgggatatctaccgaatcaggcataccagattatcgcagcgaaaaagtgggcctatatgcgcgcaccgatcggagaccaattcaacatggcgattttgttcgaagcgctcccatcaggcagagatactgggccaggaacttcgtggggtggccccagttctcctctcatcagccaaatcctgcgcactgggcactcagtacatgggagaaactgggcaagctgtactggttggtcacacagaacgtcgacgccctgcacaccaaggccggctcgagacgattgactgagttacacggttgtatggacagagtcttgtgcttggattgcggcgaacagactccaaggggagttcttcaggagagatttcaggtgttgaatccgacgtggtcagcagaagcgcacgggctggcccctgacggtgacgtcttcctgtcagaagagcaggttcgttcctttcaggtgcccacttgtgtgcagtgtggcggccatcttaagcccgacgtggtgttcttcggggacaccgtaaaccctgataaagtcgacttcgtgcacaagagggtgaaggaagccgacagcttactcgtcgtgggctcgagtctccaggtatattcaggataccggttcatactcaccgcttgggagaaaaagctgcccatagctattctgaacatcggacctacacgatcggatgacctggcctgtctgaaactgaattcccgatgtggcgagctgctccctctcatcgacccttgctag

SEQ ID NO: 205260 - DNA, 879 bp, Artificial Sequence
  Description of Artificial Sequence: Synthetic coding sequence
atgcggcccctgcagatcgtgcccagccggctgatcagccagctgtactgcggcctaaagccacccgccagtactcgcaatcaaatttgcctgaaaatggcgcgcccctcctcctccatggctgatttcaggaaatttttcgctaaggccaagcacatagtcatcatatccggagccggcgtgtccgctgaatccggagtccccacatttcgcggagccggtggctactggcggaaatggcaggctcaggaccttgctacacccctggctttcgctcacaacccatcacgtgtgtgggagttttaccattaccggagagaagtgatggggtcaaaggaacctaacgctggccaccgcgcaattgccgagtgtgaaaccaggttgggcaagcagggcaggcgggtggtcgtgatcacccagaacatcgatgagttgcatcggaaggctggaacaaaaaacttactggagattcatggatcgctcttcaagacaagatgcactagctgcggggtcgtggcagagaattacaagtcacccatctgcccagctctgagcggtaaaggctgtgaggaagctggctgtggggggttactgcgcccccacgtcgtgtggttcggcgagaatctcgaccccgccatcttggaggaggtggatagagagttagcacactgcgatttatgcctcgtggtggggacaagctcagtggtttaccccgcggccatgttcgccccgcaggtggccgccaggggagtgcccgtggccgagtttaatacagagacaaccccagccacaaacagattcagatttcacttccagggaccttgcggaaccaccctgcctgaggccctggcttgccacgagaatgagacagtgtcttag

SEQ ID NO: 205261 - DNA, 933 bp, Artificial Sequence
  Description of Artificial Sequence: Synthetic coding sequence
atgcggcccctgcagatcgtgcccagccggctgatcagccagctgtattgcggtctgaaaccgcctgccagtacacgcaatcagatctgcctgaaaatggcccggccctcttccagcatggctgactttagaaagttctttgcaaaggctaagcacatagtaatcatctctggtgctggagtgagcgctgagagcggcgtaccaactttccgaggggctggtggatattggcgtaagtggcaggcacaagacctggccaccccgttagcattcgcacataatcccagtcgggtgtgggaattctaccattaccgtagggaagtgatgggctctaaagaacccaacgctggacatagagctatagctgaatgcgagactcggcttgggaaacaggggcgccgcgtggtggtgattacccagaacatcgacgagcttcacaggaaagctggaacaaagaatctgctagaaatccacggatctctgtttaagactagatgcacatcctgcggagtcgtcgctgagaattacaaatctccaatctgtccggcacttagtggaaaaggggccccagagccaggcacgcaggatgcttccatccctgtcgaaaagctgcccaggtgtgaagaggccggttgtggcgggttgttacggccccacgtagtgtggttcggcgaaaatctggaccctgcaatactcgaagaggtcgaccgggagctggcccactgtgacctttgcctcgtagtgggaacttcttctgtcgtctatcctgcagcaatgtttgctcctcaggttgcagctagaggcgtccccgtagccgagtttaataccgagacaacaccagcaaccaacagattcagattccatttccaaggcccttgcgggaccacgcttccagaagcgctggcttgtcatgaaaatgaaactgtgtcttag

SEQ ID NO: 205262 - DNA, 900 bp, Artificial Sequence
  Description of Artificial Sequence: Synthetic coding sequence
atgcggcccctgcagatcgtgcccagccggctgatcagccagctgtactgtgggctgaaaccccccgctagtactaggaaccagatctgtctgaaaatggcccggccatcaagcagtatggccgatttccgcaaatttttcgcaaaggccaagcatatcgtgattattagcggcgccggggtatcagccgagtcgggggtgccgacttttcgcggggccggcgggtattggcggaagtggcaagcccaggatctggcaacccctctagcattcgcccataacccgtctcgtgtttgggaattttatcactaccggcgggaggtcatgggaagtaaagagcctaatgctgggcatcgggctatcgctgaatgtgagactagacttggtaagcagggcaggcgcgttgtggttatcacccagaacattgacgaattgcaccgtaaagccggaacaaagaatttattggaaatccatggctctctgttcaagaccaggtgtaccagttgtggcgttgtcgctgaaaattataaatcccctatatgccctgccctttcagggaagggagccccagaaccggggacacaggatgccagtatccccgtggagaagctgccccgctgcgaggaggctggctgtgggggcctgctccgcccccatgtggtgtggtttggcgaaaatctcgatccagcaatactcgaagaagtggatcgcgagctggcccattgtgacctgtgtctggtggtgggcacctcgtcagtggtgtatcccgcagccatgttcgcaccacaagtggcagcgcggggggtgcccgttgctgagttcaatactgaaaccacccctgctacaaatagattctcacatctcattagtatttctagtctgatcatcatcaaaaactag

SEQ ID NO: 205263 - DNA, 609 bp, Artificial Sequence
  Description of Artificial Sequence: Synthetic coding sequence
atgggcagcaaggagcccaacgccggccaccgggccatcgccgagtgcgaaacacgcttgggcaaacagggtcgtagagtcgtggtgataactcagaacattgatgagctgcatcggaaggcaggcacaaagaatcttctggagatccatggctccctgttcaagactcggtgtacctcctgtggagtggtggcggagaactataagtcacccatttgccccgctctctccggcaagggagcacctgagccggggacccaggacgcgagtatccccgtagaaaaactccctagatgtgaagaggctggttgcggtggcctgctgcgccctcacgtggtgtggtttggggagaatctcgaccccgccatcctagaagaggttgaccgggagctcgcgcactgtgatctgtgcctggtagttgggacttccagcgtggtgtacccagcagctatgtttgccccccaggtggccgcacggggagtgcccgtagcggagttcaacacagagacaactcccgcgaccaatcgatttcgtttccattttcagggaccatgcggtaccactctgccggaggctctggcatgtcacgagaacgagactgtgagctag

SEQ ID NO: 205264 - DNA, 1203 bp, Artificial Sequence
  Description of Artificial Sequence: Synthetic coding sequence
atggccgccggcggcctgagccggagcgagcggaaggccgccgagagggtgcgacgactgagggaggagcagcaacgcgaacgtctgcgacaggtgtccagaatcttgcgcaaggccgccgctgaacgatctgccgaggagggaaggctattagcagagagtgctgacttggtcacagagctccagggacgtagcagacgcagggagggcctgaagcgtcggcaggaagaggtttgcgacgaccccgaggaactccggggaaaagtgcgggaactagcctcagctgttaggaacgccaaatatttggtggtttacacgggcgccggtatatctaccgcagcctcgatcccagactaccgtgggcctaatggcgtttggaccctcctgcagaaagggcgtagtgtgtctgctgccgacctgagcgaggccgaacccactttgacacatatgtctatcactcgattgcacgagcagaagctcgtgcagcacgtggtgagtcagaattgtgacggcctgcatctgagatccggcctgccacgcacagccatctccgagctccacggcaacatgtacattgaagtgtgcacctcttgcgtgcccaacagagaatacgttcgggtctttgacgtcactgagcggaccgccttgcaccgacaccagactggccgtacctgtcacaaatgtggaacccaacttcgcgacactattgtccacttcggcgaacgcggtactctcggacagccactgaactgggaggccgcgactgaggcagccagccgagccgatactatcctttgcctgggatcaagcctcaaggtgctcaagaaataccctagactgtggtgtatgaccaagcccccctctagaaggccaaaattgtatatcgtgaaccttcagtggacccccaaagacgattgggcggccctcaaactacacggcaagtgtgacgacgtcatgcgcctgctaatggccgagctcggtctggagattcctgcctactccagatggcaggatcccatcttcagcctcgctacccccctgagagcaggtgaggagggatcacatagtcggaagtcactatgtagatctcgtgaagaagctcctcccggagaccgcggcgccccactctcgtcggcacccatactgggaggatggttcgggagagggtgtaccaagcgaaccaagcgcaaaaaagtgacatag

SEQ ID NO: 205265 - DNA, 963 bp, Artificial Sequence
  Description of Artificial Sequence: Synthetic coding sequence
atgcccggcccccggcggcggagccccagcgcctgcccccaggtgtcacggatcctgcgcaaggctgcagccgagcgtagcgctgaagagggacgtctgctcgctgagtcagcagatctggtgaccgaactgcaaggccgttctcggagaagagaggggctgaagcgcagacaagaggaagtctgcgatgaccccgaagaactgcgaggtaaggtccgcgaactggcgagcgcggtgcggaatgcaaagtacctcgtagtttacacaggcgctggcatcagcactgcggcgtcaatccccgactacagaggacccaacggagtgtggactctattacagaagggtcggagtgtttccgccgccgatctttcagaggcagagccgacgctgacgcacatgtcgatcaccaggcttcacgagcagaagctggtacagcacgtcgtgtcgcagaactgtgacggcctgcacttaaggtctggcttgccgaggactgcgatatcggagctgcatggaaatatgtatatcgaggtgtgtactagttgcgtgcctaacagagaatacgtgcgggtgttcgatgttacggaaagaacggccctgcatcgacatcagacaggacgtacatgtcataaatgtggcactcagctccgggataccatcgtacacttcggagaaagaggcaccttaggacagcctctcaattgggaggctgcaaccgaagcggcgtctcgggcagacactatattgtgtctagggagttcacttaaggttctgaagaagtaccctcgtctgtggtgtatgaccaaaccaccctcacgccgcccgaagctgtacatcgttaacctccaatggaccccaaaagatgactgggccgccctaaagctgcacggcaaatgcgacgatgttatgcgactcttgatggccgaacttggactggaaatcccagcgtacagccgcgtgctatag

SEQ ID NO: 205266 - DNA, 855 bp, Artificial Sequence
  Description of Artificial Sequence: Synthetic coding sequence
atgagcatgctgcccagcttcggcttcacccaggagcaggtggcctgcgtgtgcgaggtattgcagcagggcggaaatctggagagactggggaggtttctgtggagcctaccagcctgtgaccatctccacaaaaatgagagcgtcttaaaggccaaagccgtggtggcttttcacagaggtaattttcgggagttgtataaaattctggagagtcatcagtttagcccgcacaatcaccctaagctgcagcagctttggctgaaggcccactatgttgaggccgaaaagcttcgcggccggcccttaggagccgtggggaagtacagagtcagacgcaagttccccttgccgcggactatctgggacggggaggagacttcctactgctttaaggaaaagtctagaggtgtccttcgagaatggtacgcgcacaacccctacccgtctccacgtgagaaaagagagctggccgaagctactggcctgacaacaacgcaagtaagtaactggtttaaaaatagacgccagagagatcgagcggccgaagccaaggagcgggagaacaccgaaaacaacaatagttcttcaaacaagcagaaccagctgtctccactagagggaggcaagcctttgatgtcgagtagcgaagaggagttcagtcctcctcagtcccccgatcaaaattccgtgctccttttacaggggaatatgggtcatgcaagaagcagcaattacagcctgcctggtctcactgctagccagccttctcatggcctacagacccaccagcaccagctccaagactccctgttgggtcccttgacgtcaagcctggtggatctggggtcttag

SEQ ID NO: 205267 - DNA, 876 bp, Artificial Sequence
  Description of Artificial Sequence: Synthetic coding sequence
atgagcatgctgcccaccttcggcttcacccaggagcaggtggcctgtgtgtgcgaggtgttacagcagggcggtaacatcgagaggctcggtcgattcctgtggtctcttcctgcatgcgaacatttgcataagaatgaaagtgttctgaaagccaaagccgtggtcgccttccatcgagggaactttcgcgagctatacaagatactagagtcccatcagttctccccacacaaccacgctaaactgcagcagttgtggcttaaggcccactatatagaagcagagaaactgagaggacgcccgctgggtgcggttggtaagtacagggtccgacgaaagtttccactgcccaggtccatctgggacggcgaagagacctcttactgttttaaggagaaaagcaggtctgtactgcgagagtggtatgcccacaatccatacccatcacctcgcgaaaaaagggagttggcggaagccaccggcctcactactacccaagtttcaaactggtttaaaaaccggagacagagagacagagcagcagaggccaaggagcgagaaaataatgaaaactctaactctaacagtcacaaccccctgaatggctcggggaaaagtgtcttgggatcgtccgaagacgaaaagacccccagcggcactccagatcattccagttcctcgccagcactactactctctcccccacctcctgggctgccctccctccactcactgggtcatccccctggtccttccgcggttccagttccagtgcctggtgggggcggggcagaccccttacagcaccatcatggcttacaggacagcattttaaaccctatgtctgctaacctcgttgatctggggtcgtag

SEQ ID NO: 205268 - DNA, 999 bp, Artificial Sequence
  Description of Artificial Sequence: Synthetic coding sequence
atggtgttccggagccccctggacctgtacagcagccacttcctgctccccaacttcgctgactcgcaccataggagcatcctattagctagttccggcggtgggaatggggctggtgggggtggcggagctggcggaggtagcggtggaggaaatggcgctgggggaggcggagccggcggagcagggggcggcggcggcggcggcagcagagcccctcccgaggaattgagcatgttccagctgccaacgctgaatttctccccagagcaggtggcatccgtgtgtgaaactcttgaggagacaggtgatatcgaaagactgggccggttcctgtggagcctgcctgttgccccgggggcatgtgaggctatcaataaacacgagtccattttacgagctcgggccgtcgttgcttttcatacaggcaacttcagggatttgtatcacattcttgaaaaccataagtttaccaaggagagccatggaaaactgcaggccatgtggctcgaggctcattatcaggaagctgaaaaactccggggcaggcccctgggacctgtcgacaagtacagggtccgcaagaaattccctctgccccgaactatatgggacggtgaacaaaagacacactgcttcaaagagcggactaggagtctgctgagagagtggtacctgcaggacccttaccctaatccttctaaaaaacgggaacttgctcaggctaccggcctcacaccaacccaggttgggaattggtttaagaatcgcagacagcgggaccgtgccgccgcggcaaaaaaccgtctccagcaccaagccattggaccgtcagggatgagatctttagcggagcctggatgccctacccacggctccgctgagtcaccctctactgcagcttcgccaacaacaagcgtctcaagtctgacggaacgggcagacacgggtacctcaatattatccgtaacaagcagcgactcagagtgcgatgtgtag

SEQ ID NO: 205269 - DNA, 1020 bp, Artificial Sequence
  Description of Artificial Sequence: Synthetic coding sequence
atgaactgggagctgctgctgtggctgctggtgctgtgcgccctgctactgcttttggtgcagcttctgcgcttcctcagggctgatggggaccttacactgttgtgggcagagtggcaggggcgaagaccagagtgggagcttaccgacatggtggtctgggtaaccggcgccagttctgggatcggtgaggaactggcataccaactgtcaaagctaggcgtatccctggttcttagcgctagacgcgtacatgagcttgagcgagttaagaggaggtgcctggagaacggaaacctgaaagagaaggatatcttagtcctgcccctggacttaactgacactggttcacacgaggcagctaccaaagcagtcttacaagagtttggacggattgatatcttagtcaacaacggagggatgagccaaagatctctctgtatggatactagcctcgacgtgtacagaaagttgatcgaattgaactatctgggaactgtcagcctgaccaaatgtgtgttgcctcatatgatcgagcggaagcagggtaagatcgtgaccgtaaactcgatcctgggcattatctcagtacctttgtccataggctactgcgcctccaagcacgccctgagaggctttttcaacggtctgaggaccgagctggccacatatcctggcattatcgtctctaacatttgcccggggcctgttcagtccaatatcgtggagaattcacttgctggggaggtaacaaaaactattggaaacaacggcgatcagagtcacaaaatgacgacttccagatgtgtccgcctaatgctgatctctatggccaacgatctgaaggaagtctggatctcagagcaaccattcctgcttgtcacctacttatggcaatacatgccgacttgggcatggtggatcactaataagatgggcaagaagcggatagagaatttcaagtcaggggtcgacgccgacagtagttatttcaagatctttaagacaaaacacgattag

SEQ ID NO: 205270 - DNA, 2220 bp, Artificial Sequence
  Description of Artificial Sequence: Synthetic coding sequence
atggccaccctgcccgccgagcccagcgccggccccgccgccggcggggaggcagtggccgccgcagccgccaccgaagaggaggaggaggaagcccgtcagctgctgcagaccctccaggcagccgaaggagaggccgccgctgccgcgggggccggagcgggtgctgcagctgccggggcagagggcccagggtcccccggcgtccccggaagtcctcctgaggccgcatccgaaccgccaaccggacttaggttcagccctgagcaggtcgcctgcgtctgcgaagccctgctgcaggctgggcacgccggacgcctatcccgctttctaggggctctacctccagctgaaaggctcagaggatcggaccccgtactgcgggctcgggctctggtggccttccagcgtggcgaatatgccgagctctacagactgctcgagagtcggccattccccgctgcccaccatgccttcctgcaggacctctatctgagggcccggtaccacgaggccgaaagagctagagggcgagcccttggcgctgtcgacaagtacaggctgcgaaaaaagttcccgctgcccaagacaatctgggatggcgaggagactgtgtactgctttaaggagcgcagccgcgctgctctcaaagcttgctatagaggcaaccgctatcccacccctgacgaaaaaagacgcctggcaacactgaccgggctctccctgacgcaggtatccaattggttcaagaatcgccggcaacgggacaggacgggggccggcggcggagctccctgcaagagcgagagcgacggcaatcccacaaccgaggacgagtccagtcggtcccccgaagacctggaacgcggggcagcccccgtctctgctgaggccgccgcacaggggtctatcttcttagctggcacagggccgcctgcgccctgccccgctagctccagcatcctggtcaacggatcattcctcgcagcaagtggcagtccagctgtactgcttaacggtgggccagtcataattaacggtctagccctgggggaggcttccagcctgggaccactcttactcactggcggtggaggcgcaccccctccacagccttctcctcaaggcgcctctgagaccaagacatccctcgtgctcgatccccaaaccggggaagtgcgccttgaagaggcgcaatcggaagctccagagacaaagggagcacaagttgctgccccgggacccgcgctgggcgaagaggtgctgggtccactcgcgcaggtggttcctggcccacctacagctgccaccttcccattacctcctggaccggtgcccgccgtggcggcaccccaagtcgtgccattaagtccaccccccggctatcccacgggtctcagccctacttccccgctgctgaacctgccacaggtcgtaccaacttcgcaggtggttacccttccacaggccgtcggacccctccaactacttgctgccgggcccgggagtcccgtgaaagtggccgctgcggccggtccagcaaatgtgcatcttatcaactccggcgttggcgtgacggctctacagctgccctctgccaccgctccaggtaactttctcttagctaaccctgtgtcaggcagcccaatcgtgaccggggtcgccctccagcagggaaaaatcatattgaccgctacctttccaactagtatgttggtctcccaggtccttccccctgctcctggactcgccctgcctttgaagcccgagacagcgatttcggtaccggagggcggactacctgttgcacccagcccagcacttccggaggcacacgcccttggcacactcagtgcccagcagcctcccccagccgcggcaaccactagttcaacaagcctccccttttcaccggactcccctgggctcctgccgaattttccagcgccacctccagagggcttgatgctcagtccagcagcagtgccggtgtggtcagccggtctggagctttccgccggaaccgagggtctccttgaagccgagaaggggctaggtacacaggctcctcacaccgtcttaagacttcccgatcctgatcccgaaggattactgttaggtgcgaccgccggcggggaggttgatgagggcctggaggccgaggctaaagtcctgacgcagcttcagtccgtgcccgtagaagaacctctcgagttgtag

SEQ ID NO: 205271 - DNA, 741 bp, Artificial Sequence
  Description of Artificial Sequence: Synthetic coding sequence
atgttccagctgcccatcctgaacttcagcccccagcaggtggccggggtgtgtgagactttggaagagtcaggagacgtagaaaggttggggcggttcttatggagcctgcctgtggctcccgccgcttgtgaggctctgaacaaaaacgaatcagtgctgcgcgcccgcgcaattgttgcctttcatggaggtaattatcgcgagctgtaccatattctggagaatcacaagtttaccaaggagtctcacgcgaagctgcaggcactctggttagaggcccactatcaggaggcagagaaacttcggggccggcctctggggcctgtggacaagtacagggtgcggaagaagttccctctccctcggacaatttgggacggagaacagaagacccactgctttaaggagcggactcgacatctactcagagaatggtatctacaagacccttacccaaatccctctaagaaacgggaactggcacaggctacagggctgaccccaacccaggtcggcaattggtttaaaaataggcgtcagcgagacagggcagcggccgctaagaaccggctgcagcagcaggtcctatcccaggggtccggccgggctcttagggctgaaggggacggaacacccgaagttctgggcgttgccacttcacccgccgcgtcactgtcctcaaaggctgctactagcgctataagtatcacttcctctgacagtgaatgcgacatatag

SEQ ID NO: 205272 - DNA, 360 bp, Artificial Sequence
  Description of Artificial Sequence: Synthetic coding sequence
atgacccagcagggcgccgccctgcagaactacaacaacgagctggtcaaatgcatcgaggaactttgccagaaaagggaagagctgtgccgacaaatccaggaggaggaagatgaaaagcaaagactgcagaacgaggtgcggcagttgaccgagaaactcgcaagagtcaacgaaaatctggcacgcaagatcgcctcaaggaatgagttcgaccggaccattgcagaaacagaagctgcgtacctgaagatcctggagtcttcccaaaccctgctgtcagttctgaagcgggaggcaggcaacttgactaaagctaccgctccggaccagaagagctccggaggcagagacagttag

SEQ ID NO: 205273 - DNA, 666 bp, Artificial Sequence
  Description of Artificial Sequence: Synthetic coding sequence
atgctgtggctgttccagagcctgctgttcgtgttctgcttcggcccgggccaactaagaaacatacaggttacaaaccactcccagctgtttcaaaacatgacatgtgagctgcacctgacatgcagtgtggaggacgccgatgacaatgtatcatttaggtgggaggctttagggaatacattaagctcacagccaaatcttaccgtctcctgggatcctcgcatttccagcgagcaggactacacgtgcattgccgagaatgctgtgtcaaacctttcattctcggtatccgcccagaaactctgtgaagacgtgaagattcagtacacggacaccaaaatgattttattcatggtcagcggcatctgtattgtgtttgggtttatcattcttctgctgctggttcttcgcaaaaggcgagattcactcagtctgtccacacagcggactcagggcccggcggagagtgcccgtaacctggaatatgtctccgtttcgcctaccaataataccgtttatgctagtgtgacccactcaaatagagaaaccgaaatatggactcctagagaaaacgacactattacgatttactctaccatcaaccattctaaagaatcgaaaccaactttttctcgtgctactgcgttagataatgtcgtgtag

SEQ ID NO: 205274 - DNA, 999 bp, Artificial Sequence
  Description of Artificial Sequence: Synthetic coding sequence
atgctgtggctgttccagagcctgctgttcgtgttctgcttcggccctggcaacgtggtgtcacaatcaagcttgaccccactgatggtgaatggcatcctgggcgaatccgtgactctgcccctggagtttcccgctggcgagaaagttaactttatcacttggctttttaatgagacctctctggccttcatcgttccacacgagactaaaagcccagagattcacgttacaaatcccaagcaggggaagaggctcaactttacacagtcctattcattacaactgagcaatctgaaaatggaagacacaggatcctacagggcccagatcagcaccaagacgtctgccaagctttcatcctacaccctgagaatcctacggcagctgcgaaacatccaggttacgaatcatagtcagctcttccagaacatgacatgtgagctgcacttgacttgcagtgttgaggacgccgacgacaacgtttcattcagatgggaagcgctcggaaataccctgagcagtcagcctaatctcacagtgtcctgggatcctcggatttccagcgagcaggactacacttgcattgctgaaaacgccgtgtctaacctgtctttctctgttagcgcccaaaagctgtgcgaggacgtgaaaatccagtatacagacacgaaaatgatcctctttatggtgtccggcatttgcattgtgtttggctttataatactgctgctgctagtgctgcgaaaacgcagagactccctgagtctatctactcagagaacacaaggccctgccgaatctgccaggaacctcgagtatgtgtccgtgtcccccacgaataacaccgtgtacgccagcgtaacccattcaaacagggagaccgagatctggactccacgtgaaaacgacaccataaccatctatagcaccattaatcacagcaaggagtctaaaccaaccttctcacgggcaaccgcacttgataacgtcgtatag

SEQ ID NO: 205275 - DNA, 996 bp, Artificial Sequence
  Description of Artificial Sequence: Synthetic coding sequence
atgctgtggctgttccagagcctgctgttcgtgttctgcttcggcccgggcaatgtcgtctctcagtctagccttactcctctgatggttaacggcatcttgggggaaagcgtgacactgcctttggagttccccgcaggcgaaaaagtcaacttcatcacatggcttttcaatgagacaagtctggccttcatcgtccctcacgaaactaagtcaccagaaattcacgttacgaaccctaagcaagggaaaaggcttaactttacacagagctacagtctccagctatccaacctgaaaatggaggacaccggctcatatagggcccagatcagcaccaagacttccgcgaagttatccagctacacacttagaattctgagacagctgcgcaatatacaggttaccaatcattcgcagctatttcagaacatgacctgcgagcttcacttgacatgtagtgttgaagacgcagatgataatgtaagtttccggtgggaggctctgggcaatacattgtcctcccaaccgaacttaactgtgtcctgggatccgagaatatccagcgaacaggattacacgtgcatcgcagaaaatgctgtgtccaaccttagtttctccgttagcgcgcagaaactgtgcgaggatgttaagatacaatacacagacactaagatgattctgttcatggtgtccgggatctgcatagtgtttggcttcataatcctccttctgctggtcctgaggaaacgcagggactccttgagcctttcgactcagcggactcaaggccccgagtctgcacgcaatctcgagtacgtaagcgtgagccctaccaataacacagtgtacgctagcgtgacccatagtaatcgggaaaccgagatctggacccccagagaaaacgatacaatcaccatctactcaaccattaaccattctaaagagtctaagccaaccttctcgcgcgccactgcactcgataacgtggtgtag

SEQ ID NO: 205276 - DNA, 891 bp, Artificial Sequence
  Description of Artificial Sequence: Synthetic coding sequence
atggccggcagccccacctgcctgaccctgatctacatcctgtggcagctcacaggctcggcagcgagtggtccagtcaaggagctggtgggaagcgtcggtggagccgtcaccttccccctgaaatcaaaggtgaagcaggtggacagcattgtctggacttttaatacaacccccctggtgactattcaaccagaaggcggtaccatcatcgtgacccagaaccggaatcgggagagagtcgatttccccgatgggggttacagcctcaaactgagcaagctcaaaaagaacgacagcgggatctactatgttgggatctattctagttccctccagcagcctagcacccaagagtatgtgctacatgtctatgagcatctgagcaaacccaaggtgactatgggcttacagtcgaacaagaatgggacctgtgtgacgaatctgacatgttgtatggagcatggcgaggaggatgtgatatacacttggaaggccctgggacaagcagctaatgagtctcacaatgggtctatcctgcccataagctggaggtggggggagtctgatatgacattcatttgcgtggctcggaacccagtgtctcgaaactttagttccccaatcttggctcgtaaactgtgcgagggcgcagcggacgatcccgatagctccatggtcttactgtgtctgttgctcgtcccattgttgttgtcgctgtttgttttaggcctgtttctgtggtttttgaaaagggaaaggcaggaggagaacaaccctaaaggccgctcttcgaagtatggcctgctgcattgtggaaatactgagaaggatgggaagagcccattgaccgcgcacgacgcccggcatactaaggctatctgcctgtag

SEQ ID NO: 205277 - DNA, 687 bp, Artificial Sequence
  Description of Artificial Sequence: Synthetic coding sequence
atggccggcagccccacctgcctgaccctgatctacatcctgtggcagctcaccgaacacctatctaagcctaaggtgacaatgggtttgcagtctaacaaaaatggcacgtgcgtgacaaacttaacatgttgcatggagcacggggaagaggacgtgatatatacgtggaaggcgctgggccaggccgccaacgagtcccataatggtagcattctgcccatttcttggagatggggggaaagcgacatgacattcatctgtgtcgccagaaatccagtaagtaggaacttctcctccccaattctcgctcgaaagctgtgtgagggggctgccgatgatcctgattcatcgatggttttgctgtgcctgctgctagtgccactgctgctgtccttattcgttttgggactgttcctttggttcctgaagcgtgagcgccaggaggagtatattgaggagaagaagcgagtggatatatgcagggagactccaaatatttgcccacactcaggagagaatacagaatacgacacaataccacacaccaatcgcaccattctcaaggaggaccctgccaataccgtgtactcaacagtcgagattcccaagaagatggagaatccgcacagcctgctgaccatgcccgatacccctaggctctttgcctatgagaacgtaatctag

SEQ ID NO: 205278 - DNA, 1008 bp, Artificial Sequence
  Description of Artificial Sequence: Synthetic coding sequence
atggccggcagccccacctgcctgaccctgatctacatcctgtggcagctgaccggatccgctgcctccgggcctgtgaaggagttagtcggtagcgtcggcggcgccgttacgtttcctctaaagagcaaggtaaagcaggtcgattcgatcgtgtggacatttaatactaccccactggttactatccagcccgaaggcggtactatcatcgttacccaaaaccgcaaccgggaaagagtcgacttccctgatggtgggtattccctgaaactttccaagctaaaaaagaatgattccggcatctactatgtcggcatttattcttcttctctgcagcagccaagcacacaagaatatgtcctccatgtctacgagcatctcagcaagccaaaagtcacaatgggcttgcaatctaataaaaacggaacatgcgtgacgaatcttacgtgctgtatggagcacggagaagaagacgttatttacacctggaaggccctcgggcaggcagccaatgaatcccacaacggaagtattctgccaattagctggaggtggggagaatcagacatgacgtttatttgcgtggcacgtaaccctgtttcgagaaacttttcctccccaattctggcgaggaaactttgcgaaggcgccgctgacgacccggactcatcaatggttctgctgtgtcttcttctagtgccgctgctactgtccctgtttgtcctcggcctgttcctttggttcctcaagagggagcggcaggaagaatatatcgaagagaagaaaagggtggacatctgcagggagacaccaaacatatgcccccactctggcgaaaacacggagtatgatacaatcccccatactaatcgaactatcctgaaggaagaccccgctaatacagtgtacagtacggtcgagattcctaaaaagatggagaacccccactctctgctcaccatgccagatacgccgcggctatttgcttacgagaacgtgatctag

SEQ ID NO: 205279 - DNA, 615 bp, Artificial Sequence
  Description of Artificial Sequence: Synthetic coding sequence
atggccggcagccccacctgcctgaccctgatctacatcctgtggcagctcactggaagcgccgcttcaggacccgtaaaggagcttgtgggatccgtcggaggcgctgtgacgtttcccctcaaatcaaaagtgaaacaagtcgattccatcgtctggacttttaacacgacgcccctggtaacaatccaacctgaggggggaactataatagttacacaaaaccgaaatcgggagagggttgacttcccagacggaggatattctctcaagttgtctaagctgaaaaagaatgattcggggatctactatgtaggtatttactcaagttccctgcagcagccatcaacacaagagtatgtactgcatgtgtatgaatatattgaggaaaagaagagggtggatatttgtcgtgagactcctaacatatgtccacattctggagagaacactgagtatgacacaatacctcataccaaccgcaccatccttaaggaggacccagccaacacagtttacagtactgtggagattccaaagaagatggagaatcctcacagcctgctgacaatgccagacactcctaggttgtttgcttacgagaatgtgatctag

SEQ ID NO: 205280 - DNA, 498 bp, Artificial Sequence
  Description of Artificial Sequence: Synthetic coding sequence
atggccggcagccccacctgcctgaccctgatctacatcctgtggcagctgacagggagtgccgcgtccggtcccgtaaaggagcttgtggggagcgtggggggagcggtgactttccctctcaaaagtaaggttaagcaagtagatagtatcgtgtggaccttcaacactactcccctggtgacaatacaacccgaaggaggtaccattatcgtaacacagaatcggaatagagaacgagtggacttccctgatggtgggtacagtctgaaactttccaagctcaagaaaaatgattctggaatttattacgtcgggatctacagttcgtcacttcagcaaccttcgacccaggagtacgtcttgcacgtctatgaaaataatcccaagggtcgctcttcaaaatacggattattgcactgtggaaatactgagaaggacgggaaatcccccttgactgcacacgacgccaggcacaccaaggcaatctgtttgtag

SEQ ID NO: 205281 - DNA, 450 bp, Artificial Sequence
  Description of Artificial Sequence: Synthetic coding sequence
atggccggcagccccacctgcctgaccctgatctacatcctgtggcagctgacggagcatctgtccaagccaaaagtcactatgggcctgcagagtaataagaatggcacttgtgtcacaaacctaacctgctgtatggagcatggtgaggaggatgtaatttacacatggaaggcacttggccaagctgcaaacgagagtcacaacgggagcatcttgcccatctcctggagatggggggagagcgatatgaccttcatatgcgttgcccgcaacccagtgagcagaaatttttcctctccgatccttgctcggaagctctgcgaagagaacaaccccaagggacggtcaagcaagtacggactgctgcactgcggcaatactgagaaagacggcaaaagtccgctaacagctcatgacgcacggcacacgaaagcaatttgtctctag

SEQ ID NO: 205282 - DNA, 567 bp, Artificial Sequence
  Description of Artificial Sequence: Synthetic coding sequence
atggccggcagccccacctgcctgaccctgatctacatcctgtggcagctgacagagcatctctctaagcccaaggtgacaatgggcctccaaagtaataagaatggcacctgtgtgacaaatctcacctgctgtatggaacacggcgaggaggacgttatatatacctggaaggccctggggcaagctgccaacgagagccacaacggctctattctccccattagctggcgctggggggagtctgacatgaccttcatctgcgtggcacggaaccccgtcagccgtaatttttcatctcctatacttgcaagaaagctatgcgaggaatatatagaagagaaaaagagggtagatatctgcagagaaacacccaacatttgtccccactcaggcgagaatacggagtatgacaccatcccacatacaaacagaactattctcaaggaagatccagccaatacggtgtacagtaccgtcgagataccaaaaaagatggagaacccccattctctcctaactatgccggatacaccccgactgttcgcttatgaaaacgtgatttag

SEQ ID NO: 205283 - DNA, 858 bp, Artificial Sequence
  Description of Artificial Sequence: Synthetic coding sequence
atggtgatgcggcccctgtggagcctgctgctgtgggaggccctgctcccgatcacagttactggagctcaagtgttgagtaaggttggcggtagcgtgctgctggtagcagctcggcctcccggcttccaagtgcgcgaggccatctggcggtcattatggccatctgaggagctcctggcaactttcttccgagggagccttgagacactgtatcacagtagatttcttgggcgcgcccaattgcactctaacttatcccttgaactgggacctctcgagtccggtgatagcggtaatttttccgtcctgatggtggacacgcgtggtcagccgtggacacagactctccagctgaaggtctacgatgcagtgccacggcccgtcgtgcaggtgttcattgcagtggaacgggacgcacagccctcaaagacttgtcaggtgttcctttcatgctgggctcctaacatctctgagatcacatactcgtggaggcgcgagacaactatggacttcgggatggaaccccatagtctatttacggatggccaggtgttgtcaatctcccttggccccggcgatagggatgttgcctactcctgcattgtgtctaatcccgtcagctgggacctggccacggtgacaccgtgggattcctgccatcacgaggccgcccccggaaaggcttcttataaggacgtcctgcttgtcgtggtgcccgtgtcactgctgctgatgctggtcacactgttttcggcatggcactggtgcccttgctcgggtaaaaagaagaaggacgtgcacgctgacagagtgggacctgaaaccgagaacccactggtgcaagacctgccatag

SEQ ID NO: 205284 - DNA, 531 bp, Artificial Sequence
  Description of Artificial Sequence: Synthetic coding sequence
atggtgatgcggcccctgtggagcctgctgctgtgggaggacgccgtcccccgtccagtggtccaggtctttatcgcagtagaaagggacgcgcagcctagtaaaacctgtcaggtcttcttatcgtgttgggcacccaatatctcagagataacatactcttggcggagagaaacgacaatggacttcggtatggaaccgcattctttgttcaccgatggtcaggtcctgtccatatctcttggcccaggagatcgggatgtcgcgtactcatgcatcgtctcaaatcctgtctcctgggaccttgcaaccgttacaccctgggatagctgtcatcatgaggcagccccaggtaaagcatcctacaaggatgtgctgctcgtcgtcgttccggtatctttgctcctgatgctggtgaccctgttctccgcatggcactggtgcccctgtagcggaaaaaagaagaaggatgtgcatgccgacagggtgggccctgaaactgaaaaccctctcgtacaggatctcccttag

SEQ ID NO: 205285 - DNA, 444 bp, Artificial Sequence
  Description of Artificial Sequence: Synthetic coding sequence
atgggcggccggcaccacctgcagcggcaggtgagcgagagcatgagcgcactgtttcaggcagttcggctagagagcgcctgggccgaccgcgttcggtatatggttgtcgtttacagcagcggcagacaagatacggaagagaacattctgctcggagttgacttcagctccaaggaatccgggttttctgtctccaccgcaggaaggatgcacatcttcaagccggtgtctgttcaagcgatgtggagcgctctccaggtcctgcacaaggcctgcgaagtggctagacgtcacaattacttcccgggtggcgtggcattaatttgggccacatactacgaaagttgcatttctagcgagcagtcctgcattaatgagtggaacgctatgcaggatctggagtccactcgacctgacagtccggcgctcttcgtcgattag

SEQ ID NO: 205286 - DNA, 2112 bp, Artificial Sequence
  Description of Artificial Sequence: Synthetic coding sequence
atggcccgggcccggcgggccgtggtgggcagcgtgcgggacgtgtcaaccgctgccactaacctcttttactttacagacttctgtatcttcctccagcctacccactgtttttgctgccctgaggttagtagctccaactacctcagcgagagtttcttcatggtcaagggcgccgcactgtttctgcagcagggaagttctccccaaggacagcggagcctgcagcacccacacaaacatgcaggggaccttcctcagcacctgcaagtgatgataaacctattgcgatgcgaggacaggatcaaactggctgttagattggaatcagcctgggctgatcgcgtacgttacatggttgtcgtctatagttcgggacgccaagacacagaagaaaacattcttctgggggtggatttctcgtcaaaggaatctaagagctgtacaattgggatggtgcttcgcctatggtcagatactaagatccatttggatggcgatggcggtttcagcgtcagcactgcaggcaggatgcacatcttcaagcccgtgtcagttcaggcgatgtggtctgctttgcaagttctgcacaaggcttgcgaagtggctcgcaggcacaattactttcccggaggagtagcactgatctgggccacttactacgaaagctgcatctcatccgagcagtcatgcataaacgaatggaatgccatgcaggacctagagagcactagacccgactctcctgcactttttgtggacaagcctaccgagggcgaacgtactgaacggttgattaaagcaaagctcaggagcattatgatgagccaagatctggaaaacgtgacttcaaaggaaattagaaatgaactggagaaacagatgaattgcaacctcaaggagctgaaggagttcatagacaatgagatgctgctgatcttgggacagatggataagcccagcttgatattcgatcatctgtatctaggcagcgaatggaatgcgagcaatctcgaagagcttcagggtagtggagtagactatatccttaacgtgactagggaaatagacaacttctttccagggctgtttgcttatcataatatccgggtgtacgacgaagagacaacagaccttttagcccattggaatgaggcataccactttattaataaggccaagcgtaatcatagcaagtgtctggtccactgtaagatgggcgtgagcagatcggcctccactgtaatagcctatgccatgaaggaattcggttggccactggagaaggcttataactacgttaagcagaagcggagcatcacacgtcctaacgctggatttatgagacagctgagtgaatacgaaggtatccttgacgcttccaagcagagacacaacaaattatggcgacagcaaacagactcaagcttacaacaacccgtcgatgaccccgctggaccgggagacttccttcccgaaactcccgatgggacccccgagtctcagctgccattcttggacgacgcagctcagcccggtctaggccctcctctgccatgctgctttaggcgcctctccgatcctttattgccaagcccggaagatgaaacagggtccctggtgcacctggaagaccccgaaagagaggcgctccttgaagaggccgcccccccagctgaggtccacagacccgcccggcagccgcagcaagggtccggcctgtgtgaaaaagatgtcaagaaaaagctggagttcggatcaccaaagggacgaagcggatccttgctccaggttgaagaaactgagagagaagagggtctcggcgcgggacggtggggtcagctgcccactcaactggaccagaatctactgaactccgagaacttgaacaataattccaaacggtcgtgccccaatggcatggaagtgggaagagcacgtccggctgggtggcacactccaagcctgccaagccacagtaattggcctacctcagcatccgttgtgggtaccacgggtactcgacaccacactcagctcatcttcttctattgcctcctctgggccccttccagccatttacaaggaccggagggctcgtttactgggtag

SEQ ID NO: 205287 - DNA, 3150 bp, Artificial Sequence
  Description of Artificial Sequence: Synthetic coding sequence
atggccctggtgaccctgcagcggagccccacccccagcgccgccagctcttctgcctccaattcggagttggaggccggctccgaagaagataggaaactgaacttgagcctctcagagtcatttttcatggttaagggcgccgcgcttttccttcaacaggggagtagcccccagggtcagaggtctctgcaacatcctcacaagcacgccggggatttaccacagcacctccaagtcatgatcaacctgctgagatgcgaggatcggatcaaactggcggtgcggctggagtctgcctgggccgaccgagtccgttatatggtggtggtgtactcttccgggcgacaggacactgaagagaacatcctactgggagtggactttagcagcaaagaatcgaaaagttgcaccattgggatggtgctgagactgtggagtgatacaaaaatacacctggatggagatggcggcttttccgtaagcacagcaggaaggatgcatatttttaaaccagtcagcgttcaggcgatgtggagtgctcttcaagtgctgcataaagcctgcgaagtagcaaggcgtcacaactactttccgggcggagtggccctgatctgggccacctattatgaaagctgcatctcctcagagcagtcctgtattaatgagtggaacgcgatgcaggatcttgagtctacacgacccgactcacctgctttgttcgttgataagccaacagaaggcgaacgcactgaacgactgattaaggccaaactgcgcagcatcatgatgtctcaagatctagagaatgtcacctctaaagagatcaggaacgagctcgagaagcagatgaattgcaatctcaaagagctgaaagaattcatcgataatgagatgctgctcatcctggggcagatggacaagccctcactgatttttgatcacctgtacctgggaagtgaatggaacgcgtctaacctcgaggagctgcaggggagtggggtggactatattctgaatgttactagagagattgataatttctttcctggcctctttgcctaccataacatccgagtctatgacgaagaaacgaccgatttgctggcgcactggaacgaggcctatcactttatcaataaagctaaaagaaaccactctaagtgcctggttcactgtaaaatgggcgtttcccgaagcgcaagtaccgtgatcgcatacgccatgaaggagtttggctggccattggaaaaggcctataattacgtgaagcagaagcggtcaatcacaagacctaacgcaggatttatgcggcagctttctgagtatgaaggcattttggacgccagtaaacagaggcataacaaactgtggcgccagcagactgattcctcgcttcagcagcctgttgacgatcccgccggtccgggcgattttctgcccgaaactcccgacggtacgcctgagtctcagctacccttcctggacgacgcagcgcagcccgggcttgggcctcctctcccatgttgctttaggcggctgtccgatccactcctgcccagccccgaggatgaaacgggtagcttagtccacctggaagatcccgagagagaagctttgcttgaagaagccgctccacctgccgaagttcaccggccagcccgacagccacagcagggctccggcctgtgtgagaaagacgtcaagaaaaagttggagtttggcagcccgaagggacgctcaggatcattactgcaggtagaggagaccgaaagagaagagggtctgggtgctggacggtgggggcagttgccgacacaactggaccagaatttgcttaacagcgagaatttaaataacaatagtaagagatcatgtcccaacggcatggaggatgatgctatctttggcatcttaaataaggtgaaaccatcctataagagttgcgccgactgtatgtaccctaccgcaagcggcgcacccgaagcgagtagagagagatgcgaagaccccaacgcccctgccatctgtacccagcccgccttcctgccccatatcacaagctctccagtggcacatttagcatccaggtccagggtgccagagaaaccagcatcgggcccaaccgagccgcctccttttttacctcctgcaggatctcggcgcgctgatacaagcgggcccggcgccggtgctgccctggaaccccctgccagcttgctggagcccagcagagagactccgaaagtgctgcctaagtccctgctgttaaagaacagccactgcgacaagaatcccccatctaccgaagtcgttataaaagaggaatccagtcctaaaaaggacatgaaacccgcaaaggatctccgcctgctgttctcaaacgaaagcgagaagccgaccacgaactcatacctcatgcagcaccaagagtcaatcatccagcttcaaaaggcaggtttagtgcggaaacatacaaaggaacttgagcgcctcaagtcagttcccgcagacccagcgcctccctcccgagacggtcccgccagtaggttagaggcatctatccctgaggagtcccaggatcccgccgccttgcacgagctgggcccactcgttatgcccagccaagcgggctcagatgaaaagtccgaagctgcacctgccagtttggagggcggctctctgaagtctccacctccattcttttaccgtcttgaccacaccagctcattcagcaaagatttcctcaagacaatttgctatacccccactagtagcagcatgtcctccaacctgacccgcagttcatcaagtgattcaattcatagtgtgcgggggaagccaggtctcgtgaagcaaagaacccaggaaatagagactcggttacggttggcaggcctgacagtttcctctccactcaaacggagtcactccctggccaaactgggcagtttgacttttagcacggaggatctcagcagtgaagctgaccccagcacggttgctgactcacaggatactacactcagcgaatccagcttcctccacgagccacaggggactccacgggaccctgcggccacatccaagccctcgggaaagcctgcacccgaaaacttgaaatcaccatcttggatgtccaaatcctag

SEQ ID NO: 205288 - DNA, 2214 bp, Artificial Sequence
  Description of Artificial Sequence: Synthetic coding sequence
atgcggtgctacctgagctgggaccggtggaccagcccccccctgtcaagtattatcttcattagcgtggattacatcctcaacgtcaccagagagatagataacttttttcccggtctatttgcctatcacaacatccgagtgtacgatgaagaaacgactgacctgctggcgcactggaacgaagcataccacttcataaacaaggcaaagcgcaatcattcaaaatgtctcgttcactgtaaaatgggtgtcagcaggagcgcgtccaccgtgatcgcttacgctatgaaagaatttggatggcctctcgagaaagcgtacaattatgtgaaacaaaaacggtctataacaagacctaatgccgggttcatgcgccaactgagcgaatatgaggggatcctggatgcctctaagcagcggcacaacaaattgtggcggcagcagacggacagttcactccaacaacctgtcgatgatcccgccggccctggggactttctgccagagacccctgacgggacccccgaatctcagctgcccttcctggacgacgcagcccagcctggactgggcccaccccttccctgctgtttccggcgacttagtgatccactccttccgtcccccgaggacgaaaccgggagtctcgtgcatttagaggacccagagcgggaggccctgctggaggaggctgccccccccgcagaagtccacagacctgcaagacagccccagcagggctctggtctgtgcgagaaagatgttaagaagaaacttgagtttgggagccccaagggcagatccggttcgcttctgcaagtggaggagacagaacgggaagagggtctgggcgcgggaagatggggccagctcccaacgcagctggaccagaatcttctgaactcagaaaacttgaacaataactcaaaacgttcctgtcctaacggaatggaagatgatgctatctttggcattctgaataaagtgaaacccagctacaagtcctgcgccgactgcatgtacccaacagcctctggagcccccgaggcaagtagggaacgatgtgaagaccctaatgcacccgccatctgcacccaaccagcctttttgccccacatcacaagtagccctgtggctcacctcgcctccaggtcaagagttccagagaaaccagcaagtgggccaactgagccgcccccttttttgccacctgcaggaagtagaagggctgacactagcggtcccggcgccggggccgctttagagcccccagccagcctgttggaacccagcagggagactcccaaagttctcccgaagagtttgttactgaagaattcccactgcgacaaaaatcccccaagcacagaggtcgtcatcaaggaggagtcctctcccaagaaagatatgaaacctgccaaggacctcagactcttgtttagcaacgagagcgagaaacccactaccaattcttatctgatgcaacaccaggaatctatcatacagcttcagaaagctggactggtgcgcaaacacacgaaagaacttgagcggctgaagagtgtgcctgccgacccagccccaccatcgcgggatggaccagcctccaggctcgaagcctctattccggaagaaagccaggacccagcagcccttcacgagctgggcccactggtcatgcctagccaggctggctcagacgagaagtccgaagccgcccccgcatctttagagggcggtagcctgaagtccccacccccttttttctacagactggatcacacaagcagcttttccaaggactttcttaaaacaatttgttacacaccaacgtcttccagtatgagttccaatttaacacggagctcttcttccgactccatccactccgtgagaggcaagcctggactcgtgaaacagagaacacaagagatcgagacccggcttcggctggcaggtttaaccgtgagctcacctctgaaacggtctcactccctggctaagctgggtagtctcacgttctctaccgaggacctctcgtcagaagccgatccatcaaccgtcgctgacagccaggatacaacattgtctgagtcctcttttcttcacgaacctcagggaacaccacgagatcccgccgctacatccaaacctagcgggaagcccgctccagagaatctaaagtccccatcttggatgtcaaagtcgtag

SEQ ID NO: 205289 - DNA, 2079 bp, Artificial Sequence
  Description of Artificial Sequence: Synthetic coding sequence
atggccctggtgaccctgcagcggagccccacccccagcgccgccagctcctcagcctccaactccgagcttgaggctgggtcagaggaggaccgcaaactcaacctatccttgagcgagagcttctttatggtgaagggagcggccctgtttctgcagcaggggagttcacctcaggggcagaggtcgttacaacacccacacaaacatgctggagacttgccccagcatctacaagtgatgattaacctgctcaggtgcgaggacagaatcaaattggccgtcaggttggaatccgcttgggccgacagggtcagatacatggtagtggtatattcttctggcagacaggacaccgaggagaatatcctgctgggtgttgacttttcatccaaagagagcaagagctgtaccattggaatggtcctacgtctatggagcgataccaaaattcacctagacggggacggaggattcagcgtcagtaccgcaggtagaatgcatattttcaagccggtcagcgtccaagccatgtggagcgctctccaagttctgcacaaggcttgcgaggtggcccgaaggcataattactttcctgggggtgtggccctcatatgggcgacctattatgagagttgcataagctcggagcagagctgcatcaacgagtggaacgcaatgcaggatttggagtctactcggccagactccccagctttgttcgtagataagccaaccgaaggggaaagaactgagagactcataaaggctaagctgaggagtattatgatgagccaggacctcgaaaacgttacatctaaggaaatacgaaatgaacttgagaaacagatgaactgtaacctgaaagaacttaaagagtttattgacaacgagatgctgcttatcttgggacaaatggacaaacccagtctgatcttcgaccacctgtatctggggtcagaatggaatgcatccaatctggaggagttgcaggggagcggggtggattacatcctgaacgtaactcgtgaaattgataatttctttcctggtctgttcgcatatcataatatcagagtgtatgacgaggagaccaccgatctgcttgctcactggaacgaagcataccattttattaacaaagcgaagcgaaaccatagcaaatgcctggtccattgtaaaatgggcgtaagtcggtcggcttctacagtgatcgcgtatgcaatgaaggaatttggctggcctctggagaaagcttacaactatgttaagcagaagcgctctattaccaggccaaatgcgggatttatgcgacagttgtcagagtatgaggggatcctggatgccagcaaacagaggcataacaagctatggaggcagcagaccgatagttcgctgcagcagcccgtagatgatcctgctgggccaggggatttcctgcccgaaacccccgacggcacccctgagtctcagctgccatttctggacgacgccgctcagccaggattgggcccccccctgccatgctgtttccgcagactgtcagacccgctgttgccctctccagaggatgagaccgggtctttggtacacctagaggatcctgaaagggaggccctgttggaggaggcagcccctccagctgaggtacaccgaccggcacgccagccccagcagggaagtgggctctgtgagaaggacgtgaagaagaagctggagttcggctctccgaaagggagaagcgggagcttgctacaggtagaagagactgagcgagaagagggcttgggggcaggtagatggggccagctgccaactcagcttgaccagaatctgctgaactcggaaaatcttaacaacaattccaagcgatcctgcccaaacggaatggaggtgggtagagctcgacctgccggatggcacactccgtccctaccatcccattcaaactggcctacctctgcctcagtagttgggaccacaggcacccggcatcatactcagctgatttttttttattgtctgctttgggcaccatccagccatctgcagggacccgaaggaagcttcacagggtag

SEQ ID NO: 205290 - DNA, 4272 bp, Artificial Sequence
  Description of Artificial Sequence: Synthetic coding sequence
atggccctggtgaccgtgcagcggagccccacccccagcaccaccagcagtccgtgcgcaagcgaagccgattctggggaggaagagtgccgtagccagccccgcagtatcagcgagagtttccttacggtgaagggagccgccctgttcctgcccaggggaaatggctcctccacaccccgtatttcacaccggagaaacaaacacgcaggggatttacagcagcacctgcaagcaatgttcatcctcctccgaccagaggataatattaggctggctgtgaggctcgagagtacctaccagaaccgtacaaggtatatggtcgtggtatcgacaaatgggagacaggataccgaagagtctatcgttctcgggatggatttctcctctaacgactcttctacctgcacgatggggctcgtgctaccactctggtccgatactctgatccatctcgatggcgacgggggtttctccgtgtccaccgataatagagtgcatatatttaagcctgtctcggtacaggctatgtggtccgctctgcaatctctgcacaaggcttgtgaggtggctagggcacacaattactaccctgggagcctgttcttgacatgggtcagctattacgaatctcacattaactccgatcagtcttccgtgaacgagtggaacgccatgcaggatgtacagtcccatcgtcccgactcccccgcactatttacagatattcccaccgaaagagagcggacagagcgtctcatcaagaccaaactacgcgagatcatgatgcagaaagatcttgagaatatcacctccaaagagatcagaacagagctggagatgcagatggtatgcaatcttagagaatttaaggagtttatcgataatgagatgatcgtgatcttgggccagatggacagccccactcagattttcgagcatgtcttcctgggctcagagtggaacgcatccaatctggaagatctgcagaatagaggggtcaggtatatcctcaacgtcacacgtgagattgataatttctttccaggagtgttcgagtaccataacatccgagtgtacgatgaagaggcgacagacctactggcctattggaacgacacctacaaatttattagtaaagccaagaaacacggctccaagtgcctcgtgcactgtaagatgggtgtatcaaggagtgcaagtaccgtgatcgcctacgccatgaaagaatacggctggaacctggaccgggcctacgattacgtgaaagaacgccgtaccgtcactaaacccaatcctagctttatgcggcagctcgaagaataccagggcatcttgttggcctctaagcaaaggcacaataaactatggaggtcccattctgactccgacctgagtgaccaccacgaaccaatctgtaagccaggcttggagttgaacaaaaaggacatcacgacgtccgcagatcagattgccgaggtgaagactatggagtcccaccccccaatcccccctgtttttgtggagcacatggtgccccaagacgccaatcagaaggggctgtgcaccaaagagcgaatgatctgtctagagttcactagtagagagttccacgcaggccagatcgaagacgagttgaatctcaatgacatcaacgggtgttcaagcggatgctgtctgaacgaatctaagtttcctctcgacaattgtcatgcatcaaaggctctcatccagcctggccacgtacctgagatggctaataagttcccagatttaacggttgaggacctcgagaccgacgctctgaaagcagacatgaacgttcatctgcttccgatggaagagctcaccagcccactgaaggatccgcctatgagccctgatcctgagagtccttctcctcaaccaagttgtcaaaccgagatttctgactttagtaccgaccggatcgattttttttccgccttggagaaattcgttgagttgagtcaggagacgcggtcccgcagttttagccattctcgcatggaagaactcgggggagggcgcaacgagagttgtcggctttcagtggtagaggtggctccctctaaagtgactgctgatgaccaacgaagcagttctttatccaatacaccacacgcgtcggaggagagttcaatggacgaagagcagagtaaagcaatttctgaactggtatcaccagacatcttcatgcagtcccacagtgagaacgcaatcagcgtcaaagaaatagttaccgagatagagtcaatatctcagggggtgggacagatccagcttaaaggagacattttacctaatccatgtcacacaccaaaaaagaattcaatccatgagctgctcctcgaacgggcccagacgcctgaaaataagcccggccatatggagcaggacgaggacagctgcacggcacagcctgagcttgcaaaagacagtggaatgtgtaatcctgagggatgtcttacaacacattcctctatcgccgacctagaagagggtgagccagccgagggcgaacaagagttgcagggaagcggtatgcaccctggcgccaagtggtacccaggaagcgtgcggcgggccaccttagagttcgaagagcggctcaggcaggagcaagagcaccacggggccgcacccacctgtacatctcttagtacccggaaaaacagcaaaaatgactctagcgtcgccgacctggctccaaaagggaagagcgatgaggccccaccagagcatagctttgtgttgaaggaaccagaaatgtcgaaaggcaagggcaaatactcaggctccgaggctggtagcctgagtcacagcgagcagaacgcaactgtcccagcccctcgcgtcttagaatttgatcacctgccggatcctcaggagggccccgggtcagacactgggactcaacaggaaggggttttaaaggatctgaggaccgtgattccatatcaggaaagcgagactcaggctgtgccgcttccactgccaaagagggtggaaattattgagtacacccacattgtgacgtcccccaaccacaccggcccaggctcagagatcgcaactagcgagaagagtggagaacaggggctacgcaaggtgaatatggaaaagagtgtgactgtcctctgcaccttggatgaaaacctgaacagaacactggatcctaatcaggtgagtctgcacccacaggttctgcccctcccccacagttctagccccgagcataataggccaactgatcaccccacgtccatcctgtcatctccggaagatcgggggtcaagtctcagcaccgctctggagacggccgcgcccttcgtgtcacatactacacatctcctgtctgcgagtcttgattacctgcatccacagactatggttcacctcgagggattcaccgaacagtcttccaccacagacgaaccctcggccgaacaagtgtcatgggaagagtcccaggagtctcctcttagcagcggtagtgaggttccttataaagactcacagctgagcagtgcagacctgagtttaatttcaaaactcggggacaatacaggagagttacaggagaagatggacccactgccagttgcctgtcggcttccacactccagttcttctgaaaacatcaaatccctgagccattccccaggggttgtgaaggagagggccaaagaaattgagagtcgcgtggtgtttcaagccgggctcactaaacccagccagatgagaagatcagcttcactcgccaaactgggatacctggacttatgcaaagactgccttcccgagcgcgagcctgcttcttgcgagtccccgcaccttaaactcctgcagccattcttgagaacagattcgggcatgcatgcaatggaggatcaggagtcactcgagaatcccggagctccacataatcctgagccaaccaaatccttcgtggaacagctgacaactacagagtgcattgtgcagagcaagcctgtcgaaaggcctttggtgcaatacgcgaaagagtttgggtcttcacaacaatatctccttccccgggctggcctggagttaacttcctctgaaggggggttgcccgttctacagacccagggcctgcaatgtgcctgcccggctcccggtctggcagttgcgccgcgccagcagcacggcaggacccaccccctgcgccgcctcaagaaagccaatgacaagaagaggactactaacccattctacaacacgatgtag

SEQ ID NO: 205291 - DNA, 609 bp, Artificial Sequence
  Description of Artificial Sequence: Synthetic coding sequence
atgaccctgagcaccctggcccggaagcggaaggcccccctggcctgcacctgtagcttgggagggccggatatgattccatatttctctgcgaatgccgtcataagccagaatgccatcaatcagctaattagtgaaagctttctcaccgtcaaaggcgctgctctgtttttacctagggggaacggcagttcgacgccacgcatttcgcatagaaggaacaaacatgctggcgacttacaacagcacctgcaggcgatgtttattctgctgcggccagaggacaatattagactcgctgtgcggctggagtccacttaccaaaacagaacacgctacatggtggtggtcagtactaacggacgccaggacaccgaagagtctattgtgttgggtatggattttagttccaatgatagctctacctgcacaatgggtctggtgctccctctctggagtgacactttaatccacttagacggagacggcggctttagcgtgagcactgacaaccgggtgcacattttcaaacctgtgagcgtccaagccatgtgggtagatcgggacagcagaaacaagcactgtgatgtactgttggtcgaagagtag

SEQ ID NO: 205292 - DNA, 1350 bp, Artificial Sequence
  Description of Artificial Sequence: Synthetic coding sequence
atggccctggtgaccgtgcagcggagccccacccccagcaccaccagtagcccatgtgccagcgaggccgacagtggtgaagaggaatgtcggagtcaaccccgtagcatcagtgaaagtttcctcaccgtgaagggcgctgcgctcttcttgcctcgaggaaacggatcctctaccccacggatctcgcaccgccgtaataaacacgcgggtgatctccaacaacacctccaggccatgttcatcctcctgaggcctgaagacaatatcagactggctgtcaggctcgagagtacctatcaaaataggacaaggtatatggtagtagtctctacaaacggccgccaggatacggaagagtccatcgtgttaggcatggatttttcgagcaatgattctagcacctgtaccatgggcctggttttgcccttatggagtgacacactgattcatctagacggtgatgggggattctccgtatccacagataaccgcgtgcacattttcaagccggtgtccgtacaagcgatgtggagcgccttacagagcctccacaaggcttgtgaggtggctagagcacacaattactatcccgggtccctttttctcacctgggtgagttattatgagtcacacatcaactctgatcagtcgagcgtcaacgaatggaacgcaatgcaggacgtgcagagccataggcccgattccccagccctcttcacagacatccccaccgaacgggagcgcactgagaggctgattaaaacaaagctgcgggaaattatgatgcagaaagaccttgaaaacattacatccaaggaaattcgcaccgagctcgaaatgcagatggtatgcaacctgcgggagtttaaggagttcattgacaacgagatgatcgtgattctggggcaaatggatagtcccacgcagatctttgagcacgttttcctgggttctgagtggaatgcatcaaacctggaggacctgcaaaacagaggtgtgcgatacatcctaaacgtcactcgcgaaatagacaacttttttcctggtgtcttcgagtatcataacatccgcgtgtatgatgaagaggcgacagatctcctggcatactggaatgatacctacaaatttatttccaaagccaaaaaacatggctctaaatgcctcgtccactgtaagatgggtgttagcaggtcagcaagtaccgttatcgcctatgccatgaaggagtatgggtggaatctggatcgggcttatgactatgtaaaagagaggcggacggtgaccaagcccaacccgagttttatgcggcagctggaggagtatcagggaatcctacttgcccgctag

SEQ ID NO: 205293 - DNA, 4353 bp, Artificial Sequence
  Description of Artificial Sequence: Synthetic coding sequence
atggccctggtgaccgtgcagcggagccccacccccagcaccaccagtagcccttgcgcatctagctctcaccttgaagatagtgagtccgccgccttgctctgctgtgaatgcgaagagtcagaaattttcaccgactctaacgaggccgactctggcgaggaggaatgtcgatcgcagcctcgaagcatcagtgagtctttccttacagtgaagggcgcagcactgttcctccctcgggggaacggcagtagcaccccccgcatcagtcaccgtcgcaacaagcatgctggggatctgcaacagcacctgcaggctatgtttatactgcttcggcccgaagataacattcgactagccgtaagattggagagcacttaccagaaccggactagatacatggtcgttgtaagcacgaacggccgccaggatactgaagagtctatagtcctgggcatggacttctcatccaatgacagctcgacgtgcacaatgggcctggttctgccactgtggtcggataccctcatccacctcgacggggatggcgggtttagtgttagcactgacaatcgcgtacatatctttaagccagtatctgtgcaggcaatgtggtcggctctgcagtctcttcataaggcctgcgaggtggctagagcccacaactactacccgggtagtctgtttctgacctgggtgtcttattatgagtctcacattaattctgatcagtccagcgtgaatgaatggaacgctatgcaagacgtgcagtcacaccggccagactctccagcactcttcaccgacatccccaccgagagggagagaaccgagcgcttgattaaaacaaaactgcgggagatcatgatgcagaaggacctcgagaacatcaccagcaaagaaatccggaccgaactcgaaatgcagatggtgtgtaacctgcgggaatttaaggaattcattgataatgagatgatcgtgatcctgggacaaatggatagccccacccagatcttcgaacatgtattccttggctctgaatggaatgcctctaatctcgaggacctccagaatcgcggcgttcggtacatcttaaatgtcactagggagatagacaatttttttccaggagtattcgaataccataatattcgagtttatgacgaagaagcgactgatctgctggcatattggaatgatacctataagtttatctccaaggccaagaaacacggttcgaaatgtctggtccattgtaagatgggcgtatcgcgctccgcatcaacggtcattgcctacgctatgaaggaatatggatggaatttggatagagcctacgactacgtgaaggaacggcgaactgttaccaaacccaatccctccttcatgcgtcaactcgaagagtatcagggtattcttttagcgtcaaaacagcggcataataaactgtggcgcagccatagtgacagtgatctgtcagatcatcacgaacccatatgtaagcctggcttggaactgaacaagaaagacattaccaccagcgcagaccagatcgccgaggtgaaaaccatggaatctcaccccccgatcccaccggtctttgtggaacatatggttccccaggacgcaaatcagaagggcctgtgcacgaaggaacgaatgatctgtctcgagttcacttctcgagaatttcacgccggccagatagaagacgagctcaacctcaacgacattaatgggtgcagctccggctgctgcttgaatgagagcaaattcccgctggataattgccacgcctcgaaagctctgatacagcctgggcacgtgccggagatggcaaacaagttccccgacctcaccgtcgaggatctcgagactgatgcacttaaagctgatatgaacgtgcacttgcttccgatggaggagttaacatcacctttgaaggaccctcctatgtcccccgatccagagagcccgagcccacagccctcctgccagacggagatttctgacttctcaacggaccgcatagatttcttttctgcacttgagaaattcgtggagctgtcgcaggaaacacgcagtagaagtttctcccatagcagaatggaggagctgggcggggggagaaatgaaagttgccggctatcagttgtcgaggtggccccttcaaaagtgacggccgacgaccagcggagtagctcactctccaatactccgcacgcgagcgaggagtccagcatggatgaggagcagtccaaggccattagcgaactggtgtcccccgacatatttatgcagagccactccgaaaatgccatttctgttaaagagattgtgacagagatcgagagtatttctcaaggtgtcgggcagattcaactaaaaggggacatcctgcccaatccctgccatacacccaagaagaattccatccacgagttgctcctggagagagcccaaactcccgagaataagccaggtcatatggaacaagacgaggactcctgtacggctcaacctgagctggccaaggatagcggtatgtgcaatccagaaggttgtctgacgacccactcttcaattgctgatctggaggagggtgagcccgccgagggcgaacaggagctgcaaggcagcgggatgcaccctggggccaagtggtatcccgggagtgtgaggcgggcgactctcgaatttgaggagcgcctgcgacaggagcaggaacaccacggtgcggccccaacatgtacctccctatccacgcgcaaaaatagtaaaaatgactcttcagtggcagacctcgcaccaaagggtaagtccgacgaggccccaccagagcatagcttcgttctcaaagaacccgaaatgtctaaaggtaagggtaagtactctggctcagaggctggctctctgtctcactcagaacagaatgcaacggtgccggctccacgggttttggaatttgaccacctgcctgatccgcaagagggccccggaagcgacacaggaacacagcaggagggtgtgctgaaggatctccgcaccgtcatcccttaccaagagtctgagacccaggccgtgccactgcccttgccaaaacgtgtagagattatcgagtacacacacattgtgactagtccaaaccatactgggccagggtcagagatcgccaccagcgagaaatctggagagcagggccttaggaaggtgaatatggaaaaaagtgtgactgtgctgtgcacgctggacgagaatctcaaccggactcttgatccaaatcaagtatccctgcatcctcaggttctccccctgccacatagtagctcccctgaacacaaccgccccacggatcatcctactagtatactcagctcccccgaagatcggggatcatccctgtccacagcgctcgagaccgccgcgccattcgtgagccatactactcatcttctctcggccagcctcgattacctccatccccagaccatggtacaccttgaaggcttcactgaacagagcagtaccacggacgagcccagtgctgaacaggtgtcatgggaggaaagtcaagagagtccactctcctctggctcagaggtcccttacaaggatagccaactatcatcagctgatctctcactgatcagtaaactcggtgacaacacaggtgagctccaggaaaagatggacccactgcctgtagcttgccgcttacctcattcttcctcctctgaaaacataaagtctttgagtcactctcccggagtggtgaaagagcgcgctaaggaaatcgaaagcagggtggtgtttcaggctggactaacaaagcctagtcagatgcggagatcagcatccctggccaagctgggttatctcgatctttgcaaggactgccttccagaacgggagcccgcatcgtgcgaatcaccccatctcaagctgctgcagccctttctcaggaccgatagcggcatgcacgcaatggaagaccaggagtctcttgaaaaccccggtgcccctcacaatcctgagccaactaagagcttcgtcgaacaactgacgacgactgagtgcatcgtccagtctaagccagtagagagaccactcgtacagtacgcgaaggaattcgggtcatctcagcagtatctactccccagagccggattggaattgacaagctccgagggtggcctccctgtgctgcagacacaagggctccagtgcgcttgccccgcgccaggtttggctgtggccccacgccaacagcacggtcgcacccacccgctccgtaggctgaagaaggcgaacgataaaaagagaaccacgaaccccttttacaatacaatgtag

SEQ ID NO: 205294 - DNA, 1980 bp, Artificial Sequence
  Description of Artificial Sequence: Synthetic coding sequence
atggccctggtgaccgtgagccggagcccccccggcagcggcgccagtactccggttgggccctgggatcaggcagttcaaaggaggtccagattgcagagaaggcagtcatttgcagttctgcggggtgccgtgctcgggctgcaggacggcggggacaatgatgacgcagctgaggcttcctctgagcccaccgagaaggccccgtcagaagaggaacttcatggtgatcagacagactttggccaaggaagccagtcaccccaaaagcaggaggagcagcggcaacacctccacctaatggtacagttgctgagacctcaggacgatattagattggcagcgcagctggaggccccaaggccccctcggttacgctatctccttgtggtttcaacccgagagggtgaaggcttgtctcaggacgagaccgttttattgggagtcgactttccagatagctctagcccttcctgtaccttaggcctcgtcctgcccctatggtcagatacccaagtttacctcgacggtgacggaggcttctctgtgacttctgggggacagagccgaatctttaagcccatctccattcagacaatgtgggccactttgcaggtgctgcatcaagcatgcgaggctgcgctgggctcgggcctcgtaccaggaggctcggcgcttacatgggcttcacattatcaagagcgcctaaacagcgagcagtcgtgcctcaatgagtggaccgctatggctgacctggagagtctacggcccccaagtgcagagcctggaggtagctccgagcaggaacaaatggagcaagctattagagcagaattgtggaaagttctggacgtctcagacctggagtccgtgacttcgaaggagatacgccaggcactggagttaaggcttggcctccctcttcaacaataccgggatttcattgacaatcagatgctccttctcgtagctcaacgtgaccgcgcttcccgcatattcccacacctgtacctggggagcgaatggaatgccgctaacctggaggagctgcagcggaatagggtgacacacatcttgaacatggctcgcgagatagataacttctacccagaaaggtttacgtaccataatgtgaggctgtgggatgaagaatccgcccagctgctgcctcattggaaggagacccaccgtttcatcgaggcggcccgggcacaaggtacacacgtgttggttcactgcaagatgggagtatcccgcagcgcagccactgtgttggcttacgctatgaagcagtacgaatgcagtctggagcaagctctgcggcacgtccaggaattaagacccattgctagacctaatcctggatttctgcgccagctccaaatctaccagggtattttgactgcgagccgccagagtcacgtgtgggaacagaaagtgggaggcgtctcgcccgaagagcaccctgcgccagaagtttcaaccccattcccccctctaccacccgaacctgagggagggggggaagagaaggtcgtgggcatggaggagtcccaggcagcaccaaaggaagagccggggccaagaccaaggattaacttgcgtggtgtcatgaggagtatctcactccttgaaccaagcctggagttggagagcaccagtgagacctcagatatgcccgaagtctttagcagccatgaatcttctcatgaggagccactgcagccgtttccacagcttgcccggacaaaaggtggccagcaggtcgacagaggcccacagcccgcactgaagtctaggcagtctgttgtcactctgcagggcagcgctgtagtcgcaaacagaacacaggcttttcaggaacaggagcaggggcaggggcagggccagggcgagccgtgcatttcaagcacgcccagattccgaaaagtagtacggcaagcgtctgtccacgacagtggagaggaaggcgaggcctag

SEQ ID NO: 205295 - DNA, 2091 bp, Artificial Sequence
  Description of Artificial Sequence: Synthetic coding sequence
atgctgctgtggatcctgctgctggagaccagcctgtgcttcgccgccggaaatgtgacaggtgacgtgtgtaaggaaaagatctgttcgtgtaatgagatcgaaggcgatctccacgttgactgcgaaaaaaagggattcaccagtcttcagagattcacagcaccaacttcccagttctaccacttgtttcttcatggaaattccctaactcgcttatttccgaacgagttcgctaacttttacaacgcagtctctctccatatggaaaacaacggcctgcacgagattgttcctggagcattcctaggcctccaactggtgaaacggttgcacattaataacaacaagataaagtcattccgcaagcagacctttctgggcctggatgatctggagtacctccaggcggattttaacctgttaagggatattgacccaggagccttccaggatctgaacaaactggaggtgctaatcctgaatgataatttgatttccaccctgcctgctaatgtatttcagtacgttccgattactcacctggacctgagggggaatcgactgaaaaccctaccatacgaagaagtcttagaacagatccccggaatcgccgagatcctgcttgaggataatccatgggactgcacttgtgacctcctatcactgaaagagtggttagaaaacatcccaaaaaacgctttaataggacgcgtggtatgcgaggctccaacccgccttcaaggaaaggatcttaacgagactactgaacaagacctctgccctctgaagaaccgggtggattcttcactccctgctcccccggcccaggaggagacttttgcacccggaccgctccccacccccttcaagaccaatgggcaggaagaccatgctactcctggatccgctcccaacggcgggacgaaaatccctggcaattggcaaataaagattcggcccactgctgccatcgctactggcagctcccggaacaagccactcgccaacagcctgccatgcccaggcgggtgtagctgcgaccatattccaggtagcggcctgaaaatgaattgcaataaccgtaatgtcagctcgctggcagatctgaagcctaaactgtccaatgtacaggaattgttcttacgggataacaaaattcactcaatacggaagagccactttgtcgactacaagaatctgatcctcttagacctgggcaataataatattgctaccgtcgaaaataatactttcaagaatctcctggatttgcgttggctgtatatggattctaactatctcgacaccctgagtagagagaaatttgcaggcttgcagaatttggaatatttaaatgtcgagtacaatgccattcaattaatactacccggtacatttaacgctatgcctaaattaaggatcctgatcctgaataataacttactgaggtctcttcccgtcgatgtgtttgcaggggtcagtctgtctaaactttcccttcataacaattactttatgtatctcccggtcgccggggtgctggatcaattaacaagcataatccagatcgatcttcatggcaatccctgggaatgcagttgtactatcgtgccttttaaacagtgggcggagaggctcgggtcagaggtgcttatgagcgacctcaaatgcgagactccagtcaacttctttagaaaggacttcatgctcctttcaaacgacgagatttgtcctcagctttatgctcgaatatccccgacactgaccagtcactcgaagaatagtaccggcctggctgagaccggcactcactcaaacagttacctggatactagtcgggtatcaatttccgtcctggttccaggtctcctactcgtgttcgtgacatctgcttttaccgtcgtggggatgctggtgtttatcctgagaaataggaaacgctctaagcgccgcgatgccaactccagcgcttccgaaataaacagcctacagactgtgtgtgatagctcctattggcacaatggcccctataatgcggacggagctcatcgggtgtacgactgtggtagtcacagtctatccgattag

SEQ ID NO: 205296 - DNA, 2175 bp, Artificial Sequence
  Description of Artificial Sequence: Synthetic coding sequence
atgctgagcggcgtgtggttcctgagcgtgctgaccgtggccggcatcctgcagacagagtctcgaaagaccgcgaaggatatttgtaagattagatgcctctgcgaagaaaaggagaacgtgctgaacatcaactgcgaaaataaaggcttcacgaccgtgtctctgctgcagccaccacagtaccggatctatcaactatttttaaacgggaacctgttaacccgactgtaccccaatgagttcgtgaattatagcaatgccgttacactgcatctcggcaacaacggccttcaggaaatcaggactggcgccttttcaggtctcaaaactttgaaaaggctccacctgaacaacaataagctcgaaatcctgcgggaggatacatttctgggattggaaagtttggagtatctccaagccgactacaattacatttccgctatagaggccggggcattcagcaagctcaacaagctgaaagtgctgattctcaatgacaatctgcttctatccttgccaagcaacgtgttcagattcgtgctgctcactcacctggatctccgggggaataggctcaaggtgatgccgttcgcaggcgttttagaacacataggagggatcatggagatccagctcgaagaaaatccgtggaattgtacctgcgacctgctgccattgaaggcttggctggacaccatcactgtgtttgtgggagagattgtctgtgaaacccctttccgactccatgggaaagacgtgactcaactaaccagacaggacctgtgtccacgtaagtctgcctccgacagctctcaacgcggcagccacgctgatactcacgttcagcgcctgtctcctaccatgaatcctgcactgaaccccacccgagccccgaaagcatctcgccctcccaagatgcgcaaccgcccaactccgagggtaaccgtctctaaagacaggcagtcctttggcccgattatggtgtatcagaccaagtcacctgtccccctcacctgtccttcttcttgcgtgtgcacttctcagtcatctgacaacgggcttaacgttaactgtcaagaaagaaagtttacaaacattagcgacctgcaaccaaaacccacttcacctaaaaagctttacctcaccggaaattacctgcaaacagtgtacaagaatgacctcctggagtattcctccctagacttacttcacctcgggaacaaccgaattgcagtgatacaggagggggcttttaccaatctcacatctctccgccgtttatatttaaatggaaattacctcgaggtgctctacccttctatgtttgatggcttgcaatctttgcagtacctgtatcttgaatacaacgttattaaagaaataaagccactgacattcgatgccctgatcaatcttcagctgctttttctgaacaacaatttgctcaggtctctgcctgataacatttttggagggacagctctcactaggctgaacctgaggaataaccacttctctcatctgcctgtgaagggggtgctcgaccagctacctgctttcattcagatcgatctgcaggagaatccgtgggattgtacctgtgatataatgggtcttaaagactggactgagcatgccaactctccggtgataatcaatgaagtcacctgcgaatctccggccaaacacgcgggagagatcctgaaatttctggggagagaggctatctgccccgacagccccaatctttccgacgggacagtgctctccatgaaccacaacactgacacgccacggtccttatccgtatctccttcttcctaccctgaattacatacagaagttccattaagtgtgctaattttaggcctcctggtggtgtttatattgtctgtctgcttcggcgccggcctgttcgtatttgtgctcaaacggaggaagggggtgccatccgtgccacgcaataccaacaatcttgacgttagctccttccagctccagtacggatcctataatacagagactcacgataagaccgacggccacgtttataactatatcccacctccagtgggacagatgtgccagaatcctatttacatgcagaaagaaggtgaccccgtggcatactacaggaacctgcaagaattttcctactctaacctggaatag

SEQ ID NO: 205297 - DNA, 2538 bp, Artificial Sequence
  Description of Artificial Sequence: Synthetic coding sequence
atgctgagcggcgtgtggttcctgagcgtgctgaccgtggccggcatcctgcagactgaatcgaggaagaccgcgaaagacatctgtaaaattcgctgtctctgtgaagagaaggaaaatgtactgaatataaattgtgagaacaagggctttactactgtgtctctcctgcaacccccgcagtataggatctatcagctgtttttaaacggtaacctgctaactagactgtacccgaatgagtttgttaattacagtaatgctgtgacactgcaccttggaaacaatggtttgcaagagatcagaactggcgccttttctggcttaaaaactctgaagaggctgcaccttaacaataataagctcgaaattctgcgcgaagatacattcttgggcctggaaagtctcgaatacttacaggccgactacaattatatcagcgctatcgaggccggagcgttcagcaaactcaacaagctcaaggtcctgatcctcaatgacaacttgctgctctccctgccctccaatgtctttagattcgtgttgctgacccatttagatctgcgaggaaacagactaaaggtgatgccattcgccggagtgttggaacatatcggaggcatcatggaaatccagctggaggaaaatccctggaactgtacctgtgatctgctgccacttaaggcctggctggacacaattacggttttcgtgggtgagattgtttgtgaaacgccatttaggctgcacgggaaagacgttacccagttgacccgccaggacctttgccctcgcaaaagtgcatccgactcttctcagcggggctcgcacgctgacacccacgtccaacgcttgtcgccaactatgaatcccgctcttaatcccaccagagcacccaaggcgtctcgccctccgaagatgcgcaatcggcccaccccaagggttaccgtgtctaaggatcggcagtcattcggacctattatggtctaccagaccaagagccccgtaccacttacctgccctagtagctgtgtgtgcacctctcagtcctcagataatggtctgaatgtaaattgccaggaaaggaagtttacaaatatatcagaccttcagcccaaacccacgagcccaaagaagctttaccttaccggaaattacctgcaaacagtgtacaaaaatgatctgctcgaatattcgtccttggacctccttcacttggggaataatagaattgcagtcatccaggaaggcgcctttaccaatttgacttcactccggcgtctgtatctgaatggcaattacctggaagtcttgtacccatcaatgttcgatggccttcagtctttacagtacctgtacctggaatataatgtgatcaaggagatcaaacccctgacgttcgacgctctgattaaccttcagctgctgttcctaaacaataatttgctgagatctctccctgataacatcttcggagggacagccctgacacgcttgaacctgagaaataaccatttttcccacctccctgtaaagggtgtcttagatcagctgccggcttttattcagattgatctgcaggaaaatccttgggactgtacctgtgatattatgggcttgaaagactggacagagcacgcaaattcccccgtgataattaacgaagtgacctgtgagagccctgccaagcatgcaggtgaaatcttgaagtttctgggtcgcgaggccatctgtcccgatagccccaatctcagtgatggtacagtgctctcgatgaaccacaataccgacacacctcggtcattaagcgtgtccccctcatcttaccctgaactgcataccgaagtccctttgagtgtcttaattctgggactccttgttgtgtttatcctatccgtatgctttggggctggcctgtttgtttttgtcctgaagcggcggaaaggagtcccctccgtacccagaaacacaaacaacctggacgtcagttcctttcagctgcagtacgggtcctacaatacagaaactcatgacaagacggacggtcacgtctacaactatataccccctccagtggggcaaatgtgtcagaatcccatatacatgcagaaagagggcgatcccgtcgcgtattacaggaatctccaagaatttagctactctaatctggaggaaaaaaaggaagagcccgccacgcctgcttacactatatctgccactgagctgctcgagaagcaggcgacaccccgggaacccgagttactgtatcaaaacattgctgaaagggtgaaagagctgccttcagctggattggtgcattataacttttgcacactgccaaagaggcagtttgctccctcctacgagtcaaggcgccagaatcaggatcgaatcaataaaacagtgctatacggtacgcctcggaagtgctttgtgggccagtccaaacccaatcacccactgctgcaggccaaaccacagtccgaaccagactacctggaggtcctggagaaacagaccgcaatctctcagctgtag

SEQ ID NO: 205298 - DNA, 2538 bp, Artificial Sequence
  Description of Artificial Sequence: Synthetic coding sequence
atgctgagcggcgtgtggttcctgagcgtgctgaccgtggccggcatcttacagaccgagtcccggaaaacagcaaaggacatctgcaaaattcggtgcctgtgtgaagagaaggaaaatgtccttaatatcaactgcgaaaataagggatttactacagtgtctctccttcagcctcctcaataccggatctaccaactgtttctgaatggcaaccttctgacgcgtttatatccgaacgagtttgtgaactacagcaacgccgtgactctgcacctcgggaataacggcctacaagaaatccgtactggggccttctccggactcaagaccctgaaaaggctgcatctgaacaacaacaagctggagattctcagggaagataccttcttgggcctggaaagcctcgagtacctgcaggccgattataactacatcagtgccattgaagcaggagcttttagcaagctgaataagctgaaagtgctgatccttaacgataacctgttgctaagtctgccaagcaatgtcttccgctttgtgctcctcacccatcttgatctccgtggaaatcggcttaaggtgatgccctttgctggcgtgctggagcatatcgggggcatcatggaaatacaactggaagagaacccatggaactgtacatgcgaccttctccctcttaaggcatggctggataccataactgtgttcgtgggagagatcgtctgtgaaacgccctttcgactgcatggaaaggatgttacacaacttactaggcaagacctgtgcccgcgcaaatccgcctctgatagctctcagagaggcagtcacgctgacacacacgtgcaacggctctctccaactatgaaccccgccctcaaccccaccagggcaccaaaagcatcccggccaccgaaaatgcgcaacagacccacaccacgggtgaccgtctccaaggacagacagtcgttcgggcctatcatggtctaccagacaaaatcacccgtgcctctcacctgtccctctagttgcgtgtgtacttcacagtctagcgataatggacttaatgtaaattgccaggaaagaaagtttaccaacatcagcgacttacaaccgaagcctacttcaccgaagaagctctacctgaccggaaattatctccagactgtgtataagaatgacctgctggaatattcttccctcgatctgcttcatttgggaaataatcgaatcgctgtgattcaggagggggcattcactaacctcacatcactgcgacgattgtatctgaacgggaattatctggaggtactctacccctcaatgttcgacgggctgcaatcattacagtatctgtacctggaatacaatgtgataaaggagatcaagccactgaccttcgatgcactgataaatctgcagctgctgtttctcaataacaatttgctgcgtagcttacccgataatattttcggcgggactgcactgacgcgactgaacctgcggaacaaccacttctctcatctgcctgtgaagggtgtgctggaccagctaccggccttcattcagatcgatcttcaggaaaatccttgggactgtacctgcgacattatgggactgaaagactggaccgaacatgccaattcaccagtgatcataaatgaagtcacctgtgaatcgccggccaagcacgcgggtgagatactgaaatttctgggtcgcgaagcaatctgtcctgattcacccaatctgagtgatggcaccgtactgtctatgaaccacaatactgataccccccgttcactttcagtgtccccatcctcttacccagagttgcacaccgaggtgccattatctgtcctgattctgggactcttggtggtgtttattttgagtgtctgctttggagccgggctattcgtgttcgttctcaaacgtcgtaagggagttccgtcagtcccacggaatactaacaacctggacgtcagcagcttccagctgcagtacgggtcctacaataccgaaacacatgataaaacggatgggcacgtatacaactacatccctccccccgtgggccagatgtgtcaaaaccccatctatatgcagaaggaaggcgaccctgttgcctattacaggaatttacaggaattcagttattctaatctggaggagaagaaggaagaaccagcgactccagcgtacactatatctgccaccgagctcctggaaaagcaagcaaccccacgggaaccggagctactataccaaaatattgccgagcgcgtaaaagagctgccatctgccgggctcgttcactataacttctgcacactgcccaagagacaatttgcaccctcatatgaaagccgtagacagaaccaggaccggatcaacaagacagtgttgtatgggacgcccagaaaatgtttcgtggggcaaagtaagcccaaccacccgctgctgcaagctaaacctcagtctgagccggattacttggaggtgctggaaaagcaaaccgccattagtcagctatag

SEQ ID NO: 205299 - DNA, 2538 bp, Artificial Sequence
  Description of Artificial Sequence: Synthetic coding sequence
atgctgagcggcgtgtggttcctgagcgtgctgaccgtggccggcattctgcaaacagagtccagaaaaaccgcaaaggatatatgcaaaattagatgcctctgcgaagagaaggaaaatgtactaaacattaactgtgagaataaagggtttactactgtgtccctgctgcaacccccccagtaccggatctatcagttattcctgaacggtaatctcctgactcgcctctatcctaacgaattcgtgaactacagcaatgccgttaccctacacctgggcaacaacggactgcaggagatccgcacaggagcgttttcggggctcaagacccttaagcgcttacacttgaacaacaataagctcgagatcttgcgggaggacaccttcttaggtttagagagcctggaatatcttcaggcggattataactacatcagtgcgatagaggcaggggcctttagtaagctcaacaagttaaaggtcttaattctgaacgacaacctgctgctgtccctcccgagcaatgttttccgttttgtcttgctcactcacctcgacctcagaggtaacagactcaaagtgatgccctttgcgggagtgctggagcacatcggtggaattatggaaatccaactagaagagaatccctggaattgcacctgcgatctgctcccactgaaagcgtggctggatacgatcactgtatttgtcggcgagattgtgtgcgagacaccgttccgcctccacggcaaggacgtgactcagctgaccagacaggatctctgtcctagaaagtcagcgtccgatagtagtcaaagggggtcacatgccgacacacatgtacagagactgagtcccacaatgaatcctgcgttgaatcccacgagggcccctaaggcatcccggcctcctaaaatgagaaaccggcctacccctcgagtgacagtctcaaaagaccggcagagctttggcccgatcatggtctaccagaccaaaagcccggtaccgttgacatgccctagctcttgtgtctgcacatcccagtcttctgacaatggcctgaatgtgaattgccaagagcgaaaattcaccaacatctccgacctgcagcctaagcctacatctcccaaaaaactctacctgactggcaactacctgcagactgtttataagaacgacctcctagaatatagctcccttgacctgttgcacctaggcaacaaccgcatagccgtgatccaggagggcgccttcaccaacctcacctcgctgcgccgtctctacctaaacggaaattatctggaggtcctgtacccttccatgtttgacggcctgcagtctctgcagtacctgtacttggagtataatgtgatcaaggaaattaaacccttgaccttcgacgctctcatcaatttgcaattactcttcctgaataataaccttttaagatctcttcctgataacatttttggagggaccgcactgacgcgattgaatttgaggaacaaccacttctcacacctccctgtcaagggcgtgttggaccagctcccagcatttatccagattgacctgcaagaaaacccctgggactgcacgtgtgacatcatgggcttgaaggactggactgagcacgccaattcacctgttatcatcaacgaggttacgtgtgaaagccccgcgaagcacgccggggagatcctcaagtttctgggacgggaagctatttgtccagacagtcctaatctgtcagacggcacagtgctgagtatgaaccacaacactgacacgcccaggagtctgtcagtgtcccctagtagttacccagagttgcatacggaagtccctcttagcgtcctgatcctcggattactagtcgtgttcattcttagcgtatgctttggcgccgggctgtttgtctttgtcttgaagaggcgtaaaggcgtgcctagcgttccaaggaataccaacaatcttgacgtcagcagtttccagctccaatatggcagctacaacactgagactcatgacaaaacagatgggcatgtctacaactacattcctccccccgtgggccaaatgtgccagaaccctatctacatgcaaaaagagggggaccccgtggcctactaccgaaatctgcaggaattctcctatagcaatctcgaagagaaaaaagaagaaccggctacacctgcctatacaatctctgccactgagctcctggagaagcaggcgaccccacgggaaccagaactcctgtaccagaacatcgctgaaagagttaaagagcttccttctgctggcctggtgcactataatttctgtacccttccaaagcgtcagtttgcacctagttacgaatcccgtcggcagaatcaggatcgcattaacaagaccgtcctctacggtacacccaggaagtgctttgtcggtcagtccaaacctaaccatcctctgcttcaggctaaacctcagagtgagcctgactacttggaagtgttggagaagcagaccgccataagtcagctatag

SEQ ID NO: 205300 - DNA, 2538 bp, Artificial Sequence
  Description of Artificial Sequence: Synthetic coding sequence
atgctgagcggcgtgtggttcctgagcgtgctgaccgtggccggcattcttcagacagagagcaggaaaacagcaaaggatatttgcaagatacggtgcctgtgcgaagagaaggaaaacgtcctaaacattaattgcgagaacaaaggctttactactgtaagtctgcttcagcctccccagtatcggatttaccagcttttcctaaacgggaacctgctgacccgactgtacccgaatgaatttgtgaactattccaatgcggtgactctccacctggggaataacgggctacaagagattagaaccggggctttcagcgggctcaagacgctaaaaagactgcacctgaataacaataaactggaaatcctgcgggaggacaccttcctcggtctcgaatccctcgaataccttcaggctgattataactacattagcgccattgaagccggtgcattttcaaagctcaacaagctgaaagtgctgatcctgaatgacaacctgctgctgtcattaccaagtaatgttttcagatttgtcttattgactcatctggaccttcgagggaacaggctgaaggtgatgccattcgccggagttctcgagcacatcggggggatcatggaaatacagcttgaagagaacccttggaattgcacatgtgatttgctgcccttgaaggcttggttggacacaataactgtgtttgtgggagaaatcgtgtgtgaaacacccttcaggctacacggtaaggatgtgacccagttaactagacaggatttatgccctcgcaagtccgcgagtgatagctcacaaaggggtagtcatgcggatacacacgtccagagactgtcacctacgatgaaccctgcactgaatcctaccagagcccctaaagccagcaggccgccgaagatgagaaaccgaccaacacctcgggtcaccgtgagcaaagatagacagtctttcggccctattatggtgtatcagaccaagtctcccgtgcccctaacgtgcccctcaagttgcgtgtgcacgtctcagtcaagcgataatggcttgaatgtcaattgtcaggaacgtaaatttaccaatattagtgaccttcagcctaagcccacctctcctaagaagctgtacctgacaggaaattacttgcaaaccgtttataagaacgacttgctagagtactcttcactcgatctcctgcatttaggaaacaatagaattgctgttatccaggaaggagctttcacaaatttgacaagtcttcgacgcctctacctcaacggtaactatttagaggttttataccctagtatgtttgacgggcttcagagcctacagtatttgtacctggaatacaacgtcattaaggagatcaagccattgacattcgacgccctaattaatctgcaactacttttcttaaataataacctgttgcggagtttgccggataatatcttcggtggaaccgccctgacacgcctgaatctccggaataaccacttttcccatctgccggtcaagggggtcctggatcaactgccagcatttattcagatagacctgcaggaaaatccatgggattgtacttgcgatataatgggccttaaagattggaccgagcatgccaacagtccagtcataatcaatgaagtgacttgcgagtctccggccaaacacgctggcgagatcctgaaattcctgggccgagaggcgatatgcccagactcccctaatctcagtgacggtactgtactctccatgaaccacaataccgacacaccccgttctctgtcagtgagtccaagttcataccccgagctccacactgaagtcccactcagcgtcctaatactcggcctgctggtcgttttcattctaagcgtctgctttggcgctggccttttcgtttttgtcttaaaacgccggaagggagtgccgtccgtcccccggaacactaataatctggacgttagcagtttccagctgcagtacggcagctacaacaccgaaacccacgacaagacagacggccacgtttacaattacatcccaccacccgtcgggcagatgtgccagaatcccatttacatgcagaaagagggagaccccgtcgcttattaccgcaacctgcaggaattttcctatagtaaccttgaagagaaaaaagaggaacccgcaactccggcatacacaatctccgccaccgaactgctcgagaagcaggccaccccgagggagcctgaacttctataccagaatatcgctgaaagagtgaaagaactgcctagtgccgggctggtgcattacaacttttgcactttacccaagaggcagtttgccccatcctacgaatccaggcgtcagaatcaagaccggatcaacaagaccgtcctatacggaacccccagaaaatgtttcgttggtcagagtaagccaaatcatccactcttacaggctaagccccaatccgaaccagactacttagaagtgttggaaaagcaaaccgccataagtcaactgtag

SEQ ID NO: 205301 - DNA, 2538 bp, Artificial Sequence
  Description of Artificial Sequence: Synthetic coding sequence
atgctgagcggcgtgtggttcctgagcgtgctgaccgtggccggcatccttcaaacggagtcaagaaaaaccgcaaaggacatttgcaaaatcaggtgcctgtgtgaggagaaggaaaacgttctgaatattaactgtgagaataaaggcttcaccacagtcagcctgctgcagcccccccagtatagaatataccagctgttcctgaatgggaacttactgaccaggctctatcccaacgagttcgtcaactattctaatgctgtgaccctccacctgggtaacaatggactgcaggagattcgcacaggggcttttagcggcttaaaaacactgaagagacttcatctcaacaacaataaactcgagatcctcagggaggatacttttctgggactcgagtcgctcgaatacctgcaggccgactataactacatctcagccattgaggccggggccttttccaagctgaacaagctgaaggtgctcatcctcaatgacaacctgctgttatccctgccttcgaatgtgttccgctttgtgctactaacccacctagatctgcgcggtaaccgactgaaggtgatgcccttcgccggagttttggaacacatcgggggaattatggaaatccagctggaagagaacccctggaactgcacatgtgatctgctgccactgaaggcctggttggacaccatcaccgtgttcgttggggaaatagtgtgcgagacaccctttaggttacacggtaaagatgtaacacaactgacgaggcaggacctctgccctcggaaatccgctagtgattcaagtcaaagaggatcacatgccgacacccacgtccaacgcctgagtccaacaatgaatcccgcattaaatcccaccagagctcctaaagctagcagacctcctaaaatgagaaaccgaccaacgcctcgtgtgactgtatctaaggaccgccaatcttttggacccataatggtctaccagactaagtctcccgtgccgttaacctgcccttcctcctgcgtgtgtacatcgcaaagcagtgacaacgggctcaacgtgaactgtcaggagcggaagttcacaaatattagtgacctgcaaccgaagcccacttctccaaaaaagctgtatcttacaggcaattaccttcaaacagtgtacaagaatgacctgctggaatacagtagtctagacctacttcatctgggcaacaacaggattgcagtcattcaggagggggcgttcacaaacctcacatctctcagacgtctttacctgaatggcaactatttggaggttctgtatcccagtatgtttgacggcttgcagagtctgcagtatctgtacctcgagtataatgtaatcaaggagataaagccccttacttttgatgcgctcataaatctgcagctgttgttccttaataataatttactgcgttccctccccgataacatctttggcggcacagccttgacgagattgaatctgagaaataaccacttctcccaccttcccgtcaagggagttctggaccagttgccagctttcattcagattgatctgcaggaaaacccttgggattgtacctgtgacattatggggttgaaggactggacagagcatgctaactcacccgtgattattaacgaagtgacatgtgaatcccccgcaaaacacgcaggagagatcctaaagttcctggggagggaggcaatctgtcctgacagcccaaacctgtccgatgggactgtcctgtctatgaatcataacacagatactcccaggtccctgtcagtctcaccatcatcttatcctgaactgcataccgaagttcctctgtccgtgctgatcctgggccttctcgtcgtctttattttatcggtttgctttggagcgggcttgttcgtgttcgtgctcaaaagaagaaaaggggtcccctctgtgccgaggaacacaaataacttggatgtctccagcttccaactacagtacgggagctacaacacagagactcatgataaaacagacggccatgtgtacaattacatccctcccccggtagggcagatgtgtcagaatcccatctacatgcaaaaagagggggatcctgttgcctattaccggaacttacaggagttctcctattcaaatctcgaggaaaagaaggaagagccggcgacccctgcctataccatatcagccaccgaattgctcgagaagcaggctacaccaagggaacccgaactactgtatcagaacattgcggagagagttaaggaattaccctcagccggcctggtacactataatttctgtaccctccctaagcgacagtttgcacccagctacgagtccagacgccagaatcaagaccggattaataagacagttctttacggcacgcccagaaagtgcttcgtgggccagagcaaacccaatcaccccctgttgcaggcgaagccacagtctgagcctgattacctggaagtcctggaaaaacagacggctatcagccagttgtag

SEQ ID NO: 205302 - DNA, 2934 bp, Artificial Sequence
  Description of Artificial Sequence: Synthetic coding sequence
atgaagcccagcatcgccgagatgctgcaccggggccggatgctgtggatcatcttgttgtcgaccatcgctctagggtggactactccgattcccctgattgaagatagcgaggaaatcgatgagccctgctttgacccctgttactgcgaagttaaggagagtctcttccacattcactgtgactcaaagggctttaccaacatcagccagattacagagttctggtcgagaccctttaaactttatctccagcggaatagtatgcggaagttgtatacaaattccttcctccatctcaataacgcagtgagtataaacttgggaaacaacgctctacaggatatccagaccggagcttttaacggcctgaagatactgaagagactttacctccacgagaataagctagacgtattcaggaatgataccttcctgggtttggaatctttggaatatctccaggcagactacaatgtcatcaagagaattgagtccggggctttcaggaatttgagcaaactgcgcgtactcatcctcaacgacaatctcatccctatgctgcctacgaatttgttcaaggccgtgtcccttacacacctcgatttaagaggaaaccgcctgaaagtgctcttttatagagggatgctagatcacattgggcgctccctgatggagcttcagctcgaagaaaatccttggaactgcacatgtgaaatcgtgcagctgaaatcctggcttgagcggattccctacactgctctagtgggggacattacctgtgaaactccattccactttcatggaaaggacctaagagaaattaggaagaccgagctctgtccacttctctcggacagcgaagtggaggctagcttagggataccacattctagctcctccaaggagaacgcctggcccaccaaaccctcttccatgctctcctccgtccactttaccgcttcctccgtggaatacaagagctctaacaagcagcctaagcccaccaaacagccgcggacaccaaggccaccctccacctcccaggcactttatcccggcccgaaccaaccaccaattgcgccataccagacccgtccgcccattcccatcatctgtccaaccgggtgcacttgtaatcttcatatcaacgacctcgggctgactgtgaattgcaaggaacggggattcaataatatctctgagttactcccacgaccgcttaacgccaaaaagctctacctctcgtcgaacctgatccagaagatttaccggagcgacttctggaacttttcctctttagaccttctgcacctcgggaacaataggattagctacgtgcaggacggcgccttcatcaacctccctaacttgaagagcctctttctcaatgggaatgacatagagaagcttacccctggtatgttcagaggccttcagagcctacactacctgtattttgagtttaacgtgatccgggagatccagcccgctgctttctccttaatgcccaacctgaagctgctgtttttaaataacaacctgctgcggaccttgccaaccgatgcctttgctgggacatctctggcccgcctaaacctccgcaagaattattttctttatctgcctgtcgccggtgtcttggagcacttgaacgctattgtgcagatcgacctcaatgagaatccatgggattgcacctgcgacttagttccattcaaacagtggattgagacgattagtagtgtttcagtcgttggcgatgtgctgtgtcggtctcccgagaatctgactcaccgtgatgtgagaactattgagctcgaagtactctgcccagagatgctgcatgtcgcgcccgctggagagtcgccggcccaacccggcgattctcaccttattggagcccccaccagcgcttctccatacgagtttagtcctccaggaggccccgtgcctctgtctgtgttaatccttagcttgctggtgctttttttctctgcagtgttcgtggctgccggtttgtttgcctacgtgctgcggcggcgtcggaagaagctaccttttagaagcaaaagacaggagggtgtggacctgaccggtattcagatgcagtgccaccggctattcgaggatggcggcggtggaggcggaggcagtggcggtggcgggaggccaaccctctcctcacctgagaaggccccccccgttggccacgtttatgagtatatcccacaccctgtaacccaaatgtgtaataatccaatttataaacctagagaagaggaagaggtggcggtgtctagtgcacaggaagcaggtagtgccgagcgagggggccccggtacccaaccccctggaatgggtgaggccctccttggtagcgagcaattcgccgagaccccgaaagagaaccacagtaattacagaacactcctggagaaagagaaagagtgggccctggcggtctcgagctcacaacttaatacaatcgttaccgtgaaccaccatcacccccatcaccctgccgtgggcggggtcagcggagtggtcggcggaacggggggcgatctagccggtttccggcatcacgagaagaatgggggcgtcgtgttattccctcccgggggtggttgcgggtctggtagcatgctgctcgaccgggagaggccacagccagccccctgtacagtgggattcgttgattgtctgtacggcaccgtgcctaagctgaaagagctgcacgtgcacccaccaggcatgcagtatccagatctccagcaggatgcgcgtcttaaagagacattacttttttcagccggaaagggattcacagaccaccagacccagaaatctgattatctggaactgagggccaagctgcaaactaagcccgattacctcgaagtgctcgaaaaaactacttacagattttag

SEQ ID NO: 205303 - DNA, 2934 bp, Artificial Sequence
  Description of Artificial Sequence: Synthetic coding sequence
atgaagcccagcatcgccgagatgctgcaccggggccggatgctgtggatcatactgttatcaaccattgctcttggctggactactcccatcccactgatcgaagatagcgaagaaatcgacgagccatgtttcgatccttgctattgtgaagtaaaagagtccctgttccacattcattgcgatagtaaaggcttcaccaacataagccagattactgaattttggtcacgtccctttaagctctatcttcagagaaacagcatgcgcaagctgtatactaacagctttctgcacttaaacaacgctgtgtctattaacctgggcaataatgctctacaagacatacagactggcgcattcaacgggctgaagatcctcaagcgattgtatctgcacgagaacaagttggacgtgttcagaaatgacacgtttttgggtctggaatctctggagtatctacaagcagactacaacgtcatcaaacggatcgagagtggtgcctttagaaatctgtccaagcttagggtcctgattctgaacgataacctgattcctatgctccccactaacctcttcaaagctgtctctctgacgcaccttgacctgcgagggaaccgcctgaaggttctcttctaccgagggatgctggaccatatcggaagaagtctcatggagttacagctcgaggagaatccatggaactgcacctgtgaaatcgtgcagctgaaatcttggttggaaaggatcccttacacggccctagttggagacattacatgcgaaacaccctttcactttcatggaaaagatctgcgcgaaattcggaagactgaactatgcccactgctgtcagattcagaggtagaggcctctctggggatcccacattccagtagttccaaagagaacgcttggcccacgaagccatcatccatgctttccagtgtacattttactgcaagctccgtagagtacaaaagtagtaataaacagcctaagcctacaaagcagcctagaactccccgtccaccttcaacgtctcaagcattgtacccagggcctaatcaacctccgatcgccccctatcaaaccaggcctcctattcccatcatctgccccacaggctgtacctgcaatttacacatcaacgacctaggactcacagtcaattgcaaggagagaggcttcaataatatcagcgaacttctgccacggcctctgaacgctaagaaactgtacctctcttcaaaccttatccagaaaatctatcgctccgacttctggaacttttcctcactggatctcctgcatctcgggaacaaccggatatcatatgtccaggacggagccttcatcaacctgcccaatctgaaaagcttgttcctgaacgggaacgacatcgaaaaattaaccccaggaatgtttcgcgggttacagagcctgcactacttgtattttgagtttaatgtcattagagagatccagccagccgccttttccctaatgccaaatctcaagctcctgtttctgaacaacaacctgctccggacacttccaactgatgcatttgccggcacctccctggcgaggctgaatctgagaaaaaattattttctctatctgccagtggctggcgtgttggagcatcttaatgccatcgtgcagattgacctgaacgagaacccctgggattgcacatgtgatctagtgcctttcaaacaatggattgaaactattagctctgtatcagtggtgggagacgttttatgccgatcaccggagaatctgacacatcgagatgtccgcactatcgagctggaagtgctttgtcccgaaatgttgcatgtcgctcccgccggagaaagccccgcacagcctggagactcgcatctgattggcgccccgacctcagcatccccatacgaattttcaccgcctggcgggcctgtcccactgtccgttcttatcctgagcctacttgtcctgttcttcagcgccgtgtttgtagccgcggggctgtttgcatatgtgctgagaaggcggcgaaagaaactgccatttaggtctaaaagacaggaaggagtggatctgactggtatacagatgcagtgccacaggctgttcgaggatgggggcgggggaggtggtggtagcggcgggggtgggcgacctacactgagcagccccgaaaaagccccccccgtgggccacgtctatgagtacatcccgcaccccgtcactcagatgtgcaacaatccaatttacaagcctcgggaggaagaggaggttgcagtctcatccgcgcaggaggctggctcagctgaaaggggaggaccgggtacacagcctccaggaatgggagaggctctactggggagtgagcaatttgccgaaaccccaaaggaaaatcattcaaattatcgtacgctgcttgaaaaagaaaaagagtgggcgctggctgtgtcttcctcccagttaaatacaatagttactgtgaaccaccatcaccctcatcatccggcagtgggcggcgttagtggcgtggtgggcggcacgggcggggacctggcaggcttccgccaccacgaaaaaaacggcggggtcgtgctgttccccccgggcggtggatgtggctccgggagtatgctgttagacagagagcgtccccagcctgccccatgtaccgtgggatttgttgattgcctgtatggaaccgtgcctaagttgaaggagctgcacgtccatccccctggaatgcaataccctgatcttcagcaagacgccaggctgaaagagactctgcttttctccgcaggaaaaggtttcacagaccatcagacccagaaatccgattacctcgagctgagagcaaagttgcagaccaagcctgactatctagaggtgctcgaaaaaaccacctatagattctag

SEQ ID NO: 205304 - DNA, 492 bp, Artificial Sequence
  Description of Artificial Sequence: Synthetic coding sequence
atgaagcccagcatcgccgagatgctgcaccggggccggatgctgtggattattctgctctccacgatcgcactggggtggacaacacctatccctctgatcgaagactccgaagagatcgatgagccgtgctttgatccctgctactgcgaggtgaaagagtccctgttccatatccactgtgattctaagggcttcactaatatcagtcagattactgaattttggtcaaggcctttcaagctctatctgcagcgtaactccatgaggaaactctacaccaactcctttcttcaccttaataatgcagtttccatcaatcttggtaacaatgcattacaggatatacagactggagccttcaacgggctgaagattctcaaacgcctctatctccacgagaacaagcttgatgtcttccggaacgatacctttctgggactggagtccctggagtacctccaggctgattacaacgttataaagcgctag

SEQ ID NO: 205305 - DNA, 2514 bp, Artificial Sequence
  Description of Artificial Sequence: Synthetic coding sequence
atgttcctgtggctgttcctgatcctgagcgccctgatcagcagcaccaatgctgattcagatatctctgtggagatctgtaacgtgtgctcctgcgtgtccgtggagaatgtcctctatgttaactgtgagaaggttagcgtatatcgaccgaatcaattgaagcctccttggtctaacttttaccacctaaatttccagaacaacttcttgaatatcttgtatccaaatacgttcttgaacttctcacatgccgtttctctccatctgggaaataataaattgcaaaatatcgaagggggcgccttccttggactttctgctctcaaacaactgcatcttaataacaacgagctcaagatcctgcgtgcagatacatttctggggatcgaaaatctggagtatctgcaagccgattacaacttgatcaagtacattgaacgaggcgcctttaacaaactgcacaaactcaaggttctgattctgaacgataatctcatctccttcctgcctgacaatatcttcaggttcgctagcttaacccatttggacatcaggggtaaccgcatccaaaaactgccttatataggggttctagagcacatcgggcgcgtagtcgagctgcagctggaagacaacccatggaactgttcctgtgatctgttaccgttgaaggcttggctggaaaatatgccatacaacatatacattggtgaagccatttgcgagactcccagcgatctgtatggtcgcctgctcaaggaaaccaacaagcaggaactgtgccccatggggaccggtagtgattttgacgttagaattctgcccccatctcaattggagaatggctacactacaccaaatgggcatacaacgcaaacttccctgcatagactggtcacaaagccaccaaaaaccacaaatccatctaagatcagtggcatcgtggcagggaaagcactttccaatcgcaacttgtcccaaattgtgtcctatcagactcgggtaccccccttaactccatgcccggctccatgcttttgtaagacacacccatccgatcttgggttgagtgtgaactgtcaggagaaaaacatccagtcaatgtcagaactgattccaaagcctttgaacgccaagaagttacatgtgaatggaaattctatcaaggatgttgatgttagcgatttcaccgacttcgaaggtctggacctgctgcacctcggaagtaaccagattactgtgataaaaggtgacgtattccacaacctgacaaatctgaggagactctacctgaacggtaaccagatagagcggctctatccagaaatttttagcggcctacataacttacagtacctgtatctggaatacaacttgatcaaggagatttcagcagggactttcgactcgatgcctaaccttcaactgttgtacctgaataacaacttgcttaaatctcttcctgtgtacattttttccggggctcccctcgcgcgccttaatctgcgtaataataagtttatgtacttgccagtttctggagtgctggaccagctccagtcgttaacgcagatcgacctcgaaggaaacccctgggactgcacttgtgatctcgtagcactcaagctgtgggtggagaagttgagcgatggtatcgtggtcaaagagctgaaatgcgaaactcccgtgcaattcgccaacattgaactgaaaagtctgaagaatgagattctgtgtccaaagctgctgaacaagccttcagctccttttacatcaccagcacccgcgattactttcacaacacccctggggcccatccgctcccccccaggcggccccgtgcctttgagtatcctgattctgtctattctggtagtactgattcttacagtcttcgtggccttctgcctgctggtgttcgtgctgcggcggaataaaaaaccgacagtaaagcatgagggcctgggaaatcccgattgtgggtctatgcagctgcagctacgaaaacatgaccataagacaaataaaaaggatggcctttcaaccgaggctttcattccccaaaccatcgaacagatgtccaagtcccacacctgcggtctgaaggagagtgagaccggattcatgttttctgatcctcctggacagaaagtggtcatgaggaacgtagctgacaaagagaaggatttactgcacgtggacactcggaaacggctgtctaccattgatgagctcgatgaactatttcccagccgcgactctaatgtgtttatccagaatttccttgagtcaaagaaggagtataattcaatcggggtctcagggtttgagatacgttatccagaaaaacaaccagacaaaaaatccaagaaaagcctgattggtgggaatcattccaagatcgtggttgaacagagaaagtccgagtatttcgagctgaaggccaaactgcagtcatcacccgactatctccaggtgctggaagagcagacagcacttaataaaatttag

SEQ ID NO: 205306 - DNA, 2514 bp, Artificial Sequence
  Description of Artificial Sequence: Synthetic coding sequence
atgttcctgtggctgttcctgatcctgagcgccctgatcagcagcacaaacgccgattctgacatctccgtcgaaatttgtaatgtgtgttcctgcgtgtctgtggaaaacgtgctctacgtgaactgcgagaaagtaagcgtgtatagaccgaatcagctcaagccgccctggagtaatttttatcacctgaacttccagaataactttctcaacattctgtatccaaacacattcctgaacttctctcatgccgtaagcctccatctgggtaataataaattgcaaaacatagaagggggcgcctttctgggcctgtcggctcttaagcaactgcacctcaacaataacgaactcaaaatcttaagggccgatacttttctgggcattgagaaccttgaatacttacaggccgactacaacctgatcaagtatattgaacggggcgcattcaataagctacacaagctgaaggtgcttatactcaatgacaatcttatatcttttctccctgacaatatattcaggttcgcctctctgacacacctggatatcagggggaatcggatccagaaactgccctacataggcgttctcgagcacattgggagagtggttgagcttcagttagaggacaacccttggaattgcagttgcgatttactgccactgaaggcctggttggaaaacatgccgtacaatatctatatcggggaagcgatttgcgaaacgcccagcgacctgtacgggcggttactgaaggaaacgaacaaacaggagctgtgtccaatgggcactggttctgactttgatgtaagaatcctgcccccctcccagttggagaatgggtacacgacccctaacgggcacaccactcaaaccagcctgcacagacttgtgaccaagccacccaagactacgaaccccagtaagatatccgggattgtagctggcaaggctctaagcaacaggaacctatctcagatcgtaagctatcagactagggtgcctccactaacaccctgccccgcaccctgtttttgtaaaactcatccttcagacctgggattaagcgtgaactgtcaagagaagaatattcagagcatgagcgagcttatccccaaacctctcaatgcgaaaaagctgcacgtaaacggaaattcaattaaggatgtagacgtgagcgactttactgactttgaggggctggacctgctccacctcggtagtaatcagatcaccgttatcaaaggcgacgtctttcacaatctgactaatctgcggcggctgtatctgaatggaaaccaaattgaaaggctatatcccgagatcttttccggcctacacaatctacagtatttatacttggagtacaacctgatcaaagaaatttcagctggtacatttgatagcatgcctaacctgcaactcctgtacttgaataacaacctcttgaaatcactccccgtgtatattttctcaggagcacctctggcccggctcaacctgagaaacaacaaatttatgtatctgcctgtctcgggcgtcctggaccaacttcagagcctgactcagattgaccttgagggtaacccatgggactgtacgtgcgatcttgttgccctgaaattatgggtggagaaactgtctgacggcatcgtagtgaaggagctgaagtgcgaaacccctgtgcagttcgcgaatatagaactcaagagtctcaagaacgaaatcctgtgccccaagctgctcaataaacccagcgcgccttttacctcacctgcaccagccatcaccttcacaacccctctcggacctatccgttctccaccgggtgggcccgtccctctgtccatcctcattctgtcgattctggtagtactgattcttacggttttcgttgccttttgcctcctggttttcgtactgagacgaaacaaaaagcctacggtaaaacatgagggtctggggaatcctgattgtggttccatgcagctgcaactgcgcaaacatgaccacaagaccaataaaaaggatgggctgtcgaccgaagccttcatcccacaaactatcgagcagatgtccaagtctcatacttgtggcctgaaggagagtgagacaggttttatgttttccgatccacccggacagaaagttgttatgaggaatgtcgctgacaaagaaaaagatctcctgcatgtagatactaggaagagattaagtacaatagatgaactggacgaattattccccagcagggattcgaacgtttttattcagaattttctggaaagtaagaaagagtataacagcataggcgtctctggtttcgagatcaggtaccccgaaaagcagcccgacaagaagtccaagaagagcttgatagggggcaaccattccaagatcgtggtggagcagcgaaaatccgagtatttcgaactgaaagcaaagttacagtcgtcaccggactacctgcaggttctggaggaacagacagccctcaacaaaatttag

SEQ ID NO: 205307 - DNA, 2514 bp, Artificial Sequence
  Description of Artificial Sequence: Synthetic coding sequence
atgttcctgtggctgttcctgatcctgagcgccctgatcagcagcactaatgcagacagcgacatctctgtcgagatctgcaatgtgtgcagctgcgtgagcgtcgaaaacgtcctgtatgttaattgtgagaaagtgagcgtctatcgtcctaaccagctcaagcccccctggtctaatttctatcacttgaactttcagaataacttcttgaatatcctgtaccccaatacattcctgaatttcagccacgctgtttctctgcatttggggaataataagttacagaatatcgagggtggagcttttctaggcctgtccgccctcaaacagttacacttgaacaataacgagctcaagatactgcgggctgacacgttcttgggtatagagaacctcgaatacctccaagccgattataaccttatcaagtacatcgaaagaggtgctttcaacaagctgcacaagctcaaggttctgatcttgaatgataatcttatcagttttcttccggacaacatatttcggtttgcttctttaacccacctggacattagggggaacaggattcagaaactcccttatataggggtcctcgagcacatcgggcgggttgtcgaattgcagctagaggataacccctggaattgctcgtgcgacctgctccccctgaaggcatggttggagaatatgccatataacatttatataggcgaagctatctgtgaaactccctcagatctgtatggcaggctgctgaaggaaacaaataagcaggaactgtgccctatgggaaccgggagcgacttcgacgtcaggatactccctccctcacaattagaaaatggttacaccacgcccaacgggcacacgacacaaacatccctccataggctggtgacaaaacccccaaagactaccaacccatcaaaaatcagcggaatagtcgcgggtaaggccctcagcaataggaatctcagtcaaatcgtgtcttaccaaacccgggtacctcccctgaccccatgcccagcgccctgcttctgcaaaactcacccctccgacttggggctcagtgtgaattgtcaggaaaagaatatacagtctatgtccgaactgattccgaaacccctaaacgctaagaagctccacgtcaatggtaattcgatcaaagatgttgatgtgtcagattttaccgactttgaaggtctggacttgctccatctggggagcaatcagatcacggtcattaagggggacgtgtttcacaacctgacaaatctgcggcgcttgtatctaaacggcaatcagattgaaaggctgtatccagaaattttctcaggtctgcataatctgcagtatctgtatctggagtataatttgattaaggagatctccgccgggaccttcgattcgatgcccaacctacagttgctgtatcttaacaacaacctcctgaaatcactgccagtatatatcttcagtggagcaccacttgccaggctgaatctgcgcaacaataaattcatgtacctgcctgtgagcggcgtgctcgatcagttacagtccttgacacaaatcgacttggaggggaacccctgggattgcacttgcgacctggtagccttgaagctgtgggtcgaaaaactatctgacggtatcgtggtcaaagagctgaagtgtgaaaccccagtacagtttgccaacatagagctcaaatcattaaagaacgaaatcttatgtccgaaattattaaacaaaccatctgccccttttacctcaccagccccagccattacttttacgacacccctaggtccaataagatcaccccccggaggccctgtccctctttctatactgattctatccattctggtggtgctcattttaaccgttttcgtcgctttttgtcttctcgtcttcgtgctcaggcggaacaaaaaacctactgtaaagcatgaggggctgggaaaccccgattgtggctccatgcaactccagctgaggaagcacgatcataaaacaaacaaaaaggatggactcagcacagaagccttcattccacagacaatcgaacagatgtcaaagagtcacacgtgtggcctcaaggagagtgagactggtttcatgttctctgaccctcctgggcagaaggtggttatgagaaacgttgctgataaggaaaaagatctgcttcacgtggacacccggaaacgcctgtcaacaattgacgagttagacgaactgtttccgagccgggactccaatgtattcattcagaatttcctcgagagcaagaaggaatataattccataggggtaagtggcttcgaaattcgataccctgaaaaacaacctgataaaaaaagcaagaagagtttgattggcggtaatcattccaaaatcgtggtcgagcaacgaaaatcagaatactttgagctcaaggccaaactgcaaagctccccagattacttgcaggtgctggaggaacagaccgcgttgaacaagatttag

SEQ ID NO: 205308 - DNA, 2877 bp, Artificial Sequence
  Description of Artificial Sequence: Synthetic coding sequence
atgcacacctgctgcccccccgtgaccctggagcaggacctgcaccgaaagatgcattcttggatgttacaaaccttagcctttgctgtgacttcactcgtgctctcatgcgctgagacaatcgactattacggtgaaatctgcgataatgcctgcccttgtgaggagaaggatggcattctgaccgtcagctgcgaaaacaggggtataatctccctatccgagatctcacctccccgttttcctatttaccacctgctgttatccggaaacctccttaatcggttgtaccctaacgagtttgtaaattacaccggagcttcaatcctgcacctgggatccaatgtgatccaggacatagagaccggcgcatttcacgggctgaggggcctgcggcggctgcacctgaataataataaactggaactcctacgtgacgacactttcctcggtctcgaaaacctcgaatacctgcaggtcgattataattacatatccgtgatcgagcccaacgcgttcggaaagctacatctcctgcaagtgctgatcctgaatgacaacctgctatctagtttaccaaataatctgtttaggttcgtgcctttaacccatctcgatctgaggggcaaccggctgaagctgcttccctatgtaggcctactgcagcacatggataaagttgtcgaacttcagctggaggagaatccctggaactgttcttgtgaattgatctcactcaaagactggctcgattccatttcttactctgccctggtaggagatgtcgtgtgtgagactccattccgccttcatggcagagatttagatgaagtctcaaagcaggagctatgcccaagaagactcatttccgactatgaaatgagaccccagacaccattgtccacaaccggctatttgcacaccacacctgcttcagtgaacagcgtggcaacatcctcttcagccgtttacaagccccctctcaagcccccgaagggaacccgccaaccgaacaagcctcgcgttcggcctacatccagacagcccagtaaggatcttgggtactccaactacggcccgtccatcgcttatcagacaaagtccccagtccctctagagtgtcctacggcctgctcatgcaacctccagatcagcgatcttggtctgaatgttaactgccaggagaggaaaatcgaatcaatcgccgagctgcagccaaagccgtacaaccctaaaaagatgtacctgaccgagaattatatcgcagttgtacgcagaacagattttctggaggcaaccggcctcgacctgctgcatctgggcaacaaccggatatctatgatacaggatagagcttttggtgacctgaccaatcttaggaggctgtatttgaatggtaatagaattgagcgtctgtccccggagcttttttatgggttacaaagcctccaatatctgttcctccagtataatctcattagggaaatccaaagtggaacatttgaccctgtacccaaccttcagcttctctttctcaacaacaacctacttcaagcgatgcctagcggcgtgttcagcgggctcaccctcctccggctgaatcttcgctccaatcacttcacatccctccccgtgtcaggagtgttagatcagctcaaatctctcattcaaatcgacctacacgacaatccttgggattgcacatgtgacatagttgggatgaagctgtgggttgagcagttgaaagttggagtcttggttgacgaggtcatttgcaaggcacctaaaaaatttgccgaaacagatatgcgttcgatcaagagcgaacttctctgtccagactacagcgacgtggtcgtgagtactccgacccctagttctatccaggtcccggccaggacttctgcggtgacacctgccgtgcgtctgaactcaacgggggccccggcttccctgggcgcaggaggtggggcctcctctgtgccattgagtgttctgattcttagcttactcctggtgtttatcatgtccgtgttcgtggccgctggacttttcgtcctggtcatgaaaaggagaaagaagaaccaatccgaccatacatctaccaataactcagacgtgagtagctttaatatgcaatactctgtctatgggggcggaggtgggacaggggggcatccgcatgctcacgtgcatcatcgaggccctgccctgccgaaagtgaaaacacctgcaggtcacgtgtatgaatacattcctcaccccctgggccatatgtgcaaaaatccaatctacaggagcagggaggggaatagcgtggaggactataaggacctgcatgagttgaaggttacttattcatcaaaccatcatctccaacaacagcagcagcctccccctcctccgcagcaacctcaacagcaacccccgccgcagcttcaattgcagcctggggaggaagaaaggagagagtctcatcatcttcggtcccctgcatacagcgtcagcacgattgagcccagggaagacctgttatcacctgtgcaagatgccgacaggttttaccgaggcatcctcgagcccgacaaacactgcagcaccacccctgctggtaattctcttccagagtacccaaagttcccttgttctcctgctgcttacacattcagtccgaattacgatctgcggagacctcaccagtatctccaccccggcgcaggggactcccggctgcgtgaacccgtcctgtacagccccccctccgccgtatttgtggagccaaacagaaacgagtatcttgaactgaaggccaagctgaacgtggaaccagactatcttgaggttctcgaaaagcagacaacattttctcaattttag

SEQ ID NO: 205309 - DNA, 2154 bp, Artificial Sequence
  Description of Artificial Sequence: Synthetic coding sequence
atgggcgccggcaagcaccgggagggcggcggcggcgaccccacctcgctgaacggctgcgccgatcttattcagcggcggaccgaaatttctcgggacctggatgaggtctcaaaacaggagctctgtccacgccgcctgattagtgactatgagatgcgtccccagacacccctctcaacaacagggtacttgcataccacgcccgcctctgtgaacagcgtagccactagctccagtgcagtgtataaaccccccctgaaacctcctaaaggcacccgacagcccaacaaacctagagttaggcccacatcacgacagccctctaaagatctgggatattcaaattacgggccttccatcgcgtatcaaacgaagtcccctgtgccactggaatgtcctactgcatgcagctgcaatcttcagatcagcgatttgggtctgaacgtcaactgccaggagcggaagattgaatctatcgccgagctgcagcccaagccatacaaccctaagaaaatgtatctgaccgagaactacattgcagttgtgagaaggaccgactttctggaagcaaccggtctcgatcttttgcacttggggaacaatcgaatctcaatgatccaggatcgagcctttggggaccttaccaacttgagacggctgtatctgaatgggaacagaatagaaaggctgtctccagagctgttttacggactccagtcccttcagtatctgtttctgcagtacaatcttattagagagattcagagtggcaccttcgatcctgttccaaacttgcagctcttgttcctcaacaacaacctactgcaggccatgccatctggtgtgttctcaggactgaccttactgcgccttaacctcaggagtaaccatttcacttctctgcctgtgagtggcgtgctagaccagctgaaatccctgatccagatagacctacatgataatccctgggattgcacttgcgatatagttgggatgaagctatgggtagagcagctgaaggtcggcgtgcttgtggacgaagtgatttgtaaggcccctaagaaatttgccgagaccgacatgcgcagcatcaaatccgagctgctttgccctgactatagtgatgtagtagtgtcaactcctactcctagctctatccaggtgccggcccgcacatctgccgtgacccctgctgtaaggctcaatagtacgggcgctccagcgtccttgggcgctgggggcggtgctagttccgtcccgctgtcggtccttattctgagccttttgttagttttcatcatgtctgtcttcgtggcagcgggcttgttcgtgctcgtgatgaaaagacggaagaagaatcagtctgaccataccagcactaataactcagacgtttcctcctttaacatgcagtactccgtgtacgggggtggcggtggcacaggtggccatccgcacgctcatgtacaccatcggggacctgctctacctaaagttaagacaccagctggacacgtatacgaatacattccccatccacttggtcatatgtgtaagaatccgatctacagatccagagagggtaactccgtcgaagactacaaggacctgcacgagctcaaggtgacttactcatccaaccaccacttgcagcaacagcaacagccgccccctccgccgcagcagccacagcaacagccacctcctcagcttcagctgcagcccggagaagaggagcgaagggagagccaccatctgcgcagccctgcctatagcgtcagcacaattgagccaagggaggacctgctctcccccgtgcaagacgccgatagattctatcgtgggatcctcgagcccgataaacactgttcgactacgccagccgggaattcgttgcctgagtatcctaagttcccttgctcccctgccgcttatactttttctcctaactatgacctcaggcgtccccatcaatacctgcatcctggagccggcgattccaggctgcgtgaacccgtcttatacagccctcctagcgccgtgttcgtggaaccaaatcggaacgaatacctcgaactcaaggccaagctcaatgtggagccagattacctggaggtgttggagaaacagactactttcagccagttctag

SEQ ID NO: 205310 - DNA, 2526 bp, Artificial Sequence
  Description of Artificial Sequence: Synthetic coding sequence
atgaagctgtggatccacctgttctacagcagcctgctggcctgcattagcctgcactcacaaacaccagtgcttagttcaagaggatcctgcgactctttgtgtaactgcgaagagaaggacggtaccatgctgatcaattgcgaagctaagggaatcaaaatggtgagcgagatcagcgtcccaccatcgcgcccctttcaactgtcccttttgaacaacggcttaaccatgctccacacaaatgacttctcaggcctgaccaatgccatctcaattcatctggggttcaacaatatcgccgacatcgagataggtgctttcaatggccttggtctcctcaaacagctccatattaatcataacagcctggaaatcctgaaggaagatacttttcacggtctggagaatctagaatttctgcaggcagataacaactttatcaccgtcatcgagccctccgcctttagcaaactgaatcgtcttaaggtgctcatcctgaacgataacgctatcgaatctctccccccaaatatctttcgtttcgtcccactgacacaccttgatcttagaggaaaccagctgcagacactcccctatgtgggctttttggagcatatcggccgtatcttggacctgcagctagaagacaataagtgggcttgcaattgtgatctgcttcagctgaagacatggcttgagaatatgccaccccagtctataatcggagacgttgtatgtaacagtccccctttttttaagggaagtatcctctcacggctgaagaaggaaagcatctgcccaaccccacctgtttacgaggaacatgaggatccttctggctctttacaccttgccgctacatcctccatcaacgactcgagaatgagcactaagaccactagcattctgaagctgcctaccaaggcccccggtctgatcccttatatcacaaaaccaagtactcagctacctggcccctactgtccaattccttgcaactgtaaagtcctcagtcctagcggcctgctgatacattgccaggaacggaatatagagagcctgtctgatctaagacctccgccacagaatccccgcaagttgattctagccggaaatatcatccacagcttaatgaagagcgacttggtggagtacttcacattggagatgctgcacctggggaataatagaatagaggtgttggaagaaggaagtttcatgaatctgaccaggctgcagaaattgtacctgaacggcaatcacctgaccaaacttagcaaaggcatgttcctcggcctccacaatctcgaatatctgtatttggaatataatgctattaaggaaatactgcctgggactttcaatccaatgccaaagttgaaggtgctctatctgaataacaatcttttgcaggtgctacctcctcatatcttcagcggtgtgccactgaccaaggtcaatctaaagaccaaccagtttacacacctacctgtgagcaatattctcgatgacctggatttgcttacccagatcgacttagaagacaatccttgggactgctcgtgtgatcttgtcggactacaacagtggatccagaagctttctaagaacacagttaccgacgatattttgtgtaccagtcccggtcacttagataagaaagaactgaaggctctgaacagcgagatcttgtgccctggactagtaaacaatcccagtatgcctacccaaacatcatacttgatggtcaccacccctgctactaccacgaatactgccgacactatactgaggagcctgacagacgccgttccactctcagtgcttatcttggggctgcttataatgtttatcactattgtcttctgcgcagcaggaatcgtcgtgcttgtgctgcacaggcgacggcgatataaaaaaaagcaagtggacgagcagatgcgtgacaacagcccagtgcatctgcagtattcaatgtacgggcacaagactacacaccatactactgaaagacccagtgcatcactttatgaacagcatatggttagcccaatggtgcacgtgtatcggtccccaagctttgggcccaaacatttggaggaggaggaagagaggaatgagaaagagggtagcgatgccaagcacctccaacgttctcttttggaacaagagaatcatagcccactgaccggctcaaacatgaaatataaaacgactaaccagtcaactgaattcctgtctttccaggacgcctcttccctgtaccgcaatatcctagagaaagagcgggaactgcaacaactgggtattacggagtacttgcggaagaatatcgcacagttgcaaccagatatggaagcacattacccaggtgcccatgaggaactgaaacttatggagacactcatgtattccaggcccaggaaggtgctggtggaacagactaagaacgagtacttcgaactgaaggctaacttgcatgctgagcccgactatctggaggttctcgaacagcagacatag

SEQ ID NO: 205311 - DNA, 4578 bp, Artificial Sequence
  Description of Artificial Sequence: Synthetic coding sequence
atgcggggcgtgggctggcagatgctgagcctgagcctgggcctggtgttggcaatcctgaataaggtggctccacaggcctgtcctgcgcagtgctcttgtagtggttctactgtggactgccacggattagccttacggtcagtaccacggaacataccacgaaatacagagagactggacttgaatgggaacaacatcactcgtatcaccaagacagattttgccggattgcgacacttgagggtgctgcagctcatggagaacaagatctcgaccatagaaagaggagcctttcaagacttgaaggagctcgaaaggttacgccttaatcgcaatcacctccagctgttcccagagctcttatttcttggcaccgctaagctgtataggctggacctgtccgagaaccaaatccaggcaattcctcgaaaggcttttcgaggcgccgtcgacatcaaaaatcttcagttggattataaccaaatatcatgcatcgaagacggtgctttcagagccctacgggatttggaagtgctgactctcaataataacaatattacccggctgagcgtggcctcattcaaccacatgcccaagcttaggaccttccgactgcatagtaataatttatactgtgactgccacctagcctggctgagcgattggctgcgacagcgcccccgcgtgggcttgtacacccagtgcatgggccccagccatctccgggggcacaacgtggccgaagtgcagaagagggaatttgtctgcagtggcaagggagagggccaccagtcgtttatggccccttcatgcagcgtactgcactgtccagccgcttgtacttgctctaacaatattgttgactgtcggggtaaaggtctgactgagattcccaccaacctcccggagactatcactgagatcagactggaacagaacactataaaggttataccacccggggccttttctccttacaagaagctccgacggatagacttgtcgaacaaccagatctcggaactggctcctgatgccttccaaggattacgttcacttaacagtctcgtactgtatggcaataagataacagagctgcctaaatccttgtttgaaggtctgttttcacttcagctcctgttattaaatgcgaacaaaatcaactgtctgcgcgtcgacgctttccaggatctgcataacctgaaccttctgagtctttacgataataagctccagactattgcaaaaggaacctttagccccctccgtgcaatccagacaatgcatctggctcagaatccctttatctgcgactgccatctgaaatggctggccgattacctccacacaaatcctattgaaaccagtggggcgaggtgtacctccccacggcgcctggcaaacaagcgcattgggcaaattaaatctaaaaagttcaggtgctccgggaccgaggactatagatccaagctgagcggcgattgtttcgccgacctggcctgcccagagaagtgccgttgtgaaggtacgacagtcgactgtagcaaccaaaagctcaacaagatcccggaacacataccgcaatatactgccgaactgcgcctgaataacaacgaatttaccgtactcgaggcaaccggaatttttaagaagctaccccagcttagaaaaattaatttttcaaataataagatcactgatattgaggaaggggccttcgagggagcctcgggggttaacgaaatcctactgacaagtaaccgtttagagaacgtgcaacacaagatgtttaaaggcctcgagtcattgaagactttaatgctgagatcaaatagaatcacctgtgtcggtaatgatagttttatcggtttgtcttccgtaaggctactgtccctctacgacaatcagatcaccactgtagccccgggcgcatttgataccctccatagcctctccacgctcaatctcctggccaatccgttcaactgtaactgctacctagcatggctgggggagtggctccggaagaagaggattgttactggaaatcctagatgtcaaaagccgtattttctaaaggaaatacctatccaggacgttgctatccaggactttacatgcgacgatgggaacgatgacaactcatgctcccctctgagtcgttgcccaaccgagtgcacatgtctggacaccgtggtgcgctgtagcaataaaggcctcaaagtgctacccaaggggattccaagagatgtgacagagctttatctggacggcaatcagtttacactggttcctaaagaattaagcaattataagcatctaaccctaattgatctctccaataaccggatcagcaccctgagtaatcagtcatttagcaatatgacgcagttgctaaccctcatcctttcctataatcgcctgcggtgtattccacccagaacattcgatggactcaagagtttacggctgctctctcttcatgggaacgacatatcggtagttccggagggagcttttaacgacctgagtgccctgtctcacttggctatcggcgccaatccattatattgtgactgcaatatgcagtggttgtccgactgggttaagtccgagtataaagagccaggaattgcacggtgtgctggaccaggcgagatggccgacaaactgctgctgaccaccccgtctaagaagtttacctgtcagggtcccgttgatgtgaacatactcgcaaaatgtaatccttgtttgtctaatccgtgcaaaaacgacggaacttgcaatagcgatccggttgacttctaccggtgcacatgcccttatgggtttaaaggacaagattgtgatgtgcctattcacgcctgcattagtaacccttgtaaacacggtggtacctgccacctgaaagagggcgaagaggatggcttttggtgcatttgcgccgacggctttgaaggagaaaactgtgaggtgaatgttgacgactgcgaagataacgattgcgagaacaactctacctgcgttgacgggattaacaactacacatgtctgtgtccaccagagtatacaggagaactgtgcgaggaaaaattggacttttgtgcccaggacttgaacccttgccaacatgactccaaatgtatcctgactccaaaaggcttcaaatgcgactgcactccgggctacgtaggggagcactgcgatatcgatttcgatgattgtcaggataacaaatgtaagaatggcgcccactgcactgatgcggtaaatggatatacctgcatctgtccggagggctatagtggattattttgtgaattttcccctccaatggtattacctcgcacgagcccctgcgataattttgattgccagaacggggctcagtgtatcgtccgtatcaacgagcctatctgccagtgcctgcctggataccagggcgaaaagtgtgagaagctggttagcgtcaacttcatcaacaaggaaagttatctgcagatacctagcgcaaaggtgagaccacagacaaatatcaccctgcaaattgctacagacgaggacagtggcatccttctctataagggggacaaagatcatatcgccgtcgagctgtaccggggccgcgtgagggcctcctacgatacaggttcacacccagcatctgccatatatagtgttgagacaattaatgacgggaactttcacatcgtggagttgctagctcttgaccaatctttatcactgtccgttgacggcggtaaccctaagatcattacaaacttaagcaaacagagtacccttaattttgatagccctctctacgtaggagggatgcctggcaagtctaacgtggcatcactgagacaggctcctggccagaacggcaccagcttccatggctgcatccgtaatctgtacattaacagtgaactgcaggatttccaaaaagtgcctatgcagaccggcatcctgccgggctgcgaaccatgccacaagaaagtttgcgcccacggcacatgccaaccatcttctcaggccgggttcacgtgtgaatgtcaagagggatggatgggcccgttgtgtgatcagcgaacaaatgacccttgccttgggaacaagtgtgtgcatggcacctgtctccctattaacgccttttcttattcctgtaagtgcctcgaggggcatggcggagtgctttgtgatgaagaggaagatctgtttaacccatgccaggctataaaatgtaagcatggcaagtgtcgactcagtgggttaggacagccttactgcgagtgctctagtggatacaccggcgactcatgcgaccgcgagatatcttgtaggggggaacggatcagagactactatcagaaacagcagggctacgctgcctgccaaactacaaagaaagtttccagattagaatgccgaggtgggtgcgccggggggcagtgctgtgggccactgcgcagtaagcgaagaaaatattcttttgagtgtacagacggctcctcgttcgtggacgaagtggagaaggtcgttaagtgcgggtgcacacgctgcgtttcctag

SEQ ID NO: 205312 - DNA, 4566 bp, Artificial Sequence
  Description of Artificial Sequence: Synthetic coding sequence
atgcggggcgtgggctggcagatgctgagcctgagcctgggcctggtgttggcgatcctgaataaggttgctcctcaggcctgcccagcacaatgcagttgttccggaagcactgtcgactgtcacggcttggctctgcgatcagtccccaggaacatcccccggaacactgagcgacttgacctgaatggtaataacattacccgcatcactaagacagatttcgcgggtctccgacatctccgcgttttacaactgatggagaacaagatctccactatcgagaggggcgcttttcaggatctcaaagagctggagcgactgcgattaaaccgtaaccatcttcagctgtttcctgaactgctctttctgggaacagcaaagttgtatcggctggatttgagcgagaaccagattcaggctatccccaggaaagccttccgtggagcagtggatatcaagaatctccagttggattacaatcagatctcttgtatcgaagacggggccttccgagcactgagagatttggaagtgctaaccctaaataataacaacatcaccaggttatccgtagcaagttttaaccatatgccgaaattgagaaccttcaggctccattctaacaatctttattgtgattgccatctggcttggttgagcgattggctccgacagaggccccgtgtaggcctgtatacccaatgtatgggtccctcgcatctgcgcggccataacgtagcggaggtgcagaaaagggagttcgtgtgtagcggacaccagagcttcatggcgccaagctgttctgtactgcattgtcctgccgcgtgcacttgttccaacaacattgtggactgcagaggcaaaggacttaccgagattccgacaaatctgcctgagaccatcaccgagataagacttgaacagaacactatcaaagtcataccccccggagccttttccccttataagaagcttcgtcggattgatttaagcaacaaccaaataagtgaactggctcctgatgcctttcagggcctaagatcactgaactcactagttctatacgggaacaagattaccgagctcccaaagtcactattcgaggggcttttcagcctgcagctgctgctcttgaacgcgaacaagataaattgcctgcgggttgacgcctttcaagatctgcataatctgaatctgctttccctgtatgacaataaacttcagaccattgctaaaggcaccttcagtcctctccgggccatccaaacaatgcacctggcccagaacccatttatctgcgactgccatttgaagtggctagcagattacctgcacaccaatccaatagaaactagtggcgcaagatgcacgtctcctagaagactagcgaataagcggatcgggcagattaaaagtaagaagttccgctgcagcggcaccgaggattaccgcagcaaacttagcggcgattgcttcgccgacttggcctgccccgagaaatgccgctgcgaaggcacaacagtggattgcagcaaccaaaagctgaataagatacccgagcacattccgcaatacactgctgagctgcggctcaacaataacgaatttaccgttctggaagctactggcatcttcaagaagctgcctcaactacgtaagattaatttcagcaacaacaaaatcacagacatcgaggagggcgcattcgagggagcgagtggcgtgaacgagattttattaacaagcaatagactcgaaaacgttcaacacaagatgtttaaggggctggagagtctaaaaacactgatgctgagatccaatcgcatcacctgcgtcggtaatgatagcttcatcggcctgtcgtctgtcaggctgttgtccctgtacgataaccagattactacagtcgcacccggggccttcgacactctccacagcttgtccacactaaatctgctcgcgaacccctttaattgtaattgttaccttgcatggctgggagaatggctaaggaagaagcgcatcgtcactggcaatcctcgctgtcagaagccttacttccttaaagagatccctatccaggacgttgctatccaggacttcacatgtgatgatgggaacgacgacaactcctgcagtcctctcagccgctgccccacagagtgcacttgtctggatacagttgtacgctgctctaacaagggactgaaagtgctgccgaaaggaattcctagggacgtaacagaactctacctggacggaaaccagtttacactcgtcccgaaagagctcagcaattacaagcacctaactctgattgatctatctaacaaccggatatcgacactgtctaatcagtcgtttagcaatatgacacagctattgactttgatcctaagctacaaccgacttagatgtatccccccgcgaaccttcgacggactgaagtccctgcgtctgctgagccttcatggcaacgacataagcgttgtgcctgaaggagcgttcaatgatctgagcgcattatcgcacctggccataggtgctaaccccctttactgtgactgcaacatgcagtggctgtcagactgggtcaagagtgaatacaaagagcccggcatagctaggtgtgccgggcctggcgaaatggctgacaagctactcctgaccaccccctctaagaaattcacttgtcaagggccggttgacgttaacatcttagccaaatgcaatccatgtctgagcaatccctgtaaaaacgatggaacttgcaactctgacccggtggacttctataggtgtacctgtccttacggctttaaagggcaggattgcgacgtcccaattcacgcgtgcatctccaacccgtgcaaacatgggggaacttgccacctgaaggaaggggaggaagacggcttttggtgtatatgcgcggacggctttgaaggtgagaattgtgaagtgaatgtggatgattgcgaggataacgactgtgagaacaattcaacttgcgtggacgggatcaataactatacatgcctttgtcccccagagtataccggcgaactgtgcgaggagaagctggacttctgtgcccaggatctgaatccttgccaacatgattccaaatgtattctcacaccaaagggttttaagtgtgattgcacgccaggctacgtgggggaacactgcgatatcgactttgacgactgccaggacaataagtgtaaaaacggcgctcattgcacagacgccgttaatgggtatacctgcatatgcccagaaggctactcaggtctgttctgcgagttttctccaccgatggtgcttcctcgtaccagcccttgtgacaattttgattgtcagaatggtgctcaatgtattgttcgcattaatgaaccaatctgtcagtgtctaccaggttaccagggtgagaaatgcgaaaaactggtttccgtgaattttattaacaaagagtcctatctacaaattccatctgccaaagtgcgaccacaaaccaatatcactctgcagattgcaacagatgaagattccgggattttgttgtataagggcgataaagaccacattgcagtggagctgtatcggggccgcgtccgggcctcctacgacactggttcccaccctgcgagcgccatttattctgtggaaacaatcaatgacgggaacttccacatcgtggaactcctcgccttagaccaaagtctgtctctgtctgttgatggcggcaacccaaaaattattaccaacctgtcaaaacaaagtaccctaaactttgacagtccattgtacgtgggtgggatgcccggcaaatctaatgtggcctccctgcggcaggcaccagggcagaacgggacaagcttccatgggtgcattagaaatctgtacatcaactctgaattgcaagacttccagaaggtgccgatgcaaacagggattcttcccggttgcgagccctgtcacaaaaaggtgtgcgcccacgggacgtgccagccctcctcacaggccggctttacttgcgagtgccaggagggctggatgggacctctgtgcgaccagagaaccaatgatccatgtctgggtaacaaatgtgtgcacggtacctgcttacccattaacgccttctcctactcctgcaagtgcctcgagggacatggcggagtgctgtgcgatgaagaggaggatctcttcaacccatgccaagctattaaatgtaaacacggcaaatgtcgtctgtccggtttgggacagccatactgtgagtgctctagcggctacactggtgattcctgtgatcgggagattagctgccggggggagcggataagagactactaccagaagcagcagggctacgctgcctgccagacgaccaaaaaggtgtcaaggttagagtgccgcggcggatgcgccggcggccagtgctgcgggccgttaagaagcaagcgacgcaaatattcattcgaatgcaccgacggatcctcttttgtggatgaggtggaaaaagtggtgaaatgcggatgcacaaggtgcgtgagttag

SEQ ID NO: 205313 - DNA, 4578 bp, Artificial Sequence
  Description of Artificial Sequence: Synthetic coding sequence
atgcggggcgtgggctggcagatgctgagcctgagcctgggcctggtgttggcaatattgaacaaagtcgcccctcaggcgtgtcctgcccaatgttcctgttccggcagtactgtcgattgtcatggtctggctctgaggtcagtccctagaaatataccacgcaacacggaacgacttgacttgaatgggaacaacataacccgaataactaagaccgattttgctggtctgcggcacttaagagtgcttcagttgatggaaaacaagatcagcacaattgaaagaggagctttccaagatctgaaggaactggagcgtttgagactaaacaggaatcaccttcagctgtttccagaactactgttccttggtaccgccaagctgtacagactggacctcagtgaaaatcagatccaggccatcccacgtaaggctttcagaggcgccgtagatattaaaaacctacagctcgactacaaccagattagctgtatagaggatggcgccttccgtgcactcagagatctggaggttttaacccttaacaataacaatataacacgcctgagtgtggctagctttaatcatatgcctaaactgcgcaccttccgacttcatagcaacaacctctattgcgattgtcaccttgcatggctctcagactggctccgccagcgtcctagagtggggctctatacacagtgtatgggcccctcacacctgcgtggccacaacgtggcagaggtgcagaaacgcgagtttgtgtgctccgacgaagaggagggccaccaatcttttatggcccctagctgctccgtgcttcattgcccggctgcctgcacttgttcaaataacattgtcgattgtcgggggaagggcttgaccgaaattccaactaacttaccagagacgatcacagagatccgattagaacagaatacaatcaaggttattcctccaggtgcctttagcccttataaaaaacttcggcgaattgatctttcaaataatcagatctccgaattggcccctgacgcatttcagggactgcgaagcctgaactctctcgtgctgtatggaaataagatcacagaattgccaaagtcgttgtttgaagggttatttagcttacagctcttactgttgaacgccaacaagatcaattgtctgagagtcgatgccttccaggatcttcataatctgaacctcctatcactgtacgataacaaactccagacaatagccaaaggcacattcagtccactgagagccatccagacaatgcacctcgctcagaaccccttcatctgtgactgccatctgaagtggttggcagattaccttcacaccaaccctatcgaaactagcggagcgagatgtacctcgccacggaggttggctaataagaggatcggtcagattaagtcaaagaaatttaggtgttccggaaccgaggactacagatctaagctaagcggcgactgttttgcagacctcgcttgccccgaaaagtgtcggtgcgaaggaaccaccgtggattgctcgaatcaaaaacttaacaagatccctgagcacattccccaatacactgcggagctcaggttaaacaataacgagtttacagtcttagaagctactgggattttcaagaaacttcctcagctgagaaagattaatttctctaataacaaaatcaccgatatcgaggaaggggctttcgaaggtgcgagcggcgtcaacgagatcctgctgacctcgaaccgcctggagaatgtacagcacaagatgttcaaaggtctcgagagcctcaaaacactcatgctgaggtccaatcggataacatgtgtcgggaatgactccttcataggactgtcaagtgttcgcttgctgtcattgtacgataaccagatcacaacagtcgcaccgggggcttttgacaccctacatagcctctctaccctcaacctacttgccaatccatttaattgcaattgctacctggcgtggctgggcgagtggttacggaagaaaaggatcgtcaccgggaaccctagatgtcagaaaccctacttcctgaaggaaattcccattcaggatgttgctattcaagattttacatgcgacgatggcaatgacgataacagctgctcgcctctaagtaggtgtccaaccgagtgtacctgcctggataccgttgtgaggtgctcaaacaaggggctgaaagtgctgcccaaggggattccacgcgacgttacggagctctacctcgatgggaaccagttcaccctggttcccaaagagctgtccaactataagcatctcactttaattgacttgagtaacaaccgcatctccaccctgagcaaccaaagtttttcaaacatgacacagctcctcaccctgattctctcctataaccgcttgcggtgtataccccccaggacatttgacggcctgaaatccttaagactgttatctttgcacggcaatgacatctctgtggtgcccgaaggagcctttaatgacttgtcagcattgagccacctcgcaattggcgcaaacccattatattgcgattgtaacatgcaatggctttctgactgggttaaatctgagtacaaagaacccgggattgctcggtgtgctggtcctggagagatggccgataagctactccttaccaccccttctaaaaaattcacatgtcaaggacctgtggatgttaacatcctggccaagtgcaacccttgcctgagcaatccctgcaaaaatgacgggacatgcaatagcgaccccgttgacttctatagatgcacctgtccttacggattcaaggggcaggactgtgacgtcccgatacacgcgtgcatttcaaatccctgtaaacacgggggcacatgtcacctgaaggaaggcgaggaggatggattctggtgcatctgtgcagatgggtttgaaggggagaattgtgaagttaatgtcgacgattgtgaagacaacgactgtgagaataactccacatgtgtggatggcatcaataactatacctgcctttgcccgcctgaatatacaggagaactgtgtgaggaaaagctcgacttctgcgcgcaggatcttaatccctgtcagcatgattcaaagtgtatacttacacccaaaggcttcaagtgtgactgtactcctggctatgtcggggaacattgcgacatcgacttcgatgattgccaggacaataaatgcaagaatggagcacactgcaccgatgcagtgaatggctatacctgcatttgccccgagggttacagtggcctgttttgtgagttctcgccacctatggtcctaccacgtacatctccgtgtgataatttcgattgccaaaacggggcgcagtgcatcgtgagaatcaacgaaccaatttgtcagtgcctgcccggttatcaaggagagaaatgcgagaaactggttagtgtcaacttcataaataaagaaagttacctgcagatccctagtgccaaagtgaggccacagacaaatataacattacagatcgccacggacgaggattccggcattcttctgtacaagggggataaagatcacatcgctgtggaactatatcgtggaagagtccgcgcttcttatgatacaggttcccaccctgcctccgccatttacagcgtagaaaccatcaacgacggaaactttcatatcgtggagcttttagcacttgaccagagtctctccttgtctgtggacggaggaaaccctaagatcataactaacctctctaagcagtcaacattgaatttcgacagccctctgtatgtgggcggcatgcctggaaagtcaaacgtcgccagcctgcgccaggcccccggccagaacgggacatcatttcatgggtgtatccgcaacctctacataaactcagaattacaggacttccagaaggtgcctatgcagaccgggatcctccccggttgtgagccttgtcataagaaggtgtgcgcccatgggacgtgtcaacctagctcacaggctggtttcacttgcgagtgccaggaaggatggatggggccgctgtgtgaccagaggacaaatgatccatgccttggtaataagtgcgttcacggcacgtgcttgccaataaatgctttttcttattcgtgcaaatgtctcgagggccatggaggcgtgctctgtgatgaggaggaggacttgttcaacccgtgtcaagccatcaagtgtaagcacgggaagtgccgcttgagcggactcgggcagccatactgcgagtgttcctctggctacaccggcgactcctgcgatcgcgagatctcgtgtagaggagagcggatccgggattactaccaaaaacagcaagggtacgctgcgtgtcagacaactaaaaaggtgagcaggctggagtgcagaggcgggtgtgctgggggccagtgctgcggtcctctccgatccaaaagacgaaaatacagctttgagtgtaccgacggcagctctttcgtcgatgaggtcgagaaagtcgttaagtgtgggtgtacccgatgcgtcagctag

SEQ ID NO: 205314 - DNA, 4590 bp, Artificial Sequence
  Description of Artificial Sequence: Synthetic coding sequence
atgcggggcgtgggctggcagatgctgagcctgagcctgggcctggtgctggccattcttaacaaagtggctccccaggcttgtcctgcgcaatgctcctgctccgggagcacggtggattgccatggcttagcccttcgctcagttccccggaatataccccggaataccgagcggctggatctgaacggaaacaacatcacccgcatcacgaaaacagatttcgctgggttacggcatctgcgggtgttgcaactgatggagaataagatctcgacgatcgaaaggggtgcatttcaggatctgaaggagctagagcgtttgagactgaatagaaatcatctacagttgttcccagagctcctcttcctcggtacagccaaactctacagactggacctgtctgagaatcagattcaggcaattccccggaaagctttcaggggtgccgttgatattaagaacctccaactggattataatcagatttcctgtatcgaagacggagcatttcgtgccctgagggacttagaagttctgacgttgaacaacaacaacataactaggttgagcgtggctagcttcaaccacatgcccaaactccggaccttccggctgcattccaacaacctgtattgcgactgtcacctagcttggctatccgattggctgagacagaggcccagagtcgggttatacacccaatgcatggggcctagccatttacgtgggcacaacgtagccgaggtgcagaaacgggagttcgtatgcagcgggcatcagagcttcatggccccgtcttgttctgtgttgcactgtcccgctgcttgtacatgtagcaacaatattgtggactgtcggggcaagggcctcaccgagattccgaccaatttgcccgaaactataaccgagattcgcttggaacaaaatactatcaaagttattccaccaggtgcatttagcccatacaagaagttgcggcgaatcgacctcagcaataatcagatttctgagctggctcctgacgccttccagggcctgagatctttaaattcactggtgttatatggcaacaagattaccgagctgcctaagagcctttttgaggggctcttttcgctgcaactgttactgctaaatgccaacaagatcaactgcttaagagtggatgcatttcaagatcttcacaatctcaatcttctgtccctctatgacaataaactccagacaattgctaagggcaccttcagcccgctacgggccatccagacaatgcacctggcccagaatcctttcatttgcgactgccatctcaagtggttggcagattacttgcatacaaatcccatcgagactagcggcgcccggtgcacgagtcctcgtcgcctggcaaacaagagaattgggcagatcaagtccaagaagtttcgatgctcagccaaggaacagtattttattccgggcaccgaggattaccgaagcaaactgagtggcgactgtttcgctgacttggcctgtccagagaaatgccgctgcgaggggaccacagtggactgcagcaatcaaaagttgaacaagatcccagagcatatcccccagtacaccgccgagttgcgattgaataataacgagtttacagtcttagaggcgactggtatcttcaaaaaattaccacaactccggaaaattaacttttctaacaataagattaccgatattgaagaaggtgcattcgaaggagcgtcaggggtgaacgaaatcctgttgactagcaacagattggaaaatgtccagcacaagatgtttaagggcctggagtctcttaagacgctgatgctccgttctaatcggatcacttgtgttggaaacgattcattcattggtttgagttcagtgcgattgctttctttgtacgacaatcagatcaccaccgtggcccccggtgccttcgacacacttcattcacttagcactctcaacctgctggccaacccgttcaactgtaattgctacctcgcctggctgggcgaatggctgcgaaagaagagaatcgtgacggggaaccctcgatgccaaaagccgtatttcctgaaagaaatccctattcaggatgtcgccatacaggactttacatgtgatgacgggaatgacgataattcctgtagccccctgtcacgttgcccgacggagtgtacctgcctcgatacagtggtgaggtgttccaacaaagggcttaaagtcctgccaaagggtattccacgcgatgtcacagaactttatttagacggtaaccagtttaccttagtgccaaaggagctctcgaattacaaacatctcaccttgatcgatttgtccaataacagaatcagcacacttagtaatcaaagcttttcaaatatgactcagctattaacactcatcctgtcatataatagattgagatgtattccccctcgcaccttcgatggcctcaagtccttgaggctgctgtccctgcatggcaatgatatatcagtcgtgcccgagggggcatttaacgatctgagcgcacttagccatttggctattggcgcgaaccctctctactgtgactgcaacatgcagtggctctctgactgggtcaaaagcgaatacaaggaaccgggcatcgcgcggtgcgccggaccaggggagatggccgataaactgttactgacaactccaagcaagaagtttacctgtcagggcccagtggacgttaatattctcgcaaaatgcaatccttgtctttcaaacccatgtaagaacgacggcacatgcaacagcgatcctgtggatttttatagatgcacatgtccctacggcttcaaggggcaggactgcgacgtgccgatccatgcctgtataagcaacccatgtaaacacggaggcacatgccacttgaaagagggagaagaggacggtttttggtgtatctgtgcagatggctttgagggagagaactgtgaagtcaatgtggacgactgcgaggacaacgattgcgaaaacaactctacatgtgtcgacgggattaacaattatacctgcctctgccctcctgagtacaccggtgagctgtgcgaagaaaagctcgacttttgtgctcaggacctgaatccttgtcaacatgacagcaagtgcatcctgacccccaaaggtttcaaatgcgactgtacaccaggatacgtgggcgaacactgtgatatcgacttcgatgattgccaggataataagtgtaagaacggggcgcactgcacagatgccgtgaacggttacacctgtatttgccctgaagggtacagtggcctgttttgtgagtttagcccccctatggtgcttccacggaccagcccctgtgacaacttcgactgtcagaatggcgctcagtgcatagtgcgcattaatgaacctatatgccagtgtctccccggatatcaaggggagaagtgcgagaaattagtgagcgtgaatttcataaataaagagtcttacttgcagatcccaagtgctaaggttaggccacagacaaatattactcttcagattgctacagatgaagattcaggcattctgctctacaaaggggacaaagaccatatagcagtggaactctaccggggacgcgtgcgtgcgagttatgacacgggaagccatcccgcctctgctatctacagtgtggaaacaatcaacgacggcaacttccacattgtcgaactgctggccttagaccaaagcttgagtctaagtgtggacgggggaaatcctaagattataaccaacctgtcgaagcaaagcacattgaatttcgacagccccttgtacgtgggcggaatgcctggcaagtctaatgtggctagtctcaggcaggctccaggccagaatggaacttctttccatggatgcattaggaatttatatatcaacagcgaacttcaggactttcagaaagtccctatgcagacagggattttacctggctgcgagccttgccacaaaaaggtgtgtgctcatgggacttgccaaccgtcctctcaggccggcttcacgtgtgaatgtcaggaaggttggatgggtccactttgcgaccaaaggacgaacgacccgtgcttaggtaacaagtgcgtacacgggacctgcctgccaatcaatgctttttcctacagctgtaagtgcctggagggacatgggggggtgttatgcgacgaggaagaagacctgttcaatccgtgccaagcaattaagtgcaagcatggcaaatgtcgactgtccggactggggcagccctattgcgagtgttcaagcggatacactggtgattcttgtgacagggagatctcttgcagaggcgaaagaataagagactactatcaaaaacagcaggggtatgccgcatgccagactactaaaaaggtgtcacgtctggagtgccgcggtggttgtgcggggggccaatgttgtgggcctctcaggtccaagcgacgaaaatacagcttcgagtgcactgatgggtccagcttcgtggacgaagtggaaaaagtcgttaaatgtggatgcactcgctgcgtcagctag

SEQ ID NO: 205315 - DNA, 4419 bp, Artificial Sequence
  Description of Artificial Sequence: Synthetic coding sequence
atggcccccggctgggccggcgtgggcgccgccgtgcgggcccggctggcactcgcattggccctggccagtgtcctgagcggaccccccgccgtcgcatgccctaccaagtgcacttgttcggccgccagtgttgattgccacggactgggcctcagagccgtgcctcgcggaattccccgcaacgctgagaggttagatctggatcggaataacatcactcggattacgaaaatggacttcgccggactgaagaatctgcgggtccttcatctggaggacaaccaggtctctgtgatcgaacgcggggcgttccaggacctgaaacagctggaacggctcaggctgaacaagaacaagctacaggtgctccccgaactgctatttcagtcaaccccgaagcttactcgcctcgacctgagcgaaaatcaaatccagggaattcctcgcaaagcattcagggggataactgatgtgaaaaacttacagttggataacaaccatatctcttgtatcgaggacggggctttccgagccctccgcgatctggagatccttactctgaataacaacaacatcagccggattctagttacaagcttcaatcacatgcccaaaatccgtactcttagactccatagtaatcatttgtattgtgactgtcacttggcctggctctcggactggctgcgccagcggcggaccgttggtcagtttacgctctgcatggcacccgtccaccttcgagggttcaatgtcgcggacgtccagaaaaaagagtacgtctgcccagccccacattcagagccacctagttgtaatgccaacagtataagttgcccttctccctgtacatgtagtaataacatcgttgattgtcggggcaaaggtctcatggagattccagcgaacctccccgagggaatcgtggagatacggcttgagcagaactccattaaagccatccccgccggcgcctttacccagtataaaaaacttaagcgtattgacatttcaaagaatcagatttcagacattgctcctgacgccttccagggactgaaatctctgacatctctcgtgctttatggcaataaaataacagagatcgtgaaagggctgtttgacgggttggtctctctccaactcttgctcctcaacgctaacaagatcaattgtctcagagtgaataccttccaggatctgcagaacctcaacctcttgtccctttacgataacaagctgcagaccataagcaaggggctcttcgctcctctgcaatctattcagacccttcacctggcccagaatcccttcgtgtgtgactgccacctgaaatggttggcggactacctccaggataatccaatcgagacatctggcgcaagatgttcttcaccccggcgcctcgctaacaagcgaattagccagatcaaatccaaaaagtttcggtgcagcggcagcgaagattacagatcgcgtttcagttccgagtgctttatggatctggtctgtccggagaagtgccgctgcgagggcactatcgtagattgcagcaaccagaagctggttaggataccgagccatctccctgaatacgtaacagatctgaggctgaatgataatgaggtcagtgtgctggaggctacaggcatcttcaaaaaattgcccaacctcaggaaaattaacttgagtaataataaaatcaaggaggtgcgcgagggagctttcgacggcgctgcgtcagtccaagagctgatgctaacgggcaaccagttggagaccgtgcatgggcgggtgtttcgagggttatccggactgaagacattaatgctgagatcaaaccttattggctgtgtgagcaatgatacatttgccgggctgtcttccgtacggctactatcactctacgataatcggattaccacgataacgcccggggcttttaccactttggtatccctttcaaccatcaacctcctgagcaatccttttaactgcaactgccacctcgcatggttaggaaagtggttaaggaagcgtcgcatcgtgtccggcaatccaaggtgtcagaaacctttctttctgaaggagatacccattcaggatgtggctatccaagacttcacatgcgacggcaacgaggagtccagttgtcaactgagtcccagatgtccagaacagtgtacgtgcatggaaacggtcgtgagatgcagcaacaaaggcctgcgggcgctaccgcgaggaatgcctaaggatgtaacagaactgtatctggaagggaatcacttaaccgcggtcccaagggagctgagcgcgctccgacatttgaccctcattgatctgtcaaataacagtatctcaatgttgacaaattacaccttctccaacatgagtcacctatcaaccttgatactgtcatataataggctacgttgcatccctgttcatgcgttcaatggacttcgatccctgcgggtgctcaccctgcacgggaatgacatcagctctgtgcccgaaggttcctttaatgatttgaccagcctatcccatttggccttgggcacgaaccccttgcattgcgattgctcgcttcggtggctcagcgagtgggtcaaggcaggttataaagagcccggcattgcccgctgtagctcgccagaacctatggcggatcgcttacttctcacaacacccacacacaggttccagtgtaagggccccgtagatatcaatattgtggccaaatgtaatgcctgcctgtcctctccctgtaagaataatgggacatgcacccaagatcccgtcgagctgtaccgttgcgcttgtccatactcttataagggtaaagactgtaccgtgcccattaatacttgcatccaaaacccatgccaacatggcgggacctgtcacctctcagattctcacaaagatggtttttcgtgcagctgccccctgggctttgaagggcagcggtgtgagattaatcccgacgactgtgaagacaatgactgtgagaacaacgcaacctgtgtggacgggattaacaattacgtgtgcatttgtccacccaactacaccggcgaactatgcgatgaagtgatcgaccattgtgttcccgaacttaatctatgccaacacgaggctaagtgtattccccttgataagggattcagttgtgagtgtgtgccagggtactctggcaagttgtgtgagactgataatgatgattgtgtggcacataaatgtcgccacggggctcagtgcgtagatacaattaatggatacacatgcacttgcccccaggggttcagtggacctttctgcgagcatccacctcccatggtactgctacagacctcaccgtgtgatcaatacgaatgtcagaatggcgctcaatgcatcgtggtgcagcaggaacccacgtgtcgctgccccccaggatttgccggtcctagatgtgaaaagcttattacagtgaatttcgtgggaaaggactcctacgtggagctagcaagtgccaaggtaaggccacaggctaacatctccctccaagtggctaccgacaaggataatggtattctcctttataaaggggacaacgacccactggcactggaactttatcagggacacgtccgactggtctacgactcactgtcctctcccccaaccactgtttacagtgttgagactgtgaatgatggccagttccactctgttgagctcgtcactctcaatcagaccctcaatttggtagtcgacaaggggacgccaaagtccttgggaaagctgcagaagcagccagccgtaggaataaattcgcctctgtacctcggagggatccccacaagcactggtctgtccgctctgcgacagggaaccgacaggccgttgggcggcttccacgggtgcattcacgaggtacggatcaataatgagctccaagatttcaaggccttaccgcctcagtccctcggggtgtccccgggatgcaagagttgcaccgtgtgtaagcatggcctctgtcgcagtgtggaaaaggacagtgtagtctgtgaatgtcgccccgggtggaccggtccactgtgcgatcaggaggcaagggacccatgcctgggccatcgctgtcatcatgggaaatgcgtcgcaactggcactagctacatgtgcaagtgcgcagaagggtatgggggagacctctgtgataataagaatgatagtgccaacgcctgctcggcatttaaatgccaccatggccaatgtcacatctcagaccagggtgaaccgtactgcttatgtcaaccaggattctcgggcgagcactgccagcaggtatttcgagcacaggtttttcaatcgtctcttccaggaaattgctcttggagttgttggcctccccggccccctatgccatag

SEQ ID NO: 205316 - DNA, 4572 bp, Artificial Sequence
  Description of Artificial Sequence: Synthetic coding sequence
atggcccccggctgggccggcgtgggcgccgccgtgcgggcccggcttgccctggctcttgcgttggcttctgtgctctccggacctcccgccgttgcctgccctactaaatgtacgtgcagcgctgcttccgtagactgccatggacttggacttagagcagtgcctagaggaattcccaggaacgctgagcgattagatttggatcgaaataacatcacacgtattaccaaaatggatttcgctggtctgaagaaccttagagttctccatctggaagataaccaggtgagcgtgatcgagagaggcgcctttcaggacctgaaacagctagagcggttgcgtttgaacaaaaataaactccaggtattgcctgaactgctctttcagagtacacctaaactgacacgtttagatctcagtgagaaccagatacaggggatcccacgaaaggccttcaggggcatcacagacgtgaaaaacctgcagctggataataatcacattagttgtatcgaagatggtgcatttcgcgctctccgagacctggagattctgaccctgaacaataacaacatttcccggattctggttaccagtttcaatcacatgcccaaaatccgaacgttaagactccacagcaatcatctgtactgcgactgtcatttggcatggctttctgattggctcaggcagcgacggaccgtaggacaatttacactgtgtatggccccagtccacctgcgagggtttaacgtggcagatgtacaaaaaaaggagtatgtgtgcccagccccccactccgagccaccgagttgcaacgccaattccatctcctgccctagtccctgcacttgcagtaataacattgtcgactgccgggggaagggcctcatggagatccctgcaaatctgcccgaagggatagtggaaatcagactcgaacaaaatagcatcaaggctataccagccggggccttcacccagtacaaaaagttaaagagaattgatatctccaagaaccagattagcgacatagctcctgatgcgttccaaggcctcaagtctctgacctctttagtgctctacggcaataagataaccgaaatagtgaaaggcctcttcgacgggctggtgtcgttacagctgctgcttctcaatgcaaacaagattaattgcctgagagtgaacactttccaggacctgcagaatctcaacctcctcagcctgtatgataataagctgcagaccatcagcaaggggttgttcgcgccgttgcaatcgattcaaacgttgcacctggcccaaaatcctttcgtctgcgactgtcacctgaaatggctggccgactacctgcaggacaaccctattgagacttccggagccagatgtagttccccaaggcgactggcaaataagagaatttctcagataaaatccaagaaatttaggtgtagcggctctgaagattacaggtctcgattcagctccgagtgcttcatggacctggtgtgcccggaaaagtgcaggtgtgaaggaaccatcgtcgactgcagcaatcagaaactggtcaggattccttcacacctccccgaatacgtgacagacctgcgcctgaatgataacgaggtgagcgtgctggaagcaaccgggatatttaaaaagcttccaaaccttcggaagatcaacctctccaacaacaagattaaggaagtgcgcgaaggtgcttttgacggggctgcctcagtccaagagttgatgctgacaggaaaccagctggagacagtccatgggcgcgtattcagaggcctgagcggccttaagacactaatgctccgtagcaacttaatcggatgtgtcagcaatgacaccttcgccgggctaagtagtgttcggctgttgtccttgtatgataatcgcattaccacaataacgccgggtgcattcactacactggtgagtctgtccaccattaacctgttgtctaacccctttaattgtaattgtcatctggcctggctgggaaagtggttgaggaagagaaggatcgtttcaggtaatcccaggtgccagaagccttttttccttaaagagatcccaatccaggatgtcgctattcaagatttcacatgcgatggcaacgaggagtcatcctgtcagctcagtccacggtgccccgaacagtgcacatgtatggaaacagtcgtgcggtgcagcaacaaggggttaagggcgctcccacggggtatgccaaaagacgtcactgaattgtatcttgagggaaaccatctgaccgccgtgcctagagagctgagcgctctgcggcatcttaccttaatcgacctgtccaacaatagtatctctatgttgaccaattacacctttagcaacatgagccatttgtctacactgatcctttcatacaaccggctgagatgcattccagtacacgccttcaacggcctccgaagcctgagggtcctgactttgcacggaaatgatatcagcagcgtgccagaagggagttttaatgatctcaccagtctgagccacttggccctaggtacaaaccctcttcattgtgattgttccctccggtggctgagcgaatgggtgaaggcgggatacaaggaacccggaattgcaaggtgcagctcaccggagccgatggccgacaggctcctcctgactactcccacacatagattccagtgcaagggacccgtggacataaatattgtggctaaatgtaacgcatgccttagcagtccatgcaagaacaacggcacttgcacccaagacccagtggaactctatcggtgcgcctgtccttattcctacaagggaaaggattgtactgtgcccatcaacacgtgcatccaaaatccctgccagcacggggggacctgtcacttatcagactcacacaaggatggtttttcgtgttcctgtccgttgggatttgagggacaaagatgcgagatcaatccagacgactgtgaagacaacgactgtgagaacaatgccacatgtgttgacggaatcaacaattacgtatgcatttgccccccgaattatactggggagctgtgcgacgaagtcattgatcactgcgttccagagttgaatctctgtcagcacgaggcgaagtgtattcccttggataagggcttctcgtgtgagtgcgtaccagggtacagcggaaagctgtgcgagaccgacaacgacgactgcgtggcacacaaatgccgccacggcgcccagtgtgtggacacaattaacggctacacgtgtacatgcccacagggctttagcggccccttctgcgagcatccccctccaatggtgctcctacaaacctccccttgcgaccaatatgagtgtcagaatggagcacagtgcatcgtggtgcagcaggaacccacctgccggtgcccccctggattcgcggggccaagatgcgaaaagctaattactgtaaactttgtagggaaagactcttatgttgaactagctagcgcaaaagtgcgtccacaagctaacatcagcttacaagtggcaacagataaggataatggaatcttgttgtataagggagataatgaccccctggcactggagctgtaccagggccatgttagactcgtgtatgatagcttatcttcacctcccacaactgtgtactctgtggagacagtgaacgatggccagtttcattccgttgagttggtgacactcaaccagacactgaacctggttgtcgacaaagggacgcccaaatccctaggcaaacttcaaaaacagccagcagtgggaattaacagtccactgtatctaggagggatccccacatcaactggactatctgccctacgccagggcactgaccgcccactcgggggcttccatggatgtattcacgaggtgagaattaataacgagctgcaggatttcaaagctctgcctccccagagcctgggagtgtctccgggatgtaaatcctgcacggtgtgtaagcatggtctttgtagaagtgtggaaaaagactcagtcgtctgtgagtgtcgaccggggtggactggccctttgtgcgaccaagaagccagggacccttgtttggggcaccgatgtcaccatggtaaatgcgtggccaccgggacttcatacatgtgcaaatgcgccgagggctatgggggcgacctgtgcgataataagaatgacagtgctaatgcctgttctgcctttaagtgtcatcacgggcagtgtcatatttctgaccagggtgaaccatactgtttgtgtcagcctgggtttagcggcgagcactgccagcaggagaatccctgtctaggccaggtagttcgggaagtgatccgcagacagaaaggttacgcctcttgcgccaccgcctcaaaggtgcccattatggaatgccgcgggggttgcggtccccagtgctgtcagcccacccggagtaagagacggaagtatgtcttccagtgcacggacggatctagctttgtggaggaggtcgaacgccacctagagtgtgggtgcctcgcctgcagctag

SEQ ID NO: 205317 - DNA, 3258 bp, Artificial Sequence
  Description of Artificial Sequence: Synthetic coding sequence
atgagcacccccagccggttcaagaaggacaaggagatcatcgccgagtacgaatcgcaagtgaaggagatcagggcgcagcttgtggagcagcagaagtgcttggaacagcagaccgaaatgagggtccagctcctgcaagacctccaagacttttttagaaaaaaggctgaaatagaaactgaatactctcgaaatctggagaagctggccgagcgctttatggcaaaaacaaggagtactaaggatcaccagcagtataaaaaagatcagaatttgttgtcaccagtcaactgctggtacctgttgctgaaccaggtgcgccgcgaaagcaaggatcacgccacactgtccgacatctatctcaacaatgtgatcatgaggttcatgcaaatttccgaggacagtaccagaatgttcaagaaatccaaagagatagctttccagctgcacgaggacctgatgaaagtcctcaacgaactgtacacagtaatgaagacttaccacatgtaccatgctgaaagcatctccgcagaatctaaattgaaagaagctgagaagcaggaggagaagcagatcggaaggagtggtgaccctgtcttccacatccggttagaagagagacaccagcgtcgctccagcgtaaaaaagattgagaagatgaaagagaagaggcaggccaagtactcagaaaataaactcaaaagtattaaggcaagaaatgagtacctactgactcttgaagccaccaatgcttctgtgttcaagtactatatccatgacttgtccgaccttatagactgctgtgacctgggctaccatgcttccctgaaccgcgccctccgtacctacctatccgctgagtacaacctggaaaccagccggcatgaggggctcgatattattgagaatgccgtggataatctcgagccacggagtgataagcagcgcttcatggagatgtatcctgcggccttttgtccccccatgaaatttgaatttcagtcccacatgggcgacgaggtctgccaggtaagcgcccagcagcctgttcaggctgagctgatgctgaggtaccagcaactgcagagtcgcctggccactctaaaaatagaaaacgaagaggttaagaagacaactgaggccaccctccagacaatacaagatatggtgaccatagaagactatgacgtcagtgagtgctttcagcactcacgcagcacagagtctgtcaagagcacagtttctgaaacttatttgtctaagcccagcattgctaaacgccgggccaaccagcaggagaccgagcagttctactttatgaaattgagagagtacttagaaggaagtaatctgatcaccaagttgcaggcaaaacacgatctgctgcaacgaacactgggagaaggtcacagagcagagtacatgacaacccggccacctaacgtgccccccaaacctcagaagcaccggaaatcccgcccaaggtcgcaatataacaccaaactatttaatggtgatctggagacattcgtgaaagactctggccaagtgatcccccttatcgttgaatcctgtattcgattcataaatctttacgggctccagcaccaggggatcttcagagtgtcagggagccaggtggaggtgaacgacataaaaaactctttcgagaggggggaaaacccattagctgatgatcaaagcaaccacgacattaacagcgtggcaggggtccttaaactgtattttcgggggctggaaaatcctctatttcctaaagaacggttcaatgatctcatttcatgcatcagaatcgataatctgtacgagcgcgcattgcatatccgcaaactcttactgactcttccgagatccgtgctaatcgtcatgcgctatctgtttgctttcctcaaccacctaagtcaatattccgatgagaacatgatggatccctacaatcttgcgatctgtttcggccccacactgatgccggtaccagaaattcaggaccaagtatcttgccaggcccatgttaatgaaatcattaagacaattatcatccaccacgaaacaatcttccctgacgcgaaggagctggacggccctgtctacgagaaatgcatggcaggtgacgactactgcgactccccgtactctgagcacggaaccttagaggaggtggatcaggatgccggcacggagccccatacctccgaggacgaatgtgagcctatagaggctatcgccaagtttgattatgtgggacgatccgcccgagaactgtcgtttaagaaaggcgcttccttgctactgtaccaccgggccagtgaggactggtgggagggccgccacaacggcattgacggtctcgtgccgcatcaatacatagtggtgcaagacatggatgatacattttccgataccttatcacaaaaagccgacagtgaagcaagctccggcccagttacagaggacaagtcatctagcaaagacatgaacagtcctacagacaggcaccccgacggctacttagctagacagcgtaaacgtggtgagccaccacctcccgttcgacgacctgggcggacgtcagatggccactgtcccctgcatccaccacatgctttaagcaactccagcgtcgacctgggaagtccctctctggcgagtcatcccagaggactgctccaaaaccgtggtctgaacaacgacagtccagaaagacgcagaagacccggtcacgggagtctaaccaatatctcgcgccacgactccttgaagaaaattgattccccacctattcgccgttccacctcctctggccaatacactggatttaacgatcacaaacctctcgatcctgaaaccatcgcacaagacatcgaggagacgatgaacacagcactcaacgaattgcgggaattggaacgccagagcactgcaaaacacgcgcctgatgtcgtgctcgataccctggagcaggtgaagaacagccccactcccgctaccagcacagagagccttagtcccctccacaatgtagcccttagaagtagcgaacctcagatccggagatccactagctcatcctcagacaccatgtccaccttcaaacctatggttgctcctcggatgggagtgcaactcaagccacccgcgctgcggccaaagcccgcggtccttcccaaaaccaacccgaccatcgggcccgcgcctccaccgcagggtcccacagacaagagttgcacaatgtag

SEQ ID NO: 205318 - DNA, 3189 bp, Artificial Sequence
  Description of Artificial Sequence: Synthetic coding sequence
atgagcacccccagccggttcaagaaggacaaggagatcatcgccgaatacgaatcacaggttaaggagatacgggcccagttagtggagcaacaaaagtgtctcgagcaacagaccgagatgagggtgcagctgctgcaggacctgcaggatttctttcgcaagaaggcagagatcgaaaccgagtattcccggaacctcgaaaagctggctgaaaggtttatggcgaagacaagatctacgaaagatcatcagcaatacaaaaaggatcaaaacctgctgagccccgtaaattgttggtacctcctgctgaaccaagtgcgccgggagtccaaggaccatgctaccttaagcgacatataccttaataatgtgatcatgcgatttatgcagatcagtgaggactctacacgcatgtttaagaaatctaaggagattgcttttcagctccatgaggatctgatgaaggttcttaacgaattatacactgtaatgaaaacataccatatgtatcacgcagagtccatctctgccgaatcaaaactgaaagaggctgaaaaacaggaggagaaacagatagggagatcaggcgaccctgtgtttcatattaggctcgaggagcgacatcagaggcgaagttcggtaaaaaaaatagagaaaatgaaagaaaagaggcaagccaagtattcagagaataaattaaaaagcattaaagcccgaaacgagtacttgcttacccttgaggccaccaatgccagtgtgtttaaatactacatccacgacctgtccgatttaatcgactgttgcgatctcggttatcacgcatcccttaatagagccctgagaacatacctctctgcagaatacaacctagaaacctctcggcacgagggcctagatattattgaaaacgctgtcgacaacctggaacccagaagtgataagcagaggttcatggagatgtacccagccgcattttgtcctccaatgaagttcgagttccagagtcatatgggcgatgaggtgtgccaagtttcagcccagcagccagtgcaggccgagttaatgctaaggtaccaacagctccagagtagacttgctaccctgaaaattgagaacgaggaggtgaagaaaacaaccgaggctacactgcaaacaatccaagatatggtaacgattgaggattatgacgttagcgagtgcttccagcattcaaggtctacagagtccgtgaagagtaccgtgtctgagacttacctgtcgaagccgtctatcgctaagcgcagagcgaaccaacaagaaaccgaacagttctactttatgaaactcagggagtatctggaaggttccaatcttattaccaagttacaagcaaaacacgatttgctgcagcgtacgctgggggagggacacagggctgagtatatgaccactagcaggggcagacgcaatagccacactcggcaccaagactctggccaagtgatacccctcatcgtggagtcgtgtatcagatttatcaatctttacggccttcagcaccaggggatttttagggtatcaggaagtcaagtggaagtgaatgacatcaaaaactcattcgagagaggtgaaaaccctctggccgatgatcagagcaatcatgatatcaacagcgtcgcgggagtgctcaagctttattttagagggctggagaatccactattccccaaggaacggttcaacgacttgatcagctgtatacggatagataacctttatgagcgcgccctgcatatccgtaagctccttcttacactgccaaggtccgttttgattgtgatgcgctacctgtttgccttcctgaatcacctgtcgcagtattccgacgagaacatgatggatccttacaacctggctatttgtttcggtcccaccttgatgccagtgcccgaaatccaggatcaggtgagttgtcaagcccacgttaatgaaataataaaaaccatcattatccaccacgaaaccattttccctgacgctaaagagctggatgggccagtgtatgagaagtgtatggcaggcgatgattactgtgactccccctattcagaacacgggactcttgaagaggtcgatcaggacgctggcactgaacctcacacaagcgaagatgaatgtgaaccaatcgaagctattgctaaatttgattacgtgggcagaagtgctagggaactcagtttcaaaaaaggagcgagcctactgttataccaccgcgccagcgaagattggtgggaaggacgccataatgggatcgacggcctagtaccacatcagtatattgtggtgcaagatatggatgacaccttcagcgacacactgtcgcagaaagccgatagcgaggcaagttccggccccgtgaccgaagacaagtcttcctctaaagacatgaacagccctaccgacagacatccagacgggtatcttgcacggcagcgcaaacgtggcgagccacctccaccagtgagaaggcccggcagaaccagtgatggccactgccctctccatccacctcacgcactgtcgaactctagtgtggacttaggaagcccgagtttggcaagtcatcctagagggctgcttcagaaccgcggtcttaataatgactcaccggagcggcggagaaggccaggccatggctctctgacaaatatcagcaggcacgactcacttaaaaagatcgactctccacccatccgccgctctacctcgagcggccagtacaccggcttcaacgaccacaaaccactggaccctgagacaatagcacaggacatagaagagacaatgaacacagccctgaatgagttgcgcgagctggagaggcaaagcactgccaaacacgcaccggatgtggtgctggatacccttgagcaagtgaagaactcccccaccccagccacaagtaccgagtcccttagccctctacataatgtggccctgagaagcagcgaaccccagatacggcggagtacttcctcctcatccgacacaatgagtaccttcaagccgatggttgcacccagaatgggtgttcagctgaagcctcccgcgctcaggcctaagcccgccgtcttaccaaaaactaaccccaccattgggcctgctccacccccccaaggccccactgacaagagttgtactatgtag

SEQ ID NO: 205319 - DNA, 2958 bp, Artificial Sequence
  Description of Artificial Sequence: Synthetic coding sequence
tgaaaggaccagaacgtgctgagccccgtgaactgctggaacctgctgcttaatcaagtgaagcgcgaatcacgggatcatacaactcttagcgatatttatctgaacaacattatccccaggtttgttcaggtgtccgaagactccgggaggctgtttaaaaagtccaaggaggtggggcaacagctccaggatgatttgatgaaagtgctgaatgagctgtatagtgtcatgaaaacttaccacatgtataatgcagattcgattagtgcacagagtaagctgaaggaagcggagaagcaggaagaaaaacagattggcaaaagcgtgaagcaggaggaccgtcagactcctcgctcaccagactcaacggccaacgtcagaattgaagaaaaacacgtgagacgatcttcggttaagaaaattgaaaagatgaaagagaagcgacaagccaagtacacagagaacaagcttaaggccatcaaggccagaaacgaatatctgctcgccctggaagccaccaacgccagcgtgttcaagtactatattcacgacttgtctgacctaatcgaccagtgctgcgacctgggataccacgcgtcattaaaccgtgccttgaggactttcctttcagcagagctcaacctggagcagtccaagcatgagggcctggacgccatcgagaacgcagtcgagaatctcgacgccacaagtgataagcagcggctgatggagatgtacaacaacgtattctgcccccccatgaaattcgagttccagccccacatgggggacatggccagccagctgtgcgcccaacagcctgtccagtccgagctagtccagcggtgtcaacagctgcagtctaggctgtctacactcaaaatagaaaatgaggaggtcaagaagactatggaagcgaccctgcaaaccatccaagatattgtcactgtggaggacttcgacgtgagtgactgctttcagtacagtaattcaatggaatccgtcaaaagtaccgtgtctgaaacctttatgtccaagccgtctatcgctaagcgacgagctaatcagcaagagactgagcagttttacttcacaaagatgaaggagtacttagagggacgtaacctgattacaaagctgcaggccaaacacgacctcctgcaaaaaactttgggcgaaagccagcgaaccgattgctccctggcccggaggagttctacagtacgcaagcaagattcgtcacaggctattccactggtagttgagagttgcatccgtttcatctccaggcatggactccaacacgagggtatttttcgggtctcggggagccaggtagaggtcaacgatatcaaaaatgcttttgaacgcggggaggatcctttagcaggagaccagaacgatcatgatatggattcaattgcaggcgtgctaaaactttatttccgggggctggagcatccattatttcctaaggatatattccatgatctcatggcatgtgtgactatggataacctgcaagaaagagcactgcacattcgcaaagttctgctggttttacctaagactaccctaattatcatgaggtacctcttcgcgttcttgaatcacctgtcccagttctccgaggaaaatatgatggatccttacaacttagccatttgcttcgggccttctctcatgtccgtccccgaaggacacgatcaggtttcctgtcaggcccatgtgaacgagctaattaagactatcattatacagcatgaaaacattttcccttctcctagagagttggaggggccggtgtacagccggggtggctccatggaagactactgtgattccccccacggcgagaccacttcggtagaggattccacccaagacgttaccgctgaacaccatacaagcgatgacgaatgtgaacccatagaggccatagcaaaattcgactatgtgggccgcacggccagggaactcagctttaaaaaaggggcatcgctccttctgtaccagcgggccagcgatgattggtgggagggtaggcataatggtatcgacggcctgataccccaccagtacattgtggtgcaggatacagaagacggggtcgttgagcgcagctcaccaaagagtgaaatcgaagtaatcagcgagccacctgaggagaaagtcaccgctagagccggtgcctcctgtccaagtgggggacacgtcgccgacatttatcttgccaacatcaacaaacagcgaaaacggcccgagagtggtagtattcgcaaaacctttcgctctgattcccatggactgtcctcctcacttacggactctagctcacctggcgtgggggcatcctgccgcccttcttcccaaccgattatgtcccagagcctgcccaaagaaggacccgacaagtgttctatctcaggacacggatcccttaatagtataagcaggcattccagcctgaaaaaccgtctggacagtccccagataagaaaaaccgccaccgctggccggagtaagagcttcaacaaccatcggccaatggaccccgaggtcatcgcccaagatattgaggcaacgatgaacagcgcgctgaacgagctgagagagcttgagagacaaagcagtgtgaagcacactcctgacgtcgttcttgacacattggagcccctgaaaacatcaccagttgtcgctcctacttccgaaccatcctcccccctgcacacgcagctgcttaaggaccccgaaccagcattccagcgatctgcctctacagctggcgatattgcatgcgccttcagaccagtgaaaagtgtgaagatggccgctccagttaagccacccgccaccaggccaaaaccgactgtgttccccaagaccaacgcaacctcacccggcgttaactctagtacctcacctcagtcgactgataaatcctgtacagtatag

SEQ ID NO: 205320 - DNA, 2796 bp, Artificial Sequence
  Description of Artificial Sequence: Synthetic coding sequence
cagagcaaggaggtgggccagcagctgcaggacgacctgatgaaggtgttgaatgagttatactccgtgatgaagacataccacatgtacaatgcggactctatttccgctcagtctaaacttaaagaggctgaaaaacaggaggagaagcagatcggcaagagcgtcaagcaggaggatcgacaaacccctagatcccctgatagtactgctaacgtccgtattgaggaaaaacacgttcgccgatccagcgttaaaaagatcgagaagatgaaggaaaaacgtcaggctaaatacacggagaacaaactgaaggccatcaaggcacgcaatgagtacctcctcgccctggaagcgaccaatgctagcgtgttcaaatactatatccatgatctgagtgatctcatcgatcagtgttgtgacctggggtatcacgcaagcctgaaccgcgcattgcgaaccttcctctccgctgagctcaatctcgagcagtctaaacacgagggattggatgcgatcgaaaatgccgtagagaatctcgatgccaccagcgacaaacagcgcctgatggagatgtataataacgtgttctgcccacctatgaaatttgagttccagcctcacatgggcgatatggcaagccagctttgtgcacaacagccagtgcaatctgaacttgtccagagatgccagcaactacagagtcgtctctcaaccttgaagatcgagaacgaggaagtcaagaagacaatggaagccacactgcagactatccaggacatagtgaccgtcgaggactttgacgtgtcagattgtttccaatatagtaactctatggagagtgtaaagagtacagtctctgaaaccttcatgtcaaaaccttctattgcgaagaggagagccaaccagcaggagacagagcaattttacttcactaaaatgaaggagtaccttgaagggagaaatctgatcaccaagctgcaggcaaagcatgacctgctgcaaaaaactctcggggagtcccagcgaacagattgttctttagcccgacgttccagcaccgtgcgaaaacaggacagcagccaagccatcccgttggtggttgagtcctgcattcggttcatcagtagacacggcctgcaacacgaaggcatattccgcgtatcaggatctcaggtggaggttaacgacatcaagaatgcatttgagagaggcgaggaccctctggctggggatcagaacgaccatgatatggacagtatcgcaggggtgctcaagctgtattttagaggcctggaacacccactttttcccaaagacatttttcatgatttgatggcttgcgttaccatggacaatttgcaggagcgcgcactgcacatacggaaagtgctgctcgtgctccccaaaacaaccctaattattatgaggtacctcttcgctttcctcaaccacctaagtcagttcagcgaggagaatatgatggatccttataatctggcgatttgctttgggcctagtctcatgtcggttcctgaaggccacgaccaggtaagctgccaggctcacgtgaacgagctgattaagaccataataatacagcacgaaaatatcttcccgagccctcgggaacttgaagggccggtctattcacggggagggtcaatggaagactactgcgactcaccacatggagaaacaacctcagtggaggactccacccaggatgtcactgccgaacaccacacgagcgatgatgaatgcgaacctatcgaagcaattgctaaattcgactacgtcgggcgcactgccagagagctttcttttaaaaagggggcctccctcctcttgtatcaaagagcctccgatgattggtgggagggacgacacaacgggatagacgggctgatccctcaccaatatattgtggtgcaggatacagaggacggagtcgtggagaggtccagtccgaaatccgaaatcgaagtcatctcagaacctcctgaagagaaagtgactgctagggcgggtgcatcttgcccatccggtggccacgttgcggatatatacctggccaatattaacaaacagcggaagcggccggagagtggctcaataagaaaaaccttcaggtctgatagtcacgggttgtctagctctctgactgacagctcttctcctggcgtcggcgccagttgtagaccttcctcacagcccatcatgagccaatctctccctaaggagggcccagacaagtgtagcatcagcggccatggaagcctaaatagtatcagcaggcatagtagcctaaaaaatcgtctggactccccacaaattcgcaagactgctacagctggccgatcaaagtcatttaataaccatagaccaatggaccctgaagtgatcgcccaggatatcgaagccacaatgaattccgccttgaatgaactccgtgagttggagagacaatccagtgtcaaacacaccccagacgtcgtccttgacacgttggaacctctgaagactagcccggttgtcgctcccacctctgagccaagctcacccctgcacacacagctgctaaaagacccagagcccgcgttccaacggtcggcctcaacggccggagatatcgcttgtgccttccgccccgtaaagtcagtgaagatggctgcccctgtcaaacccccagctacccggccgaagccgaccgtctttccaaaaaccaatgctacatcaccaggcgtgaactcctcaacaagtccccagagcactgataaatcatgtacagtgtag

SEQ ID NO: 205321 - DNA, 2112 bp, Artificial Sequence
  Description of Artificial Sequence: Synthetic coding sequence
cggaaggaccagaacgtgctgagccccgtgaactgctggaacctgctccttaaccaagtcaagagggagtcaagagaccacacgactctcagcgacatctatctgaacaacattatcccgaggttcgtccaggtatccgaagattctggacgcttgtttaaaaagagtaaggaagtcggacagcagctccaagacgatcttatgaaagttctgaacgagctttatagcgtaatgaagacgtatcacatgtacaacgccgatagcatctccgcccagagtaaactgaaggaggctgaaaagcaggaggaaaagcagataggaaagagtgtgaagcaggaggacagacagactccaaggtccccagactccacggccaatgttcggatcgaggagaagcacgtcaggcgctcttcagtcaagaaaattgaaaaaatgaaagagaaacggcaggccaaatacactgagaacaagttaaaagccattaaagcccggaatgagtacctgctagcgcttgaggctacaaatgcatcagtctttaaatactacatacacgacctgtctgacctgattgactgctgtgatctggggtatcatgcaagtctgaatcgagctcttagaacatttctctcggctgaactgaacttagagcagtctaaacatgagggacttgatgcaatcgaaaacgccgttgagaacctcgacgctaccagtgacaagcaacgacttatggagatgtataataacgttttttgccctcctatgaagtttgagtttcagccacatatgggggatatggcctcccagctctgtgcccaacaacccgttcaatctgagctcgtgcagcgctgtcagcagttgcagtctagactgtccacactcaagattgaaaacgaggaagtcaaaaagacaatggaggcgacgctgcagacaattcaggacattgttacagtggaggacttcgatgtctctgattgtttccagtattctaatagcatggagtctgtaaagagcaccgtgtccgaaacctttatgtcgaagccttcaatcgccaagaggcgggccaaccagcaggagacagaacagttttactttactaaaatgaaggaatacctcgaaggccgaaacctgattacaaaattacaggccaaacacgacctgttacagaagactctgggcgagagccagcgaacagattgttctctggcccgcagatcttcaaccgtgcgcaagcaggactcctcccaggcgatccctctcgtcgtggagtcctgtattcgcttcatcagtaggcacggcctacagcacgaggggattttccgcgtgtctgggtcccaagtggaagtcaacgacatcaagaacgccttcgagagaggagaagaccctttggctggggatcagaatgaccacgacatggactccatcgctggcgtgttaaaactttacttccgcggactcgagcaccctctctttcctaaagacatttttcatgacctcatggcgtgtgtgactatggacaatctccaagagagggctctacacatccggaaggtactcctggttctgcctaagacaaccctgattattatgcgatatctgttcgcctttcttaaccacctttctcaattttcagaggagaacatgatggacccctacaacttagccatttgtttcgggccatctctgatgagtgtgcccgaaggacatgatcaagtttcctgccaggcccatgtcaatgagctcatcaagaccatcatcattcagcatgagaatattttccccagcccccgcgaactcgagggccccgtgtattcacggggagggtcaatggaggactactgcgacagcccccatggagaaacaactagcgttgaagatagcactcaggacgtgacagccgagcatcatacctccgatgatgaatgtgagcctatcgaggcaatcgccaaattcgattacgtgggccgtaccgcgagagagctgagttttaaaaagggcgcttctttgttactttatcagagggcctcagacgattggtgggagggccggcacaatgggatcgatgggttgatcccccaccagtacatcgtggttcaagatacccttataagctag

SEQ ID NO: 205322 - DNA, 759 bp, Artificial Sequence
  Description of Artificial Sequence: Synthetic coding sequence
atggaggactactgcgacagcccccacggcgagaccaccagcgtggaggactctacccaggatgtgaccgccgagcatcacacctctgatgacgagtgtgaacctattgaggccattgcaaagtttgactacgttgggagaacagccagggaattgagcttcaagaaaggggcgagtttgctcctctatcagagagcctccgatgattggtgggaaggcagacataatggtatcgacggtctcatcccacaccagtacatcgttgtgcaggataccgaggacggagtggtggagaggagctccccgaaatccgaaatcgaggttatctcggagccacccgaggagaaagtcacagcaagggccggagcttcatgcccgagtggtggacatgtcgccgacatttatctggcgaacatcaacaataatttgcacctggataataccaagcctgtaacaacaaagcagaggaagagacccgaatcaggctccattagaaagacctttcgctcggactctcatggtctgtcttcctctctgactgatagttcaagccccggagtaggcgcctcgtgccgacctagcagccagcctatcatgtcacagtctctccccaaagagggtcccgataagtgctctatttccggccacgggagcctgaatagtatcagcagacattcctcattaaagaatcgactggatagcccacagattcgcaagactgccactgctggccgttccaagagctttaacaaccactag

SEQ ID NO: 205323 - DNA, 693 bp, Artificial Sequence
  Description of Artificial Sequence: Synthetic coding sequence
tgagccgagcaccacaccagcgacgacgagtgcgagcccatcgaggctattgccaagtttgattacgtgggccgaaccgcacgggaattatccttcaaaaagggagcaagcctactgctataccagcgagccagtgatgactggtgggagggcagacacaacggcatcgacggattgatacctcaccagtacatcgtagtccaggacaccgaggacggggtcgtagagcgcagctctcctaaaagtgagattgaagtgatctctgagccaccggaagagaaagttacagctagagctggcgcatcatgtcctagcggcggccacgtggcggacatctatttagcaaacattaataataatctgcatttagacaacaccaaacctgtcaccacaaagcagcggaagcgccccgagtctggaagtatccgcaaaaccttcaggtcggattctcacggactctctagctcactcaccgattccagcagccccggggtcggggccagctgccgcccgagttcccaaccaatcatgtcccagtcccttcctaaggagggtcccgataaatgtagtatatctggtcatgggagccttaactctatcagcagacactccagcttgaaaaaccgcctcgatagtccccagattcgaaaaacagctacagccgggcgcagcaagagtttcaacaaccattag

SEQ ID NO: 205324 - DNA, 1353 bp, Artificial Sequence
  Description of Artificial Sequence: Synthetic coding sequence
gtgaagaagaccatggaggccaccctgcagaccatccaggacatcgttacagtggaagactttgacgtctcggactgttttcagtactctaacagtatggaatcggtgaaatctaccgtttctgagacgttcatgtctaaaccatctattgccaagaggcgcgcaaaccagcaggagacagagcagttttacttcactaagatgaaagaatacctggaaggtcgcaatctgataaccaaactgcaggcaaaacacgacttgctccagaagacattaggcgaaagccagcggacggattgttccctggcgcggcggtcctctacagtgaggaaacaagatagcagtcaggccatcccacttgtggttgagagctgcatccggtttatcagtaggcatggtcttcagcacgagggtatctttagggtgagtgggtctcaggttgaggttaacgatatcaagaacgcttttgagcgaggcgaggatccactcgctggggatcagaacgatcatgatatggactccatcgccggagtattgaaattgtatttccgaggcctggaacatcctctgtttcctaaggacatcttccatgatctgatggcgtgtgtgacaatggataacctgcaggaaagagctctgcacattcgcaaggtgttgctggtgctgccaaaaacaaccctgataattatgcgctatctgttcgcttttcttaaccatttaagtcagttcagtgaagaaaacatgatggatccatacaacctagctatttgtttcggacccagtcttatgtccgtccccgaaggacacgatcaagtgagttgccaggctcacgtgaacgagctgatcaagaccatcatcatccagcacgaaaacatatttccctccccacgcgagttggaaggtcccgtctacagtcgcggtggaagtatggaagactactgtgattcccctcatggagaaaccacttccgtagaggacagtacacaggacgtgaccgccgagcatcacacctcagatgatgaatgcgaacctatcgaggcgattgccaaatttgattacgtgggtagaaccgcccgcgaattgagctttaaaaagggggcctctttactcctgtatcagagggcgtcagatgattggtgggaaggtagacataatggtattgacggtctgatcccacaccagtacatcgtagtgcaggacacagaggatggcgtcgtcgagagatcttctcctaaatcagagatcgaggtcatctccgagccacctgaagagaaggtgacagctcgcgcaggcgcctcctgcccaagcggggggcacgtggctgatatttacctggcaaacatcaacaagtag

SEQ ID NO: 205325 - DNA, 3228 bp, Artificial Sequence
  Description of Artificial Sequence: Synthetic coding sequence
atgagcagccagaccaagttcaagaaggacaaggagatcatcgccgagtacgaggcgcagattaaggaaataaggactcagctggtggagcagtttaagtgcctggagcagcagagtgaatctcggcttcagctgctgcaagatctgcaggagttctttaggagaaaggctgagatcgagctggagtattcccgcagcctggagaagcttgccgagagatttagcagcaaaatccggtcctcgagagagcaccagtttaaaaaggaccagtacctcttgagtcctgtgaattgctggtacctggttttacatcagacgcggagagaaagccgcgatcatgctactctcaatgacatattcatgaataatgtgattgtgcgcttgtctcagatcagtgaggacgttattcggcttttcaagaaatctaaggagattggcttgcagatgcatgaggaattactgaaggttaccaacgaactgtacaccgtgatgaagacatatcacatgtatcacgccgagtctatttcagctgaatcaaagctcaaagaggcagagaaacaagaggagaagcaatttaacaaaagcggggacctgagtatgaatctgctgaggcatgaagatcgcccccagaggcggtcctctgtgaaaaagattgagaagatgaaagaaaaacggcaggccaaatacagcgagaacaagctcaaatgcacaaaagcacgtaatgactatctcctcaatctggctgcaacaaacgcagccatttctaaatactacatccacgacgtgtcagatttgattgactgctgtgacctcggctttcatgcatctctggccagaacttttagaacctacttgagtgcagagtacaatctggaaacctctcgccatgagggactcgatgttattgaaaatgctgtcgataatttagactcaagatcagataaacatactgtgatggacatgtgcaatcaggtgttttgcccccctctcaaattcgaatttcagccacatatgggagatgaggtctgccaagtttcagctcagcagccggtgcagacggaattgctgatgagataccaccaactgcaaagcagactagccaccctcaaaatcgagaatgaggaggttcgcaagactttagatgctaccatgcagacgctgcaggacatgctgacagtggaagatttcgacgttagcgacgcgttccagcactctcggtcgacggaatcggtaaaaagtgccgccagcgagacatatatgtcaaagatcaatatcgccaagcggcgggctaatcagcaagaaacggagatgttctacttcaccaagttcaaggagtacgttaatgggtctaatcttataacgaaacttcaagccaagcacgacctgttaaaacagactctgggcgagggggagcgggcggagtgcggcacaactagaggacggaggaacgcacggactcgtaatcaggattctggtcaggctatcccccttgtcgtggaatcatgtatcagatatataaatctttatggtttgcagcagcaaggaatcttcagagtcccaggttcccaggtggaggtcaacgacattaaaaacagttttgagcggggtgaggatcccctagtggacgaccagaatgagcgtgacataaactctgttgcaggagttttaaaactgtatttcagggggctggagaaccctctcttccccaaagagcggtttcaggacctcatttccactattaagttagaaaaccctgccgagcgcgtccaccagattcagcagatcctggtgaccctgcccagggtcgtaattgtagtgatgcgctacctgttcgcattcctgaaccatctttcacagtattcagacgagaatatgatggacccttacaacctggccatctgtttcggacctaccctgatgcatatccccgatggccaggatcccgtctcttgccaggcccacatcaatgaagttatcaaaaccattatcattcatcatgaagccattttcccctctccccgtgaattagaggggccagtttacgagaaatgcatggctggaggcgaggagtattgtgactcccctcattctgagcccggtgctatcgacgaagtggaccatgataacggcaccgagccacacacgtccgacgaagaagtcgagcagatcgaggctatagccaaattcgactatatgggccgatcccccagagaactctctttcaagaaaggtgctagccttctgctttaccacagggcatctgaggactggtgggaagggagacacaacggcgtggacggcctgatcccccaccagtacattgtcgtgcaagatatggacgatgcattctctgattctctgagccaaaaagcagactcagaagcatcctccggacctttgctcgatgacaaagcttcaagtaaaaatgatctgcagtcaccaactgaacacatttccgactacgggttcggaggcgtcatgggcagagtacggttgcgcagcgacggcgcagccatcccccggaggaggtcaggtggagacacccactcaccgccaagagggcttggcccctctatagatactcccccccgcgccgccgcctgcccctcatccccccacaaaattccacttacccgggggcgtatagagagccctgagaaaaggcgcatggccacctttggaagcgcgggctccatcaactaccccgacaagaaggctctgtctgaagggcactccatgcgctctacatgcgggtctacgcgccacagcagtctcggtgaccataagagccttgaggccgaagcactggctgaggacattgaaaagacaatgtcaaccgctctgcacgaacttcgtgaattagagcgccaaaacacagtgaagcaggcccctgacgtggtattagatactctggagccacttaagaatcccccaggacctgtcagcagcgagcctgcttccccattgcatacaatcgttattcgggatccagacgctgccatgcggaggtcctccagttccagcactgagatgatgacaacctttaagccggccttgagcgcccgcctcgctggagcacagctccgtccgccacctatgcggccagtgcggccagtggtccagcacaggagctcctcctcttcctcatctggcgttgggagccccgccgttactcccactgagaaaatgtttccgaacagttctgctgacaaatctgggactatgtag

SEQ ID NO: 205326 - DNA, 3300 bp, Artificial Sequence
  Description of Artificial Sequence: Synthetic coding sequence
atgagcagccagaccaagttcaagaaggacaaggagatcatcgccgagtatgaagcccagattaaggagattcggacccagttggtggaacagttcaagtgcttagagcagcagagcgaatcacgtcttcagctgctgcaggatctccaggaattttttagaagaaaggctgagatcgaactggaatacagcaggtctttagagaagttagcagagcgattttctagcaaaatcagaagtagccgcgagcatcaattcaaaaaggatcagtacctcctctctccagtgaattgctggtacctggtgcttcatcagacaaggagagaaagccgtgaccatgctactcttaatgacattttcatgaataacgttatcgtgagactgtcacaaatttcagaagatgtcattaggctctttaagaaaagcaaagaaatcggactccagatgcacgaagaactgttgaaggtcacaaatgagctatacactgtcatgaagacctatcacatgtaccacgcagaatcgatctcagctgaatcaaagctgaaagaggcagaaaagcaggaagagaagcagtttaacaagtctggagacttgagtatgaatctgctcagacacgaggatagaccacaaagaagatcttctgtcaagaaaattgagaaaatgaaagaaaaacgacaggctaagtacagtgagaacaagttgaaatgcacaaaggccagaaacgactacctgctgaatctggccgcgaccaacgccgcaattagcaaatactatatccatgatgtatctgacctgatcgattgctgcgacctgggatttcacgccagtctagcgaggacgtttcggacttatctgtcagcagaatataacctggaaacttctcgacatgagggattggacgtcatcgaaaatgctgtggacaacctagattccagaagtgacaaacacacagtgatggacatgtgcaatcaggtgttctgtcccccattaaaattcgagtttcagccacatatgggagacgaagtgtgccaggtcagtgcgcagcagccggtgcaaaccgaattgctgatgaggtatcaccagctgcagagtcgccttgcaacccttaaaatcgaaaatgaagaagtcaggaagaccctggatgctacaatgcagacgctgcaagacatgttaacagtggaagacttcgatgtgtctgacgctttccagcatagccgctcgaccgagtctgtaaagtcagcagcatccgaaacctatatgtccaagattaatatcgcaaaacgcagagccaatcagcaagaaaccgagatgttctactttactaaattcaaagagtatgtgaacgggtcaaatcttattaccaagctgcaggcaaagcacgacctgttaaaacagacactcggtgagggggaacgagccgagtgtggcacaacgcgcccaccctgtttgccccccaagccccagaaaatgcggaggccaagaccactctcagtgtactctcataagttatttaacggatccatggaggcctttatcaaagactctggccaagctatacccctggttgtggaatcctgtatccgctatataaatctctacggactccagcaacaggggatcttcagggtgcccggaagtcaagttgaggttaacgatatcaagaattcttttgagcggggggaggatccactggtggacgatcagaacgaaagagatattaattctgtagctggggttttgaagctctatttcagaggcttggagaatccactgttccccaaggaacgatttcaagatctgattagcactatcaagctggaaaatcccgccgaacgtgtacaccaaatccagcaaatattagtgaccctgccaagggtagtgattgtcgttatgagatatctgttcgcattcctcaatcacctgtctcagtacagcgacgagaacatgatggacccttataacttggcgatctgcttcggccctacgctgatgcacattccagacgggcaggatcctgtttcttgtcaggcccatatcaacgaggtcattaaaacaattatcatccaccacgaagcaatctttccgagtcccagggagctggagggcccagtctatgagaagtgtatggccggaggcgaggagtactgtgactccccccactccgagcctggcgctatcgacgaagtggatcacgataacggaaccgagccgcatacaagtgatgaagaagtcgagcaaatcgaagccatcgcaaagtttgactacatggggaggtcacccagggaattgagcttcaaaaagggagcttcgctccttctgtatcaccgagcgagcgaagattggtgggaaggaaggcacaatggcgtcgacggcctgatccctcaccaatatattgtcgtccaggacatggacgacgcgtttagtgacagcctgagccagaaagccgatagtgaggcttcatccgggcccctgttggatgacaaggcgagctctaagaacgacttgcagtctccaactgagcatattagcgactatggatttggcggcgtgatgggtcgggtccgactgagatcagacggcgctgcaataccaaggagaagaagcgggggagatacccatagcccaccacgggggttagggccttcgattgacaccccgcccagagctgctgcctgccccagttcacctcataagatcccactgacccgtggtcgtattgagtcccctgagaagaggaggatggctactttcggcagtgcgggatccatcaattatcccgacaaaaaggctctgtcagaaggtcatagtatgcgcagtacctgtggatcaacaaggcattcaagccttggagatcacaaaagcctggaggctgaagccctggccgaagatattgaaaaaacaatgtccaccgctctgcacgaattgcgggagttggagagacagaacacagtgaagcaggctccagacgtggtgttagacactctggaaccacttaagaaccctcccgggcctgtaagtagtgagcccgcaagccccctgcacaccatcgtgattcgagaccctgacgccgccatgcgccgctcaagctcctcatcaacggagatgatgaccacattcaaaccagctttatctgcccgactcgcaggggcacagttgcgtcccccgcccatgcggcctgtgagaccagtggttcagcaccgctctagctcctcatccagttctggggtgggatctccagctgttacgcctaccgaaaagatgttcccaaattctagcgctgataaatcagggaccatgtag

SEQ ID NO: 205327 - DNA, 1008 bp, Artificial Sequence
  Description of Artificial Sequence: Synthetic coding sequence
atgaacaacgtgatcgtgcggctgagccagatcagcgaggacgtgattcggttatttaaaaaatccaaagagattggcctccagatgcacgaggaactgctcaaagtcactaatgaactctacacggtgatgaagacctaccatatgtaccatgccgagtctatttccgccgaaagtaaactaaaggaggctgagaaacaggaagagaaacagtttaacaaatcgggcgatctgtccatgaaccttctgcggcacgaagaccgtccacagcgccgcagctccgttaaaaagattgagaaaatgaaagagaaaaggcaagctaaatactctgaaaataagcttaagtgcaccaaagcaaggaacgactatctgctgaacctggcggccacaaacgctgctatttctaagtactatatacacgatgtcagcgacctgattgattgttgcgatctgggattccacgcctctttggccaggacctttcgcacttatctctctgctgaatacaacctggagacttccaggcatgagggcctggacgtgattgaaaacgcagtcgataacttagatagcagatctgataagcataccgtgatggacatgtgcaaccaggtcttctgtccaccgttgaagttcgagtttcaacctcacatgggcgacgaggtttgtcaggtatctgctcagcagcccgtgcagaccgagttactgatgcgttaccatcagttgcagagcaggctggcaaccttgaagattgaaaatgaggaggtcaggaaaactttagacgcaactatgcagacattacaggacatgctgacagtagaagactttgacgtgtctgacgcattccagcacagtaggagtaccgagtccgttaagagcgcagcctcagagacctacatgtccaaaataaatattgcgaaacgtcgcgctaaccagcaagagacagaaatgttttatttcaccaaaggaccagacgatgtgttcccaatttgtcatcctagactctag

SEQ ID NO: 205328 - DNA, 360 bp, Artificial Sequence
  Description of Artificial Sequence: Synthetic coding sequence
atgagctggtggcggaacaacttctggatcatcctggccgtggccataattgtggtgagtgtgggcttgggactcatactgtattgcgtgtgtaaatggcaattgcggcgcggcaaaaagtgggagatcgcaaagcccctaaaacataaacaggtcgatgaggagaagatgtatgactttctcctgctgcgcacagcatgctcactacctccattgcccctgcactatagaacctctatgactgagacctatggggtgctcttatgcagaccaggctggagcgcattggcacgtagccgcttgactgcggcctccgcgtcttgggttcaggccatcctgctacctcagccacctaagtag

SEQ ID NO: 205329 - DNA, 438 bp, Artificial Sequence
  Description of Artificial Sequence: Synthetic coding sequence
atggacaccttcaccgtgcaggacagcaccgccatgagctggtggcgcaataatttttggattatcctggccgtggctatcatcgtggtgagcgtcgggctcggcttgatcctgtactgcgtttgcaagtggcagttgcggcggggcaagaagtgggagattgccaaaccactcaaacataagcaggtagacgaggagaagatgtatgaaaatgtgctgaacgaaagcccagtgcaactgcccccactgcctcctcggaactggccttcactggaagacagttccccccaggaagcgccttctcagccccccgctacctactccttagttaacaaagtgaagaacaagaagactgttagcattccatcttacatcgagccagaagatgattacgacgacgtggaaatccccgcgaatacagagaaggctagcttctag

SEQ ID NO: 205330 - DNA, 438 bp, Artificial Sequence
  Description of Artificial Sequence: Synthetic coding sequence
atggacaccttcaccgtgcaggacagcaccgccatgagctggtggcgaaacaacttctggatcattttagcggtggccattattgtcgtgagtgtgggtctgggcctgattctttattgcgtctgtaaatggcagcttcggcgcggaaaaaaatgggaaatcgctaaacctcttaaacacaaacaggtggacgaggagaagatgtacgagaatgttctcaacgagtcccctgtccagttgccaccactacctcctaggaattggccgagcctggaggactccagccctcaggaggcccccagccagcctccggcaacctattctctggttaataaagtgaagaacaaaaagacggtcagtattccatcgtatatcgagcctgaggatgactacgatgatgtcgagatacccgctaacaccgaaaaggctagtttttag

SEQ ID NO: 205331 - DNA, 1398 bp, Artificial Sequence
  Description of Artificial Sequence: Synthetic coding sequence
atgaacgtgaccagcctgttcagcttcaccagccccgccgtgaagagattgctggggtggaagcaaggggacgaagaggaaaagtgggccgaaaaggccgtcgacgccctggttaagaaattaaaaaagaaaaagggcgccatggaggagctcgaaaaggcattgtcttgccctgggcagccgtccaattgcgtaaccattccacgtagtctggacgggcgtcttcaagtttctcaccgtaaagggttgccacatgtgatttattgccgggtctggcggtggcctgatttgcaaagccatcatgagctcaaacccttggaatgctgtgaattcccattcggaagcaaacagaaggaagtgtgcatcaatccttaccattataaacgagtggagtctccagtgttgccacctgtactcgtcccgcgacatagtgaatataatccccagcactcgctgctggcgcaatttaggaacctgggccagaatgagccccacatgccactgaacgcaaccttccccgattctttccagcagcctaatagccaccccttcccccactcgcctaattctagttatcctaattcaccaggttcatcctctagcacataccctcatagccctactagttctgaccctggctcccccttccaaatgcctgctgatacccctccgcctgcatacctcccaccagaagacccgatgacacaagatggtagccagcctatggacacgaacatgatggccccacctctgccctccgagatcaaccggggggatgttcaagctgtggcatacgaggaacccaagcactggtgcagtattgtgtactatgagttaaataatagagttggagaggccttccacgccagtagcacttctgtgttggtagatgggttcacggacccgtctaacaataaaaataggttctgtctggggctgttatccaatgtaaataggaattctaccatagagaacacaagaaggcacattggcaagggggtgcacctctattatgtggggggggaggtgtacgctgagtgtctttcggactcaagtatattcgtacagtcgagaaactgtaattatcatcacggctttcatcccaccactgtctgcaagattccctccgggtgcagtctgaagattttcaacaaccaagagtttgcccagctgctggcccagtccgtgaatcacgggttcgagactgtttacgagctcactaagatgtgcactatccgaatgagctttgttaaagggtggggtgctgagtaccataggcaagatgtaaccagcaccccatgttggatcgaaatacacctgcatggaccgctgcagtggcttgataaggtcctgactcaaatgggttcgcctcacaaccctattagcagcgtgagctag

SEQ ID NO: 205332 - DNA, 1398 bp, Artificial Sequence
  Description of Artificial Sequence: Synthetic coding sequence
atgaacgtgaccagcctgttcagcttcaccagccccgccgtgaagcggttattaggttggaaacaaggggatgaggaggaaaagtgggctgagaaggcggtagacgcactggttaagaaacttaaaaaaaaaaagggggccatggaagaactagagaaggcactgagctgtcccggtcagccttcgaattgtgtgaccattcccaggtctctagacggaaggctgcaggtatcgcatcggaagggcctccctcacgtgatttactgtagggtgtggcgatggcccgacctccaatcgcatcacgagctgaaacccctggaatgctgcgaatttccctttggatccaagcagaaggaggtctgcatcaatccatatcactacaaaagagtggagagccctgttctcccgcccgttctggtgcctaggcacagcgagtacaatccacagcacagccttctggcacagttcaggaacctgggccagaacgagccccacatgccactcaacgccacgttccctgattcatttcagcagcctaacagccaccccttcccccacagccctaattcaagctaccccaactcccccgggtccagtagctctacatacccacactctccaacctcgtcagaccccggctctcctttccagatgcctgccgatacccctccaccagcctacctgccaccagaagatcctatgacccaggatggctcacagcccatggacaccaacatgatggccccgcccctcccttctgagattaatcgcggggacgtccaagccgttgcctacgaagagcccaagcactggtgttccatcgtgtattacgagctaaacaacagggtaggcgaagctttccacgcctcaagcacgagcgtcctggttgatgggttcactgatccaagcaataataaaaaccgcttttgtttgggcttgctttccaatgtgaacagaaactccacaatagagaatacaagacgccacatcggcaagggtgtccatttgtactacgtcggcggcgaggtatatgcggagtgtctctcggacagctctatatttgtgcaatcacggaactgtaactatcaccatgggttccaccctacgaccgtctgtaagatcccgtctggatgcagcctgaagatatttaataaccaggagtttgcgcagctactggcccagagtgtgaatcacgggttcgagacggtgtacgagttaacgaagatgtgcacaatccggatgagtttcgttaaggggtggggagccgaataccatcgacaggacgttacttccactccctgctggatcgagatccacctgcacggccccttgcagtggctcgacaaagttctgacccaaatgggctcccctcacaaccctatttcctctgtgtcctag

SEQ ID NO: 205333 - DNA, 177 bp, Artificial Sequence
  Description of Artificial Sequence: Synthetic coding sequence
atgaacgtgaccagcctgttcagcttcaccagccccgccgtgaagaggttgcttgggtggaagcagggtgacgaggaggagaagtgggccgaaaaagccgttgatgcactcgtaaaaaagctcaaaaaaaaaaagggggcgatggaagagctggagaaagccctgagctgtccctag

SEQ ID NO: 205334 - DNA, 33 bp, Artificial Sequence; identical to SEQ ID NO: 99140
  Description of Artificial Sequence: Synthetic coding sequence

SEQ ID NO: 205335 - DNA, 288 bp, Artificial Sequence
  Description of Artificial Sequence: Synthetic coding sequence
atgaacgtgaccagcctgttcagcttcaccagccccgccgtgaagaggttgttgggttggaagcagggagatgaggaggagaaatgggcggagaaggcggttgatgctcttgttaaaaagctcaaaaagaagaagggtgccatggaagaactcgaaaaggcactgagctgccctggacagccgtcaaattgcgtgaccattcctagaagcctggacggaagactccaggtgtcccacaggaagggactgccacatgtcatttactgccgggtgtggcgctggccctag

SEQ ID NO: 205336 - DNA, 402 bp, Artificial Sequence
  Description of Artificial Sequence: Synthetic coding sequence
atgaacgtgaccagcctgttcagcttcaccagccccgccgtgaagaggctcttgggatggaaacagggggacgaagaagagaagtgggctgagaaagcggtggacgccctagtcaagaagctaaaaaaaaaaaagggagccatggaggaactggagaaggcccttagctgtccagggcagccttcgaactgcgtaaccattcctcgaagccttgacggccgacttcaagtatcccacagaaagggcctacctcacgtcatctattgtagagtttggcgctggcctgatctccagtcgcaccacgagctaaaacctctcgaatgttgtgaatttcctttcgggtctaagcagaaagaagtctgcatcaacccataccattataagagagtggagtccccatag

SEQ ID NO: 205337 - DNA, 321 bp, Artificial Sequence
  Description of Artificial Sequence: Synthetic coding sequence
atgaacgtgaccagcctgttcagcttcaccagccccgccgtgaagaggctgcttggctggaagcagggagatgaggaagaaaagtgggctgagaaagctgtcgacgctttggtcaagaagttgaaaaagaagaagggcgcaatggaagaactggagaaggcgctgagttgccctggacagccaagtaactgtgtgactattcctagatcattggacggacgcctgcaagtgagccatagaaaaggcctgccgcatgtgatttattgcagggtttggagatggcccgatcttcaatcacaccacgaacttaagccattgtag

SEQ ID NO: 205338 - DNA, 339 bp, Artificial Sequence
  Description of Artificial Sequence: Synthetic coding sequence
atgaacgtgaccagcctgttcagcttcaccagccccgccgtgaagcgactgctgggctggaaacagggggatgaggaagagaagtgggctgaaaaggccgtggatgccctagtcaagaaactcaagaaaaagaagggtgcaatggaagagctggagaaagctctttcatgtcctggtcagcctagtaactgcgtaacgatcccaaggtctctggacggcagattgcaggtgagtcacagaaaagggctccctcatgttatctactgtagggtgtggcggtggccagacctacagagccatcacgaacttaagcccctcgagtgctgcgagttcccatag

SEQ ID NO: 205339 - DNA, 1398 bp, Artificial Sequence
  Description of Artificial Sequence: Synthetic coding sequence
atgaacgtgaccagcctgttcagcttcaccagccccgccgtgaagcgccttttgggatggaagcagggcgatgaggaggagaaatgggcagagaaagcagtggacgccctggtcaaaaagcttaagaagaagaaaggggctatggaagagctggaaaaggctttgtcatgccccggtcagcccagcaactgcgtgactattccacggagccttgatggacggctccaggtgtcccataggaaaggtttgccacatgtgatctattgccgtgtgtggagatggccagaccttcagtcgcaccacgaactcaaacctctggagtgctgtgagttccccttcggcagcaagcagaaggaggtctgcatcaacccttatcattacaaacgcgttgaatccccagtcctgccacctgtgcttgtaccaagacattcagagtacaaccctcagcactctctactggctcaattccgcaatctggggcaaaacgagccccatatgccactcaacgccacattcccagacagctttcagcagcctaactctcatccattcccacactcccccaactcatcttaccctaactcgcctggttcgagcagtagcacttatcctcacagtccaaccagctcagaccccggctctcccttccagatgccagcggacactccaccaccggcctatcttccccctgaagacccaatgactcaggatggctctcagccaatggacacaaatatgatggctcccccactgccaagcgagattaatcgaggcgacgtgcaggccgtggcttatgaggaacccaagcactggtgctccatcgtgtattatgaattgaacaaccgagtaggcgaagcgtttcacgccagctcaacctctgttctggtggatggattcaccgacccctctaataacaagaataggttctgcctagggttgctgtcaaacgtgaatcgcaattccacgattgagaatacccgccgccatattggcaaaggggtccatctatactacgtcggtggggaggtatatgcggaatgtctctcggattccagcattttcgtgcagagccggaattgcaattatcaccacggcttccatcctacgaccgtgtgcaagattcctagtggctgctccttgaaaatttttaacaaccaggagtttgctcaactgctggctcagtccgtgaatcacggcttcgagactgtttacgagctgacaaagatgtgcactattagaatgagctttgttaagggctggggagctgaataccaccgacaggacgtcacctccaccccttgctggattgagatccatcttcacggccctctgcagtggctggataaagtactgactcagatgggctctccgcacaaccccatttcttccgtgagctag

SEQ ID NO: 205340 - DNA, 1659 bp, Artificial Sequence
  Description of Artificial Sequence: Synthetic coding sequence
atggacaacatgagcatcaccaacacccccaccagcaacgacgcctgtctgtcgatcgtacattcattaatgtgtcatcgacaagggggagaaagtgagaccttcgcaaagagggcaatagagagccttgtgaaaaagctaaaggaaaagaaggacgagctcgattccctgattaccgcaatcacaacaaacggagcgcatccatccaagtgtgtaacaatccagagaaccctggacggacgcctacaggtggctggccgcaaaggattcccccatgtcatttacgcccgactatggcgttggcccgatcttcacaaaaacgaactgaagcatgtcaagtactgtcagtacgcatttgatctaaagtgtgacagtgtgtgcgtgaatccttaccactacgagcgcgtggtatccccaggcattgatttgtctggactcacccttcagagcaacgcccccagctctatgatggtaaaggatgagtatgttcacgacttcgaaggacagccctccctgtcaactgaaggccattcaattcaaaccattcagcatcccccaagtaatcgtgccagcacagagacttacagtacaccggcactcctggcaccttctgagtcaaacgccacttctacggctaatttcccaaacattccagttgcatcaacatcgcagcctgcatcaatactgggcggatcccattcggaagggctgctgcagatagcaagtggccctcagccggggcagcagcagaatggtttcaccggacagccagccacttaccatcacaatagcaccacgacttggacaggctcccggaccgctccctacacccccaaccttcctcatcaccagaacggacacctacagcaccaccccccgatgcccccacaccctggacattactggcccgtccataatgaactggctttccagcccccaatatccaatcatcctgctccggaatactggtgtagtatagcatattttgagatggatgtgcaagtgggcgagacattcaaggtcccgagctcctgtcccatagtgacggtggacggttatgtggatcctagcggcggcgatcggttttgtctggggcaattgtccaacgtgcaccgcacagaggcaattgagcgggcccggttacacatcggcaaaggggtgcagctggagtgcaagggggaaggggatgtctgggttcgctgcttgtccgaccacgccgtcttcgtgcagagctattatttggacagggaggccgggcgcgcaccgggtgatgctgtgcacaaaatctacccgagtgcctacattaaagtcttcgatctgagacaatgccacaggcagatgcaacagcaagcggctaccgcgcaagctgctgctgctgctcaggcagctgccgtggccggcaatatccccgggccaggatctgtgggagggattgcacctgcgatcagcctcagcgctgccgccggcataggcgtagacgacctcaggcggctgtgcattctgcgcatgagctttgtgaaaggatggggccccgactatcccagacaatcaatcaaggagaccccctgctggatcgagatccacttacaccgcgccctccagctgcttgacgaggtgttacataccatgcctattgcagatcctcagcctctggactag

SEQ ID NO: 205341 - DNA, 1659 bp, Artificial Sequence
  Description of Artificial Sequence: Synthetic coding sequence
atggacaacatgagcatcaccaacacccccaccagcaacgacgcctgtctctcaattgttcattccttgatgtgccacaggcaaggaggcgagtcagagacgtttgctaagcgagctatagaaagcctcgtgaagaaacttaaggaaaagaaggacgagctcgatagcctgatcaccgccattacaactaatggcgcccaccctagcaaatgcgtgacaattcagcgcaccctggatgggaggctgcaagtggcaggccgcaagggctttccgcacgtgatctacgccagactgtggagatggccagacttgcacaagaatgaactgaagcatgttaaatactgccagtacgcttttgaccttaaatgtgactcggtctgtgtcaacccttatcactatgagagggtcgtcagccccggaattgatctaagcggactcaccttgcagtccaacgctccctcgagtatgatggtgaaggacgagtacgtgcacgactttgaagggcagccatccttatcaaccgagggacattcaatacagacaatacagcatccgccgtctaacagagcctccaccgaaacatactccactcccgcgcttttagcaccttcagagtccaatgccacctccaccgctaactttcctaatatccctgtagcatctacgagccagcccgcaagcatcctgggcgggtcacatagtgaggggttgcttcagattgcgtcagggccacaacccggccaacaacagaatggctttacaggacagccagccacatatcatcataattctactaccacatggaccggaagcagaaccgctccatacactcccaatctgccccaccaccagaatggccacttgcagcaccaccccccaatgccaccccatccagggcactactggcccgtgcataacgagcttgcttttcagccccccatctccaatcacccagctcccgaatactggtgctccatagcctatttcgagatggacgtacaggtgggagagaccttcaaagtcccttcctcttgcccgatcgtaactgtcgacggctacgttgaccccagtgggggagaccggttctgcctagggcagctgtccaatgtgcaccgaacggaggccattgaacgcgcgcggctgcacattggcaagggcgtgcaactggaatgcaaaggcgagggcgacgtctgggttcgctgcttgtctgaccatgccgtgttcgtgcagtcttattaccttgacagggaagctgggcgcgcccccggagatgctgtacacaagatctatccctctgcatatatcaaagtcttcgaccttagacagtgccatcgccaaatgcagcaacaggcagcgacagctcaagcagctgcagccgcccaggccgccgctgtggccgggaatatccctggacccggatcagtgggagggatagctccagcgatctccctgtctgccgctgcaggaattggggtggacgacctgcggcggctgtgtatcctgaggatgagctttgtgaagggctggggccctgattacccccgccaaagtatcaaggagacaccttgttggattgaaatccaccttcatagggccctgcagctgttggatgaagtgcttcacactatgcccatcgccgatcctcagccgctggactag

SEQ ID NO: 205342 - DNA, 534 bp, Artificial Sequence
  Description of Artificial Sequence: Synthetic coding sequence
atggacaacatgagcatcaccaacacccccaccagcaacgacgcctgcctatctattgtccattccttaatgtgccatcggcaaggaggagagagcgagacctttgcaaaacgggccattgaaagtttagttaaaaaattaaaagagaaaaaggatgagctggattctctcattaccgcaattaccacgaatggcgcacacccaagcaaatgtgtgactatacagagaaccctcgatggcaggctacaggttgcagggcgcaaagggttcccccacgtgatctacgcaaggctatggagatggccagatctccacaagaacgaactgaaacacgtcaagtactgtcagtatgcctttgatcttaaatgcgactccgtgtgtgtcaatccataccactatgagagagtggtgtctccgggaattgacctgtcaggcctcactctgcagtccaacgagaataactggtacttttctcaattgcttttggacctggacaaggggatgatccaagagcaagccatccatggaccttag

SEQ ID NO: 205343 - DNA, 1311 bp, Artificial Sequence
  Description of Artificial Sequence: Synthetic coding sequence
atggacaacatgagcatcaccaacacccccaccagcaacgacgcctgcctgagcatcgtccacagtctgatgtgccacaggcaggggggagagagcgagacttttgctaagcgtgctatcgaatcactggtgaagaagttgaaagagaagaaggatgagctggattctttgattaccgccataacaacgaacggggcacatccaagtaaatgtgttacaatccagagaaccctggacggtcgtctgcaggtggcaggacgcaagggctttccacacgtgatttatgctagactgtggcgctggccggacctacacaaaaatgagctgaagcatgtcaagtactgccagtatgctttcgatttgaagtgtgacagcgtgtgcgttaatccgtaccattacgagcgagtggtcagtccaggaattgatctgtctggcctaacccttcagtcaaatgcaccctctagcatgatggtcaaggacgagtacgtacacgacttcgaaggtcaaccctccctctctaccgaggggcattctatacagaccattcagcatcccccatccaatcgtgcatccacagagacttacagtacaccagcactgctcgccccatcggagagtaacgcaacttccaccgcgaactttccgaatattccagttgcaagcacgtctcaacccgcatccattctaggcggaagtcattcagagggtctcctgcagattgcctctggaccacagccagggcaacagcagaacggcttcacagggcagcccgctacctaccaccataattccacaactacatggactggtagtaggaccgccccatataccccaaatcttccccaccaccaaaatggacaccttcaacatcacccaccaatgcctccgcatccaggacactactggcccgtccacaacgaactcgctttccaaccaccaatctcaaatcatcccgcccctgagtattggtgttctatcgcttatttcgagatggacgtccaagtgggagagaccttcaaagtgcccagctcatgtccaatcgtgacagtagatggatatgtggatccatcaggcggggacaggttttgccttggccagctaagcaatgtccataggacggaagcgatagagcgcgcacgactccatatcgggaaaggcgtgcagctagagtgcaaaggggagggcgatgtgtgggtgcggtgcctctctgatcatgccgtgttcgtgcagagttattatctggatagagaagccggccgcgccccaggggatgctgttcacaagatttatccaagtgcctatattaaatag

SEQ ID NO: 205344 - DNA, 243 bp, Artificial Sequence
  Description of Artificial Sequence: Synthetic coding sequence
atgaccagcatggccagcctgttcagcttcaccagccccgccgtgaagcgactgttgggctggaagcagggcgacgaggaagaaaaatgggcggaaaaggccgtagatgcgctcgtgaagaagctcaagaaaaaaaaaggtgctatggaggagttagaaaaggccctgtctagtccaggtcagcccagtaaatgcgtcaccattcccagatctctggacggcaggctgcaagtgtcccattag

SEQ ID NO: 205345 - DNA, 387 bp, Artificial Sequence
  Description of Artificial Sequence: Synthetic coding sequence
atgaccagcatggccagcctgttcagcttcaccagccccgccgtgaaacggcttttaggttggaagcagggggacgaggaagagaaatgggccgagaaggccgtcgacgctcttgtcaagaagcttaaaaaaaaaaagggggccatggaggagcttgaaaaagccctctccagtcccggccagcctagtaagtgtgtgaccatccccagatcgttagacgggaggctgcaggtttcgcaccgcaaaggtctgcctcacgtcatatactgtcgtgtctggcgatggccagatctgcagagtcatcatgagttaaaacctctggatatctgcgaattcccattcggctctaagcagaaagaagtgtgcatcaatccgtatcattactag

SEQ ID NO: 205346 - DNA, 6 bp, Artificial Sequence
  Description of Artificial Sequence: Synthetic coding sequence
atgtag

SEQ ID NO: 205347 - DNA, 405 bp, Artificial Sequence
  Description of Artificial Sequence: Synthetic coding sequence
atgaccagcatggccagcctgttcagcttcaccagccccgccgtgaagcgcttgttgggctggaagcagggcgacgaggaagaaaagtgggccgaaaaagctgtggatgcacttgtcaagaagcttaagaaaaaaaagggtgctatggaggagctggagaaggcactgtcttcgccagggcagccatctaaatgcgtgaccattccccgctccctggatggccggctgcaggtgtctcatcgaaaagggctccctcatgtgatttactgccgggtctggcggtggccagatttacagtcccaccatgagttaaagcccctggatatatgtgagttcccgttcggatccaaacagaaggaggtctgcatcaacccatatcattacaagcgtgtggaatcgccttag

SEQ ID NO: 205348 - DNA, 6 bp, Artificial Sequence
  Description of Artificial Sequence: Synthetic coding sequence
atgtag

SEQ ID NO: 205349 - DNA, 1395 bp, Artificial Sequence
  Description of Artificial Sequence: Synthetic coding sequence
atgaccagcatggccagcctgttcagcttcaccagccccgccgtgaagcgcctgttagggtggaagcagggcgacgaggaagagaagtgggccgagaaagctgttgatgccttggtcaagaagctgaagaagaagaaaggggccatggaagaactggaaaaggcactgtcctccccaggccagcccagtaaatgcgtgaccataccgaggagtctggacgggagattgcaggtgtcccatcgaaagggactaccacatgttatctactgtagggtgtggcgctggccagacttgcaatcccaccatgagctcaaaccgttggatatttgcgaattcccctttggctccaagcagaaagaagtctgcataaacccctaccactataaaagagttgagagtcctgttttgcctccagtactggttcctaggcacaacgagttcaatccacagcacagtctcctcgtccagtttagaaacttatctcacaacgaacctcatatgcctcagaacgcgaccttccctgactcttttcaccagccaaacaataccccattccccttaagccccaactctccttacccgccgagtccggcttcctctacatatcccaactctcctgcatccagcgggcccggctccccatttcagctgcctgctgacacacctccacccgcctacatgccgcccgacgatcagatgggccaggataacagccagcccatggacacatctaataatatgatcccccagattatgccttccatatcctcaagggatgttcaaccagtcgcttatgaggagccaaaacactggtgtagtatcgtatattacgaactgaacaaccgtgttggggaggcattccatgcatccagcacatccgtgctagtggatgggttcactgacccctcgaataacaagtcccggttctgcttaggtctgcttagcaatgtcaacagaaatagcactatcgagaatacgcggcgtcacatcggcaaaggagttcatctttactacgtaggcggcgaagtttatgccgagtgtctgtccgattccagcatatttgtgcagtcgcggaattgcaattttcatcatgggttccaccccacaacagtgtgtaagattcctagctcttgttctttgaagatctttaacaatcaggagtttgcgcaactcctagcccagtcagtgaatcatggcttcgaggccgtgtacgaattaacaaaaatgtgcacgattagaatgagcttcgttaagggctggggtgctgagtaccaccgccaagacgttacttcgaccccatgctggattgagatcttgcacgggcctttacagtggcttgataaggtgctaacccagatgggcagcccacttaacccgatctcctcagtgagctag

SEQ ID NO: 205350 - DNA, 1395 bp, Artificial Sequence
  Description of Artificial Sequence: Synthetic coding sequence
atgaccagcatggccagcctgttcagcttcaccagccccgccgtgaaacggctcctgggttggaagcagggggacgaggaagagaaatgggcagagaaggctgtggatgcgctcgtaaagaagctcaagaagaagaaaggggcaatggaggagcttgagaaagctcttagtagcccaggtcagccttctaagtgcgtgactattccacgcagcctagacgggaggctgcaggtgtcgcatcgaaaagggttaccccacgtgatctattgccgggtttggcggtggcctgacttgcagtctcaccacgaactgaaaccactagacatctgcgaattcccctttggcagcaaacaaaaagaggtttgcatcaatccctatcattataaaagggtggaaagtcctgtcctgcccccggtgctcgttcctcgccataacgaattcaatcctcagcactctctgctggtgcagttccgcaacctctcacataatgagccccatatgcctcaaaacgcgacgttccccgactcattccaccagccaaataataccccattccctctgtcacctaatagcccttaccctcccagcccagcctcctccacctaccccaattcccctgcttcatcgggtcccggatctccctttcaactgccggctgacaccccccctccagcgtacatgcccccagacgaccagatggggcaagataatagtcaacccatggacacctccaataatatgataccgcaaataatgccctccatttcaagccgagatgttcaaccagttgcttatgaagagccgaaacactggtgttctatcgtctattacgaactcaacaacagagtcggtgaggctttccacgcttcctctacaagcgttctggttgatggatttacagatccaagcaataataagtccagattctgtttgggcctgctcagcaacgtgaaccgtaactctactatagagaatacccggagacatatcggaaagggcgtccatctgtattatgttggaggtgaggtgtatgcggaatgcctctctgattccagcattttcgtccagagccgtaactgcaatttccatcacgggttccatccaacgactgtctgtaagataccaagctcctgttccctcaagatctttaacaaccaggagtttgcccagctgcttgcacagtccgtaaaccacggatttgaggctgtgtatgagcttacaaagatgtgtaccatacgaatgagcttcgtgaagggctggggggctgaatatcaccgacaagatgtgacaagcacgccatgctggattgaaatattgcacggacccctacagtggctggataaggtgctcacacagatgggcagccccctgaatccgattagctccgtgtcctag

SEQ ID NO: 205351 - DNA, 1491 bp, Artificial Sequence
  Description of Artificial Sequence: Synthetic coding sequence
atgttccggagcaagcggagcggcctggtgcggcggctgtggcggtctcgggtggtccctgatcgggaggaggggggaagcggcggcggcggcggcggcgatgaggacggctctctcgggagccgagcggaacccgcccccagagctcgcgagggcggggggtgtggacgctctgaagttaggccagtcgcccctcgccgaccaagagacgctgtcggccagcgaggtgcccagggtgcgggcaggagaaggcgggccggcggcccgcccaggcctatgtctgaacccggggctggggccggttctagtcttttggacgtcgctgagcctggcggcccagggtggctgcctgagtcagactgcgagaccgtcacatgctgcctcttttctgaaagagacgccgccggcgcacctcgggatgcaagtgacccgctcgctggagccgcactagagcctgctggcggcggaaggagcagagaggctcgcagcagacttttgttattggaacaggagctgaagactgtgacttatagcctcctgaaacgactgaaggagagatccctggacacccttcttgaggctgtggaaagcagggggggagtccctggcgggtgcgtactggtcccacgcgctgacctgagactgggcgggcagcccgccccaccacagttgctactgggccggctgttccgttggccagatctgcagcacgctgtggaacttaagcctctctgcggctgtcactctttcgccgctgccgcagatggaccaaccgtgtgctgtaatccatatcactttagtcggctgtgtggccctgaatccccgcctcccccgtactctcggctgtctccccgcgacgagtacaaacccctagatctgagtgactccacactgagctacactgagacagaagccacaaatagtctgatcaccgcgccaggagagttctctgacgcctcaatgtctcccgatgccacaaaaccttcgcattggtgctctgtcgcgtactgggaacatcgcacacgagtaggccggttatacgccgtctatgaccaagccgttagcatattttatgacctcccacaagggagtgggttttgtctgggccagcttaatctggagcaacgtagtgagagtgttcggcgcacacggtctaaaatcggattcggaattttgctgagcaaagagccggatggtgtctgggcttacaataggggcgagcacccaatctttgtcaactcgcctacccttgacgctcctgggggccgcgcattggtcgtccgcaaggtgcctcccggatatagtatcaaggtgttcgatttcgagagatcaggcctgcagcatgctcccgaacccgacgccgccgacggaccatacgaccccaattcagtgagaattagtttcgccaaaggatgggggccttgctattctaggcagtttatcacctcatgtccctgctggctcgagatcctgttaaataatccccgatag

SEQ ID NO: 205352 - DNA, 708 bp, Artificial Sequence
  Description of Artificial Sequence: Synthetic coding sequence
atgagccggatgggcaagcccatcgagacccagaagagccccccccccccatatagtcgcctgagtcctcgggatgagtataaaccactggacctgtctgacagcaccctgtcctacacagagaccgaagcaaccaattcgcttatcaccgctcccggcgaattctccgacgcttctatgtccccagatgccacgaaaccatctcactggtgttcagtggcctattgggagcatcgtacccgagtggggaggctttatgctgtctatgaccaggccgtgagcatattctatgacctaccccagggcagtggtttctgcctgggacaattgaatctggagcaacgatctgagtccgtacgccgcacacgatctaaaattggttttggcatcctgttgtccaaggagcctgacggggtgtgggcctataatcgaggagaacaccctatcttcgtcaatagcccaactttggacgcacccgggggacgggctcttgtggttcgcaaagtgcctcctgggtatagcattaaggtgttcgactttgaaagatcaggcctgcagcatgcacccgaacccgacgctgccgacggaccctacgaccccaattctgtcaggatctcttttgctaagggatggggtccctgctactcgagacaatttatcaccagctgtccctgttggttagagatcctgctaaataacccccggtag

SEQ ID NO: 205353 - DNA, 1017 bp, Artificial Sequence
  Description of Artificial Sequence: Synthetic coding sequence
atgttccggagcaagcggagcggcctggtgcggcggctgtggcggtctagagttgtccccgatagagaagaaggtgggtcgggcggtgggggaggcggcgatgaagacggatccctgggtagccgggctgaacctgcccccagggcccgcgagggggggggttgcggtagaagcgaagtcagacctgtggcacctaggagaccaagagatgccgtgggccagcgcggtgctcagggggccggtagacgccgcagggccggcggcccacctcggcctatgtccgaaccgggtgccggagctggcagcagtttgctagatgtggctgagccgggaggccctggatggctgcctgaatcggactgtgagacggtgacatgttgtctattctctgaacgtgatgccgccggggcacccagggatgcttcagacccattagctggagcagccctggagccagctgggggtggcagatcgagggaagcaaggtcgcgactgctgttactggagcaggagctgaaaaccgttacttactctttgttgaaaaggctaaaggagagaagtctcgataccctgctggaagcggtggagagccgaggtggcgtccccggcggttgcgttttagttccacgagccgacttgaggcttggagggcagcccgctcctccccagctcttgctgggcaggctatttcggtggcccgacttgcaacatgcagtggagcttaaacctctttgcggttgccacagtttcgccgcagccgctgatgggcccaccgtttgctgtaatccataccactttagtcgactctgcggtcccgagtctcccccccccccttatagccgcttatccccccgtgacgagtataaaccactggatttatcagactcaacgctgtcatacacggagacagaggccacgaactccctaatcaccgcacccggggagttctccgcagctgatgcagggattggaagtcgcggcaatagaggcctggagtcttcagtaccctgctcctag

SEQ ID NO: 205354 - DNA, 1293 bp, Artificial Sequence
  Description of Artificial Sequence: Synthetic coding sequence
atgcacagcaccacccccatcagcagcctgttcagcttcaccagccctgccgtaaagcgtctcctaggttggaagcagggagatgaggaggaaaagtgggcagagaaggccgtcgattcgctggtgaagaaattgaaaaagaagaagggagctatggatgagcttgaacgcgctctgtcctgtcctgggcagccatccaaatgtgttactatccctcggtcacttgatggaaggctgcaagtctcccaccgcaaggggctaccacatgtgatttactgccgtgtttggcgctggcccgacttgcagtcccaccacgagctaaagccgcttgagtgttgcgagtttcccttcgggtcaaaacagaaagaggtgtgcattaacccttaccactacagacgcgttgagactcccgtgctgccgcctgtgctcgttccacggcattcagagtacaacccacaactgtcattgttggctaagttccgctctgctagccttcactcagaaccgctgatgcctcataatgccacctaccccgattccttccagcaacccccctgcagcgctctccccccctctccttcgcatgctttcagtcaatctccttgcacagcctcctacccccatagccccggcagcccctccgaacccgaaagcccctaccagcattccgactttaggccagtgtgctatgaagagcctcagcattggtgctctgtggcttactatgaactgaataaccgggtgggtgagaccttccaagcgtcctctaggtccgtactgattgacgggttcactgaccccagtaataatcggaatcgcttttgcctgggcctgttatcaaatgtaaaccgaaattcgaccatagaaaacactaggaggcacatcggaaagggggtgcacctgtattatgttgggggggaagtttatgccgagtgcgtgtccgactcctcaatcttcgtgcagtcccggaattgtaattatcagcatgggtttcaccccgccactgtttgcaagatccccagcgggtgttccctgaaggtatttaacaatcagctgtttgcacaacttctcgcgcaatccgtgcaccatggatttgaggtggtttatgagcttacgaaaatgtgcacaatacgaatgtcattcgtgaaggggtggggagcggaatatcaccggcaggatgtcacttcgaccccttgctggatcgagatacatctgcacgggcctctgcagtggctcgataaggtactgactcaaatgggcagcccccacaacccgatctcctccgtgtcctag

SEQ ID NO: 205355 - DNA, 1404 bp, Artificial Sequence
  Description of Artificial Sequence: Synthetic coding sequence
atgcacagcaccacccccatcagcagcctgttcagcttcaccagcccagcagttaaaagactcctcggctggaagcagggcgatgaggaggaaaagtgggcagaaaaagctgtagactctctggtgaaaaaactcaagaagaaaaagggggctatggatgaattggagagagcccttagttgtcccggacagccctcgaaatgtgtcacaatacccagaagtctcgacggcagattgcaggtaagtcacaggaagggactcccacatgtgatctattgccgtgtctggagatggcctgacctccagtcacatcacgagctgaaacccttagagtgctgtgagttcccctttggtagcaagcagaaggaggtgtgcatcaacccctatcattatcgacgggtcgaaacacctgtgctcccacccgtcctggtccccagacattctgagtataacccccagctctcccttcttgcaaaatttcgatccgcatctctgcatagcgagccactgatgccgcacaatgccacgtacccagatagctttcagcaacccccatgcagtgctctcccgccatcaccatctcatgcattctctcagtctccttgcaccgcaagctaccctcactctcccgggtccccctccgagccggagtccccttaccagcactccgtggacaccccgccgctcccttaccatgccacagaagcttctgaaacccagtctgggcagcctgttgatgccacggcagatcgccatgtggtgctttcaatccccaatggcgactttaggcctgtttgttatgaggagccacagcattggtgctcagtggcctattacgagttgaacaatcgtgtaggcgagacatttcaagcctcctcacgaagcgttcttatcgatggctttaccgaccctagcaacaaccgaaatcggttttgtctggggcttctgtccaatgtgaacaggaattcaacaattgaaaatactcgcaggcatattggaaagggtgtgcatctgtattatgttggtggcgaagtgtacgctgagtgcgtgagcgatagttcaatattcgtgcaaagcagaaattgcaactaccagcatgggttccaccccgccactgtctgtaaaatcccttctgggtgttccttgaaggtgttcaacaatcagctgtttgcccagttacttgcccagagcgtacaccacgggttcgaagtcgtgtatgaacttactaagatgtgcaccatccggatgtccttcgtcaagggctggggcgccgagtaccacagacaggatgtcactagtactccatgttggatcgagatacacctgcacgggcccctgcagtggctggacaaagtcctgactcaaatgggctctccacataaccccatatcgtctgtgtcctag

SEQ ID NO: 205356 - DNA, 1404 bp, Artificial Sequence
  Description of Artificial Sequence: Synthetic coding sequence
atgcacagcaccacccccatcagcagcctgttcagcttcaccagccccgcagtgaagcgtctgctgggttggaaacaaggggatgaggaggaaaaatgggcagagaaagccgttgattccctggttaaaaagcttaaaaaaaagaaaggggctatggatgagctcgaacgggctcttagctgtcccggacagccgtccaagtgtgtcaccatccccaggtccttagacggaaggcttcaggtcagccaccggaaaggcctcccgcacgtgatctattgtcgtgtgtggagatggccggacctgcaaagccatcatgagctcaagcccttggaatgctgtgagttcccttttggaagcaaacaaaaggaagtgtgcatcaacccttaccattaccgccgagtggagacgccggttctaccacctgtgctcgtaccccgtcacagcgaatataacccccagctgagcctcttggctaaatttaggtcggcatcattacactctgagcccctgatgccacacaacgccacctaccctgattcctttcagcagcctccttgtagtgcactgccccctagccctagccacgccttctcgcaaagtccatgtaccgcctcatatccacactcccctggttcgccatctgagccagaaagcccatatcagcactccgtggataccccgcctttaccataccacgcaactgaagcatcggaaacacagagcggtcagcccgttgatgccaccgctgatcggcatgtggtgttaagcattccaaatggggactttcggcccgtgtgctacgaagagccacagcactggtgcagtgtcgcctactatgagctgaacaacagagttggtgaaaccttccaagcgagtagcaggtccgtcctgattgatggatttacggacccctcaaacaatcgaaaccgcttctgtcttgggcttctgtctaatgttaaccggaacagcacaattgaaaataccagacggcacattggcaaaggcgtgcacttgtactacgtggggggagaggtgtatgcagagtgtgtctcagacagtagcatattcgtgcagtcccggaactgcaattaccagcacggcttccaccctgcgacagtctgcaaaattccatcaggatgctcgctgaaggtattcaacaaccagctgtttgcacagcttctggcccagtcagtgcaccacggattcgaagtagtctatgagctcacaaagatgtgtaccattcgcatgtcctttgttaagggatggggggctgaatatcaccggcaggacgttacttctacaccttgctggatcgaaatccacttgcacggtccactccagtggctcgacaaagtgctcactcaaatgggttccccccacaaccccatctcttcagtgtcctag

SEQ ID NO: 205357 - DNA, 1191 bp, Artificial Sequence
  Description of Artificial Sequence: Synthetic coding sequence
atgaaggccgtgaagagcgagcgggagcggggcagccggcggcggcaccgagatggcgatgtggtcttacccgctggcgtggtggtcaaacaggaaaggctttcacccgaagtcgcaccgcctgcccatcgaaggcctgaccactcgggcgggagtccatccccaccaactagcgagccagcccgaagtgggcaccgcggaaaccgggcacgaggggtgtcacgcagtcccccaaaaaagaagaataaagcctctggacgccgctcaaagtcaccccgcagcaagcggaatagaagcccccaccactccaccgtcaaggttaagcaggaaagagaagatcatccaagaagagggagagaagacaggcagcacagggagccctctgagcaggagcaccgtagggctcgtaattctgatagggatcggcaccgcggccactcccaccaacgccgtacctccaacgaaaggcctggctcgggacagggacaggggagggatcgggatactcagaatttgcaggcccaggaagaagagcgggaattttacaacgcccgcaggagggagcatcgccagaggaatgacgtggggggcgggggcagcgagtcacaggaactggtaccccgccctgggggaaataataaagagaaggaagtccctgctaaagaaaaacccagctttgaactgtcaggggctctacttgaagatacgaacacttttaggggcgtggtgatcaaatactctgagcccccagaggccaggatccccaagaaacggtggcgactgtatccttttaaaaacgatgaggtgctcccagtaatgtacatccataggcagtcagcgtatctattagggaggcataggcggatagccgatattccgattgaccatccgtcctgctccaagcagcacgccgtgttccagtatcgattggtggagtatactagagcagacggaactgtaggaagacgggtgaagccttacattatcgatctaggctccggcaatgggacctttctcaataacaaaaggattgaacctcaaaggtattacgaactgaaagaaaaggacgtcctcaaattcggcttctcaagcagggagtacgtcctcctgcacgagtcttcagatacatcagaaatagatagaaaagacgatgaggacgaggaagaggaggaagaagtctcagactcgtag

SEQ ID NO: 205358 - DNA, 1143 bp, Artificial Sequence
  Description of Artificial Sequence: Synthetic coding sequence
atgaaggccgtgaagagcgagcgggagggcgtggtggtgaagcaggagcggctgagcccggaggtggcccccccagcacatcgcaggcccgatcatagcggtggatctccatccccacccacatcagaacctgctaggtctggtcacaggggcaatcgcgctcggggggtgagccgatcacccccaaagaaaaaaaataaagctagcggcaggaggagtaaatccccgcgttcaaaacggaatcgatctcctcaccattctacagtaaaggtcaagcaggagcgcgaagaccaccccaggaggggccgggaggaccgccagcacagggagccttcagagcaggagcacaggagagcacgcaatagcgaccgggatcggcaccgcggtcattctcaccaaagacgcacttcaaatgagcggcccgggtctggccagggacaaggcagggatagagatacgcaaaatctgcaggcacaggaagaagaaagagagttctataatgcacggcgaagagaacatagacagcgcaatgacgttggaggtggcgggagcgagagccaagagctggtaccccggccaggtgggaacaacaaggagaaggaagtgcccgcaaaagagaagcctagtttcgaattaagcggtgctctgctggaggacactaacacatttagaggcgtggtcataaagtacagcgaaccccctgaagcaaggatcccaaagaaacgttggagactctacccatttaagaatgacgaggtactaccagttatgtatatccaccgacagagcgcctacctcttaggtcgtcacaggcgtattgccgacatccccatcgaccacccttcatgctcaaagcagcacgccgtgttccaatatagactcgtcgaatatacacgggcagatggcaccgtaggaagacgcgtgaagccatacattattgatcttggatctggaaatggcactttcctgaacaataagcggattgaaccacaacggtactacgagcttaaggaaaaggacgtcttgaaattcgggttcagcagccgggagtacgtcctcctccacgaatcctccgatacatcggagatcgatagaaaagacgacgaggatgaggaggaggaggaggaagtctccgatagctag

SEQ ID NO: 205359 - DNA, 2274 bp, Artificial Sequence
  Description of Artificial Sequence: Synthetic coding sequence
atgagcaaccccggcacccggcggaacggcagcagcatcaagatcaggctcacggtgttgtgcgcaaaaaacttagctaaaaaagactttttccgcttgcccgacccattcgctaagattgttgttgacggatctggtcagtgtcattccaccgataccgtgaaaaatacattggatccgaagtggaatcagcactatgacctgtacgtggggaagacggattcgatcaccattagtgtgtggaaccataaaaaaatccacaaaaagcagggggccggattcttggggtgtgtaaggctgctatcaaacgccattagcaggctgaaagatactggctaccagcggctggatctctgtaagctcaatcccagcgacacagacgcagtccgcggccagatcgttgtcagcctgcagactagagacaggatcggcacaggcgggtcggtggtagattgccgcgggctgctggaaaacgaagggactgtgtatgaggattctggcccgggcagaccactcagctgcttcatggaggagcccgcaccttatacggattcaacaggcgctgccgctggcggcggcaattgcagattcgttgagagcccgtctcaggaccagcgcctgcaggcccagcgcttgagaaatcctgatgtgaggggctccctgcaaacccctcagaatcgccctcacggccaccagtctcctgagcttcctgagggatacgaacagcgaaccaccgtccaagggcaggtatatttccttcacacacagacaggggtctcaacgtggcacgacccccggatcccaagcccctccggaacaatcccagggggagatgccgcattcttatacgagtttcttctgcagggccacacctccgaaccccgagatttgaactctgtcaactgcgatgagctggggcctctgccgcctggctgggaagttcggtccacagtgagcggcaggatctactttgtcgaccacaataacagaacgacacagttcacggaccccagactgcatcacattatgaaccaccagtgccaactcaaggagccgtctcagccactgcctctcccttctgaagggagtctggaagacgaggaactcccagctcaacggtatgaacgcgaccttgtccagaagttgaaagtgctgcggcacgagctctccttgcagcagccgcaagccggccattgcaggatcgaggttagtcgggaagagatatttgaggaatcatacagacagataatgaaaatgcggccgaaagacctgaaaaagcggctgatggtcaaattccgaggggaagagggccttgactacgggggtgtggccagagagtggctctacctgctgtgtcacgagatgctcaatccctattacgggctgtttcaatactcaaccgataatatctacatgcttcagatcaaccctgattcaagtatcaaccccgatcatctttcatattttcattttgtgggccgtattatgggactggctgtctttcacggtcactatatcaatggaggcttcacagtgccgttctataagcaactgctaggtaaaccaatacagctcagcgatctggagtcagtagacccagaactccacaagagcttagtctggatactcgagaatgacattacccccgtcttggatcacaccttctgtgtcgagcataatgcttttggccgaatcctgcaacatgagctgaagcccaacggccgcaacgttccagtgaccgaggaaaataagaaagaatatgtgagactgtatgtgaactggcggttcatgcgcgggatcgaagcccagtttctggctctgcagaaagggttcaacgagttaattccacagcaccttctgaaaccgttcgaccagaaggaactcgaactcatcatagggggactggacaaaattgatctcaacgactggaagtcaaacactagacttaaacattgtgtggccgattccaatattgttcgctggttctggcaggccgtggagacgtttgatgaggaaagacgcgcgcgactccttcaattcgtgactggctccactagggtccctttgcaaggctttaaggcacttcaggggagcaccggcgctgctgggccccgtctatttaccatccacctcattgacgcaaataccgacaacctgcccaaggctcatacttgtttcaacagaatcgatatccccccctacgaaagctatgaaaaactgtacgaaaagctgctaacagccgtggaggagacttgtggatttgcagtcgaatag

SEQ ID NO: 205360 - DNA, 2196 bp, Artificial Sequence
  Description of Artificial Sequence: Synthetic coding sequence
atgagcaaccccggcacccggcggaacggcagcagcatcaagatccggctgaccgtgctatgcgctaaaaatctggcgaagaaagacttttttaggttaccggaccctttcgcgaaaatcgtagttgatgggtctggtcaatgccattccacagatacggtgaaaaacacactcgatcccaaatggaaccagcactatgacctctacgtcggcaaaaccgacagcatcacgatctccgtttggaaccataaaaaaattcacaagaagcaaggtgccggctttttaggttgcgttaggttgctgagcaatgccatttcccgcttgaaggacactggctatcagaggctggatttgtgtaagctcaatccatcagacactgatgcagttcgaggccagatcgtggtctccttgcaaacacgcgaccgcatcggaacaggcggttcggtggtggactgtaggggactcctcgaaaatgagggcactgtatacgaggacagcggtcccgggcgcccactctcctgtttcatggaagagcctgctccttacactgattctactggcgctgcagctggcggtgggaactgccgtttcgttgaatccccttcacaggatcagcgtctccaggcacagcggctgcgcaacccagatgtgagggggagcctgcagactccgcagaacagacctcacggccaccagtccccggagctgcctgagggttacgagcagagaaccaccgttcagggacaggtctactttcttcatacacagaccggagtgtctacatggcacgacccaagaataccgagggatctgaatagcgttaactgtgatgagctgggtccactgccccccggttgggaggtccgctccacagtatctggtcggatctatttcgtggatcataataacagaacaacccagtttacagaccctagactccatcacatcatgaaccatcagtgccaactcaaggagcctagccagccactgccacttcctagtgaggggagcctggaggacgaagagctcccagcccagagatatgaacgagatcttgtccaaaagctcaaggtactgcgccatgaattatccctgcagcagccccaggcgggacattgccggattgaagtcagccgagaagaaattttcgaggagtcataccgccaaatcatgaagatgagacctaaggacctgaaaaaacggctgatggtcaagtttcgcggggaggaggggctggactatggtggcgtagcaagggaatggctttacttgctatgtcatgagatgttgaacccatattatggcttatttcagtacagtacagataacatctacatgctccagattaaccccgacagttctattaaccccgaccacttgagttacttccacttcgtagggagaatcatgggcctggcagtgtttcatggccactacataaatggcggcttcacagtacccttttacaagcaactgctgggtaagccgatccaattgtccgatctggaatccgtagaccccgagctgcataagagtctcgtctggatcttagagaacgacattacccccgtcctagatcacaccttttgcgtggaacataatgcatttgggaggatcctgcagcacgaacttaaacccaacggtaggaacgtccccgtcactgaagaaaacaagaaagagtatgtcaggctttacgtgaactggaggttcatgagaggaattgaagcacagtttctcgccctgcagaaaggctttaatgagctgattccacagcatctgctgaagccctttgatcagaaagagctagagctgatcattggcggtttagacaagatcgacctgaatgactggaagagcaacactcggctgaaacactgcgttgctgattccaatatagtgcggtggttctggcaggctgtggagacctttgacgaagagaggcgtgcgcgcctgctgcagttcgttactggctcaacccgggtcccactgcaggggtttaaggccctacaggggtctactggtgctgctgggcctcggttgttcacgattcacctcatcgatgccaatacagataacctgccgaaggcccacacctgcttcaacagaatcgacatccccccctatgagtcctacgagaagctgtacgagaagttattgacggccgtggaagaaacctgcgggtttgccgtggaatag

SEQ ID NO: 205361 - DNA, 1323 bp, Artificial Sequence
  Description of Artificial Sequence: Synthetic coding sequence
atggccacccggagctgccgggagaaggcccagaagctgaacgagcaacaccagcttattctttccaagctgttgcgggaagaggacaacaagtattgcgctgactgcgaagccaaggggccaaggtgggcctcctggaatataggtgtatttatctgcatccggtgtgccgggattcatcgcaacttaggcgttcacatttcccgcgtgaaatcagttaacctggaccagtggacagcagagcaaatccagtgcatgcaagacatgggaaacactaaagcccgcttgttatatgaggctaacctccccgagaatttccgcaggccccaaaccgatcaagcagtcgaattctttatccgggataaatacgaaaagaaaaaatactatgacaagaacgcaattgctataacgaacaaggagaaggagaagaagaaggaggaaaagaagcgtgagaaggaacccgaaaagccagccaaacccctgacagctgagaaactgcagaagaaagaccagcagttggagcctaagaagagcacctcacccaagaaggcagccgaacctacagtcgatctcttaggtcttgatgggcccgcggtagcacccgtgaccaacgggaacacaaccgtgccacctctcaacgatgacctcgacatttttggacccatgatatccaacccgcttccggcgacggttatgccccctgcacaaggtaccccctctgctcctgccgctgctactctcagcactgtgacttccggagatctggacctgttcactgagcagacaacaaaatccgaggaggtggcaaagaagcaactctccaaagactctattttgagcctttacggcaccggcacaattcaacagcaaagcactcctggcgtgtttatgggacccaccaatatccccttcacgagccaggctcctgctgcctttcaggggttccctagcatgggagtgcctgtgccagccgctccaggcctcataggcaacgtaatgggacagtctccttcaatgatggtcggcatgccaatgcctaatggtttcatgggaaatgcacagaccggagtgatgccactgccccagaatgtagtggggccacaggggggtatggtgggacagatgggggcccctcagtcaaagtttgggttgccgcaagcccaacagcctcagtggtccctgtcccaaatgaatcaacagatggccgggatgtctatctcaagcgcaacccccacagccggattcggacagccctcctccaccaccgctggctggtcagggtcctcgtctggacagaccctttcaacacagctctggaaatag

SEQ ID NO: 205362 - DNA, 489 bp, Artificial Sequence
  Description of Artificial Sequence: Synthetic coding sequence
atgggcaacaccaaggcccggctgctgtacgaggccaacctgcccgagaactttcggaggccccagacagaccaggcagtggaattttttatccgggacaagtacgaaaaaaagaagtattatgacaaaaacgcaatcgccattaccaacatatcatcgagtgatgcccctctgcaacctcttgtatcctccccatccctgcaagctgctgttgataagaataaactggagaaggagaaagagaagaaaaaagaagagaagaaacgggaaaaagagcccgagaaacccgccaaaccacttaccgcggagaagctgcaaaaaaaagatcaacagctggaacccaaaaaatctacaagccctaagaaggccgcagaaccgacagtagaccttcttggtctggtttggcgaaagatcgaaaaagagaagagcgagaggcagttagtggaagtcgaagagctaaccttcatgtactgtttccccaagaattag

SEQ ID NO: 205363 - DNA, 1311 bp, Artificial Sequence
  Description of Artificial Sequence: Synthetic coding sequence
atggccacccggagctgccgggagaaggcccagaagctgaacgagcagcatcagctcatcttgagcaagctcctccgggaagaagataataaatactgtgccgattgcgaagcaaagggccctagatgggcaagttggaacataggcgtgttcatttgtattcgctgtgccggcatccaccgcaatctcggagtccatatctcacgggttaagagcgtgaatttggaccagtggactgcagaacagatccagtgtatgcaagatatgggtaacacaaaagcaaggctcctgtatgaggccaacttgcccgagaattttagacggcctcagactgaccaagcagtggaattttttatccgagacaagtatgagaagaaaaagtactatgataagaacgcaatcgccattactaacaaggagaaagaaaagaaaaaagaagagaaaaagcgagagaaagaaccagagaaaccggccaaaccactaaccgcagaaaagttgcagaagaaagaccagcagctggagcccaagaaatccacctccccaaaaaaagccgctgagcccacagtcgatcttctaggtctggacggacccgccgtcgcccctgtcaccaacggcaacactacggtgccacccctcaatgacgatctagatatctttgggcctatgatttcaaacccgctgccggctactgtgatgccacctgctcaggggactccttcagctccagcagctgccacactgtctacagtcaccagcggagatctcgacctgtttacagagcagacgacaaaatcagaagaggtagccaaaaagcaactcagtaaggactcaatcctgtccctgtatggaacgggcacaatccagcagcaatccactcccggagtttttatgggcccaaccaatatacctttcacttcccaggcacccgccgccttccaagggttcccgagtatgggcgtgccagtccccgcagcccctgggcttataggcaatgtaatgggccagtcccctagcatgatggtgggcatgcccatgcccaatgggttcatgggtaatgcacagacaggtgtcatgccactgccccagaatgtagttggaccccagggcggtatggtcggccagatgggtgcaccacagagtaagttcggcctgcctcaagcccaacagccacagtggtctctgtcacagataatgcagaaaggagacgcggtgctccagcactccatttccgctatctactggccgatgaccagatggctaaaatgccctctggttgatgagagcgcggacggatggcacgagtaccagtag

SEQ ID NO: 205364 - DNA, 1404 bp, Artificial Sequence
  Description of Artificial Sequence: Synthetic coding sequence
atggccacccggagctgccgggagaaggcccagaagctgaacgagcagcatcagctgatcctgtccaaactgctgagagaagaggataacaaatactgtgcagactgcgaagctaagggcccacgttgggcttcatggaatatcggcgtcttcatctgcatacggtgtgcaggtatccaccgcaacctgggcgtgcatatcagtagggtgaagtctgtcaacctcgaccagtggacagccgaacaaatacagtgtatgcaggatatggggaataccaaggcaaggcttctgtatgaagctaatctgcctgagaatttcagacgcccacagaccgaccaggcagtagaattcttcatccgggacaaatacgaaaaaaaaaagtattacgacaagaacgccattgctattaccaatataagcagctctgacgctcctctgcagccactggtatcaagcccctctctgcaggctgccgttgacaagaataagctggagaaggagaaagagaaaaaaaaggaagagaagaaacgggaaaaggagccagagaagcctgccaagcccctgacggccgagaaattgcaaaagaaagatcagcagctggagccaaagaaatcaacctccccgaagaaagctgcagaaccaactgtggatctgctgggattggatggccctgccgtggcccccgttacaaatgggaacactaccgtgcctccattgaatgatgatctggatatctttggccctatgatctctaatccattgcccgctacagttatgcctcccgctcagggaaccccatccgccccagcagcagcaacattgagcacagtgactagcggtgatctcgacctgttcacagaacagacaacaaagagcgaagaggtggccaagaagcaattgtctaaagatagcatcttgagtctgtacgggacagggactatccagcaacagtcaaccccaggcgtgtttatgggaccaactaacatcccctttacctctcaggcacctgcagccttccaggggtttccaagcatgggggtcccagtgcccgctgcccccggtcttataggcaatgtcatggggcagagccctagcatgatggttggtatgccaatgccaaacggctttatggggaacgcccagaccggcgtcatgcccttgccccagaatgttgtcgggccccaaggcggaatggtagggcagatgggagccccccaaagcaaatttggcctgccgcaggcacagcagccccagtggtcactgtctcagatgaatcagcaaatggcaggaatgagtattagctcagcaaccccaaccgcaggattcggtcagcctagttctactacagcaggatggagcggaagtagcagtgggcagaccctctcaactcagctctggaaatag

SEQ ID NO: 205365 - DNA, 414 bp, Artificial Sequence
  Description of Artificial Sequence: Synthetic coding sequence
atggccacccggagctgccgggagaaggcccagaagctgaacgagcaacaccagcttatcctctccaagctgctcagggaagaggacaataagtactgtgctgactgcgaggcgaaggggcctaggtgggcaagttggaacataggtgttttcatctgcatccggtgtgcagggattcatcgcaatttaggagtgcatattagccgagtcaaaagtgtcaatctggatcagtggacagccgagcagatccagtgtatgcaggacatgggcaacacaaaagcacggctattatacgaggccaatctgcccgaaaatttcagacgacctcaaaccgatcacgaggacattatcttagaaacgacagctgtgatcaccctattgctgaataagtgtctgccatatgctaagccttag

SEQ ID NO: 205366 - DNA, 378 bp, Artificial Sequence
  Description of Artificial Sequence: Synthetic coding sequence
tgaaagtactacgacaagaacgccatcgccatcaccaacatcagcagctccgacgctccgctgcaaccgctcgtgtcgtctccatcccttcaagcagctgtcgataagaacaagctggaaaaagaaaaagagaaaaaaaaggaggaaaagaagcgtgaaaaagagcccgagaaacccgctaaaccgcttactgcggaaaagctccagaagaaggaccaacaactagagccgaagaaatccacatctcctaaaaaagccgctgaacccactgtagatcttctgggtttggtgtggaggaaaattgaaaaagaaaagtccgagcggcagctcgttgaggttgaggaattgaccttcatgtactgttttcccaagaattag

SEQ ID NO: 205367 - DNA, 189 bp, Artificial Sequence
  Description of Artificial Sequence: Synthetic coding sequence
atgctgttcctgaagctgagcgtgttccgggccgtggagttcttcatcagagataagtatgagaaaaaaaaatactatgacaagaatgccatcgccatcaccaatatctcatcatcagacgccccccttcagcctctagtcagtagtccctccctccaggcggcggtagataaaaataagttagagtag

SEQ ID NO: 205368 - DNA, 1200 bp, Artificial Sequence
  Description of Artificial Sequence: Synthetic coding sequence
atgatcttcaagggcccccggtgggccagctggaacatcggcgtgttcatatgcatcaggtgcgctggcattcatagaaatttaggcgtccacattagtcgcgtgaaatctgttaatctggaccagtggacccaggagcagattcagtgcatgcaggaaatgggcaatgggaaggcaaatcgtctctacgaagcttatctgcctgagaccttccggcgcccacaaatcgaccccgcagtcgagggattcatcagggataagtatgagaagaagaaatacatggacaggtcactggacatcaatgctttccgcaaggaaaaggatgacaagtggaagcgcggttcggaacctgtacccgaaaagaagctcgaaccggtagtgtttgagaaagtgaagatgccacaaaaaaaagaggatcctcagctgccccgcaaatcttcccccaagtcgacagcccctgtgatggatctgttgggactcgacgcgcccgtcgcatgctctatcgctaattctaaaaccagcaatacgttagaaaaggatctcgaccttctagcttcagtaccctcccccagctcgagcgggtcccgcaaagtggtgggcagcatgccaaccgctggctccgccggatccgtgcccgagaacctgaatctctttccggagccaggttccaagtcagaagagatcggcaagaaacagctctcaaaggatagtattctgtccctgtatggctcccaaacccctcaaatgcctacacaagcaatgttcatggcacctgcccagatggcctaccccacagcctacccctcatttccgggcgtgacgccgccaaatagcatcatgggaagcatgatgccaccacctgtgggcatggtggcgcaacccggggcgagcggtatggtcgctccaatggcaatgccagccgggtacatgggtggaatgcaggcttccatgatgggcgtgccgaacggcatgatgaccacacagcaggcagggtacatggccggaatggcggctatgccacagaccgtgtatggagtacaaccagcacagcagctgcagtggaatttaacccagatgactcagcagatggccggaatgaacttctacggagcaaatggaatgatgaattatgggcagagcatgtccggaggtaacggccaagccgctaatcagacactctccccacaaatgtggaagtag

SEQ ID NO: 205369 - DNA, 1290 bp, Artificial Sequence
  Description of Artificial Sequence: Synthetic coding sequence
atgaccggcaagagcgtgaaggacgtggaccggtaccaggccgtgttggctaacctcctgcttgaagaggacaacaaattttgcgcagactgccaaagcaaaggcccacggtgggcttcatggaatatcggggtttttatctgcattcgctgtgccgggattcatagaaatctaggcgtgcacattagccgcgtgaagtccgtgaacctggatcagtggactcaggaacagatacaatgcatgcaagagatgggaaatggcaaggcgaacaggctctacgaagcctacctgcctgaaacattcaggaggccacaaatcgatcccgcagtggaaggcttcatccgagataagtatgagaaaaaaaaatacatggaccggtctctggacatcaacgcctttaggaaagagaaagatgacaaatggaaaagaggctctgaaccagttcccgagaaaaagcttgaacctgtcgtgtttgaaaaagtgaaaatgccccagaaaaaggaggaccctcagctccccagaaaatcgagtccaaagagcaccgcccctgtaatggacttactgggcctcgacgccccggtcgcctgcagcatagccaatagtaaaacgagtaacaccctggagaaagacctggatttgctcgcctccgtcccctctccaagctcctctggctcaaggaaggtcgtggggtcgatgcctacagcgggtagcgccggatctgttcccgaaaatctgaacctgttccccgaaccaggctctaaatctgaagagatcggaaaaaagcagctgtccaaagattcaattctttctctgtatgggtcccagacccctcaaatgccaacgcaggcgatgttcatggcccccgctcagatggcctatccaacagcatatccatcattccctggggtgacaccacctaactctattatgggcagcatgatgcccccaccggtcggtatggtggctcagcccggcgccagtggtatggtggccccaatggctatgcccgcagggtacatgggcgggatgcaggcatccatgatgggggtgccaaatggcatgatgaccactcagcaggccgggtatatggcaggcatggccgctatgccacagacggtgtacggcgttcaaccagcacagcagctgcagtggaatttgactcagatgacgcagcagatggccgggatgaatttttacggggcaaacggtatgatgaattacggacagtctatgtctggcggcaacggtcaggccgccaaccagaccctgagtcctcaaatgtggaagtag

SEQ ID NO: 205370 - DNA, 684 bp, Artificial Sequence
  Description of Artificial Sequence: Synthetic coding sequence
atgaccggcaagagcgtgaaggacgtggaccggtaccaggccgtgcttgctaacctgctgctggaggaggacaataaattttgcgctgactgccaatcgaaagggcctagatgggcttcctggaacataggcgtgtttatctgtatcagatgcgccggaatccatcgcaatctgggcgtacacatatccagagtgaagagcgtgaatctcgaccagtggacccaagaacagatccaatgtatgcaagagatggggaatggaaaggcaaacaggctgtacgaggcataccttcccgagactttccgtcgcccccaaattgaccctgccgtggaggggttcatcagagataagtatgagaagaagaaatatatggatcgttctctcgatatcaatgccttccgcaaggagaaagacgacaaatggaagcgtggaagtgaacctgtgcccgagaagaagctcgagcctgtggttttcgaaaaggtaaagatgccccagaaaaaagaagatccgcaactccctcggaaatcttcgcctaagagcactgcccctgtgatggacttgctgggcctggacgcgcctgtagcatgctccatcgccaatagcaagacgtctaacacattggagaaagatttggatcttctcgcctccgtgccatctcccagctctagcggttccaggaagtag

SEQ ID NO: 205371 - DNA, 1050 bp, Artificial Sequence
  Description of Artificial Sequence: Synthetic coding sequence
atgcaggagatgggcaacggcaaggccaaccggctgtacgaggcctacctgcctgagacgttccgccggccccagatcgacccagccgtcgaggggttcattagagataaatatgaaaaaaagaaatacatggatagatcattggatataaatgcctttcgcaaagagaaggacgataaatggaaaaggggttccgaacccgtgcccgagaaaaagttggaacccgttgtcttcgaaaaagtcaagatgcctcagaagaaagaagatccccagctgcctcgcaagtccagccccaaaagcaccgctcccgtaatggatctgctgggactggatgcgccagtcgcatgctctatcgctaacagtaaaacctccaacaccctggagaaagatctggacctgctcgcaagcgtcccgtctccatcgtccagtggatcacggaaagtggtgggctcaatgcctacggccggtagcgcgggttctgtccctgagaatctcaacctctttccagagcccggtagtaagagcgaagaaattggcaagaagcagctatctaaagatagcatcctgagcttatacggttcccagactcctcagatgcccactcaggccatgttcatggcacccgcacagatggcttatcccacggcttacccgagtttccccggggttacgccccctaactctatcatgggctccatgatgccccctcctgtcggaatggttgcccagcctggtgcttcaggaatggtagcccccatggctatgccagcagggtatatgggtgggatgcaggcatcgatgatgggtgtgcctaatgggatgatgacaactcagcaagctggctatatggccggaatggcggccatgccccagactgtgtacggagtgcagcccgcgcaacagctgcagtggaacctgactcagatgacacagcagatggcagggatgaatttctatggagccaacggaatgatgaactacgggcagtcaatgtccggtggaaacggacaggccgcaaaccaaactctgagtccccaaatgtggaaatag

SEQ ID NO: 205372 - DNA, 189 bp, Artificial Sequence
  Description of Artificial Sequence: Synthetic coding sequence
atggcccggggcaaccagcgggagctggcccggcagaagaacatgaagaagacacaagagatcagcaagggaaaaagaaaagaggattcactcactgcttcgcagagaaaacagagagacagtgagatcatgcaagagaaacagaaggcagctaatgagaaaaagtcgatgcagacacgcgagaagtag

SEQ ID NO: 205373 - DNA, 333 bp, Artificial Sequence
  Description of Artificial Sequence: Synthetic coding sequence
atggcccggggcaaccagcgggagctggcccggcagaagaacatgaagaaaacacaagagatctccaagggcaaaaggaaagaggattccctgactgcctcgcagcgtaaacagtcatcaggaggccagaaaagtgagtcaaagatgtctgctggcccccacctgccactcaaggcgcccagagaaaatccttgctttcctctgcctgcggctggaggatctcggtattacttggcttatgggagtattacgccaatttccgccttcgtctttgtggtgtttttcagtgttttctttccttctttctatgaagatttctgttgttggatatag

SEQ ID NO: 205374 - DNA, 147 bp, Artificial Sequence
  Description of Artificial Sequence: Synthetic coding sequence
atgaagaagacccaggagatcagcaagggcaagcggaaggaggactctctgactgcaagtcagcggaagcagcgggacagtgagatcatgcaggaaaaacaaaaagccgctaatgagaagaagtctatgcaaactcgagagaagtag

SEQ ID NO: 205375 - DNA, 63 bp, Artificial Sequence
  Description of Artificial Sequence: Synthetic coding sequence
atgaagaagacccaggagatcagcaagggcaagcggaaggaggacagcctcaccgcttcctag

SEQ ID NO: 205376 - DNA, 291 bp, Artificial Sequence
  Description of Artificial Sequence: Synthetic coding sequence
atgaagaagacccaggagatcagcaagggcaagcggaaggaggactctctcacagctagtcaacgcaaacagagcagcggagggcagaagagcgaatctaagatgtcagcaggacctcaccttcccctcaaggcccccagggaaaatccctgctttccgctacctgcagcgggtggctcccggtattatctggcgtatgggtccattacgcctataagtgctttcgtcttcgtagtgttcttcagcgtgttctttccctcattttatgaagacttctgttgctggatctag

SEQ ID NO: 205377 - DNA, 270 bp, Artificial Sequence
  Description of Artificial Sequence: Synthetic coding sequence
atgaagaagacccaggagatcagcaagggcaagcggaaggaggactcactgaccgctagccagcggaaacagtcttcaggaggacagaagtctgaatccaaaatgtccgctgggccccacctgcctctcaaagcccctcgggaaaatccgtgttttccactccctgcagcaggggggtctcgatactatctggcctatggctcaattactccaattagcgcattcgtgtttgtagtgttcttctctgttttcttcccctctttctattag

SEQ ID NO: 205378 - DNA, 3156 bp, Artificial Sequence
  Description of Artificial Sequence: Synthetic coding sequence
atgggcagcgccgaggacgccgtgaaggagaagctgctgtggaacgtgaagaaagaggttaaacaaattatggaagaggccgtgacacgtaagtttgtgcacgaggacagcagccacattatagccctgtgcggggccgttgaggcttgcctcttacatcagctgaggcggagagccgccggcttcctgagaagcgataagatggcagcactgtttaccaaggtgggtaagacatgtcccgtggcgggcgaaatatgtcacaaagttcaggaattgcaacagcaggcggaggggaggaagccgtctggagtcagccaggaagcgctgcgccggcaggggagcgccagtggaaaagctccagccttgtcgccccaagctctaaagcatgtctgggtgcgaacggctctcatagaaaaagtgctcgataaagttgtacagtacctggccgagaactgctcaaagtattatgaaaaggaggcccttctcgcggatccagtctttgggcccatacttgccagtctgctggtgggcccatgcgccctcgagtacacgaaactgaaaacagcagaccactattggacagatccaagcgccgacgagctcgtccagagacatcgcatcagaggaccgcccactcgacaagacagccccgcgaagagacctgctctcggtatacgaaaacggcactcttccggcagtgcttccgaggaccgactggctgcatgcgcccgggaatgcgtcgagtcgctacaccaaaactcaagaacgcggctcttgtatggcaagaaccacgtattagtccagccaaaggaagatatggaagccgttcccggctatttgtcgttacatcagagcgccgagtcacttactctgaagtggactccgaaccagctcatgaacggcactctcggcgacagcgagctggagaagagcgtatactgggactacgcgctagtggttccattctcccaggtggtgtgcatccactgccatcagcagaagagtgggggcacgctggttctcgtgtcccaagatggaatacagcgcccccctctgcacttcccacaaggaggacacctcctcagcttccttagttgtttggagaacggtctcctcccccggggccagttggaacctccactgtggacccaacagggtaagggaaaagtcttcccgaaattgcggaaacggtcttcaatccgctccgtagacatggaagagatgggtacagggagagcaactgactacgtgttcaggattatttacccagggcatcgacacgaacacattacaatcaattaccatcatctggccgcgagcagggcggcctccgtggatgatgacgaggaagaggaggacaagctgcatgccatgctttccatgatatgtagccgaaacttaacagcccccaatcctatgaaggatgccggtgacatgattgagatgcagggcttcggaccatccctgcccgcctggcatcttgaacctctgtgttcacaaggatctagttgtttgagctgctcctcaagtagctccccacacgcaaccccttcccactgttcttgtattcctgacaggctccctctgaggctgctgtgcgagagcatgaagagacaaatcgtctccagggctttctatggatggctcgcccattgccgtcacttatcaaccgtcaggactcacctcagcgccctcgtccatcacagcgtgattccgccagaccggccacctggagctagtgccggcctgactaaggacgtgtggtcaaaatatcaaaaggacaaaaaaaactacaaggagctggagttacttaggcaggtgtactatggcggcatcgaacacgagatacgcaaggacgtctggccattcctactgggccattacaaattcggcatgtccaaaaaggaaatggaacaagtggatgcagtagtagctgcgagatatcagcaggtcctggctgagtggaaggcttgcgaagtagtggttcgacagagggagcgagaggcccatcccgccacccggaccaagttctcttctggtagttctattgattcccacgtgcagcgcctcatccaccgcgatagcaccatttcgaatgacgtgtttatttcagtcgatgaccttgagcccccagaacctcaggacccagaggatagcaggccaaagccagagcaggaggctggtcctgggacccctggcaccgctgtggttgagcagcagcattccgtagagttcgactcccctgattcgggcctgccatccagcaggaattactctgtggcatcaggaatacagtcctccttggacgagggacagtccgttggattcgaggaagaagatggtggaggtgaggaaggtagtagtgggcccggaccagctgcgcataccctgcgggaaccccaggatcccagccaggagaagccgcaggctggtgagctcgaggctggtgaagagttagctgccgtctgcgccgctgcctatactatcgagttgctggacactgttgccctgaacctgcatagaatcgacaaggacgtgcaaaggtgtgaccggaattactggtattttacgcctccaaatctggagaggctgagagatgtgatgtgtagttacgtgtgggagcacctggacgttggctacgtccagggaatgtgcgatctgctagccccactcctggtcacactggacaacgaccagctcgcgtacagctgttttagccaccttatgaaacggatgtcccaaaatttcccaaacgggggcgccatggatactcactttgcaaatatgaggagcctgatacagattctcgattctgagctgttcgagctgatgcatcagaatggcgactacacacacttctacttctgctatcggtggttcctactggatttcaagagagaattgctgtacgaggacgtattcgctgtatgggaggtaatctgggctgcaagacatatctctagcgagcatttcgttctctttatcgccctggccctcgtcgaggcctatagagaaattatccgggataacaatatggattttacggacattattaaattctttaatgaacgggcagagcatcatgatgcccaggaaatcctgcgaatcgccagagatttggtccacaaagttcagatgctaattgagaataaatag

SEQ ID NO: 205379 - DNA, 3021 bp, Artificial Sequence
  Description of Artificial Sequence: Synthetic coding sequence
atgggcagcgccgaggacgccgtgaaggagaagctgctgtggaacgtgaagaaagaggttaagcagattatggaagaggctgtgacacgcaaattcgtgcacgaagactcgagccacattattgctctttgtggagcagttgaggcctgcctcctacatcaactgaggagacgcgctgctggctttctaaggagcgacaagatggctgcactctttacaaaggtgggaaagacatgccccgtagctggagaaatttgccacaaagtgcaggagttacaacagcaggcagagggccggaaaccctctggggtctcgcaggaagctttacgacggcagggctccgcttctggcaaggctcctgccctgagtccgcaagcactcaagcatgtgtgggtccgcaccgccctcatcgagaaagttctggacaaagtggtgcaatacctagccgagaattgttccaagtactatgagaaggaagcgctgctggcagatccagtgttcggtccaatcctggcaagcctgctagtgggcccgtgcgccctggaatacaccaaattgaaaacagcagaccactactggacggaccccagcgcagacgaactagtccagcgacaccgcatccgtggcccacccactcggcaggatagccccgccaagcgtcctgcgctgggtattcgcaagcgtcattcttctggcagcgccagcgaggatcgcctggcggcctgtgcgcgcgaatgtgttgaatcactccaccagaacagtaggacgaggctactctacggtaagaaccacgttctggtacagccaaaagaagacatggaggcggtgccaggctatctctctcttcaccagtctgcagaaagtctgactctaaagtggaccccaaaccagttaatgaatggcacactaggggacagcgagcttgaaaaaagcgtgtactgggattacgctttggtagtgcctttcagtcaagtcgtctgtattcattgtcatcagcagaagtccggcggcacattggtcctcgtctcacaggacggtatccagagaccccccctccactttccccaaggcggacacttgcttagcttcctgagctgtctcgaaaatggcctgctgccccgggggcagcttgagcctcccctttggacacagcaggggaaaggcaaagtgttcccgaaacttcggaagaggagttctatcagaagcgttgatatggaggaaatgggcacgggacgcgcaactgactacgtcttcaggattatatatcctggccatagacacgagcacaatgctggagacatgatcgagatgcagggctttggaccatcgctgcccgcatggcatcttgaacctctgtgctcacaggggtcaagctgtctatcctgcagctcatcaagttcacctcatgctacgccgtcacactgttcgtgcatccccgaccggctcccacttagactgctctgcgaatctatgaagagacagatagtatctcgtgcattctacggttggctggcacactgccgccatctttctactgtccggacgcatctttcagctctcgttcaccactccgtcattccacccgatagaccaccgggggcctctgcaggtctgaccaaggatgtctggagcaagtatcagaaggataagaaaaactataaagagttggaactgctgcggcaggtctattacggcggaatcgaacacgagattcgcaaagacgtatggccatttctgctggggcactacaagtttggcatgtcaaagaaggaaatggaacaagttgatgccgtggtcgcggcccggtatcagcaggtcctggccgaatggaaggcgtgcgaggtggtggtgagacaacgagaacgagaggcgcatccagccacccgtacaaagttttcttccgggtcaagcattgacagccacgtgcagagactaattcatcgcgacagcacaatcagtaatgacgtgtttatctccgtggatgacttggaaccgcccgaaccccaggatcctgaggactcaaggcctaagccagaacaggaagctggacccggaacccccggtaccgcggtggtagagcaacagcattcagtggagttcgatagtccagattctgggctacccagctcaagaaactattctgtcgcctctggtattcagtctagtctagacgaaggccaaagcgtcggctttgaagaggaggacggcgggggggaagagggatcttctggccccggacccgcagcccacacccttcgcgagccgcaagacccgtcacaggaaaaacctcaggctggagagcttgaagcgggagaggaactggcagctgtttgtgctgcagcctacactatcgagctgttagatactgtcgccctgaatttacatcggattgataaggacgtccaaaggtgcgacagaaattactggtatttcacgcctccaaacctggaacggctccgggacgtaatgtgcagctatgtgtgggaacacctggacgttggctacgtccagggcatgtgtgacttgctagctccgctgctcgtaactctggacaacgatcagttagcttactcctgtttctctcatctcatgaagagaatgtcacagaacttccccaacggcggtgcgatggatacgcactttgcaaatatgagaagcctcattcagattttggactcggagctatttgaactaatgcaccagaacggcgattatacacatttttacttttgctacaggtggttccttctggactttaaaagagagctgctttatgaggacgtctttgctgtgtgggaagtgatatgggcagcaaggcatatcagctcagagcattttgtcttattcatcgcgcttgccctggtggaagcatatcgggagataatacgagacaacaacatggatttcaccgacatcatcaagttttttaacgaaagagccgagcatcacgatgctcaggaaatacttagaatcgcacgagatctggttcacaaagtgcagatgttaatcgagaataaatag

SEQ ID NO: 205380 - DNA, 795 bp, Artificial Sequence
  Description of Artificial Sequence: Synthetic coding sequence
atgtgccacaagaacggcttcccccaggagggcggcatcaccgccgctttcctccagaagcggaagctgcgcctgagcaagaaccacaggccagcccgggccaaggtgacagaacacgtccgtggcacccgaccaggcagagctacggccggtccggccgcctctacccgcgccgctgggtccttgtttttcgatcgttgggggaatcggggtcctgccgggtgcaggggatcatctcatctgccccagcagctcaaattcactacctcggatagctgtgatcgaataaaagacgagttccaactgctgcaggcccagtaccacagcctaaagctggaatgtgataaactggcctccgaaaaatcggagatgcagcgccactatgtgatgtattacgaaatgtcttacggcctgaatattgagatgcataagcaggcggagatcgtaaaacggcttaatgggatttgcgcccaggtgttgccctatttaagccaggagcaccagcagcaggtgctgggggcgatcgagcgggccaagcaggtgactgcacccgagctgaattctatcatccggcagcagctccaggctcatcagttgtcgcaactacaggcattggccctgcctctgactcccttgccagtgggcctgcaaccaccatcgttaccagccgtgtctgctggaactggactcctgtccctgtctgctctgggttcccaggcccatttaagtaaggaagacaagaatggccacgacggtgacacacatcaggaggatgacggcgagaaatcagattag

SEQ ID NO: 205381 - DNA, 267 bp, Artificial Sequence
  Description of Artificial Sequence: Synthetic coding sequence
atgaacatgagcaagcagcccgtgagcaacgtgcgggccatccaggcaaacatcaacatcccaatgggtgcctttagaccaggcgccggccaaccccctcgacgcaaggaatgtacccctgaagtagaagaaggggtgcctcctaccagtgatgaagagaagaagccgattcctggtgccaagaaactgccaggacctgccgtcaatctctctgaaatccagaacatcaagagtgaactgaaatacgtaccgaaagcagagcagtag

SEQ ID NO: 205382 - DNA, 6411 bp, Artificial Sequence
  Description of Artificial Sequence: Synthetic coding sequence
atggccgacgtgaccgcccggagcctgcagtacgagtacaaggccaactctaatctcgtcttgcaggccgaccgctccttgatagatagaactaggcgcgatgaacctaccggagaagttctcagtctggtgggtaagctggaggggacccggatgggggacaaagcacagcggaccaaaccccagatgcaggaagagcggagggcaaaacggaggaaacgagacgaggacaggcacgatatcaacaagatgaaagggtataccctactctctgaaggcattgacgagatggtcggtatcatttacaagcctaaaacgaaggaaaccagggagacttatgaggtgctgctgtctttcatacaggctgcgctcggcgaccaaccccgggacattctgtgcggggccgccgatgaagtgctggctgtcctgaagaacgagaagctacgggataaggagcggagaaaagagattgatttgctattaggccagacggacgacacccgctatcacgtcctcgtcaatctgggtaaaaagatcacggattacgggggcgacaaggagattcaaaatatggatgataacattgatgaaacatatggggtgaacgtgcagtttgagagcgatgaggaagagggtgatgaagacgtctatggggaggtgcgggaggaagccagcgatgacgatatggagggtgatgaggccgtggtgagatgtacactgtccgctaaccttgttgcttctggcgaactaatgtccagtaagaaaaaggaccttcacccccgggatattgacgccttctggctccaacgccagttaagtaggttctacgatgacgctattgtgagccagaagaaagctgacgaagttttagagatcctcaaaaccgcgagcgacgatcgagaatgcgagaaccagctggtcctcttattaggcttcaataccttcgatttcatcaaggttctgcgccagcatcgtatgatgatactctactgcactctcttggcctctgcccagtctgaagccgagaaggaacgaataatggggaaaatggaggccgatcctgagttgtcaaagttcctttaccaacttcacgaaacagagaaggaggacctgatccgggaagaaaggtcacggagggagagggtcaggcaaagtcgtatggatacagatctcgagacaatggaccttgaccagggtggagaagctttggctccccgccaggtactcgatctcgaagatcttgtcttcacacagggatcacacttcatggcaaataaaagatgccaactgccagatgggtcattcaggcgtcagagaaagggatacgaagaggtgcacgtccctgcattgaagccgaagcccttcggctccgaagaacagttgctgccagttgagaagttacctaaatatgcacaagctggattcgaaggattcaagacactgaatcggatccagagcaaactctatagggccgcattggaaactgatgagaacctgcttctgtgcgctcccaccggcgctggaaagaccaatgtggcacttatgtgcatgctcagggagatcggtaagcacattaacatggacggcacaattaacgttgatgactttaagattatatacatcgcacccatgcgttcgttggttcaggagatggtcggctccttcgggaagcgactcgccacgtacgggatcaccgtggcggaattgacaggtgatcaccagttgtgtaaagaagagatatcagctacgcagatcattgtgtgcacacccgaaaagtgggatatcatcacccgaaagggaggagaaagaacatatacccagctcgtgaggttaatcatactggatgagattcaccttttgcacgatgaccgcggccccgtgttggaggccctggtggcccgtgctatccgcaatatcgaaatgacgcaagaagacgtccgactgattgggctcagtgcgactctgccgaactacgaagacgtcgctacttttttgagggtggacccggcaaagggtttgttctacttcgataattccttcagacccgtgcccctggaacagacctatgtgggaatcaccgagaagaaagccatcaagcgctttcaaattatgaatgagatcgtgtatgaaaaaatcatggaacacgcagggaaaaatcaggtactggtcttcgtacacagtcgtaaagagaccgggaagactgctcgagctataagagacatgtgtctcgagaaggacacactcggactcttcctgagggaggggtcagcttcaactgaagtgctgaggactgaggcagaacagtgtaagaatttggaactgaaagacctcctgccgtacgggttcgctattcatcacgctggtatgactagggtggataggactctggttgaagacctgtttgcggacaagcacatccaggtcctcgtttctacagcaactctggcctggggcgtcaacttgccagcccacacagtgatcataaaggggacacaggtgtactccccggaaaagggacggtggaccgagctcggcgcgcttgatatactgcagatgttgggcagagcaggtcgcccacaatacgacaccaagggtgaaggcatacttattacaagccatggcgagctgcagtattacctgtctctgctcaaccaacaactcccaattgagtcccaaatggtctccaaactaccagatatgctgaatgccgagatcgtcctggggaacgttcagaacgcgaaggacgccgtgaattggctgggctacgcgtatctatatatcagaatgctgcgctctccgactctgtatggcattagccacgacgatctgaagggagatcccctcctcgatcagcgacggttagatctagtgcacaccgccgctctgatgctggacaaaaacaacttggtgaagtatgacaaaaaaacaggaaatttccaagtgacagaactgggccgtattgcttcgcactattacataaccaacgatacagtgcagacgtataaccagcttcttaagcccacattgtctgagatagagcttttcagagttttctccttgtcttcggaattcaaaaacattaccgtgcgagaggaggaaaaactggagcttcagaagttattagagcgtgtaccaatcccagtgaaagagtcaatcgaagagccttcagcaaagattaatgttcttcttcaggctttcataagccaactgaaactggagggattcgctctcatggcagatatggtgtatgtcacccaatccgctgggcgccttatgcgggcgatatttgagatagtcctgaatcgagggtgggcgcagctgaccgataagactttaaacctgtgcaaaatgattgacaagcgcatgtggcagtcaatgtgcccactcagacagttccggaagctccccgaggaggttgtcaaaaagatcgaaaagaaaaacttcccattcgagagactgtacgatctcaaccacaatgaaatcggagaacttattcggatgcctaaaatgggcaagaccattcacaagtatgtacatcttttcccgaaactcgaactttcagtccatcttcaacccatcacgcgttccaccctcaaggtggagctgacgattactccagactttcaatgggacgagaaggtgcatgggagttcagaggcattctggatcctcgttgaggatgtggattcagaagttattctgcatcacgaatattttctcctgaaggctaagtacgcacaagatgaacatttaattacattcttcgttcctgtttttgagccactccctcctcagtattttatacgggtggtgtcagacagatggctttcttgtgagacacagcttcctgtgagctttaggcacctcattttgccagaaaagtatccgccaccaacagaactgttagaccttcaacctttacccgtgtctgctctgcggaatagtgcttttgagtcactgtaccaggacaagtttccttttttcaatcccatccagacacaggtatttaataccgtatacaacagcgacgacaatgttttcgtgggcgccccaacgggctcaggtaaaaccatctgtgccgaatttgccattctgaggatgttgctgcagtcatctgagggccgctgcgtctacatcaccccaatggaggccttagctgagcaggtttatatggattggtacgaaaaattccaggataggttaaataaaaaagtggtgctgctaaccggtgaaacctccaccgaccttaagctccttggaaaaggaaacataataatttccacacccgaaaagtgggacatcctatcgaggcggtggaaacaacgcaagaacgtgcagaacatcaaccttttcgttgtggatgaggtgcacctcatagggggagagaatggaccggtgctggaggtgatttgctcaagaatgcgatacatctcttctcagatagagagacccatacgcattgtggcgttgagctcttcactgagcaatgccaaagacgtggcacattggcttgggtgtagtgctacatctaccttcaatttccacccaaatgtgcgacccgtgcctctggaactgcacatacaaggatttaacatctcacatacgcagactagacttctgtccatggcgaagcccgtttatcacgccatcaccaagcattctcctaagaagccagtgatcgtgttcgtgccctccaggaagcagactagactgacagccatcgatattcttacaacttgcgcagctgatattcagcgccagcgcttcctgcactgtacagagaaggatcttatcccatatctggagaaactcagtgattcaactttgaaggagacactgctgaacggtgtcggttacctgcatgagggactgtctcccatggagaggaggctggtggagcaactcttttccagcggagcgatacaggtagtagttgctagtaggagtctgtgttggggaatgaatgtggctgcccatctagtcatcattatggacacccaatactataacgggaagatacatgcctatgtcgattacccgatctatgacgttctccaaatggtggggcacgcaaacaggcctcttcaggacgacgagggacgttgcgttattatgtgtcagggatccaaaaaagactttttcaagaaatttctgtatgaaccactgccagtggaatctcacctagatcactgtatgcacgatcactttaacgccgagattgtaactaagacaatcgaaaacaagcaggatgccgtggattacctgacctggaccttcctgtaccgaaggatgacccaaaatcctaattactataatctgcaagggattagtcaccggcacctgagcgatcatctctcagagctggtggagcaaaccctcagtgatttagagcagtctaaatgtatcagtattgaagatgagatggatgtcgcgcctctaaacttgggcatgattgccgcctattattatatcaactatacgaccattgagttattttcgatgagcctgaacgccaaaacaaaagtgcggggcctgattgagattattagtaatgcagcggagtatgagaatatccccattagacatcacgaggataacttgctcagacaacttgcccagaaggtcccacacaaacttaacaaccccaagttcaatgatcctcacgtcaaaaccaacctcctgttgcaggcccatctaagtcgaatgcagctgagcgctgagttacagtccgataccgaagagatcctatctaaggccattcgccttattcaggcatgcgtcgatgtactgtcctctaatggatggttaagccctgccttagccgccatggagctggcccagatggtcactcaagctatgtggtctaaggacagttatctgaaacagctcccacacttcaccagtgaacatattaaacggtgtaccgacaagggcgtggaaagcgtttttgacatcatggagatggaagatgaagagaggaatgcactgctgcagctgaccgattctcagatcgctgatgtggctcgcttttgtaatagatatcctaacattgagttgagctacgaagttgtggacaaggacagcataaggagcggcggtcctgtcgtggtcctcgtccagctcgagcgcgaggaagaggttaccggcccggttatcgccccactcttcccacaaaagagagaggagggctggtgggtggtgatcggagatgcaaaatctaactccctgatcagtatcaagaggctgacactgcagcaaaaggcaaaagtcaagcttgacttcgtcgctcccgccacgggggcacataattacacactctacttcatgtcagacgcatacatgggctgtgatcaggagtacaagttttccgtcgatgtcaaagaagcagagactgactctgatagtgattag

SEQ ID NO: 205383 - DNA, 1878 bp, Artificial Sequence
  Description of Artificial Sequence: Synthetic coding sequence
atggccgacgtgaccgcccggagcctgcagtacgagtacaaggccaacagtaacctcgtgttgcaggcggaccgcagcttaattgacagaactcgtcgcgacgaacccaccggcgaggtactgagtcttgtaggtaagctggaaggaacacggatgggcgataaagcgcagcgcaccaaaccccagatgcaggaggaaagacgggccaagcgacggaagcgcgacgaggatcggcacgatataaacaaaatgaaaggctacacccttctgagcgagggaattgacgagatggtgggaatcatatacaagcctaaaactaaggagacccgcgagacttatgaggtcctgttgagcttcatacaggccgcgctcggagaccagccacgcgatatattgtgcggcgccgctgacgaggtgctagctgttctcaagaatgaaaaattgagggataaggaacggcgcaaggagattgacctgctcctgggtcaaacagatgatactcgctatcacgtgctggtcaatttgggcaagaagattactgattacggcggggataaagagatccaaaatatggatgacaatattgacgaaacatacggggtgaacgtccagttcgaatcagacgaggaggaaggggacgaggatgtgtacggagaagtgagggaagaggcatctgacgacgacatggagggtgatgaagcagtggttaggtgtaccctgtccgctaatctggtagccagtggtgagctgatgtccagtaaaaagaaggacctgcacccgagggatatcgacgcattctggcttcagagacagctttcacggttctatgacgacgccatcgtaagccagaagaaagccgatgaagtgctggagatcctgaagactgctagcgacgaccgcgagtgcgagaatcaacttgtgcttctcctgggtttcaatacattcgatttcatcaaggtcctgcgtcagcatcggatgatgatactgtactgtaccctgctggcaagtgcgcagtcggaagccgagaaagaacgaatcatgggaaagatggaggctgatccagaactgagcaagtttctctatcagctacacgagacggaaaaggaagacttgataagagaagagcgctctcgcagggaacgtgtgcggcagtcgcggatggacaccgatttagagacaatggatttggaccaggggggcgaggctttggcgcctagacaggtcctcgatctggaggacctagttttcacgcaggggagccatttcatggcaaacaagagatgtcagctgccagacggaagcttccgcaggcagcggaagggctatgaggaggtgcacgtgcccgctttgaaacctaagccctttggatccgaagaacagctcctgcctgtcgagaagttaccaaagtacgcccaggccggatttgaagggtttaagacactcaatagaatccagtccaaactgtaccgtgcagccctcgaaactgatgaaaatctcttactttgcgctcccaccggggctggcaagaccaatgttgctctcatgtgtatgttgcgcgagatcggaaaacacatcaacatggacggcacaattaacgtcgacgattttaagataatatacattgcacctatgcgcagccttgtacaggaaatggtgggcagctttgggaagcgcgacgctaaaagcaacagtctgatctccatcaaacggctgacccttcagcaaaaggctaaagtgaaacttgattttgttgcgccagccaccggagctcataattatactctgtactttatgagcgatgcctacatgggttgtgatcaagagtataagttctccgtggacgttaaggaagctgagactgactcagacagcgattag

SEQ ID NO: 205384 - DNA, 1788 bp, Artificial Sequence
  Description of Artificial Sequence: Synthetic coding sequence
atgcggtacatcagcagccagatcgagcggcccatccggatcgtggcattgtcctcaagtctctccaacgcgaaggacgtggcccactggctgggatgctctgctacttctacctttaacttccaccccaacgtgaggcccgtacccctggaactgcacatacagggatttaacatctcacatacccaaactaggctcctcagcatggctaagcccgtataccacgccatcactaaacacagtcctaagaagcctgttattgtgtttgtaccctcaaggaaacagacgagattgacagcaatcgatattttgaccacatgtgccgccgacatccagcgacagcgcttcctgcattgtactgaaaaagatcttatcccatatctggagaaactttccgattctacactcaaagagacactactaaacggagtgggctatctgcacgaggggctgagcccaatggaacggcggctggtcgaacaactgttcagctcaggcgccattcaggtcgtagtggcctctagatccctctgctggggcatgaacgtggccgctcacttggtgatcattatggacacacagtactataacggaaagatccacgcctatgtcgattaccccatctatgacgtactgcagatggtcggccacgcgaacaggcccctgcaggacgacgaagggagatgtgttattatgtgccagggcagcaagaaggacttctttaaaaaattcctgtatgagcctttgcctgttgagtcccaccttgatcactgtatgcatgaccacttcaatgccgaaatagtgacaaaaaccatcgagaacaaacaagacgctgtcgactacttaacctggacgttcttatacaggcgcatgacccagaatcccaactactataaccttcaggggatcagccatcggcacctatctgaccacctttcagagttggtcgaacaaaccctgtcagatctcgagcagtctaaatgtatctcaatcgaggatgagatggacgtggcaccacttaacctgggcatgatcgctgcgtattactacataaactacacaaccatcgagctgttctccatgtcacttaatgctaaaaccaaggtgagaggtctcatcgaaataattagcaacgctgcagaatacgaaaatatccctatccgccatcacgaggacaatctgctgcggcagcttgcacaaaaggtgccccataaactcaataatcccaagtttaatgatccacacgttaagactaatctgctgctccaggcccatttatctcgtatgcagctaagtgcggaactgcagagtgacactgaagagattctgtctaaagcgatccggctaatccaggcctgcgtagatgttctaagctcaaacgggtggctcagcccagctttagccgctatggagctcgcgcagatggtgactcaagctatgtggagtaaagactcctacctcaagcagctgccccatttcacgagtgaacacattaaacggtgcaccgacaagggcgtggagagtgttttcgacattatggagatggaagatgaagaacgtaatgctcttctgcaactcacagatagccagattgctgacgttgctcggttctgtaatagatatcctaatatcgagttgtcttatgaggttgttgacaaggattcaatccggagcgggggtccagtcgttgtgttggtacagcttgagcgggaggaggaagtcacgggtcccgtgattgcccctctgttccctcagttccgcgcaggccggtccggaagtcgcctgtag

SEQ ID NO: 205385 - DNA, 1788 bp, Artificial Sequence
  Description of Artificial Sequence: Synthetic coding sequence
atggccaagcccgtgtaccacgccatcaccaagcacagccccaagaagcctgtgatcgtttttgttccaagcaggaagcagacacgtctgaccgccattgatatactcaccacttgtgcagcagatatccaaaggcaaagattcctccactgtacagaaaaggacctgatcccttacttggaaaaactgtccgacagcacactcaaggagaccctgctcaacggggtgggatatcttcatgaggggttgagccctatggaacgtagactggtggagcagttgtttagttctggggcaatacaggtggtagtggctagtcggagcctgtgctgggggatgaatgtcgctgctcacctggtgatcattatggatacacagtattacaatggtaagattcatgcttatgttgactacccaatatatgatgtcctgcagatggtgggtcacgcaaaccggcctctgcaggatgacgagggtcggtgtgtgatcatgtgccagggctccaagaaggacttttttaagaaattcctgtacgaaccattgccagtagagagccacttggaccactgcatgcatgaccacttcaacgcagagattgtaaccaagactatagaaaacaagcaggatgccgtcgactacttgacctggactttcttatatcgacgcatgacccaaaatcctaactactacaacctccaaggaataagtcaccggcacctgtccgaccaccttagcgaactcgttgaacagactttatctgacttggagcagagtaagtgtatcagcatcgaggatgagatggacgtggctccactgaatctcggcatgatcgcagcttattactacattaattacaccacaattgaattgtttagcatgtccctgaatgccaaaactaaagtgaggggcctcattgagatcatttccaacgccgcggaatatgagaatatccctatccgccaccacgaagataatcttttaaggcagcttgctcaaaaggttccacataagctgaataatccaaagtttaatgaccctcacgttaagaccaacctgctcctgcaggcacatctcagccgtatgcaactgagtgcggaacttcagagcgatactgaggagatcctgagcaaggcgataagactcattcaggcatgcgtggatgtcttgagttccaacgggtggttgagcccagccctggccgcaatggagctggcccagatggtcacgcaagccatgtggtctaaggacagttatctcaaacagttgccacactttacgtcagaacatatcaaacgatgcaccgataagggcgtggaatcagtttttgatataatggaaatggaggacgaggaaagaaatgcattgctacagctgactgactcacagattgctgatgtcgctaggttttgtaatcggtatccaaacatcgagctgtcatacgaggttgtcgataaggacagtattcggagcgggggacctgtggtggtgctggtgcagctagagcgagaggaggaggtgacaggcccagtgattgcacctctcttcccccagaaaagggaagagggatggtgggtggttatcggagatgctaaaagtaattcactcatctctattaaacgcctgactcttcaacagaaggcgaaggtgaagcttgatttcgtggctcctgctaccggagctcataattacactctgtattttatgtcagacgcctatatgggctgcgaccaggagtataaattttctgtggatgttaaggaagccgagacagattccgattccgactag

SEQ ID NO: 205386 - DNA, 2325 bp, Artificial Sequence
  Description of Artificial Sequence: Synthetic coding sequence
atgatgatcctgtactgcaccctgctggccagcgcccagagcgaggcagagaaagagcgcataatggggaaaatggaagcggaccccgaactgagtaaatttctataccagctgcacgaaactgaaaaagaagatctgatcagagaagaaaggtctcgccgcgagcgtgttcgtcaatctcgaatggacacagacctcgagacaatggacttggatcagggtggcgaggcactcgcgccaagacaagttctggacctggaagacctcgtgtttacgcaaggttctcacttcatggccaataagcggtgccagcttcctgatggctcgttcaggcggcagaggaaggggtatgaggaagtgcacgttccagccctgaagccaaagccttttggatctgaggaacagctcttacccgtcgaaaaactgccaaagtatgcgcaggccgggtttgagggctttaaaaccctgaataggatccaaagtaaactgtaccgagccgctttggagacagacgaaaatctgctactgtgcgctccaacaggagcaggtaaaaccaatgtggcactgatgtgcatgctacgcgaaattggaaaacacatcaacatggatggaaccatcaatgtcgatgatttcaagataatatatattgcaccgatgagatccctggtacaggaaatggtcggttcattcggcaagagactggcaacctatggcattaccgttgccgaactcactggcgatcaccagctgtgcaaagaagaaattagcgcaacccagataatcgtgtgtacccctgaaaagtgggacatcatcactcggaaaggcggggaacgtacatacacgcagcttgtgagattgataattctggacgaaatacacttactacacgacgaccgagggccagtactcgaagctctcgtcgcccgagccatcaggaacatcgaaatgacccaggaggacgtgagactgattggattgtctgctactctccccaattatgaggacgtggcaacatttctacgggtggaccctgcgaaggggctgttttatttcgacaactcatttagacccgtgccattggaacagacatacgtgggcattaccgagaagaaggccattaagcgtttccagataatgaacgaaattgtgtacgagaagattatggaacacgcaggcaaaaaccaggtgctcgtgtttgtgcacagcaggaaggagaccggtaaaacggccagggccatcagagacatgtgtctggagaaagatactctgggcctgttccttcgcgagggctcagcctctactgaggtcttacggactgaggctgaacagtgtaagaacctggagctcaaggacttgcttccatacggattcgcaattcaccacgctggcatgactagggttgatcgtacattagtcgaagatctgtttgccgataaacacatccaggtgctggtttcgactgctacattagcatggggagtgaacctccctgcccataccgtgattattaagggcacccaggtgtatagccctgagaagggccgctggacagagctcggagcacttgatattctgcagatgttgggaagagctggaagaccacagtatgacacgaaaggggagggaatcctgatcaccagccacggcgagttacagtactatctgagcttactcaaccaacaactcccgattgaatcacagatggtgtccaagttgcctgacatgctgaatgcggagatagtactaggtaacgtacagaatgctaaagatgcggttaattggctcgggtatgcatacctgtatatacgcatgctgcggtcaccaacactgtatggcatcagccacgatgacctcaaaggcgaccctctgctggatcaacggagactcgacttagtgcacacagcagccctgatgttggataagaacaacctggttaagtacgacaagaaaacaggcaactttcaagtgacagagttagggaggatagcctcacactactatattacaaatgataccgtccaaacgtataaccagctgcttaaacctaccctgagcgagattgagctatttcgggtgttctcactgtctagcgaatttaaaaacatcacagttcgcgaagaggaaaaacttgagttgcaaaagctgcttgaacgggtgccaattcctgtcaaggaatccattgaagaaccgtcagcaaagattaatgtcctcttgcaggccttcatctcacaactgaaactggagggttttgcgctgatggccgacatggtttatgttacgcaaagtgccggacgacttatgagagcgatcctgaaactgtcttag

SEQ ID NO: 205387 - DNA, 2160 bp, Artificial Sequence
  Description of Artificial Sequence: Synthetic coding sequence
atgctgctgcagagcagcgagggccggtgcgtgtacatcacccccatggaggcacttgccgagcaggtgtacatggattggtacgaaaaatttcaagatcgcctgaataagaaagtcgtacttctcacaggcgagaacggaccagtgctggaggtcatttgttccaggatgcggtatatttccagtcagattgagcgccctatacgcattgtggctttgtccagcagcctgtcaaacgctaaagacgttgcgcattggttgggctgctccgcaactagtacatttaatttccaccccaacgtacggcctgtacccctcgagctccacattcaggggtttaatatctctcatacacagactaggctgctctcaatggcgaagcctgtctatcacgctataacaaaacactctccgaaaaagcccgttatcgtgttcgtgccctctagaaaacaaacgcgcctgaccgcgatcgatatcttaacaacatgcgcagcagacatccagaggcagcgatttctccattgcactgagaaggatttaatcccatatctcgagaaattgtctgacagcaccctgaaagagactctccttaacggtgtaggctatcttcatgagggtttgagcccaatggagcgccgtctggtggagcaactgttctcgtccggagccattcaggtggtcgtggcttctaggagcctttgttggggtatgaatgttgcagctcacctagttataattatggatacacagtactacaatggcaagatccacgcctatgtggattatcctatatacgatgtcctgcagatggtcgggcacgccaaccgccccctgcaggacgatgaagggcggtgtgtgatcatgtgccagggttctaaaaaagacttttttaaaaagtttctctatgaacctctgccagtggaatctcatttagaccattgtatgcatgaccatttcaatgccgagatcgtgacgaaaaccattgagaataaacaggacgcggttgactacttaacatggacattcctgtatcggagaatgacgcagaatcctaactactacaacctccagggaatttctcacaggcatctctccgaccacttgtctgagctcgtcgagcaaacacttagcgacctcgaacagtccaagtgtatttccattgaggatgaaatggacgtcgcaccactcaacctaggcatgattgcagcctattattacataaactacaccaccattgaactgttcagtatgtccttgaacgcaaaaacaaaggtgcgaggcctcatcgagattatatccaacgccgccgagtacgaaaacatacctattcggcaccacgaggacaacttgctccgtcagctggctcagaaagtgccccataagttgaataatcctaaattcaacgatccccatgtgaagacgaatctcctgctacaggctcatctgagtcggatgcaactttcagcagagttacagtctgataccgaagagattctgagtaaggcaatacgcctgattcaggcttgtgtggacgttctgtcgagtaatggttggttaagcccggcactggccgccatggaactggcccagatggtgactcaggcaatgtggtcgaaggactcataccttaagcagcttccacatttcactagtgaacacatcaagcgctgcactgataaaggagtcgagagcgtgttcgatatcatggagatggaggacgaagagagaaacgccctcttacagttaacggactctcagatagccgatgtggcccggttttgtaaccgctatcccaatattgagctgtcctacgaagtcgtggataaggacagcatccggagtggcggacccgtggtggtgttagttcagctggaacgagaagaggaagtcaccggacccgtaatagcccctctgttcccccaaaagagagaagaaggttggtgggtggtaatcggtgatgcaaagagtaactctttaattagtattaaaaggctgactctgcagcagaaggctaaggtgaaactggatttcgtggctccagccacaggggcccacaattatacactctacttcatgtcagacgcttatatggggtgcgatcaggagtataagtttagtgtggacgtgaaggaggccgaaacagactccgactcagattag

SEQ ID NO: 205388 - DNA, 1074 bp, Artificial Sequence
  Description of Artificial Sequence: Synthetic coding sequence
atgatcgagcagcagaagcggaagggccccgagctgcccctggtgcccgtgaaacggcaacgccacgaacttctgctgggcgctgggtccgggcctggtgccgggcagcaacaagctacaccaggagccctccttcaggcggggcccccccggtgttccagcctgcaagccccgatcatgctgctctcaggacacgaaggcgaagtgtattgttgcaagttccaccctaacggttcgaccctcgcctccgctggattcgaccggcttatattactgtggaatgtgtacggtgactgtgataactatgcaacattaaagggccactcaggcgccgtcatggagctgcattataatacagacggtagcatgctgttttcagcgtctacggacaagaccgtcgccgtgtgggactccgagaccggagaacgtgtgaagcgcttaaaaggccatacttcttttgtgaactcttgttatcccgctcgtcgggggccccagctggtatgcactggcagtgatgatgggactgttaaactctgggacattcggaaaaaggccgcaattcagactttccaaaatacttatcaggtgctggcagtgactttcaatgacacatccgaccagatcatcagcgggggaattgataacgacatcaaggtgtgggacctgcggcagaataagctaacctacaccatgaggggccatgccgacagtgtgaccggtctgagtttaagtagcgaagggagctacttgctgagtaatgcaatggataacactgtccgcgtttgggacgttcgcccatttgcccctaaagagcggtgcgtcaaaatcttccagggcaacgtgcataatttcgaaaagaatttgttgcgttgcagctggtcacctgatgggtcaaagattgccgctggatctgcggaccgcttcgtctatgtctgggataccacaagccggcggattctttacaaactcccggggcacgctggatcaattaatgaggtggcttttcacccagatgagcctataattatttctgccagctcagataagcgcctttatatgggcgagatacagtag

SEQ ID NO: 205389 - DNA, 384 bp, Artificial Sequence
  Description of Artificial Sequence: Synthetic coding sequence
atgatcctgatcagcgccggctgccccggcggcctgtggcccatcgtagttcttgtaggtcttttcatatggatctgttttgctgtgcgggtctgggatgtgcgaccatttgcccctaaagagcgctgcgtcaaaattttccagggcaatgtgcacaattttgagaaaaatctcctcaggtgcagctggagcccagacggatctaagattgcggccggcagtgccgacagattcgtatatgtgtgggacacaaccagcagaaggatcctctacaaattgccgggccacgccggatctatcaacgaggttgcatttcaccccgacgagcctatcattatcagtgcatccagcgataagagattatatatgggggagatccagtag

SEQ ID NO: 205390 - DNA, 1230 bp, Artificial Sequence
  Description of Artificial Sequence: Synthetic coding sequence
atgatcgagcagcagaagcggaagggccccgagctgcccctggtgccggttaaaaggcagcgccatgagctgctgctgggggccggaagcggccccggcgcaggacagcaacaggcgaccccaggcgcactactccaggctggtccacctcgttgctcatcgctgcaggctcctataatgttgttgtctgggcacgaaggagaggtgtactgctgcaaattccatcccaatggctcgaccctggcctcagcaggcttcgatcgtcttattttactgtggaatgtgtatggtgattgcgataactacgcgaccctcaagggccattccggcgccgtgatggaactccactacaatacggacgggtctatgctgttctctgccagcactgacaaaaccgttgcagtctgggattccgaaacaggagagagggttaagcgtcttaaagggcacacgagtttcgtgaatagttgctaccccgctcgcaggggcccccagctggtgtgtactgggtctgatgacgggacagtgaagctgtgggatataagaaaaaaggcggccattcagacctttcagaatacctaccaagttctagctgtaacatttaacgacacctccgaccagattatctccggagggatcgataacgatatcaaagtctgggatctgcgtcagaacaagctgacatataccatgcgggggcacgccgattccgtgaccggtctgtcactttcctccgagggcagctatttattgagtaacgctatggataacaccgttcgcgtgtgggacgtgaggccctttgcgcctaaagagcgatgcgtgaagatcttccaggggaacgtgcataactttgagaagaatctcctccgatgcagttggtctcctgacggatctaagatagcggctggatccgctgatcgatttgtgtacgtgtgggatactacatcaagaaggattctttataagctgcccggtcatgcgggctccataaacgaggttgcatttcacccggacgagccaattatcgaaaccggcttccacagaatcggacagggcggacatgaattacttacttcatcaaacccacccgcaagcgcatcacaaagtgcggggatcacgggcgtctcacactgcgcccaactccaaacagtctttatgtgggtgtccatgtccgtgagtcctctcttaatctccggggaatctaagagtaacgctcctttctcatcctag

SEQ ID NO: 205391 - DNA, 849 bp, Artificial Sequence
  Description of Artificial Sequence: Synthetic coding sequence
atggccgtgcccgagacccggcccaaccacaccatctacatcaacaacctgaatgagaaaatcaagaaagacgaactgaagaagtccctgtacgccatttttagccagttcggtcaaatacttgatatattggttagtcggagtctgaagatgaggggtcaagctttcgttatctttaaagaggtgtcctctgcaacaaacgccctgcgctccatgcaaggctttcctttctatgacaagccaatgaggatccagtacgcgaaaacagactccgatatcatcgcgaaaatgaaaggaacattcgtggaacgcgaccgtaagagagagaaacgtaagccaaaaagccaggaaacgcctgctacgaaaaaagccgttcagggcgggggagctactcccgtggtcggagcggtgcaggggcctgttccaggcatgccgcccatgacgcaagctccacggataatgcatcacatgccaggacagccgccatatatgccacccccaggcatgattcccccaccaggtctggcccctgggcagattccacccggggctatgccccctcaacaactcatgcctggtcagatgcctcccgcacaacctctctcagagaacccccctaaccacattcttttcctgactaacttgcctgaagaaactaatgagttgatgctctctatgttgttcaaccagttcccggggttcaaagaggtgagactggtgcctggaagacacgacatcgcctttgtggagttcgacaatgaagttcaggccggagctgctcgcgatgcacttcagggcttcaaaataactcagaataatgccatgaagatttcatttgcaaagaaatag

SEQ ID NO: 205392 - DNA, 612 bp, Artificial Sequence
  Description of Artificial Sequence: Synthetic coding sequence
atggccgtgcccgagacccggcccaaccacaccatctacatcatcgcaaagatgaagggcacatttgtcgaacgggatcggaagcgggagaaaaggaagccaaagagccaagaaaccccagccaccaagaaggctgtgcagggcggcggtgccacccctgtggtaggggccgtgcaggggcccgttccgggcatgccaccgatgactcaggcgccacgaatcatgcaccatatgcctggacagcccccctacatgccccctccgggaatgatacctccacccgggctggctcctgggcaaattcctcccggagccatgccaccacaacagctgatgcctggccagatgcctccagcccagccactgtctgagaatcctcctaaccacattttgttcttgactaacctgccagaagaaacgaatgagttaatgctttccatgctatttaaccagtttccggggttcaaggaggtgcgcctcgtgcctggaagacacgacatagccttcgtcgagttcgacaatgaagttcaggcaggcgctgcccgagatgctttgcagggattcaaaataacccagaacaatgctatgaaaattagctttgcaaagaagtag

SEQ ID NO: 205393 - DNA, 768 bp, Artificial Sequence
  Description of Artificial Sequence: Synthetic coding sequence
atggtgaagctgaccgccgagctgatcgagcaggccgcccagtacactaacgctgtgcgagatcgtgagctggacctccgaggctataagatacccgtaatcgagaatctgggcgccacacttgaccaattcgacgccattgatttctcggacaatgagattcggaagttggatgggttcccgcttttgagaaggctgaagactttgttggttaacaacaacagaatctgcagaattggagaggggttagaccaggcactgccctgtcttaccgaacttatcctcaccaacaactctctcgtggaactgggggatctcgatccattggccagcctcaaatcgttaacctacctgtctattctgagaaaccccgtcactaacaagaaacattaccgactatacgtcatctataaggtgccgcaggtccgggtcctggacttccagaaagttaagctaaaagaacgacaggaagccgagaagatgtttaaggggaagaggggagcccaactggcaaaagacatagcaagaagatctaaaactttcaacccgggcgctgggctacctactgataagaagaagggaggtccttctccgggagacgtggaggcgataaagaatgccatcgctaatgcttcgacactggcagaagtggagcgcctcaaggggctgctccagtcagggcagatccctgggcgggagcggaggtcagggcccacagatgacggggaggaagagatggaggaggacacggtgaccaatggcagctag

SEQ ID NO: 205394 - DNA, 480 bp, Artificial Sequence
  Description of Artificial Sequence: Synthetic coding sequence
atgcccaagttctactgcgactactgcgacacctacctgacccacgattcaccctcggtgcgcaaaacacattgttccggacgtaagcacaaggagaacgtgaaggattattaccagaagtggatggaagagcaggctcagtcattgatcgataagactaccgccgcttttcaacagggaaaaattccgcccacgcccttttctgccccaccccctgcaggagcaatgatccctccacctccgtccctacctggaccccccagacccggcatgatgcctgcccctcatatgggcggccctcctatgatgcccatgatgggtcccccaccccccggcatgatgcccgtgggccctgcgccaggaatgcgtccacctatggggggccatatgccaatgatgccaggtccccccatgatgagacctcccgccagacctatgatggtccctactaggccaggcatgaccagacctgatcgctag

SEQ ID NO: 205395 - DNA, 543 bp, Artificial Sequence
  Description of Artificial Sequence: Synthetic coding sequence
atgaacagcgccagcgtggacggccacctgagcggctgccggctgtttcttttcttgtcacccctcttccgcttctattgtgattactgcgacacgtacctgacccacgacagtccttctgtgcgtaaaacacactgttctggaagaaaacataaagagaatgtgaaggactattaccaaaagtggatggaagagcaagcccaatcactgattgataagaccaccgccgcttttcagcaaggaaagattccacccacaccatttagcgccccgccacctgctggtgcgatgattccacccccccccagcctccctgggcctcctcgacccggaatgatgcctgcgccccacatgggaggcccaccaatgatgccaatgatgggaccaccgcctcctggtatgatgccagtggggcccgctcccggtatgcgcccgcctatggggggtcacatgccaatgatgcccggaccccctatgatgaggccccctgcccgaccaatgatggttcctacacgtcctggaatgactcggcctgacaggtag

SEQ ID NO: 205396 - DNA, 357 bp, Artificial Sequence
  Description of Artificial Sequence: Synthetic coding sequence
atggaggagcaggcccagagcctgatcgacaagaccaccgccgccttccagcaaggtaagattcctcctacccctttttccgcgcctccgcctgccggagctatgatccctcctccgccttcattgcctgggcccccccgccccggtatgatgccagcaccgcacatgggtgggccgcctatgatgcccatgatgggcccacctccccctggcatgatgcccgtgggtcccgccccaggaatgcgtccgccaatgggagggcacatgccgatgatgcccgggcctccgatgatgcgtcctcccgctcgccctatgatggtacctaccaggccaggaatgacccgacctgatcgttag

SEQ ID NO: 205397 - DNA, 159 bp, Artificial Sequence
  Description of Artificial Sequence: Synthetic coding sequence
atgcggatcgagggctgcatcatcggcttcgacgagtacatgaacctggtgctggatgatgccgaagagatacatagcaagaccaagtccaggaagcagctgggaagaattatgctgaagggtgacaacatcacattgttacagtccgtgtcaaattag

SEQ ID NO: 205398 - DNA, 279 bp, Artificial Sequence
  Description of Artificial Sequence: Synthetic coding sequence
atggcctaccggggccagggccagaaggtgcagaaggtgatggtgcagcccattaacctgatttttagatatctccagaatcgctcacgaatccaggtgtggctgtatgaacaggtgaacatgagaattgaggggtgtatcattggctttgacgagtacatgaacttggtcctcgatgacgcagaggagatccattccaaaactaagtccaggaagcagctgggccgcattatgctgaagggggataacatcacacttctacaatcggtgtctaattag

SEQ ID NO: 205399 - DNA, 723 bp, Artificial Sequence
  Description of Artificial Sequence: Synthetic coding sequence
atgaccgtgggcaagagcagcaagatgctgcagcacatcgactacagaatgcggtgtatcctgcaggacggcagaattttcataggaacgtttaaggcatttgataaacacatgaacctgatattatgcgactgcgatgagttccggaagataaaacccaaaaacgccaagcagcctgagcgagaggaaaaaagggttttggggctcgtactactccgaggtgagaatctcgtgagcatgaccgtcgaggggcctcccccaaaagatacgggaatcgccagagtgcctctcgccggggccgctgggggaccaggcgtgggacgcgcggctggacggggggtccctgctggggtgccaatcccccaggctcctgccggtctggccggcccggtcaggggtgtaggaggaccctcacagcaagtcatgactccgcaagggagggggaccgttgccgccgcggccgttgcagctacggcctcaatcgcaggggcacccacccagtaccccccaggccgggggactccaccaccgccggtgggacgcgcaaccccccctcccggtatcatggctcctccacctggcatgcgcccgccaatgggccctcccataggcctcccaccagctcggggcactcctatcggcatgccgccccccggaatgagaccccccccacccggtattagagggccaccccctcctggtatgcgtcccccgaggccatag

SEQ ID NO: 205400 - DNA, 723 bp, Artificial Sequence
  Description of Artificial Sequence: Synthetic coding sequence
atgaccgtgggcaagagcagcaagatgctgcagcacatcgactacagaatgaggtgtatcctgcaggacggccggattttcattggcacatttaaagcctttgacaagcacatgaatctgatactatgcgactgtgacgagtttaggaagattaaacccaagaacgccaaacaacccgagcgcgaagagaagagggtgttggggcttgtgctcctgaggggagagaatttggtgagcatgaccgtcgagggcccgcctccaaaagataccgggatcgctcgggtgcctctggctggcgccgccgggggccccggtgttgggcgagccgctggccgcggggtccccgccggcgtgcccattccacaggcccccgccggtctagcggggcccgtgcgaggtgtgggaggcccatcccagcaagtgatgacaccccagggacgcggtaccgtggctgccgccgccgtcgcagccacagcgtctatagccggcgcaccaacacagtatccacctggcagaggcactccgccaccaccagtcggccgcgcgaccccacctcccggaatcatggcccctccccctggtatgcgcccacccatgggtccaccaatcggcttaccaccagccaggggcaccccaatcggcatgcctccccccggaatgcgaccccctcctcccggcatacggggaccccccccccccggaatgaggccgccccggccatag

SEQ ID NO: 205401 - DNA, 723 bp, Artificial Sequence
  Description of Artificial Sequence: Synthetic coding sequence
atgaccgtgggcaagagcagcaagatgctgcagcacatcgactacagaatgagatgtatcttgcaggatggtaggatttttatcggaaccttcaaggcctttgataagcacatgaatttgatcctgtgcgattgtgacgaatttaggaagattaagcctaaaaatgcgaaacagcctgagagagaagagaaaagagtactcgggctagtgttactcagaggggagaatctggtatctatgaccgtggagggaccccccccaaaggataccggtatcgcccgcgtccctttggcaggggccgcagggggccccggcgtgggtagggcagctggccgcggagtacctgctggggtgcccatccctcaggcacccgccggcctggctggccctgtacgaggcgtggggggacctagccaacaagtgatgactcctcaggggcgaggcacggttgccgcagccgccgtcgcggccactgcctctatcgcaggtgcccctacgcagtatcccccagggcggggaacgccccctcccccagttgggagagccactccgccccccggtattatggctcccccccctggtatgcggccgccaatgggtccaccgattgggctccctcctgcaagaggcacaccgatcgggatgccgcctcctggcatgagaccaccaccacccgggatccgcgggcctccaccgcctggaatgcgcccaccccggccctag

SEQ ID NO: 205402 - DNA, 723 bp, Artificial Sequence
  Description of Artificial Sequence: Synthetic coding sequence
atgaccgtgggcaagagcagcaagatgctgcagcacatcgactaccggatgaggtgtatcctccaggacgggagaattttcatcggtacctttaaagctttcgataagcatatgaatttgattttgtgtgactgtgacgaattcaggaaaattaagccaaaaaacgctaaacagccggagcgggaggagaagcgggtgctgggactggtgctgctccgcggggaaaacctggtgagtatgacagtcgaaggaccacctcccaaggataccggcatcgcaagggtgcccctcgccggagccgccggcggacccggagtgggccgcgccgccggtaggggagtgcctgccggtgtgcccatcccccaggctcctgccggcttggccggacctgtgcggggtgtaggcggcccaagtcagcaggtgatgacacctcaaggccggggtacagtggctgctgccgccgtcgctgcgacagctagcattgcaggagcgccgactcagtacccacctggcaggggtacgcctccacctcctgtggggcgtgcaacccccccgcccgggattatggcgccgccgcccggaatgagaccacctatgggtcctcccatcggcttgccccccgctcgcggcactccgatcgggatgccaccccctggaatgcggccaccacctccaggcattagaggacctccacctcctggtatgagaccgcctagaccctag

SEQ ID NO: 205403 - DNA, 735 bp, Artificial Sequence
  Description of Artificial Sequence: Synthetic coding sequence
atgatggacagccagaccgtgggcaagagcagcaagatgctgcagcacatcgactaccggatgagatgtatcctgcaggacggccgcatcttcattggtacgtttaaggcttttgataaacacatgaacctcatcctctgtgattgtgacgaattcaggaagattaaacccaagaatgctaaacagccagagagagaagaaaagcgggtgcttggactagtgttgctgaggggagagaacctcgtgtctatgactgtggaaggccctccgcctaaagataccgggatcgccagagttcccctggcaggcgctgcaggagggcctggtgtgggcagagcagcaggacgcggagtgcctgccggtgttcctattccacaggctcccgccgggttggcggggcccgtgagaggagtagggggtccgagccaacaggtgatgaccccgcaaggtcgaggaacggtagctgccgccgccgttgcggccactgctagtatcgccggggcccctacccagtaccctcctggcagaggcacccctccacctcccgtggggcgggctacccctccgcctggtatcatggctccaccaccagggatgcggccaccaatgggcccccctatcggattgccccctgccagaggtactcctattggtatgcctccccccgggatgagacctccacctcccggcatccgaggtccgcctccgccaggcatgcgcccacctaggccctag

SEQ ID NO: 205404 - DNA, 945 bp, Artificial Sequence
  Description of Artificial Sequence: Synthetic coding sequence
atgagccgggtgcccgccttcctgagcgccgccgaggtggaggagcatcttcgctcttcctctttattgatcccacctctggaaaccgccctggctaactttagcagcggccctgagggcggcgtgatgcagccagtgcgtactgtcgtacccgtcaccaagcatcgcggatatctcggggtcatgcccgcatactcagccgcagaggatgccctcacaactaagcttgtgacattctacgaggaccgcgggatcacttctgtggttccctctcatcaagccaccgtgctgttgttcgagcccagtaatgggacactcctcgcagtgatggacggtaatgtcatcacggctaagagaaccgctgcagtgtccgcaatcgcgaccaaatttctgaagccgcctagtagtgaggtactgtgcattctcggtgccggcgtgcaggcctactcccattatgagatcttcaccgagcaatttagtttcaaggaagtgcgaatctggaatagaacgaaggagaacgccgaaaaattcgcggataccgtgcagggggaggttcgcgtctgttcatctgttcaggaagccgtggccggtgccgacgtcatcataaccgtcaccctagctaccgaacccatactctttggcgagtgggtcaagcccggcgctcatattaatgccgtgggggcttctcgccccgattggagagagttagatgatgagctcatgaaagaagccgtcttgtacgtcgatagccaggaagcagccctcaaggagagtggggacgtgttgcttagcggtgcagagatattcgctgagctgggggaggtcatcaagggggtgaagcctgctcattgcgagaaaactaccgtttttaagtccctgggtatggcagtggaagatactgtggctgctaagttaatctatgattcatggagcagcggcaaatag

SEQ ID NO: 205405 - DNA, 1248 bp, Artificial Sequence
  Description of Artificial Sequence: Synthetic coding sequence
atggccaccgtgggcgagtggagctgcgtgcggtgcaccttcctgaaccccgcaggacagcgacagtgttctatatgtgaagcgccaaggcacaaacccgacctcaaccatatcctgcgtctgagtgtggaagagcaaaaatggccgtgtgctcgttgcacttttcgaaactttttgggaaaagaggcctgcgaagtttgtggattcacacccgagccagcccctggggcggcttttctgccagtgctgaacggggtgctgccgaagcctcccgctatactgggagagcccaagggttcatgccaggaagaagctggccctgtgcggacagcaggtctcgtggccaccgagccagcaaggggtcagtgtgaagataaagatgaagaagagaaagaggagcaggaggaggaggagggcgccgctgagcctagaggcgggtgggcatgtccacgatgcaccctccataacacccctgtggcttcttcatgcagtgtatgcggcggaccccgaaggctgtcactaccccgaatccctcccgaggctctggtcgtgcccgaagtcgtggcgcccgccggattccatgtggttccagccgccccaccgccaggactgccgggagagggagccgaagcaaatccccccgctaccagtcaggggccagccgcggaacctgagccacccagggtcccccccttctccccttttagttcaacactccagaataatcccgtgccaaggtcacgccgtgaggtgcctccacagctgcaacccccggtgcctgaggctgcccagccctccccctccgccggatgccgaggggctccccagggtagcggttgggccggggcatcacgcctggcagaactattaagcggaaagagactatctgtgctcgaggaagaagctacagagggaggcaccagtagagtggaggccggatccagtacttcaggatctgatataatcgaccttgccggtgatactgtgcgttataccccagcgagcccaagctccccagattttacgacttggagctgtgccaagtgcactcttaggaatccatccccgcccagtctgcagcccctgggacggggccccgagtctctcccccgcgcagctggacctagggctggttgcgtccaactcgaggcaggacacggtggcgcccggggttcccctgctgatcacgctggcaggcgccaccaccccgcgcacagggagcctcgacgcgctgccagaggcccctag

SEQ ID NO: 205406 - DNA, 270 bp, Artificial Sequence
  Description of Artificial Sequence: Synthetic coding sequence
atgagcagccagcagcagaagcagccctgcaccccccccccccagctgcaacagcagcaggtgaaacagccctgtcaacctcctccacaagagccgtgcatccccaagaccaaggagccctgccaccccaaagtgcctgaaccgtgtcacccgaaggtgcctgagccatgtcagcctaaagttccagaaccttgccatccgaaggtccctgagccttgtccatcaatagtgacacctgcccccgcacagcagaaaacgaagcagaaatag

SEQ ID NO: 205407 - DNA, 222 bp, Artificial Sequence
  Description of Artificial Sequence: Synthetic coding sequence
atgagcagccagcagcagaagcagccctgcaccccccccccccagttacagcaacagcaggtaaaacagccctgtcagccaccaccccaggaaccctgtatcccgaaaactaaggagccatgtcatccgaaggtgccagagccctgtcatcccaaagtgcccgaaccatgtccaagtattgtaacgccagcccctgcacagcagaagaccaagcagaagtag

SEQ ID NO: 205408 - DNA, 219 bp, Artificial Sequence
  Description of Artificial Sequence: Synthetic coding sequence
atgagctaccagcagcagcagtgcaagcagccctgccagcccccccctgtgtgtccgacacctaaatgtcccgagccgtgtccgcctccaaagtgtcccgaaccatgcccgcctccaaaatgccctcagccatgccctccccagcagtgtcaacagaaatacccaccggtgactcctagccctccttgccaatcaaagtatccaccgaaatcaaaatag

SEQ ID NO: 205409 - DNA, 219 bp, Artificial Sequence
  Description of Artificial Sequence: Synthetic coding sequence
atgagctaccagcagcagcagtgcaagcagccctgccagcccccccctgtgtgccccactccaaaatgtccggaaccatgcccaccacctaagtgtccagagccttgccctcctcctaagtgtccccagccatgcccaccgcagcagtgtcagcagaagtaccctcccgtaactccatcaccaccatgtcaaccgaaatatccgcctaagtccaagtag

SEQ ID NO: 205410 - DNA, 219 bp, Artificial Sequence
  Description of Artificial Sequence: Synthetic coding sequence
atgagctaccagcagcagcagtgcaagcagccctgccagccccccccggtctgccccacacccaaatgtcccgagccttgtcctccccctaaatgccctgaaccctgcccccctcccaagtgcccacagccctgccctccacaacaatgtcagcagaagtatcctccagtaacccctagtcccccatgccaaccaaaatatcccccaaaaagtaaatag

SEQ ID NO: 205411 - DNA, 219 bp, Artificial Sequence
  Description of Artificial Sequence: Synthetic coding sequence
atgagctaccagcagcagcagtgcaagcagccctgccagccccccccggtgtgccctacgccaaaatgtcccgagccttgtcctccacctaagtgtcccgagccctgtccccctccaaaatgtcctcagccttgcccccctcagcaatgccaacagaaatacccacccgttaccccgagccccccttgccagcccaagtatccccccaaaagtaagtag

SEQ ID NO: 205412 - DNA, 510 bp, Artificial Sequence
  Description of Artificial Sequence: Synthetic coding sequence
atgagcagctaccagcagaagcagaccttcaccccccccccccagctgcagcagcagcaagtaaaacagccctctcaacctccgccacaggagattttcgttcctaccaccaaggaaccctgccatagcaaagtccctcagccagggaacacaaaaatcccggagccaggctgtacaaaggtacccgagcctggttgtactaaggtccctgagccaggatgtaccaaggtccctgagcccgggtgtacaaaggtgccggagcctggatgcaccaaagttcccgagcccggctgcacgaaggtgcctgaaccaggctacactaaggtccctgagccagggagcatcaaggtgcccgaccagggcttcattaagttccctgagcccggcgctatcaaggtcccagagcagggctataccaaggtgcctgttcctggctatacgaagctccctgagccttgccctagcaccgtaacccccggccccgcccagcagaagaccaagcagaagtag

SEQ ID NO: 205413 - DNA, 510 bp, Artificial Sequence
  Description of Artificial Sequence: Synthetic coding sequence
atgagcagctaccagcagaagcagaccttcaccccccccccccagctgcagcaacagcaagtgaagcagccctctcaaccaccgccacaggaaatattcgtccctacgactaaggagccatgtcacagcaaagtgccacagccgggaaacactaagatcccggaaccaggctgtaccaaggttccggaacctggttgtactaaagtgcctgagcccggctgtacgaaagtcccagagccagggtgtacaaaggtgccagagcccgggtgcactaaggttccagagcctggctgtacaaaggtaccagagcccggatataccaaagtccctgagccaggctcaataaaggttccagaccaggggtttattaagttcccggagcccggtgcaatcaaggtgccggagcagggctatacaaaggtccccgttcctggatacacgaaactcccggaaccatgtccttcgactgtgacccctgggcccgcccagcagaaaacaaagcagaaatag

SEQ ID NO: 205414 - DNA, 480 bp, Artificial Sequence
  Description of Artificial Sequence: Synthetic coding sequence
atgagcagctaccagcagaagcagaccttcaccccccccccccagctccaacaacagcaggtgaagcaaccctcccagcctccacctcaagaaatatttgtacctaccaccaaggaaccctgccactctaaagtccctcagcccggaaatacaaagatacccgaacccggttgcacgaaggtccctgagcccggctgtactaaagtgccggagcccggatgtactaaagtgcccgaacccggctgcacgaaggtgcccgaaccaggatgtacaaaggtgcctgagccaggatgcacaaaggtcccggagcctggctacaccaaagttcccgaacccggctcaattaaggtgcccgaccagggctttatcaagtttccagaaccgggtgcaataaaagtccccgagcaagggtataccaaagtgcccgtgcccggatataccaaacttccagaaccatgtccttcgacagtgactccctag

SEQ ID NO: 205415 - DNA, 486 bp, Artificial Sequence
  Description of Artificial Sequence: Synthetic coding sequence
atgagcagctaccagcagaagcagaccttcaccccccccccccagctccagcaacagcaggttaagcagccctcccagcctccccctcaggaaattttcgtccccacaacaaaagaaccctgtcactctaaggtgccccagccgggcaacactaaaatcccagaaccaggttgcacgaaagttcccgagccagggtgcaccaaggtccccgaacccgggtgcactaaggtaccagagccaggatgtacgaaagtcccagagcccggctgtacaaaagtacctgagcctggttacaccaaagtgccagagccggggtcaatcaaagtgccagaccagggctttattaagtttcccgaacccggtgctataaaagtcccggagcagggatatacgaaagtccccgttccaggatacaccaagttaccggaaccatgcccgagtaccgtgactcctggcccagcacagcagaaaacgaaacagaaatag

SEQ ID NO: 205416 - DNA, 10989 bp, Artificial Sequence
  Description of Artificial Sequence: Synthetic coding sequence
atgagccggcgggcccccggcagccggctgagcagcggcggcggcggagggggaactaagtatccccgtagctggaacgattggcagccccgtacggattcagcgtccgccgacccagataatttaaaatattctagttccagagatcgcggcggttccagttcttatgggctacaaccatcaaactccgccgtagtgtcccgccagagacacgacgatacccgggtacacgccgacattcaaaatgatgaaaagggaggctactccgttaatggcggatccggggagaatacctatgggcgtaaatccctgggccaagagcttagagtgaacaatgtgacttcccctgaatttacatctgtgcagcacgggtctagggcattagcaaccaaggatatgagaaagtcccaggagcggagcatgtcctattctgatgagtcgaggcttagtaatttgctgagacgcattacccgggaggacgaccgtgaccggcggcttgccaccgttaagcagctgaaggaatttattcagcaacccgaaaataagctggttttagtcaagcaactggataatatactcgctgcggttcacgacgttttaaatgaaagctctaaactgttgcaggaactgagacaagaaggagcgtgctgcttaggacttctgtgtgcctccctgagctacgaagcggagaaaatttttaagtggattttttccaagttcagctctagtgcgaaggacgaggtaaagttgttgtacttgtgtgcgacgtacaaggcattggagaccgtcggcgagaagaaagccttctcttcagtcatgcagctcgttatgacttctttgcaatccattctggagaacgtggatacacccgaattgctgtgcaaatgcgtaaaatgcattttattagtcgcacgatgctatccgcatatcttttctactaacttcagggatacagtggacatccttgtgggatggcacattgatcacactcagaagccatccctgacgcagcaagtgtccggatggcttcagtcactcgaaccattctgggtagctgatcttgccttctccacaaccctgctgggccagtttctggaagatatggaggcttacgctgaggacctgagtcatgtcgcatcaggcgagtccgttgacgaggatgtccctccaccctcagtgagcctccctaaactggcggctttactacgcgttttctccactgtcgttagaagcattggagaacgatttagtccgatccggggccctccgattaccgaagcatacgtcacagatgtattataccgtgttatgcggtgcgtgactgccgcaaaccaggtttttttctcggaggctgtgctgacggccgcgaatgagtgcgtcggagtgttgctaggctccttagatccaagcatgacaatccactgtgacatggtgatcacatacggacttgaccaattagagaactgccagacatgtggaaccgattacatcatctccgtgctgaacctcctgacactcatcgtcgagcagataaataccaaactaccatcgtcctttgttgagaagttgtttatcccaagctcaaaactgctcttcctgcgatatcataaggagaaagaggttgtggccgtcgcccatgcggtgtatcaagctgtactatcactgaagaatattccagtgctggaaacggcctacaaacttatcctgggtgaaatgacctgtgcactaaacaatttgctgcactctctgcagctgccggaggcctgcagtgaaattaagcatgaagcgtttaagaatcacgtgtttaacgtcgacaacgccaagtttgttgtgattttcgatctgagcgctctcacgaccataggaaacgctaagaattcgctgatcggcatgtgggccctgtcccccacagtgtttgccttactgagcaaaaacttgatgatcgtgcacagtgatctggcagtacacttcccggccattcagtacgctgtgctatacactttgtatagtcactgcaccaggcacgatcactttataagttctagcctttcatcctccagcccctccttatttgacggggcggtaattagcaccgtgacgactgctacaaaaaagcactttagcatcatcctgaacttactcggaatcctgctgaagaaggataacctcaaccaagacacgcgaaagttactcatgacttgggcgctcgaggcagcagtcctgatgaaaaaaagcgagacctacgctccactcttttcactcccttcatttcataagttctgtaagggcttactggccaacaccttggtagaggatgtgaacatctgtttacaggcttgcagctctctgcatgcactcagtagcagcctgccggatgatctgcttcagcgctgtgtagatgtgtgcagagtacagctggtccatagtggaacaaggatccgccaggcattcgggaaactcctgaagtccatcccgctagacgtggtactgtcaaacaacaaccacaccgagattcaagagatcagtctcgctctgcgcagccacatgagtaaagcccctagcaacacctttcaccctcaagatttctccgacgtcattagttttatattatacggcaattctcataggaccggaaaggacaactggctggagagactgttttacagctgccagcgcctggacaagagagatcagtccacaatcccccggaatctgctcaagaccgacgccgtgctgtggcaatgggccatttgggaagcagctcaattcactgtgctcagcaagcttcgcacgcctcttggtcgagcccaagatacatttcagaccatcgaagggatcatacgttccctggccgcacacacactgaatccagatcaggatgtgtcccagtggaccactgcggacaatgatgaagggcacggaaacaaccagctcagacttgtcctgttgcttcagtacctcgaaaatctcgaaaagcttatgtacaatgcttacgaaggctgcgctaatgctctgaccagtccccccaaagtgataaggacattcttttacaccaacagacagacatgccaagattggttaacccggattcggttgagcataatgagagtaggtctgctagccggccaacccgccgttacagtgcgacatggattcgacctgcttaccgagatgaagaccacgagtttaagccagggcaacgaactggaagttacaattatgatggtggtcgaggcactctgcgagctgcattgtcccgaggctatacagggcatagcagtgtggtcatcatcgattgtgggaaaaaacttactctggatcaactccgtggcacagcaggccgaaggccgcttcgagaaagcctcagtggaatatcaggaacacctttgcgcgatgacgggagtggattgctgtatctcgtcctttgacaaatcagtgctgacactagctaacgccggccgtaatagtgctagtcctaagcatagcctgaacggggagtcaagaaagactgtcctatccaagccgactgattcctcacctgaagtgatcaattatcttggtaataaagcttgcgagtgttacatctccatcgctgactgggcggcggtgcaggaatggcagaacgcaattcacgatctgaaaaagagtaccagttcaacttcacttaatttaaaggcagactttaactacatcaaatcccttagcagcttcgagagcgggaagttcgtggagtgtaccgaacagctcgaattgctgcccggggagaatatcaaccttttggctggcggtagtaaagagaaaatcgatatgaaaaaactgctgccgaacatgctctctcccgacccccgcgagctgcaaaagtctatcgaagtgcagctgttgcggtcgagtgtgtgtcttgccacagcactcaaccccatcgagcaagatcagaaatggcagtctatcacagagaatgtagtgaaatacctgaaacagaccagtaggattgcaatcggacccctccggctgtctaccctgactgtgagccagagcctgccagtgctctccacacttcagctgtattgcagcagcgccctagaaaataccgtttctaataggctatctaccgaggattgtctcatcccactcttctctgaagcccttcggagttgtaaacagcatgatgtacggccctggatgcaggctttacgctacaccatgtatcagaaccaactgctggagaagattaaagagcagaccgtgcccataagatcacacctgatggagctgggcttgacggccgccaagtttgcccgtaagagaggaaatgttagccttgctacacggttactggcacagtgctctgaggtgcaacttggtaagaccacaactgcacaggatcttgtgcagcatttcaagaagctaagcacacagggacaggtggatgagaagtggggaccggagctggatattgaaaaaacaaagctcctttacaccgcaggacagtctacccatgctatggaaatgctatcctcctgcgctatcagtttctgtaagtccgtgaaagcggagtacgctgtggccaagagtatcttgaccttggcgaaatggatacaggccgagtggaaggaaataagtgggcaacttaagcaagtgtatcgagcccagcatcagcagaacttcactggtctttcgactcttagcaagaacatcctgacattaatcgaactcccctcggtcaataccatggaagaggagtatccgcgcatagaatcagagtccactgtccatattggcgtcggagagcccgacttcattctgggacaactgtatcacctctcttctgtccaggcccctgaggtggccaagtcctgggccgcattggcttcctgggcctacagatggggccgcaaagtcgtggataacgctagccagggcgaaggggtaagactcctacctagagagaaaagtgaagtgcagaacctcctgcctgacactatcacagaagaggaaaaggagcgcatttatggtatcctaggccaggcagtgtgtcggccagcggggattcaagacgaagacatcacactgcagattaccgagtccgaggataacgaggaggatgacatggtggatgttatatggcggcaacttataagctcctgcccatggcttagcgaactggacgaatccgccacagaaggggtcatcaaagtctggcgaaaggtcgtggatagaatattttcactatacaaattgtcatgctcagcttactttaccttcctaaaactcaacgcaggccagattcctttagatgaagatgatcctagactgcacctgtcacatcgcgtcgagcagagtaccgatgatatgatcgtgatggctactctccgtctactgaggctccttgtgaaacacgctggggagctcagacagtacctggagcacggactcgagacgacgccgacagctccttggagagggattattccacagctgttttctcgattgaaccatcccgaagtgtacgtgcgacaaagcatctgcaatttactgtgtagagtagcccaggattccccccatctgatcctatatccagccatcgtaggtacaatctccctgtcttcggagagccaggcatctgggaataaattcagtaccgccatcccaactctccttgggaacatacaaggagaggaattgctggtgagcgagtgcgaaggaggctctccgcccgcctcccaggatagcaacaaagatgagccgaagtctggcctaaacgaggaccaggctatgatgcaggattgctactccaagattgtggacaagctatcctccgcaaaccctacaatggtgctccaggtgcagatgttagtcgctgagctgcgacgtgtgaccgtgttgtgggacgaactgtggctcggagttcttctccagcaacacatgtacgtgctgcggagaatccagcaactggaagatgaggtcaagcgcgtgcagaacaataatacattgagaaaggaggaaaaaatcgctatcatgagggaaaaacacaccgcccttatgaagcccatcgtgttcgcactggagcacgttcggtctattaccgccgcgccagcagagacacctcatgagaagtggttccaggacaactatggagatgccattgagaacgcccttgagaaattgaagacacctctgaatcccgctaaacccggtagtagctggattccctttaaggaaatcatgctgtctctgcagcagcgcgcacagaagagagcatcgtatattcttcgcctggaggaaatctccccatggctggctgcgatgaccaacaccgagatcgctctgcccggggaggtgtctgctagagataccgtgaccatccactcggtaggcggaacaattacaatcctgccgaccaaaactaaaccaaagaaacttttgttcttaggcagtgacggcaagtcctacccatacttgtttaaagggttagaggacctgcacctagacgaaaggatcatgcagttcctgtccattgtcaacactatgttcgccactatcaatcggcaggaaacgccccggtttcacgcccgtcattactctgtcactccccttggcacgcgttcgggacttatccagtgggtggacggagctaccccactttttgggctgtataaaagatggcagcaaagggaggcagccctgcaggcacagaaggctcaggactcgtatcaaacaccccagaaccctggaattgtacccagacccagtgagctgtattacagcaaaataggacccgccctgaagaccgtcggcttgagcctagatgtgtcccgacgcgactggccactgcatgtgatgaaagcagtattggaggaactgatggaggcgactccccctaatctcctagctaaagaactgtggtcctcatgtaccacgcccgacgagtggtggcgcgtcactcagtcctatgcgagatcaaccgcagtaatgagtatggtgggatatatcataggcttaggcgatcgccacctagataatgttctcatcgacatgaccacaggagaagtcgttcacattgactacaatgtctgttttgagaaaggcaaatctttgcgggtgccggagaaagtaccattccggatgacacagaatatcgagacagcccttggcgtcactggtgtcgagggcgtttttcggttgagctgcgaacaggtcttgcatatcatgcggcgggggagggagaccctgttgacgctgctcgaagcattcgtgtacgacccacttgtggattggaccgccggcggcgaagctggatttgcgggcgcagtgtacggaggaggtggccagcaggcagagagcaaacagtccaaaagagaaatggagcgcgagattacccggtccctcttttcaagccgggtggctgagatcaaagtaaattggttcaaaaatcgcgatgagatgctggtggtgctcccaaaactagacggctcactggacgaatatctcagtttacaggaacagcttacagatgtggagaagctgcagggcaagttgctcgaggagatcgaattcctggagggggccgagggggtcgatcatccttcacacactctccagcatagatatagcgagcacactcagttgcagacgcagcaaagggccgtacaggaggcaatccaagtgaagctgaatgagtttgagcaatggataacacactatcaggcagctttcaataacctcgaagcgacccagctggcctcactgcttcaagaaatatcaacacaaatggatctgggaccgccttcttacgtaccagctacagcctttttgcagaacgccgggcaggcacacctcattagccagtgtgaacaactggagggcgaagttggcgccttgcttcagcagaggaggagcgtgctgcggggctgtctggagcagctgcatcactatgctacagttgcactccagtatccgaaggctatcttccaaaagcacagaatcgagcagtggaagacctggatggaggagttgatctgtaatacaactgtggagcggtgccaggaactatatagaaagtacgaaatgcaatatgctccccagccccctccaactgtgtgccaatttatcacagctaccgaaatgaccctccagcgctacgctgcagacatcaactcacggcttatacgccaggtggagcgcctgaagcaggaagcggttacagtgcccgtgtgcgaggaccagctgaaagaaattgagcgttgcattaaggtttttcttcatgagaacggggaagaaggctctttatctctcgcctcggttataatatcggctctatgtactctgacaaggcgaaacttgatgatggagggagctgccagcagtgccggggaacagctggtagacctgacttcccgggacggcgcctggttcctggaggaactatgcagcatgtcaggcaacgtcacatgtttggtgcaactcctgaagcaatgtcaccttgtgcctcaggatctggacataccgaatcccatggaagccagcgaaaccgtgcatctggcaaatggggtttatacttccctccaggagctaaactctaatttcagacaaatcatttttcctgaggcactgaggtgtctaatgaaaggagagtacactttggagagcatgcttcacgagctggacggcctaatcgagcagacgaccgatggcgtgcccctgcagactctggtggaaagcttacaagcctacctgagaaacgcggccatgggactggaagaagaaacacatgctcattacattgatgtggcccgcctgctccacgcccagtatggggagctgatacaaccaagaaatgggtcagtggacgaaaccccaaagatgtccgccggtcagatgcttctggtggccttcgatgggatgtttgcacaggtcgagaccgcatttagcctcttggtggagaagctgaataagatggaaattcctatcgcctggaggaagattgacatcatccgagaagcgagatccacacaggttaacttcttcgacgatgacaatcacaggcaggtcctggaggagatcttcttcctgaagcggctccagacaatcaaagagtttttccggctttgcggcacattctccaaaacgctaagtggctccagctctctggaggatcagaatactgtgaatggcccggttcagattgtgaacgttaagacgctgttccgcaacagttgcttttctgaagaccagatggccaagcctatcaaagcttttacagcagatttcgtgcgacaactcctcattgggttgccaaaccaggcactcggactgaccttatgctctttcatctccgcccttggagtcgacatcatcgcccaagtggaggccaaggatttcggtgccgaaagcaaagtttccgtggatgacctttgtaaaaaggcagttgaacataacattcagatcggcaagtttagccagcttgtgatgaaccgggctaccgttctagcaagttcctacgacacggcatggaaaaagcatgatttggtgagacgtctcgagacgagcataagtagttgcaaaacctcacttcagagagtgcaactgcatatagcaatgttccagcagtggcaacacgaggatctactcatcaaccggcctcaggccatgtcagttactcccccaccaagaagcgccattctgacctctatgaagaaaaagctccatacactgagccaaatagaaacctccatcgctactgttcaggagaagctagcggcactcgaatctagcattgagcaacgcctcaagtgggcaggaggtgccaatcctgctttggcaccagtgctgcaggattttgaagccacaatcgcagagagacgaaacctcgtgctcaaggagtctcagcgtgcaagccaagtgaccttcttgtgttccaatatcattcattttgaatccctgagaacccgtacagcagaggccctgaacctagacgccgccctgttcgagcttatcaagagatgccaacagatgtgttcctttgcttcccagttcaactcatctgtgtcggaactcgaactgcggctgctccagcgggttgacacgggcctggaacacccaatcgggtcctccgagtggttgctctcagctcataagcagctgacgcaggatatgagcacccagagggccatacagacagagaaagagcagcagattgagactgtctgcgagactattcagaacctcgtcgacaatatcaaaacagtgttgactggacacaaccgtcagttgggcgacgtcaagcatctgctgaaggccatggccaaagatgaagaggcggctctggccgacggggaggacgtgccgtacgaaaactctgttcggcagttcttgggggaatataagtcctggcaagataatattcagacagtgctgtttacattggtccaggccatggggcaggtgcgctcacaagaacacgtggaaatgctccaggaaatcactcctacactcaaagaacttaaaactcaaagccagagcatttataacaacttggtctccttcgccagtccactcgttacagacgctactaacgagtgctcttctccaacttcttcagcgacttatcaaccttcattcgcagccgccgtgagatcaaatacagggcagaaaactcagcctgatgtcatgtcccagaacgcccgaaaactgattcaaaagaatctggccaccagcgccgacacgccaccctcaacagtgcccgggacaggcaagtccgtcgcttgcagtccaaagaaggctgtccgcgaccctaagactggcaaggcagtacaagagaggaattcctatgccgtgtccgtgtggaagcgggttaaggcaaagctcgagggtcgtgacgtggacccaaatcgccgaatgtccgtggcagaacaagtggattacgttattaaagaggcaaccaatcttgacaatctggcccagctgtacgaggggtggacagcttgggtctag

SEQ ID NO: 205417 - DNA, 10986 bp, Artificial Sequence
  Description of Artificial Sequence: Synthetic coding sequence
atgagccggcgggcccccggcagccggctgagcagcggcggcggcggaggaggtacgaagtaccctcggtcttggaacgactggcaaccacgcactgattccgctagcgcggatccagataacttgaaatattcgagtagcagggatcgcggcggcagctccagctatggcctccaaccttctaacagcgccgtcgtctctaggcaaaggcatgacgatactcgcgtgcacgctgacatacagaatgatgagaaggggggttatagcgtgaatgggggaagcggggaaaatacatacggaaggaagagtttggggcaagaattgcgtgttaataacgtgaccagccccgagtttacgtcagtgcagcacgggagtcgagcactggctaccaaagacatgcgtaaatcgcaggaaagatccatgtcctactcagatgaaagccggctaagcaacctcctccgcagaatcacgcgcgaagatgatcgagatcggaggctggccaccgtcaagcagttgaaggaattcattcaacaacctgagaataagctggttctcgtgaagcagttggacaatattttagctgccgtgcatgacgtcctaaacgagtccagcaagctgctccaagagttacgccaggagggagcttgttgcctgggtctgctctgtgcctcgctctcttacgaagccgagaaaatattcaaatggatcttttcgaagttcagctcatctgccaaagacgaggtgaaactgttatatctatgcgcaacttacaaggccctggaaacagtaggcgagaagaaggctttttccagtgtgatgcagttagtgatgacatcgctgcagagcatacttgagaacgtggatactccagagctcttgtgtaaatgtgttaagtgcatccttctagtggcccggtgttatccccacatattcagtactaacttccgagatactgtggacatcttagtgggttggcacattgaccacacccagaagccctcactgactcagcaggtttccggctggttgcagtcactggaacctttctgggtggccgacctggctttctctacaaccttgctggggcagtttcttgaggatatggaagcctacgctgaggatttgtcccacgtggcctccggggagagcgtagacgaagacgtgccccccccttccgtgtctctccccaagttagccgctttgctgcgagttttttctacggtggtgaggagtatcggggagcgtttttctcccattcggggccctcccattaccgaggcctacgtgactgacgtgttataccgagtcatgagatgtgtcaccgctgctaaccaggtgttcttcagcgaggcagttctgaccgccgccaatgaatgtgtcggggtgctgctgggcagcctagacccctccatgacaatccattgcgatatggttatcacctatggccttgaccagctagagaattgtcagacatgcggcacagactacatcatcagcgtcctcaacctactgactctcattgtggaacagatcaacacaaagcttccaagtagcttcgtggaaaagttgttcatccctagtagcaaactgctgtttctgaggtatcacaaggagaaagaagtggtcgcggtggcacacgccgtttatcaggcagttttaagcttgaaaaacattcccgtattagagacggcctataagttgatactgggcgagatgacttgtgccctgaataatcttcttcatagtctgcagctccccgaggcttgttccgaaattaagcacgaggccttcaaaaatcacgttttcaacgtggataacgcgaagttcgtggtaattttcgacctgtcagctctgaccacaattggaaacgcgaaaaatagcctgatcggaatgtgggctctctctccaacagtatttgctttgctttctaagaacctgatgatcgtccattccgacctcgccgtccacttccctgccatacagtatgcggtgctgtacacattgtacagtcactgcaccaggcatgaccattttatcagctcgtccctgtcatcttcgtctccaagcctgttcgacggggcagtaattagtacagttaccactgccaccaaaaaacacttttccatcattctgaatctgctcggcattctgttgaagaaagataacctgaatcaggatactaggaaactcctcatgacatgggctttggaagcagcggtgttgatgaagaaatctgagacatatgcccccctgtttagccttcccagtttccataagttttgcaaaggactccttgctaataccctggtagaggatgtgaatatctgcttacaggcttgcagttccttgcatgcccttagttcctctctccccgatgatcttctgcagcgatgtgttgatgtttgcagagtccagcttgttcattccggaacccgcattagacaggcctttggtaaattattgaagtcgataccgctggacgtggtgctgagtaataataaccacaccgagattcaagaaatttccttggcgttaagaagccatatgagcaaagcccccagcaacaccttccatccccaggacttctctgacgtaatatccttcattttatacggtaactctcataggacaggcaaagacaattggctggagcgactgttctacagttgtcagaggttggataagagagaccaatccactattcctcgcaatctcctgaaaacagacgccgtcctctggcagtgggccatctgggaggcagcgcagttcaccgttctctccaagctgcgcacccctctgggccgggcccaggataccttccagacaatagaaggtatcatcaggagtctggctgctcacactttaaacccagatcaggatgtcagccagtggaccactgcggacaacgacgaaggccacggcaacaaccagctgcgtctggtcttgctcctgcagtatctggaaaatctggagaaactaatgtacaacgcatatgaaggttgcgccaacgcgctgacctcgcctcctaaggtgattcggactttcttttacacaaacaggcagacgtgccaggactggcttacaagaatacggctgtccatcatgcgcgtgggcctgttggctggccagccagctgtaaccgttagacatgggtttgacctgctcacagaaatgaaaaccacttcgctgagccagggcaacgagctggaagtgacaatcatgatggtggtggaggcactctgtgagctgcactgtcctgaggcaatccagggcatcgccgtctggagttcaagcatcgtggggaaaaacctactgtggattaattcagtagcccagcaggctgaaggtcgattcgaaaaagcctctgttgagtaccaggagcacctttgcgccatgacaggcgttgactgttgtatcagctcatttgacaagtcagtgctgacactagctaacgccggacgcaactcagcatcaccaaagcatagcctcaacggggagtctcgaaagactgtgctcagcaagccgacagactcatctccagaagtaatcaactatctcggcaataaggcttgcgaatgttacatcagtatcgccgattgggctgcagttcaggagtggcagaacgctattcacgaccttaagaagtccacaagttccacatccctgaacctgaaggcagatttcaactacataaaatccctctctagttttgagagcggtaaattcgtggaatgtacggaacagctggagcttcttcctggtgagaacataaatttgcttgcgggcggaagcaaggagaagatcgatatgaagaagctgctgcccaatatgttgtctccagatcccagggaactccagaaatctatcgaggtgcaattgctccggtcctctgtctgtctcgccaccgccttaaaccctattgaacaggatcagaagtggcaatctattacagagaacgtagtaaagtacctgaagcagacctcccgaatcgcgattgggccactacgactgtccaccttaactgtaagccagtccctgccggtactctccacattacaactttactgtagcagcgctctcgaaaacacagttagtaatcggctttccactgaggattgtctgatcccgctcttctctgaggcactaaggtcctgcaagcaacacgatgtccggccctggatgcaggcactccgatatacaatgtatcaaaatcaacttctggagaagatcaaagagcaaaccgttcctataagaagtcatctcatggagctgggccttacagcggccaagttcgcgcgcaaacgggggaacgtaagcctggccacacgattattggcccaatgtagcgaggttcagcttgggaagacaacaaccgcgcaggatctagtgcagcattttaagaaactgagcactcaggggcaggtggacgagaaatggggaccggagctagatatcgagaagactaagcttttatatacggcgggccagtctactcacgcaatggagatgcttagcagctgcgccatctcattctgcaaatctgtgaaggccgagtacgctgttgctaaaagtatcttgacccttgcaaagtggatacaggctgagtggaaggagatcagcggacagctaaagcaggtctacagggctcagcaccagcagaattttacaggcctttccacactgtccaagaacatcctcactctgatcgagctgcctagcgtgaacaccatggaggaggagtaccctcgaattgagagcgaatctaccgtccatatcggcgtgggtgaacctgactttatcctgggccagctctatcacttgtcttctgtgcaagcacctgaggtcgctaaatcttgggcagcactggcatcttgggcctaccgctggggccggaaggtagtggacaacgcctcacagggcgaaggggtgcgattgctaccccgcgagaaatcggaggtgcagaatcttttacctgataccatcacagaggaggagaaggagcggatctatggcattcttggccaggccgtatgcagacctgcagggattcaagacgaggatatcactcttcaaataaccgagtctgaggacaatgaggaggatgatatggtagacgtgatttggagacagctcatctcctcgtgcccatggctgagtgagcttgacgaatctgccacggagggcgtgatcaaggtgtggagaaaagtggtcgaccggattttctctttgtacaagctcagctgctccgcctactttaccttcttgaaactgaatgccggccaaatcccactggacgaagacgaccctcgtctacacttatctcatagggtggagcaatccactgatgacatgatcgtgatggcgacacttcgactattacggctactcgtcaagcacgccggtgagctaagacagtacctggaacacggactggagacaacaccaaccgccccatggcgggggatcattcctcagctgttcagtcggctaaaccatcccgaagtgtatgttagacagtcaatctgtaacctgctatgtcgtgtggcgcaggatagccctcatctgattctctatcccgcaatcgtcgggaccatctctctctccagtgagagtcaagcgtcaggcaacaaattttccaccgctatccctaccctccttggtaacattcagggggaggagctgctcgtgtccgaatgtgaaggcgggagtccccctgccagccaggactcgaataaagatgaaccgaagtcgggattaaatgaggatcaggccatgatgcaggactgctactccaagattgttgataaattgagcagcgctaatccaacaatggtcctgcaggtccaaatgctcgtcgcggagttgagacgcgtgacggttctgtgggatgagctctggctcggcgtcttgctgcagcaacacatgtatgtactcagacgtattcagcaacttgaggacgaagtaaagcgggtgcagaataacaacacccttaggaaggaagagaaaatagccattatgcgcgaaaagcacacagccctgatgaaaccgattgtcttcgccctcgaacacgtcaggagtatcactgccgccccagccgagacacctcatgaaaaatggtttcaagacaattatggcgacgccatagagaatgcactcgagaaactgaagacgccgctgaaccccgccaaacccggctcttcctggataccttttaaagaaataatgttaagtttacagcagcgcgcccagaaaagggcctcatatatcctgcggctagaggagatctcgccttggttggccgctatgacaaatactgaaatagcacttcctggtgaagtgagcgcccgggacacggttactatccacagcgtgggcgggaccattactatattgccaacaaaaaccaagccaaaaaaattactttttctggggtcggacggaaaaagttatccgtacctctttaagggcttagaggacctgcatctcgatgagcgcatcatgcagtttctgagcatcgttaacaccatgttcgccaccattaatcggcaggaaacacctaggtttcatgccaggcactactcagttacccctctaggaacaaggtctggccttattcagtgggtggacggagccacccccctgttcgggctctataaaagatggcagcagagagaagcggctctacaggcccagaaggcccaggattcctatcagacgcctcagaacccaggaatcgtacctagaccttctgagctgtactatagtaagattggccctgcgctgaaaactgttggactgagcctggacgtctcgaggagagactggcctctgcacgtcatgaaagccgtgctcgaggaattgatggaggcgactcctccgaatctgctcgcgaaagaactgtggagcagctgcactaccccggacgaatggtggcgtgtgacacagagctacgctaggtctaccgctgtgatgtccatggtgggctatataatcggcctaggggatcggcatctggacaacgtccttattgacatgacaaccggcgaggtcgtacatatcgactacaatgtctgcttcgaaaagggcaagagccttcgggtgccggagaaggttcccttccgcatgactcagaatatagaaactgcactcggcgtgaccggggttgaaggcgtgttccgcctctcatgcgagcaagtcctgcacatcatgaggagggggcgcgaaaccttgctgactctactcgaggcgttcgtgtatgatccactggtcgattggacagccggaggcgaggctggattcgccggagccgtttatgggggcggtggacagcaggccgagtcaaaacagagcaagagagaaatggagcgagagattacaagatcactcttttcatctcgtgtcgccgagatcaaggtgaactggtttaaaaatcgggatgaaatgctggtcgtcctgcccaaactggacggctctctggatgagtacctctccctccaggagcagctgaccgatgtcgagaagctccaggggaagctactcgaggagatcgaatttctggagggcgctgagggcgtagatcacccatcccatacgctgcagcaccgttattccgaacacactcagttacagacccaacaaagggcggttcaggaggccatccaggttaaattaaacgagtttgagcagtggattacacactaccaggccgcatttaacaatctcgaagccacccagctggctagcctgctgcaagaaataagtacccagatggatctgggtccaccgtcctacgttcccgctactgcttttcttcaaaacgccggacaagcccatttgatctctcaatgtgagcagctcgagggggaagtgggggccctcctccagcagaggcgctctgttttgcggggttgcttagaacaattacaccactacgcaaccgtggcactgcagtatccaaaggctatttttcagaaacatagaatagagcagtggaagacttggatggaggaactgatctgcaatacgaccgtcgagaggtgccaggagctctatcgaaaatatgaaatgcagtacgccccgcagccaccccctactgtttgccagtttattaccgccacagaaatgaccttgcagaggtacgccgccgatatcaactcgcgcttgattcggcaggtggaacggctcaagcaagaggccgtcacggttccagtgtgtgaggaccagctcaaggaaatagagcggtgcataaaagttttcttgcacgaaaacggagaagagggttccctgagcctggcctccgtcattatctcagcactgtgcacactgacaagacggaacctcatgatggaaggtgccgcgagctccgcgggtgaacagctagttgatctgaccagtcgcgacggtgcctggttcctcgaggaactctgctcaatgtcaggcaatgttacttgcctcgtccagctgctgaagcagtgccatttagtcccccaggacttagatattcctaacccaatggaagcctcagagacagtgcacctggctaatggcgtatacactagtttgcaggaactgaattctaatttcaggcagatcatttttcctgaagcgctgaggtgcctcatgaaaggagaatatacattggaatccatgctccatgagctcgacggtttgattgagcagactaccgatggggtgccccttcaaaccttggtcgagagtctccaggcctatctgcgtaacgctgccatgggactcgaggaggagactcacgctcactacattgacgtagcaaggttactacacgcacagtacggcgagctgatacagccacggaatggatcggtggatgagacacccaagatgtctgctggacagatgctcttggttgctttcgatgggatgttcgcacaggtggagacggcttttagtctgctggttgaaaagcttaacaagatggagatacccatagcgtggcgcaaaattgatatcatccgggaggcaagaagcacccaggtcaacttcttcgatgatgataatcatagacaagtgctggaagagatctttttcctaaagagactgcagaccatcaaggagttcttccgtctgtgtgggaccttctcgaaaactcttagcggatcttcctccttggaggatcagaacacagtcaacggccccgttcaaatcgtgaacgtgaagacgctgtttaggaattcttgcttctcagaagatcagatggcaaagccgataaaggctttcacagctgacttcgtgagacaactgctaatcggcctgcctaaccaggcgcttggcctcactctgtgttcattcatctcggcccttggtgtggatatcattgctcaggtagaggcaaaagatttcggagctgaatcaaaagtttcagttgatgacttatgtaagaaggccgtggagcacaacatccaaattggcaagttctcccagcttgtcatgaacagagccaccgtgctagctagttcctacgacaccgcatggaagaagcacgacctcgtaagaagactcgagacatctataagctcttgcaaaacatcactgcagcgggtccagcttcatattgccatgtttcagtggcagcacgaggatctgctcatcaacagacctcaggctatgagcgtcacccctcctcctaggagcgcaatcctaactagcatgaaaaagaagctgcataccttgtctcagattgagacttctattgccaccgtgcaagagaaactggccgccctggagtcttctatcgagcaacgtctgaagtgggcaggcggtgctaaccccgcactcgcaccagtgctgcaagacttcgaggccacaattgccgaaagaagaaacctggttctcaaagaatcacaacgagcgtctcaggtcacttttctgtgcagcaacatcattcacttcgagtctcttagaactaggacagctgaagccctgaatctagacgccgcactcttcgagttgattaagagatgccagcaaatgtgttcctttgctagtcagttcaatagttccgttagcgaacttgagctcagactactgcagcgggttgataccggcttagaacacccgatcggaagttctgagtggctcctgtcagcacataaacaactgactcaggatatgagcacacagagagctatccagacagagaaggaacagcagatcgaaaccgtctgtgagacaatccagaacctggtggataacattaagaccgtgctgacaggacataacaggcaactcggcgacgtgaaacaccttctgaaggctatggccaaggatgaggaggctgctctggccgatggggaggacgtgccttacgaaaattcagtgaggcagttcctgggcgaatataaatcctggcaggacaacatccaaacagtgctcttcactttagttcaggccatgggtcaggttcgatctcaagaacacgtcgagatgctacaggaaatcactcctacgcttaaagaactgaaaacccagtcccaatctatttataacaacctggtctcttttgcatcgcccctggtgaccgacgctactaatgaatgtagtagtccgacgagtagcgccacataccagccctcctttgcagccgccgtacggtcgaatactgggcaaaaaacccagccagatgtcatgagtcagaacgctcgaaagctgattcagaagaatttagcaaccagtgcagacacccccccatcgacagtgcccggtaccggtaagtctgtcgcttgctctcctaaaaaagctgtaagagaccctaagaccggcaaggctgtgcaagaaagaaatagttacgccgttagcgtatggaaaagagtgaaagcaaaactagaggggagagacgtggatccgaaccgcagaatgtccgttgctgagcaggtggactacgtcatcaaagaagcgacgaacctcgacaatctggcgcagctctatgaaggatggacagcgtgggtctag

SEQ ID NO: 205418 - DNA, 3051 bp, Artificial Sequence
  Description of Artificial Sequence: Synthetic coding sequence
atgagccagggcccccccaccggcgagagcagcgagcccgaggccaaggtgctgcatacaaaaagactgtaccgagcagtggttgaagcagtgcacaggctcgacctgattctgtgtaataagacagcatatcaggaggtcttcaagcccgagaacataagtcttaggaacaaactgagggagctctgtgtgaaactgatgtttctccaccccgtcgattatggaagaaaagcagaggagttgctctggaggaaagtgtattatgaggtcatccagctcatcaaaacaaacaagaagcacatccattctagatccactcttgaatgtgcctatcggacacatctggtggccgggatcggtttttaccagcacctgctgctgtacattcagagccattatcaactcgagttacagtgttgcatcgactggacacacgtcactgaccccctgatcggatgcaagaagcctgtgtcagcttcaggcaaagaaatggactgggcacagatggcttgccacaggtgcctggtttatttgggtgatctctctaggtatcagaacgaactcgcgggagtggatacagagctgctggctgagaggttttactaccaagccttgtcagtagccccccaaatcgggatgccattcaaccagctcggtactttggccggcagcaagtactataacgtcgaggcaatgtactgctacctccgttgcattcaaagtgaagtgtccttcgagggagcatacgggaacctcaagaggctctacgacaaagctgcaaagatgtatcaccagctcaaaaagtgcgagactcgcaagctctcccctgggaaaaagcggtgcaaagacattaagagattattggtcaactttatgtacctgcagtcacttcttcaaccaaaatccagttctgtggactccgaactcacctcactgtgtcaatctgtacttgaggactttaatctctgtctgttctatctgcctagctccccaaatcttagccttgcatccgaagatgaagaagaatacgaaagcgggtatgcgtttcttccagacctcttgatttttcagatggtgattatctgcttgatgtgtgtccacagcctggagagagcagggtctaagcaatattccgctgctatcgcctttaccctggccctgttttcgcacttggtcaatcatgtcaacattcgcctccaagcagagctggaggagggtgagaaccccgtgcctgcatttcaatctgacgggactgacgagcccgagagcaaggaacccgtggagaaagaagaagaaccagatccggaacccccaccagttaccccccaggtgggtgaaggacgcaagagcagaaagttcagcagactgagttgtctgagacggcggcggcacccgccaaaggtgggggatgatagcgacctgagcgagggttttgagagcgatagttcccacgatagtgcacgcgcctcggaaggttccgacagcggaagcgataagtccctggagggcggggggacagcttttgatgccgagactgattcagaaatgaactctcaggagtctaggtctgatctcgaggacatggaagaggaggagggcacccgctcacctactctcgaaccccccaggggaaggtctgaggcaccagatagcttaaatggaccccttgggccaagtgaggcaagcatcgctagcaaccttcaggcaatgtccacacagatgttccagactaagaggtgttttcgtctagcacctaccttttccaacctgctcctgcagccaaccacaaacccccatactagcgcaagccacaggccatgtgttaatggcgacgtggacaagcccagcgagcccgccagcgaggagggctccgagagcgagggttccgagtcatccggccgctcctgtagaaatgaacggtcgattcaagagaagctgcaggttctgatggctgaaggtctgctcccagctgttaaggttttcctggactggctccggacgaatccagaccttattatcgtgtgcgctcagagcagtcaatctttgtggaaccgtctcagtgtcttactgaatctcttgcctgccgccggggagttgcaggaatcaggactggcactttgtcccgaggtgcaagacctccttgagggatgcgagctgcccgatcttccttcttctctactcctcccagaggacatggccctacgcaacctgcccccactgcgcgccgcccataggaggtttaactttgacaccgatcggcctctactgtcgacactggaggagtctgtggtacgcatctgctgtatccggagctttggacactttattgcaagactgcagggctcaattcttcagttcaacccagaagtcggaatcttcgtaagcatcgcccagtccgaacaggagagtctcttgcagcaggctcaggcacagttccgtatggcacaggaagaagctcggagaaatcggttaatgcgtgacatggctcagctgcggctgcagctggaagtaagccagctcgaaggatccctccagcagccaaaagctcagtcagccatgagcccttacttagttccagacacgcaagccctgtgtcatcatctcccagttatccggcagctggctacgtcaggacgcttcattgtgattatcccacgaacagtcattgatggactcgacctacttaagaaagagcaccccggcgccagagatggcattcgctacttagaagctgaattcaagaaaggtaacagatatatcagatgtcagaaggaggtgggcaaaagttttgagaggcacaagctgaagcgacaggacgcagatgcgtggacactgtacaaaattttagacagctgtaagcagttgacactagcccagggagccggcgaggaagacccatctggcatggtaaccattataactggactgcccctcgacaatccatcagttttgagtggtccgatgcaagcggcgctgcaggcggctgctcatgcatcagtggacattaaaaatgtcctggacttctacaagcaatggaaggaaatcggatag

SEQ ID NO: 205419 - DNA, 1125 bp, Artificial Sequence
  Description of Artificial Sequence: Synthetic coding sequence
atgagccagggcccccccaccggcgagagcagcgagcccgaggccaaggtcctccacaccaaaagactgtaccgtgctgttgtcgaggctgtgcacaggctggatctgatcctctgtaacaagactgcataccaggaagtgttcaaacctgagaacatcagcctccgtaataagcttcgggagctgtgtgtgaaactgatgtttttacatcccgtggattatgggcgaaaggccgaggaactgctctggagaaaagtctactatgaggtgattcagctgattaagaccaataagaaacacattcattcgagaagcacactggaatgcgcataccgcacacacctggtcgccggcattgggttctaccagcatctgctgctgtacatccagagccactaccaactggaactgcaatgttgtattgattggacccatgtcacagaccctctgattggttgtaaaaagcctgtgagtgccagtggcaaagaaatggactgggcacagatggcgtgtcacagatgcttagtgtacctaggcgacctgtcgaggtatcagaacgagcttgcaggggtcgacactgaactgctggcggagcgattttattatcaggccctgtccgtcgccccacagatcggtatgcccttcaaccaactcgggacacttgctggctctaagtactacaatgtcgaggccatgtactgttacctacgctgtattcagtcagaagtgtcctttgagggcgcctacgggaatctcaagagactgtatgataaggccgcgaagatgtaccaccagcttaagaagtgtgaaacacggaagctgtctcctggtaaaaagaggtgcaaagatataaaacgtctcctggtcaattttatgtatctccagtcattgcttcagcctaagtcacgcggttgcacatcacattgccccacgtcggcgttatgtttaccattgagctccttccagggcagagaacaggcgccacccagggctgccgggtccctcgcttgcgcctccacggtgtcctgcgctcatcagccacaccggtgctgtgcgctgtgttcttggctactctgctgggaccggatgggatgccaagaagaaaagaaaggcggcgctgtgtag

SEQ ID NO: 205420 - DNA, 417 bp, Artificial Sequence
  Description of Artificial Sequence: Synthetic coding sequence
tgattcatcgtgatcatcccccggaccgtgatcgacggcctggacctgctcaaaaaagagcatccaggagcgcgcgacggaatccggtacctagaggccgagttcaaaaaagggaatagatacatcagatgccaaaaagaagtgggaaaatctttcgagaggcacaaactcaagaggcaagacgccgatgcatggacactgtacaagattcttgattcgtgcaagcagctaaccttggcccaaggtgcaggtgaagaagacccgtcaggaatggtcactatcatcactggactccctcttgacaatccttctgtgctctcgggaccgatgcaggctgctctgcaggccgctgcgcatgccagtgtagatatcaagaatgtcctggacttttataagcagtggaaagaaattggctag

SEQ ID NO: 205421 - DNA, 3438 bp, Artificial Sequence
  Description of Artificial Sequence: Synthetic coding sequence
atgctggtgaccgacctggagtacgccctggacaagaaggtggagcaagatctgtggaatcacgccttcaaaaaccaaatcaccaccctccaagggcaggcaaaaaatcgtgctaacccaaatcggtcggaagtgcaagccaatctgagcctcttcctggaggcagccagtggcttctatacccagctgttacaggaactctgtactgtttttaatgttgatctgccttgcagagtaaaaagttcacaattaggaatcatctccaacaagcaaacacatacttccgcaatcgtcaaaccccagtcgtcctcctgttcctacatctgccagcactgtttggtccatttgggagacattgccaggtatagaaatcagactagtcaagccgaatcatattaccgccatgctgcacaactggtcccctctaacgggcagccatataaccagctggcaatcctggcaagcagcaaaggtgatcacctaacaaccattttctactactgcagaagcatcgctgtcaaattcccttttcccgctgccagtacaaacctgcagaaagccctgtctaaggccctggaatcgagagacgaggtgaaaacaaagtggggggtctcggatttcatcaaggcttttataaagttccacggtcatgtctacctgtctaaatctctggaaaagttgagtcctctgcgggaaaaactggaagagcagtttaaaaggctgctgttccaaaaggctttcaatagccagcagctcgtgcatgttaccgtgatcaacttgttccagttacatcatctgcgtgatttcagtaatgagacagaacaacatacatatagccaggatgaacagctgtgttggacccagctgctggcattgttcatgtcctttctcgggattctgtgcaaatgtccactgcaaaatgagtcacaagaagagagttacaatgcctacccactgcctgccgtgaaggtatccatggactggctcagactgagacccagagtatttcaggaagccgttgtagacgaacgccagtatatctggccttggctgatatctctgctgaactccttccatccacacgaggaggacttgtctagcataagcgccacacctttacccgaggaattcgaattacagggcttcctcgcccttagacccagcttccgtaatttagatttctccaaaggtcaccaaggcataaccggtgataaagaaggccaacagcgaaggataagacaacagcgcctaatatctatcggcaagtggatcgccgacaatcaaccccgcttgattcagtgtgagaacgaggtgggtaaactgctatttatcaccgagattccagagctgatacttgaggacccttccgaagccaaggaaaatttaatcttgcaggagacctccgtgatcgaatcccttgcagccgatggtagtcctggcctgaagtctgtgctgtcaaccagtcggaacttgtcaaataattgcgatactggtgagaagccagtcgtcactttcaaggaaaacattaagacacgtgaagttaatagggaccaaggcagatccttccctcccaaggaggtgcggagagactactcaaagggtatcactgtgaccaagaacgacggcaaaaaggataataacaagcgcaagacagaaaccaaaaagtgcactcttgaaaagctgcaggaaactggtaagcagaatgtggcagtacaggtcaagagccagacagagctgaggaagaccccggtgtccgaagccagaaagacccccgtcactcagacgcccacacaagcaagtaattcacagtttatcccgatacatcacccaggcgcttttcccccccttcccagcagaccaggctttcccccaccaacatacgtgatacctccccctgtggctttttctatggggagtggttacacgtttcctgcaggggtgtctgttcccggaacctttctgcagcctactgcccactcccctgctggaaaccaggtccaggctggaaagcagagtcatatcccttacagccagcagaggcctagtggcccgggccctatgaaccaaggcccccagcagagccaacctcctagccaacagcccctgacctctttgcccgcccagccaactgcacagtccactagtcagttgcaggttcaggctcttacccagcagcagcagagccccaccaaggctgttcccgctctgggaaagagccccccacaccactccggcttccagcaatatcagcaggcagacgcctcgaagcagttgtggaatcccccacaggtacaaggccctctaggtaaaataatgccagtcaaacagccttactatctgcagacacaggaccccatcaagctctttgagccgtctctacaacccccagttatgcagcaacaacctctggagaagaaaatgaagcctttccccatggagccctacaatcataatcctagcgaagtgaaggtgcccgaattttactgggactcctcctacagcatggccgacaaccggtctgtaatggcacagcaggccaacatagatcggcgcggcaaacggagccctggagtctttagaccagagcaggatccagtcccgcggatgcccttcgaggatccgaagtctagccctctcctgcccccagacctgctgaaatctctagccgcattggaagaggaagaagagctgatttttagtaacccacctgatctctatccagctctcttggggcccctggcgagcctgcctgggcgaagtctgtttaagtccctattagagaaaccttccgaacttatgtcacactcctcctccttcttgtcactcacgggctttagtttgaatcaagaaaggtatcccaacaattcgatgttcaatgaagtgtacggaaagaacctcacgtcatcatcaaaagctgaactgagtccctcaatggccccacaggagacctccttatactcattgtttgagggaactccctggtcaccctccctgccagcaagcagtgaccattcaacccctgcgtctcagagcccacattcctccaatccttcttccctaccttcatcgccacctacccacaatcacaactcagtaccattctctaattttggaccgataggcacccctgacaaccgtgacagacggacagctgaccgctggaagaccgacaagcctgccatggggggcttcggcatagattacctgagcgcaacttcttccagtgagtctagctggcaccaggctagcactcccagcggcacttggaccggccacggtccgagcatggaggacagctcagccgtgctcatggaatcactcaaatccatttggtcaagtagtatgatgcacccagggcccagcgcccttgagcaactcctgatgcaacagaaacagaagcaacagcgtggtcaggggacaatgaaccctccacattag

SEQ ID NO: 205422 - DNA, 3414 bp, Artificial Sequence
  Description of Artificial Sequence: Synthetic coding sequence
atgagcctgcagagcgcccagtacctgcggcaggccgaggtgctgaaagcggatatgacagacagcaagttaggcccagccgaggtctggacatcccgtcaggccctgcaagacttgtaccagaaaatgctggtgacagatctcgaatacgcccttgataaaaaggtggaacaggacctgtggaatcatgcctttaaaaaccagatcactacactccaaggccaggcaaaaaatcgcgccaacccaaatagatcggaagtccaggctaatctgtcattattccttgaggccgcctccgggttctatacacagctgcttcaagaactttgcacagtctttaatgtggacctcccgtgtcgggtcaagtcctcccagctaggaatcatcagcaacaagcagactcatacgtcggccatcgtgaagcctcagtcttcatcatgctcttatatttgtcagcattgtctcgtccacctgggtgacatagctcggtaccggaaccaaacgagccaggccgagagttactatcgacacgcagcgcaactcgttccctctaatggccagccatataatcagctagctatactagccagttctaagggggaccacctaaccacaatcttttactactgcaggtcgatcgctgtgaaatttcccttccctgctgcgtcaactaatctgcaaaaagcactctcaaaggctctcgagtctagggatgaagtcaagacaaagtggggagtgtccgattttatcaaggcatttatcaaatttcacggtcatgtatacctcagcaaatcgcttgagaaactgtctcctcttcgcgaaaaattagaagagcaatttaagaggcttctctttcagaaagcctttaactcccagcagctcgttcatgttactgttataaacctcttccagctccatcacctgcgggattttagtaatgaaaccgagcagcacacctacagccaggacgagcaactgtgctggacccagctgctggctctgttcatgtcttttcttggcattctctgcaagtgccccttgcagaatgaatcgcaagaggagagttacaacgcatacccactgcccgctgtgaaagttagcatggattggctacgtctgcgcccacgggttttccaagaggctgtggttgacgagaggcagtatatctggccttggttgatctctctgctcaattccttccatccccatgaggaggatctgtcctccatttccgccacccccctacctgaagaattcgagttacaggggttcttggccttgcggccttcctttcgaaacctcgacttctccaagggccatcagggaatcacaggcgacaaggagggccagcaaagaagaattcggcagcaaaggctgatatctatcggtaagtggattgccgataatcaacctcggctgattcaatgcgagaatgaagtcgggaaattgctgttcatcactgagatcccagagctgatcctggaggaccccagtgaggccaaggaaaatctgattcttcaggagacctcagtgatagagtccttagccgctgatggctcgccaggcctgaaatctgtcctcagtacttctcggaatctgtccaacaattgtgacactggagagaaaccggtagtcacttttaaagagaacataaagaccagggaagtcaatcgggaccaggggagatcatttccacctaaggaggtgcggcgagactactctaagggtatcacggtcactaagaatgacggaaagaaagacaataataaacgcaaaactgaaacaaaaaaatgtacactggagaaattgcaagaaactggaaagcagaatgtagccgtacaagtcaagtcccagactgagctgcgtaaaactccggtgtccgaagccaggaagaccccggtgacccaaacgccaactcaggcaagcaactcccagttcatcccaattcaccatccaggcgcttttccaccattgccttcccggcccgggtttcccccacccacttacgtgatcccccctcctgttgcattcagcatgggttccggatatacttttcccgccggggtgtcggtgccgggcacgtttctgcaaccaaccgcccactccccggcagggaatcaggtacaggctgggaagcagagccatattccttattcacagcaaaggcctagtggcccagggccaatgaaccagggccctcaacagtcccaacctccgagccaacaaccactgacttcactgcccgcccagcctaccgcccaaagcaccagccaactgcaggtccaggctctgactcagcagcagcagtccccaaccaaggcagtccctgccctcggtaaaagtccaccacaccattccgggttccagcaatatcagcaggctgacgcctctaaacaactgtggaaccctcctcaggtccaggggcccctcggaaaaattatgccagtgaaacagccatactaccttcagacacaggacccaattaaactttttgaaccatctttacagccccctgttatgcagcagcaacctctagaaaagaaaatgaagcctttccccatggagccttataaccacaatccatccgaggtgaaggtgcccgagttctactgggactcctcatacagcatggctgacaatcgctctgtgatggcccagcaggcaaacatcgatcgtcgcggcaagcgatctcctggcgtgttcagacctgagcaggacccagttccaaggatgcctttcgagaagtctctgttagaaaagcccagtgaactgatgtcccactccagcagctttctgagtcttaccggatttagtctaaaccaggaacggtaccccaacaattcaatgttcaatgaagtttacggaaagaatctcactagttcatccaaggcagagctctcaccaagcatggctccgcaggagacatcactgtatagcctgtttgagggaacgccttggagtccaagtttgccagcttcttccgaccactcaacaccagcctctcagtctccgcatagtagtaacccatccagccttccctcatcccctcccacccataaccataacagcgtcccattcagcaatttcgggccaatcgggacaccggataacagagatcgcaggactgctgaccggtggaagacagataaacccgctatggggggatttggcatcgactacctgtccgccacctcttcaagcgagtcatcttggcaccaggcctccaccccctctggcacctggacagggcacggcccctcaatggaagattcttccgcggtactgatggaatccctcaaatccatttggtccagttcaatgatgcatccggggcccagcgcactggaacagctgctcatgcaacagaaacagaagcaacagcgcggccagggcactatgaaccctccccattag

SEQ ID NO: 205423 - DNA, 3513 bp, Artificial Sequence
  Description of Artificial Sequence: Synthetic coding sequence
atgcggaactggatgttcctgcagatcgtgatcgtgggcgagaacgtttcgttcaaaagtcagatgcgaacagaaaatttaaaatcagaagagcatctcaaaagctcaaacatccggcaggcggaagtccttaaggcagatatgacagacagcaaactcggacctgctgaggtgtggaccagtaggcaggcacttcaggacctttaccaaaaaatgctcgtgactgatctggaatacgcactcgacaaaaaagtcgagcaggacttatggaaccatgccttcaaaaaccagataacgacgctccagggccaggctaagaatcgggccaaccctaacagatccgaggttcaagccaacctctccctcttcctcgaagcagccagcgggttttacacccagttactgcaggagctgtgcacagtcttcaacgtggatctgccctgtcgcgtgaagtcctcacagttgggcatcatctcaaacaagcagacacacacatcagcaattgttaaaccacaatcttcctcctgttcttacatatgtcagcactgcctggttcacctaggcgacatagcccgctatcggaatcagacctcccaggctgagtcttactaccggcatgcggctcagttggtcccctcaaacgggcagccttacaatcaactcgccattctggcctcatcgaagggggatcacttaacaacaatcttttactattgccggtccatcgccgtgaagttcccattccctgcagcctccactaatctgcagaaggccctaagcaaggccctagagtcaagggatgaagtgaaaaccaagtggggagtctctgactttatcaaggcctttattaaattccacgggcacgtgtacctgagtaaatccctggagaaactcagccccctgcgggagaagttggaagaacagttcaagagactgctcttccagaaagctttcaactcccagcagttagtacacgtgaccgtaattaatctgttccagctccaccacctgagggatttctcaaacgagaccgaacaacatacatacagtcaggacgaacagctatgctggactcagctgctggcactctttatgtcatttctagggatcttatgtaaatgtcccctccagaatgagtcacaggaggagagctacaatgcgtacccgctacccgccgtgaaagtctccatggactggctccggctgcggcctagggtcttccaggaggcggttgtggatgaaagacagtatatctggccctggctcatctcccttctcaactccttccatccacacgaagaggacctctcgagcattagcgctacccctttacctgaggaattcgagctgcagggatttctcgcattgaggccatcttttaggaatttggattttagtaagggtcatcagggtatcaccggggataaggaggggcagcagcgacggattcggcagcagcgcctgattagcattggaaagtggatcgccgacaaccagccacggcttattcaatgcgagaatgaggttggtaagctcttgtttattacagagatcccagagctcattctagaggacccatctgaagcaaaggaaaacctcattctgcaggaaacatcagtcatcgagtcacttgcagctgacggctccccaggtttaaaatctgtgctatctacatctcgtaacctgtctaataattgcgacaccggcgagaagccggttgtcaccttcaaagaaaatatcaaaaccagggaggttaaccgggaccagggccggtctttcccgccaaaagaagtaaagagccagactgagttgcgtaagacccccgtgtccgaggcaaggaagacgccggtgacacagacccccacacaggcctccaacagtcagtttatccccatccatcatcccggagcgttcccccccctgccctccagaccagggttcccccccccgacttacgtcattcctcccccagttgcctttagcatgggctccggctacacttttccagctggcgtctcagtccctggaaccttcctacagcctacagcccattcgcccgccggcaatcaagtgcaggcagggaagcagagtcatatcccttatagccagcagaggccttctggccctggcccgatgaaccaagggccccagcagtcccagcccccctcccagcagcccttgaccagtctgcccgcccagcccaccgctcagtcaacctcccagttacaggtccaggcactgacccagcagcaacagtcacccactaaagctgtgccagccttagggaaatcaccaccacatcatagtggtttccagcagtatcagcaggctgacgcttcaaagcaactatggaatcctccgcaggtccaaggcccccttggcaagataatgccggttaaacagccttactacctgcagacacaggacccaattaagctcttcgaacctagcctccagccccccgtaatgcagcagcaacccctggaaaagaaaatgaagccctttcccatggaaccgtataaccacaatccatccgaggtcaaagtaccagagttctactgggatagcagctattccatggcagacaataggagtgtgatggcgcagcaggctaatattgatagacgaggtaaacgaagccctggcgtgttcagacctgagcaggatcctgtacccagaatgcctttcgaagatcctaaaagcagtccgttactgccgcccgacctcctcaagtccctggcagctctggaagaggaggaagagctgatttttagtaatccaccagatctctatccagcactcttggggcctttggcatccttgcctggtagaagtctgtttaaaagcttactggagaaaccctctgagctgatgagccactcttcgtcttttttgtcactgaccggcttctcactgaaccaggagaggtaccccaataacagtatgttcaacgaagtatacggcaagaatctcacaagcagcagcaaggcagaattatcaccctccatggcaccccaggagaccagcctgtactccctatttgagggcaccccatggtccccgtctctgccagcttcctctgaccatagtactcctgcatctcaaagcccccactcctcaaaccccagctccctgccatcctcaccacctacacacaaccataacagtgttccattcagcaattttgggcccattggcacacctgataaccgtgacaggcgtaccgccgatcgctggaaaactgacaagcctgctatggggggcttcggcattgactacctgtccgcaaccagcagcagtgagagttcttggcatcaagcgtcaacacctagcggtacctggactggtcacggaccctctatggaagactcctctgccgtgttgatggagagcttgaagtctatttggtcatcttccatgatgcatccaggcccctccgcactggagcagctgctaatgcagcagaaacaaaaacagcagcgtgggcagggtactatgaatccgccacactag

SEQ ID NO: 205424 - DNA, 2274 bp, Artificial Sequence
  Description of Artificial Sequence: Synthetic coding sequence
atgctggtgaccgacctggagtacgccctggacaagaaggtggagcaggatctttggaatcatgcattcaagaaccagattactacactacaggggcaggccaagaaccgggccaatcccaaccggtccgaagtgcaggctaatctctctctcttcttggaggctgcctcaggtttttatactcagctcctccaggagctgtgtactgtgtttaacgtcgatctgccctgtagggtcaagtcttcccaactcggcatcatctccaacaagcaaactcatacctcagcaattgtcaaaccacagtcatctagttgttcctacatctgccagcactgcctcgtccacttaggagacatagcccggtacaggaatcaaacttcgcaggcagagtcctactaccggcacgccgctcagctggtcccatccaacggccaaccatataaccagttggccattctcgccagctccaaaggggatcatctgacaaccattttctattactgtagatccatcgctgtgaagttcccatttcccgcagcaagcacaaacctacaaaaagctctttcaaaggcgctggagagtcgggatgaagtgaaaacaaagtggggtgtttcagactttattaaggcgtttatcaagttccatgggcacgtgtatctgtccaagagcctggaaaagttatcccccctgagagagaaacttgaggaacagtttaagcgactcttgtttcagaaggcttttaactcacaacagcttgtgcacgttacagtaattaacttgtttcagttgcatcacctacgggatttctcaaatgaaacagagcaacacacctactcacaggatgagcagctgtgttggacacagttgctagctctctttatgtccttcctcggaatcctttgcaaatgtccactgcagaatgaaagccaagaagaatcatataacgcctatccgcttccagcggtgaaggtgagcatggactggctgcgacttcggccccgagtattccaagaggcggtagtggatgagcgacaatacatctggccctggctgattagtctgctcaattcgtttcacccccatgaggaagatctttccagcatctccgccacgccgttacctgaggagtttgaactgcagggcttcttggccctgcggcccagtttccgcaaccttgacttctccaaggggcatcaggggattacaggcgacaaagagggacagcagagacgtattcgtcagcagcgacttatttcaatcgggaaatggatcgcggataaccagcctcgactgatccagtgcgagaacgaagtggggaagctgctttttatcaccgaaatccccgaattgatcttggaagatccgtcagaagccaaggaaaacttaatactgcaggagactagtgtgatcgagtctcttgcggccgacgggtcccctggactgaagagtgttttgagcacctctcggaacctgagcaataattgcgatacaggcgaaaaacctgtcgtcacttttaaagagaacatcaagaccagggaggttaaccgggaccagggccgctcctttcctcccaaggaagtgaagtctcaaaccgaactccggaagaccccggtgagtgaggcccggaagactcctgtaactcagacacccacacaggcttcgaattcgcagttcattccaattcaccatcccggggccttccctcctctgccaagccggccagggttccctccccccacctatgtaatcccaccacctgtggcctttagcatgggatcagggtatacattcccggctggcgtgtccgtccctggaacgtttctccagccaaccgcacactccccagctgggaatcaggtccaagccggcaagcagtcccacataccttacagtcagcaaaggcccagtggtcccggtcccatgaaccagggtccgcagcagtcccaaccccctagtcagcagcccctcacatccctacccgcccaacctacagcccaaagtacatctcagctgcaggtccaggcactgacacagcagcaacagagcccgaccaaggccgtcccagcactagggaaatctcctccacaccactcaggctttcagcaataccagcaggcagatgcatctaagcagctgtggaacccccctcaggtacagggaccactgggcaagatcatgcccgtcaagcaaccctactatctgcagacccaggatccaatcaagctgtttgaacctagccttcagcctcctgtgatgcaacagcagcccttgtag

SEQ ID NO: 205425 - DNA, 3150 bp, Artificial Sequence
  Description of Artificial Sequence: Synthetic coding sequence
atgctggtgaccgacctggagtacgccctggacaagaaggtggagcaggatctgtggaatcacgcctttaaaaaccagattaccacactccaaggccaggccaaaaacagagccaacccaaacagatcagaggtgcaagcgaatctaagtctctttttggaggccgcatcagggttctacacgcagttactgcaggagctatgcacagttttcaacgtggaccttccctgtcgggtgaagagttcccaactgggcatcatcagtaataagcagacccacacctctgccatcgtcaagccgcagagcagctcttgttcgtacatttgccagcactgcctagtgcatttgggcgacatcgcgaggtatcgcaatcagactagccaggccgagagctactaccgtcatgccgcccagctggtgccctccaatggccagccatacaatcagctggctatccttgccagttcgaaaggagaccatctgacaacaattttctactattgtcggtccatagcagtgaagttccccttccccgctgcaagcactaacctgcagaaggccctttcaaaagccctcgagagccgcgacgaagtgaagacgaaatggggagtgtcagacttcatcaaagcattcatcaaattccacggccacgtctatttaagtaagtctctggagaaactgagtccactgagggagaagttggaggagcagttcaaaagactcctctttcagaaggcctttaattctcagcagttggttcatgttactgtcataaacctgttccaattgcatcaccttcgggacttctcaaatgagacggagcaacacacgtattcccaggacgaacagctctgttggacacaactgctggcattgttcatgagctttctggggattttatgcaagtgtcctttgcagaacgaaagccaggaggagagctacaatgcttaccctctccctgccgttaaagtctccatggattggctaaggctaagacctcgggtgtttcaggaagccgtggtggacgagcgacagtatatttggccttggcttattagtctgttgaacagtttccacccccatgaagaggatctctctagtatcagcgccactcctttgccagaggagttcgagctgcaggggttcctggccctcaggcccagcttccgaaaccttgatttttctaagggacaccagggtatcactggggacaaagaaggccaacagcgaaggattaggcagcaaaggctgatttctattggaaaatggatcgcggacaatcagccaagactcattcagtgcgaaaatgaagtcgggaagttgcttttcatcacggaaatcccagaactgattttggaggaccccagcgaggccaaagagaacctgattctgcaggagacctccgtgatagaatcccttgctgccgacggtagcccggggctgaagagcgtcctttctaccagcaggaatctgtctaacaattgtgatactggggagaagccagttgtgactttcaaggagaacatcaaaacccgggaggttaaccgcgatcaaggaaggtccttccctcccaaagaggtcaaaagtcagaccgaactacgcaagacccctgttagcgaggccaggaaaactccggttacccagactccaacccaagcgtctaattcccagttcatcccgatacatcatcctggagcttttccacctctgccgagtcgacccggatttcctcctcctacatacgtgattccaccgcccgtggcgtttagcatgggatcaggctataccttcccagctggggtgtcagtgcctggtacctttttacaacctacagctcattcaccagccgggaatcaggtgcaggctggtaaacagagtcacatcccctactcgcagcagaggccctctgggcccgggccaatgaaccaggggcctcaacagtctcagccgccctcacagcagcccctgactagcctgcccgcgcaacctaccgcccagagcacctcccagttgcaggtacaggccctcactcagcaacagcaaagtcccacaaaggcagtccccgcactcgggaaatcacccccccaccacagcgggttccagcaatatcaacaggctgatgcctctaaacaactctggaacccaccccaggtgcaaggccctctggggaagatcatgcccgtcaagcagccatattatctccagacccaggatcctatcaaactcttcgaaccaagtctccagccgcctgtcatgcagcagcaacctctggagaaaaaaatgaagccctttcctatggaaccatacaaccataacccgtctgaggtgaaagttcctgagttctactgggactcctcatattccatggctgacaatagaagtgtgatggctcagcaggctaatattgacaggagaggaaagcgaagcccaggagttttcaggcctgagcaagatccggtccctaggatgcctttcgaaaagtccctcctcgaaaaaccaagcgagttgatgtcccactcttcttcctttctgtccctgacaggattcagcctcaatcaggagagatatccaaacaactcgatgttcaatgaggtatatgggaagaacttaactagctcgtccaaagcagagctcagtccctcaatggctccccaagaaacatcactctattctctgtttgaaggaacaccttggtctccaagtctgcccgcatcaagcgaccactcaaccccagcttcacaatcccctcattcttctaatccaagcagcctgccgagcagtcctccaacacacaaccataacagcgtgccattttctaactttggacccatcggtacacccgataatcgagatcgacgcaccgccgatcgctggaaaaccgacaagcccgcaatgggaggttttggcatcgattacctgtccgcaacttccagttccgagtcctcttggcaccaggcaagcacacctagcgggacatggacgggtcacggcccttcaatggaggattctagtgccgtccttatggaatccctgaaatcaatttggtcttctagcatgatgcaccccgggccgagcgcactggagcagctgctgatgcagcagaaacaaaaacagcagcgcgggcagggcacaatgaatccacctcattag

SEQ ID NO: 205426 - DNA, 3537 bp, Artificial Sequence
  Description of Artificial Sequence: Synthetic coding sequence
atgagcctgcagagcgcccagtacctgcggcaggccgaggtgctgaaggctgacatgaccgattctaagcttggccctgccgaggtgtggacatcccgtcaggccctgcaggatctgtaccaaaaaatgcttgtcactgatttggaatacgctttggataagaaggttgagcaggacctgtggaaccacgcattcaagaaccagatcacaaccctccaggggcaggctaaaaaccgggctaatcctaatagatcggaggtgcaggccaatctgtcactgtttcttgaagctgcatccggcttctatactcagctgttgcaggaactgtgtaccgtctttaacgtcgatctgccatgtagggtcaaatcatcccagctgggaattatctctaataaacagacgcacacatcagcaattgtgaagccccagtccagttcctgcagttatatttgccagcactgtttagtacatctgggtgacattgccagataccggaatcagacgtctcaggcagagtcatattatagacacgccgcgcaactggtcccaagtaacggtcaaccctataatcagctggccattctggcctctagtaagggcgaccacttaactactatattttattattgccggtcaatcgccgtaaagtttccgtttccagccgcgagcaccaacctccagaaagccttatctaaagccctggaaagccgcgatgaggtcaaaaccaagtggggcgtctcggacttcattaaggcctttattaagttccacgggcatgtctacctgagcaaatccctcgaaaagctgagtcccctgcgggagaagctggaagaacaattcaagcgcctgctttttcagaaggccttcaactcccaacaattagtgcatgtgacagtgattaacctgtttcagttgcaccacttgcgcgacttctcaaacgagaccgagcagcacacatattctcaggatgaacagctttgttggactcagttgctagccttgttcatgtctttcctgggtatcttgtgcaagtgcccattacagaacgaatcacaggaggaatcatataacgcctaccctctgccggcggtcaaagtttctatggactggctgcgacttcggcccagagtgtttcaggaggccgtggtcgatgagcgacagtacatctggccatggctgatttccctactgaattctttccaccctcacgaggaggatttgtcttcgatatccgccactccattacctgaagaattcgagttacagggatttctcgccctgaggccctcattccggaacctggacttcagcaagggccaccagggcatcactggtgacaaagaagggcaacagcgccgtattaggcagcagcggctcatctccattggcaagtggatagcagacaatcagccgaggcttatacaatgcgaaaatgaagttggcaagctcctatttattaccgaaattccggaacttattcttgaagaccccagcgaggcaaaagagaatctaattttgcaggagacttcagttatcgagagtctggctgcagacggcagtcctggactgaaatccgtactgtcgacctctcgaaacctctctaataactgcgatactggtgaaaaacctgtggtaacattcaaagaaaacattaaaactcgcgaagtcaacagggaccagggacgctcgtttcctccgaaggaggtgaaatcacagaccgaactgcgcaagaccccagtctctgaagctcgaaagacacccgtcactcagaccccgactcaggcatccaattctcagttcataccaatccaccaccctggcgcttttcctccactcccaagtcggcccgggttcccacctcccacctacgtgatcccaccacctgtggccttcagcatgggctctgggtacaccttccctgcaggtgtgagtgtgcccggaactttcctgcaaccaaccgcccacagcccagccggtaaccaagtgcaggccgggaagcagagccatatcccttactcccagcaaagacctagcggaccaggacctatgaatcaaggccctcaacagtcccagccaccttcccagcagccattgactagtttgccagcccaaccaactgcacaatctacctctcagctgcaggtccaagcactgacccagcaacagcagtctcccacaaaggctgtcccagccctgggcaaatctcccccccaccactcaggcttccagcagtatcagcaggccgacgcaagtaagcagctctggaatcccccacaagtgcagggtcccctgggaaagattatgccagttaaacagccatattacttgcagacacaggatccaatcaaactcttcgaaccctccctccagcccccagttatgcagcagcaaccactcgagaagaagatgaagcccttccccatggaaccttacaaccacaacccctccgaggtaaaggtgcccgagttttattgggatagtagctattcaatggcagataaccgctccgtaatggcccagcaggcaaacattgatcggcgcgggaaaaggtccccaggcgtttttagacccgagcaggatccagttccccgtatgcccttcgaagaccccaagtcctcgccactgcttccccctgaccttctgaagagcctggccgcccttgaagaggaagaggagctgatcttcagcaaccctcccgatctctatcctgccctgttagggccactcgccagcctccctgggagaagcctgtttaaatctttgctcgaaaaacctagtgaactgatgtcccactctagttctttcttaagcctgaccggtttcagtcttaatcaggaaagatacccgaataactccatgtttaatgaggtatatggtaaaaatctcacatcaagttcgaaggcggaattgtcgccaagcatggccccgcaggaaacatcactgtacagcctattcgaagggacaccttggagtcccagcttgcctgccagttccgaccactccaccccggcatcacagtccccccattcctcaaatccgagctctctgccaagctcaccccccacccacaaccacaattccgtaccattctccaatttcggtccaatagggacacccgataacagagaccgacgaacagccgatcgctggaagacggacaaacccgccatgggagggttcggtattgattatctctccgctacttcaagtagcgaatccagctggcaccaggcgtctacaccgtcagggacatggactggtcatgggccttcaatggaagattccagcgccgtccttatggagagcctcaagaagcaacaacacggtgtgcagcagctgggcccaaagagacagagcgaggaagaagggtccagttctatctgcgtggcgcaccgaggcccgagacccctccccagttgcagcctccccgcctcaacatttcgggttaaattcaaggcagcaaggacatgcgcccaccaggctcagaagaagaccagacggcggcctttttggaaacggagaaagaaggggaagtag

SEQ ID NO: 205427 - DNA, 3276 bp, Artificial Sequence
  Description of Artificial Sequence: Synthetic coding sequence
atgagcctgcagagcgcccagtacctgcggcaggccgaggtgctgaaggccgatatgaccgactccaaactaggccccgctgaggtctggacaagcaggcaggcactccaggatctctatcagaagatgctggtgacggatctggaatacgcgttggacaaaaaggtggaacaggacctgtggaatcacgcatttaagaaccagattaccacactccaggggcaggccaaaaatagggctaaccccaacagatctgaagtccaagcaaacctcagcctgttcctggaagccgcatcaggcttttatactcagctcctgcaggaactttgcacagttttcaacgttgacctgccctgcagagtgaagtcaagccaactcgggataatttccaacaaacagacccacacgtccgcgattgtgaaacctcaaagtagctcttgttcgtatatatgtcagcactgtttggtgcatttgggagacatcgcgcggtaccggaaccaaaccagtcaggcggagagttactaccgacacgccgctcagctggtcccctcaaatgggcagccatataaccagctcgcaatactagcgagctctaaaggcgaccatctgaccacaattttttattactgcaggtcgatcgcggtaaaattccccttcccagcagcgtccactaacttgcagaaagctctgtctaaagctcttgagagccgtgatgaggtgaagactaagtggggtgtcagtgatttcataaaggcattcattaaattccatggacatgtttacctcagcaagagcctcgagaaactcagccccctgcgagaaaagcttgaggagcagtttaaaagactgcttttccagaaggcatttaatagccagcagctcgtacacgttactgttattaatcttttccagttacatcatctacgggacttcagtaatgagacagagcaacacacgtacagccaggatgagcagctttgttggacccaactgctggcactgtttatgtccttcctgggaatcctgtgtaaatgtccattacagaacgaatctcaggaagagagttataatgcttacccactccccgccgtgaaggtgtctatggactggctgcggctcaggccgcgggtctttcaggaggcggttgtcgatgagaggcagtacatttggccttggttgataagcttattaaatagtttccatccccacgaggaagaccttagttctatttcagctacacccctgcccgaggagttcgaactgcagggattcctcgctctgcgccctagctttcgtaatttggatttcagcaaaggccaccagggaatcactggagacaaagaagggcagcagcgtagaatccgtcagcagcggttaatctctattgggaagtggattgcagacaaccaaccgcgcctgatccagtgcgagaatgaagtcggaaagctgctttttatcacggagatcccagaactgatactggaagacccatctgaagctaaagaaaacctcattctgcaggaaacatctgtgatagagagcctggcggcagatgggtctcctggtcttaagtcagtgctctccacaagtagaaacctgagcaataactgcgacacaggggaaaagcctgtagtcacctttaaggagaacatcaagactcgagaggtaaatcgagaccagggtagatcatttccacctaaagaggtgaaaagccagactgagctgcgcaagacacccgtcagtgaggcccgcaagacccctgtgacccagacccccacacaagcttcaaattcccagtttatcccaatccaccacccgggtgcattccccccactacctagtagaccgggatttccacctcctacctacgttatcccacctcctgtggccttctcaatgggttccgggtacacgtttcctgcaggtgtgagcgtccctggcacgttcttacagccgaccgcgcacagccctgccgggaatcaagttcaggctgggaaacaaagtcatataccctattctcagcaacgcccctcagggcctggccccatgaatcagggccctcagcaaagtcagcctccctcacaacagccactgaccagtctgccagctcaaccaaccgcccagtcaacatcccagctacaggtgcaagctttgacccagcagcaacagagcccaaccaaagcggtaccggccctgggcaagtccccgcctcatcattcagggttccagcagtatcagcaggcagatgcctctaagcagttatggaacccaccgcaagtgcaaggaccccttgggaagatcatgccagttaagcagccctactacttgcaaactcaggacccaatcaagctgttcgagccaagcttgcaaccccctgttatgcagcagcaacctctggagaagaagatgaaaccatttccaatggagccttacaatcacaacccgagtgaggtgaaggtcccggagttctattgggattcctcctactcaatggcagataataggtccgtgatggcgcaacaggcaaatattgacagaagaggaaagaggagtcctggagttttccggccagagcaggacccggtgcctaggatgcccttcgaaaagagcttgctggagaaaccatcagagctgatgagccattcatcttcttttcttagtctcactggcttcagcctgaaccaggagaggtatcctaacaactcgatgttcaatgaagtctatgggaaaaatttaacatcctcaagtaaagccgagctctcaccaagcatggcacctcaagagacttctttgtactctctgttcgaggggaccccatggagcccttcgctgccagcaagctcggaccactccacacccgcttctcagagcccccacagcagcaacccttcctcgttacctagttcacccccaacccacaatcacaatagtgtgccattcagcaatttcggtcccattggcactccagataaccgggatagacgcacagccgatcgttggaagacagataaaccggccatgggcggcttcggtattgattacctcagtgcaacttcctcttcagaatcctcttggcatcaggcctcaaccccgtctggcacttggacggggcatggacctagcatggaggacagctcggctgtgttgatggaaagcctgaaaagtatttggtccagcagtatgatgcacccaggaccatccgcgctagagcagttgctgatgcaacagaagcaaaagcagcagagagggcagggcacgatgaacccaccccactag

SEQ ID NO: 205428 - DNA, 2976 bp, Artificial Sequence
  Description of Artificial Sequence: Synthetic coding sequence
atggccggccccgtgagcctgcgggacctgctgatgggcgccagcgcctggatgggtagcgaatcccccgggggatcccccaccgaggggggaggcagcgcagctggaggccctgaacccccatggagagaggacgaaatatgcgtggtcggcatttttggaaaaacggctctgaggctcaattcagagaagttttcactggtaaatactgtttgcgacagacaggtcttcccactcttcaggcaccaagatccaggcgaccctggacctgggatccggacagaagctggagctgttggggaggcaggtggtgcggaggatccaggggcagccgcaggagggagtgtgcgtggaagtggcgcagtggcagagggaaaccgtacagaagccggttcacaggactacagccttctgcaggcttattacagtcaggaatccaaggtgttgtatctgctgctgacctccatatgtgataattcccagctcctgcgagcatgccgcgcattgcagtccggggaagcaggcgggggactcagcctgccacatgctgaagcacacgagttctggaagcaccaggaaaaactccagtgccttagtttgctctatcttttcagtgtctgccatattctgctgttggtgcatcctacctgttcattcgatataacctatgaccgagtgtttcgcgcactggatggcctccggcagaaagtcctgcctctgctgaaaacagcaattaaggattgccccgtgggaaaggactggaaacttaactgccgcccgtgtccgcctagactcctctttctgttccagctcaacggggccctgaaggtggagccaccccgtaaccaggacccagcacatcccgataaaccaaagaagcactcaccaaagcggcgactgcaacatgctctcgaagatcagatctaccgcatttttaggaaatcgcgtgtccttactaatcagtccattaattgcttattcaccgtgcctgctaaccaggctttcgtctatatagtcccgggatcccaggaggaggatcccgttggaatgctgttggaccagctgcgcagccattgcaccgtcaaagaccctgagagtctgctggtccccgcacccctaagtggtcctaggcgatatcaggtaatgaggcagcactctcgccagcagttgtcattccacatcgatagctcctccagttcatcatcagggcaattagtagattttacactccgggaattcttgtggcagcatgttgagcttgtactttccaaaaagggattcgatgacagcgtcggcagaaaccctcagccgtctcacttcgagttacctacataccagaagtggatctcggcagcctcgaagctatatgaggtggcaatcgacgggaaagaagaggacctgggatcacctactggtgagctgactagcaagatactctcaagcattaaggttctggaaggcttcttagacattgataccaagttctcagagaaccgctgtcaaaaggcgctgcccatggctcatagcgcctaccagagcaacttgccacacaattacacaatgaccgttcataagaatcaattggctcaggccttaagggtgtactcacagcatgcaaggggacccgcatttcacaaatatgccatgcaactgcacgaggattgctataaattttggtcaaatggtcatcagctgtgtgaagagcggtcactgacagaccaacactgtgtccataagtttcactctcttcccaaaagcggcgagaaaccagaagccgaccggaaccccccagtactttatcataacagcagagcccgcagtactggagcatgtaattgcggacggaagcaggccccgagggatgatccttttgacatcaaggccgccaattatgacttttaccagttgcttgaagagaagtgttgcggaaagctcgatcacatcaattttcccgtgttcgaaccctccacgcctgatcctgcaccggccaagaatgaaagtagcccagctccaccagattcagatgccgataaacttaaggagaaagagcctcagacccagggcgagagcacttccctgagtctggcactaagccttggtcagagtacagattctctgggtacctatcccgccgacccgcaggccggtggtgataacccggaggtgcacggccaggtagaagtgaaaacggagaaacgccccaacttcgtggaccgacaggcctctactgtagaatatctccctggaatgctgcattctaactgccccaaaggcctgcttcccaagttcagcagttggtccctcgtaaagctcggtcccgccaaatcatataattttcataccggcctggaccaacagggctttatacctggcaccaactacctcatgccttgggacatcgtgattcggacccgcgctgaagatgaaggagacctggacacgaactcctggccagctcctaataaggccatccctggaaagcgctcggctgtcgtgatgggccggggtcggcggagggatgacattgccagagcattcgtaggatttgagtatgaggactcacgcggcaggcgatttatgtgttccggccctgataaagtgatgaaggtgatgggatctgggcctaaggagagcgcattaaaggccttgaattccgatatgcccttatacatactgtccagtagtcagggacgcgggctcaagccccactacgcacagctgatgcggctgtttgtcgtagtgccagacgcccctctgcagatcattcttatgcctcaggttcagccaggccccccgccttgccccgtgttttatcctgagaagcaggagatcactttgcccccggacgggctttgggtgctgcggtttccttacgcctacgtcactgagcgaggcccttgcttccctcccaaggaaaatgtgcagctgatgagttataaggtattaaggggggtcttgaaggccgtcactcagtag

SEQ ID NO: 205429 - DNA, 2925 bp, Artificial Sequence
  Description of Artificial Sequence: Synthetic coding sequence
atggccggccccgtgagcctgcgggacctgctgatgggcgccagcgcctggatggggagtgaatcacccggcgggtcaccaacagaaggcggaggctctgcagcaggcggcccggagccaccttggagagaagatgagatttgcgtggtgggcatattcggaaaaaccgcactgaggctcaacagcgaaaagttctccttagtaaacaccgtgtgcgatagacaggtcttcccactctttcgccaccaggaccccggagatcctggacctggaatccggactgaggctggtgcagtgggcgaggcaggcggagcggaagatccaggggccgccgccggtggcagcgtgaggggctcaggcgcagtagccgagggcaataggaccgaagctggctcacaggattactccctgctccaggcatactactcccaggaatctaaggtgctgtatttgctgctcacttctatctgtgataactctcagttgctcagggcctgccgcgctctgcagtcaggagaagccggggggggactgagtctccctcatgcagaagcacatgagttttggaagcaccaggaaaagctgcagtgcctttctctactttacctgttctcagtgtgtcacattctgttactggttcatcccacttgtagctttgatattacatacgacagagtgttcagagccctggacggccttcgacagaaagtgctgccgttactgaagaccgcaatcaaggattgtccggtggggaaagactggaagcttaattgtaggccatgtcctcccagacttctgtttctgtttcagcttaacggggcactcaaggtggaacccccacgcaaccaggatccagcccacccagataaacctaaaaagcattcacccaaacggcggctgcagcatgccctggaggaccagatctatagaatttttagaaaatctcgggtgttaacgaatcagtccataaactgtcttttcacagtccctgctaatcaggcattcgtatacattgtcccaggtagccaggaagaagaccctgtgggtatgcttctggaccagctgaggtctcactgcactgtcaaagaccccgaaagcctgctggtgccagcgcccctgagcgggccgagaaggtatcaggtgatgaggcagcactccagacagcagctcagcttccatatagacagttcatcatcctcaagcagcggccagttggtcgattttacactccgggaattcctctggcagcacgttgagctagttctcagcaaaaagggcttcgacgactccgttggtagaaacccccagccctcgcacttcgaactgccaacttaccagaagtggataagcgccgcgagcaaactctacgaggtagcaatcgatggcaaggaggaggacctcggctcccccacaggagagcttacatctaagatcctttcctctatcaaggtcctcgaaggctttttagacatagataccaaattcagcgagaacaggtgccaaaaggccttgccaatggcacatagcgcataccagtctaatctgccacataactatacaatgacggtgcataaaaatcagctggctcaggctctgagagtctattcccagcacgccaggggtcccgctttccacaagtacgcgatgcagctccatgaggactgctataaattttggagcaatggtcaccagctttgtgaagagaggtccttgaccgaccaacactgcgtgcacaagttccactcgctgccaaagagcggcgaaaagccggaggctgatagaaatcctccagtgttataccacaattcacgcgccagatccaccggggcatgtaactgcgggcgcaagcaggctcccagggatgatcccttcgatattaaagccgccaactacgatttctaccaattgctggaagagaagtgctgcgggaaattagatcacatcaattttcctgtcttcgagccctccacccccgaccctgcacccgccaaaaatgaaagctcacctgccccgcctgacagcgacgcagacaaactgaaagagaaagagccccagacccagggagagagcacatcgttatcactggctttgagcctgggtcagagtacagacagtttggggacatatcccgctgatccacaagcaggtggagacaacccggaggttcacggccaagtggaggtgaagaccgaaaaacgtcccaacttcgttgaccgccaggcctctacagtggaatatctcccagggatgctccattcaaattgtcctaaagggctgttgcctaaattcagttcgtggtcattggtgaagctgggacctgctaagagctataattttcataccggcctggatcagcagggctttattcctggcacaaattatctgatgccatgggacatcgtcatccggacccgggcagaagacgagggggatctcgacaccaacagctggcctgcacccaacaaagcaatccccggtaagcgtagtgctgtggtcatggggcgtggaagaaggcgcgacgatattgcaagggccttcgtggggtttgagtatgaagattcccgcgggcgccgattcatgtgttccgggcctgataaagtaatgaaagtgatgggatccggccctaaggaatccgccttaaaggctctgaattctgacatgcccctctacatcctcagctcttctcagggccgcgggctgaaaccgcactacgcgcaactcatgcgcctatttgtggtggtgccggacgctcccctgcagatcatactcatgccccaggtgcagcccgggcctcctccatgccccgtcttctaccctgaaaagcaagaaattacactgccacccgatggactttgggtgcttagatttccttacgcatacctgcgagaggatctcgtgagccccctgagaaagatgtgcagctag

SEQ ID NO: 205430 - DNA, 1563 bp, Artificial Sequence
  Description of Artificial Sequence: Synthetic coding sequence
atgagcgagagcggccacagccagcccggcctgtacggcatcgagcgaagacgtcggtggaaggagccgggctccggcggccctcagaacctctcaggccccggaggacgggaaagagactatatcgctccctgggaacgtgaacgacgcgatgcttcagaggaaacttccacatcggtgatgcagaaaacacctattatcttaagtaaaccccctgcagaaagatcaaagcaaccccctccccctaccgccccagcagctccccctgctcccgctccgctcgaaaagcctatcgtactgatgaaaccaagagaggagggaaaggggcctgtggccgtaactggtgcttccaccccagaaggcacggccccgccccccccagccgcgcctgcacctccaaaaggtgagaaggaagggcaacgtccaacccagccagtttatcagatccagaatcgaggaatgggaactgctgctccagctgccatggaccccgtcgtgggccaggctaaattgctccctcccgagcgtatgaagcactctattaaattagtcgatgaccagatgaactggtgcgacagtgcaatcgaatacctcctggaccagaccgatgtgctggttgtcggagtgctaggacttcaagggactgggaaatccatggtcatgagtctgctgagcgcaaatacacccgaagaggaccagagaacatacgtattcagagcgcagagtgccgagatgaaggaacgcgggggtaatcaaaccagtggaatcgacttcttcatcactcaggagcgtatagtgtttttagatactcagcctatcctctcaccctcaatccttgatcacttaataaacaacgatagaaaattaccaccagaatataacctgccgcatacttatgtagagatgcaaagcctccaaatcgccgcatttctgttcacagtgtgtcacgtggtaatagtggtgcaggactggttcactgacctctccttataccgttttttacagacagccgagatggttaagccctccactccttctcccagccacgagtcttcctcctcttctggcagcgacgaaggtactgaatactatccacacttggtgttcctccaaaataaggcccgaagagaggacttctgccctagaaaactgcgacagatgcacctcatgattgaccagttgatggcccatagccacctgaggtacaaaggaaccctatcaatgctgcagtgtaacgtgtttcctggtctaccccccgatttcctggatagcgaggtaaacctcttcctggtccccttcatggacagtgaggccgagtccgagaatccacccagagccgggcccggttccagtcccttgttctctctcctgcctgggtatcggggtcatccctcatttcagagccttgttagcaagttgcggtctcaggtgatgtcaatggcaaggccccagctgagccacacaatcttgactgagaaaaattggtttcattacgcggcccggatttgggacggggtgaggaagtcctcagcactggctgagtactcacgtttgctggcttag

SEQ ID NO: 205431 - DNA, 2742 bp, Artificial Sequence
  Description of Artificial Sequence: Synthetic coding sequence
atggccgacgaggccctggccggcctggacgagggcgccctgcggaaattactggaggtgaccgccgatcttgctgagaggaggcgcatcagatccgcaatcagagaactgcagcgacaagagctcgaaagggaagaggaagccctcgcttctaagcggttccgggcagagcgacaggataacaaggagaactggttacactcacaacagcgggaggccgagcagagagccgccctggccaggcttgcaggccagttggagagcatgaacgatgtggaagagctcaccgctctgttgcggtctgccggcgagtatgaggaacgcaaattaatccgcgcagccattcgccgggtgcgtgcccaggaaatcgaggcagctaccctcgctggcagactgtacagcggcaggcctaattctggcagtcgagaagacagtaagggccttgccgcacacaggttggaacagtgtgaggttccagagagggaagaacaggagcagcaggcagaagtcagcaaaccgacaccgacacccgagggaacgtctcaggatgtcactacagtaacactcctgttgagggctcctcccggctctacgagctcgagcccagctagtccatcctcctctcctacacccgcctcaccagaaccgccgttagagccagctgaagcacaatgtttgaccgcagaggtccctggaagccccgagcccccaccttcacctcctaagacgacatccccagaaccccaggaatcacctacccttccttcaacagaagggcaggtagttaacaagctgctgtctggcccaaaagagactccggcggcacagagccccacaagaggcccgagtgataccaagcgtgcggatgtggcgggcccaagaccttgtcagaggagtttgagcgtgctatctccacggcagccagcgcagaatcgggagtctacccctctggcctctgggccatcctccttccagcgcgctggatcagtccgcgatagagtgcataagttcacatcggacagtcctatggcagcgcgactgcaggatgggaccccgcaggccgccttgtccccactgccacgcaaggcccccgggccactgccccaccagcaccacccctgtctgctgttgcagcgcctgttactgagcggacctgatacatcatcaagattctctaaagaacagcggggcgtggcgcagcccttggcacagctccgatcctgccctcaggaggaggggccccggggacgcgggctggccgctaggcctctggaaaatcgcgcaggaggccctgtcgcacgaagcgaagaacccggtgccccactgccagttgcggtgggcacagctgagccagggggcagcatgaagactacattcacgattgagatcaaagatgggcgcggtcaggcctccacagggcgggtgctgttgccaaccggcaatcagcgggcagaacttacactggggctgagggcccccccgacattgctgtccacgtcctcaggcggaaagagcactattacaagagtgaactcccctgggacattggccagactgggatctgttacgcacgtgacaagtttctctcatgcccctccttcttcccggggaggatgctcgatcaaaatggaggctgagccagcagagccccttgctgccgccgtggaggcagccaacggcgccgagcaaacacgggtgaataaggcacccgaggggaggagccctctgtctgccgaggagttaatgacaatagaggatgaaggcgtgctggacaagatgctggatcagtcgacagactttgaagagcgcaaactgatcagagccgccttaagggaactaaggcaacgaaagcgggatcagagagataaggagcgagagcgtcgcctccaagaggcaaggggaaggccaggagagggccgaggcaatacggcgacggagaccacaacccgccacagccagcgggccgctgatggatcagccgtgtcaacagtaacaaagactgagagactggtgcatagcaatgacggaaccagaacggccagaacgacgacggtggagtcaagttttgtgcggagatctgaaaacgggtcagggagtaccatgatgcaaaccaagacgtttagctccagctcttccagcaaaaaaatgggcagtattttcgacagggaggaccaggcgtccccgagggccggttcactcgctgcactggagaagcggcaggcggagaagaagaaagaactaatgaaggcccagagtctccccaaaaccagtgccagccaggctcggaaagcaatgatcgaaaagctggagaaggaaggcgcagcgggatctccagggggacctagggccgcagtgcagcgcagcacaagttttggagtgccaaacgccaactctatcaagcaaatgctgctggattggtgcagagctaaaactcggggctatgaacacgtcgacatccagaatttcagctcctcctggtccgatgggatggcattctgcgccctcgtgcacaacttcttcccggaggcctttgactatggccagctctccccacagaatcgcagacagaattttgaggtagctttttcaagtgcagaaacacatgccgattgcccgcaactgctggacacagaggatatggtaaggcttcgtgaacctgactggaagtgcgtgtacacatacattcaggaattctatcgctgcttggtccaaaagggcctggtcaagactaagaagtcctag

SEQ ID NO: 205432 - DNA, 2748 bp, Artificial Sequence
  Description of Artificial Sequence: Synthetic coding sequence
atggccgacgaggccctggccggcctggacgagggcgccctgcggaagctgctggaggttaccgcggacctggctgagaggcgaagaataagatcagcaatcagggagctgcagaggcaggagctggagagggaggaggaagccctggcctctaaaaggtttcgagccgagcgacaggataacaaagaaaactggctgcacagccaacaaagagaggccgaacagagagccgccttggccagactggctggccagctggagtcgatgaatgatgtcgaggagctgacagctttgttaagatccgcaggagagtacgaggaaaggaagctgatcagagctgccatacgacgtgtccgcgctcaggagatcgaggccgcaactttggccggcaggctgtatagtggtcggcccaacagtggctcacgcgaagactctaagggactggctgcacatagactggaacagtgcgaagtgccggagcgcgaggagcaggagcaacaggcggaagtcagcaaaccaacccctacacctgaagggacctcccaagatgtaacaacagtgaccctccttctgagggctcctcccggcagcacttccagtagcccagcttcaccgtctagtagcccaacacccgcttctccggagcccccgctcgagccggctgaagcccagtgcctcacggccgaagtgccaggatctccagagcccccaccgtctccccctaaaactaccagtcctgaaccgcaggagtcgccgaccttgccttctacagaaggccaggttgtgaacaagctgcttagcggtcccaaggagacgccagccgcacagtcaccaacccgtggtccttcggacactaagagggccgacgtggccggaccacgcccgtgccaaaggtcactgagcgtgctgtctccaagacagccagcccagaacagagagagcactccccttgcctccggtccttcctctttccagcgtgctggcagcgtcagggacagggtccacaaattcacgagtgactctccaatggccgcacggctccaagacggaaccccgcaagccgccttaagccccctcaccccagctcggctactaggtcctagtctcacaagcactactcccgcttcttcctcgagtggcagttcctcccggggcccttcagatacctcttctagatttagcaaggaacagagaggcgtcgctcagcctctcgcacagcttcggtcttgcccccaggaagaggggcctcggggtagaggactggcagccaggccactcgagaacagagcggggggacccgtggctcggtcagaggaacctggcgcccccctgccagtggctgtgggcaccgccgaacctgggggcagcatgaagacaacctttacaatcgaaatcaaagatggtagaggccaagccagcaccggccgagtactactgcccacaggcaaccaaagggccgaattgaccctggggctgagagcccctccaacgttactttctacatctagcggaggaaaatcaaccattacccgggtgaacagtcccggcacactggcacgactggggagtgtgacgcatgttaccagtttctcccacgcccctcccagcagtcggggaggctgctcaatcaaaatggaggctgaaccagcagaaccactcgctgccgctgtggaggctgcgaatggggccgaacagactagggtgaataaggcacctgaaggaagaagtccactgtctgccgaagagctaatgaccattgaggacgagggagtacttgacaaaatgttggatcagtcaacggattttgaagagcgtaagctgatccgcgccgcactcagagagttgcgtcagagaaagagggatcagagggataaggaaagagaacggcgactgcaggaggcccgggggcgcccaggggaagggaggggcaacacagccacagaaaccactactcgacatagccagagggcggccgacggcagcgcggtcagcactgtaacaaagacagagagactggtccattccaacgacggcactcggacagcacgcacaacaacagtcgagagctcttttgtgcgtaggtccgagaacggatccgggtcgacaatgatgcagaccaagacctttagtagctcttcttcaagcaaaaaaatgggctcaatctttgacagggaggaccaagccagcccacgcgccgggagtctcgccgccttggagaaacgccaggccgagaaaaaaaaggagctgatgaaagcacaatcacttcctaagacatctgcttcccaagcgcgaaaagccatgatagagaagctcgaaaaggagggcgccgccggaagtccgggtggccctagagccgcagtgcagcgctccacctctttcggagtacctaacgccaattccatcaaacaaatgctcctggattggtgtcgggcaaaaacccgagggtatgaacatgtggacattcaaaatttttctagctcttggtcggacgggatggcgttctgcgctctggtccacaatttttttcccgaggcgtttgactatggacaattatctccgcagaatcggaggcagaattttgaagtggctttctcttctgccgaaacacatgccgactgccctcagttactcgacacagaggacatggtgcggctccgggagccagattggaagtgcgtgtacacatacattcaggagttttacaggtgccttgtgcagaagggcctggtaaaaactaagaagtcctag

SEQ ID NO: 205433 - DNA, 2754 bp, Artificial Sequence
  Description of Artificial Sequence: Synthetic coding sequence
atggccgacgaggccctggccggcctggacgagggcgccctgcggaagctgttagaggtgacagctgatctggccgaacggagaaggatcagaagtgccatccgagaattgcagcgacaagagctggagcgcgaagaggaggcgctcgccagtaagaggttccgggccgagcgacaggataacaaagagaattggctccactctcagcagagggaggccgaacaaagagccgccctggcccgcctggcaggtcaactggaaagtatgaatgacgtggaggagctaacagccttgttgcggtctgccggagaatacgaagagaggaagctgatcagagccgctatccgtcgtgtgagggcccaggaaatagaggctgccaccctcgccgggagactttattcagggaggcccaattctggctctagggaagactctaaaggtcttgcggcccataggctggagcagtgcgaagtgcctgagcgggaagaacaagagcaacaggccgaggtcagcaaacctacacctactccggagggtacctcccaggacgttacaaccgtgactcttctgttgcgcgcgccccctgggtctaccagctccagccctgcctctcccagtagtagccccacgcccgcctcccctgagccgcctctcgaaccagcagaagctcagtgtctgaccgcagaagtgcccgggtctccggagccaccaccatccccacctaaaacaacatcacccgagccccaagagtcccccacactgccctcaacggagggccaggtggttaacaagctcctctcaggacctaaagagactcctgctgcccaaagccccacacgtggaccttctgacaccaaacgggcggacgtggctggaccgaggccttgccaacgctccttgagtgtgcttagtccccgccagccggctcagaatcgagaatccactcccctcgcctctggtccctcatctttccaaagagccgggtccgtgcgagacagggtgcataagttcacgagcgactctcccatggccgccaggctgcaagatgggacaccgcaggcagccctctctcccttgacccctgcccgattgttaggcccatctctgaccagcacaactccagcttcgagcagtagcgggtcttcgtctcgcggccccagtgacactagcagcaggttttccaaggagcagcgtggggtggcccagccactcgctcagttgcgcagctgcccccaggaggaaggccctcgcggccgcgggctagcggcccgcccccttgagaaccgggctgggggacctgttgccagaagcgaagagccaggggctcccctccccgtggctgttggtactgccgaacccggggggtccatgaaaaccaccttcaccattgagatcaaggacggccgaggtcaggcatccactggaagagtactgctgcccactggaaatcagagggccgagttgaccctggggctccgtgcccctccgacactgctatctacgagctctggcggtaaaagcaccataactcgggtgaattccccggggacgctggcccgcctggggtccgtgactcacgttacctcgttctctcacgctccgccctcaagtagaggcggatgttccataaagatggaggctgaacctgccgagcctctggccgccgccgtggaggccgccaacggggcggagcagacacgcgttaataaggccccggaaggcaggtcacccctatccgccgaagagctaatgacgatagaagatgaaggcgtgctagacaaaatgctggaccagtctactgacttcgaggagagaaagctaatccgcgcggctctgcgagagcttcgccaaaggaagcgcgatcaacgcgataaagaaagggagcgacgcctgcaggaggctcgaggacgcccgggagagggaagggggaacacagccactgaaaccacgacaagacattcacagagggccgcggacggaagcgccgtcagcaccgtgacaaaaactgagagactagtgcactcgaacgacggcacccgcacagctcgcaccacaacagtggagtcatcttttgtccgccgcagtgaaaatggctctggaagtactatgatgcagactaaaacattctctagctcttcttccagtaagaaaatggggagcatcttcgacagagaagatcaagcctccccgcgtgccgggagcctggccgctctcgagaagcgtcaggcagaaaaaaagaaggagctgatgaaagcacaatcccttcctaagacttccgcatcccaagccaggaaggctatgatcgaaaaactagaaaaggagggagccgcaggctccccaggcggccccagagctgcagtgcagcgtagcacctccttcggcgtgcctaatgctaacagtattaaacagatgctgctcgattggtgtagggctaagactcgcggctacgagcacgtggatatccagaatttctcttcttcctggtccgacggcatggccttttgcgccctggtgcacaatttttttccagaagcttttgattatggtcagctttcgccacagaacaggcgccaaaacttcgaagtagcgttttcctcagcggagatgctggtggattgcgttccactagttgaggtagatgacatgatgattatgggcaaaaagcccgaccccaaatgcgttttcacgtacgttcaatccctatacaatcacctccgtaggcacgagttgagattgcgcggtaagaatgtgtag

SEQ ID NO: 205434 - DNA, 888 bp, Artificial Sequence
  Description of Artificial Sequence: Synthetic coding sequence
atggaggccgagcccgccgagcccctggccgccgccgtggaggccgcaaacggagccgagcagactagagttaataaggcccctgaaggcagatcacccttaagtgctgaggaacttatgaccatcgaagacgagggcgtgctcgataaaatgttagaccagtcaaccgatttcgaagagcggaagttaatcagggctgcattgcgggagctaagacaacgcaagagagacggcagtgggagcaccatgatgcagacgaagaccttcagcagctcctctagctcaaagaagatggggagtatattcgaccgtgaggaccaagcatcaccgcgtgctggcagccttgccgcactggaaaagcgccaggccgagaagaagaaggaactgatgaaagcgcaaagcctgcccaagaccagtgcaagccaagcgaggaaggcgatgattgagaagctggagaaagagggcgctgctggatctcctgggggacctcgagctgcagttcaacgctcgacctccttcggcgtcccaaatgccaactccataaagcagatgctcctggattggtgcagagccaagacgcgaggttacgagcacgttgatatccagaactttagttcctcatggtctgatggaatggcgttttgtgcactggtgcataactttttccctgaagcttttgactacggccaacttagcccccaaaacaggcgacagaattttgaggtcgcattctcctctgccgaaacccatgccgattgtccacagctgttagatacagaagacatggtgagattaagggaaccagattggaagtgcgtgtacacttatatccaggagttctatcgatgcctggtgcaaaaaggcctggtgaagaccaagaaatcttag

SEQ ID NO: 205435 - DNA, 2817 bp, Artificial Sequence
  Description of Artificial Sequence: Synthetic coding sequence
atgacctgcctgagccaccccctgcagctggaggtgaccgccgacctcgccgaaagaagaagaatccgatcagctatcagggagttgcagaggcaggagctggagagggaggaggaagcgctcgcctctaagcgatttagagctgagagacaggacaataaagaaaattggctacactcccagcagagagaggcagagcaacgggcagccctcgcaaggcttgccggacagctggagtccatgaacgacgtcgaggagctgaccgcactactgcgaagtgctggggagtacgaagaaaggaagttaattcgcgctgccatccggagggtgcgcgcacaggagattgaggcggctacactcgcaggaagactctactcaggcagaccaaacagcggctcacgtgaggacagcaaaggcttggccgcacaccgcctggaacagtgtgaggtgccagagcgcgaggaacaagaacagcaggccgaggtctcaaagcctactccaacccctgaaggcacaagccaggacgttaccacagtcactcttctgctaagagcaccgccgggctccacttccagcagtcctgcttccccaagtagctcccccactccagcctctcctgaacccccactggaacctgctgaggcccaatgcctcaccgcggaggtccccggtagtccggagcctcctccgtcaccccccaagacgaccagtcccgaaccgcaagaatcccctacgctgcctagtaccgaaggccaggtagtgaataaactcctgagtggcccgaaagaaacccccgcggctcaatcccccacgaggggaccgtctgacaccaaaagagcggacgtggcaggaccacggccttgtcagaggtctctttccgtactaagtcctcgccagccagctcagaatagggaatccacaccacttgcaagcggcccttctagtttccagcgggctggatctgttcgagatcgggtgcacaaatttacttccgattctccaatggccgccaggctgcaagatgggaccccccaggccgcactgtcacccctcactccagcgcgactgctcgggccaagcttgacaagtacaacccccgcctccagtagctccggcagcagcagtaggggcccttcggatacatccagccgcttctctaaggagcagcggggggtggcccagcccctggcacagctgcgtagttgtccacaggaggagggccctcgggggcggggattagctgccagacccctcgaaaaccgggctgggggaccagtggcacggagcgaagagcccggggctcctttaccggttgctgtaggcaccgctgagcccggcggcagcatgaaaactacattcacgatcgagattaaggacggccgaggccaggcaagcacgggacgtgtactcctgcccacagggaaccaacgcgccgaattaaccctgggcctgcgcgccccccccactctgttaagcacgtcctcaggtggcaagtccactatcacccgggtcaacagtcccggcaccctcgcccggttgggctctgtcacacatgtgacctccttcagtcatgccccgccatcgtccagggggggttgctccattaaggctgccgaggatgcaggtacacccgtcgctcatccccccgccttctctacaagacgacgatcctctaccgggaccactaggagcacaagcctcatggaagcggagccagcagagcccctggctgcggcagtggaggccgcaaacggggcagaacagaccagggttaacaaggcaccagaggggcggagtccgctgagcgctgaagaattgatgaccatcgaggacgagggggtactggacaagatgctggaccagagcacagactttgaagagagaaagctcatcagagctgcattgcgcgagctgcggcagcgaaagcgcgatcagagggataaggagcgtgaacgccgtctgcaggaagcccgcggtcggcccggggagggccgagggaacaccgcgacagagacgaccacccgtcactctcagcgagccgcagatggttctgcggtatcgacagtcaccaagacagagaggctggtgcactcaaatgacggaacgcgcacggccaggactactactgtggaatcgtccttcgtgcgcaggtccgaaaatggtagtgggagtacaatgatgcagaccaagaccttttcatcctcatcctcctccaaaaaaatggggagcattttcgacagagaagatcaagcatcgcccagggctggctccctggcggcccttgaaaagcgtcaagccgagaagaaaaaggaactaatgaaagctcaaagcttgccgaagacctccgccagccaggcccgaaaggcaatgatcgagaagctggaaaaggaaggcgcagccggaagccccggaggccccagggctgcggtccagcggagtacttccttcggagtcccaaacgctaattcaattaagcaaatgctgctggactggtgcagggccaaaacccgggggtatgagcacgtggacatccagaatttctcttcttcttggagtgacgggatggctttctgtgcgctcgtgcataacttttttcctgaggcatttgactacggtcagttaagccctcagaaccggcgtcagaacttcgaagtcgctttttcgtccgccgaaacgcatgcagattgtcctcagctgttagatactgaagatatggttaggctgcgagaacctgattggaagtgcgtctacacttacattcaagaattctatcgatgcttggtgcagaagggtttggttaagaccaaaaagagctag

SEQ ID NO: 205436 - DNA, 114 bp, Artificial Sequence
  Description of Artificial Sequence: Synthetic coding sequence
atggccgacgaggccctggccggcctggacgagggcgccctgcggaagttgctagaggtcactgccgacctggccgagaggcgtagaatccgcagcgctattcgcgaactctag

SEQ ID NO: 205437 - DNA, 2823 bp, Artificial Sequence
  Description of Artificial Sequence: Synthetic coding sequence
atggccgacgaggccctggccggcctggacgagggcgccctgcggaaacttctcgaagtcaccgccgacctagctgaacgacggcggatcaggagcgcaatacgcgagctccaaagacaggaactggagcgcgaagaagaggcactggccagtaagaggttccgagcagaacggcaggataataaagaaaattggttgcacagtcaacagcgcgaagctgagcagcgagcagctctggctcggcttgcgggacagctggagagcatgaatgatgtggaggaactgaccgccctgctgcgctcagccggggaatacgaagaacgcaagctgattagagctgctataaggcgggtgagggcccaggagattgaagctgcaacattggccgggcgcctgtacagcggtcgaccgaacagtggctcaagggaagattcaaaaggcctagctgctcacagactggagcaatgcgaagtgcctgagagggaagagcaagagcaacaggctgaggtctccaagcctacccccactcctgagggaacaagccaggacgtaacgacagttactcttctgttgagagccccacccggaagcacttctagcagccctgcctcgcccagtagcagccctactccggcttctcccgagcctcctctggagccggcggaggcccaatgcctgacggccgaggtgcctggctcccctgagcctcctccttcacccccaaaaacaactagcccggaaccccaggaaagcccaacgttgccttctaccgaggggcaggtggtcaataagctgctgagtggtccaaaggaaacccctgctgcacagagccccactcgaggtccttctgacaccaaacgggcagatgttgccggcccaaggccttgtcagaggtcactaagcgtgctaagcccccgccaaccggcgcagaatcgggaaagcactccactcgcttccggaccatcctcttttcaacgtgccggtagcgtgcgggaccgtgtccataagttcacgtccgactccccaatggcagctagattgcaagacggaactcctcaagcagctctctcgccgttgaccccggcgcgattactgggtccgagccttaccagtacaacccccgcatcatcgtcctccggatcttcttcccgcggaccctccgacacttcctccagatttagcaaggagcaacgcggagtggcccagcccctcgctcagttgaggtcttgtccgcaagaagagggtcctcgtggaaggggcctggcagcccgccccctagagaatagggcagggggacccgtcgctcggtcagaagagccaggcgcccctttgcccgtcgccgtagggacggcagagccaggcgggagcatgaagacaacctttacgattgaaattaaagatggccgcggccaggctagcacaggtagggtgctgctgcccacgggcaaccagcgggccgagttaactctcggattgcgagcccccccgacccttctctccacatctagtgggggcaagagtactattactcgtgttaattcgcccggcaccctcgctcgacttgggtcggtaacccacgtgacctcattcagccacgcccccccctcttccagaggcggatgtagcattaaaatggaggccgagccggccgagcccttggctgccgcagtcgaagccgcaaacggggccgaacaaactagagtaaataaagccccagaaggcagaagcccgctgtctgctgaggagctgatgacaatcgaggacgaaggcgttctcgataagatgcttgatcagtctacagatttcgaggaaaggaagctgatccgggccgcattacgcgaactcagacaaagaaagcgggaccagcgcgacaaggagcgggaacgccgattgcaggaagcacggggaagaccaggagaagggagaggaaatacagccactgaaaccacaacacgccacagtcagcgcgctgccgatggttcagctgtttcaactgtgactaagaccgagcgcttggtccacagtaacgacggcactagaaccgctcggactacaactgtggaatcctctttcgtccggcgaagtgaaaacggcagcggatccacaatgatgcagaccaagactttctcatccagttcatcatctaagaagatggggagcatatttgaccgtgaagaccaggcaagccctagggctggatcactcgccgcccttgaaaagcggcaggctgagaaaaagaaggagttaatgaaagcccaaagtctgcctaagacctccgcatcccaggctagaaaggccatgatcgagaaactcgaaaaagagggcgctgcggggagcccgggcggtcccagagcagcggtccagcgttccacatccttcggcgtcccaaatgctaattccataaagcaaatgctgcttgactggtgcagagccaagactaggggctatgagcacgtggacatccagaatttctcctcctcatggtcagatggcatggccttttgtgcgctggtacataattttttcccagaggcattcgactatggccagctatccccacagaacagacggcagaactttgaagtcgcattcagtagcgccgaaacgcatgcagactgtccccagctactggacactgaggacatggtacgcctacgggaaccagattggaagatgctggtcgactgtgtcccattggtggaggttgatgacatgatgatcatgggtaagaagccagatcccaaatgcgtctttacttatgtccagtccctctataaccacctgcgccggcatgagctgaggctcagaggcaaaaacgtctag

SEQ ID NO: 205438 - DNA, 1374 bp, Artificial Sequence
  Description of Artificial Sequence: Synthetic coding sequence
atggagcagaaggagggcaagctgagcgaggacggcaccaccgtgtcccccgcagccgacaaccccgaaatgagcggcggaggagcgccagcggaagaaacaaagggtacagctgggaaagctattaatgaggggcccccaacggaaagtgggaagcaggagaaggcacccgccgaagatggaatgtccgcagagctgcagggggaagcaaatggactggatgaggttaaagtggagagccagcgggaggctggcggtaaggaagacgccgaagctgagctcaaaaaagaagatggagagaaagaggaaacgacggtgggcagccaggaaatgacaggccgaaaggaggagacaaagtccgagccgaaagaagccgaggagaaggagagtactctggcctccgagaaacagaaggcggaagagaaggaggccaaacctgagagcggccaaaaggccgatgctaacgaccgcgacaagccagaacccaaagcaaccgttgaagaagaagatgccaaaaccgcctctcaggaggagacagtagtagaggatgaagctaaagcagagccaaaagaaccagatggaaaggaggaggcaaagcacggagctaaagaagaggcggacgagcctgggtccccctcagaagagcaggaacaggacgttgaaaaagagcccgaaggcggagctggagttataccaagttcccccgaagagtggccggaatcgccaacaggcgaagggcataacctttccaccgacggcttaggaccagattgtgtcgcctcggggcaaactagcccatccgcctctgaaagcagccccagcgatgtgccgcagtccccacctgagagcccctcctcaggggagaagaaggagaaagcacccgaacgacgagttagcgctcccgcgaggcctcgaggccctagggcccagaacagaaaggccatcgtagataagtttggaggggcagccagcggaccaaccgcattatttcggaacaccaaggctgccggtgcagcgattggaggcgtgaagaacatgctgttggagtggtgccgagcgatgacaaagaagtacgaacatgtcgatattcagaattttagctctagttggagttctgggatggccttctgtgcgctcatacataagttctttccagacgcattcgactacgctgaactggacccagcaaagcggcggcataacttcaccctggcattcagcacagcggagaaactggcggattgcgctcagttacttgacgtcgatgatatggttagattggctgtgcctgattctaaatgcgtctacacctacattcaagagttgtaccggtcattagtgcaaaaaggcctagtgaagactaaaaagaaatag

SEQ ID NO: 205439 - DNA, 1539 bp, Artificial Sequence
  Description of Artificial Sequence: Synthetic coding sequence
atgctgcccggcgccgtgggcgagagcgactgcagcgccgaggccagggagaagatggaacagaaagaagggaagctttcagaggatggaacaactgtgtcgcctgcagctgacaatccggaaatgagtgggggaggcgccccggctgaggaaactaagggcaccgctggcaaggctatcaatgagggacctcctacagaatcgggtaaacaggaaaaagcacctgcggaggatggcatgagcgctgagcttcagggcgaggcaaacggactggacgaggtcaaggtggagtcccagcgcgaggcaggcgggaaggaggatgctgaggctgaattgaaaaaggaggacggcgagaaagaggaaacaactgtgggttcccaggagatgacaggacgtaaagaagaaaccaagtcggagccgaaagaggccgaggagaaagaatctaccctggcctcggaaaaacaaaaggctgaggaaaaagaggctaaaccagagagcggtcaaaaagccgacgccaacgaccgggacaagccagagcccaaggccacggtcgaagaggaagatgccaaaaccgcatctcaggaggaaacaggacaaaggaaagagtgcagtacagagccgaaggagaaagccaccgacgaagaggctaaagctgaaagccaaaaagccgttgtggaggacgaggccaaggccgaaccgaaagagcctgacgggaaagaagaggctaaacacggcgctaaagaggaggctgatgccaaagaggaggccgaggatgccgaggaggcggagccaggcagtcctagcgaagaacaggaacaagatgtggagaaggaacccgaagggggggctggggtgatcccctctagccccgaggagtggcctgagagtcctaccggcgagggccacaacttgtccaccgacggactcgggccagattgtgtggcctcaggccaaactagcccctctgcctccgaatcatctccatctgacgtgccacagtcaccccctgagagtcctagctcaggtgagaagaaggagaaggcacccgaacggcgggtttcggctccagcaagaccccggggcccacgtgcccaaaaccggaaggcaattgtcgataaatttggcggcgccgcctccggaccaactgctctgtttcggaatacaaaggctgctggagcagcaattgggggggtaaagaacatgttacttgagtggtgccgggcgatgacaaagaagtacgagcacgtggatatccagaacttcagcagctcatggagctctggaatggctttttgcgcacttatccataagttcttccctgacgcctttgattatgcggaattggaccctgcaaaacgcagacataacttcacactggcattctctaccgcagaaaagttggcggactgtgctcagctgctggacgttgatgacatggtgaggctggctgtcccagactccaagtgcgtgtatacctatattcaggagttgtaccgctcattggtacagaaggggctggttaagacaaaaaagaagtag

SEQ ID NO: 205440 - DNA, 1485 bp, Artificial Sequence
  Description of Artificial Sequence: Synthetic coding sequence
atggagcagaaggagggcaagctgagcgaggacggcaccaccgtgagtcccgctgctgacaaccctgagatgagcgggggaggcgctccggctgaagagacaaagggtaccgcaggaaaagctattaatgagggacccccaaccgaatctggaaaacaggaaaaggcaccggctgaagacggtatgtctgcggagttacaaggcgaagccaacgggctggacgaggtgaaggtagaatcgcaacgcgaagcagggggaaaggaggacgccgaggccgaactcaaaaaggaagacggtgagaaggaggaaacaacagtaggttcccaggaaatgaccggccggaaggaggagaccaaaagtgagcccaaggaagccgaagaaaaagagagtaccctcgcctctgaaaaacagaaggctgaagaaaaagaagccaagccagaatcaggacagaaagccgatgccaatgatcgggacaaaccagagccaaaggccacggtggaagaggaggatgcaaagactgcctcccaggaagagacagggcagaggaaagagtgttcaacagagccgaaggagaaagctactgacgaggaagctaaggcggagtcgcaaaaagctgtggttgaggacgaagccaaggctgaacctaaggagcctgatgggaaggaggaggccaaacacggtgccaaggaagaggccgacgccaaagaggaagccgaggacgcagaagaggctgagcctggaagtcctagcgaagaacaagaacaggatgtggaaaaggagcccgaggggggcgcgggggtgatcccctcttccccggaggaatggcccgaaagccctacaggagaagggcataatctgtctacagatggcctaggtcccgattgcgtggcctccggacaaacgagccccagcgcttcagagtcttcaccatccgatgtgccacagtccccaccggagtctcccagctcgggggagaagaaggagaaggctcccgagcggcgcgtgtctgcccccgcgcgcccaaggggaccccgcgcacagaatcgaaaggccattgttgataaattcgggggggctgcctccgggcctacagccctattcagaaacacgaaggccgccggcgctgccattgggggcgtcaaaaacatgctgctcgagtggtgccgagctatgactaagaagtacgaacacgttgatatacagaatttttccagctcttggtcttcaggaatggcattctgcgctctgatccataagttctttcccgatgcattcgattatgctgaactcgacccagccaaacggaggcacaactttactttggcattctccacagccgagaaactggccgactgtgctcagctgctggatgttgacgatatggtccgcttggcagtcccagactccaaatgcgtgtatacatacatacaagaactttatcgaagcctggtgcaaaagggactggtgaaaactaaaaagaagtag

SEQ ID NO: 205441 - DNA, 312 bp, Artificial Sequence
  Description of Artificial Sequence: Synthetic coding sequence
atgagcgaggagaagcccaaggagggcgtgaagaccgagaacgaccacatcaatttaaaagtggcagggcaggacggctcggttgtccaatttaaaatcaaacggcacactccactgtccaagttaatgaaagcctactgcgaacgtcaaggactctccatgcgacagattagattccggtttgatggccagccaattaatgagaccgacactcctgcgcagcttgagatggaggacgaagatacgatagatgtgtttcaacagcagactggaggtgtcccagaatcttcactagcaggccactcattttag

SEQ ID NO: 205442 - DNA, 426 bp, Artificial Sequence
  Description of Artificial Sequence: Synthetic coding sequence
atgagcgaggagaagcccaaggagggcgtgaagaccgagaacgaccatatcaacctcaaggttgcaggacaggacggatccgtcgtgcagtttaagataaaaagacacaccccactatctaagctcatgaaagcctactgtgaacggcaagttcggcatctggcccccccacaaagccttccggtgtgcgctctggtgctttgcgtgccgggaatccctcgggctagagctagtaggggctggactcagatgcagctccctgagggtctgtcaatgcgtcagattcggtttaggtttgatggacagccaatcaacgaaacagatacacctgcccaactcgaaatggaggacgaggacactatcgacgtattccaacagcaaactggaggtgtgcccgagagtagtctggccgggcactcattttag

SEQ ID NO: 205443 - DNA, 288 bp, Artificial Sequence
  Description of Artificial Sequence: Synthetic coding sequence
atggccaacgagaagcccaccgaggaggtgaagaccgagaacaacaatcacattaatttaaaggtcgcaggtcaagacggatcagttgttcagttcaagatcaagcgacaaacccccctctctaagctgatgaaggcatattgtgaaccccgggggctgagcgtcaagcagattcggtttcgcttcgggggtcaacctattagtggaactgacaagcctgcccagctagagatggaagatgaagacacaattgacgtatttcagcaaccaaccggcggggtgtactag

SEQ ID NO: 205444 - DNA, 411 bp, Artificial Sequence
  Description of Artificial Sequence: Synthetic coding sequence
atggccggcgccggcagcgccgccgtgagcggcgccggcacccccgtggctggccccaccggcagggacctgttcgcagagggcctgctggagtttctcagaccggctgtccagcagcttgactctcatgtgcatgcggttcgtgagtcccaggttgaactgcgcgagcagatcgacaacttggctacagagctatgtaggattaacgaggaccaaaaggttgctctcgatctggacccctacgttaagaagctgttgaatgccaggcgtcgggtggtcctcgttaataacattctgcaaaacgctcaagagcggcttcggcgtctcaaccacagtgtggccaaagagaccgcccgacgccgagcaatgctggatagtgggatttatccaccggggtccccagggaagtag

SEQ ID NO: 205445 - DNA, 2298 bp, Artificial Sequence
  Description of Artificial Sequence: Synthetic coding sequence
atggccggcttcaagcggggctacgacggcaagatcgccggcctgtacgatctcgataaaacacttggccggggccacttcgccgtcgttaaactggctcggcacgtgttcaccggagaaaaggtggccgtgaaagttattgacaagaccaaactcgacaccctggccacagggcacttgttccaagaagttcggtgtatgaagctagtgcagcaccccaatatcgtgcggctatacgaagtgattgacacgcagacaaagttgtacctaatcctcgagctcggtgacgggggggatatgtttgactacatcatgaagcatgaagaaggtctgaatgaggacctggccaaaaagtactttgcacagattgtgcatgcgatttcatactgtcacaagctgcacgttgtccaccgggacctgaaaccagaaaatgtggtgttttttgaaaaacagggtctggtgaaattgactgacttcggctttagcaacaaattccagccagggaagaagcttaccacaagctgcggctcactggcttattccgctccagaaatactattaggtgacgaatatgacgctcctgctgtcgacatatggagtctgggtgtgatcctgtttatgctagtctgcgggcagcctccattccaagaggccaacgattctgagacactgacaatgatcatggactgcaagtacacagtcccgtcccatgtgagcaaagagtgtaaggaccttatcacaagaatgctgcagcgggatccaaagcgcagagccagccttgaggagatcgaaaatcacccttggctgcagggcgtagacccctcaccggcaacaaagtacaacatcccgctcgttagttacaagaatctctctgaggaggaacacaatagcattatacaacggatggtcttgggtgacatcgcagatcgagatgccatagtggaggccttagaaaccaatcgctataatcatattaccgccacatacttcctcctcgccgaaagaattctccgagagaaacaggaaaaggaaattcagactaggagcgcctccccgagcaacatcaaagcccagttccggcagagctggcctactaaaatcgacgttccgcaggacctggaggacgatctcactgcaacgccattatcacacgcaacagtgcctcagtcgccagccagagccgccgatagcgttctcaacggtcataggagcaaaggtctttgtgactccgctaagaaagacgacctgccagaacttgccggtcctgccctgagtaccgtcccaccagcgtcgctgaagcctaccgcctcagggaggaaatgccttttcagagtggaggaggatgaagaagaggacgaggaagacaagaagccaatgagcctcagtacacaggtcgtcttacggcgcaaaccgtcagtcactaatcgactcacgagtcgcaaaagcgcacccgtgttgaatcaaatcttcgaggaaggcgagagcgacgacgaattcgacatggacgagaacctgcccccgaaattatcaaggctcaagatgaatatcgcatctcctgggacggttcataaacggtatcataggcggaagtctcaaggtcgggggagtagctgttctagcagcgagacttccgacgatgactctgagtctcggaggaggctagataaggacagcggcttcacctattcctggcaccggcgagatagctccgagggaccccctggatccgaaggcgacggagggggacagtcaaagcctagtaacgcgagcgggggcgtcgacaaagcaagcccgtccgaaaacaatgcaggaggcgggtctcccagcagcggctcaggggggaaccccaccaacacaagcggcacaacgcgtcggtgtgcgggcccaagtaacagcatgcagcttgcctctcgttctgccggagaacttgtggaatcgttgaaacttatgagtctctgtctaggttcgcaactgcacggcagcacaaagtacattatagatccccagaatggtctaagttttagtagcgtgaaagttcaggagaagtccacctggaagatgtgtatctcctctacggggaacgctggccaggtcccagcagtgggcggcatcaagttttttagcgatcacatggccgacaccaccaccgagttggaacggatcaagtctaaaaacctgaaaaataacgtccttcagctgcctttgtgtgagaaaactatttcggtgaacatacaaaggaatcccaaagagggtctgctctgcgcaagctcacccgctagttgctgccatgtgatctag

SEQ ID NO: 205446 - DNA, 2298 bp, Artificial Sequence
  Description of Artificial Sequence: Synthetic coding sequence
atggccggcttcaagcggggctacgacggcaagatcgccggcctgtatgatcttgacaagactctgggaaggggacacttcgccgtcgttaagttggcacgacacgtcttcaccggggaaaaagtggctgtgaaagtgatcgacaagacaaaacttgataccctagccacaggacatctttttcaagaggttcgttgcatgaagttggtccagcatcctaatatcgtgaggctatatgaagtaattgatacccagaccaagttgtacctgatcctcgaactcggagacggcggtgatatgtttgactacatcatgaagcacgaggagggactgaatgaggacctggcgaagaagtatttcgcccagattgtgcacgcgatatcatactgccacaaactgcacgtcgtccacagagacctaaagccagaaaacgttgttttcttcgagaagcaggggctggtcaagttaacagattttggattttccaataaattccaaccggggaaaaaactaactacatcctgcggctcactggcctacagtgcccccgagatcctgttaggtgacgagtacgatgcccccgccgtcgacatttggtcccttggggtaatcttgtttatgcttgtgtgcggtcagccaccctttcaagaggctaacgactcagaaaccttaaccatgatcatggattgcaaatatactgtccctagccacgtgagcaaagagtgtaaagatttaatcactcgtatgctgcagcgagaccccaagaggcgcgccagcctggaagagattgaaaatcacccttggctgcaaggcgtggaccccagccccgccaccaagtataacatccctctggtgtcatacaaaaatctgtccgaggaggagcacaacagcattattcagcgaatggttctgggggacatcgctgaccgtgatgcaattgttgaggccttagaaactaaccgatacaaccatatcacggcgacttactttctgctggctgaacgaatcctcagagaaaaacaggagaaagagattcaaacccggtccgcgagcccctcaaatatcaaagctcaattccggcagtcttggccgacaaaaattgatgttcctcaggacctggaggatgatctgactgctacccccttgagccatgctacagtaccgcagagtcccgcaagggccgccgactccgtcctgaacggccacaggtctaaggggctttgcgatagcgctaaaaaggacgatctgcccgagttggcaggccccgcactcagcaccgtaccgccggctagcctcaagcctactgcaagcggaaggaaatgtctgttccgcgttgaggaagacgaagaggaagacgaagaggacaaaaaacccatgagcctgtctacacaggttgttctccgccgaaaaccatccgtcaccaaccggctcacttcaagaaagtcggctcctgttcttaaccaaatcttcgaggagggcgagtctgatgatgaattcgacatggacgaaaacctcccacctaagctgagccggctgaagatgaacatcgcctctcccggaacagtgcacaagaggtaccacaggcgcaagtcccaaggtagagggtcatcctgcagctcctccgaaacatccgatgatgactccgaaagccgccgcaggctggacaaagactccggatttacgtactcttggcataggagggatagctccgagggccctccaggatccgaaggcgatgggggggggcagtcaaaaccctctaatgcatcagggggcgtcgacaaggcctcccctagtgaaaataatgcagggggaggctcccccagttcaggcagcgggggtaatcctactaatacatccggcaccacccgacgatgtgctggtccctccaacagcatgcaactggcaagtcggtccgccggcgagcttgtggagtcactaaaactgatgagtctgtgtctcgggagccagctccacggaagcaccaaatacatcatcgatcctcagaacggcttaagcttttcttccgtcaaggtgcaggaaaagagcacatggaaaatgtgcatcagctcaacggggaatgcaggccaggtcccagcagtgggcgggatcaagttcttctctgaccatatggcagatacaactactgaactggaaagaataaagagcaagaacctgaagaacaatgtgctgcagctgccactgtgcgagaaaacaatcagtgtcaacatccagcggaacccgaaagagggactcctttgcgcctcttctcccgctagctgctgtcatgtgatttag

SEQ ID NO: 205447 - DNA, 2298 bp, Artificial Sequence
  Description of Artificial Sequence: Synthetic coding sequence
atggccggcttcaagcggggctacgacggcaagatcgccggcctgtatgatttggacaagaccctcggccgtgggcacttcgctgtggttaagctggcaaggcacgtttttacaggagaaaaagtggccgtcaaggtcatagataaaaccaagctggataccttagccaccgggcacctatttcaggaggtgagatgcatgaagctcgtccagcaccccaatatcgtgcggttatatgaagtgatagacacgcaaaccaagctctatctgattttggagttgggcgatggaggcgacatgtttgattacatcatgaagcacgaggagggcctgaatgaagatcttgctaagaagtacttcgcccagatagtgcacgccatttcctattgtcacaaattacacgtagttcacagggatcttaagccagagaatgtggttttctttgaaaagcaggggttggttaaactgactgacttcgggttctccaataaatttcagcctggcaagaagctgacgactagttgcggaagcctggcttacagcgctcccgaaatcctcttgggggacgagtatgatgcgcccgctgtcgatatttggagcctgggggtgatcctattcatgctggtttgcgggcagccacctttccaggaggcgaacgattcagaaacattaactatgattatggactgtaagtataccgtgccttcccatgtttccaaggagtgcaaggatctaatcactcgcatgctgcagcgcgacccaaaaagacgagctagcttagaggaaatcgagaatcatccatggcttcagggcgtggatccaagccctgcgacaaagtacaatatccctttagtcagttataagaatcttagcgaggaagagcataattccatcatccaacgcatggtactcggagacattgcagaccgcgatgcaatcgtcgaggctttggagactaaccgttacaaccatataaccgctacatattttctccttgcagagcgtatcttaagagagaagcaggagaaggagattcagactagatccgctagcccatccaatatcaaagcccagtttcgacagagctggccaacgaagattgacgtgcctcaagatttagaggatgacctaacggctacccccctgtctcatgcaactgtgcctcagagtcccgcacgcgcagccgatagcgtgctgaatgggcaccgatctaagggactgtgtgattccgccaaaaaggacgacttaccagagctagcaggtccagccctgtcgaccgtcccacccgcctctctcaagcctaccgctagcgggcgaaaatgtctattccgagtggaagaggacgaggaagaagatgaagaggataagaaaccaatgagccttagtacacaagtggtgttacggcgcaaaccaagcgtgactaacaggctcacatctcggaagtccgcgcctgtcctgaaccagattttcgaagaaggcgagtctgacgacgagtttgacatggatgagaatctcccaccaaaactcagcagattgaagatgaacatagcatcgcccggcacagttcacaagagataccaccgtaggaaaagccaaggacgggggtcttcctgctcaagttccgaaaccagcgacgatgacagcgaatcccgtcggagattagataaagactctgggttcacctactcctggcataggagggactctagcgagggaccgccaggctcagaaggggacgggggggggcaatctaagcccagtaatgcatcaggcggagtggataaggcatccccaagtgaaaataatgcaggaggagggtcgccaagctcggggagtggagggaaccctaccaatacctctggaacgacccgccgctgcgctggaccttctaactccatgcagttagcttcgcgatctgccggcgaattggtcgaaagcctgaagctcatgtctctctgcttagggtcacaattgcatgggagtacaaaatatatcatcgacccacagaatggattatcattttcatccgtgaaggttcaggaaaaatcaacctggaagatgtgtatctcaagtactggaaacgctggtcaggtacccgctgtcggcgggatcaagtttttcagtgaccatatggcggacactacaaccgagcttgaacggatcaaaagcaagaacttgaagaataatgttcttcaactgcccctgtgcgagaaaacgattagcgtgaatattcaacgtaatccaaaggaaggcctactctgcgccagctcccctgccagctgttgtcacgtcatttag

SEQ ID NO: 205448 - DNA, 9693 bp, Artificial Sequence
  Description of Artificial Sequence: Synthetic coding sequence
atgcagagcagccccagccccgcccacccccagctgcccgtgctgcagactcaaatggtttctgacggcatgaccggaagtaaccccgtgagcccagcatcctcgtcaagtccggcttcgagtggggccggcgggatcagcccccagcacatagcccaggattccagtctagatgggccgcctgggcctcccgacggtgcaactgtgccattagaaggcttttcactgtctcaggcagctgatttggccaataagggtccgaagtgggaaaagtctcacgcagagattgccgagcaggctaaacacgaggccgaaattgaaacaaggattgccgaactccggaaggagggattctggtcactcaagagactgcccaaggtccccgagccgcctcggccgaagggccactgggactatctgtgtgaagagatgcagtggcttagcgccgattttgctcaggagcggaggtggaagcggggcgtagcccgaaaagtggtgagaatggtgatacggcaccacgaagaacagcggcagaaggaggaacgggcgagaagagaggagcaggcaaagcttcgcaggattgcctctacaatggccaaggatgtgcgtcagttttggagcaatgttgagaaggttgtccagttcaaacagcagtcccgcctagaagaaaagaggaaaaaagccttagacttgcatctggattttatcgttggacaaaccgaaaagtactctgaccttctgtctcagtcactcaaccaacccctaacctcatccaaagccggtagttctccctgtctcggcagttcctcggcagcaagttctccgcctcctccagctagccgcctggacgacgaagacggagacttccagccccaagaggatgaggaggaagacgatgaggaaacgattgaggtggaagagcaacaggagggaaacgacgccgaagcacagcgaagggaaatcgagttactacggagagaaggggagttgcctctggaagagctcctccgatcattgccgccccagcttcttgagggtccaagcagcccctcccaaaccccgtcttcccacgacagtgacacccgagacggacccgaagagggggccgaggaagagccgcctcaggtgctggagataaagccccctccgtctgcagttactcagcgcaacaagcagccttggcacccagacgaggatgacgaggaatttactgcaaatgaggaagaggcagaagacgaggaggacaccattgccgctgaggaacagctggagggtgaggtggaccacgctatggagctgtccgaactcgcacgggaaggggaactttcaatggaagagctgctgcagcagtacgctggcgcctacgcacccggttctggtagctcagaggatgaagatgaagacgaagttgacgctaacagtagtgactgcgagccagagggccctgtggaggccgaggaacctccccaggaggactcctcttcacagtccgattccgttgaggatcgaagcgaagacgaggaggatgagcacagcgaggaggaagaaacttctggatccagcgcctcggaagagagcgaatctgaggaaagtgaggatgcccaatctcagtcgcaggcagacgaagaagaggaggacgacgacttcggagtggaatatttactggctcgggatgaggaacagtccgaggccgatgccggttccgggcctcccacacccggtccgaccacgctggggccaaagaaagagatcaccgacatcgccgcggcagccgaatctttgcagccaaaaggctacactctcgccactactcaggtgaaaacccctatccctctgctgttgcgcggacagttgagagagtaccagcacattggactggactggctggtcacgatgtacgaaaaaaaactcaatgggatcctagcggacgaaatgggtcttggcaagactatccagactatctcacttcttgctcatctcgcctgtgagaagggaaattggggtccacacctaattatagtgccaactagtgtgatgctgaattgggaaatggaactaaaaagatggtgcccaagcttcaaaatactaacatattatggcgcccagaaggagcgaaaactcaaacgacagggatggactaagccgaatgccttccatgtttgtatcaccagctataaactggtgttacaggaccatcaagccttcagacggaagaattggcgatatttgattctggatgaggcccagaatatcaagaattttaagtcccagcggtggcagagcctgttaaacttcaactcacagcgccgcttactgctgacagggacaccactgcagaactccctcatggagctatggtccttaatgcacttcctaatgcctcatgtgttccagtcccaccgggagttcaaggaatggttttccaacccgttaaccgggatgatagaggggtctcaagagtacaatgagggtttggtgaagcgactccacaaggtgctacgaccgttcctgctccggcgagtaaaagtcgatgttgaaaaacaaatgccaaagaagtatgagcatgtcattcgctgtaggctgagcaagcgacagcgatgtctttacgatgacttcatggcacagaccaccacaaaggagacgctagccaccggccacttcatgtccgtcatcaacatcttaatgcagctgcggaaagtctgcaatcacccgaacctgttcgaccctcggcccgttacctcacccttcataacccccggaatctgtttttctacggccagcttggttctaagggctacagacgttcacccactgcaacgcatcgatatgggtagatttgacctaatcggactcgaaggtcgagttagcagatacgaggcagatacatttctgcctcggcatcggctttcacggagagttctgctggaggttgctaccgcacctgatccccctccacggcctaaacccgtcaaaatgaaagtgaacaggatgctacagccagtacccaagcaggagggaagaacggtggtggtggttaataaccctcgagcgccactggggccagttccagtccgccctccccccggtcctgagttaagtgcacaacctactcccggccccgtaccacaggttcttcccgctagcctgatggttagtgccagccccgctgggccccctctgattcccgcttctcgaccacctggacccgtcctgctgcccccattgcagcccaattccgggagcctgcctcaggtcctgccatcaccactgggtgtactctctgggacatctagaccacctactcctaccctcagcctgaagccaacacctcccgcccccgtccgactttcgcccgcacctccccctggttccagttcccttctaaagccgctgactgtgccgccagggtataccttccctcctgccgccgctaccacaacaagtacaactactgccaccgcaaccaccaccgctgtgcctgcgcctacccccgcgccacaacggcttattttgagtcctgatatgcaggcgcgcctgccaagcggagaggtggtgtcaatagggcagctcgcctcactggctcagagaccggtagccaatgccgggggcagtaagcctttgaccttccagattcagggcaacaagcttacactgaccggtgcccaggttagacagttggccgtcggccaaccacgacctctgcaaagaaacgtcgtgcacctcgtctccgcgggggggcaacatcatctgataagccagccagctcacgtggctttgattcaggccgtggctccaacgcctggcccaacaccagtgagcgtgctgccttcatccacgccctccactactcccgccccaactgggctgtcactgcctttggcagccaaccaggttccaccaactatggttaacaatactggtgttgttaagattgtggttaggcaagccccacgagacggcctgactccggtgcctcctctggcccctgcccctagacctccctcaagcgggcttcccgcagtgctgaatccacggcctaccctgactccggggaggttaccgacgcccacactgggaactgctcgggcaccgatgcccactcctacattggtgcgtcccttgctaaagttggttcactccccctcacccgaagtgagcgcttccgctcctggagctgcccccctgacgattagctcaccactgcatgtccccagcagcttgccgggccccgcatccagccctatgcctattcccaattcttcccccctcgccagtcctgtgagcagtaccgtgagtgtccccctgtccagcagcctccctatcagtgtgccaactactctgccggcacctgctagcgcccccctgaccatccctatcagcgccccccttaccgtatccgcctccggcccagcgctgctaacctccgtgactcctcctctcgcaccggtcgtcccggctgcacccggccctccctctctggcaccaagtggcgcaagtccaagcgcttccgcgttgacattgggattggccactgcacccagcctctcatcttcacaaacccccgggcatcctctgctgctggcccccacctcaagccacgtgccgggcctgaatagcaccgtggctcccgcctgcagcccggtcttggtccctgcaagcgccctcgctagccctttccccagcgcacctaatcctgcccccgctcaggcctccctgctagcccctgcgagcagcgccagccaggcactagcaaccccgctggctccaatggccgcaccccagaccgccatcctggcaccttctcctgcacccccccttgcccccctgccggtcctggccccctcgcccggagccgctcctgttctggctagtagccagacacccgttccggtgatggccccaagcagcacacccggcacttcattggctagcgcatccccggtacccgctcctactccagtgctcgctcccagctctacccagacaatgctccccgctcctgtgccgagtcccctgcccagccctgcttctactcaaacactggccctcgcccccgctctcgcccccaccctagggggctctagtcccagccaaacacttagcctggggacaggtaatccacaggggccctttccaacccagaccctgagtctgaccccagcaagtagcctcgtcccaactcctgctcagaccttgagcctggcccctgggccccctcttggtccaacccagacactgtcccttgctcccgcacctccgctggctcctgcatctcccgtgggacccgctcccgcacatacattgacgctcgcgcccgcaagctcatctgcatcattgctggccccagcttctgtgcagacgctgactctgtcgcctgcgccagtcccaactctggggcctgccgccgcccaaactctggccctggcacccgcaagtacccagtctcccgccagccaagcgagcagccttgtggtctccgcttcaggggctgccccactccccgttacaatggttagccggctgccggtaagcaaggacgaacctgatacccttacactgcggagtggaccaccctctccaccgagcacagccactagctttggaggccctagacctaggagacagcctccacctccaccacgcagccccttttacttggattctttggaggagaagaggaagcgccagcgttccgagcgcctcgaacgaatcttccagctgagcgaggcccatggagccctggcgcccgtgtacggcacagaagtcctagacttctgtacattgccacagccagtggcttcccccattgggcctcgctcaccagggcctagtcacccaactttctggacgtataccgaagctgcacatagggctgtgctgttcccccagcagaggctggaccaactgagcgagatcatcgagcggtttattttcgtgatgccgcctgtggaggctccccctccctccctgcatgcctgccacccgccaccatggctggcaccccgacaagctgcatttcaggaacaactggctagcgaactgtggccccgtgccaggccccttcaccgaattgtgtgtaacatgcgaacccagtttccagacctgagacttatccagtatgactgcggtaaactgcagaccctcgctgtgttgcttagacagctcaaggcggagggacatagagtcttaatctttacccagatgacccgaatgctagatgtgttggagcaatttctcacttatcatggccatctctatctaagactggatggttcaacccgcgtcgagcaaagacaggctctgatggagcggtttaatgccgacaaaagaattttctgctttatcttgtccacccgctctgggggagttggtgtgaacctgactggcgctgacactgtggtgttctacgactcagattggaaccccactatggatgcgcaagcgcaggacagatgccaccggatcggtcagacacgcgacgttcacatctacagattaatttcagaacgtacggtggaagaaaatattttaaaaaaagccaaccagaagcgtatgctgggcgacatggctatcgagggtggcaactttaccactgcttattttaagcagcagaccatacgcgagctcttcgacatgccattagaggagccgagctcttcatctgtgcctagcgcacctgaggaggaagaggaaacagttgcctcaaagcagactcacatactcgaacaggcactatgtcgtgctgaggatgaggaggatattagggccgcaacccaggcaaaggccgagcaggtagccgagcttgccgagttcaatgagaatgatggcttcccagccggggaaggggaagaggctgggagaccaggcgctgaggacgaagagatgagcagggctgagcaggagattgccgctctggtcgagcaactgacacctattgaaagatatgcaatgaaatttctagaggccagcttggaggaggtgtccagagaggagctgaaacaggcggaggagcaggtagaggccgccaggaaggatttggaccaggctaaggaagaggtgttccgcctgccccaggaggaggaggaaggcccaggcgctggtgacgaatctagttgcggaacagggggaggcactcatagaagaagtaagaaggccaaagcccctgagcgtccgggcaccagggtgagcgagcgcctgaggggagcccgggccgaaacccaaggcgctaaccatactccggtcattagcgcccaccaaacccgcagtaccaccactcctccgaggtgtagccccgctagagagcgcgtgccaaggcccgcgccgcggcccaggccaacgcctgcgtcggccccggcagcgatacctgcgctcgtgcctgtgccagtgtcagctcctgtccctatcagcgcaccaaatcctattactatcctgccagtccacatattgcccagccctccacccccgtctcagattccaccttgctcaagccctgcctgcacccctccccccgcgtgcactccgcccccggcccacactccacctcccgcacagacctgtctcgttacaccctcaagtcctctcttgctcggcccacccagtgtaccaatcagtgctagtgtgaccaatctgccgctgggactgcgccccgaggctgaattgtgtgcccaggccctcgcatctcccgaatcgctggagctggccagcgtcgcttcctcagagacaagctcattgtccctcgtgcccccaaaggacctgctacccgtcgccgttgagatcctgcctgtgtccgaaaaaaatttgtcactgactccatcagccccgagcctgactctggaggctggcagtattcccaatggtcaagagcaagaggccccagactctgccgaaggaaccacactcacagtgctgccagagggggaagagctgcccctgtgcgtgagcgagtcaaacgggctagaactgcctccctcggcagcgtcagatgaaccgctccaggagccattagaagccgatagaaccagtgaggagttgacagaggccaaaactcccacctcttccccggagaaacctcaggagctggtgacagcagaggtcgccgcaccatccacatcaagtagtgcgactagctcccctgaaggtcctagcccagcaagaccaccaagacgccggacctccgcagatgtggagataagaggccaggggactgggcgccctggccaaccccccggtccaaaagtgctgagaaaactgccgggaaggttagtgacagttgtggaggagaaagagctggttcggcggagaaggcagcagcgcggagccgcaagtacacttgtgcccggtgtgtcagagacaagcgcttccccaggttctccgagtgtacgatcgatgagtggtccagagtcatctcctccaattggaggaccttgcgaggccgccccaagttctagtctcccaactcccccccagcagccttttatcgcgcgacggcacatagaactgggagtaactggcggagggagccccgaaaatggcgacggtgctttgctggcaattacacccccagcagtcaaacggagacgaggccggcctcctaagaagaaccggtctccagcagacgccggccgaggtgttgatgaagcccccagcagtacgcttaaggggaagacaaatggcgcagacccagtcccagggcccgagacactaattgtcgcggatcccgtcctggagcctcagcttatcccggggccacagcccttaggcccacagcctgttcatcggcccaacccgttactgtccccggtcgagaaaaggcgtcgcggtagaccacctaaggcccgcgaccttcctattcccggtactatttcttcagccggagatggcaacagcgagtcccgcactcaacccccaccccacccatctcctttaactccgcttccgccactgcttgtttgtccaaccgcgacagtcgccaacacggtcacgactgtgaccatttcgacaagtccgccaaagaggaagaggggtagacccccgaagaacccaccctcaccacgtcccagtcaactaccggtcttagacagagattccacctccgtactggagagttgcggtctcggccgcaggcggcagcctcagggtcaaggtgagtccgaggggagcagtagcgacgaagacggtagtagaccattgactagactggcccgactgaggttggaagccgaggggatgcgtggtagaaaaagcggcgggagtatggttgtcgccgtgatccaagacgatctggatttagctgatagcgggccagggggactggaactgaccccaccagtggtgtccctcacaccaaagttgcggtctacaagattgcggccaggctctctcgtgcctccactcgagacagagaaactgccgcggaagcgggccggggcaccagtgggagggtcgccaggtttggccaagcgaggaaggctgcaaccccccagtccactgggccccgagggcagcgtagaagagagcgaagcggaggccagtggtgaggaggaggaaggcgacggcactcctaggagaaggcctggcccgcgtaggcttgtgggcacaacgaatcagggcgaccagaggattttgaggagcagtgccccacctagccttgcagggccagcagtgtcgcacaggggtagaaaagctaagacctag

SEQ ID NO: 205449 - DNA, 9219 bp, Artificial Sequence
  Description of Artificial Sequence: Synthetic coding sequence
atgcagagcagccccagccccgcccacccccagctgcccgtgctgcagactcagatggttagcgacgggatgactggatccaacccagtaagccctgccagctcaagttcaccagcatcttctggtgccggtgggatctcacctcaacacatagcccaggactctagcttggatggaccacctggcccgccagatggagcgactgttcctctggaaggtttttcactctcccaggccgcagacctggccaataaaggacctaaatgggagaagtctcacgctgaaatcgccgagcaggccaaacatgaggccgagatcgagaccaggattgctgaactgcgcaaggaggggttctggtcgctgaaaaggctccccaaggtgccggagcctccaagaccaaaggggcattgggactacctctgcgaagaaatgcagtggctgtccgcggacttcgctcaggaaaggcgctggaaacgcggagttgcaaggaaggtggtaagaatggtgatccgccatcacgaggagcaacggcaaaaggaggagagagcacgtcgcgaagaacaggcaaagctgcgccgaatcgcatcaaccatggcgaaagacgtccgccagttctggagcaatgtcgaaaaggttgtccagttcaaacaacagagtaggctggaggaaaagaggaagaaagctctggacttacatctggacttcatcgtagggcagaccgaaaagtacagcgacctgttgtcacagagcctgaaccaacccttgacatcaagcaaggccgggagctcgccatgcctcggctctagtagcgctgcttcatcacctcctccaccggcctcccggttggacgacgaagacggagacttccagccgcaggaagacgaagaagaggacgacgaggaaactattgaagttgaagagcaacaggaagggaatgatgctgaggcccagaggcgggagatagaacttcttagaagagagggcgagctcccactcgaggagctgctccgctcactcccaccccagctgctggagggaccgtcttcgccctcacagactccctccagtcacgacagcgacacccgagacgggccagaggagggtgcggaagaggaacccccgcaggtcctggaaatcaagccgcctcctagcgccgtgacgcagcgaaataaacagccttggcatcccgatgaagatgatgaggaattcactgctaacgaggaggaagcagaggatgaagaggatactatcgccgccgaggaacagctcgagggtgaagtggatcacgcaatggagttgagtgagctagctagagaaggcgaactgtccatggaggaactcctgcagcagtacgcgggggcctatgctcctggttccgggtcctcagaggacgaggatgaggacgaagttgacgcaaatagcagcgactgtgagcctgagggccctgtcgaggcagaggaaccgccacaggaagactcttccagtcagagcgattctgttgaagatcggagcgaggatgaggaggatgagcattctgaagaggaagaaacgtccggctccagtgcctcagaggaaagcgagtctgaggaaagtgaggatgcccaaagccaaagccaagcggatgaggaggaggaagacgatgacttcggtgtagagtatcttctagcgagagatgaggagcagagcgaggccgatgccggcagtgggcctcccactccaggcccaactactctcggtcctaagaaggaaataacggatatcgccgctgctgcagagtctctgcagccaaagggctacactcttgccactacacaggtgaagactcccatccccctgctactgcgtggtcagctgagagagtaccaacacattggtctcgattggctcgtgactatgtacgaaaagaaacttaacggaatcttggccgacgagatgggcttaggaaagacgattcagactatttctctgttagcacatttagcttgcgaaaaaggcaactgggggccccacttaattattgtgccaacatctgttatgctcaattgggagatggaactgaaacgatggtgccctagctttaagatccttacatactatggagcacaaaaagaaagaaagctcaaacgacaggggtggaccaaaccaaatgccttccacgtttgtatcacctcctataaattggtgttacaggatcaccaagccttccgcaggaagaactggcggtatctgatcctggacgaagcccagaatatcaaaaacttcaaatcacaaagatggcaatctctactgaattttaatagtcagcgacggctgctactcactggtacacctctccaaaactctttgatggagctgtggtcactcatgcactttctgatgccccatgtctttcaaagtcaccgtgagtttaaggaatggttcagtaacccattgacaggcatgattgaagggtcccaggaatacaacgaaggcctcgtgaaaagactacataaagtgctgagacccttcctactgagaagggtcaaggtggacgtcgagaagcaaatgcctaaaaaatacgagcacgtaattcgctgtaggctgagcaagaggcagagatgcctttacgacgactttatggcacagaccactacaaaggagaccctagccacgggacactttatgtctgtgataaacatcctcatgcagctgaggaaggtgtgtaaccatccgaacctgttcgatcccagacctgtgactagcccatttatcacccctggaatctgtttttctacagcaagtctcgttctgagagcgacagacgttcacccactacagaggattgatatgggcagattcgatttgatcggcctggaggggcgtgtgtcacgatacgaagccgataccttcctgccacgacaccgtctttccaggagggttctgctggaggtggcgacagcacctgaccccccgccccgtccaaagccagtgaaaatgaaagtcaacaggatgctgcagcctgtacccaaacaggagggacgtacagtagtggtggtcaataaccctcgtgctccccttggccctgtcccagtgcgccccccaccgggccccgaactgagcgcccagccaacaccaggacccgtgccccaagtcctcccagcttctctcatggtctctgcaagcccagctgggccccctctcatacccgcaagtagaccccccggcccggtgctgctaccccctctgcagcccaacagtggaagcctgcctcaggcaggcgaggttgtcagcatcggacaactggcttcactagcgcaacggcccgtagctaatgctggcggcagcaaacctctgacatttcaaatccaggggaacaagttgacactcaccggtgcacaagttcggcaactggccgtgggccagccaagacctctgcagatgccaccaactatggtgaacaatactggtgtcgtgaaaatcgttgtccggcaagcccctcgggatgggctgactcccgtgccccccctggcacctgcccctagacctccaagctcaggactgcccgcagtgcttaaccctaggcctaccctcacacccggacgactgcccacccctaccctgggcaccgctcgagcccctatgcctacacctactctggttaggcccctcctcaaactggttcattctcctagccccgaagtaagcgccagtgctcctggtgccgctccgctcaccatctcctctccccttcacgtacctagctctctcccaggaccagcctcttcacctatgcccatcccaaattcctcccccctggcatccccggtgtcttctaccgtctctgtcccgttatctagcagtctgcccattagcgtgcccacaacgctgcccgctccagcgtctgccccattaacaatcccaatctcggctcccttgactgtgtccgcctccggaccagcacttctgaccagcgttacaccaccactggctcctgtggtcccggctgcccccggaccaccgtccctggcccctagcggcgccagtccaagtgcgtctgccctgactctagggctggccacagcacccagcctgagctcgagccagactcccggacatccgctgttgttggcccccacctcaagccatgttccaggactgaactccaccgtcgcccctgcctgctctcccgtcctagtgcccgcatcagccctggctagcccctttccctccgcacccaaccccgctcctgcccaggcatccctgctcgcgcccgcaagcagcgcaagtcaggctctagcaacccctctggccccgatggccgctccccaaacagccatcctggcccctagccccgccccacctctggcgccgttacctgttctggcaccctctccaggcgctgcccccgttctggccagttcccagaccccagttcctgttatggcacccagctctacccccggaactagcctcgcatctgccagcccagtgcctgcccctacacccgtgttggcccctagcagtactcagaccatgctgcctgcacctgtgccatctccccttccctctccagcaagcactcagacccttgccctggccccagcactggctcccactcttggaggctcctccccctcccagaccctttcgcttggaacaggcaatccccagggtccgtttcccactcaaacgctgtcattgacccccgcttcttcgctcgtgcccacacctgctcagactctgagtttggcgcccgggccacctctcggtcccacacagacattatccctggcgccagcaccgcccttggcccccgccagcccagtgggccccgccccagcccacacactgacactggccccagcttccagtagtgcttctctgctggctccagcctctgtccaaactctcacattgtccccagcccctgtgcccaccctggggcccgcagccgcccagactctcgccctcgcccctgcaagcacccaatctcctgcctcccaggctagctccctcgttgtgagcgcttctggggccgctcccttgcccgtcaccatggtgtcaaggctgcctgtgtctaaagatgagccagatacccttacactgcggtcaggtcccccgagtcctccgtcaacagcaactagtttcggtggaccccggccaagaaggcagcctccacctcctccaaggagtcccttctacctggatagcctggaggagaaacgcaaacggcagaggtccgaaagactggaacgaatctttcaactgtctgaggcccacggcgccctcgcacccgtttatggtaccgaagtgctcgacttttgcactcttccccagcctgtcgccagccctatcggtccccgaagccctggaccttcccatcctactttttggacctacaccgaggcagctcatcgcgccgttttattcccccaacaaaggttggatcaactttcagaaataatcgagcgatttatttttgtgatgcctccggttgaggcgccgcctccctcacttcacgcttgtcaccctcccccttggctagccccccgccaagccgcgttccaggagcaactggccagtgagctgtggcctcgggcccgcccactgcacagaatcgtatgcaatatgagaacacagtttcccgatctgcggctgatacagtatgattgtggcaaattgcagactctcgcagttttgctgcggcagctaaaggctgaagggcaccgcgtcctgatctttacacagatgaccagaatgttggatgtgctagagcagtttctgacataccacggacatctgtatctgaggttggatggatcaactcgggtcgagcagcgccaggccctgatggagcggtttaacgcagataagcggatattttgttttattctttccacacgaagcggcggcgtgggagtgaacctgaccggcgccgacactgtggtcttttacgactcagattggaaccccaccatggatgcacaggcacaggacaggtgccacaggattgggcagacccgggatgtccatatctacagactaatttcggaaagaactgtcgaagagaacattcttaagaaagccaatcagaaacggatgctgggcgatatggccattgagggcggcaactttaccacagcttactttaagcagcagactattcgtgaattattcgatatgccactagaggaacctagctcctcaagcgtgccttccgctccggaggaggaagaagaaaccgtcgcctcaaaacagactcacattctcgagcaagcactgtgtcgagcagaagatgaagaggacatccgggctgctacacaggcgaaagcagaacaagtggctgaacttgcagagtttaacgaaaatgacgggtttcctgctggtgaaggggaagaggcaggtaggcctggcgcagaagatgaggaaatgtctcgagccgagcaggagatagccgccctcgtcgagcagcttacccccattgaaaggtacgctatgaagtttttggaggcatccctagaagaggtcagcagagaggagctaaagcaggctgaagaacaggtcgaagccgcacggaaggacctggatcaggcaaaagaagaggtttttaggctccctcaggaggaggaagaggggccaggcgcgggcgacgagtccagttgtgggacgggcggcgggactcatcgacgatctaaaaaagctaaggctccagagaggcccggtaccagagtgtcggagaggctgcgcggggcaagagccgagacccagggggcaaatcatacccctgtgatcagcgcccaccagacaaggtctacaaccaccccacccaggtgctctcccgcgcgtgagcgtgtcccacgtcccgcaccacgcccgaggcccactccagcgtctgctcccgcagctatacctgcactggtccctgtacctgtgagcgctcccgtcccgatcagtgcccccaatccgattacgatcctgcctgttcacattcttcctagcccccctccaccttcacagattcctccatgcagcagccccgcatgtacccccccaccagcctgtacgcccccacctgctcatacccccccccccgcccaaacatgcttagtcaccccttccagtccgttgttgctcggccccccaagtgtcccgataagtgcttccgtgacaaatctcccactgggattacgccccgaagcagagctttgcgcccaggccttagcctcacctgaaagcttggagctcgcgagtgttgccagctcagaaaccagcagtctttccctcgtgcctcccaaagatctcctaccggtagcggtggagattttacccgtctcagaaaagaaccttagcctgacaccatccgcgccttctctcactctggaagccgggtcaatcccgaacggtcaggaacaagaggcaccggatagtgccgaagggacaactttgacagtattacctgagggtgaggaactgccactgtgtgtgtctgaatctaatggcctggaactcccccccagcgctgcatctgacgagcctctgcaggaacctcttgaggccgacagaacgagtgaggagctgaccgaggctaaaacgccaacctcgagccctgaaaagccccaggagcttgtgacagcagaggtagcagccccaagtactagctccagtgccacttcctcgcccgaagggccatcacccgcccggcctcctcggcggcgaacttctgccgatgttgagatccgtggacagggaacgggacgccccggtcagccacctggacctaaggttctcaggaaattgccaggcaggctcgtaaccgtggttgaagaaaaagaactcgtgagacgcagacgccagcagcgcggggccgcctctaccctcgtccccggcgtctcagaaacctccgccagtcctggatccccctccgtgaggagcatgtctggacccgaaagctcaccacccatcggaggtccctgtgaggctgcaccgagttcttccttacccactccgccccagcagccttttatcgcacgtcgccatatcgaactgggggtaacagggggtgggtcacccgagaatggcgacggggccttgctggcaattacgccaccagcggttaaaaggcgcagagggaggccacctaaaaaaaatcgcagtcccgctgatgccggcaggggcgttgatgaggcaccatcaagcacacttaaagggaaaactaatggggcggaccccgtgcctggaccagagaccctgattgtagctgacccagtcctcgaaccacagctgatccccggcccccagcctctcggcccccagcccgttcacagaccgaaccccctactatcgcccgtggaaaaaaggcgccgcggccgcccccctaaggctcgcgacctgccaatcccaggtactatatctagcgctggcgacgggaacagtgagtcccgtacccagcccccgccgcacccatccccgctgacaccactgccgcccttgctcgtgtgcccgaccgctacagtcgccaacacagtgactacagttaccatttctacttcaccaccgaaacgcaaacgaggaaggcctcctaagaacccacccagtcctagaccttctcagttacctgttctcgaccgagacagcacatctgttttagagtcatgtgggctggggcggagaagacagcctcagggccagggggagtctgaagggagtagctctgatgaggatggctcccggcctctgacaagactggcacggctgagactggaggcggaaggcatgaggggtagaaagtctggcggctccatggttgtggcagtcatccaggacgacttggaccttgcagattcgggtccaggagggttggagctgaccccgcctgtggtctctcttacaccaaagcttcgctctaccagactcaggccagggtccctggtaccccccctggaaactgagaaactcccaagaaagcgtgcaggcgcacctgtgggcggatcccccgggctagctaagagaggccggttgcaacccccctccccgttgggtccagagggctccgtagaagaaagcgaagctgaagcatccggggaggaggaggagggcgatggcacccctagacgaaggcctggaccccgccggctggtgggaaccaccaatcaaggcgatcagcggatcctgcggtccagtgcacccccctctttagctggccccgcagtgtcacataggggtagaaaggctaaaacttag

SEQ ID NO: 205450 - DNA, 9507 bp, Artificial Sequence
  Description of Artificial Sequence: Synthetic coding sequence
atgcagagcagccccagccccgcccacccccagctgcccgtgctgcagacacaaatggtaagtgacgggatgaccgggtcaaaccccgtatcgcccgcatcaagctcaagtcccgcctcttctggcgctggtggaatatctccccagcatatcgctcaggacagcagtctagacggaccccctgggcctcccgacggagccacagttccactggaaggcttctcactgagccaggccgccgatctggccaataaaggtcccaagtgggagaagtctcacgcagagatcgcggagcaggcaaaacatgaagcagagatagaaacccggatcgccgagttgaggaaagaaggattctggagtttaaagcggctcccaaaggttcctgagccgccccgccccaaagggcattgggactacctgtgcgaagagatgcaatggcttagcgccgacttcgcccaggaacggaggtggaagcggggagtggccagaaaagtggtccgaatggtgattcgccaccacgaggaacagagacagaaggaggaacgggctcgtagggaggaacaagcaaagttgaggcggattgcgtctactatggcaaaagacgtgaggcaattctggtccaacgtggagaaagtggtccagttcaagcaacagtctagactggaagagaagcgtaaaaaagcattggatctgcaccttgacttcatcgtaggtcagacagaaaaatattcagacctcctgtcccagtcattgaatcaacctctgacaagttcaaaggcaggctccagtccgtgccttggaagctcatcagccgcgagctccccccctcctcctgcttccagattagacgatgaagacggggactttcagccccaggaggacgaggaggaggacgatgaggagaccattgaagttgaggaacagcaggagggtaatgacgccgaggctcagcgacgtgagattgagctcctaagacgggagggtgagttgcccttggaggaattactacggtctctgccacctcagcttctcgagggccctagtagtccttctcagactccctctagccacgattccgacactcgcgacggcccggaagagggcgcagaggaggagcctccacaggttctggagatcaagcccccaccgagcgcagtcacccagagaaacaagcagccatggcatcccgacgaagacgatgaagagttcaccgccaatgaagaggaagcggaagatgaagaggatacgatagcggccgaagagcagttggaaggggaggtggaccacgcgatggagctgtctgagctcgcccgtgaaggtgaactgagtatggaagaactactacagcaatatgctggagcctatgcccccggaagcggctcctccgaggacgaggacgaagatgaggttgatgccaattcatcggactgcgagcctgagggacctgtcgaggccgaagagcccccgcaggaagattccagcagtcagtctgacagcgtggaagacaggagcgaagacgaagaagacgagcatagcgaagaagaagagacaagcggcagtagtgcatccgaagagagtgagtctgaagagtctgaagatgcccaaagccagtcccaagctgatgaggaagaggaagacgatgatttcggggtggagtacctgctggcacgcgatgaggagcaatctgaggcggatgccggctccggaccccccacccccggaccaaccaccttgggccctaaaaaggagatcaccgacatcgctgctgcagccgagagcctccagccgaaggggtatacgcttgccactacccaggtaaaaaccccgattccactgcttctgcgaggacagctgcgggaataccaacacatcgggctggactggctcgtgactatgtacgaaaagaaactgaatggcatccttgctgacgaaatgggactgggtaagacaattcagaccatcagcctgcttgcacatcttgcctgcgagaaaggcaattggggccctcatctcatcattgtgccaacctcggtgatgctcaactgggagatggaattgaagaggtggtgtccatcctttaaaatcctgacatactacggcgcccagaaggaacggaagctcaaaaggcagggctggaccaaaccaaacgctttccatgtatgcattacatcatacaagctcgttctgcaggatcatcaggcctttcggcgaaagaattggagatacctcatactggatgaagcccagaacattaagaatttcaagtcacagcgatggcagagtctgcttaatttcaattctcagcgcaggcttttgctgacagggacacctctgcagaactccctaatggagttgtggtctctaatgcattttctgatgccacatgtgttccagtcccatcgtgagttcaaagagtggttttccaaccctctgacaggtatgatcgaaggatcccaggagtataacgagggtttagtgaagcgactccacaaggttctgaggccgttccttcttaggagagtgaaggtagatgtggaaaagcagatgcccaagaagtatgaacatgtgattaggtgtagacttagtaaaagacagcgctgtttgtacgacgacttcatggcacagaccactacgaaggagaccctggcaacagggcactttatgagcgtcattaacatcctgatgcaacttcgcaaagtgtgcaatcatccaaacctgtttgacccacgtcccgtcacgtcccctttcattactccagggatttgcttcagcacagcttccctcgtcctgcgtgctacagatgtccatccccttcagagaatcgacatgggtcgatttgacttgattggtctggaaggcagagtgagccggtacgaggcagacaccttcctgccccgtcacagactcagccggagggtgctgctggaagtggccacagccccggatcctccaccaagaccgaagcccgtgaagatgaaggtcaatcgtatgctgcagcccgtcccgaaacaggagggtcgtacagttgttgtcgtcaataacccacgcgctcctctcggacctgtcccagttcgccccccccccggtcccgagttgtcagcccagcccacgcccgggcctgtgccccaagtactccctgcttcccttatggtatcagcctctcctgccggtccacccctgatacctgcctcaaggccacctggcccagtgttactccctcccctgcagcctaactccggtagtttgccccaggtgttgccaagtcctctgggagtgctgtccggtacctcgagaccgcccaccccaactctctccctcaagccaaccccaccagccccggtgcggctaagcccagctccccctcccggctcttcaagccttctaaagcctctgaccgtgcctcccggctacaccttccctcccgctgccgcaacaacaacctccacgactactgctactgccactacaactgcagtgcctgccccgactcctgccccacagagattgattctgtcaccagacatgcaggccagactgcctagcggcgaagtagtatcaattgggcagctcgccagcttggcacaacggcccgtcgctaacgccggcgggtccaagcctttgacttttcagattcagggcaacaagctgacactgactggcgcccaggtacggcagttggccgtgggccagcctaggccgttgcagatgccacctactatggtgaacaatacaggcgtcgtcaaaattgtcgtgcggcaggcgccgagagacggcttgacgccggtgcctcctctggcacccgccccacgaccaccctcctccggcctaccagccgttcttaacccccgcccaacactgaccccgggaagactccctactcctacactgggaacagcacgggctccaatgccgaccccaacccttgtgcgaccgctactgaagctggtgcactctccatccccagaggtcagcgcttcagcccctggagctgctcccctgaccatcagtagccccctgcacgttccttcctcgctgccggggccagcaagttcccctatgcctattccaaatagcagccctcttgcctctcctgtgtcaagcactgtaagcgtgcccttgtctagttcacttcctatatcggtccctaccactctgcccgcccctgcttccgcccccttaacaattccaattagcgccccacttacagtctcagcctccggcccagccctcctcacctcagtgacacctcctttagctcccgtcgtgccagcagcccctgggcccccctcacttgccccttcgggagcgtcaccctctgcgagcgcactgactctggggctggccactgcaccttccctgtcctcaagccaaacacctgggcaccctttgcttttagcccctacttcctcccacgtgcctggcctcaatagtaccgtcgcccctgcctgctcccccgtcctagtcccagcaagtgcccttgctagcccctttccaagcgctccaaatcccgcccccgcccaggcgagccttctggctcctgcctcaagtgcatcacaggctctggcaactcctcttgcgccaatggccgcaccgcagacagcaattcttgctccatccccggcaccacctctcgctcccctgccagtcctcgccccttccccaggagcagcaccagtgctcgcatctagccagacacccgtaccagttatggcgcccagctcgactcccggtacctccctggcaagtgcctcccccgtccctgccccaaccccagtgctggctcccagttccacccagaccatgctgcctgcaccggtgccctcccctctgccaagccccgctagcacacagactcttgccctcgcccctgctctggcaccaactctgggcggttcttcgcccagccaaacgctgtccctaggcacgggtaaccctcaagggcctttcccaacacaaactctaagtctcactccagcgagctcacttgtcccaactcctgcccagactctgtcactggcccccggcccccccttgggccccactcagacccttagcctggcccccgctcccccactagcacccgcttccccggttggtcccgccccagcgcatacgttaaccctggcaccagcctcctcatccgccagccttctggccccggccagtgtgcagaccctgaccctgagccctgcccccgtgccaactttaggccccgctgctgctcagaccctggccttggcccccgcctctacccagagcccagctagtcaggcctctagcctggtggtgtcagcttcaggtgccgccccgctacccgtgacgatggtgagccgccttccagtgagcaaagacgagcccgataccctgacactcagaagcgggcctcccagcccgccctccactgctacaagtttcggcggaccccggccccgccgacagcccccgcctccgccccgttctcctttctatttggacagccttgaagagaaacggaagcgacagagatcggaacgtttagagagaatttttcaactgagtgaggctcatggtgctcttgctccggtctatggaaccgaggttttggatttctgtacacttccgcagcccgtggcctcccctatcggccctcgctcgcccggacctagtcatccgacgttctggacttacacagaagccgcccaccgcgccgtactgttcccgcagcagaggttggaccaattgtcagagatcattgaaagattcatcttcgttatgcccccggtcgaagccccaccccccagcctgcacgcatgccatcccccaccttggctcgctccacgtcaagctgctttccaggagcagcttgctagcgaattgtggcctagagccaggcccctgcatcgaatcgtgtgtaatatgagaacacagttccccgacctgagactgatccagtacgattgcggaaagctccagactcttgccgtgctcttgcggcagttaaaggcagagggccatcgggtgttgatctttactcagatgacacggatgttagacgtactggagcagttccttacatatcatggccatctctatctcaggctcgacggcagcactcgtgtagagcagcgccaagccctgatggaacggttcaacgccgataagcgaatcttctgcttcattctttccaccagatctggaggagtcggagtgaacctgactggcgctgacaccgtcgtgttctacgattcagattggaatcctaccatggacgcccaggctcaagatagatgccaccggatcggccagacgagagatgtccatatttaccggctcattagtgagcgtacagtggaggaaaatatcctgaaaaaggctaaccaaaaacgaatgctcggagacatggcgattgagggaggcaactttactacggcctactttaaacagcaaaccatcagggagctattcgatatgcccctggaagagcccagctcctcatccgttcccagcgcacccgaagaagaagaagagaccgtggcttcaaagcagacccacatcctggaacaggccttatgcagggctgaagacgaagaagatatacgcgccgcaacccaggcgaaagctgaacaggtcgcggagctcgcggaattcaacgagaacgatggatttccagccggtgagggcgaagaggctggccggcctggcgccgaagatgaggaaatgtctagggctgagcaggaaatcgccgctttagtggaacagctcacccctattgagaggtacgccatgaagttcttggaggcaagcctggaggaagtgtctagggaggagctgaagcaggctgaggagcaggtggaggcagcacgcaaagatctggatcaagcgaaggaagaagtattccggctgcctcaggaagaagaagagggaccaggagcaggcgatgagtcatcttgcgggaccggtggtggaactcacaggcgaagcaagaaggccaaggcacccgagcgtccagggacccgcgtcagcgaacgacttcgaggagcaagggccgagactcagggtgcgaatcacaccccagtgatcagcgcacaccagacccgctctaccacaacaccacccagatgcagccctgcgcgtgaacgggtccccagacccgcccctaggcctcgacccacccccgcgagtgctccagccgccatccccgcactggtgcctgtgcctgtctctgcccctgtgccgatctctgctcctaaccccatcaccatactgcctgtccatattcttccttctcctccccctccctcccagatccccccctgctcctccccagcctgtacacctcctccggcatgcacaccaccgcctgcccatacaccacctcccgcacagacatgtcttgtcacaccatcatcacctctcctcctcggccccccctccgtgcctatctcagcttcagtgaccaacctaccccttggcctgcgacctgaggctgaactgtgtgctcaggcgctggcgtccccggaatcattggagctggcctcagtggcgagttcagagacatcctcactctctctggtgccgccaaaagatctgctcccagtcgcggtggagatcctccccgtctctgagaaaaatctgagtcttacaccttcagccccttccctgacgttggaggcaggctcaattccaaatggacaggaacaggaagccccggacagcgcagagggcaccacactcacagttctgccggaaggcgaagaacttccactgtgcgtgtccgagtccaatggcttagagctgcccccctctgcagcctccgatgagcccctccaagagccactcgaagcagatagaacaagtgaggaacttacagaagctaaaaccccaacctccagtcctgagaagccccaagaactggttaccgcggaagtggcagctccatcaacttcttcttctgccactagcagtcctgagggcccatccccagcacgcccaccacgacggcgaacaagcgcagatgtggaaattcgcgggcagggcacagggcggcctggtcagccgcccggccccaaggtccttcgaaaactgcccggccgcctggtcacagtggtggaggagaaggagcttgtcagaagacggcggcagcagagaggagcagcctccaccttagtgcccggtgtgtccgagacttcagctagtccagggagcccttctgtgcggtccatgtccggtcctgagagcagccctcccatcggaggcccctgtgaggccgcaccaagctcatctcttccgactcccccacagcagccatttatcgctagaaggcatatcgaactcggagtgacgggaggaggtagtccagagaacggagatggggctctgctggcgatcacgccacccgccgttaaaaggagacgtggccgccctcccaagaaaaatcgcagccctgctgacgcggggaggggtgttgacgaagccccatctagtaccctcaaggggaaaacgaatggcgcagaccctgttcctggacccgaaacacttattgtggcagatcccgtgctcgaaccacagctgatcccaggtccacagccactggggcctcaaccagttcaccgtcctaacccactgctttctccggtggagaagcgcaggcgaggtcgccctcctaaagcccgcgacctacctatcccaggaaccataagttctgctggcgatggaaactccgaatccagaactcagcccccaccccacccttctccgttgactcctctgccaccgttactggtttgccctacagccacagtggccaacacggttacaacagttaccatctctacaagtccccccaagaggaaacgcgggagaccccccaagaaccccccatcaccacgaccatctcaattacctgtgctggacagggatagcacttccgttctggagagttgcggactggggagaaggagacagcctcagggacaaggtgagagtgagggttcatcttccgatgaggatggctcgcgaccactgactagactcgcccgactccgcctggaagccgagggtatgcgcggacgcaagtctggaggctcaatggtcgtggccgtaattcaggatgatctggacctggccgactctggccctggcggattggaactcactcctcctgtcgtgtccctgacccccaagctgagaagcacccggttgcggcccggttctctggtgcccccgctggagaccgagaaactgcctcgaaaacgtgcaggggctccggtgggggggagccccggattagccaaacgcggccgcttgcaaccaccctcacctctgggcccggagggatccgtggaggaatccgaagcagaggcctctggggaggaggaggagggcgacgggacgcctagacggcggcccggccctcgccgactggtcggaaccacgaatcagggtgaccagcgtatccttaggagctccgcacccccaagccttgctggacctgcagttagccatcgcggacgaaaggccaagacttag

SEQ ID NO: 205451 - DNA, 180 bp, Artificial Sequence
  Description of Artificial Sequence: Synthetic coding sequence
atgcagagcagccccagccccgcccacccccagctgcccgtgctgcagacccagatggtgagcgacggcatgactggcagtaaccctgtcagccctgcctcctctagctccccagcctcatcgggggctggtggcattagccctcaacacatcgctcaggattcctctttggatgggtag

SEQ ID NO: 205452 - DNA, 774 bp, Artificial Sequence
  Description of Artificial Sequence: Synthetic coding sequence
atgcaccggcggggcgtgggcgccggcgccatcgccaagaagaagctcgccgaggccaagtataaggagcgcggaaccgtcctggccgaagatcagttggctcagatgtcaaagcagctggacatgtttaaaacaaaccttgaagagttcgcttctaaacataagcaagagattagaaagaatccggaattcagagtgcagttccaagatatgtgcgctaccattggcgtggaccccctggctagcggtaagggcttctggtctgaaatgctgggcgttggtgatttctattacgaactcggcgttcagattattgaggtttgtctagcgctgaagcaccggaatgggggactaataactctggaggaattacaccagcaggtgttaaaagggcggggcaaattcgcacaagacgtctcccaggatgaccttatccgggccattaaaaaactcaaagcgcttggcacgggattcggtatcatacctgttgggggcacttatctgattcagtccgttcctgctgagctgaatatggatcatactgtggtgttgcagctcgccgagaacggctacgtcacagttagtgagatcaaagcgtcacttaagtgggagactgaacgagccagacaggtgcttgagcatctgctgaaagagggcctcgcctggctggatctacaggcccctggagaggcacattattggttgccagcattgtttacggacctctactcccaggaaatcacagcagaggaggcgcgtgaagccctgccttag

SEQ ID NO: 205453 - DNA, 777 bp, Artificial Sequence
  Description of Artificial Sequence: Synthetic coding sequence
atgcaccggcggggcgtgggcgccggcgccatcgccaagaagaagttagctgaggcaaagtataaggagagaggtaccgtgctggctgaggaccagctcgcacagatgtctaagcagcttgacatgttcaagactaacctggaagaattcgcttccaaacataagcaggagatccgcaagaatccagagttccgggtgcagtttcaggatatgtgtgccaccattggcgtcgacccccttgcaagcggtaagggattttggtccgaaatgcttggtgtgggagacttttactacgagttgggagttcagatcattgaggtgtgcctggccctcaaacacaggaatggagggctgatcacactggaggagctgcatcagcaggtcttgaaagggaggggcaagtttgctcaggatgtatcacaggacgacctaatccgggcaataaagaagctaaaagcgcttggtaccggctttggcatcatacccgtgggtggcacttatctgatccagagcgtgcctgcggagcttaacatggatcacaccgtggtgctccaactcgccgaaaagaatggctacgtcaccgtgtccgaaataaaggccagcctcaaatgggagacggagcgcgccaggcaagttctcgagcacctcttgaaggagggtctggcttggctggatcttcaagcccccggcgaagctcattattggctgcccgccctcttcactgacctgtacagccaggagatcaccgccgaggaggctcgagaagcactcccctag

SEQ ID NO: 205454 - DNA, 1611 bp, Artificial Sequence
  Description of Artificial Sequence: Synthetic coding sequence
atgagcagcagcctgggcaaggagaaggacagcaaggagaaggacccaaaggtgccatccgccaaagaacgcgaaaaggaggctaaagcttctggcggtttcggaaaagagtctaaggagaaagagccgaagactaaaggaaaggatgcgaaggacggaaagaaggatagctccgcagcacagcctggcgttgccttctcagtagacaacacaatcaagcgccccaacccagccccagggactcggaagaaatcatctaacgcagaggtaataaaagagttaaataagtgtcgcgaagagaatagcatgcggctggatctaagcaagagaagtatccatattctgcctagtagtatcaaagagctcacccagctgactgaactatacctatattccaacaaactgcagtccctgcctgccgaagtcggatgtctggttaacctgatgaccttggcactcagtgaaaactctctgacctctctcccagacagtctcgataacctgaaaaaattaagaatgcttgacctcagacataacaaattacgagaaatccccagtgtagtctaccgcctggacagcctgacaactttgtatctcagatttaaccgtatcaccacagtggagaaggacattaagaaccttagcaaactcagcatgctgtccatcagggagaacaaaatcaaacagctgcccgcagaaatcggaaaccttagctctcttagccgactgggcctgcggtataatcggctgagcgctatcccccgatcgctcgctaaatgcagcgcccttgaggagctcaatctggagaataacaacatttctacactgcccgagagcttactttcctctctggttaaactgaacagtctcaccctcgctcgcaactgctttcagctgtacccagtgggaggccccagccagttcagcaccatttactcgctcaacatggagcataatcgtatcaataaaattcccttcgggatctttagccgagccaaggtgctgagcaaacttaacatgaaggacaatcagctgactagcctacctctggacttcgggacatggacaagcatggtggaactcaatctggccactaatcagctgaccaagatcccggaggatgtgagtggtctggtcagcctggaggtgcttatcctcagcaataacctcttgaagaagctgccccatggcctgggcaatctcaggaaattgagggagctggacctggaagagaacaagcttgaatcactgccaaacgaaatagcttacctgaaagatcttcagaagcttgtgctaacaaacaatcaactaaccactttgccccgcgggattgggcaccttacaaatcttactcacttgggactgggtgagaacttactaacccatctgccagaggagattggaactctcgaaaaccttgaggaactgtacctgaatgacaaccccaacctccactcacttcccttcgaattagccctctgcagcaagctctccattatgtccatcgagaactgccccctcagccatctgcccccacagattgtggccggcggtccctcgtttattatacagtttctgaagatgcagggcccttatcgagcaatggtgtag

SEQ ID NO: 205455 - DNA, 1749 bp, Artificial Sequence
  Description of Artificial Sequence: Synthetic coding sequence
atgagcagcagcctgggcaaggagaaggacagcaaggagaaggaccccaaggtgccaagcgcgaaagagcgggagaaggaggctaaggcatcaggaggcttcgggaaagagagcaaggagaaagagccaaagactaagggcaaggacgcaaaagatgggaaaaaagattcaagtgctgctcagccgggagttgcattctcagtcgacaacaccataaaaaggcctaaccccgcgccaggtacgcgcaaaaaatcaagcaacgctgaagtgattaaagaactcaacaagtgcagagaagagaattcaatgcgactcgatctgtctaagaggtctatccacattctgccttcatctatcaaagaactgactcagctgactgagctgtacctttactccaataaactccagtccctcccggccgaggtgggttgcttggtgaatttaatgacattagccctgagcgaaaattcactgaccagcttgccagactcgttggacaatcttaagaaactgcgaatgctcgatctcaggcacaacaagttgcgggagattccatcagtggtgtacaggttggatagcctgaccaccttgtatttaagatttaaccgcatcacaacagtcgagaaggacatcaagaatctttcgaagctgagcatgctatccatcagggagaataaaatcaaacagttgcccgctgagatcggggagctgtgcaacctgattaccctagatgttgctcataaccagttagaacacttgcctaaagagatcggtaactgtacccagattacaaatctggacctgcagcataacgaattactcgacttacctgatacgatcggaaacctgagtagcttgtcgcgcttggggctgagatataaccgcctttccgctattccaaggtctctggcaaagtgtagtgccttagaggaattaaacctggagaataacaacatatcaacgcttccggagtctctgctgtcatcattggtcaaattgaacagtctcacactggccaggaattgctttcaactttatcctgtcggaggcccttcccagtttagtacaatctactcgctcaatatggagcacaataggattaataagattccattcggcatattcagtagggccaaggtcctgtccaaattaaatatgaaggacaaccagctgaccagtctgcccctagacttcggtacttggacctctatggtcgagctgaatctggccactaatcagttaactaagatacctgaagatgtaagtggtctggtctcccttgaagtgctaatcctgtcaaataatctgctaaagaagctgccgcacgggctgggcaacctgagaaaactgcgagaattggatttggaagaaaataaattggagagccttccaaacgaaattgcctacttaaaagacctgcagaagttggtgttgacaaacaaccagttgacaacattacctagaggaatcggccaccttactaaccttacccacctgggactcggggagaacctcttaactcatctccctgaagagatcggtactttggaaaatctggaagagctgtatctcaatgataaccctaatctgcatagcctgccgttcgaactggccctctgcagcaagttatccatcatgtccatcgagaattgtccgctcagtcacctcccccctcaaattgtggccggagggccttcattcattattcagtttctaaagatgcaaggaccataccgggcgatggtgtag

SEQ ID NO: 205456 - DNA, 1119 bp, Artificial Sequence
  Description of Artificial Sequence: Synthetic coding sequence
ctggacaacctgaagaagctgcggatgctggacctgcggcacaacaagctgagagagatcccgtctgtggtgtaccgactggattccctgacaaccctgtacctgcgcttcaatcggatcactacggtggagaaagacatcaaaaacttgagcaagctaagcatgctatctattagagagaataaaatcaaacaactgcccgccgagataggaaacctgtcttcattatcccgactcggactgcgatacaaccgcttaagtgctattcccaggtccctggcaaagtgttccgcactagaggagctaaatctcgagaataataacatctctacactgcccgagtctctgctgtcttcactggttaagctgaacagcctcactctggcccggaattgctttcagctgtatcccgtgggcggtccttcacaatttagtaccatctactcccttaatatggaacacaacagaataaataaaatccccttcggaatattcagcagagcaaaggtgttaagtaaattgaacatgaaagataatcagctgacatcattacctctcgatttcggaacctggacgtcgatggtggagctcaacctcgctaccaatcagttgacaaaaatcccagaagacgttagcggactggtctcacttgaagttcttatcctgagcaacaacctcctgaagaaactgcctcacggtctggggaatcttagaaaactccgggagctggatctcgaagagaataagctagagagtctccccaatgagatcgcatacctaaaagacttacaaaagctagtgctcaccaacaaccagctaactaccctacctaggggaattggccaccttacaaatctcactcatctgggccttggagagaatctgttgactcacctgcctgaggaaatcgggacactcgagaatctcgaagaactgtatctgaacgataacccgaacttacattccctgccctttgagctggctctctgcagcaagctctctattatgtccatcgaaaactgtcctctgagccacttgcctcctcagattgtcgcaggcggacctagctttataatccagtttcttaagatgcagggtccgtacagagcaatggtttag

SEQ ID NO: 205457 - DNA, 588 bp, Artificial Sequence
  Description of Artificial Sequence: Synthetic coding sequence
atgctgcgggacggccggttcgcctgcgccatctgcccccaccggccggtgctcgataccctcgccatgctgactgcacatcgagccggaaagaagcatctgtccagcctccagcttttttacggaaaaaagcagccaggcaaggagcgtaaacaaaatcctaaacaccagaacgaacttcgtagagaagagaccaaagcagaggcaccattattgacccaaacaaggcttattacacaaagcgccctacatagggcccctcattacaatagctgctgcaggcggaagtaccggcccgaagcacccggcccgagcgtgagcttgtcccccatgcccccatccgaggtaaagctccagtcaggaaagatttcaagggagcccgaaccagccgccgggccgcaagccgaggagagcgcaaccgtgtcagcccccgcaccaatgtccccaacgcgtcgcagagccctggaccactacctgaccctccgcagttccggttggatccctgatgggcgcgggaggtgggtgaaggacgaaaatgtggaatttgactctgatgaagaagaacctcctgatctcccccttgattag

SEQ ID NO: 205458 - DNA, 693 bp, Artificial Sequence
  Description of Artificial Sequence: Synthetic coding sequence
atgagcttcaagcgggagggcgacgactggagccagctgaacgtgctgaagaagcgaagggtgggagacctgctcgcatcctatatccccgaagatgaggccctgatgctgcgcgatggtcgttttgcttgtgcaatttgtccccacaggcccgtgttggatactcttgccatgctgacagcccatcgtgcaggtaagaaacacctctcaagcctgcaacttttttacggaaagaagcaacctggaaaggaacgaaagcagaatcctaagcaccagaacgagctgcgtcgcgaggaaacaaaggccgaggccccactccttacacagacccgtctcatcactcaatcagcccttcacagagcaccccattacaacagctgctgcaggcgaaagtacagacctgaggcgcccggtccctctgtcagcctgtcgccgatgcccccgagtgaagtgaaactacagtctggcaagatttctagggaacctgagcccgctgctggaccccaggccgaagagagtgccacagtgtccgcccccgctccgatgtcacccactaggagaagggcattagaccactatctgacattaagatctagcggctggattcctgatggacgtggccgatgggtgaaagacgagaacgtcgagttcgactccgacgaggaggagccaccagatctaccgctggactag

SEQ ID NO: 205459 - DNA, 1038 bp, Artificial Sequence
  Description of Artificial Sequence: Synthetic coding sequence
atgtacaaggactgcatcgagagcaccggcgactacttcctgctgtgcgatgctgaaggtccttggggaattatactcgagtctctggccatcctgggcattgtagtaacgattctgctgctgttggcattcctctttctgatgcggaagatacaggactgctcacaatggaacgtattgcccactcagctgctcttcttgttgagtgtgctgggcttatttggcctggcattcgctttcatcatcgagctgaaccagcagacggcccctgtgcggtattttctgttcggtgttctgtttgccctgtgctttagttgcttactagcccacgcctctaacctggtgaagctggtgcggggttgcgtgagtttctcttggactaccattctgtgcatcgctattggatgttcattactgcaaattataattgctactgaatatgtaacactaatcatgacacgggggatgatgttcgtgaatatgactccatgccagctcaacgtggattttgtggtgctgctcgtttacgttctcttcctgatggccctcacgttcttcgtcagcaaagccactttctgcggcccatgtgaaaattggaagcagcacggtcgcttaatctttatcaccgttctgttctccatcattatttgggtggtttggatcagcatgttgctgcgcggcaatccacaatttcagcgtcaaccccagtgggatgatccggtggtgtgtattgctctcgtgaccaacgcctgggtatttttactgctctacattgtgccagaattgtgcatcttataccgctcttgtcgccaagagtgtccactgcagggaaatgcctgtccagttaccgcctatcagcactccttccaggtggagaaccaggaactgagtcgagccagggacagcgatggtgctgaggaggatgtcgctctcacatcttacggaacaccgatccagccgcaaacagttgatcctacccaggaatgctttattcctcaggccaagctgagtcctcaacaggacgctggcggcgtgtag

SEQ ID NO: 205460 - DNA, 2076 bp, Artificial Sequence
  Description of Artificial Sequence: Synthetic coding sequence
atggagggcaacaagctggaggagcaggacagcagccccccccagtccactccgggcttaatgaaagggaacaaacgagaggagcagggcctaggaccagaacctgcagccccccaacagcccactgctgaggaagaggcattgatcgagttccaccggtcatacagagaactgttcgagtttttttgtaacaatacgaccattcacggagcaatcagactagtgtgctcccagcataaccgcatgaaaactgccttttgggcagttttgtggctgtgcactttcggaatgatgtactggcagtttgggctgctgtttggagaatattttagctaccctgtgagcctcaatattaatctcaatagcgacaaattggtgttccctgcagtgacaatttgcaccttaaacccctacaggtatccagaaatcaaagaagaactcgaagagctggaccgcatcactgaacagactctcttcgatctgtacaagtattcctctttcaccactctcgttgccggcagtagaagcagacgggatttgaggggcaccctccctcaccctctccagcggttacgggttccacctcctccccatggggcacgtcgagcaaggtcagtcgccagttcgctccgcgacaataacccccaagtagattggaaggactggaagataggctttcagttatgcaatcagaataaatctgactgtttctaccagacctacagctccggcgtggacgctgtgagggaatggtatcggtttcattatattaatatcctctcacggcttccagagaccctcccctcattggaggaagacacgctaggaaattttatcttcgcatgcaggttcaatcaggttagttgcaaccaggctaattacagccatttccaccatcccatgtacggcaattgctacaccttcaacgataagaacaatagtaatctgtggatgtcctctatgcctgggattaataacggcctatccctgatgctgagggcagagcaaaacgattttattccattgctcagcacggtgacaggggctcgggtaatggtgcatggccaggatgaacctgcttttatggatgatggcggcttcaacctaagaccgggagtggagacaagcatttctatgagaaaggagacactggaccgcctagggggggattatggcgactgcacaaagaatggctccgatgtgcctgtagagaatctatacccatcaaaatatacacagcaggtgtgcatccatagctgcttccaggaaagtatgatcaaggagtgtggatgcgcctatatcttttatccgaggcctcagaacgtagagtactgcgactacagaaagcactcatcctggggtcaggtccggagcctcaccccagtgattccagccctctgggaggccgaagcgggtaggtctcgaggatactgctattacaagctccaagtcgacttctctagcgatcacctcggatgctttaccaagtgtcgcaaaccttgcagtgtaaccagctaccagttgtctgcaggctactctcggtggcccagcgtgacctcccaggaatgggtgttccagatgctatctagacagaacaattataccgtaaacaacaaacggaatggcgtggcaaaggtcaatatcttttttaaagagctcaattacaaaaccaactcagagtccccatctgtcaccatggtgactctactgagcaacctagggtcacagtggtccttatggtttggttcttcagtgttatccgtagtggagatggcagaacttgtgttcgacttactggtcattatgttcctgatgttacttcgccgcttcaggagtaggtactggtcacccggaaggggagggcgtggcgcccaggaagtggcgagtaccctcgccagttcacccccttctcatttctgtccacaccccatgagcttgagtctgtcacaaccgggaccagccccatcgcctgccctgaccgcacctccacccgcttacgcgaccctggggccccggccctccccaggggggtctgctggggcctcaagctccacctgtccgttgggcggtccctag

SEQ ID NO: 205461 - DNA, 2058 bp, Artificial Sequence
  Description of Artificial Sequence: Synthetic coding sequence
atgctgctgcacatcaaccccgcctacctgttcaagctgctgcacggtttccctccatggatcatgccaactgacgggaatctgggggacaaaaatttccagatgggaaaacccggacatagagaaggcgcaaccatgcatgtgaagaagtatttgctgaagggtttgcatcggttgcagaagggccctggttatacctacaaagagctcttggtatggtactgcgataacacaaacacccacggcccaaagaggattatttgtgagggtccgaaaaagaaagccatgtggttcctgctcacactgctgtttgctgcattggtctgctggcagtggggaattttcattcggacctacctaagttgggaggtctcggtaagcctgtcggtgggatttaaaacaatggatttcccagccgtgacaatttgtaatgctagtccctttaagtacagcaaaatcaaacacctcctgaaagacctggatgagctgatggaagccgtcctagagcgcatcctggccccagagctgagtcacgccaatgccacaaggaatctgaacttctccatctggaatcacaccccgttggtcctcattgacgagcgcaatcctcatcaccctatggtgttagacctgtttggagataaccacaatggcctgacctcaagtagtgcctctgagaagatctgtaacgcacacggctgtaagatggcaatgcgactgtgttctctcaaccggacacaatgcactttcaggaattttacttctgccacgcaggccctgactgaatggtacattctacaggcaactaacatcttcgctcaggtgcctcagcaggagcttgtagaaatgtcataccccggggaacagatgatattggcgtgcttgtttggagcagagccctgtaattaccgaaatttcacatctattttctatccgcattatggaaactgctatatctttaactgggggatgaccgaaaaagctctgccaagtgcgaatcccggaacggaattcggtctgaagctcatcctggatattggacaggaggactatgttccgtttctggcctccaccgccggagtgagactaatgctgcatgagcaacgctcttatccatttatcagagacgagggcatctacgcaatgtcaggaacagagacaagtattggtgtgttagtggataagctgcagagaatgggcgagccgtactcaccctgcacagttaatggttctgaagtcccagtgcagaacttctatagtgactacaacactacttattcaattcaggcatgtctgcgatcatgttttcaagaccacatgattcgtaactgcaattgtggtcattatctgtatccactgccccgcggggagaagtactgtaacaatagggactttccagactgggctcactgctattctgacctgcagatgagtgttgctcagagagaaacgtgcattgggatgtgtaaagaaagctgtaatgatactcagtacaagatgaccatctctatggctgattggccttcagaggctagcgaggattggatattccacgttctttcacaggagcgcgaccagtcaactaacatcactctgagcagaaagggcatcgtgaagttgaacatctatttccaggagtttaactataggacaattgaggagagtgccgcaaataacattgtgtggctgttgtctaatctgggaggccagtttggtttctggatgggcggaagcgtcctgtgtctcatagagtttggggagatcatcatcgacttcgtctggatcactattatcaagctggttgcacttgcaaagtcactcaggcaacgcagagcccaggcgtcctatgccggacctccaccaactgtagccgagttagtcgaggcccatactaatttcggatttcagccagataccgctcctcggagccctaacacagggccctatccctcagaacaggcacttcctatccccggaacaccccctccaaattacgactccctgcggctgcaacccctggatgtcatcgaatccgactcagaaggagacgccatatag

SEQ ID NO: 205462 - DNA, 1923 bp, Artificial Sequence
  Description of Artificial Sequence: Synthetic coding sequence
atgcacgtgaagaagtacctgctgaagggcctgcaccggctgcagaaagggccgggttatacttacaaagagctgctcgtgtggtactgcgacaacactaacacccacggacctaaaagaattatatgcgaaggcccaaagaagaaggccatgtggtttcttctaacgctgttgttcgccgcactggtgtgctggcagtggggcatttttatcagaacatatctcagttgggaagtatccgtcagcctttcagtgggctttaagactatggatttccccgctgtcacaatttgtaacgctagccccttcaagtactccaaaataaaacacctcctgaaggatttggatgagcttatggaggctgttctagagaggatactggcgccagagctgtcccatgccaatgccaccaggaatctgaactttagcatctggaatcacacacccttggttctgatagacgaacgcaatcctcaccacccaatggttctggacttgttcggagacaaccataacggtctaaccagtagcagtgcaagcgaaaaaatctgcaacgcgcacggatgtaaaatggccatgcgactctgctcactgaatcgcacacagtgtacattcagaaatttcacgagtgctacacaggctttgacggagtggtacatccttcaagccacaaacattttcgcacaagtgccacagcaggaattggtcgaaatgtcctacccaggcgaacagatgattcttgcctgtctatttggagccgaaccttgcaattacagaaactttaccagcatcttctatcctcactatggcaactgttatatcttcaattggggcatgactgaaaaagctctgccatctgcaaatccagggactgaatttgggctgaagctgatcttagacatcggccaagaggattatgtgcccttcttggcctcaaccgccggtgtcaggctgatgctgcatgaacagcgctcatatccttttatcagagacgaaggcatctatgccatgagcggtaccgaaacttccatcggagtcctcgttgacaagttgcagcgcatgggggaaccctactccccgtgcactgtgaatggaagcgaggtccccgtgcagaacttttatagtgactataatactacatacagtatacaggcatgtttgagatcttgcttccaggatcacatgatcagaaattgcaattgtggccactacctgtaccccctacctcgaggggagaagtattgcaacaacagggactttcctgactgggcacactgttactccgatctccagatgtcagtggcgcaacgcgaaacctgtattggcatgtgcaaggagtcgtgcaatgacacacagtataagatgacaatttccatggccgactggccttccgaagcctccgaggactggatttttcacgtgctcagtcaggaaagggatcagtcgacaaacattaccctctcaagaaaagggattgtaaagctgaacatctactttcaggaatttaactatcgcaccattgaggagagcgccgccaacaacatcgtgtggctcctttcaaatctcggcggacaattcggattttggatgggcggctctgttttatgcctgatagaatttggcgagatcataatcgactttgtgtggattacgattatcaagctggttgcattggcaaagagcttaaggcagaggagggcccaggcttcctatgctggaccaccccccacagtagccgagctagtggaagcccatacaaacttcggctttcaacctgacacggctcccaggtcaccaaatactgggccttatccctctgagcaagcactgccgatccctggaacccctcctcccaactacgattctctgcgcttgcaaccactggatgtgattgagtctgactctgagggcgacgcaatctag

SEQ ID NO: 205463 - DNA, 2115 bp, Artificial Sequence
  Description of Artificial Sequence: Synthetic coding sequence
atggccttcctgagccggaccagccccgtggccgccgccagcttccagagccgccaggaagccagaggcagtatcctgctacagtcctgtcagctcccaccccagtggttgagcacggaggcctggacgggagagtggaagcaaccccacgggggagctctcacctcaaggagccccggaccggtcgcaccccagcgcccctgtcatttaaaggggtggcagcatagacccacacagcacaatgccgcctgcaaacaaggacaagctgctgcccagactcctccgaggccagggccgcccagcgccccacctccgccaccaaaagaaggacatcaggaaggtttagtcgaactgcccgcctctttccgagagcttctgacttttttctgtacaaatgctaccatacacggtgctatccggctcgtttgtagccgtggcaatcgacttaagactacatcctggggactactctccctgggagccctggtggctctatgttggcagcttggccttttgttcgagagacactggcacaggcctgtactgatggcggtgtctgtccacagcgaaagaaagttgctccccctggtgactttgtgtgacggaaatcccagacgccctagtcccgtgttgaggcaccttgaactgcttgatgaatttgcccgcgaaaacatagactccctctacaatgtgaatttgtccaaggggagagctgcattgagcgccactgttcccagacatgagcctccctttcacctggaccgagagatcaggctacaaaggctgagccattctggcagccgcgtccgggtgggtttccgcctctgcaatagcaccggcggcgattgcttttaccggggttatactagcggcgtggccgccgttcaagactggtatcatttccattacgtcgacattcttgccctcctgcccgcagcatgggaagattctcatggcagccaagacggccactttgttctgtcgtgcagctatgatggcctggattgtcaagctcgacagttcaggacatttcatcatcctacctacggttcttgctacaccgtagatggagtgtggactgcccagagaccagggataacacacggcgtagggcttgtcttacgtgtggaacagcagcctcacctgcccctgttgtctaccttggctggcattcgtgtgatggttcatggtcggaatcatacaccgttcctggggcaccactctttttccgttcggcccggcacagaagccacgattagtatcagagaggatgaggtgcacagactgggttcgccctatgggcactgtaccgccgggggcgagggagtggaggtcgaactgctgcacaacacatcatacacccggcaggcgtgcttggtgtcctgcttccagcagctcatggtcgagacctgcagctgcgggtactacctccatccactgcccgccggtgccgaatactgctctagcgctagacaccctgcatggggacattgtttctataggttgtaccaggatttggagacccatcgactgccttgtacctcacgctgtcccagaccatgccgtgagtccgcatttaagctgagtaccgggacctccaggtggcccagcgccaaatcagcgggctggactctcgccaccctgggcgaacagggtttgcctcaccagtcacatcgacagcggagctccctggcaaaaatcaacattgtgtaccaggagcttaactaccggtcagtggaggaggctccggtgtatagcgtcccccaacttctatcggcaatgggctccctctgctcactgtggtttggtgcctctgttctctccctgctggagctgctcgagctcctgttggatgcatccgccctgacactggttctaggtggcagaagattgaggcgggcttggttctcatggccacgagccagccccgcgtccggtgcaagctctatcaaacccgaggcaagccagatgccacctcctgccgggggaactagcgacgaccccgaaccaagcggcccacacctccccagggtgatgctgccaggggttctggcaggtgtcagtgcggaagagagttgggctgggcctcagccattggagacactggatacttag

SEQ ID NO: 205464 - DNA, 1917 bp, Artificial Sequence
  Description of Artificial Sequence: Synthetic coding sequence
atggccgagcaccggagcatggacggccggatggaggccgccaccagaggcggctcccacttgcaggccgctgcccagactcctccacgtccgggcccaccatcagccccacctccaccccccaaagaagggcaccaggagggcctagttgagttgcccgcctcatttcgggaattactgacctttttttgcacaaacgctacaatacatggggccattcggctggtgtgcagcaggggcaacaggctgaaaacaaccagctggggcctgcttagccttggagccctggtcgctctgtgttggcaactgggcctcttgttcgagagacactggcaccgcccagtactcatggcggtgagcgttcactccgaaaggaagttgttgcccctggtcacgttgtgcgatgggaatccaagacggccctctccagtgttaaggcacctagagctcctagatgaattcgccagggagaatatagactctctttacaatgttaatctcagcaaggggcgggcggctctatcagccaccgttccgcgccatgagcctcctttccatctcgacagagagatccggttgcagcgacttagccactccgggtccagggttcgggtggggttcaggctatgcaatagtaccggaggagattgtttttatcgggggtatacctcaggcgtggctgctgtgcaggattggtatcattttcattatgtcgatattctcgctttgcttccggccgcgtgggaggactcccatgggtctcaggacggacacttcgtcctgtcatgttcctatgacgggctggattgtcaggcacgccaattcaggacattccaccaccctacatatggcagctgctataccgttgacggcgtatggaccgctcagaggcccggaatcacacatggcgtaggcctggtattgcgcgtcgaacagcaaccgcacctgcccctgctttccaccttagcaggcatccgggtcatggtgcacggtcgtaaccacacacccttcctgggacatcattccttctccgtgcggccaggcactgaagccaccatcagtattcgggaggacgaggtacatcggttggggtcaccttacgggcactgcacagcaggcggggagggggtggaagtggaactgctgcacaacacttcatacacacgccaggcctgtctcgttagctgtttccagcagttgatggtggaaacatgctcctgcggatactatctgcaccctctgccagcaggcgcagaatactgcagctccgcccggcaccccgcgtggggccattgcttctaccggctctaccaggacttggagacccacagactcccatgcacgtcaagatgcccaagaccttgcagggagtcagcattcaaactgtccacggggacatccagatggccatcagcgaagagcgccggttggactctggccacgttaggtgagcaggggctcccccatcagtcccatcgtcaaaggagctcccttgccaaaatcaatatcgtgtaccaggagctaaactaccgaagcgttgaagaagcaccggtgtacagtgtgccccagctgctgtccgcgatgggaagcctgtgcagcctgtggttcggcgcttccgtgcttagcctcctggaactgctcgaactcttactggatgccagcgcgttaaccctggtgctgggcggaagacggctgcgccgggcctggttttcttggccacgcgccagtcctgcctctggggcctcgagcattaagcccgaggctagccaaatgcctccgccagctggggggacatctgatgatcccgagccatcaggaccgcatctgccgagggtgatgctgcctggcgtccttgccggtgtaagcgccgaggagtcctgggccggcccccagccattggaaaccctggacacatag

SEQ ID NO: 205465 - DNA, 927 bp, Artificial Sequence
  Description of Artificial Sequence: Synthetic coding sequence
tgagccaccgcccgggccgccaccgccttcaccgaggccacccggcaggcatggaggctctcacgtaccggtacaacgagtacgatgtggatctcctggccatgctgtcctcgacacgggcgaaccgccaccggcgcgcgcaccgctacctccagcagccctgctgtcactatggcatggaccgctcggcctgattcgtcaggtcccagtactacgcctcctaccgcggccgccacgaggtctatggcatctggtcagctctccgcacccgcgtcgccaactgtgggggcgtctccttggccggtgaggggacagggttgcaggagtgggggactgacccccgctctgggacttccaggagtgggtctcgtcctgcgtgtggaacagcaaccgcacctccctcttctttctacactggcaggcatacgagtgatggtacacggaagaaaccacaccccgttcctcggccaccattcattctctgtccggcccgggacagaagctaccatctccatacgtgaggacgaagtgcacaggttgggcagtccatacggccactgcacagccgggggcgagggagtggaggtagagctcttgcataacacttcctacactagacaggcctgtcttgtcagttgtttccagcagctgatggtggaaacttgttcctgcggatattacctccaccccctgccagccggcgccgagtattgctcaagtgcccgccatcccgcgtggggccattgcttttacagactgtaccaggacctggagacacatcggcttccctgcacgtcaagatgccctcgcccttgcagggagtctgccttcaagctcagcactggaacctcaagatggccctccgccaaatctgccggttggacgctcgccactctgggagagcagggcttgccgcaccagtcatag

SEQ ID NO: 205466 - DNA, 2010 bp, Artificial Sequence
  Description of Artificial Sequence: Synthetic coding sequence
atggccgagcaccggagcatggacggccggatggaggccgccaccagaggaggaagtcacttgcagatcgcatgggcttgcgggtcccctgaagccctccctccagaaggcatggccgcccagacgcacagcgctcagcgctgtctgcagaccgggcccggctgcagtcccgatgcaccccagccaggcccaccgagcgcacccccccccccccccaaggagggtcaccaggagggcttggtagagctcccagcaagcttcagagagctcctgaccttcttctgcacaaacgccaccattcatggagctatcaggttggtatgctcaagaggcaacagactaaagacaacatcctggggcctgctctctctgggtgccctggtggctctgtgctggcaactcggtctgctgttcgagaggcactggcatcgcccggtgcttatggcagtttccgtacactcagaacgaaaattgcttccgttggtgacattgtgcgatggaaatccgagacggccttcccctgtactgagacaccttgagcttcttgacgagtttgctagggagaatattgactccctgtataatgtgaacttgagcaaggggagggcagcactgtctgcaaccgtaccaagacatgagccgcccttccacctcgatagagaaatccgcctccagcggctcagtcatagcggaagtagggtcagagtggggttccgtttatgcaatagcactggcggggattgcttctaccgtggttatacatcaggggtagccgctgtgcaagactggtatcatttccactacgtagatattttggctctgctgccggccgcctgggaggattcccacggaagtcaggacgggcacttcgtgcttagttgctcctacgacggccttgactgccaggctcggcagttccgaacattccaccaccccacatacgggtcatgctacaccgttgacggcgtgtggacagcccaacgtccaggcattacacatggggtgggcttggtgttacgcgtggaacaacagccacatcttcctttactgagcactctggcaggtatccgtgtaatggtgcacgggaggaatcacacgccctttctaggccatcactcctttagtgtgcgcccgggaactgaagcaaccatttcaatccgcgaggacgaggttcatcgcctcggctctccttatggccattgcacagcgggaggcgagggggtggaagtggagctgctgcacaacaccagttacacgcggcaagcatgcctcgtgtcatgcttccagcagctgatggtggaaacatgcagctgcggttactatctacacccacttcccgctggcgcagagtactgcagcagcgccagacaccccgcctggggccactgtttctacagactgtaccaggatctcgaaacacacaggttgccgtgtacgagccgctgcccccgaccttgtagagaatccgctttcaagttatcaaccggcacatcccggtggccctccgctaagagtgcgggctggacgctggcaaccctgggggagcaaggactgccccaccagagccacagacagcgcagctctctggccaagatcaatatagtttaccaggaactcaattatagatcagtcgaagaggctcccgtgtattctgtgcctcagctcctgtcagctatgggctctttgtgttcactgtggtttggtgcatccgtgttgagtctgctcgaactgttagaactgttactggacgcttctgcacttacattagtcctgggtggaagaaggcttcgcagggcctggttcagctggcccagagctagtccagccagtggtgcatcttcaattaaacccgaggccagccaaatgcctcctcccgcaggcggtacaagtgacgatccggaacccagcggcccccacttacctcgtgtgatgttgcctggtgtgttagctggagtctccgccgaagaatcctgggctggcccacagccgttggagactcttgacacctag

SEQ ID NO: 205467 - DNA, 2409 bp, Artificial Sequence
  Description of Artificial Sequence: Synthetic coding sequence
atgcgggccgtgctgagccagaagaccacccccctgccccggtacctgtggcccgggcacttaagtgggcctaggcggttgacctggtcttggtgctcagaccacagaacgcccacatgtagggagttaggtagtccccaccccacgccttgcacggggcctgctcggggctggccaagacggggtggcggcccttgtggatttacatcagctggccatgtgctgtgtggctacccattgtgcctcctgagcgggcctatccagggttgcggcaccggtcttggtgactcttcgatggcctttctctcccgcacttcaccggtcgctgccgctagctttcaaagtcggcaagaggctcgtggttctattttactgcagtcttgccagctgccaccgcagtggttatccactgaggcatggacaggcgagtggaagcagccccacgggggtgccctgaccagtcgctcacccggccctgtggcgcctcagaggccctgccaccttaagggctggcaacacagaccaacccagcacaacgcagcctgcaaacagggccaggctgccgcccaaactcctccacgcccggggcctccatctgccccgcctccgcctccaaaagaggggcatcaagaggggctagtcgagctccctgcaagctttagagagctactcacgtttttctgtactaacgccaccattcatggagcgatccgtctcgtctgtagcagaggtaaccggctgaaaactacctcatggggcttgctcagcctcggcgccctggtcgcactgtgttggcaactgggactgctgttcgagcggcactggcacagacctgtgctgatggccgtatctgttcactcagagaggaagcttctgcccctggtaacattgtgtgacggtaatccaaggaggccgtctcctgttctgcgccatttggagctgctggatgagtttgcccgtgaaaatatcgacagcctgtataacgtgaatcttagcaaaggtcgggcagcattgagcgctacagttccacgccacgagcctccattccacctggatcgcgaaatacgactccagagattgagccatagtggctccagagtacgtgtagggttccggctgtgtaacagtactggcggagattgtttctatcgtggttacacaagcggtgtggccgccgttcaggattggtaccactttcactacgtcgacatccttgcactgcttccagctgcctgggaagactcacacggcagtcaggatggacatttcgtcttgagttgctcttacgatggccttgattgccaggcccgccaattccgaacatttcatcaccctacctacggctcctgttacacggtggatggcgtgtggacagcgcaacgacccgggattacccacggggtgggcctcgtgctgagggtcgagcaacagccacatctgccattgttatccacacttgcaggtataagagtcatggtccacggaagaaatcatacccccttcctgggtcaccactcctttagcgtgcgcccaggaactgaggcgaccatcagtattcgcgaagatgaagtgcatcgactcggttcaccatatggacactgtacagctgggggcgagggcgtggaggtagaactgctgcacaatacaagttacactcgacaagcatgcttggtgtcgtgttttcagcaattaatggtcgagacttgttcgtgcggatactatctgcaccctctgccagctggggcagaatattgcagtagcgcccggcaccccgcctggggacactgtttttacagactgtaccaggacctcgaaacacatcgactgccctgcacatccagatgccccagaccctgccgagaaagcgcctttaaactgagtaccgggactagccgatggccttcagctaagagtgccggttggacactcgctactttgggggaacagggccttccacatcagtcccaccgccagcggagctcgctggccaaaattaatattgtttatcaggagttaaactatcggagcgtagaagaggcccccgtgtactccgtacctcagttgctgagtgccatgggcagtctgtgttcactgtggtttggggcttctgttctgtccctgctagagcttctggaactccttctagacgcctccgcgttaacactcgtcctgggtggccgccggttgagaagagcttggttttcatggcctcgggcttcgcccgcctccggcgccagctcaattaagcccgaggcgtcccagatgccacctccagccggagggacgtccgacgacccggaaccatccggcccccatctgccaagagtcatgctccctggggtccttgcgggagtaagtgccgaggagtcttgggctgggccccagcccttggagacactcgatacgtag

SEQ ID NO: 205468 - DNA, 1917 bp, Artificial Sequence
  Description of Artificial Sequence: Synthetic coding sequence
atggccgagcaccggagcatggacggccggatggaggccgccacccgaggcggctcccatctgcaggcggctgcacagactccacctaggcctggtccaccttccgcccccccccctcctccaaaagagggccaccaggaaggtcttgtggaattgcccgccagctttcgggagctcttgacctttttttgcactaatgcgaccatacacggggccattaggctggtgtgtagtaggggcaatagattgaaaactacttcttggggcctgctgtcattgggtgctttggtcgccctgtgctggcagctgggccttcttttcgagcgccactggcatcggccggtgctgatggcagtgagcgtgcactcagaacggaaactgctcccactggtcaccctgtgtgatggcaatccccgacgaccatcccctgtgctgaggcatctcgaactcctggacgaattcgccagggaaaacattgactcgttatataacgttaacctatccaagggtcgtgccgccctatccgctacagtgcccagacacgagccgccgttccatttggatagggagatcagactccagaggcttagccatagcggttctagagtgagagtgggatttaggctatgcaacagcactgggggcgactgcttttataggggatataccagtggtgttgccgccgtgcaggactggtaccactttcattacgtggacatcttagccctgctgcccgctgcatgggaggattcccacggatctcaggatgggcacttcgtgctctcttgctcctacgatgggctggattgccaggcccggcaatttcggaccttccaccaccccacttacggctcttgttacacagtagacggagtttggactgcccaaaggccggggatcactcacggtgtggggttggtgctccgggtggagcagcaaccccacctgccactgttgagcactctagccggtattagggtcatggtacatggccggaaccatacccctttcctggggcaccatagcttcagcgttcggccggggacggaggccacgatttcgatccgtgaggatgaggtgcacagactgggaagtccctacggccactgcaccgctggcggcgagggtgtggaggtggagctgcttcataacacaagttacacaaggcaggcatgtttggtttcctgctttcaacagttgatggtggaaacctgtagttgtgggtactaccttcaccccctacccgccggagctgagtattgttccagcgcccggcaccccgcctggggtcactgcttctaccggctctaccaagacttggagacacataggcttccctgcacctcccggtgtccacgcccatgtcgagagtcagccttcaaactctctaccggaacatcccggtggccgagcgcaaagtctgccgggtggactctagcaaccttgggcgagcaggggttaccacaccaaagtcacaggcagagaagctccctagctaaaattaacattgtgtatcaggagttgaactatagaagtgtcgaggaggctcctgtatattcagtgcctcagctactctccgcgatgggcagcttatgtagcctctggttcggcgcgagcgtcctgagcctcttagagctcttggagcttttgctggacgcatccgcactgacattggttcttggaggccggaggctaaggcgagcttggttcagctggccacgcgcatcccctgcctcaggtgccagctcgataaagcccgaagctagtcagatgccccctcccgccgggggaacctctgacgaccctgagccttccgggccccacctccctcgggtgatgctgccaggtgtgctggcaggagtgtctgccgaggaaagctgggcaggccctcagcctctcgagaccctcgacacctag

SEQ ID NO: 205469 - DNA, 1950 bp, Artificial Sequence
  Description of Artificial Sequence: Synthetic coding sequence
atggcccccggcgagaagatcaaggccaagatcaagaagaacctgcccgtcacagggccccaggcccctacgatcaaggagcttatgagatggtattgccttaacacaaatacccacggatgtagacgcatcgtggtgagtcgcgggagacttcggcgacttttgtggattggattcaccttgactgccgtggcccttatattgtggcagtgcgctttgcttgtgttttctttttacaccgtcagcgtgagcatcaaggtgcattttagaaaattggacttccccgcggtgaccatttgtaatatcaatccatacaagtatagtactgttaggcacttactggcagacctggagcaggagactagggaggctttaaagtccttgtacggcttcccagagagtcggaagcgcagagaggcggagagctggaatagtgtctcagagggcaagcagccaaggtttagtcatcgcatccccctcctcatcttcgatcaggacgagaagggaaaagcccgggatttttttacgggacgcaaaagaaaggtgggtgggagcatcatccacaaagctagcaacgtgatgcacattgagtctaagcaggtggtgggctttcagttatgtagcaacgacacatccgactgcgctacttatactttcagctccggcataaatgctattcaggaatggtacaagctgcactacatgaatattatggcgcaggttcccctcgagaagaaaattaacatgtcctacagcgcagaggaacttctggtgacctgcttttttgacggcgtttcttgtgacgcccggaacttcaccctgttccatcaccccatgcatggaaattgctacaccttcaataaccgagaaaacgagacaatcctgtccacctctatggggggttcagaatacggcttacaagtgatcctttatattaacgaagaggaatacaacccatttctggtatcaagtactggtgcaaaagtgatcatccatcgacaggacgagtaccccttcgttgaagatgtgggcaccgaaatagagaccgcaatggtcacatccatcggtatgcacctaaccgaaagcttcaaactctctgagccatactcccagtgtaccgaagacggcagcgacgtgcccattcgtaacatttataatgctgcctacagccttcaaatctgtctgcactcctgctttcagactaaaatggttgagaaatgtggctgtgcacagtactcccagccactgcccccagctgccaattactgcaattaccagcagcaccctaactggatgtattgttactatcagctccaccgcgctttcgtgcaggaagaactgggatgccagtctgtgtgtaaggaagcctgcagtttcaaggagtggactttgacgacttctctcgctcagtggccatcagtggtatctgagaagtggctcctgcctgtgctgacttgggatcagggccgccaggtaaacaaaaagctcaacaagacggatctcgcgaaacttctcattttttataaagatctgaaccagaggtccatcatggaaagtccagccaattccattgagatgctgctgtcgaactttgggggacagctggggctttggatgtcctgctccgtcgtgtgtgttatcgagattatcgaggtgtttttcatcgattttttttctatcattgctcgccgccaatggcagaaagcaaaagagtggtgggcatggaaacaggcgcctccatgccccgaagccccacggtctccccagggacaagacaaccccgccttggatatcgatgatgaccttcccactttcaacagcgcattacatctgcccccggccctcggcactcaagtacccgggacccccccacccaagtacaacacactgcggttggagcgcgccttttctaaccagttgactgatacccagatgctggatgagttatag

SEQ ID NO: 205470 - DNA, 5943 bp, Artificial Sequence
  Description of Artificial Sequence: Synthetic coding sequence
atggccgcccggctgctggccccccccggccccgacagcttcaagccctttacccccgagtccttggccaatatcgagaggagaattgctgagtcaaagttgaagaaaccaccaaaggctgacggcagccatcgcgaagacgatgaagatagcaagccaaaaccaaactctgacctagaggccggtaaatcactcccctttatctatggcgacattcctcaggggctcgtggctgtacctttggaagactttgatccatattatctgacacaaaagacattcgttgtgctgaatcgaggcaagaccttatttagattctcggctacccccgctctgtatattctctctccctttaacctgattagaaggatcgcaattaagatactgatccactccgtcttctccatgattattatgtgcaccatactgactaattgcgttttcatgacttttagcaaccctccagattggtcaaagaacgtagagtacacattcaccggaatttacacctttgagtcgctggtcaagattatagcccggggattttgcattgacggcttcaccttcctccgggacccttggaactggctcgactttagtgtgatcatgatggcatatataacagaatttgtgaacctcggtaacgtgtctgccttaagaacctttcgggtgctgcgcgctctcaaaacaattagcgtgatcccaggcctgaagaccatcgtgggagcgctgatacaatcagttaaaaaattgagtgacgtcatgatactaaccgtgttttgcctctcggtcttcgcactcatcggactccagttgttcatgggaaatctgcggaataaatgtgttgtctggcccatcaatttcaacgaatcttacctggagaatggaactaaaggattcgactgggaggagtacatcaacaacaagaccaatttttacaccgtcccagggatgctggagcccctgctgtgcggcaattcaagcgatgccggccagtgccctgaagggtatcaatgcatgaaggccggaagaaacccgaattatggttatacatcattcgatacattcagttgggcgtttcttgcactcttcagattaatgacacaagactattgggagaatctctatcagctgactctccgcgcagcgggaaagacctacatgatcttctttgtcctcgtcattttcgtgggctctttctatctggtgaatcttatccttgcagtcgtggctatggcctacgaagagcaaaatcaggccaccctggaagaggccgaacagaaggaggccgaattcaaagcaatgttggaacagcttaagaaacagcaggaagaagcccaggctgctgcaatggccacaagtgccggcactgtgagcgaagatgcaatcgaagaggaaggcgaagaagggggcgggagcccccgctcttcatctgagatttcaaagctgagttcaaagtctgctaaggaacggcgcaatcgccgcaaaaaaagaaaacagaaagagctcagcgagggggaagaaaaaggggaccccgagaaggtgttcaaaagtgaatctgaggacggcatgaggagaaaggccttccgactgcccgataaccgaatcgggcggaaatttagcattatgaaccagtctttactcagtattccaggcagccccttcctctctagacacaatagcaagagctccatattcagtttcagaggacctggaaggtttagggacccgggttcagagaatgagttcgctgacgacgagcattcaacagtcgaagaatcagaaggaaggcgggattctctgtttattcccataagggctagagaacggaggtcttcttactctggttactccggctatagtcagggctcaagatccagccggattttcccgtctctccggcgatccgtgaagaggaactctactgtcgactgtaatggggtggtttccttgatcgggggtccaggaagtcacattggagggcggctacttccagaggcaactacggaggtcgagatcaaaaaaaagggacctggctctctgctcgtgagtatggaccagctggccagttacggacgtaaagacagaatcaacagcatcatgtcagtggtgaccaataccctcgttgaggaattagaggagagtcagagaaagtgccccccctgttggtataaattcgctaacactttcctgatctgggagtgccatccgtattggatcaagctgaaggagatcgtgaatctgatcgtgatggacccatttgttgatctcgccattaccatctgtatcgtgctgaacacactgtttatggcgatggagcaccatccaatgaccccgcagtttgaacatgttcttgccgttggcaatctcgtgtttaccggtattttcacggcggaaatgtttttgaagctgatagcgatggatccgtactattactttcaagagggctggaacatctttgacgggttcatagtgagcctgtccctgatggagctgagtctggctgacgtagaggggctcagtgtcttgagaagcttccggttgctgcgcgttttcaaattggctaagtcctggcccaccctcaacatgctgatcaagattatcgggaattccgttggtgccctggggaaccttactctggtgctggctattatcgtttttatcttcgcggtagtggggatgcagttgttcggaaagtcttacaaagagtgcgtttgtaaaattaatcaggattgtgagctcccgcgatggcatatgcatgattttttccactcattcctaatcgtttttagggtcctgtgcggcgagtggattgagaccatgtgggattgcatggaggtggcagggcaagccatgtgtctgatcgtctttatgatggttatggtgatcggcaacctcgtcgtacttaatctcttccttgcgctgctgctgtcctccttttcagccgacaatctcgcggctaccgacgatgacggggagatgaacaacctccaaataagcgtgatcagaattaaaaagggcgtagcttggactaagctcaaggtccatgcatttatgcaagctcacttcaagcagcgggaggcagacgaggtcaagcccctggacgagttgtacgaaaagaaagcaaactgcatcgctaaccacaccggggctgacattcacaggaatggggacttccaaaaaaatggcaacggaacgacctctggaatcggctctagtgtagaaaagtatattatagatgaggatcacatgtcttttatcaataacccgaatctgacagtcagggtcccaatcgccgtgggtgaatccgatttcgaaaatctgaacactgaggatgtgtcgtctgaatccgacccagaaggcagcaaagacaaactcgacgacacatcgtcctccgaaggaagcaccattgacattaagcctgaagttgaggaggttccagtcgaacagcctgaggagtatctcgatccagacgcctgtttcactgagggttgcgtgcaacgattcaagtgctgccaggtgaacatcgaggagggattgggtaagtcctggtggattctcaggaaaacatgtttcctcatcgtcgagcataactggttcgaaacctttatcatttttatgatcctgctgtcaagtggggccttggcatttgaagatatctatatcgagcagaggaagaccatcaggaccattttagagtacgcagataaagttttcacatacatctttatactggagatgctcctgaagtggacagcctacggcttcgtaaaattttttaccaatgcatggtgttggttagacttcctcattgtggcagtgtccctggtgagtctcattgctaatgccctgggctactccgaactcggagccataaagtccctgaggactctaagagccctcagacccctccgtgctctgagtcggtttgagggaatgcgggtggttgtgaatgcactggtgggcgcgattcccagtattatgaacgtgctgttagtatgtctgattttctggctgatcttctccatcatgggtgtgaatttattcgcaggcaagtatcactattgttttaatgagacttccgagattcggtttgaaatagaggatgttaacaacaagaccgagtgtgaaaaactgatggaaggcaacaatacagagatcaggtggaagaacgtgaaaatcaacttcgacaacgtgggcgctggatacctggcactgctgcaggtggcaacattcaaaggctggatggatatcatgtatgccgctgtcgattcccgtaagccagatgagcagccaaaatacgaggacaatatttatatgtatatctacttcgtcatttttatcatctttgggtctttcttcaccttgaatctgtttatcggtgtcataatcgataacttcaaccaacaaaaaaagaagttcggagggcaggacatctttatgacagaggagcaaaagaaatattacaatgctatgaagaagctgggatccaagaagcctcagaaacccatcccaaggcctctgaacaagattcagggcatcgttttcgactttgtcacacagcaggcctttgatattgtaatcatgatgctcatctgcctgaatatggtcaccatgatggtggaaaccgacacccaaagtaaacaaatggagaatatcctgtattggatcaatctggttttcgtgatcttctttacttgtgaatgtgtactcaagatgtttgccctgagacactactatttcactatcggttggaatatctttgactttgtggtagtcatacttagcattgtgggtatgttccttgctgacattattgagaaatatttcgtgagtcccaccttattcagagtcataagattggccaggatcggcagaattctaagacttataaagggggctaagggaatccgcactctccttttcgcgcttatgatgagtctgccagccctgttcaatatcggactgttactctttctagttatgttcatcttttccattttcggcatgtcaaacttcgcttatgtcaagcatgaagccgggatcgacgatatgttcaacttcgaaaccttcggtaattcaatgatctgtctgttccagattaccacctcagctggttgggacgggctcctactccctatcttgaaccggcctccagactgtagcctagataaggaacaccctggcagcgggtttaagggagactgcggcaacccctcagtaggcatattctttttcgtttcgtacattatcatctcattcctgattgtcgtcaacatgtacattgccattatacttgagaatttttccgtagccacggaggaatcagcagatccactttccgaagatgatttcgaaacattctacgaaatttgggaaaaatttgacccggacgcaacacaatttatcgagtactgcaagttagccgacttcgcagacgcgctagaacatccactgcgcgtacctaaacccaatacaatagaattgatagcaatggatctgcctatggtgtcgggggatcgcatacactgtttggacattctgttcgcatttactaagcgagttttgggcgacagtggggaactcgacatcctgaggcagcagatggaggaacgatttgtggcatcaaatcccagcaaggtgtcttacgagcccataactactacactgcgaagaaaacaggaagaagtgtccgccgtcgtacttcagagagcttatcgggggcatctagcccgacgggggtttatctgcaagaagaccacatctaacaaactggaaaatggcgggactcatagggaaaagaaagaatccacacctagtaccgcctctctaccctcttacgatagcgttaccaaaccggagaaagagaaacagcagcgggccgaagaagggaggagggagagagccaaacgccagaaggaggtgagggaatctaagtgttag

SEQ ID NO: 205471 - DNA, 4674 bp, Artificial Sequence
  Description of Artificial Sequence: Synthetic coding sequence
atggccgcccggctgctggccccccccggccccgacagcttcaagcccttcactccagagtcgctggccaacattgagcgacgtatagccgaatctaaactcaagaagccccccaaggccgatgggagtcacagggaggatgacgaggattccaagcctaagccaaattcagatcttgaggcaggcaagtcgctgcccttcatctacggcgatatcccgcagggcctggtcgccgttccgctggaagacttcgacccctattacctgacccagaaaactttcgtcgtgttgaatcgaggcaaaacgctgttccgctttagcgcaacgccagcgctgtatatcctgtctccattcaacctcatccggcgcatagctataaagattctgatccacagcgtgttcagtatgatcatcatgtgcactatacttacaaactgtgtgtttatgactttttcaaacccgcccgactggtccaagaacgtggaatacacctttaccgggatatacacctttgaaagtctggtaaaaattatcgcgaggggtttttgtattgacggctttaccttcctgagggatccatggaactggctggacttctcagtgattatgatggcctatatcactgagttcgtgaatctggggaatgtgagcgccctgcggacttttcgggtcctgagagccctgaagaccattagtgtgattccgggactaaaaactatagtaggtgccttgattcagagcgtgaaaaagctgtctgatgtgatgattttgaccgtgttctgtttgtctgtattcgccctgatcgggttacagcttttcatgggcaacttaagaaataaatgcgtcgtgtggcctatcaacttcaatgagtcttatctcgaaaatggtacaaagggcttcgactgggaggagtacatcaataataaaaccaatttctacaccgttcccgggatgctggagccgctgttgtgtggcaactcctccgatgcagggcagtgcccggagggttaccagtgcatgaaagcagggcggaatcccaactacggatataccagctttgatacatttagctgggctttcctggccctttttcgacttatgacacaagactactgggaaaacctgtatcagttgaccctcagggctgccggaaaaacatatatgattttttttgtccttgtgatattcgttggctcattctatttagtgaatctgatcctggctgtcgtcgctatggcatacgaagagcagaatcaggcgaccctggaggaagccgagcagaaggaggcggagttcaaggccatgctggagcagctgaagaagcagcaggaagaggcccaggcagccgcaatggccacaagtgcggggactgtgtcagaagatgcgatagaggaggaaggtgaagagggcgggggtagtcctagatcttcttccgaaatcagcaaactgtctagcaaatcggccaaggagagacggaaccgtagaaaaaagcggaagcagaaagagctgtcagagggagaagagaaaggcgatcccgagaaggtatttaaatccgagagtgaagatggtatgaggcgcaaggctttccgccttccagacaaccggattgggagaaagtttagtattatgaaccagtctctcctgtctataccaggaagtccttttttaagccggcacaactctaagtcttcaatctttagctttagagggccgggacgttttagggaccctggatcagagaacgagtttgcagacgatgaacacagtaccgtggaggagtccgaaggccgacgcgattctctgtttatccccatacgggctcgcgagagaagaagctcttacagcggttactctgggtactcccaagggtcccgatcttcgaggatctttccctcactcagaagaagcgtgaagcggaatagcacagtggattgcaacggggtggttagcctgatcgggggtccggggtcccatattggagggagactgctccccgaagccactactgaggtggaaatcaagaagaaggggcctggttcgctgctagtttcaatggaccagctcgcctcctatggtagaaaggatcgaattaattcaattatgtctgtggtgacaaacacccttgtcgaggagctagaagagtctcagcgcaagtgccccccctgctggtacaagttcgctaacacatttttgatttgggaatgccacccatactggatcaagctgaaggagattgttaacctgattgttatggacccattcgtcgacctggcaatcacaatctgtatcgtgctgaacactcttttcatggccatggagcaccatcccatgacaccccaatttgagcatgtgctggctgtcggcaatctggtcttcacaggcattttcactgcggagatgtttctgaaattgatcgccatggacccctactattacttccaggagggctggaatatcttcgacggcttcatcgtcagcctttcattgatggaactgtctttggcagacgttgaagggctttccgtcctcagatcttttcgcctgttgcgcgtgttcaagttagcgaagtcatggcctactctgaatatgcttattaaaatcataggtaattcggtcggggctttagggaacttgactttagtcctcgccataattgtgtttatcttcgcagtggtgggcatgcagctgttcggtaaaagctataaagagtgtgtgtgtaaaattaaccaggactgtgagctgccacgttggcacatgcatgacttcttccactcatttctaatcgtattcagagtgctttgtggagagtggattgaaaccatgtgggattgtatggaggtcgctggccaggctatgtgcctgattgtcttcatgatggttatggttataggcaatttggtggttctgaatttgtttttggcactgctgttaagctcatttagcgccgacaatctggcagctaccgacgatgatggagaaatgaataaccttcagattagcgttatacggattaagaagggagtggcctggaccaagttgaaggtgcatgcatttatgcaggcccattttaaacaaagggaggcggacgaagtcaagccattggatgagctctacgaaaagaaggctaattgcatcgctaatcataccggcgctgacatccaccgcaatggggacttccaaaaaaacggtaacggaacgacttcaggaatcggctcgtcagtggagaaatatattattgatgaggaccatatgtcatttatcaacaaccccaacttaacagtgcgcgtacctatagccgttggagagagtgacttcgagaacctgaataccgaagatgtgagttcagagtctgacccagagggctcaaaggacaagctcgacgatacgtcctcatctgaagggtctacgatcgatattaagcccgaagttgaagaggtcccagtcgagcagcctgaggaatacctcgacccagatgcatgttttacggaggggtgcgtacaacgcttcaagtgctgtcaggttaacatcgaggaaggcctgggtaaaagctggtggattctcaggaaaacttgctttctgatcgtcgaacacaattggttcgaaactttcataatcttcatgatcctgctgagcagcggagctttagcattcgaggatatttacatagaacagaggaagacaatacggacaatcctcgaatatgcagacaaggtgtttacctatatattcatcctggagatgctgttgaagtggacagcatacgggttcgtgaaattcttcacaaatgcgtggtgctggctcgactttcttatcgtggccgtcgtggtcaatgcccttgtcggtgccataccaagtattatgaacgtgctgctggtgtgccttattttctggttgatcttttcaattatgggggttaacctgttcgccggtaagtatcactattgttttaatgagacctctgagattcggttcgagatagaggatgtgaacaacaagacggaatgcgaaaagctcatggagggcaacaacacagagataaggtggaagaacgtcaagatcaacttcgacaacgtcggggcagggtatctcgctctgctccaggttgcaacatttaaagggtggatggatataatgtatgccgccgtggatagccggaaacccgatgaacagccgaaatacgaagacaatatctatatgtacatttacttcgtgatttttattatttttggctcctttttcacactgaatcttttcattggcgtgatcattgacaacttcaatcagcagaagaagaagttcggggggcaggacatcttcatgaccgaggagcaaaagaagtattataacgctatgaagaagctgggtagtaaaaaacctcagaagccaatcccccggcctctgaacaagatccaggggatcgtttttgattttgtgacacagcaggcctttgatattgtgatcatgatgctgatctgtctgaatatggtgacaatgatggttgagactgacactcaatccaaacagatggagaatatcctctattggataaacctggtgtttgtgatatttttcacctgcgaatgcgtattaaagatgtttgcgctgaggcactattattttacaattggatggaacatttttgactttgttgtggtaatcctctcgatcgtgtag

SEQ ID NO: 205472 - DNA, 3588 bp, Artificial Sequence
  Description of Artificial Sequence: Synthetic coding sequence
ttcctgagcccccagaccttcgtggtgctgaaccggggcaagaccctattccggttctccgccacacctgccctgtacatcctatcacccttcaacctgatccgccggattgctataaagatccttatccattctcttttcagtatgattatcatgtgcacgatcctgacaaattgcgtgttcatgacattctccaaccccccggattggagtaaaaacgtcgaatacaccttcaccggaatctacacgttcgaaagcctcgtgaaaatcatcgcgagaggcttttgtattgatggattcactttcctgcgtgatccgtggaactggttggatttcagtgtaattatgatggcctacatcaccgagttcgtgaacctgggaaatgtctccgctctccgcacattccgagtacttagggcgctcaagactatttcagtgattccagggctaaaaaccatcgttggggccttgattcagtcagtgaagaaactgagtgatgttatgatacttaccgtgttttgtctgagcgtatttgccctgatcggcctccagctgttcatggggaacctgcggaataaatgtgtagtatggcctatcaactttaatgagtcctatctggaaaatggtaccaagggcttcgactgggaggagtacattaataacaaaactaacttctatactgtgcccggaatgttagagccattgctgtgcggcaactcaagcgatgccgggcaatgtcccgaggggtatcagtgcatgaaagccggacggaatccaaactacggatacacgtcctttgataccttctcttgggcctttctggctctgttcagattgatgactcaggactactgggagaacctttaccaactgacgttgcgtgcagccgggaaaacatatatgattttttttgtactcgtcatttttgtcggctcattttacctagtgaatcttatcttggccgtggtggcaatggcctatgaagagcaaaatcaggccacgttggaggaagcagaacagaaggaagccgagtttaaagctatgctggagcagctgaagaagcaacaagaagaggcacaagcggccgctatggctacaagtgccggaacagtctccgaggatgccattgaggaggaaggagaagaaggcgggggctccccccgttcctcctcagaaattagtaagctttctagcaagagcgccaaagagcggaggaatcgtagaaagaaaagaaaacagaaggaactatccgagggggaggaaaagggcgatccggaaaaggtgtttaagtcagagagtgaagacggcatgaggcggaaggcgttccgtctgccggacaacaggataggcagaaaatttagtattatgaatcaatccctgttgtcaatcccagggagtccgttcctgtctaggcataattcgaagagctccatattcagttttagaggcccaggcagattccgcgacccaggctcagaaaatgagtttgccgatgatgagcactctaccgtggaagaaagcgagggccggcgggactcactgtttatcccaattagagcacgggagaggagatccagttatagtggatacagtggttatagccagggatccagatccagtaggatcttcccttctctccgtcggtcggttaaacggaattcaacagtagattgtaatggcgttgtatcacttatcggcggcccaggctcccacattggtggccggttactgcctgaggcgacaaccgaggtggaaataaaaaaaaaggggcccggctcccttcttgtgagtatggatcagctcgccagttatgggaggaaagaccgcatcaattccatcatgagtgtggtcactaacactctcgtagaagagctggaagagtcccagaggaagtgcccaccgtgttggtataagtttgcgaatactttccttatttgggagtgtcacccttattggatcaagcttaaggaaattgtgaacctgattgtgatggatccttttgttgacttggccattacgatctgcatcgttctcaatacattgttcatggcaatggagcatcacccaatgacaccccagttcgagcacgtgctcgctgtgggcaacctggtgttcacaggtatttttaccgcagagatgtttttaaaactgattgccatggatccatactactacttccaggaagggtggaatattttcgacggttttatagtctcgctgagtctgatggagttgagtctggctgatgtggagggcctgtcagtcctgcgctccttccgtctgctgagagtgtttaaactggctaagtcatggcccaccctgaatatgcttattaaaatcatcggcaacagcgttggcgcactgggcaaccttacgctggttcttgcaattatcgttttcattttcgccgtcgtggggatgcaactcttcgggaagagctacaaagagtgtgtgtgtaaaatcaatcaagattgcgaactgcctcgctggcacatgcacgacttctttcatagcttcctgattgttttccgggtcctgtgtggcgaatggattgagaccatgtgggactgtatggaggtcgccggtcaagcgatgtgtttaatcgtgtttatgatggtgatggtgattggcaacctcgtcgttctgaacctgttcctggccctgttgctttcatctttttccgcggacaatttggctgccacggacgacgatggcgagatgaataacctccaaatcagcgtcattaggattaagaaaggagtcgcttggacaaagctgaaagtgcatgcttttatgcaagcccacttcaaacagcgcgaggccgatgaggtgaaacctctagacgagttatacgagaagaaggccaactgtattgctaatcatacgggagccgatattcacagaaacggagattttcagaagaacggaaacgggactaccagcgggatcggtagcagcgtggaaaagtacattatcgacgaagaccacatgtcatttattaacaaccccaatctgaccgtgcgagtgcccatcgccgtaggcgaatccgattttgagaatctaaatactgaagacgtgtcctccgaaagcgatcccgagggttctaaggacaagctcgacgatacttccagttcagaaggctcgacaatagatattaagccggaagtggaggaagttcctgtggagcagcccgaggaatacctcgatcctgacgcatgtttcactgagggatgcgtgcaaaggtttaagtgttgtcaggtgaacatcgaggaaggccttgggaagtcttggtggatcctccgcaaaacatgcttcctgatcgtggagcacaactggttcgaaacctttattattttcatgatcctcctgtcgtcgggggcccttgccttcgaggatatctatatcgaacagagaaagaccattaggaccattttggagtatgcggataaagtgtttacctatatttttatcctggaaatgctgttgaagtggaccgcctacggatttgtcaagttctttacaaatgcctggtgttggttggactttctgatagtggccgtcccacttaatctctcaggcctgatctag

SEQ ID NO: 205473 - DNA, 5820 bp, Artificial Sequence
  Description of Artificial Sequence: Synthetic coding sequence
atggccgcccggctgctggccccccccggccccgacagcttcaagccctttactccagaaagccttgcaaatatcgaacgaaggatcgcagagtctaagctcaaaaaaccacctaaggccgatggatcccacagagaggatgacgaagatagtaaacccaaaccaaactctgatcttgaagccgggaaatcccttcccttcatttacggggatattcctcagggcctggtggctgttcctctagaagatttcgacccgtattatctcactcaaaagacctttgtggtgctgaatagagggaagacgctctttcgcttttcagcgactcctgcgctgtacatcctgtctcctttcaatttgatccgcaggattgccatcaagatactcatccactccgtcttttccatgattataatgtgcaccatactgaccaactgcgtattcatgaccttttccaatcctcctgattggagtaaaaacgttgaatacacatttacgggaatctacacgttcgagagcctggtgaagattattgcacgtggcttttgtatcgacgggttcacttttcttagagacccctggaattggctggacttctctgtgattatgatggcttacatcaccgagttcgttaacttgggtaatgtcagcgcgctaagaacattccgcgtactgagggcactgaagactatcagtgtcattccaggactcaaaacaattgtaggggcccttatccaatctgtgaagaagctgtcagacgtcatgattctcaccgtcttctgcttatccgtattcgcgctcatcggcctccagctcttcatgggcaatcttcgtaacaaatgtgtggtgtggcctatcaacttcaatgaatcttaccttgagaacggtacaaaaggcttcgactgggaggaatacattaacaacaagacgaatttttacacagttcctgggatgcttgagccactgctgtgtggcaatagctctgacgcaggccagtgccctgaaggataccagtgtatgaaggctggccgcaaccctaactatggctatacaagcttcgacacattttcttgggcattccttgccttgttcagactaatgactcaagactattgggagaatctctaccagcttacactgcgcgccgcagggaagacgtatatgattttctttgtgctcgtcatctttgtgggctccttctacttggtgaacttaatcttagcagtggtagccatggcctatgaagagcaaaaccaggcgactctggaggaagcagaacagaaagaggctgaattcaaagccatgttagaacaactgaagaaacagcaggaagaagctcaggccgcggccatggcaactagcgccggcacagtgagtgaggatgcgatcgaggaagaaggcgaagaaggcggtggctccccccgcagctcctccgagataagcaaactgtctagtaagtcagcaaaggagagacggaatcgccgaaagaaaagaaagcagaaggagctcagcgagggggaagaaaaaggggaccctgagaaggtgttcaagtcagaaagcgaggatggtatgcgaaggaaggctttcaggctgccagacaatcgaataggcagaaaattttccatcatgaaccagtccctgctctcaatcccaggtagcccttttctatcgagacacaactctaaatcttcaatcttttccttccgcggtcccggacgctttcgagaccctggttctgagaatgagttcgccgacgatgagcattcgacagtcgaggaaagtgaggggaggagagattccctgtttataccgatccgggcgcgagagcggaggtctagctactccggttactctggctatagccaggggtcacgttcttctcgtatctttccatctctccgacgttccgtgaagcgaaattcaacagtcgattgcaacggcgttgtgagtttgattggcggtcctgggtcccatatcggggggcggctcttgcccgaagccactaccgaagtcgaaattaaaaaaaagggtcctggcagcttactcgtgtcgatggatcagctcgcctcttatggacgcaaagataggattaactcgataatgtctgttgtaactaataccctggtggaggaattggaggagagccaacgtaaatgtccaccttgttggtacaagtttgcaaacacctttcttatttgggagtgtcacccttactggattaaactgaaggagatcgtcaatctcattgtgatggaccctttcgtcgaccttgcgatcaccatatgcattgtactcaatacgctgtttatggccatggagcatcatccgatgacacctcagttcgaacatgtgttggcagttggcaacttggtctttaccggaattttcactgctgaaatgttcctaaaattgattgccatggatccctactactattttcaagagggctggaacattttcgatggctttattgtttctctttccctaatggaactgtccttggctgacgttgagggtctgtcagttcttaggtctttccgtttgctacgggtctttaaacttgcaaagtcatggccaacactgaatatgctcatcaaaataattggaaatagcgtcggagctctgggtaatctgacactcgttttagccatcatagttttcatattcgcagtagttgggatgcagttgttcggtaaaagctacaaggaatgtgtttgtaagattaatcaggactgcgagcttccaaggtggcacatgcacgacttctttcatagcttcttaattgtctttagagtgctgtgtggagagtggatcgagacaatgtgggactgcatggaagtggcgggacaagccatgtgcttaattgtcttcatgatggttatggtgattggaaacctggtggtgcttaacctctttctcgcgctgctgctgtctagcttctccgccgataatctggctgcaactgacgatgacggagagatgaacaacttgcaaatcagcgtcatccgaataaagaagggggtagcctggacgaagctgaaggtacatgccttcatgcaggcgcattttaagcagcgtgaagctgatgaggtgaaacccctggacgagctgtatgaaaagaaggccaactgtatcgcaaaccacacaggcgctgacatacaccgcaacggcgattttcagaagaacgggaatgggacaaccagcggcatcggatccagcgtggagaagtatatcatagacgaggatcacatgtccttcattaataaccccaatctcactgtgcgcgttccaattgcagtaggtgagtcggactttgaaaacctcaacactgaggatgtcagtagcgaatcagatccagaaggctccaaagacaagctggatgacaccagctcttccgagggatcaactatcgacatcaagcccgaggtagaagaagtccccgtggaacagccagaggaatatttagatcccgatgcctgcttcaccgagggatgtgtgcagcgttttaagtgttgtcaagtcaatattgaagagggactaggtaaatcttggtggattttaagaaaaacttgctttctgattgtagaacacaactggtttgaaaccttcattatcttcatgatactgctgagtagtggcgctttagcctttgaagatatctacattgaacagcgaaaaactattagaaccattctggagtatgcagacaaggtcttcacctacatcttcatcttggagatgctcctcaagtggacagcatatgggttcgtgaaattcttcacaaacgcctggtgctggttggactttttgatagtggcagtggtggttaacgccctggtcggagcaataccctctatcatgaacgtcctcctggtatgcttaatcttttggcttatattctccatcatgggcgtcaacctcttcgctgggaagtatcactactgcttcaacgagaccagtgagatcaggtttgaaattgaagacgttaataataagaccgaatgcgaaaagctaatggagggcaataatacggaaatccgctggaagaacgtgaagattaattttgacaatgttggggccggatacttggctctcctacaggtggccacctttaaggggtggatggatataatgtatgccgccgtggactctaggaagccggatgagcagccaaaatacgaagacaatatctacatgtatatttactttgtaatcttcatcattttcggcagcttttttaccctaaacctcttcatcggtgtcatcatcgataactttaaccagcaaaagaagaagttcgggggccaagatatattcatgaccgaagagcagaagaagtattacaatgcaatgaaaaaactcggctctaagaagcctcaaaagcctattccccgccccctgaacaaaattcaggggatcgtgttcgattttgtgacacaacaagcctttgatatcgtcatcatgatgctcatctgtctcaacatggtgactatgatggtggaaactgacacacagtctaaacagatggagaatatcttatactggatcaacctagtgtttgtgattttctttacatgtgaatgcgtactgaagatgtttgctctcagacactactattttaccataggctggaatatcttcgatttcgtggttgtcatactgtccatagtggggatgtttctcgctgacataatcgagaagtacttcgtctctcccacattgttcagggtcatcagactggcacgtattggccggatcttgcggctgataaaaggggctaagggtatccgcacactgttgtttgccctgatgatgagcctgcctgccctctttaatatcgggttgttactcttcttggtgatgtttatcttctccattttcggcatgagtaattttgcttacgtgaagcacgaagccgggattgatgacatgtttaatttcgagacatttggcaattccatgatctgtctgttccagatcactactagtgctggctgggatgggttacttctgcccatcctgaataggccccccgactgcagccttgacaaagaacacccaggatctggatttaaaggagactgcggaaatcccagcgtgggcatattctttttcgtctcctacatcattatctctttcctgattgtggtcaacatgtacatcgcaataattctagagaatttttccgtggctaccgaggagagtgccgatcctttatctgaggatgattttgagactttctatgagatctgggaaaagtttgaccccgacgcgacacagttcattgaatactgtaagctagccgattttgccgacgccctggaacatcccttgcgagtgcccaaaccaaacacaattgagctaattgccatggacctgccaatggtttcaggggaccgaatacactgtcttgatatactgttcgccttcacgaagagagtgttaggggattctggggagttggatatacttagacagcagatggaagaaagattcgtggcttctaatccaagtaaagtgtcatatgagcccattacaacaaccctgcgacggaagcaggaggaagtgagcgccgtggtactgcaacgggcctatcgcggacacttggctcgacgcggctttatttgcaaaaagactacctccaataaattggagaacggtgggacacaccgcgagaagaaagaatcgacaccttcaacagcttccttaccttcctacgactctgttaccaagccggaaaaagaaaagcagcagagagctgaggaaggtcgcagagaacgcgcgaagagacaaaaggaggtacgggaatccaaatgctag

SEQ ID NO: 205474 - DNA, 2919 bp, Artificial Sequence
  Description of Artificial Sequence: Synthetic coding sequence
atggccgcccggctgctggccccccccggccccgacagcttcaagccctttacacccgaaagtctggccaacatcgaaaggaggatagctgagagtaagctgaaaaagcctcccaaggcagacggctctcatagggaggacgatgaagacagtaagccgaagcctaactccgatctggaagcgggaaagagtttgccgttcatttacggcgacataccgcaggggcttgtcgcggtgcccctcgaggactttgacccgtattacctgacacaaaagacatttgtggttctaaaccgtgggaaaaccttgttccggttctctgctacacctgccctctacatactctcccctttcaacctcattcgccgcatagctatcaagatccttatccattccgtgtttagcatgatcatcatgtgtaccatcctgacaaattgcgtctttatgaccttctccaatcctcccgactggtctaagaatgtagagtatacattcacgggcatttatacattcgaaagcctagtgaagattatcgccagaggcttctgcatcgatggctttacattcctgagagacccatggaattggctcgacttcagcgtgatcatgatggcttacgtgaccgagttcgttgatctggggaacgttagcgccctccgaacctttcgcgtactgcgtgccctgaaaacgatttccgtgattcccgggctgaagaccatcgtgggcgcattaattcagagtgtaaaaaagcttagcgacgtgatgatcttgaccgttttctgtctctccgtgttcgccttaatcgggctgcagctgtttatgggcaatctcaggaataagtgtgttgtctggcccataaatttcaatgagtcctacctggagaatgggacgaagggattcgactgggaggaatacatcaataacaagactaatttctatactgtgcccggcatgctcgaacctctgctgtgcgggaatagtagtgatgcaggccagtgccccgagggataccagtgcatgaaggctgggagaaacccgaattacgggtatacatccttcgatactttttcatgggccttcctcgccctgttcagattgatgacacaggattactgggagaatctgtaccaactgacactgagagccgccggtaagacctatatgatcttcttcgtcctggtgatcttcgtgggttccttctatctggtgaacctgattctggcagtagtggcaatggcctatgaggaacagaaccaggctacgcttgaggaggcagaacagaaagaagcggaattcaaggctatgctcgaacagctcaagaaacaacaggaggaagcccaggctgctgcaatggccacatccgctggaaccgtatctgaggatgccattgaagaagaaggcgaggaggggggaggctcaccacgaagtagcagtgaaatcagcaagctcagcagcaagtccgctaaagagaggaggaacaggcgcaagaagcggaagcaaaaggagttgagcgagggtgaggaaaagggagatcccgaaaaagtgttcaaatcggagagcgaggatggcatgcgccggaaggcatttagactcccagacaaccggatcgggagaaaattctcaattatgaaccagtccttgctgtctattcccggttcacctttcctgtcccggcacaactcaaagtcatctattttctcctttcgcggccctggtagattccgcgatccagggtctgaaaatgaattcgccgatgatgaacattccaccgtggaggagtcagaggggcggcgagattctctgtttattccaattcgagcgagagagcgccggtccagttactctggatattctggctatagccagggcagtcgtagctcaaggatcttcccatcgctcaggagaagcgtgaagcgaaattccacggtggactgtaatggagtggtgagcctgataggggggccaggttcacacatcggcgggagactcctacctgaagctacaaccgaagttgaaatcaaaaagaaaggacctggctctcttttggtcagcatggaccagttggccagctatgggagaaaagaccgcatcaactctataatgtccgtagtcacaaatactcttgtcgaggagttagaggagtcgcagcgaaaatgcccaccttgttggtacaagttcgccaatactttcctgatttgggagtgccatccctactggatcaaacttaaggaaatcgtgaatttgatagtgatggaccccttcgtggacctggccatcacaatttgcatcgtactgaacactctgtttatggccatggaacaccacccaatgaccccacagtttgagcacgtcctggccgtcggtaatctggtcttcacgggcatcttcacagcggaaatgtttcttaagttgatcgctatggacccctactattactttcaagaaggatggaatatctttgacggatttattgtgtctctgagtctgatggaattgtcactggccgatgtggagggcctgtccgtgctgagatctttccgcctgttgcgagttttcaagctcgcaaagagttggccaacattgaacatgctaattaagattattggaaatagtgtgggagcccttggcaacttaactttggtgctggccataatcgtgttcatctttgccgtggtcggcatgcaattgttcgggaagtcttacaaggagtgtgtatgtaaaatcaatcaggactgtgagctccctaggtggcacatgcacgactttttccacagctttctgatcgtgtttcgggtcctgtgcggcgagtggatcgaaacgatgtgggattgcatggaagttgccggacaggctatgtgcctgatagtgtttatgatggtgatggtcattggaaacctggtagtatcgacaaatctgtag

SEQ ID NO: 205475 - DNA, 6030 bp, Artificial Sequence
  Description of Artificial Sequence: Synthetic coding sequence
atggagcagaccgtgctggtgccccccggccccgacagcttcaacttttttacccgcgagagtttggctgcgatcgaacgccgcattgcagaggaaaaggcgaagaaccccaaacccgataaaaaggatgacgatgaaaatgggccgaaacctaacagcgacctcgaggcgggaaaaaatctaccattcatctacggcgatatccccccagagatggtctccgagcctctcgaggatctggatccctactacatcaataaaaagaccttcattgtgttaaataaaggaaaggccatattccggttctccgccacaagtgctctatacattttaaccccctttaacccgctcaggaaaatcgcgatcaagatccttgtccactcacttttttccatgctcattatgtgcactattctcaccaactgtgtgtttatgacaatgtccaatccacccgactggacgaagaacgttgagtatacttttacaggtatctatacgttcgaaagcctgattaagataatcgccaggggattttgtctggaggatttcacatttctgagagacccatggaattggctcgacttcacggtgattacttttgcctatgtgactgaattcgtcgacctgggcaacgtgtccgccctgcggacctttagggtcttgcgagccctaaagacaatctcggtcatccccggactgaagacaatcgtgggggccttgattcagagtgtcaaaaaacttagcgacgtaatgattctgactgtgttctgccttagcgtcttcgcgctcattggtttgcagctgttcatgggcaatcttagaaacaagtgcattcagtggcccccgactaatgcttcgctcgaggaacacagtattgagaagaacatcaccgtgaactacaacggcaccctcatcaatgaaactgttttcgagttcgattggaagagctatatccaggactctcgataccactattttctggaaggattcctggacgccctgctatgcggcaattctagcgacgccgggcaatgtcctgagggctacatgtgcgttaaggcaggtcggaaccccaactatggctacacctcattcgacacattttcctgggcctttttgagcctgttcaggctgatgacacaagacttctgggagaacctctaccaactgactctgagagccgccggcaagacttatatgatttttttcgtgctggttatcttccttggttcattttacctgataaatttgatacttgcagtggttgcgatggcctacgaggaacagaatcaagccacattggaggaggccgaacagaaagaagctgagtttcagcagatgattgagcagctaaagaaacagcaggaggctgcacaacaggccgccacagccactgcaagtgagcactcccgggagccgagcgcggccggtaggctatccgatagcagctctgaagcgtctaaactctcgtccaaaagcgccaaggaacgtagaaatagaagaaagaagcgcaagcaaaaagaacaatccggtggggaagaaaaagacgaagacgagtttcagaaatctgagtccgaggatagcatccggaggaaaggattcaggttcagtatcgagggtaataggcttacatacgagaagcgctatagctcaccccatcagagcctgctctctataagggggtccttgttctccccccgtagaaactctcggacgtccttatttagctttaggggccgcgcaaaagacgtgggcagcgaaaacgacttcgccgatgatgagcactctacctttgaggacaacgaaagccgccgggattctcttttcgttcccagacggcacggtgaacgacggaactccaatctttcacaaaccagtaggtcctctcggatgctggcagtttttcccgctaacggaaaaatgcacagtaccgttgattgcaatggggtggtgtcgctcgtcggtggaccaagcgtcccaacatcccctgttggccagctgttgccagaagtaattattgacaaacctgccactgacgataacggcacaacaactgagactgaaatgcggaaacgaaggagttctagctttcacgtgagtatggactttctggaggaccctagtcaacgacaaagagctatgtcaatcgcttccattctgactaataccgtggaggaattggaagaatctcggcaaaagtgccctccctgttggtataagttctcgaacatattcctcatttgggattgctcaccctactggttgaaggtgaagcacgtggtcaatctcgttgtaatggacccttttgttgatttggccatcaccatttgcatagttttgaacactctgttcatggctatggagcattatccaatgaccgatcactttaataatgtgctgacggtcggtaatctggtgtttaccggcatttttacagccgagatgtttcttaagatcattgcaatggatccttattactactttcaggagggctggaacattttcgatggctttatcgttacactgagcctggttgagctcggtctggcaaatgtggagggtctttcagtgctgcggagtttccggctgctgcgcgtgttcaaactggccaagtcgtggcctactcttaatatgctgattaaaattatcggaaattctgtcggcgccctgggcaacctgaccctggtgctggctatcatcgtgtttatttttgcagttgtcggcatgcagttgtttggtaagagttacaaggattgcgtgtgcaagattgcttctgactgccaattgcccagatggcacatgaatgatttttttcactccttcctgatagtgtttagagttctgtgtggggagtggatcgaaacaatgtgggattgcatggaggtggctggacaggcaatgtgcctgactgtgtttatgatggtgatggtaatcggtaatctggtcgtcctgaacttatttctggcactgcttctgtcctccttctctgcggataatctcgccgccacagacgacgacaatgaaatgaataacctgcaaatcgccgtggatcgaatgcataaaggagtggcatacgtgaagcgcaagatatacgaatttatacagcagtcctttatccgaaaacagaaaatccttgacgagatcaaacccctcgacgatctgaacaacaaaaaagattcctgcatgtccaatcataccgctgagatcggtaaggatttggattatctcaaggacgtaaatggtaccacaagtggcatcggaacagggtccagcgttgaaaagtatatcattgatgagtctgattatatgtccttcattaacaatcccagcctgactgtgacagtcccaatagccgtgggcgagtccgattttgaaaatctcaacaccgaggattttagctctgagtctgatcttgaggagagcaaggaaaagttaaacgaatccagttcaagtagcgaggggagcactgtcgatatcggggcccctgtcgaggaacaaccggtggttgagcctgaagagacactcgaacctgaagcatgcttcaccgaaggctgtgttcagcgcttcaaatgctgccagatcaatgtcgaagaaggccgcgggaaacagtggtggaacctgcgccgcacatgttttagaatcgtggagcacaattggttcgagaccttcattgtgtttatgattctgcttagctccggagcactggcctttgaggacatctatattgaccagcggaaaaccataaaaactatgttggagtatgctgacaaagtgttcacttatatttttatcctggaaatgctcctgaagtgggtcgcatacgggtatcagacatattttaccaatgcgtggtgctggttggatttcttaatcgtagacgtgagtctcgtgagcctgaccgccaatgccttgggctacagtgaacttggagcaatcaagagccttagaaccctcagggccttgcgcccactgcgggctctgtcacgcttcgaagggatgagggtggtggttaacgcactcctgggcgccataccaagcatcatgaacgttctgctggtgtgtctcatcttttggctcatcttttccatcatgggggtcaatctttttgcaggtaagttttatcattgtattaatacaaccaccggtgacagatttgacatcgaagacgtgaacaatcacactgactgtttgaagttgatcgaacggaatgagaccgctcgctggaagaacgtcaaagttaactttgataacgtcgggtttggatatttatccctactccaggtggccacatttaaggggtggatggacatcatgtatgcagcagtggactccagaaacgtggaactgcaaccaaaatacgaggagtccctgtatatgtacctgtactttgtaatctttattatctttggatctttctttaccctgaacctgtttataggcgtcatcatagacaattttaaccaacagaagaagaagtttgggggccaggacattttcatgaccgaagagcagaaaaaatactataacgccatgaaaaagctcggctctaagaagccccaaaaaccaatacctcggcccggtaataagttccagggcatggtttttgatttcgtcaccagacaggtattcgacatttctatcatgatcctcatttgccttaatatggtgaccatgatggtggaaactgatgatcagtctgagtatgtgacaactatcttaagccgcattaatctcgttttcattgtactctttaccggagagtgtgtgctgaaactaatttccctacggcattactacttcactattggttggaacattttcgatttcgtagtcgtgatcctcagtatagtggggatgttcttggctgagttgatagaaaaatactttgtcagccctaccctatttcgggttatccgactggcaaggattggacgcatcttgaggctgataaaaggcgctaagggaatccggacgcttctttttgctctaatgatgtcactccctgccttgttcaacatcggattgctgctgttcttggtgatgttcatttacgcaatcttcggcatgtctaacttcgcatacgttaagcgagaagtgggaatagacgacatgtttaacttcgagacgtttggaaactccatgatctgcctgtttcagattaccacaagcgccggctgggacggcctgctggcccccatcctaaacagtaagccaccagattgtgaccccaacaaggttaatcctgggagttcagtcaagggagattgtgggaacccctccgttggaatatttttcttcgtctcatacattatcatctctttccttgtggtcgtgaacatgtacattgcagtgattctggaaaacttctcagttgcaaccgaggaaagcgcggagccactatcggaggacgacttcgagatgttttacgaggtgtgggagaagtttgacccggacgcaactcagttcatggagttcgagaagctctcccagtttgcagcagcactagaaccccctctgaatctccctcagcctaacaaactacagctgattgctatggacctgccgatggtatcaggcgataggatacactgtctcgatatcctcttcgcctttacaaaacgagtgcttggcgaatctggtgaaatggacgcccttcgcatccaaatggaggagcggtttatggcctccaatccatctaaggttagctatcagccgattactaccactctcaagagaaagcaggaagaggtcagtgcagtcattatccaaagggcctacagaaggcacctactgaagcggaccgtcaagcaggccagctttacttacaataaaaacaaaatcaaaggtggggccaacctcttgataaaagaggacatgataatagatagaattaacgagaactccatcactgaaaagaccgacctaacaatgagcacggccgcctgtccccctagctacgacagggtgaccaagcccattgttgaaaagcatgagcaagaaggcaaggatgagaaagcgaaagggaaatag

SEQ ID NO: 205476 - DNA, 5997 bp, Artificial Sequence
  Description of Artificial Sequence: Synthetic coding sequence
atggagcagaccgtgctggtgccccccggccccgacagcttcaacttttttacccgagagtccctcgcagctattgagagacgaatcgcagaagagaaggcaaagaatccaaaaccggataagaaggacgatgacgaaaacggccccaagcccaactcagacctcgaagccggaaaaaacttgccgtttatttatggcgacatccctcctgagatggtgtccgaacctttagaagatctggatccttactatattaataaaaagacttttattgtgttgaacaaagggaaggctattttcaggttttccgccacatcagccttgtatatcctgacccccttcaatcccctccgcaaaatcgctattaagatccttgtgcatagtctgttcagcatgctgattatgtgcacgattttgaccaattgtgtctttatgacaatgagtaatcctcccgattggacaaaaaatgtcgaatatacctttactgggatttacacctttgagtctttaatcaagatcattgcccgcggcttttgccttgaggatttcacatttctaagggacccttggaattggctggactttaccgtgattactttcgcgtatgtcaccgagttcgtggatctgggtaatgtgagcgccctcagaactttccgcgtgctaagggcgctcaaaactatcagtgttattcccggtctcaagaccattgtcggtgccctgattcaatcagtaaaaaagctctccgacgtgatgatcctgacagtgttctgtctttcagtctttgcgctgattggcctgcagctgtttatgggaaaccttcggaacaagtgcatacaatggccccccaccaatgccagtcttgaggaacactcaattgagaaaaatattactgtaaattataacggtacactgattaatgaaaccgtgtttgagttcgactggaagtcatacatccaagactcccgataccattactttttggaggggttcctggacgcactgctgtgtggaaactctagcgatgccggacagtgccccgagggatatatgtgtgtcaaggctggacgcaatccaaattacggatacacatcctttgacacgttttcttgggcatttctgtcattattcagactcatgactcaggacttttgggagaatctctaccagctcacactgcgggctgctggcaagacgtatatgattttcttcgtgcttgtgatttttctcgggtccttctatttgattaacctcatactggctgtcgtggcgatggcttacgaggaacagaaccaggccacgctcgaagaggccgaacagaaggaagctgaattccagcagatgatcgaacagttgaagaaacaacaggaggctgcccagcaggcagctactgctacagcctcggaacatagccgggagccctccgcagccggacgcttgtctgattccagctctgaggcttccaagctgtcgagtaaatctgcaaaggagaggcggaacaggagaaagaagagaaagcagaaagagcagtccggcggcgaggagaaagacgaggatgaatttcaaaaatccgagagtgaagactccattcggaggaaaggtttccgcttcagcattgaaggcaatcggttgacctacgagaaaagatactcttcaccccaccagagcttgctctccattcggggatcattgtttagcccacggagaaattctaggacttcgttgttttcattcagaggacgggctaaagatgttggctccgaaaacgactttgcagatgacgagcactcaacttttgaggacaacgagtcacgtcgagattctcttttcgtcccccgtcggcatggcgagcgccggaattccaacttgagccaaacctctcgttctagccggatgctggccgtctttcctgcaaatgggaaaatgcacagcacggtcgactgtaatggtgtggtcagcttggtaggcggaccatccgtaccgacttcaccggtcggccagctgttgcctgagggcactactaccgaaactgagatgcgcaagcgacggtcatcctctttccatgtgagtatggatttcctagaggacccaagccagcgtcagcgagctatgtccattgcatcaattttgaccaataccgtggaagagctagaggagtcaaggcagaaatgtcccccatgctggtataaatttagcaatatatttctcatttgggactgttccccgtattggctcaaggtgaaacatgtggtgaacttggtggtcatggatccttttgttgatttagctatcaccatctgtatagtacttaacacactgtttatggctatggagcactatcccatgaccgatcatttcaataacgtcctcactgttggtaatttggtgttcacaggcatctttactgcggaaatgtttctcaagattattgccatggacccgtattattattttcaggagggctggaatatctttgatgggttcattgtgaccctttcactggtagagctgggtctcgccaatgtcgaaggactttccgtcctccggtcctttcgattgttgagggtgttcaagctcgcaaaatcctggccaacgctgaacatgctaataaaaattattggtaacagcgttggtgccctgggaaatttgacgcttgtgcttgccattatcgttttcatatttgcagtggtcggaatgcagttattcggcaagtcgtacaaagattgtgtgtgtaagatagcctccgattgtcagttgccacgttggcatatgaatgactttttccacagtttccttatagtctttagagtactctgtggagagtggattgagaccatgtgggattgtatggaggtcgccggccaggctatgtgcctcaccgtttttatgatggtcatggtcattggcaacttggtagtcctcaatttgttcttagctctgctgctgtcctctttcagcgccgacaaccttgccgccaccgatgatgacaatgagatgaataacctccaaatagcggtagatcgaatgcataaaggtgtggcctacgtgaaacgcaaaatttatgagtttattcagcagtcctttatcaggaaacagaagatattggatgagataaaacccctggacgaccttaataataagaaagatagctgtatgtccaatcacacagcggagataggaaaagaccttgattatctgaaggacgtcaatggcactaccagcgggataggcaccgggagtagtgtggagaaatatattattgacgagtcagattatatgtcattcattaacaaccctagcttaactgtaacagtacccattgcagtgggggagagcgacttcgagaatctgaacactgaggacttttcctcggagagtgaccttgaggagagcaaggaaaaattgaacgagtccagttcttcctcagaggggtccactgtggatatcggcgctcccgtagaagaacaacctgtcgtggagcccgaggagaccctggagccagaagcctgctttacggaggggtgtgtgcaaagattcaagtgctgtcagatcaatgttgaggaggggcggggtaagcagtggtggaatctgcgcaggacttgcttcaggattgtggagcacaattggttcgaaaccttcatagtgtttatgatcttgcttagttctggagcccttgcttttgaggacatctatatcgatcaacggaagactattaagacaatgctagaatacgccgataaagtgttcacctacatcttcattctggagatgctgctaaagtgggtggcttacggttatcagacctactttaccaacgcatggtgctggctggattttctaatagttgatgtgtcactggtcagcctgaccgccaatgcccttgggtacagtgagctaggggcgatcaaatccctgcgaacactgcgggccctccggccactacgggccctctcacggtttgagggaatgcgtgtggtggtgaacgctctgctcggtgccataccctctatcatgaatgtgcttctggtctgtctaatcttttggttaattttctcaatcatgggggtcaatttattcgctggcaaattctaccactgtatcaatacaaccacaggcgaccgtttcgatatcgaggacgtcaataatcataccgactgtctgaagctgatagaacgcaatgaaactgctagatggaaaaacgtgaaagtgaatttcgacaacgttgggttcgggtacctgtcgctcctacaggtagctacttttaagggatggatggatataatgtacgctgcagttgattcaagaaatgtggagttacagcctaaatacgaagagagcttgtacatgtacctctactttgtgattttcataattttcgggagcttctttacgctgaatctgttcatcggcgttatcatagacaactttaaccaacagaagaaaaagttcggcgggcaggacatctttatgactgaagagcagaaaaaatattacaacgccatgaaaaagctaggatcgaaaaaaccgcagaagcccatcccccggccaggaaataaatttcagggcatggtgttcgactttgtgactagacaggttttcgacatcagcataatgattctcatctgtctgaatatggtgacaatgatggttgaaactgacgatcaatctgagtacgtcacaaccattctttccagaatcaacctagtattcattgtgctgtttaccggtgagtgtgtgctgaagctaatctccttgcggcattattactttaccatcggctggaatatctttgacttcgttgtcgtcatcctaagcatcgtggggatgttcctcgcagaattaattgagaagtatttcgtgtcgcctactctgtttcgcgtgattcgattagcaaggattgggagaatcctccggctaatcaaaggtgcaaagggaatacgaaccctgctgtttgcactgatgatgagcctgccagcactgtttaatatcggccttcttttattcttggtgatgttcatctacgccatattcgggatgtctaattttgcgtatgtcaagcgggaggttggcattgacgatatgtttaacttcgaaacattcggcaattcaatgatttgcctgtttcaaattaccacatctgcaggttgggatgggctgctcgcccccattctgaattcaaaaccacccgattgcgatcctaacaaggtgaatcccgggagcagcgtgaagggtgactgcggaaatccctcagtgggcatctttttcttcgtctcatacatcattatatcattcctagttgtggtgaacatgtacatcgcagttattctggagaacttctccgtagccactgaggagtctgccgagcccctatctgaagatgacttcgagatgttctatgaggtttgggagaagttcgatcccgatgcgacccagtttatggaatttgaaaagctcagtcagttcgccgccgctcttgaacccccacttaacctgccacagccgaataagctgcagctgattgctatggatctcccgatggtgagtggggataggattcattgcttggacatattatttgcctttacaaagcgagttttaggggagagtggggagatggacgcgctccgcatccagatggaggaaagatttatggctagcaatccctctaaagtgagttatcagccaataacaactacattaaaacggaaacaagaggaagtgtcagccgtgattatccagagagcatatcggcgacatctcctaaagaggaccgtcaagcaggcatcgttcacctataataaaaacaagatcaaaggcggtgccaacctgttgatcaaggaagatatgatcatcgatcgcattaatgaaaactccattacagagaaaacggacctcaccatgtcaactgctgcctgcccgccatcatacgatagggtcacaaagccgatcgtggaaaaacacgagcaagaaggtaaagatgagaaggccaagggcaaatag

SEQ ID NO: 205477 - DNA, 5946 bp, Artificial Sequence
  Description of Artificial Sequence: Synthetic coding sequence
atggagcagaccgtgctggtgccccccggccccgacagcttcaacttttttacacgcgagagccttgcagcgattgaaagacgcattgctgaggaaaaagctaagaacccaaaacccgataagaaggatgatgatgagaacggtccaaaaccgaattcagatctcgaggcggggaagaatctaccattcatctacggggacatccctcccgaaatggtaagcgaaccactggaagatttggacccctattacataaataagaagacgttcatcgtcctcaataagggaaaggcgatcttcagattctcggcaaccagtgcattatacatattgacccctttcaacccacttcgcaaaatcgccatcaagatcttagtccacagcctgttctctatgcttatcatgtgcaccatcttgactaattgtgtgttcatgacaatgagcaatccacctgattggacaaagaacgttgaatacaccttcactggaatatacaccttcgagtccctcatcaagatcatcgccagaggattctgtttagaggacttcaccttcctgagggatccatggaactggctggattttactgtaatcacatttgcatacgtcacggagttcgtggacttgggaaatgtgtcagcgctcagaacattccgcgtcctgcgcgctctgaaaactatcagcgtgattcctgggctgaagacaattgtgggggcccttattcagtcagttaagaagctttctgatgtgatgatactgactgtcttctgtttgtccgtgttcgccttaatagggttgcagctcttcatggggaacctgcgcaacaaatgcattcagtggccccccacaaatgcgagcctggaggagcacagcattgaaaaaaatatcaccgtgaactacaatggcactttaatcaatgagaccgtgtttgaattcgactggaagtcttacatccaggattctcgataccactatttccttgagggcttcctggacgctctgctgtgcggaaactctagcgacgctggacaatgccccgagggctatatgtgtgtaaaggcaggtcgaaaccctaactatggctatacatcatttgacacattctcatgggccttcctgagtctgttccgcctgatgacccaggacttctgggaaaacttataccaattgacactgagagccgctggcaaaacttatatgatattcttcgtgttggtgattttcctcggatctttctatctgatcaacctgattctggctgttgtggctatggcgtacgaagagcagaaccaagccactctggaagaggcagaacagaaggaagccgagtttcagcaaatgatagagcaactaaagaaacagcaggaggcagcacagcaggctgcaacagccaccgcctcagagcattcacgagagccgtctgctgccggccggctatcagactctagctccgaggcgtctaagctgagttctaaatctgcgaaggagaggagaaataggcgaaaaaagcggaagcagaaggaacagtcggggggagaggagaaggacgaagacgaatttcaaaaatccgaaagcgaagattcgataagacggaagggattcaggttttcaattgaggggaacagactgacatacgagaagcgatacagcagcccccaccagagtcttttatcaatcagagggtctttgttcagcccacggcgcaatagtagaacctccctcttcagttttcggggccgtgcgaaggatgtcggcagcgaaaatgatttcgctgatgacgaacactcaaccttcgaagacaatgaatcgagacgggattccctctttgtgcctaggcgacacggggaacgccgcaattcgaacctgagccagactagcagatccagcagaatgctcgcagtgtttccggccaacggaaaaatgcactctacagtcgactgcaacggagtggtctccttagggacaactactgagactgaaatgagaaagcgaagatcatcctcttttcatgtgagtatggattttttggaagatccaagtcagcgtcagagagccatgagcattgcatccattctcactaacacagtcgaggagctcgaggagtctagacagaaatgtcccccttgttggtataagttttctaacatctttctcatctgggactgctccccttactggctaaaggtgaagcatgtagtcaatctcgtggttatggatcccttcgtcgacttggccattacgatctgtattgtgctcaacaccctcttcatggccatggaacactatcccatgacagaccattttaataacgtgcttaccgtagggaatctcgtcttcacaggaatcttcactgctgagatgtttctgaaaataatcgccatggacccttattattattttcaggaaggatggaacatatttgatggctttatagttacccttagcttagttgaattgggactggccaatgttgaagggctgtctgtactccgctctttcagactcttgagagtatttaaactggcgaaatcatggccaacactgaatatgctcatcaaaatcattggcaactctgtaggtgccctcggtaatctcacactggttctagctatcattgtgtttatctttgccgtggtcggtatgcagttattcgggaagtcatacaaggactgcgtgtgcaagatagccagcgattgtcaactcccgagatggcacatgaacgactttttccattccttcctcatcgtgttccgggtcctgtgtggcgagtggattgagacaatgtgggactgtatggaggtagccgggcaagccatgtgtttaacagtattcatgatggtgatggtgatcggaaacctcgtggtgctgaatctgttcttggccctcttgctgtcctcattctcagctgataacttggctgccacagacgatgacaacgagatgaacaatctccagatcgccgtggaccgtatgcataaaggcgtcgcatacgtgaaaaggaagatatatgaatttatccaacaatcctttattcgaaagcagaaaattctggacgagataaaacccctggacgatcttaacaacaaaaaagattcctgcatgagcaatcacaccgccgaaattgggaaggaccttgactacttgaaggacgtcaacggtacaacgtccggcattggcaccggcagttccgtggagaagtatatcatcgatgagagcgattacatgtctttcattaacaatccctcccttacagtaactgtccccatagctgtgggagagagcgactttgagaacttgaacacggaggacttctcctctgaaagcgatttggaagagtccaaagagaaattgaatgaaagttcctcttcgtcggaggggtctacagtcgatatcggagcaccagtggaggaacaaccagtggtggaacctgaagaaaccctggagccagaggcttgctttacagagggatgtgtgcagagatttaagtgctgtcagattaatgtagaggagggcagaggtaaacagtggtggaatttaaggcgaacttgtttccggatcgtggagcacaactggtttgagacttttatcgtgtttatgattctcctatctagtggcgctctcgcctttgaggacatttatattgaccaacgaaaaactattaagaccatgctggaatatgccgacaaagtattcacctacatattcatcttggagatgctccttaaatgggtggcctatgggtatcagacttattttacgaacgcatggtgttggcttgatttcctcatcgtcgatgtgtcactggtttctctgacggccaacgcactgggctactcggaactgggagcaattaagtcccttcgcacgctccgggccctgcggcccctgcgggctttatccagattcgagggtatgagagtggtggtgaatgccctgttgggcgccataccatccataatgaacgtgctgctcgtctgtctcattttctggttgattttctcgatcatgggggtcaacctgttcgctgggaagttttatcactgtataaataccacaacaggggacaggttcgatatcgaggacgtgaacaaccatactgattgtttaaaactcattgagagaaatgaaaccgctaggtggaagaacgtgaaagtgaactttgacaatgtcggattcgggtacctgtcgctcttacaggtggccaccttcaagggatggatggatattatgtacgccgccgtggattctcgcaacgtggagctgcagccaaagtacgaggaatccctgtacatgtatctgtattttgtcatatttataatcttcggctctttcttcaccctgaatctctttataggagttatcattgacaatttcaatcagcagaagaaaaagtttggcggacaggatatctttatgaccgaggagcaaaaaaaatattataatgccatgaagaaactgggcagcaagaagcctcagaagccgatccctagaccaggaaataagttccagggcatggtgttcgactttgtgacgagacaagtgtttgatatatcaatcatgattctcatttgtctgaatatggtcactatgatggtcgaaacggatgatcagtctgagtacgtaacgaccattctttcacgcataaatcttgtgttcattgtgttgttcactggcgagtgtgttctgaaactcatcagcctacgccattactacttcaccatcggttggaatatcttcgacttcgttgtggttatattgtctatcgtggggatgtttctcgctgaactaatcgagaagtatttcgtgagccctaccctgttccgtgtgatcagactggctcgcattggacgaatcctgcggcttattaaaggtgctaaaggtattcgcactctcctgtttgcactgatgatgtctctacccgccttgtttaatattggcctcctgctcttcctggtcatgttcatctacgccatcttcgggatgtcaaactttgcctacgtgaaaagagaagtgggcatagatgatatgtttaatttcgaaacttttgggaatagcatgatttgcctgtttcagataacaacctccgctggttgggacgggcttctggcccctatcttaaacagtaagccgccggattgtgaccctaataaagtcaatccagggtcgtccgtcaagggagactgcgggaacccttccgtaggcatttttttcttcgtttcctatataatcattagctttttggtggttgtgaatatgtacatcgcagtcatcctagaaaacttttcagttgcaactgaggaaagcgccgagcccctttctgaggatgactttgagatgttttatgaggtgtgggaaaagttcgaccctgatgcgacacagttcatggagttcgagaaactgtctcagtttgctgcagcactggaacccccgctcaatctgccccagccgaataagctgcagttgattgcaatggacctccccatggtctctggtgatcgcatccactgtctggacatcctgttcgcttttaccaagcgggtgcttggggaaagcggggagatggacgcactgcggattcaaatggaagaacgcttcatggcctctaacccaagtaaggtctcctatcagcctataaccactactctaaaaaggaagcaggaagaggtgtcagccgtgatcattcagcgggcttaccgccggcatctgctcaaaaggaccgtcaaacaagcgagtttcacttacaacaagaacaagataaaaggcggcgccaatcttctcatcaaggaagatatgattatcgataggattaacgaaaacagtattacggaaaaaacagatctgactatgtctacagcggcttgcccaccttcttacgaccgagtgaccaaaccaatcgtggagaaacacgagcaggagggaaaagacgagaaagccaaaggcaaatag

SEQ ID NO: 205478 - DNA, 6030 bp, Artificial Sequence
  Description of Artificial Sequence: Synthetic coding sequence
atggagcagaccgtgctggtgccccccggccccgacagcttcaacttcttcacgcgggaatcccttgcagcaattgaacggagaatcgctgaagaaaaagccaaaaaccctaagcctgataaaaaggatgacgacgaaaatggacctaagccaaattcggatctggaagcaggaaagaatttaccttttatttacggtgacatcccacccgagatggtttccgaaccccttgaagatctggatccatattacatcaacaaaaagaccttcatcgttctcaacaaaggcaaagctatcttccgattttcagccacttcagccctgtacattctgacccccttcaacccattgaggaaaattgctatcaagattctggttcatagtctattcagcatgctgattatgtgtactatcctcacaaattgtgtgttcatgaccatgtctaatccccccgattggacgaaaaacgtcgaatacaccttcacgggcatctacacctttgaatcacttatcaaaatcattgcccgagggttctgtctcgaagactttacattcttgcgcgacccttggaactggttggatttcacagtcattacctttgcctatgtgaccgagtttgtagacctggggaatgtcagtgccctgcggaccttcagagtcctgagagcgctgaaaacaatatctgtcattccagggctgaaaacaatcgttggagctctaatccaaagcgttaagaagctttccgacgtcatgatactgaccgtgttctgcctgagtgtgttcgctcttatcgggcttcagctgttcatgggcaatctgcgaaataaatgtatccaatggcctccaaccaacgccagtctcgaggaacacagtatcgaaaagaatattaccgtcaattacaacggcacccttatcaatgagaccgtttttgagtttgactggaaaagctatatccaggattccaggtaccactattttctcgagggcttccttgacgctctactgtgcgggaactcgagcgacgccggccagtgccccgagggttacatgtgtgtaaaggcaggcagaaatcctaactatggatataccagcttcgatacatttagctgggcgtttctgagtctgttcaggctcatgacacaagatttctgggagaatctatatcagctcacactccgggctgccgggaaaacgtacatgattttcttcgttcttgtgattttcctgggctcattttacctgattaatttaatcctcgcggtggtggcaatggcatacgaagagcagaaccaagcaacgttagaggaagcggagcaaaaagaggccgagtttcagcagatgatcgaacagttgaagaaacagcaggaggcagcccagcaggctgcaacagcaactgcctccgaacactcccgggagccctcagccgcaggccgtctttctgacagtagtagtgaggcaagcaagctgagtagtaaaagtgccaaagagcggcgtaatcggcggaagaaacgtaaacagaaagagcagtcgggtggggaagagaaggatgaggacgagtttcaaaaaagcgagtctgaagatagcatccgcagaaaaggatttcgattttcaattgaggggaatagactcacttacgaaaagcggtatagcagtccacatcagagccttctttctattaggggctccctcttcagccccaggagaaactctaggacgtccctattttcctttagaggtagggccaaggacgttggttcggaaaacgattttgctgatgatgaacactccacatttgaagacaacgagtcaaggcgggatagtctctttgtgcctaggcggcacggagaaaggcgcaacagtaacctgagccagacatccagaagcagcaggatgctcgccgtgtttcccgccaacggtaagatgcactcaactgtcgattgcaacggagttgtgtcactggtgggtggtccaagtgtgcctactagccctgtgggccaactactgcccgaagttattattgataaacccgccaccgacgataacggaacaaccacagagaccgagatgcgaaagaggcgttcttctagctttcatgtttccatggatttccttgaggacccatctcaacgccaaagagctatgagcatagcttcaatcctaactaacacagtggaggaactggaggagtctaggcagaaatgtcccccgtgctggtacaagttcagcaacattttcctcatatgggattgttctccgtactggctgaaagttaagcatgtcgtgaacctcgtggtgatggacccattcgttgatctcgccattaccatatgcatcgttctgaacacccttttcatggccatggaacactaccctatgactgaccactttaataacgtgttgactgtcggcaatctggtcttcaccggcatcttcactgccgaaatgtttctcaaaattattgcgatggacccttactactattttcaggagggctggaacatttttgatggctttatcgtgaccctgagcctcgtggaactgggactggcgaacgtggaaggtctctccgtgctgaggagtttcagattactgagagtgtttaagctggcgaagagctggccaaccctgaatatgctcataaaaatcatcggtaactctgtaggcgccctgggcaatttaacacttgtgctcgcaatcattgtgttcatttttgcggtcgtgggcatgcagctattcggaaagtcatacaaggattgcgtgtgcaagatagcctccgactgtcagctgccaaggtggcacatgaacgactttttccattcctttctaatcgtgtttcgcgtgctctgtggagagtggatcgagacaatgtgggactgcatggaggtcgccggtcaggccatgtgcctgaccgtctttatgatggtcatggtgattggcaatctcgtcgtcttgaacctttttctcgctctcctgctttctagcttcagcgccgacaatctggccgccacagatgatgacaatgagatgaataacctgcagatcgccgtggaccgcatgcataagggcgtcgcttacgtcaagagaaagatctatgaatttattcagcaatcgttcattcgtaaacagaagatactggacgagatcaaaccactggacgacctgaacaacaagaaggattcgtgcatgtctaaccataccgctgagattggtaaggacctggactacctgaaagatgtgaacggaaccacctctgggatagggacaggttcgtcggtggagaaatacatcatcgatgaatcggactacatgtctttcattaacaacccttcgcttaccgtcactgtgccaattgccgtgggtgagagcgattttgaaaacctgaacaccgaggatttctctagtgaatcagacctcgaagaatccaaggaaaagctaaacgagtcctcatccagcagcgagggaagtacagtggacattggcgctcccgttgaagagcagcctgtcgtggagcctgaggaaactctagagccagaggcatgcttcactgaaggctgcgtacagagattcaagtgctgccagatcaatgttgaagaggggagaggtaaacagtggtggaacctgaggcgcacctgctttagaattgtggagcataattggttcgagacattcatcgtattcatgatattgctctcctccggagcactggccttcgaggatatatacatcgatcagaggaagacaattaaaactatgctggaatacgcggacaaggtgtttacatacatctttattctggaaatgcttctgaaatgggtagcctacggatatcagacctattttacgaacgcatggtgttggctcgatttcctgatagttgatgtcagccttgtgagcctgaccgccaatgctctcggttatagcgaacttggcgccattaaatcactgcgaaccctcagagctctccgacccctgcgtgcattgtcccggttcgagggtatgagagttgtggtcaacgctttactcggcgcaattccaagcattatgaacgtgctgttggtttgtcttattttctggttaatcttcagtattatgggagtgaaccttttcgccggcaagttttatcactgcatcaacacaacaaccggcgatcgttttgacatcgaggacgtgaataaccacacggattgcctcaagcttatcgagagaaacgagactgcacgttggaagaacgtgaaggtgaacttcgataacgtcggcttcggctacctatctctactgcaggttgccacgttcaaggggtggatggacataatgtacgccgccgtggactcaagaaacgttgagctgcagcccaagtacgaggagagcctgtatatgtatttgtatttcgtcattttcatcattttcggatctttttttaccttaaatttgtttataggagtgatcatagataactttaaccagcagaaaaagaagttcggcggacaggacatctttatgactgaagagcagaaaaagtattataacgccatgaagaaattgggctctaaaaagccacagaagcctataccacgacctgggaacaagtttcagggaatggtgtttgatttcgttacccggcaagtgtttgacatatcaatcatgattctcatctgcctgaatatggtgacaatgatggtggaaaccgatgatcaatcagaatacgttaccaccattcttagtcgaattaacctggtctttattgtgctgtttaccggcgagtgtgtgttgaaactcatttccttaaggcattactatttcacaattggttggaatatctttgattttgtcgtggtgatcctaagcatagtaggtatgttcctcgcagagctgattgaaaaatacttcgtcagtcctacattgttccgtgtaattcggctggccaggattggtcgaatcctgagactgatcaagggcgcaaagggtatccgaacccttctcttcgctttaatgatgtcgcttcccgcactgttcaatatcggcctgctgttgtttctcgttatgttcatttacgcaatcttcgggatgtctaatttcgcttacgtaaagcgcgaagtgggcatcgacgacatgttcaacttcgagactttcggcaactcgatgatttgcctgtttcagatcactacaagtgccggatgggacggactgctggcccccatactcaactctaagccaccagattgtgaccccaataaggtgaatcccgggagttccgtgaagggggattgcgggaatccttcagtcggaatcttttttttcgtgagctacataatcattagctttctggtggtggttaacatgtatatcgcagtcatcctggagaatttttctgtagccacagaggagtctgcagagcctctgagtgaagatgatttcgagatgttttacgaagtttgggaaaaattcgacccggatgccactcagttcatggaattcgagaagctctcacagttcgcagcagctttagagccaccattaaacctaccacaaccaaataagctgcagttgattgcaatggacctcccgatggtgtcaggcgatcgaattcactgcctcgatattttgtttgcttttaccaaaagggtgctgggagagagtggtgagatggacgcgctccgtatacagatggaagaacgctttatggccagcaaccccagtaaggtctcttatcaaccaatcacaacaactctgaaaagaaagcaagaagaggtgtctgccgtgattattcagcgcgcatatcggcgacatctccttaagcgaaccgtgaaacaggcctctttcacttataataagaacaaaattaaaggaggcgcaaacctgctgatcaaagaggacatgataatcgatcgtattaacgagaacagcatcaccgagaaaactgacctgaccatgtctacagccgcctgtcctcccagctacgatcgggttacaaagcccatcgtagagaaacatgagcaggagggcaaagatgagaaggcgaagggcaaatag

SEQ ID NO: 205479 - DNA, 657 bp, Artificial Sequence
  Description of Artificial Sequence: Synthetic coding sequence
atgggccggctgctggccctggtggtgggcgccgccctggtgagctcagcctgtggcggttgtgttgaagtggactctgagacagaggccgtctatgggatgaccttcaagattctctgtatttcatgtaaaaggcggtcagagaccaacgctgagacctttaccgaatggacatttcggcagaaaggtacagaagagttcgtgaaaatcctccggtacgaaaacgaagtcctgcagttggaagaagacgaaaggttcgagggccgcgtcgtgtggaacgggtcaagaggcactaaagacttgcaggatctatcaatctttatcaccaacgtgacttacaatcacagcggcgattatgagtgtcacgtgtacaggctgctattcttcgagaattacgaacacaacacgagtgttgtcaagaagatccacatagaagtggtggataaggctaatcgggatatggcaagcatcgtctcagagattatgatgtacgttcttattgtggtgctcacgatctggcttgtggccgagatgatctactgctataagaagattgcggcagccaccgaaaccgccgctcaggagaatgcttcggaatacttagcgatcacttctgaatcgaaggaaaattgtaccggggtgcaagtcgctgagtag

SEQ ID NO: 205480 - DNA, 807 bp, Artificial Sequence
  Description of Artificial Sequence: Synthetic coding sequence
atgggccggctgctggccctggtggtgggcgccgccctggtgagctccgcgtgcggcggatgcgttgaggtcgacagcgaaacggaggctgtgtatgggatgacatttaagatcctgtgcataagttgtaaaaggagatccgagacaaatgccgaaactttcaccgagtggacctttaggcaaaagggaaccgaagaatttgtgaagattctcaggtacgaaaatgaagtgttgcagcttgaggaggacgagaggttcgaagggagggtggtctggaacgggtctcgaggaactaaggatctgcaggatctctccatttttatcaccaatgttacgtacaaccattcgggggactacgagtgccatgtatacaggctcctgttctttgagaactatgagcacaacactagcgttgtgaaaaagatccatattgaagtagtcgataagggagaatctggggctgcatgcccctttacagtgacccaccgccgtgcccgctggagggacagatggcaagcggtggacaggactggctggttgtgtgcctggcccgcgaatcgaccccagcagagagccgagggggaaggaagctcccccagctgcccactccagctttggccgttgtttctgtccagcccaagacggggtcagagcatgccagtgcctcacaggcgctcaggatataggacccagctgtgccacctctgctgcatgactagtgggcggtgcctcttgagtttgtcccagagagtagttttgggtttacctggcatcatcatccggtgtgtatctcgcggtgtggtgtag

SEQ ID NO: 205481 - DNA, 6018 bp, Artificial Sequence
  Description of Artificial Sequence: Synthetic coding sequence
atggcccagagcgtgctggtgccccccggccccgacagcttccggttcttcactcgcgaaagtctagcagccattgagcagaggatcgcagaagagaaagccaagcgcccgaagcaggagcggaaggatgaggacgatgaaaacgggccaaagcctaattcagacctggaggccggcaagtccctgccattcatctacggagacattccccctgagatggtttcagtgccgctcgaggatctcgatccgtactacatcaacaaaaaaaccttcatagttctaaacaagggaaaagccatttctagattcagcgccacacccgccctgtacatactcacgccatttaatcctatcagaaaactcgcaataaagattctggtccacagcctttttaacatgctcattatgtgcactatactcaccaactgtgtattcatgacaatgagcaaccccccggactggaccaaaaatgtggaatacactttcacaggcatttatacttttgaatctctcattaaaatcttagcccggggcttttgcttagaggactttacttttctgcgcgatccctggaattggctggatttcaccgtgataacattcgcctacgtgaccgaatttgtggatctggggaatgtatcggcactgcggacctttcgcgtccttcgagcactgaagaccatcagtgtgattcccggcttaaagacaatcgtcggagccctgatccaatctgtcaagaagttgagtgacgtgatgatactgacagtgttttgcctgtccgtctttgccctcatcggcttgcaactgttcatgggaaatttgcggaataagtgtctgcagtggcccccagataactcctccttcgagattaacatcaccagcttttttaataattccctggatggcaacggcacaacctttaatcggacggtttctatttttaactgggacgagtacattgaagacaaaagccatttctatttcttggaggggcagaacgacgctctgttatgcggtaacagtagcgacgcgggtcagtgccccgaagggtatatttgcgtgaaggccgggcgaaatcctaactatggttataccagttttgatacattctcctgggcatttttatcactgttcaggctgatgacacaggacttttgggaaaacttgtaccagctgacactgcgcgcggcaggcaagacctatatgatttttttcgtccttgtcattttcctgggctccttctatctaataaatttgatccttgcagtggtagctatggcatacgaggagcagaatcaggcaacgttagaagaagcagagcagaaggaggccgagtttcagcaaatgttagagcaactgaaaaagcagcaggaagaagcacaagcggccgctgccgctgcctctgctgagagccgggacttcagcggtgctggggggatcggagtcttctcagagagcagttcagttgcctccaaactgtcaagcaagtccgaaaaggagttaaaaaaccgaaggaagaagaagaagcaaaaggagcaaagtggagaggaggagaagaacgatcgagttcgcaaatcggaatccgaagacagcattagacgcaagggcttccggttctcacttgaggggagccgtctaacatacgagaaaaggttcagttctccccatcagtccttgctgagcattagaggatcattattcagccccagaaggaacagtcgcgctagccttttttcattcagggggcgcgccaaagacatcgggtctgagaatgactttgccgacgacgagcacagcacctttgaggataacgactctaggagggacagcctctttgtgccccaccggcatggcgagcgccgccactccaatgtgtcccaggcgtcacgggcgtcccgcgttctgcccatacttccgatgaacggcaagatgcactctgcagtggattgcaatggtgtggtgtccctggtgggcggcccttctacactgacaagcgctgggcaactcctcccagagggtaccactacagagactgaaattcggaagaggcgctccagcagttatcacgtgtctatggacctgctggaagatcccacctcgcggcagagggcaatgtcaatcgcttctattctgacgaatacaatggaagagctggaggagagtcggcagaagtgccccccgtgttggtacaaattcgctaacatgtgtcttatttgggattgctgcaagccctggttaaaagttaaacatctcgtcaacctcgtcgtcatggacccttttgtggatcttgcgattacaatctgcatcgtcctgaacactttgtttatggctatggagcactatccaatgacagaacaattttcatccgtcctatctgttgggaacctagtgttcactggcatcttcacagctgagatgttcctgaagatcattgctatggatccctattattatttccaggagggctggaacattttcgatggtttcattgtgagcctctccctcatggaactcggcttggccaatgtcgagggcctgagtgtgttgagatccttccgcctgctgcgcgtcttcaaactcgccaagtcctggcctacactgaacatgctgattaaaatcatcgggaatagcgttggcgctctcggcaatctgaccttggtgttggctatcattgtcttcatttttgctgtggtggggatgcagctgttcgggaagtcctacaaagaatgcgtgtgcaagatatcaaatgattgcgaactgcctcgatggcatatgcacgactttttccacagctttctgatagtgtttcgggtgctctgcggagaatggattgaaacaatgtgggactgtatggaggtggcgggacagacgatgtgccttacggtttttatgatggttatggtgattggtaacttggtggtgttaaatctctttctagccttgctccttagtagcttcagctctgacaacctagccgcaacagacgatgacaacgaaatgaataatctgcaaatagctgtgggtaggatgcagaaggggatcgattttgttaagcgtaaaatccgggagtttatacagaaggctttcgtccgcaaacaaaaggccctggacgagatcaagccgctggaggacctgaacaataaaaaggatagttgtattagtaaccacacgacaatagaaataggaaaagacctgaactatttgaaggatgggaacgggaccacatcaggaattgggagtagtgttgaaaagtatgtggtggatgagagcgactacatgtcattcatcaataacccctcactgaccgtgacagtgcccattgccgtaggcgagtccgactttgagaaccttaacacagaggagttctcttccgagtcagacatggaggaatccaaggagaagctgaatgctacgagttcttcagagggatcaaccgtggacattggtgcaccagcagaaggcgaacagcccgaagtggaacctgaggaaagcttggagccagaagcatgtttcactgaagactgcgtgaggaaattcaagtgctgtcagataagcattgaagaaggtaagggcaagctttggtggaacctgaggaaaacatgttacaagatcgtggaacacaactggtttgaaactttcatcgtctttatgatccttctcagctccggcgcactggccttcgaggacatttacatcgagcaacgcaagaccatcaagacgatgctcgagtatgcagataaggtcttcacctatatcttcatcctcgaaatgctcttaaagtgggtggcgtacggattccaggtgtattttacaaacgcttggtgctggctcgactttctgattgtagacgtgtcattagtgtcgttgaccgctaatgcccttgggtactctgaactgggtgcaataaagtctctgaggaccttacgtgctctcaggccattgcgcgctctcagtcggttcgaaggcatgcgagtggttgttaacgccctgctgggtgccatccctagcatcatgaatgtgctgttagtttgtctcatattttggcttatcttctccatcatgggtgtgaatctcttcgctgggaagttctatcattgtatcaactacacaaccggagaaatgttcgatgtgagtgtagttaacaattacagtgaatgtaaagctctgattgaatctaatcagacagctcgctggaagaatgtgaaggtaaattttgataatgtgggcctcgggtatttgtcgctgctccaagttgccaccttcaagggctggatggacatcatgtatgccgccgtggatagcaggaatgttgaactccagcctaagtacgaagacaacctgtatatgtatctctacttcgtgatcttcatcattttcggatcttttttcacactgaacctgttcatcggcgtaattatagacaatttcaaccagcaaaagaagaagtttggaggccaggacattttcatgacagaggaacaaaaaaagtattacaacgccatgaagaagctgggcagtaaaaagccccagaagcccatccctcgaccggcaaataagtttcagggtatggtatttgacttcgtgaccaagcaggtatttgatatatcaatcatgattctgatatgtctaaacatggtgacgatgatggtggagactgatgaccagtctcaggagatgaccaatattctctactggattaatctagtatttatcgttttgtttaccggagagtgcgttctgaagctgatcagtctgcgatattactactttacaatcggttggaacatctttgacttcgtagtggtgatcttatctattgtgggaatgtttctggcagagctcatcgagaaatactttgttagccctacgcttttcagggtcattcgcctcgctcgaattggccgtatactgcgactaattaagggtgctaaggggattagaaccctccttttcgcccttatgatgtctctgcctgctcttttcaatataggccttctactgtttctggtcatgttcatttacgccatcttcggaatgagcaatttcgcatacgtgaaaagggaggtgggaatagatgacatgttcaattttgagactttcggcaatagcatgatctgtttatttcagataaccacatcggcaggctgggatgggctgctggcccctatcttgaacagcggccccccagattgtgatccagacaaggaccatcctggctccagtgtgaagggcgactgtggaaaccctagtgtgggcattttcttctttgtgagttacattatcatctctttccttgtcgttgtgaatatgtatattgccgtcattctagagaacttctctgtggcgacagaggagtccgcggagcctctctccgaggatgattttgagatgttttacgaagtttgggagaaattcgatcccgacgctacacaattcatagagttcgccaaactctcagatttcgcagatgcactggacccaccactgctgatagcaaagccaaacaaggtgcaactcatcgcaatggacttgccgatggtgtccggagataggattcattgtttggatatcctattcgccttcaccaagcgcgtcctgggggaatcaggcgaaatggacgcactgcgtattcagatggaagagcgctttatggccagtaacccttctaaagtcagttacgaaccaattactacgacattgaagcgcaagcaggaggaagtgagtgccatcatcatccaacgggcctatcgcagatacctgttgaagcaaaaagtcaaaaaagtctcttcaatatataagaaggataaaggaaaggagtgcgatggcacgccaattaaagaagacactctgattgacaagctgaatgaaaacagcacgcccgaaaaaaccgacatgacaccaagtaccacgtcaccaccatcctatgattctgttactaaaccggaaaaagaaaagttcgaaaaggacaagagcgagaaagaggataagggtaaggatatcagagagtctaaaaaatag

SEQ ID NO: 205482 - DNA, 6018 bp, Artificial Sequence
  Description of Artificial Sequence: Synthetic coding sequence
atggcccagagcgtgctggtgccccccggccccgacagcttccggttcttcacacgggagagtctcgccgctatcgagcaacggatcgctgaggaaaaagcaaagagacccaagcaggagagaaaggatgaagatgatgaaaacggcccaaagcctaatagcgacctggaggcaggtaagtcattaccctttatctatggagatatcccccctgagatggtttctgtccccttggaagacctcgacccatattacattaacaaaaaaacatttattgtgctgaataaagggaaggcgatttctaggttctctgctacccccgcgctctacatacttaccccattcaatccaatcaggaaactcgctatcaagatcttagtgcatagcctgttcaacatgttgataatgtgcacgatcctgactaactgcgtgttcatgaccatgtccaatccccccgactggaccaagaacgtggaatatacttttaccgggatctacacttttgaaagtctgatcaagatcctggcacggggattttgtcttgaagattttacattcctccgggacccttggaattggctggattttaccgtaatcacgtttgcctacgtcacagagttcgtaaatctgggcaatgtgtccgctctgagaacattcagggtgctgcgggcactgaagacaatttccgtcatccctgggttgaagaccatcgtgggcgctctgatccagtcagtaaagaagctgagcgacgtgatgattctcacagtgttttgtctatctgtctttgccttgatcgggctccagctgttcatggggaaccttcgtaataagtgtctccaatggccccctgacaattcttcctttgagattaacattaccagttttttcaataattccctcgacggaaatggaactacatttaatagaacagtttccatctttaattgggatgaatacatcgaagataagagtcatttttactttttagaaggacagaatgatgccctgctgtgcggaaacagctccgacgcagggcagtgtccagagggctatatctgcgtcaaggcagggcgtaacccaaactacggatataccagcttcgacacgttctcctgggccttcctcagcctttttcgtctgatgacccaggacttctgggagaacctgtaccagcttaccctccgagctgctgggaagacgtacatgatattcttcgtcctggtgatcttcctggggtccttctacttgatcaacctcatcctcgccgtcgtcgctatggcttatgaggagcagaaccaggccacactggaagaggctgaacagaaggaagcagagtttcagcaaatgctggagcaacttaagaaacagcaggaagaagcccaggctgcagccgctgctgcctccgccgaaagccgcgacttctccggcgcaggcggtatcggcgtcttttccgagtcatccagtgtggcctcaaagctatcaagtaaaagtgagaaagagttgaaaaatcgacgtaagaaaaaaaaacaaaaggaacagtctggcgaagaggagaagaatgatagggtccggaagagcgaatctgaagatagtatccgcagaaagggcttccgattttccctggaaggatcacggctcacgtatgaaaagcggttctcgtcccctcatcagtcactgcttagcatcagaggtagcctgttttctccacggaggaactcaagagccagcctcttctcatttcgcggccgtgccaaagatattgggagcgaaaacgacttcgctgatgatgagcactctaccttcgaagacaatgactctcgccgagactcattgttcgtaccacataggcacggcgaaagacgccattctaacgtcagccaagcaagtagggccagccgcgttctgccaattctacccatgaatggcaaaatgcattcagctgtggactgcaatggtgtcgtcagcctggtgggagggccatcaacgttaacaagtgccggacagctgctccccgagggaacaacaaccgagactgagatcaggaagcggcgatccagcagctaccatgttagcatggacctcctcgaggatccgacctctcggcaacgggctatgagcatagcttccatcctcaccaacactatggaggaactggaggagtctaggcagaaatgtccgccatgctggtacaagtttgctaacatgtgtctgatatgggattgttgtaagccttggctgaaggttaaacacctcgtgaatttggttgttatggatccattcgtggacctggccattactatttgcatcgtgctaaatacactgtttatggcaatggagcactatcccatgaccgagcaattcagcagcgtcctgtctgtgggcaaccttgtttttacaggtatatttaccgcagagatgtttctgaagatcattgccatggacccctactattacttccaggaggggtggaacatctttgacggcttcattgtgtctctctccctgatggagctagggcttgcaaacgtcgaaggtctgagtgttctgaggagtttcaggctgctgcgagttttcaagctcgcaaaaagctggccgacactgaacatgctgatcaaaatcattgggaatagcgtaggtgccctcgggaatcttacactggtgctggctattatcgtgttcattttcgcagtggtgggaatgcagctgttcgggaagagctataaggagtgcgtctgtaagatctcaaatgactgcgagctgcctcgctggcacatgcatgatttctttcattcctttctcatcgtgttcagggtgctgtgtggagagtggatcgagacaatgtgggactgcatggaagtggccggacagacaatgtgtctgaccgtgttcatgatggtaatggttattggaaacctggtcgtgctcaatctcttcctggccctgcttctctcaagtttctccagcgataatcttgcagctactgatgacgacaatgaaatgaacaatttgcagatcgccgtgggcagaatgcagaaaggcattgattttgtgaaacgaaagatccgggaatttatccagaaggccttcgtcaggaaacaaaaagccctggatgagattaagccgctggaagatctgaacaataaaaaggatagctgtatctcaaaccacaccacaatagagatcggcaaagacctgaattatctaaaggatggtaatggaaccaccagtgggatcggctcaagcgtggaaaaatacgtggtcgacgaatcggattacatgtccttcattaataacccatcactcacagttaccgttcctatcgccgtgggagagtccgacttcgaaaatctgaatactgaggaatttagcagtgagtctgacatggaagaatccaaggagaagttgaacgcaacttctagcagtgagggaagcacagtggatattggggccccagccgaaggtgaacagccggaagtggagcccgaggaaagcttagagccagaagcctgtttcaccgaagactgtgtacggaaatttaagtgctgccaaattagcattgaggaaggtaaaggtaagttgtggtggaacctcaggaaaacctgctacaaaattgtagagcataactggttcgaaaccttcattgtcttcatgattcttctctcttcgggggctctggcctttgaagatatctatattgaacaacgaaaaaccatcaaaaccatgttagagtacgccgataaagtgtttacctatatcttcattctggagatgctgttaaaatgggttgcatacggcttccaggtctacttcactaatgcttggtgttggctagattttttgattgtggacgtctctctggtctctctgacggccaatgcgctgggctattctgagctaggagctatcaagagcctgagaaccctgcgggcactcaggccgcttcgagccctgtccaggttcgaaggcatgagagttgtagtaaatgctctgttgggggctatccccagtatcatgaacgtgcttctcgtctgtctaattttttggctcattttttccatcatgggcgtgaatctgttcgccggaaagttctatcactgcatcaactacactactggggaaatgtttgatgttagcgtggtgaataattatagcgagtgtaaggccctgatcgaatcaaatcagacagcgcgctggaagaacgtgaaggtgaactttgataatgtcggactgggatacttaagcctattgcaggtcgccacgttcaagggatggatggacattatgtacgccgctgtggacagtcgcaatgtcgaactgcaacccaaatacgaggataacctgtacatgtatctgtattttgttatatttatcatatttggcagcttctttaccctcaacctctttatcggcgtgatcatcgataattttaatcagcaaaaaaaaaagtttggcgggcaggatatcttcatgactgaggagcaaaaaaagtactacaacgcgatgaagaagctgggcagtaagaagccacagaaacctatcccaagacccgcaaataaatttcaagggatggtgtttgattttgtaactaaacaagttttcgatatatcgattatgattcttatctgcttaaacatggtgacaatgatggtggaaacggacgatcagtcccaggaaatgacgaatatcctgtattggattaatctggtgtttatcgttttgttcaccggagagtgtgtcctcaaacttatctctctgagatattattatttcacgatcggctggaacattttcgactttgtagttgtcattctgtcaattgtgggcatgttcctcgctgaactgatcgaaaagtacttcgtgtccccgaccctttttagagttatccggctggctcgaatcggtagaattctaaggctgatcaagggagccaaaggaatccgcaccttgctctttgcgctgatgatgagtctgcccgctctgttcaatattggtctgctgctgttcttagtgatgttcatttacgctatcttcggcatgagtaatttcgcgtatgtgaaaagggaggtgggcatcgacgacatgtttaattttgagacttttgggaacagcatgatatgcttgttccagataaccacaagcgctggctgggacgggttacttgccccgattcttaactccggcccacctgattgcgacccagataaggatcacccaggtagtagtgtgaaaggtgactgtggtaatccatctgttggcatttttttttttgtgtcttacataatcatcagctttcttgtggtggtgaacatgtatatcgccgtcattctcgagaacttttcagttgcaaccgaggaatctgctgaacctctttccgaggatgattttgagatgttctacgaggtctgggagaaatttgaccctgacgccacacagttcattgagttcgctaagctaagcgacttcgccgacgccctggacccgcctttactgattgccaagcctaataaagttcagctgatagccatggaccttcccatggtgagcggtgataggatccactgtctggacatccttttcgcattcacaaagcgagtgctcggcgaaagtggggagatggacgcactccgcatccagatggaggagaggttcatggcctccaacccatctaaagtgtcctatgaacccatcacaaccaccctgaagcgaaagcaggaggaagtttccgctataatcatccagcgggcatatagaagatatctgctgaagcagaaggttaaaaaagtcagtagcatctacaagaaagataaaggcaaagaatgtgacggcacaccgattaaggaggatactctgattgacaagttgaatgagaacagcactccagagaagactgacatgacgccctccactaccagtccgccctcctatgacagcgtgactaagcccgaaaaggagaaatttgagaaggataaatctgagaaagaagataaaggtaaagacatcagagaatctaaaaaatag

SEQ ID NO: 205483 - DNA, 6018 bp, Artificial Sequence
  Description of Artificial Sequence: Synthetic coding sequence
atggcccagagcgtgctggtgccccccggccccgacagcttccggtttttcacacgggagtcacttgcagccattgagcagcgcatcgccgaagaaaaagcaaagagaccaaaacaggagcgaaaggacgaggacgacgaaaatggccccaaacctaattcagacctcgaggccggtaaatcactcccgtttatctacggcgacattcctccagagatggtctctgtgcctctcgaggacttagatccttactacatcaataagaagacattcatcgtgctgaacaagggtaaggcgatatctcgcttctcagccacacccgccctgtatatcctgacaccttttaatcctatcaggaaattggctatcaaaatcttagtgcatagcctgtttaacatgttaatcatgtgcaccattttgacaaattgtgtttttatgaccatgtcgaacccccccgattggaccaagaatgtggagtatacttttaccggcatttacacctttgaaagcctcattaaaattctcgctagagggttctgtcttgaggactttaccttcctccgggacccatggaactggctggactttaccgtcattactttcgcctatgtcaccgagttcgtgaacctcggcaacgtttctgcacttcgtaccttccgagtgctccgtgcgttgaaaaccatcagtgtcattcctggactaaagactatcgtcggtgccctgatccagtccgttaaaaagctatccgacgtaatgatcttaacagtcttctgcctttcagtgttcgccctcattggcctgcagctcttcatggggaacttgagaaataagtgcctacaatggcctccagataattcctcctttgaaatcaacatcacaagcttcttcaacaatagcttggatggtaatggcaccactttcaatcgaacggtgtccattttcaattgggatgagtacattgaagacaaaagccacttctactttttagagggacaaaacgatgcactcttgtgtgggaatagctctgatgctggtcaatgtcctgaagggtacatatgcgttaaagctggtaggaaccccaattacggttacacctccttcgacaccttctcatgggccttcctgagccttttccgcctcatgacacaggacttctgggaaaatctctatcagttaactctaagggccgccgggaagacctatatgattttttttgtcctggtcatcttcctcggcagtttctatctgatcaatctgatccttgccgtagttgccatggcgtacgaggaacagaaccaggccacactggaagaggctgagcaaaaagaggccgaattccagcaaatgctggagcagctaaaaaagcagcaggaggaggctcaggccgccgccgcagctgcctctgctgagagccgagacttcagcggagcaggggggataggcgttttttccgagtcatcaagcgtggcctcaaaactgtcaagtaagtccgaaaaagagcttaagaatcgacgcaaaaaaaaaaagcagaaagaacagtcaggtgaagaggagaagaacgaccgtgtccgaaaatcggagagtgaagatagtatcagacggaagggcttccgattcagcctagaaggctctcggctcacatatgagaagcgcttctctagtccccaccagagcttgctgtcgataaggggaagtctcttttcaccgcgcagaaactctcgggcttccctctttagttttagaggcagagcaaaagacatcggcagcgagaatgacttcgctgacgatgagcactctacgttcgaggataacgattccaggagggacagccttttcgttccgcatcgacatggagagcgacgacattctaatgtgagtcaggcctcccgggcgagtcgggtcttgccgattctgcctatgaatggcaaaatgcactcagctgtggactgtaacggcgtagtgagtctagtgggaggccctagtactctgacttccgccggacagttattaccagagggcactacgactgagacagaaataaggaagcgccggagttcctcatatcatgtcagcatggacctgttggaagatcccacttcaaggcaaagggcgatgtcaatagcttccatactgacaaatactatggaggaattggaggagagtagacagaagtgcccaccctgttggtacaaatttgccaacatgtgccttatatgggactgttgcaaaccatggctgaaggtgaaacaccttgtcaacttggttgtgatggaccccttcgtggatttggctattacaatttgcattgtgctcaataccctctttatggccatggaacattatccgatgacagagcagttctcctcggtcctgagcgtggggaatctcgtttttactgggatttttactgctgagatgttcctgaaaattatcgccatggatccctactattactttcaggaaggatggaatattttcgatgggtttattgtgagcctgagcctcatggaattggggctcgccaacgtcgagggtcttagcgtgctgagatccttccgtctcttacgtgtcttcaagctggcgaagtcctggccaacgctgaatatgctgattaagattattggcaattccgtgggcgctctcggaaacctaaccctcgtgctagccatcatagtttttatattcgctgtcgtggggatgcagcttttcgggaagtcatataaggaatgtgtttgcaagatctctaatgactgcgagttacctcgatggcatatgcacgatttcttccacagcttcctgatcgtgttcagggtgttgtgtggagagtggatcgagaccatgtgggactgtatggaagtcgctgggcagacaatgtgcctgacagtcttcatgatggtgatggtcatcggcaatctcgttgtgcttaacttgtttctggctctgctactctccagcttcagctcggataatctcgcggccactgatgacgacaatgagatgaacaatcttcaaatcgccgtggggagaatgcagaaaggtattgattttgtcaaaaggaaaatccgggaatttatacagaaagcttttgttaggaagcagaaggcactggatgaaattaagcccctggaggacctcaacaacaaaaaagactcttgtatctcgaatcacactacgattgagatcggcaaggacctaaattacctcaaagacggcaatggaaccacctctggcatcggttccagtgttgagaaatacgttgtggacgaaagtgattatatgagtttcattaataatccatcacttaccgtaacggtgcccatagccgtgggtgagagtgatttcgaaaacctcaacactgaggagttctcctccgaatccgatatggaagagtcaaaggaaaagctaaatgccaccagctctagtgaggggtccactgtcgatataggcgcacccgcggaaggcgaacagcccgaagttgagccagaagagtcattggaacccgaggcatgcttcactgaggattgcgtccgtaaatttaagtgctgccagatttcaatcgaagaaggcaaggggaaattgtggtggaatctccgaaaaacgtgctataaaatagttgaacacaattggtttgagacattcatcgttttcatgatccttctgtcttccggcgcgctggcctttgaagatatttacatcgagcaacggaagacgattaaaaccatgctcgagtacgcagataaagttttcacatacatcttcattctggagatgctgctgaagtgggtggcctacgggtttcaggtctacttcaccaacgcttggtgttggctcgatttcctgattgttgacgtttcgctggtgtctctgacagcaaacgcactcggatatagcgaactgggtgctataaagagcctgaggaccctgcgcgctcttcgtccactgcgcgctttaagtcggtttgagggaatgcgcgttgtcgtaaacgcgcttctgggagcaattccctcaattatgaacgtgttgctcgtctgccttatattctggctcatcttctctattatgggcgtcaatctgttcgccgggaaattttaccactgtatcaactacactaccggggaaatgtttgatgtatctgtggttaacaactacagtgagtgcaaggcccttattgagtccaatcagacagctcggtggaagaacgtgaaggtaaacttcgataacgtgggcctggggtacctgtccctgctgcaggttgccacattcaagggatggatggatatcatgtatgcagcagtggactctcggaacgtggagctgcagcccaaatacgaagataatctatacatgtatctttacttcgttattttcattatctttggctcatttttcacgctgaacctgtttatcggggttatcattgacaatttcaatcaacagaagaagaaatttgggggacaggacatctttatgacagaggagcagaagaagtattataatgctatgaagaaacttggctctaagaaaccccagaaacctatcccaagaccagcaaataagttccagggcatggtgtttgactttgtgacaaaacaggtctttgatatctctataatgattctgatttgccttaacatggttaccatgatggtcgaaaccgatgaccagtcccaggagatgaccaatatactatattggataaacctagtctttatcgtgctctttacaggggaatgtgtgctgaaactcattagtctgcgatattattacttcactatcggatggaacattttcgatttcgtggttgtcatcctcagcatagtaggcatgtttctggccgaactgattgagaaatattttgtgagtcccacattgttccgggtgatacggctggcccgaattggtcggatccttcggcttataaagggcgctaagggaataagaaccttactgttcgcacttatgatgagcctgcctgcattgttcaacatcggactgctcttgttcctcgtgatgttcatttatgcgatcttcggcatgtctaactttgcctatgtaaaacgtgaggtcggcatagatgatatgttcaatttcgaaacctttggaaatagcatgatctgcctcttccaaatcacaactagcgctggctgggacggcttgttggcccccattctaaactccgggccacctgactgcgaccccgacaaggatcatcctggatcgtccgttaaaggggattgcggtaaccccagcgtgggtatattcttctttgttagctacattattatcagcttcctggttgttgtgaacatgtacatcgcagtcatactggagaactttagcgtcgctacggaggagagcgcagagcccctctcagaagacgacttcgagatgttctacgaagtctgggaaaagttcgaccctgatgccacacagttcatcgagttcgctaagctatctgactttgctgatgctctggatccccccctactcattgccaagccaaacaaggtccagcttattgccatggatcttccaatggtttccggcgatcggatccactgcctggacattctgtttgcattcacaaagcgtgtccttggggagagcggcgaaatggacgcactgcgcatacaaatggaggagcgttttatggcaagtaatccctcaaaggtatcctatgaaccaataactacgacattgaagaggaagcaggaggaggtgtccgcgattataattcagcgcgcctaccgcagataccttttgaaacaaaaggtcaagaaggtgagcagcatttacaagaaagacaagggcaaggagtgtgacgggacacctatcaaagaggataccctcatagacaaactaaatgagaactccacccctgagaaaacagatatgaccccctctaccacctcaccacctagctatgactcagtgaccaagccagagaaggagaagtttgaaaaggacaagtctgagaaagaggataaaggtaaggacatccgcgagtccaagaaatag

SEQ ID NO: 205484 - DNA, 6018 bp, Artificial Sequence
  Description of Artificial Sequence: Synthetic coding sequence
atggcccagagcgtgctggtgccccccggccccgacagcttccggttcttcacccgcgaaagcttggctgcaattgaacagcggatcgctgaggagaaggccaagaggccaaaacaggagaggaaagacgaggacgacgagaatggcccaaagccaaacagcgacctcgaagccgggaaatctctcccttttatttatggtgacatccccccggaaatggtctctgtgcccctggaggacctggacccttactacataaacaaaaagacctttatagtgctaaacaagggaaaagctatttcccgatttagtgccacgcccgccctctatattcttactccattcaaccctattagaaagctggcaatcaaaatcctggtccactctctcttcaatatgctaatcatgtgcacgatcctgacaaactgcgtctttatgaccatgagtaaccctcccgactggactaaaaacgtagagtatacatttactgggatctataccttcgagtccttaataaagattctggcccggggcttctgtctagaagatttcaccttcttgcgagacccatggaactggcttgatttcacggtgattacctttgcttatgtgaccgaattcgtcgatctcgggaatgtgagtgcgctgagaacctttagggtcctgcgagccctgaaaactatctccgtcattcctggcttaaagacgatcgtcggggcacttatccagtccgtgaaaaagctgtctgacgtgatgatcctgacagtgttctgcctgtcagtgttcgcactgatcggcttgcagctattcatgggcaacctgaggaataagtgtctgcaatggccacctgacaactcatccttcgagatcaatattacctcattctttaataacagcttggacggaaatggaaccacatttaatcggaccgtcagtatattcaactgggatgagtacatcgaggacaagtcacacttctacttcttagagggccagaatgacgctttgctgtgcggcaactcgagtgacgctggtcagtgcccagaaggctacatctgtgtgaaggctggacggaatcccaactatggttacacctcatttgataccttttcatgggcgtttctttctttgttccgcctgatgacacaggacttttgggaaaatctgtaccagttgactctgagggctgctggtaagacctacatgatattttttgtgctggtaatttttttaggcagcttttacctgattaaccttatactagcagttgttgctatggcctacgaggaacaaaatcaggctaccctagaggaagctgaacaaaaggaagccgagttccaacagatgttagaacagcttaaaaagcagcaagaggaggcccaggcagcggctgcggcagccagcgccgagagtagggattttagtggggccggagggataggggtgttctccgaatcatcttcagttgcttctaagcttagctccaagtcagagaaggagctcaaaaacagacggaagaagaaaaagcagaaggagcagtccggtgaggaagagaagaacgacagagtgagaaaatccgaatctgaagatagcattcgacgaaagggcttcagatttagcttggagggctcccgcctgacctatgagaagagattcagctctccccatcagtccctgctatccatacgcgggagtcttttcagcccccggcgcaactccagagcgagcctcttctcttttaggggacgcgccaaagacattggatccgagaacgatttcgccgatgacgagcacagtacatttgaagacaatgactcacggcgggacagtctgtttgtgccacaccgccatggtgaacggcggcattctaacgtcagccaggccagtcgggccagccgggttctgccgattctgcctatgaacggcaaaatgcattccgctgttgattgtaatggcgtggtgtcacttgtggggggcccgagcacactcacttccgccggacagctgctgccagagggaactacgactgagaccgagattcggaaacgacggtcatcatcataccacgtcagtatggacctgctggaggaccccacatcaagacaaagagctatgagtatcgctagcatactgacgaacaccatggaggagttggaggagtcacggcagaagtgccccccatgctggtataagtttgcgaacatgtgcctcatctgggactgctgtaagccctggctgaaggtcaaacacctcgtgaatttggtagttatggatcccttcgttgacctggccatcactatttgtattgtgttaaataccctgtttatggccatggaacattacccaatgactgaacagttcagtagcgttcttagcgtggggaacctggttttcactgggatctttactgcagagatgttcttgaagattatagcaatggacccatattattatttccaggagggctggaacatcttcgacggtttcatagtcagtcttagcctgatggagctgggactagcaaacgttgagggcttgtccgtactgaggagctttcgcctccttagagtgtttaagttagccaaatcttggcccaccctgaatatgcttattaagatcataggtaactcagttggcgcactgggtaacctgaccctagttctggctattatcgttttcattttcgctgtagttggtatgcaactgttcggaaaatcatacaaagaatgcgtatgtaaaatcagcaacgattgcgaactccccagatggcacatgcacgacttttttcacagctttctcatcgttttccgggttctttgtggagaatggattgagaccatgtgggattgcatggaggtggctggtcagaccatgtgtttgactgtgtttatgatggtgatggtgattggaaatctggttgtcctgaacttgttcctggcgcttttactgtcgtccttttccagcgataacttggcggcaacagatgacgacaacgaaatgaacaatttacagatagcagtgggaagaatgcagaaaggcatagacttcgtgaagcgcaagattagggaattcatccagaaagctttcgtgcggaagcagaaggccctggatgaaataaaaccgctcgaggacttgaataacaaaaaagattcatgcatctcaaaccacactaccatcgaaatagggaaggatctcaactatctaaaagatggcaatggtaccacaagtggcattggttccagtgtggaaaagtacgtcgtagacgaatctgactatatgagcttcatcaataacccatcactgacagttactgttcccattgccgtcggagaaagcgatttcgagaacctcaacacagaggagttctctagtgagagcgacatggaagaatccaaggagaagctaaatgcaacctcatcttcggagggtagcacggtcgacatcggcgctccagccgaaggcgaacagccagaggtagagccagaggagtccctggagccagaagcttgcttcacagaagattgcgtgcggaaattcaagtgttgtcaaatcagcatcgaagaggggaaaggcaagctgtggtggaatctccgcaagacatgctataagatcgttgagcataactggtttgagacattcatcgtcttcatgatcctgctgagttctggggctctcgcatttgaagatatctatatagagcagaggaagacgatcaagacgatgctggagtacgccgacaaggtttttacttatatctttatattggaaatgttacttaaatgggtcgcctacggctttcaggtgtactttaccaacgcttggtgttggctggattttctaatcgtcgacgtgtccctagtatcactcaccgcgaacgcgctgggatactctgaacttggagccatcaaatctctgcggacactgcgtgcactgcggcctcttcgggcgcttagtcggttcgaggggatgagggtggtggtcaacgcactcttaggcgcgattccttccattatgaatgtcctgcttgtttgcctgatcttctggctgattttcagcattatgggcgtcaatctgtttgcaggtaaattctatcactgcattaactacacgacgggggaaatgtttgacgtctccgtagtgaataactactccgagtgcaaggccctgatagaatccaaccagactgcccgctggaagaatgtgaaggtaaacttcgacaatgtggggcttggatacctatctttattgcaggtggctacctttaagggttggatggacattatgtatgccgcagtggatagccgcaacgtggagctgcagccaaagtacgaggacaacttatacatgtatctgtactttgtcattttcattatttttgggtcatttttcaccttaaacctcttcatcggggtgattatcgataactttaatcagcagaaaaaaaagttcggcggccaagatatctttatgaccgaggagcagaagaaatactacaacgcaatgaagaaacttggcagcaagaagccccagaagcctatccccagaccggctaacaagttccaggggatggtgtttgactttgtgacaaaacaagtgttcgatattagtatcatgattctaatctgcttgaacatggtcacaatgatggttgagacagacgaccagtcacaggagatgacgaacatcctttactggatcaatttggtatttattgtcctgttcaccggggagtgcgtgctgaaactcatttctttacgatattactacttcactatcgggtggaatatctttgacttcgttgtcgttatcctgtcaattgtggggatgttcctggcagagttgatagagaagtacttcgtatcccccactctatttagggttatacggttagcacgcattgggaggattctacggctaatcaagggcgccaaagggatcaggacattgctctttgccctaatgatgtcactgccggcgctgtttaatatcggattgctgctttttctcgtcatgtttatctacgcaatatttgggatgtctaattttgcatatgtcaagagagaagtgggcattgatgacatgttcaacttcgaaacctttggcaattctatgatttgtctctttcagatcaccactagtgcaggctgggatggcttgctggcccctatactaaactccggccctccagattgcgatcccgacaaggaccaccccggatcctctgtcaaaggcgactgcggcaaccccagcgtggggatctttttctttgttagctatattatcatttccttcttggtggtcgtcaacatgtacatcgccgtaattttagaaaatttcagcgttgcaaccgaagagtctgctgaaccattgagcgaagacgacttcgagatgttttacgaggtctgggagaaatttgatcctgatgcaacacagttcatcgagttcgctaaacttagtgattttgcggacgcactcgatcctcccttactaatcgccaagccaaacaaggtgcagcttatcgccatggatctgcctatggtgtctggagacagaatccattgcctggatatactgtttgcatttacgaagcgggttctaggggagagcggtgagatggacgcattaagaattcagatggaggaacgctttatggcctctaacccatcaaaggtctcatacgagcctattactactactctaaagcggaagcaagaggaggtgtccgctattatcatccagagggcctacagaagatacttgctgaaacagaaggtgaagaaggtctccagcatatataagaaggacaaaggtaaagaatgtgacggcacacccattaaggaggatacgttgattgacaagcttaacgagaactctaccccagagaaaaccgacatgacacctagtactacgtcacccccctcatacgatagtgtgaccaaacccgagaaagagaaatttgaaaaggacaagtctgaaaaagaagataagggtaaagatataagggagtctaagaaatag

SEQ ID NO: 205485 - DNA, 1512 bp, Artificial Sequence
  Description of Artificial Sequence: Synthetic coding sequence
atggcccagagcgtgctggtgccccccggccccgacagcttccggttctttacgagggagtccctggctgccattgaacagagaattgctgaggaaaaggctaagcggcctaagcaggagcgcaaagacgaggacgatgagaacggtcctaagccgaacagcgatctggaagccggcaagagtctgcccttcatctatggggacatcccccccgagatggtctccgtgccattagaggacttggacccgtattatatcaacaagaagactttcatcgtactgaataaaggaaaagcaataagccgcttctcagccacgccagctctttacatcctgactccctttaaccccatccggaaactggcaattaaaatactcgtacacagtctgttcaacatgcttattatgtgcacaattcttaccaactgcgtcttcatgaccatgtctaatcccccagattggaccaagaatgtggaatacacgttcacaggaatttataccttcgaaagccttatcaagatcttggcccgtgggttctgcttggaggattttacctttcttcgggatccatggaattggctcgacttcacagtcatcaccttcgcatatgttaccgagtttgtggatctgggcaatgtatcagccctgaggactttccgagtgctccgagccctaaaaacaatttcagttattccagggttgaaaaccattgtgggggcactgatccagtctgtaaagaagttaagcgatgtgatgatcctgacagtgttttgtttgagtgtattcgccctcatcggactccaattattcatgggaaatctcagaaacaaatgtctgcaatggcctcccgacaactctagtttcgagatcaacattactagctttttcaataattcacttgacggcaacggaactacttttaaccgtacagtctcaatcttcaactgggatgaatacattgaagataagtcccacttttattttctagaaggacagaatgatgcattgctttgtggcaacagctctgacgccggacaatgccctgaaggctacatatgcgtcaaggcaggtcgaaacccaaattacggctatacttccttcgataccttttcatgggcttttctgagtctgttccgccttatgacccaggacttttgggaaaacctataccagctgactctgcgggccgctgggaaaacctatatgatcttttttgttcttgtaatctttttggggagcttctatctgattaatttaattctcgccgtcgtagcgatggcttacgaggagcagaatcaggccactctggaagaagctgagcagaaagaagctgagttccagcagatgctggagcagctgaaaaaacagcaggaagaagcacaagctgccgcagctgccgcttctgcagagtcaagagatttctcaggagccggaggaatcggtgtgttcagtgagtcctcatctgtggcctccaaactgtcatctaagagtgagaaggagttgaaaaactag

SEQ ID NO: 205486 - DNA, 648 bp, Artificial Sequence
  Description of Artificial Sequence: Synthetic coding sequence
atgcaccgggacgcctggctgccccggcccgccttcagcctgaccggtctgtctctgttctttagcctggttcccccaggccggtctatggaagttaccgtacccgctacacttaatgtgttaaatggctctgacgcgcggcttccatgtaccttcaattcttgttacactgtgaaccacaagcagtttagcctaaactggacttaccaggaatgcaataattgctccgaggaaatgttccttcagtttagaatgaaaatcataaatctgaagcttgaacggtttcaggacagggtggagttcagtggaaacccatcaaagtatgacgtctcagtgatgctcagaaacgtgcagcctgaggatgaaggaatctataattgttacattatgaatcccccagaccggcatcgtggacacggaaagattcacctgcaggtccttatggaagagccgcctgaacgcgatagcacagttgccgttattgtcggagcttccgtgggaggcttccttgccgtagtgatccttgtgctgatggttgtcaaatgcgttcgaagaaagaaagaacaaaaactgagtaccgatgaccttaagactgaggaggaaggcaagactgacggtgagggtaatcctgatgatggggccaagtag

SEQ ID NO: 205487 - DNA, 6003 bp, Artificial Sequence
  Description of Artificial Sequence: Synthetic coding sequence
atggcccaggccctgctggtgccccccggccccgagagcttccggttattcacccgggaatctctggcggccatcgagaagcgggccgccgaagagaaggccaagaaaccgaaaaaggagcaagataatgacgacgagaataaacccaagcctaacagtgacttggaagccgggaagaaccttcctttcatttacggggatattcctcctgaaatggttagtgagccactggaggatctcgatccctattacatcaacaagaaaacatttattgtcatgaataagggcaaggccatcttcagatttagcgcaaccagcgcactgtatatccttacaccccttaatcctgttagaaagattgctatcaaaatcctggttcactccttattcagcatgttaatcatgtgcacaatattgaccaactgtgtattcatgaccttatcaaatccacctgattggacaaaaaatgtggaatacactttcactggtatctacacctttgagtctctgatcaagatcctcgctcgaggattttgcctcgaggattttactttcttaagagacccatggaactggctcgacttttcagtaatcgtaatggcatacgtcacggaattcgttgatctgggcaacgtgagcgcactcaggacgttccgcgtcctccgtgcgttgaagacaatatctgtaataccaggcttgaagaccattgtgggggccctgatacagagtgtgaagaaactatccgatgtaatgatactgacggtgttctgtctgagtgtgtttgccctgatcggcctccaattgttcatggggaacctccgtaataagtgtctccaatggcctccaagtgacagcgctttcgagactaatacaacaagctattttaatggtactatggattccaatggcacattcgtcaatgttacaatgtctacctttaactggaaagactacatcggagacgattctcatttctacgtgctggatggtcagaaagaccctctgctgtgtgggaatggatcagacgctggccaatgtcccgaggggtatatttgtgttaaggcaggcagaaacccaaattacggctatacatcctttgatacattctcatgggcttttctttcactgttccgattaatgacccaggactactgggaaaacttgtatcagctgactctgcgggcggccgggaagacctatatgattttctttgtattggtgattttcttgggttcattttacttggtgaatctcatcttggcagtcgtggctatggcatacgaagagcagaatcaggccaccctcgaagaagcggagcaaaaggaggcagagtttcagcagatgctggagcagctgaagaaacagcaagaggaggcccaagcagtcgccgccgccagcgcagcctccagagacttctccggcataggcggtctcggtgagctccttgaatcatccagcgaggcctcaaagttatccagcaaaagcgcgaaagaatggcggaaccgacgtaagaagcggcgccagagagaacacctggagggtaacaacaaaggtgaacgggactccttcccaaagtccgaatctgaggactcagttaaaaggagcagcttcctgttctcaatggacggaaacagactgacctcagacaaaaagttttgttctcctcaccaaagcctgctgagtattagaggctcactcttctccccacgaagaaactctaagacttccatcttttctttccgcggaagagccaaagacgtaggctcagaaaatgacttcgcggatgacgagcattccacttttgaagattcagagtcacggagggatagtctgtttgtaccccatcgacacggcgagcgacgtaacagtaacgtctctcaagctagcatgagctctcgcatggtgcctggccttcccgctaacggtaagatgcacagcacagtggactgcaacggggtagtctctttagtgggcgggccctcagccctcaccagcccaacgggccagcttccccccgaaggtacgacaacagaaacagaagttcggaaaagaaggctctcaagctatcagatttcaatggaaatgctggaggactcttcaggtcgtcaacgcgctgtctcaatcgcgagcattcttactaatactatggaagagctggaagaaagcaggcagaaatgtcctccctgctggtacagatttgcgaacgtctttttgatctgggactgctgtgatgcatggcttaaagtgaagcatctagtgaatctaatcgtcatggacccatttgtcgatctagcaattacaatttgtattgtccttaacactttattcatggccatggagcattatcccatgaccgaacaatttagctccgttcttaccgtgggaaacctagtgtttaccggtatcttcaccgctgagatggtgctgaaaatcatcgccatggatccgtactattatttccaagaggggtggaacatctttgatggaattattgtttctttatctttgatggaactggggttgtccaacgtggagggactttcagtgttacgctcattccgcctgctccgtgtgtttaagcttgctaagtcttggcctactcttaacatgttaatcaaaattattggaaatagcgtgggcgccctgggcaatttaactctggtgttggccatcattgttttcatcttcgccgtggtggggatgcaacttttcggaaaatcttacaaagagtgcgtatgcaaaattaatgatgattgcactctcccgaggtggcacatgaatgacttcttccacagcttcctgatcgtgttccgagtcctgtgtggtgaatggatagagactatgtgggactgtatggaggtggcgggccagacaatgtgcttaatcgtgtttatgctcgtgatggtgatagggaacctagtagtgttgaaccttttcctcgctttattactctcctcatttagctctgataacctggccgcaacagatgacgataacgaaatgaacaaccttcagatagcggttggcaggatgcagaaaggcatagactacgtcaaaaacaagatgagggagtgctttcagaaagccttcttccggaagccgaaggtgatagagatccacgagggcaacaagatcgattcgtgcatgtcgaacaatacaggaattgaaataagcaaggagttaaattaccttagggatggcaatggaaccaccagcggcgtggggacgggaagctcagttgagaagtacgtgatcgacgagaacgattacatgtcctttatcaataatccaagcctaactgtgactgtgccaatcgctgtcggcgagtctgattttgagaacttaaacacggaggaattctcaagcgaatctgagctggaggagtcaaaagagaagctgaacgccacatccagttctgagggatccactgtggacgtggtactccctagagagggcgagcaggccgagaccgaacctgaggaggatttaaaacccgaggcctgctttacggagggctgcattaaaaagttcccattttgccaggtgagcactgaagaaggcaagggaaagatctggtggaatctgagaaagacctgttattccatcgtggagcataactggtttgaaacgtttatagtttttatgattctcctgtccagtggcgccttggcttttgaagacatctatatagaacagcgcaagactatcaaaaccatgcttgaatacgccgacaaggtgtttacgtacatctttatattggagatgctgttgaagtgggtagcttacggattccagacctattttaccaacgcctggtgctggctagacttcctgattgttgatgtgagcctggttagtctagtggcaaacgccttgggttactccgaacttggtgccattaagagtttgcgaactctgagggccctgaggccactccgagccctgagtcgctttgaagggatgcgggttgtcgtgaacgccctcgtgggagctatcccaagtatcatgaatgtactgcttgtgtgtcttatattttggctcatattctccataatgggagttaacctgttcgctggaaaattctatcattgtgtgaatatgacaactgggaatatgttcgatatcagtgatgttaataacttatctgattgccaggccctgggtaaacaggcacgatggaagaacgttaaagtgaacttcgataacgtgggagctggatacctggctttactgcaagtggcaacgttcaagggatggatggatataatgtacgccgccgtggactcaagggacgttaaactacaacctgtatacgaggaaaatctctacatgtatttatatttcgttatttttatcatttttggatcattctttacgctgaatttgtttatcggagtgatcatcgacaacttcaatcagcagaagaagaagtttggaggccaggatatatttatgaccgaggagcagaagaaatactataacgccatgaagaaacttgggtcgaagaagcctcaaaaacccatccctagacccgctaataaattccaaggcatggtattcgatttcgtgacgcggcaagtttttgacatttctattatgatactgatttgtctgaacatggtgaccatgatggttgagaccgatgaccagggtaagtatatgacactggtcttgtcacggattaacttagtgtttatcgtgttattcactggtgagtttgtactgaagttagtgtcactacggcactactattttactattggctggaatatcttcgattttgttgtggtgattctttccatcgtagggatgttcttggccgagatgatagaaaaatacttcgtcagtcccacactgtttcgcgtgattcgtctagcacggattggaagaattctccgacttatcaagggagctaaggggatccgaaccctgctctttgctctcatgatgtctttacctgccttgtttaacatcggcctgctcctgttcctggtgatgttcatctatgccatctttgggatgtccaattttgcttacgtcaaaaaagaagctggaatagacgacatgttcaactttgagaccttcgggaatagtatgatttgcctgtttcagatcacaacatctgcaggatgggacggtctgctggcccccatcctgaattctgcccctccagactgtgatcctgacacgatccatccaggctcctctgtgaagggcgactgcggtaaccccagtgtgggaatattcttttttgtctcatatatcattatatcattccttgtggtcgttaacatgtatatcgccgttatcttggagaacttctcagtcgccactgaagagagtgctgagcccctgtcagaggatgatttcgaaatgttttacgaagtctgggaaaaattcgaccctgatgccacccagttcattgagttctccaaactcagcgactttgccgcggcacttgaccctcctctgcttattgcaaagcccaacaaggtgcagctgatcgctatggacctgcctatggtgtccggcgatcgcatccactgtctcgatatcctgttcgcattcactaagagggttctgggggagagcggagagatggatgcactgagaatccagatggaggacaggtttatggcatccaaccctagcaaggtgtcttacgagcctatcacaacgacgctcaagaggaagcaggaggaagtctccgccgctattatccagagaaatttcaggtgctatctgctcaagcagaggctgaagaatataagttcaaactacaacaaagaggcaataaaaggtagaattgatctccctattaaacaggatatgataatcgacaagctgaacgggaattccacacctgagaagacagatgggagctcaagcacaaccagtccaccgagttatgattctgtgacaaagcccgataaggagaaatttgaaaaagataagccagaaaaagagtccaaagggaaggaagtgcgggaaaatcagaaatag

SEQ ID NO: 205488 - DNA, 6003 bp, Artificial Sequence
  Description of Artificial Sequence: Synthetic coding sequence
atggcccaggccctgctggtgccccccggccccgagagcttccggctattcacgcgagaatccctggccgccatcgagaagagggcagcggaagaaaaggctaagaaacccaagaaggaacaggataacgacgatgagaataaacccaaacctaatagtgatctggaagccggcaagaatctaccctttatctacggtgacatcccccccgaaatggtgtccgaaccactcgaggacctggacccttattatatcaataagaaaaccttcatcgtgatgaataaaggaaaggccatctttcgcttttcagccactagcgccttgtacatcctgacaccactcaacccagtgcgcaaaattgctataaaaattttggtccactctctattttccatgcttatcatgtgcactatactcacaaactgtgtgttcatgaccctgagcaaccccccagactggactaagaatgtggagtacacattcactggcatatacacctttgaaagcctgataaaaatcttggctaggggcttttgcctggaggatttcacctttctccgtgatccttggaactggctggacttcagcgtcattgttatggcatacgtcacggaattcgtgagcctgggaaacgtgtccgctctcagaacctttcgtgtgctgcgggctctcaagactatcagtgtaattcccgggctgaaaacaattgtgggcgcactgatacagtctgtgaaaaaactctctgacgtcatgattcttacagtcttctgcctgagcgtatttgccctcatcggcttgcagctgtttatgggaaacctgcgtaacaagtgcctccagtggccccctagtgatagtgccttcgagaccaacacaacgtcatacttcaatgggaccatggacagcaatggaacttttgtaaatgtcactatgtctacatttaattggaaagattacatcggtgatgactctcatttttacgtgctagatggccagaaggatccactactatgcggcaacggctcagacgccggccagtgccctgagggttacatctgtgtgaaagctggccgcaaccccaactacggatacacttcattcgacactttctcatgggcctttcttagcctgtttagactgatgactcaagactactgggaaaatctttatcagctcacactgagagccgccgggaaaacctatatgattttctttgtgctggttattttcctggggagcttttatctcgtgaatttaattcttgccgtcgtcgccatggcctacgaggaacagaatcaagcgacgctcgaggaggccgaacaaaaggaggcagaattccaacagatgctggagcaactaaagaaacaacaggaagaggcgcaagccgttgcagctgcatcagccgcatcccgcgactttagcgggataggaggcctgggggagctacttgagtcctcatcagaggcttctaagctgtcctccaagtccgctaaagagtggaggaaccgccggaagaagcggcggcaacgtgaacaccttgaaggaaacaataaaggcgagagagattctttcccaaagtcagagtccgaggatagtgtgaaaagatcctcctttctgttctccatggacggtaatcggctcacttctgacaagaagttttgcagcccacaccagagtctactgtcaatacggggctcccttttttctccacgtagaaatagcaagactagcatcttcagttttcggggacgagctaaggacgttggatccgagaacgacttcgcagacgacgaacactccacattcgaagatagcgagagtagaagagattccctctttgtcccacaccgacacggcgagaggcggaatagtaatgtgtcgcaggcctctatgtcgtcccggatggtgccaggtcttcccgctaacggaaagatgcactccaccgttgattgtaatggcgtagtgagcctggtgggagggccctccgccttaacctcgcctacagggcagctgcctcctgaagggaccactactgagacagaggttcgtaagcggagactgtccagttaccagattagcatggaaatgctagaagatagcagcggtcggcagcgagctgtcagtattgcctccatccttactaacacaatggaagaactggaggagagccgccaaaaatgcccaccctgttggtatcggtttgcaaacgtctttctgatttgggattgttgtgatgcttggcttaaggtgaagcatctggtgaacctcatcgtgatggatcccttcgttgatctcgcaatcacgatatgcatcgtactgaatacactctttatggcgatggagcattaccctatgacagaacagtttagtagcgtactgaccgtcgggaaccttgtcttcaccgggatattcaccgcggaaatggttctcaaaatcattgctatggatccatactattactttcaggagggatggaacatctttgatggaatcatcgtaagtctcagcctgatggaacttgggctgtctaatgtcgagggtctcagcgtcttacggtccttcaggcttctgagggtctttaagcttgccaagtcctggcctactcttaatatgttaatcaaaatcatcggaaacagcgttggtgctctgggcaatctcacactcgtgctcgcaattattgtgttcatattcgccgtggtggggatgcagctgtttgggaaatcttataaggagtgcgtgtgtaaaattaacgacgattgtaccctgcctcggtggcacatgaatgacttcttccactcatttctgatagtatttcgggtgctgtgcggagaatggatcgaaactatgtgggattgcatggaggtcgctggacagacgatgtgtttgatcgtgtttatgctcgtgatggtaatcggcaatctggtggtcttaaatctgttccttgccttgctcctgtcttcattctctagcgataatcttgctgcgactgacgacgataacgaaatgaataaccttcagatcgctgtcggaagaatgcagaaagggatcgactatgtcaagaacaaaatgagggagtgcttccagaaggcgttttttagaaaaccaaaagtgattgaaatccatgaagggaacaagatcgactcgtgcatgtcaaacaatactggaattgagatctcaaaagagttgaactacctccgcgacgggaacggcacaacctctggcgtgggcactggctctagcgttgagaagtacgttattgacgaaaacgactacatgagctttataaacaacccctctctgactgtgaccgttccaatcgctgttggggagtctgacttcgagaatctaaacaccgaggaattttcgagcgaatcggaactggaagagtctaaggagaaactcaacgccacatctagtagcgaagggtctaccgtggacgtggttctgccaagggaaggcgagcaggccgaaactgagccagaagaggacttaaagccagaagcttgcttcactgagggttgcatcaaaaaattcccgttctgccaggtgagtacagaggaaggcaaaggcaagatctggtggaacttgcgaaagacatgttactcaatcgtcgagcataattggttcgagacctttatagtgttcatgatcttgttgtcctccggcgcgctcgccttcgaagacatttatatcgaacaacgcaagaccatcaaaacaatgctcgaatacgcagacaaggtcttcacctacattttcatattggagatgctgcttaagtgggttgcatacgggttccagacgtactttacgaacgcgtggtgctggttggatttcctgattgtggacgtttcgctggtctctctcgtagcgaatgcactgggttattctgagctcggggcgattaagtcacttcgtaccctgagagccttgcggccacttagggctctcagcagatttgagggcatgcgggtggtggtgaatgcgctggtgggcgctattccatctatcatgaatgtgctcctggtgtgtctcattttttggctcatcttcagtatcatgggggtcaacctgttcgcaggaaaattttaccattgtgtcaatatgactacaggcaatatgtttgacatatccgacgtgaataatctgagcgactgtcaggcactgggaaaacaagcgcgatggaagaatgtaaaagttaattttgataatgtgggtgctgggtaccttgccctcttgcaagttgcaaccttcaagggatggatggacattatgtatgcggccgtggacagtagagacgtcaaactgcaacctgtttatgaggagaatctatacatgtacctttacttcgtcatctttattatcttcggatcattcttcacgctgaatctgttcattggtgtgatcattgacaactttaatcagcagaaaaagaaattcggagggcaggatatcttcatgactgaggagcagaagaagtattacaatgctatgaaaaagctggggtctaaaaaacctcaaaagcctatcccacgcccagctaataaatttcaggggatggtattcgacttcgtgactcggcaggttttcgacattagtataatgatcctcatctgtctgaatatggtaactatgatggtagaaactgacgatcagggcaaatacatgactctggtgctttcacggataaatctggtcttcatcgtattgtttaccggagagttcgtgctgaagcttgtgtccctcaggcattactacttcactatcgggtggaacatttttgactttgtggtggtgatcttgtccatcgtcggcatgttcctcgcagagatgatcgaaaagtactttgtgtctccaaccttatttcgggtgatcaggttggcccgcattggacgcatattgcggcttatcaaaggcgcaaagggtatcaggactttactgttcgccctgatgatgagtctacctgccttgttcaacattggactgctgctgttcctcgtgatgtttatctacgccattttcgggatgtctaatttcgcctatgtgaaaaaagaggccggaattgatgacatgtttaactttgagacattcgggaattcgatgatttgtttgtttcagatcacgacctcagctggctgggatgggctgctcgctcccattttgaattctgccccaccagattgcgaccctgacaccatccaccccggatctagcgtcaaaggagactgcggtaatccatctgtgggcatttttttttttgtaagctacatcatcatctcctttctcgtggtcgtgaacatgtacatcgccgtgatcctggaaaactttagcgtggctactgaagagagcgccgagccactgtcagaagacgatttcgagatgttttacgaagtctgggagaaattcgatcccgacgctacccaattcatcgaattttcaaagttgtctgacttcgctgcggcccttgatccaccactgttaatcgccaagccaaataaggtgcagctgatcgccatggacttaccaatggtatctggggacagaatccactgtttagatattttgttcgcttttaccaagcgcgtgttgggcgaaagcggtgagatggatgctttacgtattcagatggaagaccgattcatggcatccaaccccagcaaggtgtcctatgagccaataaccaccaccctgaaaagaaagcaggaggaagtatctgctgcaattatccagagaaactttagatgttaccttctcaaacagcgtctgaagaacatcagctctaattataataaggaggcgataaagggccgcatcgacctgcctattaaacaggacatgataattgataagctcaatggaaactccaccccggagaagacagacgggtccagctccacaaccagccccccttcctacgactccgtaaccaaacctgataaagagaagttcgaaaaggacaaacctgagaaggagagtaagggcaaagaggtgcgggagaatcagaagtag

SEQ ID NO: 205489 - DNA, 5856 bp, Artificial Sequence
  Description of Artificial Sequence: Synthetic coding sequence
atggcccaggccctgctggtgccccccggccccgagagcttccggctattcactcgggagagcttagctgcaatcgaaaagcgcgctgccgaggaaaaagcgaaaaagcccaaaaaagagcaagacaatgacgatgaaaacaaacctaagccaaattctgatctggaggcgggaaaaaatctgccattcatctatggagatatcccaccagaaatggtctccgaaccactggaggatctcgacccctactacatcaataagaaaacctttatcgtgatgaacaaaggtaaggctatttttcgtttttccgccacaagtgcgctctacatactcaccccgctgaacccagtcagaaaaatagccattaaaatccttgtgcattctctgttctcgatgctcatcatgtgtacaatattgaccaattgcgtatttatgaccctgtcaaatccaccagattggactaaaaacgtcgagtacacttttaccggcatttacaccttcgagtcccttattaagatcttggcccggggattttgtctggaggacttcacttttctaagggatccttggaactggctcgacttctccgttattgtcatggcatatgtgaccgaatttgtgagcttgggcaatgtgagcgctttgcgaacattcagggtgctccgggccctaaagactatttcagtgattccaggcctcaagacaatcgtgggtgctcttattcagtccgtgaaaaagttgagcgacgtgatgattctaaccgttttctgcctctccgtgtttgccctcattggattacagctgttcatgggaaacctgaggaataagtgcctgcagtggccgccaagtgattctgcctttgaaaccaacaccaccagctacttcaatggaacaatggacagtaatggaaccttcgtcaacgtgaccatgagtacatttaattggaaggactacatcggcgatgactcgcacttctacgtgttggatggtcagaaagaccctcttctttgtggtaatgggtctgatgcaggacagtgtcctgagggctatatctgtgtgaaagccgggcggaaccccaactacggctatacctctttcgatacattctcctgggcctttttgagtctgtttcgtcttatgacacaagactattgggaaaacctgtatcagctaacactgcgtgctgccggcaagacttatatgatcttcttcgtactcgtgatctttctcggctcattttatctggtcaacctgatactcgccgtggtcgcaatggcttatgaagagcagaaccaagccactcttgaggaagcagaacagaaagaagcggaattccagcagatgctcgagcaattgaagaagcagcaggaagaggctcaggccgttgcagcggcttctgcagcatcccgggatttttcgggaattggcggcctgggggaactcctagaatcctctagcgaggcgagtaagctttcctcaaaatccgccaaggaatggagaaacagaagaaaaaagcggagacagcgtgagcacctggagggtaataacaagggagagagggactcttttcccaaaagcgaatctgaagattccgtgaagcgcagcagttttctcttcagtatggacggcaatcggctcacaagtgacaaaaagttctgttccccccaccaatctcttctaagcatcagagggtcactcttttctccaaggcgcaattcaaaaacgtctatcttcagtttcagggggagagccaaggatgtggggagcgagaacgattttgcggacgacgagcactccactttcgaagacagcgagagtaggagagattcactgttcgtcccccatcggcacggtgaacgtagaaactctaatggaaccaccacagaaacggaggtgcgcaagcgacggttatctagctaccagatctccatggaaatgcttgaagacagcagcgggaggcagagggctgtctctattgccagcattttaaccaatacaatggaggaactagaggagagtcggcaaaaatgtcctccctgttggtataggtttgctaatgttttcttgatatgggactgttgcgatgcttggctgaaggtcaaacatctcgtcaacttgatcgtgatggatccctttgtcgatctcgcgattaccatttgcatcgtgcttaatactctgttcatggcaatggaacattacccgatgacagaacagttcagctccgtcctgactgttggcaacctcgtcttcactggcatatttaccgccgaaatggtgcttaagattattgcgatggatccatactattatttccaggaaggatggaatatatttgatgggatcattgtttcgttaagcctaatggagctcggacttagtaatgtggagggattgtccgtgctgaggagtttccggcttctccgcgttttcaagctggctaagtcatggccaacactgaacatgctcattaaaattattggcaatagcgtgggggccctcggtaacctcaccctggtcctcgctattattgtttttatcttcgcggtcgtcgggatgcagttgtttggcaaatcttacaaagagtgtgtctgcaaaatcaacgatgactgtaccctgccccgatggcatatgaacgactttttccattcattcttgattgtttttcgcgtcctttgtggggaatggatcgaaactatgtgggattgcatggaagttgcaggccagacaatgtgtctgattgtgtttatgttggtgatggtcataggtaatctggtcgttctgaatctgtttctggccctgctgctgagcagtttcagttccgacaacctagcagccactgatgatgataacgagatgaacaaccttcagatcgccgtgggtcgcatgcaaaaggggatcgactatgttaaaaataagatgcgtgagtgcttccagaaggctttctttagaaagccaaaagtgattgaaatccacgaaggaaataaaatcgattcgtgcatgtctaacaacaccggtatagagataagcaaagagctgaactacctgcgggacggcaatggaacaacttctggcgtcggaacagggtcgagtgttgaaaagtatgtcatagatgagaacgattatatgtcctttatcaacaacccaagcctgacggtgacagtacccatcgcagttggcgaatccgacttcgagaacctcaacacggaagaattttcttcagaatccgagctggaagagagcaaggaaaaactcaatgccaccagcagcagtgagggatctacagtcgacgtggtcctgcctagagaaggggagcaggcagaaacggaacctgaagaagacctaaagccggaggcatgctttacggaaggctgtatcaaaaagttcccgttctgtcaggtgagtaccgaagaaggaaaaggaaagatctggtggaatctcagaaaaacctgttactccatcgtggagcacaattggtttgaaacctttatcgtattcatgatcctactgtccagcggggctctcgcttttgaggatatttatattgaacagcgcaagactattaaaacaatgttggaatatgctgacaaagtctttacatacatctttatcctggagatgctcctgaaatgggtcgcctatggattccagacgtatttcactaacgcatggtgctggcttgacttcctcattgtcgacgtgtcgttggtaagtttggttgccaatgctctgggatactcagaactgggagcgattaagtcacttaggaccctgcgtgccctgcgacctctccgcgccctttcaaggttcgagggaatgcgcgtggtcgtcaacgcgttggtgggagcaattccttctattatgaatgtgctccttgtgtgcctcatcttctggttaatctttagtattatgggcgtgaatctttttgctggcaaattttatcactgtgtaaacatgactaccggcaatatgttcgatattagcgatgtgaataacctgtctgattgccaggccctcggcaaacaggcacgttggaaaaatgtgaaagtgaacttcgacaatgttggagcaggctatctggcacttctgcaagttgctacttttaaggggtggatggacatcatgtatgccgctgtggactcaagagacgttaagctgcaaccggtgtatgaggagaatctctatatgtacctgtacttcgtaatatttattatatttgggtccttctttaccctgaacctgttcattggcgtcattattgacaattttaaccagcagaagaaaaaattcggtgggcaggacatttttatgactgaagaacaaaagaagtactacaatgccatgaagaagcttggttctaagaagcctcaaaagcccatccctcgacctgctaacaagtttcaggggatggtttttgatttcgtgacaagacaggtgttcgacattagtatcatgatcttgatctgcctcaatatggttacaatgatggtcgagaccgacgatcaggggaaatatatgacactcgtgctgtctcggattaacctagtcttcatcgtactgtttactggggaattcgttctgaaacttgtgtctctccggcattattacttcactatcggctggaatatcttcgactttgttgtggtgattctttctattgttgggatgtttctggccgaaatgattgagaaatacttcgtcagcccaaccctttttcgagtaatccgcctggcccggatagggaggatcctccgactcattaaaggcgccaaagggatcaggacactgctgttcgcccttatgatgagcctgcctgcgctgtttaacataggcctcctgctgtttttggtcatgttcatctacgccattttcggcatgagtaatttcgcctacgtcaaaaaggaggcaggcatcgatgacatgttcaactttgagacattcggcaatagcatgatctgcctgttccaaatcaccacgagcgctggctgggacggattgttggctccaattctgaactccgccccccccgactgcgaccccgatacaatccatccagggagttctgttaagggtgattgcggtaacccgagcgtggggatattcttttttgtatcctatatcatcatctcatttctggtcgtcgttaacatgtacattgccgtgatcctcgagaactttagcgtggcgactgaggaatccgctgaaccactatcagaggatgacttcgaaatgttttacgaggtgtgggaaaagttcgaccccgatgccactcagttcattgagttttccaagctttccgatttcgccgctgccctggatccacccttgctgatcgctaagcccaacaaagtgcagctcatcgcaatggatctgcctatggtgagtggtgatcgtattcactgtctggatattctgttcgcctttaccaaacgtgtcctcggagaatcaggcgagatggatgctcttcgcattcaaatggaggaccgtttcatggcctcaaatccttccaaggtgagctatgagccgatcacaaccactctgaaacggaagcaggaggaggtgtccgctgccatcatccagcgtaattttagatgctatctcctaaagcagaggcttaagaatatctcctctaactataataaggaggcgattaaaggtcgaatcgatttgccaataaagcaagacatgataatcgacaaacttaacggtaactccacaccagagaagactgatgggtctagcagcaccacaagtccaccgagttatgatagcgtcaccaagccagataaggaaaagttcgagaaggacaagcctgagaaagaatccaagggtaaggaggtccgagagaaccagaaatag

SEQ ID NO: 205490 - DNA, 4095 bp, Artificial Sequence
  Description of Artificial Sequence: Synthetic coding sequence
atggcccaggccctgctggtgccccccggccccgagagcttccggctcttcactcgcgaatcactagcagccattgagaaacgcgccgcggaagagaaagccaaaaaacctaagaaggagcaagacaatgacgatgagaataaaccaaagccgaattctgatcttgaagccggcaagaatctgccattcatttatggagacatcccaccggaaatggtttccgaacccctcgaagatttggacccatactacatcaacaagaagaccttcattgtgatgaataaaggcaaggcaattttccggttctccgccaccagcgcactgtacattctcactccactgaatcctgtcagaaaaatcgcaatcaagattttggtccactcactcttttccatgttaatcatgtgtaccatccttaccaactgtgtctttatgacactgtcaaacccccctgactggactaaaaatgtggaatacaccttcaccggtatctacaccttcgaatccttgattaaaatactggctcgcgggttctgcctggaggactttaccttcctgcgggacccatggaactggctggacttcagcgtaatcgttatggcttatgtcaccgaatttgtggacctgggaaacgtcagtgccttgagaacgttccgggttctgagggccttgaaaacgatttccgtgattccaggtctaaagactatagtgggtgctctcattcagtctgtgaagaagctgtccgacgtgatgatcctgacagtgttttgcctgagtgtgttcgctctgatcggcctgcagctctttatgggcaacctgcgtaataaatgccttcagtggccaccatccgatagtgcattcgagacgaacacgacgagttatttcaacggtactatggatagtaacggtacatttgtcaacgtcacaatgtcaacattcaactggaaggactacataggcgacgacagtcacttttatgtgctggacgggcagaaggacccactactttgcggaaatggctcagatgccgggcagtgcccggagggatacatatgtgtgaaagccggaaggaaccccaattatggttatacgtcattcgatactttctcatgggcttttctgagcctgttccggctcatgacacaggattattgggagaacctatatcagcttaccctccgggccgccggtaagacatatatgatcttttttgtactagtgattttcctcggctccttctatttagtgaatctgattctcgctgtagtcgccatggcctatgaagaacagaaccaagcgactctggaggaggccgaacagaaagaagctgagttccagcagatgctagaacaattgaagaaacaacaagaggaagcccaagccgtagcagccgctagcgcagcttctagggatttctctggaattggaggattgggcgagctcctggaatcctcaagcgaggcttcaaaacttagctcaaagagcgccaaagagtggcggaaccgcaggaaaaagcggcggcaaagagagcacctggaggggaacaataagggggagagggacagctttcctaagtcagaaagcgaggattctgtgaagcggtctagtttcctgttctccatggatggcaaccgcctcacgagtgataaaaaattttgctctcctcatcagtcattactaagcattagggggagcctgttttctccacgacgtaatagcaagaccagtattttctcctttagaggacgagccaaagacgtgggaagcgaaaacgacttcgccgacgacgaacactccacttttgaggacagcgaaagccggagggattcattgttcgtgccccaccgacatggtgagcgacgaaattcaaatggaaccaccactgaaacggaggtgagaaagagaaggctgtctagctaccagatttcaatggaaatgctggaggatagctcagggcggcaacgggcggtgtccatagcatccattcttacaaatactatggaagagctggaagagagcagacagaaatgccctccctgctggtaccgctttgcaaatgtgttcttgatctgggattgctgtgacgcctggttgaaggtaaaacacttggtcaatctgatcgtgatggatccgttcgttgacttagcaatcacaatctgcatcgtgctgaacacactgtttatggccatggagcactaccccatgactgagcagttcagctccgtcctcactgtcggaaatttggtctttacagggatcttcaccgcagagatggtgttaaagattatagcgatggacccgtactactattttcaggaggggtggaatatttttgatggtataatagtctcgctgtccttgatggagttgggcctctctaatgtggaggggcttagcgtgttgagatccttccgcctgttacgggtcttcaaactggccaaatcttggccgacactcaacatgctgatcaaaataattggaaattccgtgggtgccctcggaaatttgacgctcgtcctcgcaataattgtttttatcttcgccgtggttggaatgcagttattcggaaaatcgtataaggagtgcgtgtgcaagatcaacgatgattgtactctcccacgctggcatatgaacgattttttccactcttttctgatcgtctttcgcgtgctatgcggggagtggatagaaactatgtgggattgtatggaggtggccggccagaccatgtgcttgatagtgttcatgctcgtgatggtaattggaaacctggtagtgcttaatctatttctggctttgctgctgtcttctttcagtagtgacaacctggccgcaacggacgacgacaacgaaatgaacaacctgcagatcgcagttggacggatgcagaaaggcattgactatgtaaagaataaaatgcgcgagtgctttcagaaggccttttttaggaaacccaaagtcatcgagattcacgaggggaacaagattgactcttgtatgtcaaacaacacaggcatcgagatctcaaaagaattgaactacctccgggacgggaatggcacgacctccggcgtgggtacagggagctcagtggagaagtatgtcattgatgagaatgactatatgtcgttcataaacaacccgtcactgactgtgacagttccgatcgcagtcggcgagagcgatttcgagaacctcaatactgaagagttcagtagtgagtcagagctggaagagtctaaagaaaagcttaacgcaacatctagtagtgaaggatcaacggtggacgtggtcctgcctagagagggggagcaggccgagacagagccagaggaggatctgaaaccagaggcctgcttcacagaaggatgtatcaagaaatttccgttttgccaggtgtcaaccgaagaaggaaaaggcaagatttggtggaatctcagaaagacgtgttactctatagttgaacacaactggttcgaaacattcatcgtcttcatgatccttctgtcaagcggagcgctggcgttcgaggacatttacatagaacagagaaaaaccatcaaaactatgctggaatatgcagataaagtgtttacatacatattcatcctggaaatgctcctgaaatgggtggcatacggcttccagacatattttactaacgcctggtgttggcttgatttcctaatcgtcgatgtgtcgcttgtgagcctggtcgccaatgccctgggttattctgagcttggcgccatcaaatctctccgtacccttcgggccttgagacctctgagagcactgagtcggttcgaaggtatgcgtgtggtcgtgaatgcactcgtcggcgccatccccagcataatgaatgttcttctcgtatgtcttatattttggctgattttttctataatgggagtgaatctcttcgctggtaaattctaccactgcgtgaacatgaccacgggcaacatgtttgacatctctgatgtcaataacctatccgactgccaggccctcggaaagcaggcccggtggaaaaatgtcaaagttaatttcgacaatgtcggtgccggttacttagcactactgcaggtctag

SEQ ID NO: 205491 - DNA, 603 bp, Artificial Sequence
  Description of Artificial Sequence: Synthetic coding sequence
atggcccaggccctgctggtgccccccggccccgagagcttccggctatttacaagagagtccctggcagccatagagaaaagagcagctgaagagaaagcaaaaaaaccaaaaaaggagcaagataacgatgatgaaaataagcctaagccaaactcagatctcgaggccggaaagaacctccccttcatttacggtgatatcccacctgaaatggtcagtgagccactggaggacctcgacccctactacatcaacaagaaaacttttatcgtcatgaacaaagggaaagctatctttaggttttccgctacatcagctctgtacattctgacgccactcaaccccgtcagaaagattgccattaaaatccttgtgcactccctctttagtatgctgattatgtgtacgatcctgaccaactgcgtcttcatgacgctaagcaacccacccgattggactaagaatgttgagtacactttcacaggcatatatacctttgaatctctgattaagattctggcgcgggggttctgcttagaggacttcaccttccttagagacccgtggaactggttggatttctctgtgattgtcatgtag

SEQ ID NO: 205492 - DNA, 1452 bp, Artificial Sequence
  Description of Artificial Sequence: Synthetic coding sequence
atggtgttcgacttcgtgacccggcaggtgttcgacatcagcatcatgatcctgatttgcctcaacatggtcacaatgatggtagagaccgacgatcagggcaagtacatgacactcgtgctgtccaggattaacctggtgttcatcgtgctttttaccggggagttcgtcctcaaactcgtgtcacttaggcactattactttacaattgggtggaacatctttgacttcgtggtggtgatactgtccattgttggtatgtttttggccgaaatgattgaaaaatattttgtatctcccactctctttcgcgttattcggctcgcgcggatcggaaggatcttaaggcttataaagggcgccaaggggatccgaaccctgttgttcgcgcttatgatgagcctgcccgcattgttcaacatcggactattacttttcttggttatgttcatctacgctatctttggaatgtctaacttcgcgtacgtcaaaaaagaagccggcatcgacgacatgttcaacttcgagacatttgggaacagcatgatctgccttttccagattaccacttccgctggatgggatgggcttttggcgcccatcctgaactcggctccaccagactgtgatcccgacacaattcatcctggaagttcagtcaagggagactgtggcaatccttccgtgggcattttttttttcgtgtcctatatcattatcagcttcctggtggtggttaacatgtatatcgcagtgattctcgagaactttagcgtagctactgaggagagcgccgagcccctgtcagaagacgacttcgaaatgttttatgaggtttgggaaaaattcgaccctgatgctacccagtttatagaattctctaagctgtcggatttcgcagcagctctggatccaccactgctaattgccaaacctaacaaggtgcagttgatcgcaatggacctcccaatggtctcaggagaccggattcattgcctcgatattctcttcgccttcacgaaacgggtgctcggcgagagcggcgagatggatgctctgaggattcagatggaggacaggtttatggcaagtaacccttccaaagtgtcatacgaacccatcaccactaccctcaagcgaaaacaggaggaggtgagtgctgctattatccaacggaatttccggtgttacctgctgaaacagagactgaagaacatcagttcgaattacaataaagaggcaattaaagggaggattgatctacctataaaacaggacatgatcatagacaaactgaatggcaacagcacccctgagaagactgatggcagttcttccactacctctcccccttcttacgacagtgtgacaaagccggacaaggagaagtttgaaaaagacaaaccggaaaaagagagcaaaggtaaagaagttagggaaaatcagaagtag

SEQ ID NO: 205493 - DNA, 648 bp, Artificial Sequence
  Description of Artificial Sequence: Synthetic coding sequence
atgcccgccttcaaccggctgttccccctggccagcctggtgctgatttactgggtatctgtctgtttcccagtttgtgtggaggtgccgtccgaaacggaggcggtccaggggaacccgatgaaactgcggtgtatatcgtgcatgaaaagggaggaggtcgaagccaccactgtggtcgagtggttctaccgaccagaagggggtaaagattttttgatatatgaataccgcaacggccaccaggaggttgaatccccattccaaggcaggctgcagtggaacggatcaaaggatttgcaagatgtgtcaattactgtgcttaatgtgactctcaacgacagcggcttatatacttgtaacgtcagcagagagtttgagttcgaggcgcaccgtccatttgttaaaacaactagactgattccactgagggtgacggaggaggctggcgaggactttacctcagtggtctcagagatcatgatgtatatcctactcgttttcttgactctttggctcctgatcgaaatgatctactgctacaggaaagttagcaaagccgaggaggctgcccaagaaaatgctagcgactatctggccattccaagcgaaaataaagaaaattcagcggtccccgtggaagaatag

SEQ ID NO: 205494 - DNA, 648 bp, Artificial Sequence
  Description of Artificial Sequence: Synthetic coding sequence
atgcccgccttcaaccggctgttccccctggccagcctggtgctgatttattgggtgtccgtatgcttccctgtgtgcgtagaagtcccttccgagaccgaagccgtgcagggaaatccgatgaagctgcggtgtatatcatgtatgaaaagggaggaagtggaagccaccacggttgtagagtggttttatcgccctgagggaggaaaagattttctcatttatgagtatagaaacgggcaccaggaggtggagagtcctttccaggggcgtctgcagtggaatggttccaaggatctgcaggacgtctccatcaccgtcttgaacgtgactctgaatgactctggactgtatacttgcaatgtgtccagggagttcgaatttgaggcccatcgccctttcgtcaaaaccacaaggctgataccattgcgggtgacagaggaagcaggagaagacttcaccagcgtagtcagcgaaatcatgatgtatattttgctggtgtttctgacgctgtggctgctgatagaaatgatctattgctaccgtaaggttagcaaagctgaagaggccgcccaggagaatgcatctgattatttggccatcccaagcgagaacaaagagaacagcgcagtacctgtggaagagtag

SEQ ID NO: 205495 - DNA, 426 bp, Artificial Sequence
  Description of Artificial Sequence: Synthetic coding sequence
atgcccgccttcaaccggctgttccccctggccagcctggtgctgatttattgggtgagcgtatgtttcccagtgtgcgttgaggttccctccgagactgaggctgtgcagggaaatccgatgaagttgcggtgtatcagttgcatgaaacgggaggaggtcgaggccacaactgtcgttgagtggttctatcgccccgaagggggaaaggattttctgatttacgagtaccgcaacggccatcaggaagtagaaagtcctttccaggggcgccttcagtggaatgggagcaaggacctccaggacgtttctataactgtgctgaatgttactttaaatgactccggtctgtatacctgcaacgtgtccagggaatttgagtttgaggcccataggccatttgttaaaacgacgcgcctcatctag

SEQ ID NO: 205496 - DNA, 648 bp, Artificial Sequence
  Description of Artificial Sequence: Synthetic coding sequence
atgcccgccttcaaccggctgttccccctggccagcctggtgctgatatactgggtcagtgtgtgcttcccagtgtgtgtagaagttccttcagaaacagaggctgtacagggtaaccctatgaaactacggtgcatttcctgcatgaaacgtgaggaggtggaagccaccaccgtcgtggaatggttctatagaccagaaggtggcaaggactttctgatctacgaatatcgtaacggacaccaggaagtggagtcacctttccagggtagattgcagtggaacgggtccaaggacctgcaggatgtgtccattactgttctgaatgtgactctgaatgatagcggattatatacttgtaacgtgtcacgtgagttcgaatttgaggcccatcgtccgttcgttaagacgacgaggctgattcctcttagagtgaccgaggaagctggagaggatttcaccagtgtggtcagtgagatcatgatgtatattctcctggtctttctgaccctttggctgctgattgaaatgatttattgttataggaaggtgtcaaaggccgaggaggccgcccaggaaaatgcaagcgactatctagcaataccatctgaaaataaagaaaactccgccgtccccgtggaggagtag

SEQ ID NO: 205497 - DNA, 5511 bp, Artificial Sequence
  Description of Artificial Sequence: Synthetic coding sequence
atggcccggcccagcctgtgcaccctggtgcccctgggccccgagtgcctgcggccattcacaagggagtctttggctgccatcgaacagcgagctgtggaggaagaagcacggctccagcggaataagcagatggaaatcgaagaaccagaaaggaagcccagaagtgatttggaagcaggcaagaatttaccaatgatctacggggatccccccccggaggtcatcggcattcccctggaggatctggatccctattattccaataagaaaacatttatcgtactcaacaaaggtaaagccatctttcgcttctcggcaacccctgccctctacctgctctccccctttagcgtggtcaggaggggagccatcaaggtgcttattcacgctctgttcagcatgtttattatgattactatcttaacaaattgtgttttcatgacgatgtcggatcccccaccttggtccaaaaacgtggagtacacgtttaccggtatctatacattcgagagcctcattaaaatcctggcaagagggttctgtgtggatgatttcactttcctgagggatccatggaattggctagatttttccgtgattatgatggcatacctcacagaatttgtggatctcggcaacatctcggcgctcagaacattcagggtcctgcgggcactgaaaaccattaccgtaattccaggattgaaaacaattgtgggagctttgatacaatccgtgaagaaactgtctgatgtgatgatcctgaccgtcttctgtttgtctgtttttgcactggtaggattacagctattcatggggaatctcagacagaaatgtgtcagatggccacctccatttaatgatacaaacactacctggtacagtaacgacacctggtacggaaacgacacatggtacggaaacgaaatgtggtatgggaacgattcatggtacgccaacgacacttggaattcccacgcgtcttgggccacaaacgacacatttgactgggacgcttacatctccgatgagggcaatttctactttctggagggatctaatgatgcccttctgtgcggaaattcttctgacgctgggcactgcccggaggggtatgaatgcattaagactggacggaaccctaactacggatataccagctacgacacgtttagctgggctttcctggcactgttcagactgatgacgcaggattactgggagaatctcttccagctgaccctcagggccgctggaaaaacgtacatgatcttttttgtcgtaatcatttttttaggatctttctaccttataaatctgatcctggctgtcgtcgctatggcttatgcagagcagaatgaggccacacttgctgaagataaagagaaagaagaggaatttcaacaaatgttggagaaatttaagaaacaccaggaagagctagagaaagccaaagccgcacaagcactcgagggtggcgaagctgatggcgatccggctcatggcaaagactgtaacgggtcactagacacctcccaaggagaaaaaggcgctccacgtcagtcgtcatcaggagactcaggcatttcagacgcgatggaggaattggaggaggcccatcaaaaatgtccaccatggtggtacaagtgcgcccacaaggtcctgatctggaactgctgcgctccttggttaaaattcaagaacattatacatctcattgtgatggacccattcgtggacctaggtataaccatatgcatcgtcctcaatacactgttcatggctatggagcactatcccatgaccgagcatttcgataatgtcttaactgtcgggaaccttgtgttcactgggatctttacagccgaaatggttctcaagctgatagcaatggacccctacgagtatttccagcaagggtggaatatcttcgatagcataatcgttaccctgtccctggtggagcttggtttggctaacgtgcaaggactgtctgttctgcgcagctttcggctcctcagagttttcaagctggccaagtcatggcctacactcaacatgctgattaagatcattggcaacagtgttggggcccttgggaatcttactctagtcctggcaataattgtatttattttcgccgtggtggggatgcagctttttggcaagtcctataaagaatgcgtgtgtaagatcgcgctggactgcaacttgcctaggtggcatatgcacgacttcttccattctttccttattgtgttcagaattctgtgtggcgagtggatcgaaaccatgtgggactgcatggaggtggcagggcaggccatgtgcttgacggtgttcctgatggtcatggttatagggaatctggtcgtactgaatctcttcctggccctcctcctgagctctttcagcgcagattcgctggcggccagcgatgaagacggggagatgaacaatttgcagatcgccatcgggagaataaaactgggaataggctttgcaaaagcattccttctgggcctgctgcatggcaaaatcctgtcccctaaggatatcatgttgtcactcggcgaggctgacggcgccggtgaggcgggggaggctggcgagacagcccctgaggacgagaagaaggaaccccctgaggaagacctgaagaaggacaaccatatcttaaaccatatggggctggcagacggcccaccttctagcctggagcttgatcacctgaatttcattaataatccttacttaaccatccaagttcctatcgcgtcagaggagtctgacttagaaatgccaactgaggaggagactgacactttctctgagccggaggactccaagaaacctccacagcctctttacgacggaaattccagcgtttgtagtactgctgactataaaccccccgaagaggatccagaggaacaagcggaagaaaacccagagggggaacagcctgaggaatgtttcacagaggcctgcgtgcagaggtggccctgcttgtacgtcgatatttcccaaggtcggggaaagaagtggtggactctgcgacgggcctgttttaaaatcgttgagcataactggtttgaaaccttcatagtgtttatgatattactgtcctccggagccctcgcctttgaggacatctatattgaacagcgtcgggtaattaggaccatcttggagtatgccgacaaggtgtttacctatattttcatcatggagatgttattgaagtgggtcgcgtacgggttcaaggtgtatttcacaaacgcatggtgctggctagactttttaatcgtggatgtgagtattatctctctcgtagctaactggctcggctacagcgaattgggccccataaaatccctgaggacactccgtgcactgcgacccctgagagctctgtcccggttcgaaggaatgagagtagtagtgaatgctctgctgggggccatccccagcatcatgaacgtgctgctcgtctgcctgatcttttggctcatcttctctatcatgggcgttaaccttttcgcagggaagttctattactgcataaatactaccacgtcagagagatttgacatctcggaggtcaacaataagtccgagtgcgagtctctgatgcacaccgggcaggtaagatggttgaacgtgaaggtgaattacgacaacgtcggactgggctatttaagtctcttgcaggttgcaactttcaaggggtggatggacatcatgtatgctgcagtcgattctagggaaaaggaagagcagcctcagtacgaagtgaacctttacatgtacctgtatttcgtgatattcataatttttgggtccttttttacgctaaacttatttatcggcgtcattatagacaattttaaccagcagaagaagaaattaggcggcaaggacatcttcatgaccgaagagcagaaaaagtattataatgcgatgaagaagctcggatccaagaagccccagaaacccattcctagaccgcaaaataagatccagggtatggtctacgatctggtgactaagcaagcatttgatatcacgatcatgatccttatctgtcttaacatggtgaccatgatggtagaaaccgataaccagtctcagttgaaggtggacattttgtataacattaacatgatcttcattattatatttacaggagaatgcgtgttgaaaatgctagcgctgcgccagtactatttcaccgtggggtggaacatttttgactttgtggtggtcattttgtctatcgtgggcctagctctatcagaccttatacaaaaatattttgtctcacccaccctctttagagtgattcgcttagctcggatcggtcgcgtgctgaggctgattagaggagctaaggggatacgaaccctgctgttcgccctcatgatgagtttgccagcactgttcaacatcggacttctgctgttcctggtgatgtttatttactctatcttcggcatgagcaactttgcctatgtgaaaaaggagtccggcatcgacgacatgttcaattttgagactttcggtaacagcattatctgtctgtttgagattaccacctccgctggatgggacgggctgttgaaccccatcctgaactccggacctccggattgcgatccgaatttggagaatcccggcacctcagtgaagggcgactgcggaaatccatctataggcatatgttttttttgtagctacatcatcatatcgtttctaatagtcgttaacatgtatatcgccattatcctcgagaactttaatgttgctacggaggagtcttccgaacctttaggtgaagacgatttcgagatgttttacgagacttgggagaaatttgaccctgatgcaacccagttcatagcatattcaagactttctgattttgtcgatacccttcaggagcccctccgtatagcaaaacctaacaagatcaaactgatcaccctcgatctgccaatggttcctggagacaagatccattgcctcgatatcctattcgcccttactaaggaggtgctgggcgattcaggcgagatggatgcactgaaacagaccatggaggaaaaatttatggcggccaaccctagcaaggtgtcctacgagcccattacgaccacgttaaagaggaagcatgaggaagtttgcgccatcaaaatccagcgggcctaccggcggcatttgcttcaaaggtctatgaaacaggctagctacatgtatcgacactctcatgacggcagcggggacgacgcccctgaaaaagaaggactattagcgaacacgatgtcaaaaatgtatggtcatgaaaacggaaactctagcagcccatctcctgaggagaagggggaggccggtgacgcgggtcctacaatgggcttaatgcccataagcccatcagatacagcatggccacctgcacccccccctggccaaaccgtaagacctggagtgaaggaatctttagtctag

SEQ ID NO: 205498 - DNA, 687 bp, Artificial Sequence
  Description of Artificial Sequence: Synthetic coding sequence
atgcccggcgccggcgacggcggcaaggcccccgcccggtggctgggaacaggactgcttggcctgttcttactgccagttacgctgagcctcgaagtgtcggtaggcaaagctaccgatatatatgcagtgaacggcacagaaatattactgccctgcaccttctcctcatgttttggatttgaggacctccacttcagatggacatacaactcctcagacgctttcaagattttaattgagggaaccgtaaagaacgagaaatctgatccaaaggtaacattgaaggatgacgatcgtatcaccctggttggaagtaccaaagagaagatgaacaatattagcatcgtgctaagggatttggaattttcagatacagggaagtacacctgtcatgtaaaaaaccccaaggaaaataatctgcaacaccatgccacaatctttcttcaggtcgttgaccgccttgaagaagtagacaacacagtcactctgatcatcctggctgttgtcggaggcgtcattgggctgctgatcctgattctgttgatcaaaaaactgattatttttatattgaaaaagaccagagaaaagaaaaaagagtgtttggtgtcttccagcgggaatgacaataccgagaacggactgcccggcagtaaggccgaagagaagcccccatccaaagtgtag

SEQ ID NO: 205499 - DNA, 285 bp, Artificial Sequence
  Description of Artificial Sequence: Synthetic coding sequence
atgcccggcgccggcgacggcggcaaggcccccgcccggtggctgggcacgggcctgcttgttgaggaagtggacaataccgtcaccctgatcatcctcgccgtggtaggaggggttattgggttactgatcctcatccttctgatcaaaaagctgattatttttatcctgaagaaaaccagggagaaaaagaaagagtgcctggtgagttcctcgggcaacgataacaccgaaaacggcctgcctgggtccaaagcagaggaaaaaccaccctccaaggtttag

SEQ ID NO: 205500 - DNA, 5970 bp, Artificial Sequence
  Description of Artificial Sequence: Synthetic coding sequence
atggccatgctgcccccccccggcccccagagcttcgtgcacttcaccaaacagtctcttgccctgatcgaacagcgaattgcagagcggaagtccaaagagcctaaagaggaaaagaaggatgacgatgaagaggcacctaaaccaagctcagatttggaggccggaaaacaactcccatttatttacggtgacataccaccagggatggtgtctgaaccacttgaggacctggatccatattacgctgataagaaaacattcattgtcctcaataagggaaaaaccatcttcaggttcaacgctactccagccttgtatatgttgtctccttttagtcctctacgtaggatctcaatcaagatcttagtgcacagtaccctattttcgatgcttatcatgtgtaccatcctcaccaattgcattttcatgaccatgaacaaccctcctgactggactaaaaacgtggagtacacatttaccggcatctatacatttgaaagtcttgtgaagattttggcacgtggtttctgcgttggtgagtttacatttcttcgagatccttggaattggctggacttcgtcgtaatcgtattcgcttatctgacggaattcgtgaacctagggaatgtgagtgctctcagaacgtttagagtgcttagagctctgaagacaatcagcgtcattcctgggctcaaaactattgtgggcgcactgatccaatccgtgaaaaaactgagcgatgtgatgatactcaccgttttttgcttatctgtgtttgcactgataggactgcagctttttatgggaaatctgaagcacaagtgctttaggaacagcctcgagaataatgagactctcgagagtatcatgaacacccttgaatcggaagaggacttcagaaaatacttctattatctggaaggcagcaaggacgccctgttatgcggcttctctacagacagtggccagtgccccgagggatacacctgcgtgaaaattgggaggaatcccgactatggctatacttctttcgacacattctcatgggcatttctggccctctttcgcctgatgacccaggattactgggagaatctctaccagcagactttaagggctgccggtaagacttatatgattttcttcgttgtggtcattttcctgggctcattttatctcataaacttgatactcgccgtcgttgcgatggcctacgaggaacagaaccaggcgaatattgaggaagcaaagcagaaagaactggagtttcaacagatgcttgatcggctgaagaaggagcaagaagaagctgaggccatcgctgccgcggcagctgagtacacatccattagacgctctcggataatgggactttctgagtctagcagtgagacaagtaagcttagctccaagagcgccaaagagagaaggaaccgacggaagaaaaagaatcagaaaaaactaagttcaggagaagagaagggtgatgctgagaaactcagtaaatcagagtcagaggactctatacgtaggaagtcctttcacttgggtgtcgaaggccacaggcgggcacacgaaaaacggttatccacaccaaatcagtcccctctcagcatcagaggctccctattcagcgcccgccgatccagtagaacgtcattgttcagttttaagggaaggggcagagatattgggtcagagaccgagttcgctgatgatgaacacagtatctttggcgataacgaatcacgtaggggatctctatttgtgcctcatcggccccaagaacgcaggtcgagtaacataagccaggctagccgcagtccgccaatgctccctgtcaacggaaagatgcattccgccgtggattgtaatggggtagtgtctctcgtcgacggccgatctgcccttatgctgcctaatggtcagctgctgccagaggtgatcattgacaaagcaacaagcgacgactctggaaccaccaaccagatacacaagaaaagacggtgttcttcatatttgttatcggaggatatgctgaacgatcccaatttacgacagagggccatgagccgcgcctctatcctaacaaatacagtggaagagctggaggaatctaggcagaagtgtccgccctggtggtatcggtttgcacacaaattcctgatctggaactgcagtccatattggatcaaattcaagaagtgtatttactttatcgtgatggaccccttcgtggaccttgcaataacaatttgtatcgtgcttaacactttattcatggccatggaacaccacccgatgactgaagagttcaagaatgttctggctattgggaatctcgtttttactgggattttcgctgccgagatggttctgaaacttattgccatggacccgtatgaatattttcaggtgggctggaacattttcgactcactgattgtcaccttgagtttagtcgagctgttccttgctgatgttgaaggtctatcagtattgaggtctttccggcttctgagggtgttcaaactggcaaagagttggcccactctgaacatgctcattaagattatcggaaactcagttggagcgctggggaacctgactttggtcctagcgattatcgtgttcatttttgcagtagtcggcatgcaactctttggaaagtcttacaaagagtgtgtttgcaagataaacgatgactgcactctcccgaggtggcatatgaatgactttttccactcatttttaattgtcttccgagtcctgtgcggtgaatggattgagacaatgtgggactgcatggaagttgcagggcaggccatgtgcttaatcgtctacatgatggtcatggttatcggcaatcttgtagtactgaacttgttcctggcgttactgctgtcaagcttctcttccgacaacctgaccgctattgaagaggatcccgacgctaataacttgcagatcgcagttacccgaatcaaaaaggggattaattacgtgaagcaaactttgcgagagttcattctcaaggccttcagcaagaaaccaaagatcagccgggaaatccgacaggccgaggacttgaataccaaaaaggagaactatatatcaaaccatactctggctgaaatgtctaaagggcacaactttctgaaagagaaagataagataagcggatttggttcaagcgtggacaagcaccttatggaagactctgacgggcagtcattcattcacaacccgagcctgacagttactgtccctattgcccccggagaatccgacctggagaacatgaatgccgaggaactgagcagcgacagcgatagtgaatacagcaaagtccgcttaaatcgctcttcttcctcagagtgctcaaccgtggacaatcccctcccaggggaaggggaggaggccgaggccgagccaatgaatagtgatgaacccgaagcatgcttcactgacggctgcgtgtggaggttcagctgttgtcaggtcaacatcgaaagtggcaagggcaagatttggtggaatattcgaaaaacgtgctataagatagtggagcatagctggttcgagagcttcatcgttttgatgatcctgctgtcctcgggcgcgttggcctttgaggacatttacatagagagaaaaaagacaatcaaaattattctggagtacgcggataagatttttacttacattttcatcttagagatgcttctaaagtggatcgcctacggctataaaacatacttcaccaacgcgtggtgctggttggatttcctaatagtggatgtgtctcttgttactctggtggcaaacacactgggctactccgacctgggtcccataaaaagcctgcggaccctccgggcgctaaggcccttgcgcgctctctccaggtttgaaggcatgcgcgtggtggtgaacgcattgattggtgctattcctagcatcatgaacgtcctgctggtgtgcctgatcttctggctaatctttagtatcatgggcgttaatctatttgccggcaaattttatgaatgtataaataccactgacggcagccgctttcccgcctctcaagtaccaaatcggtcagaatgtttcgctttaatgaatgtcagccaaaacgtgcggtggaaaaacttgaaagtgaatttcgacaacgtggggctgggatatttgtccttactccaggttgcaacttttaaggggtggactatcattatgtacgctgctgtggacagtgttaacgtggacaagcagcctaagtacgagtactcactctatatgtacatatatttcgttgtcttcattatcttcggaagtttctttactctcaatctgtttatcggtgtaatcatcgacaatttcaaccaacaaaagaaaaagctgggcggtcaggatatatttatgaccgaagaacagaaaaagtattacaatgcaatgaaaaaactcggcagcaagaaaccacagaaacctatcccgaggccaggtaataaaattcagggctgtatatttgaccttgtcactaaccaggcctttgatataagcatcatggtgttgatctgtctgaacatggtgacaatgatggtggagaaagagggccagagccagcacatgactgaagtcctttattggattaatgtggtgttcataattctcttcactggtgagtgcgttttaaagctcatcagcttgcgccattactatttcacagtgggatggaacatttttgactttgtcgttgtgatcatctccattgtgggtatgttcctggcagatttgatagagacctattttgtctctcctactttattccgtgtcataagattggctagaatcggccggattttgagactggtgaagggggctaaggggatccggacccttctgtttgcccttatgatgtctctgcccgcgctgtttaacatcggcctgttgttgttcttagttatgtttatttacgccatttttggaatgagtaacttcgcatacgtgaaaaaggaggatgggatcaacgatatgttcaacttcgagaccttcggaaattccatgatttgcctgttccagattactacctcagccggttgggatggcctcctagcacctattttgaattcaaagccacccgactgtgatccaaaaaaggtccatcccggttcaagcgtggagggagattgcgggaacccaagtgtgggcatcttttacttcgtctcctacattataatatcatttctcgtggtggtaaatatgtatatcgctgtcatattggaaaacttctccgttgctacagaggaatctactgaaccgctgagcgaggatgactttgagatgttttatgaagtttgggagaaattcgatccagacgcgacccagtttatagagttcagtaagctcagcgatttcgccgcggccctagacccccccttgctgatcgccaagccaaataaagtgcaactcatagcgatggacctgccaatggtgagcggagatagaatccactgtctagatatcctgttcgctttcactaagcgggtcctcggggagtctggggagatggattctttgcgctctcagatggaggaaagattcatgtcagcgaacccctccaaagtctcttatgaaccaattactaccaccctgaagcgaaagcaagaggacgtttcggccacagtgatccaacgcgcgtaccggagatatcgcctgaggcaaaacgtgaagaatatcagctcaatttacatcaaagatggagaccgagatgatgatttgctgaataagaaggacatggcgttcgataacgttaatgaaaattcttcccctgaaaagactgacgccacttcctccacaacatcccccccctcctatgactccgttacaaagccagataaagagaaatatgagcaagaccgcacagagaaggaagacaagggaaaagatagcaaggagtccaagaagtag

SEQ ID NO: 205501 - DNA, 5970 bp, Artificial Sequence
  Description of Artificial Sequence: Synthetic coding sequence
atggccatgctgcccccccccggcccccagagcttcgtgcacttcactaagcagagcttggcactgatcgagcaaagaatagccgaacgtaagagtaaggaaccaaaagaggagaaaaaggacgacgacgaggaagctcctaaacctagctctgacctagaagcaggtaagcagctcccgtttatttacggcgatatcccaccaggcatggtgtcagagcccctcgaggatctggatccatactacgcagacaagaaaaccttcatagtgctgaacaaaggcaaaacgatatttaggttcaacgcaactcctgctctctacatgttgtccccattctctcccctgcgccggatatccatcaagatcctggttcattccacactgttcagcatgttaataatgtgcaccatcttgaccaattgtatcttcatgaccatgaacaaccccccagactggacgaaaaatgtggaatatacgtttaccggaatatacacgttcgagtctctggtgaagattctcgcccggggattctgtgtgggcgaattcacttttctgcgggatccttggaactggttggactttgttgtgatagtattcgcatatgtgacagagtttgtggatctgggtaatgtgagcgccctacgaaccttcagagttctccgggctctgaaaaccatctccgtcattccaggcctgaagactatcgtcggagccctgatccaatcggtaaagaagctatctgacgtgatgatactcaccgtgttctgcctcagcgtgtttgcactgattggccttcagttgtttatgggaaacctaaagcacaaatgttttcgtaacagcttggagaataatgaaaccctggagagcataatgaacacactggagtcagaggaagattttagaaagtatttctactacctcgaaggatctaaagatgcgctcttgtgcggtttctccacggacagcggccagtgtccagaaggatacacctgcgtgaaaatcggacgcaaccccgattatggatataccagctttgatactttcagctgggcctttttggcactttttaggctcatgacgcaggactactgggagaacctctatcaacagaccctccgcgcagcaggcaagacatatatgatcttttttgtggtggtgatctttctggggagtttctatctcatcaacctgattctcgctgttgtggccatggcatatgaggaacagaaccaggccaatattgaggaagccaaacagaaggaactagaatttcaacagatgctggaccgactcaaaaaagagcaagaagaagccgaggcaatcgctgccgccgctgcagaatacaccagtatccgcagatcccggattatgggactctcggaatcttcttccgaaacatccaagttatcttcgaaatcagcgaaagagaggcggaatcgacgaaagaagaagaatcagaagaaactctccagcggcgaggagaaaggcgatgccgaaaagctctctaagtctgaaagcgaagattccatacggagaaaatctttccatctgggagttgagggacacagacgcgcccatgagaaaagactaagcaccccaaaccaatctccactgtcaattcggggttccctgtttagcgcaaggcgttctagccgcacctccctcttttcattcaaaggaagagggagggatattggttcagagaccgaattcgcagatgacgaacattccatttttggcgacaatgagtctcgccggggttctctatttgttcctcacaggcctcaggaacgccggagcagcaacatctcccaagcgtcgcggtctccgcctatgctcccggtgaatggaaaaatgcactccgccgtggactgtaatggcgtcgtgtcattagtagacggcagaagcgctttgatgctcccaaatggtcagcttctgccggaggtaatcatcgacaaagccactagcgatgatagtggcaccaccaaccagatccacaagaagcgacggtgctcttcatacctgctgtctgaagatatgttgaatgaccccaaccttaggcagcgagcaatgtcccgggcttcgatcctcacgaatactgtcgaggaactggaggagtccagacaaaaatgccccccttggtggtaccgcttcgcgcacaaattcctcatctggaactgctcaccatactggataaaattcaagaagtgtatctactttatcgtgatggaccccttcgtggacctggctattactatatgcattgtactcaacacccttttcatggctatggagcaccaccccatgactgaggaatttaaaaatgtcttggctatcgggaaccttgtgtttaccggcatcttcgccgcggagatggtcctgaaactcatcgctatggacccatacgaatactttcaggtcggttggaacatattcgatagcctcatcgtcactttgtccctcgtagaattgtttttggcagatgtcgaaggcctgtccgtactgagatccttccgcctgctgagagtgttcaaactggccaaatcctggcctacattgaacatgctcatcaagatcataggcaattctgttggggcactagggaacctgacgctggttctggccatcatcgtattcattttcgcagtggtgggtatgcagttgttcggtaagtcatacaaggaatgtgtctgtaagatcaacgacgattgcaccctgcctcgttggcatatgaacgacttcttccattccttcttgatcgtgtttcgtgtgctgtgtggtgaatggattgagactatgtgggactgcatggaagtggctggtcaggccatgtgcctaatagtgtatatgatggtgatggttataggaaaccttgtcgttctgaatcttttcctcgcccttcttttaagcagcttctcctcagacaatctgaccgctattgaggaagaccctgacgccaataatctgcaaattgcagtgaccaggattaagaaaggtattaattacgttaaacagactctgagagagtttatccttaaggctttcagtaaaaagcccaagatttctagggaaattaggcaggccgaggatctcaatacgaaaaaagagaactacatctcaaatcatacgctagctgaaatgtccaaagggcacaactttcttaaagagaaggataagatttctggctttggtagttcagttgacaagcacctcatggaagactctgatggccagagcttcatacacaacccctcacttaccgtgacagtcccaatcgcccctggggaaagcgacctcgagaacatgaatgcagaggagttgagctccgatagcgacagcgaatacagcaaggtccgattgaatagaagctcttcatctgagtgcagcaccgtggacaaccccttgcctggtgagggcgaggaggcagaagcggaaccaatgaattctgacgagccggaggcttgttttaccgacggatgcgtttggcgcttttcatgctgtcaagtgaacatcgagtctgggaaaggtaaaatatggtggaatattagaaaaacttgttataagattgtagaacactcttggttcgaatctttcattgttctcatgatcctgctctcctctggcgcactggccttcgaagacatctacatagaacgaaagaagacaatcaagatcattctggagtacgcagataaaatttttacctatatctttattttggaaatgctcttgaaatggattgcctacgggtataaaacctacttcactaacgcatggtgctggttggattttctgatagtggatgtttccctagttaccctggtcgctaataccttgggctattctgatctgggaccaatcaagtctctgcgaaccctccgcgctctgagaccactgcgcgcccttagtaggttcgaggggatgagggtagtcgtgaatgcgctaattggcgcaatcccctctattatgaacgtcttgttggtatgcctgattttctggttaatattctctatcatgggcgtcaatttgtttgctggaaagttctacgagtgtattaatactaccgatggcagcagattccctgcgtctcaagtcccgaatcgctccgaatgttttgctttaatgaatgtgtctcagaacgttaggtggaaaaatctgaaggtcaactttgataacgtcggactgggctacctttccctcctgcaagtcgccactttcaaagggtggaccattatcatgtacgctgccgtggacagcgtgaacgttgacaaacagccaaaatacgagtatagcctgtatatgtatatctacttcgtggtctttatcattttcggcagtttctttactttgaacctatttatcggagtgatcattgataatttcaaccagcagaaaaagaaactgggcggtcaggatatatttatgacagaagaacagaagaagtactacaacgcgatgaagaagttggggagcaagaagcctcagaagccaattccccgaccaggcaataagatccagggatgcattttcgacctcgtgacgaatcaagcttttgacatctcaatcatggtgctcatctgtcttaacatggtgactatgatggttgaaaaagagggacagagtcagcatatgaccgaagttctctactggattaacgtcgttttcatcattctattcactggcgagtgtgttctgaaacttatcagcttgcgacattactatttcacagtgggttggaacatttttgatttcgtcgtggtgattatttcgattgtgggcatgtttttggccgacctaatcgaaacttacttcgtgagcccgaccctgtttcgcgtgatcaggttggcccgaattgggcgcattttacggctcgttaaaggcgccaagggtatcagaacattactcttcgctctgatgatgtcactgcccgccctgttcaacatcgggctgctactgttcctcgttatgtttatctatgctatcttcggcatgagcaatttcgcatacgttaaaaaagaagatggcataaatgacatgttcaactttgaaacttttgggaatagcatgatatgcttgtttcagatcaccactagcgctggctgggacgggctgcttgcccccatcttgaacagcaaaccgccagattgcgaccccaagaaggtgcatccagggtctagtgttgagggtgactgcggaaacccaagcgtgggaattttctacttcgtgagctatattattatttcttttctagtggtcgttaatatgtatatcgcagtcatcttggaaaacttcagtgtggcaactgaggaatctacagagcctctatcagaagacgattttgaaatgttttacgaagtgtgggaaaagtttgaccctgacgcgacacaattcatagaattttccaaacttagcgattttgcagctgccctcgaccctccacttctgatagctaaacccaacaaagtgcagttaatcgccatggatctacctatggtcagcggagatcgcattcattgcttagatatcctgtttgccttcaccaaacgcgtgctgggggagtccggcgagatggatagcttgcgcagccagatggaggagcgctttatgtccgcaaatccatcaaaggtatcttatgagcccatcaccaccacgttgaaaagaaagcaggaggatgtgtcagccacggtgattcagcgcgcttatagacggtaccgactacgccaaaacgtgaagaatatatccagcatctacatcaaggacggcgaccgcgatgatgatttgctgaacaaaaaggatatggccttcgacaatgtaaacgaaaattcttcacccgaaaagacagatgccactagctctactacgtcccctccttcctacgacagcgtgaccaaacccgataaagagaagtatgaacaagacagaaccgaaaaggaggacaaaggtaaagactccaaggaaagcaagaagtag

SEQ ID NO: 205502 - DNA, 5967 bp, Artificial Sequence
  Description of Artificial Sequence: Synthetic coding sequence
atggccatgctgcccccccccggcccccagagcttcgtgcacttcacaaagcagtcccttgcactgattgaacagcgcatcgccgagcgtaaatctaaagagccaaaggaggagaaaaaagatgacgacgaggaggctccgaagccctcttctgacctcgaggcagggaaacagctgcctttcatctacggtgacatcccaccaggcatggttagtgaacccttggaggacctcgacccctattacgctgataaaaagacttttattgttcttaataagggcaaaacgatattcagattcaacgccacaccggctctttacatgctcagcccgttttccccactgagacgcatctccatcaagattctcgtgcacagcctgttttcgatgctgataatgtgtactatcctcaccaattgtatattcatgacgatgaataaccccccagactggacaaagaatgttgaatatacctttacaggaatatataccttcgagtctctggtcaagatcttggcgcgtggcttctgtgtgggggagttcacctttttgcgcgacccttggaattggctagatttcgtcgtgatcgtgtttgcctacttgacagaattcgttaatctgggcaacgtgtctgcgctgagaaccttccgggtcctgcgcgccctgaagacaataagcgtgattcctggcctgaagactattgtgggcgccctcatccagagtgtaaaaaagctgtcagacgtcatgatactgactgttttttgcctgtccgtgtttgctcttatcgggttgcagctgttcatgggcaacctgaaacataagtgcttcaggaactcgctcgagaataacgagaccctggaatccattatgaatacgctagagagtgaagaggattttcggaaatacttttactacctggagggctccaaggacgccctcctgtgcggattctcgacagatagtggacagtgccccgaagggtacacctgcgtcaaaatcggacgcaatcccgactacggttatacatctttcgacacatttagctgggccttcttagctctgttccggcttatgacccaggactactgggaaaatctttaccagcagacattaagggctgccggcaaaacttatatgatcttttttgtcgtggtcatcttcctgggatcattctatctgataaacctgatactggctgttgtggcaatggcgtacgaagaacagaatcaggcaaacattgaggaagcgaaacaaaaggaactggaattccagcagatgttggataggctgaagaaggagcaggaggaagccgaggccattgctgccgcagccgctgagtatacaagcattcgtcgctcccggattatgggcctctctgaatcctcctctgaaaccagtaagctgtcctcaaagtccgccaaggagcgcaggaatcgccgtaaaaaaaagaatcagaaaaaactgtccagcggagaggaaaaaggggacgcagaaaaactgtctaagagtgaatccgaggactcaattcgacggaaatcctttcacctcggagttgaagggcaccggcgcgcccacgaaaaacgtctgtctacccccaaccagagcccgctctctatcaggggatcgctgtttagcgcacgccgcagctctaggacttctctgttcagctttaagggacggggcagggacatcggcagcgaaaccgaatttgctgatgatgagcactccatctttggggacaacgagtctcgtcgtggcagcttattcgtaccccatagacctcaagaaagaagatcctccaatatctcacaggcttcccgctccccaccgatgttgccggtgaacgggaagatgcacagcgcagttgactgcaacggagtcgtgtcgctggtcgacggacgttctgcattaatgttgcctaatggccagctgctgccagaggtcataatcgataaggctacatccgacgactccgggaccactaaccagatccacaagaaaagacggtgttccagctacctcttatccgaggacatgttgaacgacccaaacctcagacagcgcgctatgtcacgggctagcattcttactaatactgtggaggagttggaggagagccgtcagaaatgcccgccgtggtggtacagattcgcccataaattcctgatttggaattgcagcccctattggattaagtttaagaaatgtatctactttatcgtgatggatccatttgtcgatttggctattacaatctgtatcgtgttgaatacgctatttatggcaatggagcatcatccgatgaccgaggaatttaagaatgtgcttgcgatcggcaatcttgtattcaccgggatattcgccgccgagatggtgctgaagctcatcgcaatggatccgtacgagtacttccaggtcgggtggaacatttttgatagcctgattgttacactgagtctagtcgagctattcctggccgacgttgaaggtctgtcagtacttcggagctttcgcttattgagggtcttcaagctcgctaaatcctggccaacgttaaacatgctgatcaagatcatcggcaattcagtgggcgcgctcggtaacttgacattagtacttgctataatcgtcttcatctttgcagtagtgggtatgcagcttttcggtaagagctataaagagtgtgtgtgtaagatcaacgacgattgcaccttacccaggtggcatatgaatgatttctttcactctttcctgatcgtcttcagggtgctctgcggtgagtggattgaaaccatgtgggactgtatggaagtagcagggcaggccatgtgccttattgtctacatgatggttatggtgatagggaatttagttgtgctcaacttgtttttggccttgttactctcctctttctcatcggataacctcactgcaattgaggaggacccagacgccaataatctgcagattgcagttacccgcatcaaaaagggaatcaattacgtcaaacagacactcagagagttcatcctgaaggcattttccaaaaaaccaaagatctcgagggagatacggcaagccgaagacctgaataccaaaaaggaaaactatatctccaatcatactctcgctgaaatgtctaaagggcacaattttctcaaagaaaaggacaaaatcagtggtttcggtagctcggttgataaacacttaatggaagactcagatggtcagagttttatccacaacccttctctgacagttaccgtgccaatcgctcctggagaaagcgacttggagaacatgaatgccgaggagctgtcatccgactccgactccgagtatagcaaggtccgtttaaacaggtcttccagctcagagtgcagtactgtggacaaccctctccccggagagggcgaagaagcagaagccgagcctatgaattcagacgagccagaggcctgcttcacggacggatgtgtgtggagattttcctgttgtcaggttaatatcgagagcggtaagggaaaaatctggtggaacatcaggaaaacctgctacaagatcgtagagcattcctggtttgaaagttttattgtactgatgattttgctgtcctctggggcgctggcatttgaggacatctacattgagcggaagaaaacaataaagattatcctggagtatgctgataaaatcttcacatacatctttatcttggaaatgctgctgaaatggattgcatacggttacaaaacctactttaccaacgcatggtgctggctggatttccttatcgtggacgttagcctggtgaccctggtcgcgaatacgcttggatactctgatcttgggcccatcaagtctctgagaaccttacgcgcccttcggcctctgagggcactctctcgatttgaggggatgagggtagtcgtcaacgctctgatcggagccattccgagcataatgaatgtcttactcgtatgccttattttctggctaatcttctcaatcatgggtgttaatctgttcgccggaaagttctatgagtgcatcaacacaactgacggatcccggttcccagcgagccaggtgcctaacaggagcgagtgcttcgctcttatgaatgtaagccagaacgtcagatggaagaacctcaaggtgaacttcgacaacgtgggcctcggctatctgagtctactgcaggtcgccactttcaaaggatggacaatcataatgtatgcagcagtggatagtgtgaatgttgacaaacagcccaagtacgaatacagtctgtatatgtacatctactttgtggtcttcattatcttcgggtctttctttacacttaacctctttatcggtgtaattatcgataatttcaaccagcagaagaagaagctgggaggccaggacatttttatgaccgaagagcagaagaaatattacaacgcgatgaaaaagctgggtagtaagaaaccccagaaaccgattccacgtccaggcaacaagatacaaggctgtattttcgatctcgtcacaaatcaggcgtttgacattagcatcatggtcctaatctgcttgaacatggtgaccatgatggtggagaaagaggggcagtcccagcatatgaccgaggtactatactggataaatgtcgtcttcattatactgtttacgggtgagtgtgtcctgaaacttattagcctgcggcactattacttcaccgtcgggtggaatatatttgatttcgtcgtggttattattagcatcgtcgggatgtttttggctgatctgatagaaacctacttcgtttctcctaccctgttcagggtgatccgccttgcgagaattggacgaattctcaggttagtaaaaggcgctaaaggcatcaggacactcctctttgccctcatgatgagtctgcctgccctgttcaatatcgggcttctgctgttcttggttatgttcatttacgccatatttggcatgtcgaacttcgcgtacgttaaaaaggaagatgggatcaatgatatgtttaatttcgagaccttcggaaactccatgatttgcctttttcaaattactacatctgcaggatgggacgggctcctggcccctatcttaaactccaaaccccccgactgtgacccaaaaaaggtgcacccaggttcatcagtagaaggcgattgcggaaatcccagcgtgggaattttctacttcgtaagctacatcataatctctttcctcgtcgtcgtcaacatgtacatagccgtgattcttgagaatttttctgttgcaaccgaagaaagcactgagcctctttctgaggatgatttcgagatgttctacgaagtctgggaaaaatttgaccctgacgccactcagttcattgaattttccaagttgtccgactttgcagcagccctagacccaccactgctgattgccaaaccaaacaaggtgcagctcatagctatggacttgccaatggtgtcaggtgacaggatccactgtctggatatactattcgctttcacaaaaagagtgcttggcgaaagcggggagatggactcactgagaagccagatggaagagcgtttcatgtctgccaaccctagcaaagtgtcatatgagccgatcacgaccacccttaagagaaaacaggaagacgtttcagctactgtcattcaacgggcttataggcggtataggctgcgccagaacgtaaaaaatatttcatcaatctacataaaggatggggatcgagatgacgacttgctcaataaaaaagatatggcctttgataacgttaacgagaactctagcccagaaaagacggacgcgacctcctctaccacctcccctccttcttacgattcggtaacaaagcccgacaaagagaagtacgagcaggatcgaactgagaaagaagataaggggaaagatagcaaggaatccaaaaaatag

SEQ ID NO: 205503 - DNA, 5934 bp, Artificial Sequence
  Description of Artificial Sequence: Synthetic coding sequence
atggccatgctgcccccccccggcccccagagcttcgtgcacttcaccaagcagtcactggctctgatcgagcagcggattgctgagaggaaaagcaaggaacccaaagaagaaaagaaggacgacgacgaagaagcccccaaacccagtagcgacctagaggctggcaagcagttgcccttcatctatggtgatatcccccctgggatggtgagcgaaccactggaagatctagatccctattacgctgataaaaagacattcatcgtgttaaacaagggcaagacaattttccgcttcaacgccacgcccgctctgtacatgttgtcccccttttccccactccgccgcatcagcatcaaaattcttgtgcatagtctgttttcgatgctgatcatgtgcacaatacttacaaattgcatttttatgactatgaacaaccccccggactggacaaagaacgtcgaatatacattcaccgggatctacacctttgagtccctggtgaaaatcctggcgcggggattttgcgttggcgaattcacatttctgagggatccctggaactggttggactttgtggtaatcgtcttcgcctatcttaccgaatttgtgaatctcggcaacgtgtccgcactcagaactttcagggtactgagagccctcaagaccataagcgtgatccctgggctgaagacgatcgtgggagcacttatccagtctgttaaaaagttgtccgacgtcatgatattgaccgtgttctgcctttccgtatttgcgctcatcggattgcagttgtttatgggtaatttgaagcacaagtgtttcaggaactccctcgaaaacaatgaaaccttggaaagcatcatgaatactctggagtccgaagaggatttcagaaaatacttttattacttggagggttccaaagacgcactgctgtgcgggttttcaaccgactccgggcagtgtccagaaggctacacgtgtgtgaagattggcaggaatccagactacggttatacatctttcgacacattctcttgggccttcttggccctcttccggcttatgacccaggattattgggagaatctctatcaacagactctaagggcagcgggcaaaacttatatgattttttttgtcgtggtaatcttcctcggatcattctatctgattaatttaatcctcgctgtggtggccatggcgtacgaggagcagaaccaggctaacatcgaggaagcgaagcagaaggagctcgaattccagcagatgctagatcgactgaaaaaagaacaagaggaggctgaagcgattgcagcagcagccgccgaatacacatctatccgtcgttcccgcatcatggggttgtccgagtctagctctgagaccagcaaactgagttccaagagcgccaaagaacgccgtaatagacgaaagaagaagaatcagaaaaagctctcctcaggtgaggagaagggagatgccgaaaaactgtccaagtctgaaagcgaggattccattaggagaaagtctttccatctgggcgtggagggacaccggcgcgctcacgaaaagaggctgagcaccccgaaccaatccccactgagtatccggggtagcctcttttccgccaggagatcaagtaggacgagcttgttttctttcaagggacggggtcgggatatcgggtcagagacagaattcgcggatgatgagcattcaatatttggtgacaatgagagtagacgcggctcactcttcgtcccacaccgcccacaggagaggcgctcctccaatatttcacaggcatcccgctcccctccgatgttgcccgtgaacggcaaaatgcacagcgccgtggactgtaacggagtggtgagcttagtggacgggagatcggcgttaatgctcccgaacgggcaacttctgcccgaaggcaccaccaatcagatccacaaaaagcggcgctgttcctcatatttgctgtccgaagacatgctgaacgacccgaatctaaggcagagggcaatgagccgggcaagcattctcactaacacagtggaggaactcgaagaatccagacagaagtgtccgccatggtggtatcgctttgcccacaagttcctaatttggaactgcagtccttactggataaagttcaagaaatgtatctatttcatagtgatggacccgtttgtcgatctcgccataaccatatgcatcgtcctgaataccctgttcatggcgatggagcatcaccctatgaccgaagagtttaagaacgtgttggcaatcggaaatcttgtttttacgggaatcttcgctgcggaaatggtgctgaagctgatagcgatggacccttatgagtacttccaagtcgggtggaacattttcgattccttgattgtgactctgagcctagtagaattgtttctagctgatgtcgaagggctgtctgttctccgttcgttccgactgctgagagtgtttaagcttgcgaagtcatggcctacgctaaacatgcttatcaagattatcggaaattccgtcggcgccctcggtaacctgaccctggtattagctattatcgtattcatctttgccgtcgtcggaatgcagctgtttggcaaatcttacaaagagtgcgtctgcaagatcaatgatgactgcacactccccagatggcatatgaacgactttttccatagcttcctgattgtttttcgggtgctctgtggcgagtggatcgagaccatgtgggattgcatggaggttgcaggacaagccatgtgtctcatcgtgtacatgatggttatggtcattggaaacctggtggtactgaatttgttcctggcactgctactgagctcatttagctcggataacctcaccgctatagaggaggatcctgatgccaataatctccagatcgccgtgacccgtatcaaaaagggcatcaactatgtcaagcaaactctaagggagttcatccttaaggctttctcaaagaagccaaaaatttctcgagaaattcggcaagcagaggatcttaacactaagaaagagaactacatctcaaatcacacgttggccgagatgagcaaaggtcataattttctgaaagaaaaggataaaatatctggctttggctcttctgtggacaagcacctaatggaggatagtgacggccaatccttcattcacaatccatccttaaccgtaactgtgcccatcgcccctggagaaagtgatctggagaatatgaatgccgaagaactgtctagcgattcagatagcgaatactccaaagtcaggttgaatcggtcaagcagctcagaatgttccaccgtggacaatcccctgcccggggaaggggaggaggctgaagctgagcctatgaattctgatgagcctgaagcctgtttcaccgacggctgtgtgtggcggttctcgtgttgccaagtgaatatcgagtccggcaaagggaaaatctggtggaacattagaaagacctgttacaagatagttgagcacagttggtttgaatcctttattgtcttgatgatcttgctctcaagtggagcactggccttcgaagacatctacatcgagcgaaagaagacgattaaaatcattctcgaatatgccgataagatcttcacctatatattcatcctagagatgctgctgaaatggatcgcctacggttataagacttacttcacgaacgcctggtgctggctcgacttcctgattgtggatgtgagcctcgttaccctcgtcgctaataccttgggatattccgatttggggccgatcaagtcattgcgcacccttcgcgctctgcggcccctccgtgcactgagtaggtttgagggtatgagagtagtggtgaacgctttgattggcgccataccatccataatgaacgtgctgctagtttgtctgatcttctggctgattttttcaattatgggcgtcaatcttttcgctgggaaattttacgagtgtattaatacaacagatggaagtaggttccccgcttcccaggtgccgaacaggtctgaatgtttcgctctgatgaacgtgagccagaacgtgaggtggaagaatctcaaggtaaactttgataacgtgggactggggtacctgagcctcttgcaagtggctacttttaaaggttggaccattatcatgtacgcagctgtagatagcgtgaatgtggataaacagcctaagtacgagtattcactgtacatgtacatatactttgtggtcttcattatttttggctccttttttacacttaacctttttataggcgtgattattgacaactttaaccagcagaagaagaagttgggaggacaggatatcttcatgacagaggagcagaagaaatactataatgccatgaagaaactagggtctaaaaagcctcagaaacctatcccccgcccaggcaataagattcagggttgcatctttgacctggtcactaaccaagcattcgacatctccatcatggtcctgatctgtttaaatatggttactatgatggtagagaaagaagggcagtcccagcacatgacagaagtactctattggataaacgttgtgttcatcattctttttacaggcgaatgtgttctgaagttaatcagccttcgccactactactttacagtcggatggaatatcttcgactttgttgtggtaataatatctatcgttgggatgttcttggcagatctgatcgagacatatttcgtttcgcccactttattccgggtgattcgcttggccagaatcgggcggatattaagactggtgaaaggagcgaaaggaattagaactttattgttcgccctgatgatgtcccttcccgcactcttcaacatcggccttcttctgttcctggtgatgttcatctacgctatctttggcatgtcaaactttgcttacgtcaagaaggaagatggcatcaatgacatgttcaactttgagaccttcggaaatagcatgatatgtctgttccagataaccacgtcggcaggttgggacggtcttcttgctccaatcttaaattcaaaaccaccagattgtgaccccaaaaaggtacaccctgggagctccgtggagggggattgcggcaatccttctgtgggaatcttctattttgtgtcctatatcatcatctctttcctcgtggtggtgaacatgtatatcgccgtgattcttgaaaactttagtgtagcgaccgaggagtccaccgagccactatccgaggacgatttcgaaatgttttatgaggtctgggagaagttcgaccctgacgcaacccagttcatcgaattttccaaattgtcagatttcgccgctgcacttgatcctcctctcttgatcgcaaagcccaacaaagttcaacttatagctatggatttaccaatggtgagtggagatcggatccactgcctagacatcctattcgcattcaccaaaagagtcctcggagagagtggcgagatggacagtctgcggagccagatggaggagagattcatgagcgctaaccccagtaaagtttcatacgaaccaattacaacaacattaaagcggaaacaggaggatgtgtcagccaccgtaatacagagagcatataggcggtacaggttgagacaaaatgtgaagaatatctccagcatttacattaaagacggggatagggacgatgacctgctgaacaagaaggacatggcattcgataatgtgaacgaaaattcatctccggaaaagaccgatgcaacgtcaagcacaactagtcccccatcttatgacagcgtcaccaagcccgataaggaaaagtacgagcaggatcgtacagagaaggaggacaaagggaaggacagcaaggaatcaaagaaatag

SEQ ID NO: 205504 - DNA, 1620 bp, Artificial Sequence
  Description of Artificial Sequence: Synthetic coding sequence
atcctgaccaactgcatcttcatgaccatgaacaacccccccgactggaccaaaaacgtggagtacacattcacaggcatctacacatttgagtccctcgtgaaaattctcgcacgcggcttttgtgtaggcgagttcaccttcctacgggacccctggaattggctcgactttgtggttatagtgtttgcctatgtgactgaatttgtggaccttggtaatgtatccgcgctccgcaccttccgcgtgctgcgggcactaaaaactatcagtgttattcctggcctaaagacaatcgtcggagcccttatccagtctgtgaaaaaattgtctgatgtgatgatcctgaccgtcttttgtctgtcagtgtttgcattgattgggctccagctttttatgggtaacctgaaacataagtgctttcgcaacagcctggagaacaacgagactcttgagtccattatgaataccctagaatctgaggaggactttaggaagtacttctattatctggagggctccaaggacgctcttttgtgtgggttcagtaccgattcaggacaatgccccgaaggatatacttgcgttaagataggccgaaatcctgattatggctataccagtttcgatacatttagctgggccttcctggccttatttcggttaatgacccaggactactgggaaaacctgtaccagcagacccttcgggccgccggcaaaacatacatgatatttttcgtcgtcgtcatcttcctgggttctttttatctaatcaatcttatactagccgtcgttgccatggcatacgaggaacagaatcaagctaatatcgaagaggctaagcaaaaggaactggaattccaacagatgctggacagactgaaaaaggagcaagaagaagctgaagccattgcggcggcagcagctgagtacacatcaattaggagaagcaggatcatgggactttctgaatcatctagtgagacatccaagctctcgtctaaatcagctaaagaacgccgcaatcgccgaaaaaagaagaaccagaagaaactcagttcaggtgaggaaaaaggggatgccgaaaaactatccaaaagcgagtctgaagactctattaggcgcaaaagcttccatctgggggtggaaggacaccggagggcccacgagaagcgcctgtctacacctaaccaatcacccctgagcatccgggggagcctgttttccgctcgccggagtagtcggacaagcctattctctttcaagggccgaggtagagatattggtagcgaaaccgaattcgctgacgatgaacactcaatctttggcgacaatgaatctcgccgggggagtctgtttgtcccacatcgcccacaggagcgtcgatcatcaaacattagccaggcctcacggtcacccccaatgctgcccgtgaacggaaaaatgcactccgccgtggactgtaatggcgttgtctccctggtggacggaaggagtgcactgatgcttccaaacggccagcttctgcctgaagtcattatagacaaagccacaagcgacgattccggtaccaccaatcagatacacaaaaagcgaagatgctcgtcttacctgtag

SEQ ID NO: 205505 - DNA, 198 bp, Artificial Sequence
  Description of Artificial Sequence: Synthetic coding sequence
atggccaacttcctgctgccccggggcaccagcagcttccggcggtttactcgtgagtctctggccgcaattgagaaaagaatggccgagaagcaggcaagaggcagcacgaccctgcaggagtcaagggaaggtcttcccgaggaagaagcccctcggcctcaactggaccttcaggcttctaaaaagctgccttag

SEQ ID NO: 205506 - DNA, 6051 bp, Artificial Sequence
  Description of Artificial Sequence: Synthetic coding sequence
atggccaacttcctgctgccccggggcaccagcagcttccggcggtttacaagagagagcctcgcggcaatcgagaaaaggatggccgagaaacaggcacgcggcagcaccacactccaggaatccagggaagggctgccagaagaggaagcaccaagaccccagctggatcttcaggcttccaagaaactccctgatttatacgggaatcctccgcaggaactgatcggagagccgttggaggatctcgaccccttttactccacacagaagacatttatagtcctcaacaagggcaagacaatcttcagattctcggccacaaatgcgttatatgtactcagtccgttccatcctatcaggcgtgctgctgttaagatactggtccactcacttttcaatatgttgattatgtgtaccatcttaactaattgcgtctttatggcgcagcatgacccaccgccgtggacgaagtatgtcgagtacactttcaccgctatttataccttcgaaagcctggtcaagatactggcgaggggattctgtctgcacgctttcacctttctacgagatccctggaattggctggacttttccgtgatcattatggcatatactaccgaattcgtggatctcggcaacgtgtctgccctgcgcaccttccgcgtacttcgtgctcttaagacaatctccgtgataagcggcttgaaaactatcgtgggagctctcatccagtctgtgaaaaaactcgcggacgtgatggtgctgactgttttttgcctgtcagtctttgcactgattgggctgcagctctttatgggtaacctgcgtcacaaatgcgtgcggaattttaccgcactgaacggcacaaatggaagcgtggaggctgacgggctcgtctgggagagtctggacctgtacctctccgatcctgaaaattatttactgaagaacggaacctccgatgtgctgctttgcggcaacagtagcgatgcgggaacatgtccggagggctatcggtgcctgaaagctggcgagaaccccgaccacggctacacgtcatttgactcttttgcctgggcgtttctggctctctttcgcctgatgacccaggactgttgggagaggctataccaacagacccttcgctctgccggcaagatctacatgatctttttcatgctagtgatcttcctggggtctttctacttagtgaacttaattcttgctgtggtggcgatggcctacgaggagcagaatcaggcgactatcgcggagacagaggaaaaagagaaaagatttcaggaggctatggaaatgctaaaaaaagagcacgaggccctgacaatcagaggcgtcgataccgtcagccgctcgagtttggaaatgagccctctcgctccagtgaacagtcacgagaggaggtccaaacggcgcaagcgaatgagcagtggaaccgaggaatgtggagaagatcggctccccaaaagtgactctgaagatggcccacgggcgatgaatcacttgtccctcactcggggacttagccgaacatccatgaagcctagatctagccgggggagcatcttcacgtttagaaggcgcgacctgggctcagaagctgactttgccgacgacgagaactctacagcgggcgagtccgagagccatcacacatcccttttggtcccatggcctcttcgaaggacgagcgcacaggggcagcctagtcctggaaccagtgcccctgggcatgccctgcacggaaaaaaaaacagtacggttgattgcaacggagttgtaagcctgttaggggctggcgatccagaggccacttccccggggtcgcacctgctcagacctgttatgcttgagcatccccccgatactaccacccccagcgaggaaccgggtggaccccaaatgctcacctcccaagccccgtgcgtggacggctttgaagagcccggagccaggcagcgagccctgagtgctgtctccgtcctgaccagcgccctcgaggaattggaagagagtcggcacaagtgtcccccctgctggaatcggcttgctcaaaggtacctgatttgggaatgttgccccctgtggatgagcatcaaacagggggtgaaactggtggtgatggacccattcaccgatctaacaatcacaatgtgtatcgtccttaatacattgtttatggccttagaacattacaacatgactagtgagtttgaggagatgctacaggttggtaacctcgtctttactggaatattcactgcggaaatgacattcaaaatcatagcgttggacccatactattattttcagcaaggatggaacatcttcgacagcattatcgtcattctttccttgatggagctgggactgagtcgcatgtccaacctgagcgtgctgaggtccttccgcctgcttcgcgtgttcaagttggccaagtcatggcctacattaaatacattaattaagatcattggaaactccgtgggagcactcggaaatctcactctggtgcttgctattatcgtattcatcttcgcagtcgttggcatgcagttatttggcaagaactattcggaattgcgggatagcgatagtggcctgctgcctcgctggcacatgatggacttcttccacgcctttctcatcatctttagaatcctctgtggcgaatggatcgaaacaatgtgggactgcatggaggtgtctggtcaatcactgtgcttgctcgtgtttctactcgttatggtaataggtaatctcgttgtcctcaatctctttctggcattactgctctcttcttttagcgccgataacctaaccgctcccgatgaagacagggaaatgaacaacttgcaactggctttggctcgcatacagaggggactccgtttcgtgaagagaacaacatgggacttctgttgtggtcttctgcgtcagcgccctcaaaaaccagccgcactagcagcccaagggcagctcccctcatgcattgctacaccatattcccctccccccccagagacagaaaaggttccaccaaccaggaaggagacaaggtttgaggagggggagcagccaggccagggaacgcccggcgacccagagcccgtctgtgttcctatcgcagtcgccgaaagcgacaccgatgaccaagaggaggacgaggagaacagcctggggaccgaggaggagtctagcaagcagcaggagtctcaaccagtgagtggtggacccgaggcaccacctgactctagaacatggtcacaagtttctgccaccgcttcaagcgaagcagaagcctcagccagccaagcggattggcgccagcaatggaaagctgagccacaggcccccgggtgcggcgaaacgcctgaggattcttgttcggagggaagtacagccgatatgacaaacacagccgaactgctggagcaaatccctgatttggggcaagacgtgaaagacccagaggattgcttcacagaggggtgtgtgaggagatgcccgtgttgcgcagtggacacaactcaggcccctggaaaagtctggtggaggctgagaaaaacatgctaccacatcgttgaacacagctggtttgagaccttcatcattttcatgattttattaagtagtggcgctctggcttttgaggacatctacctcgaggagaggaaaaccatcaaggtgctgctcgagtatgccgataaaatgtttacttatgttttcgttcttgaaatgctattaaaatgggttgcttacggcttcaagaagtacttcacgaatgcctggtgctggctcgatttcctaatcgttgatgttagtttagtgtctctggtggccaacaccttggggttcgcagaaatgggacctatcaagagcctcagaactctccgggctttacgccccctgagggcactgtcacgatttgaaggaatgcgagtggttgtaaacgctcttgtgggcgccatccctagcattatgaacgtgttgctggtgtgtctgatcttctggctcatatttagtattatgggcgtgaatctctttgccggaaaatttggccggtgtattaatcagacagagggtgacctgcccttgaactacacaatagtaaataacaaaagccagtgcgaatctctgaacctgaccggtgagctgtattggacaaaggtgaaggtcaattttgataatgttggcgctgggtacttagccctcctgcaggttgccacattcaagggatggatggatatcatgtacgcagcagtcgatagcagagggtacgaggagcagcctcaatgggaatataacttgtacatgtacatctactttgtcatctttattatcttcggctctttctttacactcaatctattcattggggtgattatcgataatttcaaccagcagaaaaagaaactcggtggtcaggatatcttcatgacggaggaacagaaaaagtactacaacgccatgaaaaagttgggttcaaagaaacctcaaaagccaatcccccgtccccttaataagtaccaagggttcatttttgacattgtgacgaagcaggcctttgatgtgaccattatgttcctgatttgtctgaatatggtcactatgatggtggagaccgatgaccagagccccgagaaaattaatatccttgcgaagatcaacctattgtttgtggctatcttcacaggtgagtgtatcgtgaaactcgcagcgttgcgacattattacttcacaaattcatggaatatctttgacttcgtggtggtgatactgtctattgtgggtacagtcctcagcgacatcatccagaagtacttttttagtcctactcttttccgagtgatccgactggcacggattggacgcattctgagactgatccgtggcgctaagggcatccgcacactgctctttgcattgatgatgtccctccccgcactatttaatatcggcctcctgttgtttttagtcatgtttatctacagcatcttcgggatggcaaatttcgcctacgtgaaatgggaagccggcattgatgacatgttcaactttcaaacttttgccaactccatgctgtgcttgttccagattacaacatccgctggctgggatggattattaagccccatcctgaacaccggaccgccttattgtgacccaacccttcccaacagcaatggttctagaggagattgcggatctccagctgtgggcattctgtttttcacaacttacattatcatcagttttctgatcgtagtgaacatgtatattgccatcatcctggaaaacttcagtgtggctacagaggagtcaactgaaccccttagtgaagacgattttgatatgttttacgagatctgggagaagtttgaccccgaagcaacccaatttatagagtacagcgtactgagcgattttgcagatgcactctccgagccactcagaatcgctaagccaaatcagattagtttgatcaatatggatctgcccatggtctccggtgataggatccattgtatggatattttgtttgcattcacaaagagggtcctcggagaatctggcgaaatggatgctcttaagatccagatggaagagaagttcatggccgctaatccatctaaaatttcctatgagccaatcacaaccaccctgcggaggaaacatgaggaggtctcagccatggtgattcaaagggcgtttagaaggcacctgcttcagcggtcactgaagcacgcttcctttctgttccgacagcaagcggggagtgggctgtcagaggaggatgctcccgagcgagagggcctcattgcatacgttatgtcagagaatttcagtcgaccactggggcctccctcttcgagctcaatctcaagcacttccttccctccctcttatgactccgtaacgcgagctacatctgacaacctccaggtacgcgggtcagactattcgcactcagaagatctggccgactttcccccctcccctgacagggatagagaatctattgtgtag

SEQ ID NO: 205507 - DNA, 342 bp, Artificial Sequence
  Description of Artificial Sequence: Synthetic coding sequence
atggcccagcacgacccccccccctggaccaagtacgtggagtacgtttccgagaacattaaactaggcaacctgtctgccctgagaacctttagggttcttagagccttaaaaaccatttccgtcataccaggtctgaagacaatagtgggtgcccttattcagagcgtgaaaaagctcgctgatgtcatggtactgaccgtgttctgtctcagcgtattcgctttgatcggccttcagctgttcatgggtaacctgcgccacaaatgcgtgcggaacttcaccgctctgaatggcaccaacggaagcgtcgaggctgacggtttggtgtgggagagctag

SEQ ID NO: 205508 - DNA, 6051 bp, Artificial Sequence
  Description of Artificial Sequence: Synthetic coding sequence
atggccaacttcctgctgccccggggcaccagcagcttccggcggtttacccgagagtcccttgcagccatcgagaaacggatggcagaaaaacaggccaggggctccaccacgctgcaggagtctcgggaagggctccccgaagaggaagccccccgtccccagctcgaccttcaggcgagcaagaaactgcccgacttatatgggaatcccccccaagaactaattggcgaaccactggaagacctggacccattctattctactcagaaaacgttcattgttctgaataagggtaagaccattttccggttctctgccaccaacgccctgtacgtgctgtcacctttccatccaatcagacgtgcagctgtgaagatcctcgtccattctctctttaacatgcttattatgtgcaccatcctcactaactgtgtgttcatggcccagcacgatccccccccctggacaaagtacgtggaatacacgttcactgcaatttacacttttgagtccctggtgaaaattttggctcgcggattttgtctgcacgcatttaccttcctgcgagacccatggaactggttggatttctctgttattattatggcatacgtctccgaaaatatcaaattgggaaatctgagcgccttacggacctttagagtgttgagagccctgaaaaccatctctgtgatcccaggcctcaagaccatcgtgggcgcccttatccagagtgttaagaaactcgcagacgtgatggtccttacggttttctgtctgtcggttttcgcattgattggtttgcaacttttcatgggcaacctgaggcacaaatgcgtgaggaattttaccgcgctgaatggaacaaatggcagcgttgaagccgacggccttgtgtgggagtcactggatttatacctaagtgacccggaaaactatctactgaagaacggcacgagcgacgtgctcctctgtggcaactcgtcagacgctggcacctgccccgaggggtataggtgtctcaaagccggagaaaacccggaccacggctacacaagcttcgacagtttcgcttgggcctttctcgccctgtttcgtcttatgacacaggattgctgggaaagattgtatcagcagactctccgttcggctgggaagatttatatgatcttcttcatgctagtgatctttcttgggtcgttttatctggtaaatctaatactggcagtggttgccatggcctacgaggagcagaaccaggccaccattgctgagaccgaggaaaaggaaaaacgctttcaagaggctatggaaatgcttaaaaaagagcatgaagccctgaccattaggggcgtcgacacggtgtcccggagctccttagagatgagccctcttgcacccgtgaatagtcacgaacgtagaagtaagcgaagaaagagaatgagctccggaaccgaggagtgcggggaagatcggctgccaaaatctgacagtgaggacgggcccagagccatgaaccatctgtccctgactagaggactctcacggacaagtatgaaaccacggtcctcgagagggtccatattcacatttagaagaagggatctggggtctgaggctgatttcgcagatgacgaaaactcgacagcaggagagtcagagtcacatcatacctctctacttgtgccatggcctctgcgccggacgtccgctcaaggccagcctagtcccggtaccagtgcccctgggcatgctctacatgggaagaagaatagtacagtggactgtaatggagtggtctcactgctgggcgcgggggaccctgaagcaacctccccaggatcacatctgctccggccggttatgctagagcatccacccgataccaccaccccctccgaagagcctggtggaccccagatgctgacaagccaggccccatgtgtcgacggatttgaggagcctggcgccagacaaagggccctttcagctgtcagcgtgctcacttccgcactggaggagctggaagaaagccgacataaatgtccaccttgctggaaccgcctggcacagagatatctcatttgggagtgctgtccattgtggatgagcatcaagcagggcgtaaagttggttgttatggacccattcactgacctgaccataaccatgtgcattgtgctgaataccctatttatggccctggaacactataatatgacgtctgagtttgaggagatgctgcaagtcggaaatctggtgttcaccggcattttcactgcggaaatgacattcaagatcatcgctctggacccatattactactttcaacaaggctggaacatcttcgatagcataatagtgatactgtctctgatggaactcggtctcagtaggatgagcaatctttctgtcctacgaagttttcggctgctgagggtattcaaattggcgaagtcttggcccacacttaatacgcttatcaagatcattggaaactccgtcggcgcactgggaaacctgacactggttttggccataatagtgttcattttcgccgttgttggcatgcagctgtttgggaaaaattatagcgagctccgagactcagatagtggtctgctacctagatggcacatgatggacttctttcatgctttccttatcatcttcaggattctgtgtggggaatggattgagacgatgtgggattgcatggaagtgtcaggccaatcactatgtctgttggtgttcttactggtcatggtgataggaaacctggtcgtgctgaacctgttcctggcactattgctgagtagtttttcagccgataacctgacagctcccgacgaagaccgcgagatgaataatctgcaactggcgctggcacggatccaacgaggcctgcgatttgtgaagagaaccacttgggacttctgctgtggcctgctccgccagcgaccacagaagcccgctgctttggctgcacaaggacagctgccaagctgcattgccaccccttatagtcccccccccccagaaacggaaaaagtcccaccaacccgcaaagagacccggttcgaggagggggagcagcctggccagggtactcccggagacccagaacccgtctgcgtgccgatcgccgtggcggaaagcgatacagacgaccaggaggaggatgaggagaacagcctcggcacagaggaggagagtagcaagcagcaggagtcacagccggtgtcgggcggccctgaggcaccaccagacagcagaacctggtcccaggtgtctgccacagcaagcagcgaggccgaggcatctgctagtcaggcagactggagacagcagtggaaggcagagccgcaggcaccgggctgcggagaaacgccagaggatagctgcagcgagggttccacagccgacatgactaacactgccgagttgctggaacagatacctgatctaggacaggatgtgaaagatcctgaggactgcttcacggaagggtgcgtgcgccggtgcccatgttgtgccgtcgataccacgcaggcacctggcaaggtttggtggaggttgcggaaaacttgctatcacattgtggagcactcttggttcgaaaccttcataatttttatgatcctcctgtcatctggcgcgttggcttttgaggacatatatctggaagaaagaaagacgattaaggtgcttctcgaatacgccgacaaaatgtttacatacgtctttgtccttgaaatgcttcttaaatgggtagcatacgggttcaagaagtactttaccaatgcatggtgttggttagactttttaatagtggacgtgtccctcgtttcactggttgcgaacacactgggcttcgcagagatgggccctataaagtcccttaggacgctccgcgctttgaggcctctgcgagccctgtcccgatttgagggcatgcgggtggttgtcaatgcactcgtgggtgccatcccgtctataatgaatgtgctactggtctgcctcattttctggttaatattctccattatgggagtcaacttgttcgctggcaagtttggtcggtgtattaaccagaccgaaggcgatcttcctctcaattacacaattgtcaacaacaagagccagtgtgagtccttaaaccttacaggcgagctttattggaccaaggtgaaagttaatttcgacaacgtgggagccgggtaccttgctctcctgcaggtcgctacttttaagggatggatggatatcatgtatgccgcggtcgattcccgggggtatgaggaacagccccaatgggagtacaatctttatatgtatatatacttcgtcatctttatcattttcggaagcttctttacactcaatctgtttatcggggttatcattgacaacttcaatcagcagaagaaaaagctgggcggacaggatatattcatgacagaagaacaaaagaaatattataatgccatgaaaaaactgggcagtaaaaaaccccagaaaccgataccgagacccctcaataagtatcagggcttcatctttgatatcgtgactaagcaggccttcgatgtgaccatcatgttcttgatctgtcttaatatggtaaccatgatggtggagaccgacgaccagtcacccgaaaagattaatatcctggccaaaataaatctgctgttcgtggcgatttttaccggcgagtgcattgtgaaactggccgctctgagacactattactttactaattcttggaatatctttgactttgtggttgtgatcttatcaatcgttggcaccgtgttatcagacattatccagaaatattttttctccccaacactcttccgggtgatcagattggctagaatcggccgcatcctgagactgattcgcggggccaaggggatccgtacgctgctgttcgctctgatgatgagcctgccagcactgtttaacatcggcctcttgttatttctcgtgatgttcatttactcgatcttcggtatggctaacttcgcctacgtcaagtgggaggctggaatcgatgacatgtttaactttcagacctttgctaattcaatgttgtgtctctttcagatcacaacctctgcgggatgggacggtttactatccccaattctgaacaccgggccgccctattgcgatcctaccctccccaactccaatggctcaaggggagactgcggttcccccgctgttggcattcttttcttcacaacttacatcatcatttccttcctgattgtggttaacatgtacatcgccatcatcctcgagaattttagtgtggcaaccgaagaatctacggagccacttagcgaggatgattttgatatgttctacgaaatttgggagaagttcgatccagaagccactcagtttattgaatatagcgttctctcagacttcgctgacgcactgagcgaaccactgagaattgctaagcctaaccagatctccctgataaatatggatttgcctatggtcagtggcgatcgcatacattgcatggacattctcttcgcattcaccaagcgagttctgggcgagtccggggaaatggacgctctgaagatccagatggaggaaaaattcatggccgctaaccccagcaagatttcttacgagcctatcaccaccactctgaggaggaagcacgaggaagtgtccgccatggtgatccagcgggcgtttaggaggcatctgcttcagcgcagcttgaagcatgctagcttcctattcagacagcaggccggctccggactctctgaagaagacgcaccagaacgcgagggtctcatcgcctacgtaatgtcagagaacttcagtcggcccctgggcccaccttcctcatccagcatatcatctactagtttcccaccgtcctacgactccgttacccgcgccacctcggataacttgcaggtccgaggtagtgactattcgcactctgaagacctggctgacttccctccctctcccgacagagaccgggagtccatcgtgtag

SEQ ID NO: 205509 - DNA, 5997 bp, Artificial Sequence
  Description of Artificial Sequence: Synthetic coding sequence
atggccaacttcctgctgccccggggcaccagcagcttccggcggttcactcgggaaagcctggccgccatcgaaaaaagaatggccgaaaaacaggccaggggcagtaccaccctgcaggagagtcgggaaggattgcctgaagaagaagcaccgaggcctcagctagacctgcaagcttcaaagaagctgcctgacctgtatggcaaccctccgcaggaacttataggtgagcccctcgaggatctggatcctttttattcaacacagaagacttttattgtgctgaataagggaaaaaccatttttcgctttagtgccacaaacgccctctatgtgttatcaccctttcaccccatcaggagagccgccgtaaagatattggtgcactcactgttcaatatgttaatcatgtgtaccattctgactaattgcgtgtttatggcccagcacgaccctcctccttggaccaagtacgtggaatacacttttacagcgatttatacctttgagtctctcgtcaagattctggcacggggcttttgtctccacgcttttaccttcttgagagatccgtggaattggttagacttctccgttataataatggcctacgtcagtgagaacattaagcttggaaatttgtccgccctccgtacctttcgcgtcctgcgcgccctcaaaaccatctctgtgataccgggactgaagactattgttggagccctgattcaaagtgtgaaaaagctagcagacgtgatggtactgacggtgttctgcctcagcgtcttcgctcttattggactgcaactgtttatgggaaatctccgtcataaatgtgtgaggaattttacagctctcaacggtaccaacggcagcgtggaggcagatggtctcgtgtgggaaagtctcgatttgtatctatctgatccggagaactatctcctgaagaacggcacctctgacgtcctgctttgtggtaatagtagcgacgccggaacgtgtcccgagggttatcgatgtctgaaagctggggaaaaccccgatcatggatatacctcctttgactcattcgcctgggcattcctggctttatttcgcttgatgacgcaagactgctgggagagactctatcagcagaccttacggtccgccgggaaaatttatatgatcttctttatgctagttatattcctcggatccttctatctggtgaatctaatccttgccgtggtggctatggcctacgaggagcagaatcaagccaccatagccgagactgaagaaaaggaaaagcgttttcaagaagctatggagatgctgaagaaggaacatgaggccctgactatacgcggagtggacactgtgtcaaggagtagtctcgaaatgtctcctctcgcaccagtaaactcccacgagcgtcgcagtaaacgtagaaagcggatgtcttcggggacggaggagtgcggggaggaccgccttccgaagagtgattcagaagacggcccaagagcaatgaaccacctgtccctgaccaggggtctgagtcgaacgtctatgaagcctaggtcttcaaggggctctatattcacattcagacgcagagatttaggcagcgaggccgactttgcagacgatgagaactcaactgccggcgaatcagaaagtcatcacacaagcctgctggttccatggcccctgcgccgcacttctgcccagggacagccaagtcccggcacaagcgctccagggcatgccctgcacggaaagaagaactctacagtggactgcaatggggtggtctccctcctgggagccggtgacccagaggccacttcccccgggtcccatctgctgagaccggtgatgttggaacatccaccagacactaccactcccagcgaggagccaggtggaccccaaatgttaacatcccaagccccgtgtgtcgacggcttcgaggagcccggggcaaggcagagggcgttatctgcggtttcagttctgacgtcagcactggaggaacttgaagaaagtcggcacaaatgcccaccctgttggaaccggctagcacagagatatctgatctgggaatgttgtcccctgtggatgtccatcaaacaaggggtcaaactggtggtaatggaccccttcactgacctgaccattaccatgtgcatcgtgcttaataccctgtttatggctctggagcactataacatgacgagcgagtttgaggagatgttacaagtgggaaacctcgtctttacaggaatcttcaccgccgaaatgacattcaaaatcatcgcattagacccatattattacttccagcagggctggaacatcttcgattccattattgtgattctctccttaatggaattaggtctctcccggatgtcaaacctctccgtgctgagatccttcaggttgctcagagtatttaaactggcaaaatcctggcccacactgaacaccctaatcaagatcataggcaactctgtgggggccttgggcaacttgacattggtattggcaatcatcgtgtttatctttgccgtggtcggaatgcagctgttcgggaaaaattattccgaactcagggacagtgactctgggctattgccaaggtggcacatgatggacttttttcatgcattcctcatcatatttcgaattctgtgcggcgagtggatcgagactatgtgggattgtatggaggtgagcggtcagtcgctctgtctgctggtctttctcttagtcatggtaattggaaatctcgtggtcctgaatctgtttttagccctgcttctgtcttctttctccgccgataatctgacagcgcccgacgaggatagagagatgaacaatctgcagcttgctctggctagaattcagagaggcctgcggttcgtgaagagaactacatgggatttctgctgtggtctcctgcgacaaaggccacagaagccagccgctctggcagcccagggccaactgccgtcatgcatcgccactccctactctcccccgcctcccgagactgaaaaggtgcccccgactcgtaaggagacaagattcgaggagggggaacagcctggtcaaggaacccctggagatcctgagccggtctgtgtcccaatcgcagtggccgagtcggataccgacgaccaagaggaagacgaggaaaacagcctcggcaccgaggaggagtcttcaaagcaacaagaatctcagccagtgtccggcggcccggaagcaccacctgattcacggacgtggtcacaagtgtcagcaactgcctcgagcgaggcagaagcttccgcgtctcaagcagactggcgccagcagtggaaggccgagcctcaggctccagggtgtggggagacccctgaagattcttgttccgagggatctacggccgatatgaccaatacagccgaactgctggagcagattccggacctcggacaggacgttaaagatcctgaggactgctttacagaagggtgcgtccgccgctgtccatgttgcgcagtggatactacacaggcaccagggaaggtgtggtggcgcctgagaaaaacctgctaccatattgtggagcactcttggttcgaaaccttcatcatttttatgatcttactcagtagcggcgccctggcgtttgaggatatctacctggaggaacgaaaaacaattaaggtacttctggagtatgcggacaagatgtttacatatgtattcgtactagagatgttgctaaagtgggtggcgtacgggtttaaaaaatacttcaccaacgcgtggtgctggctagacttcttgatcgtggatgtctccttagtgtcactcgtggcgaatacgttgggttttgccgagatgggccccatcaagagcctccggactctccgtgcattgagacccttgcgtgctcttagtagatttgagggaatgcgcgttgtggtgaatgcccttgtcggggcaattccttctattatgaacgttctcctggtctgtttgatcttttggcttattttttccattatgggagttaacctgtttgcaggcaagtttggaaggtgcattaaccaaacggagggcgatctgccactaaattacaccatagtgaacaacaaatcacagtgcgagtctctgaacctgaccggagagttgtactggactaaggtcaaagtgaatttcgataatgtcggagctggttacttggctctgctccaggtctacgaagaacagccccagtgggaatacaacttgtacatgtacatatacttcgtgatttttattatcttcggttctttcttcacattaaatctgttcattggggtgattattgacaatttcaatcagcaaaaaaaaaagttgggcggacaggatattttcatgactgaagagcaaaagaagtattacaatgccatgaaaaagctgggttctaaaaagcctcagaagcctattccccggcctctgaataaatatcagggtttcatttttgacatcgtgaccaagcaggcgtttgacgtcactatcatgtttctgatctgtctgaatatggttactatgatggtggagactgacgatcagtcacccgagaagattaatattttagcaaaaatcaatctactgtttgtcgccattttcactggcgaatgtattgtgaaactggccgcccttcggcattactatttcaccaattcatggaacatctttgatttcgtggtggtgatcttatcaattgtgggcactgtactcagcgatattatccaaaaatactttttctctcccacgctttttcgggtaattagactcgccaggattggaaggattctgcgtctgatcagaggtgccaaaggcatccggaccttgctgttcgccttaatgatgagcctaccagcactttttaatatcgggctgctgctgtttttagttatgttcatatatagtatcttcggcatggctaatttcgcctacgtcaaatgggaggcggggattgacgatatgtttaatttccagaccttcgccaactccatgttatgtctcttccagatcactacctccgcaggctgggatggcttgctaagtccaatccttaacactggaccaccctactgcgatcctacactacctaactctaacgggtcccggggggactgtgggtctcccgccgttggcatccttttctttaccacgtacattataattagttttctgatcgtggttaatatgtacattgcaatcattctagagaactttagcgtcgctacggaggaaagcacagagcccctttccgaggatgattttgacatgttctacgaaatctgggaaaagtttgatccagaggcaacacagttcatcgaatattcagtgttgtcagactttgctgacgcgctgagcgaacccctccgaattgctaaacccaaccagatcagcctgatcaacatggacttgccaatggtctctggagaccggatccattgtatggacattctctttgcctttacgaagcgcgtactgggggagtccggtgaaatggacgcattgaagatacagatggaagagaaattcatggccgccaacccatccaagataagctacgaacctattaccaccaccttgagacgtaagcacgaagaggtatctgccatggtgatccagcgggcgttccggcggcatctgctgcagcggtctctgaaacacgctagcttcttattcaggcagcaggccggctcaggcctatctgaagaggatgcacccgaaagagaagggctcatagcgtatgttatgtctgagaatttctcccgaccattgggcccccctagttctagctctatctcaagcactagtttcccaccctcctacgacagcgtgacgcgcgccacaagcgacaatttacaggtgcgcggatcagactatagccattccgaggacctggccgattttccccccagtcccgatcgtgatcgagagagtatcgtctag

SEQ ID NO: 205510 - DNA, 6048 bp, Artificial Sequence
  Description of Artificial Sequence: Synthetic coding sequence
atggccaacttcctgctgccccggggcaccagcagcttccggcggttcacacgtgaatcgctggccgccattgaaaaaagaatggccgagaaacaggctcgcggaagcaccaccctacaagagagtcgcgaagggcttccggaagaggaggcacctaggccacaattggacctgcaggcctctaagaagctccccgacctctacgggaatccccctcaagagcttatcggcgaacctttggaagacctggaccccttctatagcactcagaaaacatttattgtcctgaataagggcaagaccatcttcaggttcagtgctactaatgccctgtacgttctgagtccttttcaccccatccgccgagccgcagtcaagatcctggtgcactctttgtttaatatgctgattatgtgtactatcctcacaaattgtgtgttcatggcacagcatgatcctcctccctggactaaatacgtggagtatacctttacagctatctacactttcgagtcactggtaaaaatcctcgcacggggcttttgcctgcatgccttcacatttctgcgagacccttggaactggttggacttctcggtgattattatggcctacaccaccgagttcgttgatttaggcaacgtttctgctcttcgcacattcagagtcttgcgggccttaaagacaatcagcgttatttcaggattgaaaactattgtgggagcactgattcagtctgtgaagaagctggccgatgtcatggtgctcaccgtgttctgtctgtctgtgtttgctctcatcggtttacagctcttcatgggtaacctgcgacataaatgcgtccgaaattttaccgctctgaatggaaccaacggcagcgtggaggcagacggactcgtttgggaatccctggatctgtatctaagcgatccggaaaactacctcctcaagaatggaacatctgatgtactcctttgtggcaacagttctgacgccggcacttgccctgaagggtaccggtgtctgaaggcaggcgagaacccagaccacggctacacctcgttcgattcatttgcctgggcctttctggccctgttcaggctgatgacccaagattgctgggaacggctctatcaacagactctacgctccgccgggaaaatttacatgatctttttcatgttggtgattttcttgggatctttctatctagtaaacctaatccttgctgtggtggctatggcctacgaggagcagaatcaggcaactattgctgaaacagaggaaaaggaaaaacggttccaagaggcaatggaaatgttgaaaaaggagcacgaagcactgactatccggggagttgacacagtgagtcgcagcagcctggaaatgagtcctctcgcccccgttaattcccatgagaggcggtccaagagacggaagcggatgtcatcgggcacggaggagtgcggagaagatcggttacccaaatccgatagtgaggatgggcctcgtgcaatgaatcatctgagtctgactcggggattgtccaggacatccatgaagcccagatcatctcgtggaagcatctttacattcagacggagggatctcggttccgaggccgacttcgctgacgacgagaactccaccgctggagaaagcgaaagccaccatacctccctcctcgtgccttggcctctgcggaggacatcagcacagggacagcctagtccgggtaccagtgctcccggccacgccttacacggcaagaagaattctacagtggactgcaatggcgtcgtctcactgctgggtgctggcgatcccgaagccacttctccggggagtcatttactgcgccccgtgatgcttgaacatccccctgatacaactacaccttctgaggaacctggagggccccagatgctcacatctcaggctccatgcgtcgacggctttgaggagcccggggccagacagcgggcattatccgcggtgtctgtgctaacctcagctctggaagaactcgaggaatctaggcacaagtgtcccccatgttggaatagacttgcccaacggtacttaatctgggagtgctgcccactgtggatgtcgattaaacagggggtgaagcttgtggttatggacccttttaccgacttgacgatcacaatgtgtattgtcctgaacaccttgtttatggcattagaacactacaatatgaccagtgagtttgaagagatgttgcaggtaggcaacctcgtgtttactggaatcttcaccgccgagatgacctttaaaataatcgccctggacccatattattacttccaacagggctggaatatttttgattcaatcatcgttattctttccctcatggaactagggctgagtaggatgtcaaaccttagcgtgctgagatcgttcagactgttaagggtttttaagctcgcaaaaagctggcccacattaaatactctaatcaaaattataggaaactcagttggcgcacttggcaacctaaccctggtgctcgcaattattgtattcatatttgcagttgtgggcatgcagctgtttggcaaaaattacagtgaactgcgggattcagactccggccttttgccacgctggcatatgatggacttcttccatgcctttctgatcatctttcggatactgtgtggcgagtggattgagactatgtgggactgcatggaggtttcaggtcagtcactctgtctcctggtttttttgctggtcatggtgataggaaatctggtcgtgttgaacttatttctcgcactccttttaagttctttcagcgccgacaacctcacagcccctgacgaagatcgcgaaatgaacaacctccaattggctctggcacgcattcaacgagggttacgatttgtcaagcgcacaacatgggacttctgctgtgggctcttgcgtcagagaccccagaaacctgccgctttagctgcccagggccagcttccgagctgcattgccacaccttacagccccccccctcccgagacagagaaggtgcctcccacccgaaaagagactcggttcgaagagggagaacaaccgggccagggaacacctggggaccccgaaccagtgtgtgttcccattgccgtggctgaaagcgacacggatgaccaagaagaagacgaggaaaatagcctcgggacagaggaagaaagcagcaagcaggaaagtcagccagtgtctggtgggccagaagctccccccgactcgcgaacatggtcgcaggtgtccgctaccgcatcttcggaggccgaagcaagtgcttctcaggctgactggcggcagcagtggaaggcggaaccacaagctcccgggtgtggagaaactcccgaagatagttgcagtgagggttctacggccgacatgacaaatacagctgagttgctggaacagattccagatctcggacaggatgtaaaagatccagaggattgcttcaccgaagggtgcgttagaaggtgtccatgctgtgcagttgataccactcaggcgcccggcaaagtgtggtggagactccggaagacctgttatcacatcgtggaacacagttggtttgagacatttatcatattcatgatcctgttgagttccggagcactggcttttgaggacatttacctggaagaacggaagactatcaaagtcctgctggaatacgcagataaaatgttcacctacgtgttcgtcctggagatgcttcttaagtgggtggcgtacggctttaaaaagtactttactaatgcttggtgctggctggacttcctaattgtcgatgtctctctagtgtcacttgtcgccaacacgctagggttcgctgagatgggaccaatcaagagccttcgcaccctgcgtgctctcagacctttgagggctctgagtcgctttgaaggaatgagagttgtagtgaacgctctggtcggcgccattccctccattatgaacgtcctcctggtgtgcctcatcttttggctgatcttcagcatcatgggtgtgaatttgttcgctggaaagtttggcaggtgcatcaatcaaactgaaggagatctgcccttaaattatactatcgtgaacaataaaagccagtgcgaaagccttaacctcacaggagaactgtattggacgaaagtgaaggtaaattttgacaatgtgggagccgggtatctcgctttactgcaggtcgcaacttttaaaggttggatggacatcatgtatgcggctgtagactcacgcggatacgaagagcaaccacaatgggaatataacctctacatgtacatttatttcgtcatttttatcattttcgggtcgttcttcacactgaatttattcatcggggttattatcgacaacttcaaccagcagaaaaaaaaactgggtggtcaggacatctttatgactgaggaacagaagaagtactataacgcgatgaaaaagctgggctctaagaagcctcagaaacccattccccgtcccctaaacaaataccagggcttcatttttgatatcgttaccaagcaggccttcgatgtcactatcatgtttcttatttgcctgaacatggtcacaatgatggtggaaacagacgatcagtctccagaaaaaatcaacatccttgccaagataaaccttctcttcgtggccatcttcacgggagagtgtatcgttaagctcgccgccctccggcactactatttcacgaactcctggaatatctttgactttgtggtcgtgatccttagtatcgtgggaactgtcctctcggacatcatccaaaaatacttctttagccccacactgtttcgagttattaggcttgccaggataggaaggattcttaggttgattcggggggctaaaggaattcggaccctcctatttgccctgatgatgtccctaccagcactgtttaacatcgggctcctgttatttttagtaatgtttatctattcaatcttcgggatggccaatttcgcctacgtgaaatgggaagccggcatcgacgacatgttcaattttcagaccttcgctaacagtatgctctgcctctttcagataaccacttctgccggatgggatggcctactgtctcccatcctgaacactggccctccatattgcgatcccactctccctaattctaatggtagcaggggggactgtggcagcccagcagtgggcatcttgttttttactacatatatcattatctcatttctcatagtagtgaatatgtatattgcaataatcttggaaaacttcagcgtagcaactgaagagagtacagaacccctgagcgaggacgactttgacatgttctacgaaatatgggaaaagtttgatccagaggctacacagttcattgagtactccgtgctctcggatttcgcagatgcactcagcgaacctctccgcattgcaaagccaaaccagatatcgctgatcaacatggatctgccaatggtgagcggcgaccggatacactgcatggacattctgttcgcttttaccaagcgggtgctgggcgagtcaggggagatggacgccctaaagattcagatggaagagaaattcatggccgcgaatccatcaaagatttcttatgagccaattactaccaccctgcggcggaagcacgaagaggtctcagccatggtgattcagcgggcattcaggagacacctgttacaacggagcctgaaacacgcttcttttcttttcaggcagcaggctggttcgggactttccgaggaggatgccccagagagggaaggacttattgcttacgtgatgtcagaaaactttagccgaccgctggggcctccgagcagctcaagcatcagcagtacctccttcccgccatcatacgacagtgttactcgtgccacatccgataacctgcaggtccgcggtagtgattactcccattccgaagatctggcggactttccccctagccccgatagggacagagagagtatagtttag

SEQ ID NO: 205511 - DNA, 5997 bp, Artificial Sequence
  Description of Artificial Sequence: Synthetic coding sequence
atggccaacttcctgctgccccggggcaccagcagcttccggcggtttacacgggaatccctggccgctatcgaaaagcgcatggcagagaagcaagcgagaggatctacaactctccaggagtcccgggagggcctgcctgaagaagaggccccacgcccccagcttgacctccaagcctccaagaaacttcccgatctctatggtaatccaccgcaggaactgattggggaacctctggaggacctcgaccccttttattctacacagaaaacgtttattgtcctcaataaagggaagaccatatttcgatttagtgcaacaaacgccctgtatgttctgagcccttttcatccaatacggcgggccgccgtaaagatactggtgcactctctgtttaatatgctcatcatgtgtaccattctgaccaactgcgtgttcatggcacagcatgatccaccaccttggaccaaatacgttgagtacactttcactgcaatctacacctttgaatcactggtgaagatcctcgccagggggttctgcctgcatgctttcacctttctgcgggacccttggaactggctggacttttcagtgattattatggcttacgtatcagaaaatattaagttaggaaatttatcagcactccgaacgtttcgagtgttgcgcgcacttaagacaatctcagtaattcccgggctaaagaccattgtaggagcactgattcagagtgtgaagaaattggctgacgttatggttctcaccgtgttttgcttgtccgtctttgctctgatcgggctgcaactctttatgggaaaccttcgacacaaatgcgtgcgaaactttacagcactgaacggtactaacggaagcgtggaggctgacggtttggtatgggaaagcctggatttgtacctgagcgacccagagaattatctacttaaaaatggtacttctgacgtcctgctgtgtgggaactcctcagatgccggaacctgccccgagggttacagatgcctgaaggctggggaaaatcccgatcacggctacacgagttttgacagttttgcctgggcctttctcgctttattccgccttatgacccaggactgttgggagcggctctatcagcagacgttacgtagcgccggcaagatctatatgattttctttatgttggttatctttctaggttccttttatctcgtgaatctgattctagcagtggtggcgatggcatatgaggaacagaaccaagctacaatcgcggaaaccgaggagaaagaaaagcgattccaggaggctatggaaatgcttaagaaagagcacgaagcactgaccattaggggagtggacacagtgtctagatcctccctcgagatgagccccctggccccagtcaacagccacgagcgcaggtcaaagaggagaaaacgcatgtcgtctgggaccgaagagtgcggggaggaccgcctgcctaaatctgatagtgaagacgggccaagagccatgaaccacctttcccttacccgcggactcagccgcacctcaatgaaaccaagaagttcccgtggcagtatctttactttccggaggcgcgacctgggatcggaggcagactttgctgacgatgaaaactccacggccggcgaaagcgagagtcatcacaccagcttgctagtcccttggccactgcgcaggacaagtgcacagggccaacctagccccggaacctctgcacctgggcacgctctccacggcaaaaaaaattctaccgtcgattgcaacggggtagtgtctttgctgggcgccggcgatccggaggccacgtcaccggggtcacatctgctcaggccagtcatgttagagcacccgcccgacacaaccacgcctagcgaggagcctgggggccctcagatgcttacgagtcaagccccctgtgtggatggatttgaggagcctggggctcgacaacgcgcactctccgctgtaagcgtgctgacttcagccctggaggagttggaagaatctaggcacaagtgtcctccttgctggaaccgcctcgcccagagatacctcatctgggaatgttgtccactctggatgagcattaagcagggtgtgaagctcgttgtcatggatccctttacagatctgaccataacgatgtgtatcgtgttgaatactctctttatggcgctcgaacactataatatgacttccgaattcgaggagatgttacaggtcggcaacctggtgttcaccgggatctttactgctgagatgacctttaaaattatcgcactggacccatattactactttcagcaaggctggaacattttcgacagtataatcgtgatcctgtcactgatggagttgggactgagcaggatgtccaatctatctgtgctgcggtccttccgcctgttgcgcgttttcaagttggcaaagtcttggccgacgttaaatacgttaatcaagattataggcaactctgttggtgctttaggaaatctcactctggtgctcgccattattgtctttattttcgcagtcgtaggaatgcagctgttcggaaagaattattcagaattacgggacagcgattctggcctgttgccccgctggcacatgatggatttcttccacgcatttttgattatctttcgcattctgtgcggcgagtggattgaaaccatgtgggactgtatggaggtctcgggtcagagcctgtgcctgctggtctttctactggtcatggttatcggaaacttggtggtgctgaatctcttcctggctctgctgctgagctcatttagcgctgataatctcaccgcacccgacgaagatcgagaaatgaacaacctccaacttgctcttgccaggattcagagaggcttgaggttcgtgaagagaactacatgggatttctgttgtggtctcctgcgccaaagaccgcagaaacctgccgctctcgctgcgcagggccagctgccttcctgcatcgcaaccccctactctccccctcctcccgagactgagaaggtgccccctactcggaaggaaaccaggttcgaagaaggcgaacagcccggccaaggcaccccaggtgaccctgagcctgtctgcgtgcctattgccgtcgctgagtctgacactgacgaccaggaggaagacgaggagaacagcttagggacagaagaggaaagctctaagcagcaggaatcccagcctgtgtctggtggtccagaggccccaccggacagtcggacctggtctcaggtgtcggcaactgcctcttctgaggccgaggccagcgcctctcaggccgactggcggcagcaatggaaggcagaaccacaggcccccggctgtggcgagactcctgaggacagttgctctgagggctctaccgctgacatgaccaacacagcagagctgctggagcaaatacccgatcttggacaagacgtgaaagacccagaggattgcttcactgaagggtgcgtgcgccgttgcccctgttgtgccgtcgataccacacaggcaccagggaaggtctggtggagactacgaaagacttgctatcatatcgtcgagcatagttggttcgaaacctttattatcttcatgattctcttgtccagcggtgctttggctttcgaggatatataccttgaggagcggaagacaataaaagtgcttctagagtacgctgataaaatgttcacatacgttttcgttctggaaatgttgttgaagtgggtggcctacgggttcaaaaagtacttcaccaacgcatggtgctggctcgatttcctcattgttgacgtctcactagtgtccctagtggccaacactctgggcttcgcggaaatgggccctatcaagtctcttaggaccctgcgcgccctcaggcccctgcgcgcactgtcccgcttcgaagggatgagggtcgtagtaaatgcactggtcggggccataccatctataatgaacgtgctgctggtgtgtttgatcttctggctcatattctccatcatgggtgtaaacttatttgcaggcaagttcggccgctgtataaatcagaccgaaggcgacctgccactcaattatacgatagtcaacaacaaatcacagtgcgagagtctgaatctaactggcgagctatactggacgaaagttaaggtaaatttcgacaacgtcggcgcgggctacctggccctgctgcaggtctacgaggagcagcctcagtgggaatataacctgtatatgtacatatatttcgtgatcttcattatttttggctctttttttacactcaacttgttcattggtgtgattatcgacaacttcaaccaacagaagaagaaactcggagggcaggacatctttatgacagaggaacagaagaagtactataacgcaatgaagaagttgggctccaagaaaccccagaagccaatcccgcgccctctgaataagtaccagggattcatcttcgatatagtgacgaagcaggcctttgatgtgacaatcatgtttttaatctgcctgaatatggtaaccatgatggtcgaaacggatgatcagtcccccgagaagataaacatactcgccaaaataaacctgctattcgttgccattttcacaggggagtgcatcgtcaaacttgcagccttgcgccactattacttcaccaattcatggaacatctttgacttcgtagtggtgatcttgtcaattgtgggcaccgtgctatctgacattatccaaaaatatttcttttcacccacgttgtttcgcgtgatacgcctggcccgcattggtagaattctgcggctcattcggggcgcaaaaggcatcagaacactgctgttcgcattaatgatgtcactccctgctctgttcaacattggcctcctgttatttctggtcatgttcatttactccattttcggaatggcaaacttcgcctacgtcaaatgggaagcaggcattgatgatatgttcaatttccaaaccttcgcgaatagcatgctttgtttatttcagattaccacaagtgcaggctgggacggcttgctctcgcccatactgaataccggccctccttattgcgacccgacgcttccaaattccaatgggagccgcggagactgcgggagccctgctgtggggatcctgttctttaccacctatataatcatctcttttctcatcgtagtgaacatgtatatcgcaattatcctggagaatttcagtgttgccacggaagagtctaccgagccacttagcgaggatgactttgatatgttctatgagatatgggaaaaatttgatcctgaagcaacccaattcattgaatatagtgtgctgagcgactttgctgatgccctgtctgagcctctgcggatagctaagcccaaccagatctccctcataaatatggacctccccatggttagcggagatagaatacactgcatggacatactattcgctttcactaagcgagtcctgggagaatccggcgagatggacgccctgaagatccagatggaggaaaaattcatggcggccaatccgtctaagatatcttatgaacctatcacaaccacactccgtcggaaacacgaagaagtgtcggccatggtgattcagcgcgcatttagacggcacctactgcagcgctcccttaaacacgccagcttcttgttcaggcagcaggcgggctcaggactgtccgaagaggacgccccagaaagggagggcttgattgcttacgtgatgtcagagaacttctctagacccctgggtccacccagctcctcatccatttcatctaccagttttcccccaagttacgatagtgtgacccgagcaactagcgacaacctccaagtcagagggtccgactattctcactcagaggatctcgcggatttcccaccgagccccgatagagatagggagtccatcgtgtag

SEQ ID NO: 205512 - DNA, 6048 bp, Artificial Sequence
  Description of Artificial Sequence: Synthetic coding sequence
atggccaacttcctgctgccccggggcaccagcagcttccggcggtttacccgggagtcgctcgcggccatagaaaaaaggatggctgagaagcaggcacgcgggagcacaacattgcaggaatcacgggaaggattgcctgaagaggaagccccccgccctcaattggacctgcaagcttctaaaaaactccctgatctctatggtaaccctccccaagaacttattggcgaacctctggaggatcttgatcctttttattctacccaaaaaacttttattgtgctgaacaagggtaagaccatctttaggtttagcgcaacgaatgccttatacgtcttaagcccgtttcatccaatccgcagggctgcagtcaaaatcctggtacacagtcttttcaatatgttgattatgtgcacaattttaaccaactgtgtttttatggcgcaacacgacccccctccgtggacaaaatatgtagaatatacatttactgccatttacacgttcgaatccttggtcaaaattctcgcacggggtttctgtctgcacgcttttacgtttctcagggatccttggaactggctggacttctccgtaatcattatggcctataccacggagtttgttgacctagggaatgtgtcggctcttagaacattccgcgtgctacgtgctcttaaaaccatcagtgtcatctctggcctgaagacaatcgtgggagctctgattcagagcgtgaaaaaactcgcagacgtgatggttctgacagtgttctgtctgtctgtgtttgcactgattggactgcagctattcatgggcaatctgcgccacaaatgcgtgagaaactttacggccctcaatggaacgaatggttctgtagaggctgacggtcttgtctgggagtctctggacctgtacctgtccgatcctgaaaattatttgctgaaaaatggaacaagcgatgtactcctatgtgggaacagttcagacgccggcacgtgcccagagggttatcggtgtctgaaagctggggaaaatccagaccatgggtacacaagctttgacagcttcgcctgggcctttctcgccctcttcaggctgatgacccaagattgttgggagcggctctaccagcagacattacggtctgcaggcaaaatttatatgattttctttatgctagtgatttttcttggcagcttttacttggtcaatctaatcctggccgtcgtcgccatggcctatgaggagcagaaccaggccacgattgccgagactgaggaaaaggagaaacgcttccaagaagccatggagatgttgaagaaggagcatgaggctttgacaatacgcggcgttgataccgtgtcaagatcctccctggagatgtctccgctggccccggtgaactcccacgaacggcgttcaaagcgtaggaaacggatgagttcaggcacggaggagtgtggagaggatcggctccctaaatcagattctgaggatggaccgcgagcaatgaaccatttgagtctaacgaggggcctcagtagaacaagtatgaaacctagatcaagtcggggatccatattcacatttcgcagacgagatctggggtcagaggccgacttcgcagatgatgagaacagcaccgcgggcgagagcgaaagccatcacacgagcctgctcgttccgtggcctctgcgaagaacaagcgcccaagggcagccttcacctggtacaagcgcccccggacacgcgcttcatgggaaaaaaaattcgacagtggattgtaacggcgttgtgtctcttttaggcgccggtgatcccgaggccacatcgcccgggagccacctgctccggcctgtcatgttggaacacccgccagatactacaacgccttccgaggaacctgggggaccacagatgctgacatctcaggcgccttgcgtggacgggttcgaagagcccggggcacggcagcgagctctctctgccgtgagcgttctgacttctgcgctggaagagttagaggagtcaagacataagtgtcccccatgctggaatagattagcgcagcggtatctgatatgggagtgctgcccgctctggatgagtattaaacagggcgtcaaactcgtggtcatggaccctttcaccgacctgacaatcacaatgtgtatcgtcctcaacacactgtttatggcactggaacactataacatgacctcagagtttgaggagatgttacaggtggggaacctcgtctttacaggcatatttactgccgaaatgacctttaagattatcgccctcgacccatactattactttcaacaaggatggaatatcttcgacagcattatcgtaatcctgtctctgatggaactgggactaagcaggatgtccaatctctccgtcttgcggagctttcgtttactgagggtgttcaagcttgctaaaagttggcccactctgaataccctgattaagatcatcgggaatagcgtgggcgctcttggtaatttgaccctggtgttggctatcatcgtgttcatttttgccgtggtcggtatgcagctgtttggaaagaactactcagaattgagagacagtgattccggcctcctgcctcgatggcacatgatggatttttttcacgcctttctcatcatcttcaggatactgtgcggggaatggatcgagaccatgtgggactgcatggaagtcagtggacagtcactctgtctgctcgtttttctgctggtaatggtcattggtaacctggtcgtattgaacctgttccttgccctcctactcagttcattctcagcagataatctgactgcccccgacgaagatcgcgagatgaacaacttacagcttgctcttgctcgaatccagcggggtttgaggttcgtgaaaagaaccacatgggacttctgttgcggcctgctgcgacaacgtccacagaaaccagccgcgttagctgcccagggccaactcccctcttgcatagcaacaccttacagcccgcccccaccagagaccgaaaaggtgcctccaaccaggaaggaaacaagatttgaagaaggagagcagcccggacagggtacacccggcgatcccgagccagtttgtgtcccaatagcagtcgctgaaagcgataccgacgaccaggaggaagacgaggagaacagcctcggcactgaggaagagtcaagtaaacaggagagccagccggtgtctggcgggccagaggcaccacctgatagtcgaacctggtctcaagtatctgcgactgcctcctccgaagcagaggctagtgctagtcaggcagattggagacagcaatggaaggcagagcctcaggctcccggctgcggtgaaactcctgaagattcttgttctgaggggagcactgcagacatgaccaataccgcagagctactcgagcagattccggatctggggcaggatgtgaaggatcccgaggactgcttcactgaaggttgtgtgagacgatgtccatgttgtgccgtcgatacaactcaggcacctggtaaagtgtggtggcgcctgcgtaaaacatgttaccacatagtggagcattcctggttcgagacgtttatcatattcatgatcctcctatctagcggcgcacttgccttcgaggatatctatctggaggaacgtaagacgattaaggtgctactggagtacgcagataaaatgtttacatacgtctttgtgcttgagatgttgctgaaatgggtggcttacggttttaaaaagtacttcacgaacgcctggtgctggttggactttttgatcgtggatgtctcgctcgtcagcctggtggccaacacactgggatttgcagaaatgggacccattaagtccttacgtacccttcgagcactgaggccgctcagagccctgtctagatttgagggcatgcgggtggtggtcaacgccctggttggggccatccccagtatcatgaacgtgctcctggtttgcctgattttctggttgatattctctattatgggggtcaacttattcgcaggaaagttcgggcggtgtatcaatcagacggagggagatctcccattgaactataccatcgtgaacaataagtcccagtgcgagtctttgaaccttacaggcgaactatattggaccaaggtgaaagtgaacttcgacaatgtcggagccggctatctagccttgcttcaggttgccaccttcaaaggatggatggatatcatgtacgccgccgttgactctcgggggtacgaggaacaaccacagtgggaatataatctctacatgtacatctacttcgtcatctttattatatttgggagcttttttactttgaatctgtttattggagtaattatcgacaactttaaccagcaaaaaaaaaaattgggaggtcaggacattttcatgactgaggagcagaagaagtactacaatgccatgaagaagctggggagcaaaaagcctcagaaacccatcccaagaccgctgaacaaataccaagggttcatttttgatattgtaactaaacaggcttttgatgttaccataatgtttcttatttgcctgaacatggttacaatgatggtggagacggacgatcagagccccgaaaaaattaacatactggccaagataaacctgctgttcgtagcaatcttcacaggcgagtgtatcgtcaagcttgcagctctacgtcactactacttcacaaatagctggaacatattcgacttcgtcgtggtgattctttctatcgttgggaccgtgctgtcagatatcatccaaaaatactttttttcccctactctgtttcgtgttattaggctcgcacggatcggccgcattctgcggcttatccgcggcgcgaaaggtatcaggactctgctttttgctctcatgatgtcacttcctgcgctttttaacattgggttactcctttttcttgttatgttcatctattccatcttcggcatggcaaactttgcctatgtcaagtgggaagccggcatcgacgatatgtttaatttccagacctttgccaacagcatgctttgcctgtttcagatcacaaccagtgcgggctgggacgggctcctgagccctatcctcaataccgggccaccatactgtgaccctaccctgcctaattcaaatggatctcggggtgactgcgggagtccagctgttgggatcctgttttttacaacatatatcattatttcattcttgatagtcgtaaatatgtacatcgccataatccttgagaacttcagcgtggcaacagaggagtcaaccgagcccctatcagaggacgatttcgacatgttctacgagatctgggagaagtttgacccagaggcaacacagttcattgagtacagtgtgttatcagacttcgccgatgctctcagcgaacctctgcggatagctaagcccaaccagatctctctgattaacatggacctgcctatggtgtctggcgaccgtatccactgcatggacatcttgttcgcttttaccaagcgtgtactgggagaatcgggcgagatggacgccctgaagatccagatggaggaaaaattcatggctgcaaatccctctaaaatatcttatgagcccattacaaccacgctgcgcagaaaacatgaggaagttagcgcaatggttattcagcgcgcctttcgcagacacctgctgcaacggtccctgaagcatgcctcatttctgtttaggcaacaggcgggctcgggactgtcagaagaggacgcccctgaacgcgagggactgattgcatatgtaatgtctgaaaatttttctaggccgctaggaccaccaagctcctccagtatctccagcacatcttttccaccatcctatgatagcgtgacgagagcaacctctgacaatctgcaggtgagaggttctgactattcccactctgaggatctggcggacttcccaccgagccctgatcgagatcgggaatccatcgtatag

SEQ ID NO: 205513 - DNA, 5889 bp, Artificial Sequence
  Description of Artificial Sequence: Synthetic coding sequence
atggccaacttcctgctgccccggggcaccagcagcttccggcggtttacaagagagtcactggccgcaatagaaaagagaatggccgaaaaacaggccagaggctcgacgacactgcaggagtcccgcgaaggtctgcctgaggaagaagctcctcgaccccagctggatctgcaggcaagcaaaaaactcccggatctgtacgggaacccaccgcaggaactgatcggcgaaccactggaggatctagatcccttttacagcacacagaaaacttttattgtgctgaacaagggtaagacaatatttagattcagcgctaccaacgcgctgtacgttctgagtccttttcatccaatcagacgggctgccgtaaagatactcgtacactccttgtttaacatgttgatcatgtgcactattctcaccaattgtgtattcatggcacaacacgatcccccaccctggaccaagtatgtggagtataccttcaccgccatttacactttcgaaagtctggtgaagatacttgctcgcggcttctgtttgcatgcctttaccttcctgcgagatccctggaactggttggactttagtgttatcattatggcctatacaacagagttcgttgacctggggaatgtcagcgcactgagaacctttcgcgtgcttcgcgccctgaaaactatttcagtgataagcgggttaaagactattgtaggcgctttaatacaatccgtgaagaagctggctgatgtgatggtcttaactgtattttgcctctccgtctttgctctcatcggtttacagctgttcatgggcaatctcagacacaaatgtgtgaggaacttcacagcgttgaacggtactaacggcagtgttgaagccgacggtctggtgtgggagagcctggacctatacctcagcgatcccgagaactacctgctaaagaacggaaccagcgatgttctgctgtgtggcaactcaagtgacgccggaacttgccctgagggatacagatgtcttaaggctggagagaatccagaccacggttacaccagctttgactcttttgcctgggcctttcttgcactttttcggcttatgacccaggactgctgggagcggctgtaccaacagaccctgagatcagccggcaaaatctatatgatttttttcatgctggtcatcttcctgggcagcttttatctggtgaatctcatccttgccgtggtcgccatggcttacgaggagcagaaccaggctacaattgctgaaacagaggagaaggagaagaggttccaggaagctatggagatgctcaagaaggagcatgaggccctgacgattcgcggggtcgacaccgtttcacggagctcgctcgaaatgtccccacttgcccctgttaattcccacgaaaggcgcagtaagcgtcggaagagaatgagcagcggtactgaggagtgcggggaggaccgactgccaaaaagcgacagcgaagatggaccaagagcaatgaaccacctttctttgactcggggcctatcccgtacttctatgaaacccagaagctccagaggcagtattttcacattcaggcggcgtgatctgggcagtgaggcagactttgcagatgacgagaacagcaccgccggggagtcagagagtcatcatactagcctactggtgccttggccactcaggaggacaagtgcacaaggacaacccagtccgggtacatccgctcccggccacgctttacacggcaaaaaaaacagcaccgtagactgcaatggagtggtgtccttgcttggcgccggcgatcccgaagctacaagccctggatcccaccttttaaggccagtgatgttggagcacccccctgatacaaccactccatctgaagagcccgggggcccccagatgctaacgtctcaggctccatgtgtagacggcttcgaggagccgggcgctaggcagagagcgctttctgctgtctccgttctcacctctgccctcgaggagctcgaggaatcgcgtcataagtgtcctccttgttggaaccgtctcgcccagcgctatctcatctgggagtgttgtccgctgtggatgtctatcaagcagggggtgaaactggtggtcatggacccttttacagacctgaccattacaatgtgcatcgttcttaatactttatttatggctcttgaacactataacatgactagcgagttcgaggagatgctgcaggtaggaaacctggtgtttacaggcatcttcaccgccgaaatgacttttaagattattgccctggatccatattactactttcagcagggctggaatatcttcgattcaataattgtgatcctctccttgatggagttgggcctgagtaggatgagcaacctttctgttctaagatcctttcgcctgttgagggtgtttaagctggctaaaagctggccaacgctgaacactcttataaagattatcgggaatagcgtgggcgccctgggcaaccttacactggttcttgccattatagtgtttatcttcgccgtcgttgggatgcaactttttggaaagaactactcggaacttagggattcagactcgggactcctgcctcgctggcatatgatggacttcttccacgcatttctcattatctttcgaatcctctgtggcgagtggattgagacaatgtgggattgcatggaagtctctggacagagcctgtgcctgttagtttttctcctcgtgatggtgattggtaatttggtggtgctgaatctctttctggcactgctactctcaagcttctctgctgataacctcaccgcgcccgacgaggatagggaaatgaacaacctgcaactggcactcgcccgaatccagcgcggccttaggtttgttaagaggacaacttgggatttctgctgtggcctgctcagacagcggccccagaagcctgccgcacttgccgcccagggccagttgccaagctgcatcgcgacgccatacagcccaccaccaccagagacagagaaggtgcctcctacccgtaaggagaccaggttcgaagagggcgagcaacctggacaaggcacgcccggggaccctgagcctgtctgcgtgccaatcgccgttgccgaatcagataccgacgatcaggaggaagacgaggagaactcgctcgggaccgaggaggagtcttctaagcagacccccgaagacagctgttcagaaggcagtacagccgacatgactaatactgcagaacttcttgagcagatacccgacctaggccaagacgtcaaggaccccgaagattgttttacagagggatgcgtgcggcggtgtccctgctgcgctgtcgatactactcaagctccagggaaagtgtggtggagactgaggaagacttgctaccacattgtagaacactcttggtttgagactttcattatttttatgattctcctcagttccggcgccctcgcattcgaagacatttacctggaagaaaggaagaccatcaaagtgctgcttgaatatgccgataaaatgtttacttatgtattcgtgctggaaatgttgctgaaatgggtcgcttacggattcaaaaaatacttcaccaatgcttggtgctggcttgattttcttatcgtagacgtgagtctggtaagcctggtggccaacactctgggatttgccgagatgggccctatcaagtcactccggactctgcgtgccctgcgtcccctgcgagctctcagtaggttcgagggcatgagagtggttgtgaatgcgctagttggcgcgattcccagcatcatgaacgttctcctcgtttgcctgatcttttggcttatcttttccattatgggagttaacctttttgctgggaagttcgggagatgtatcaatcagactgaaggcgacttacccttaaactatactatagtgaacaacaaaagtcagtgcgagtctctaaatttaaccggtgagttgtactggaccaaggtcaaggttaatttcgacaatgtgggcgcaggctacctagctctccttcaggttgctacctttaaggggtggatggatatcatgtatgcagcagtggatagccgggggtacgaagagcaaccgcagtgggaatacaatctgtacatgtacatttacttcgtaatatttataatttttgggtcatttttcaccctaaacctgtttatcggcgttattatagataacttcaatcagcaaaaaaaaaaacttggtgggcaggatatcttcatgacagaagaacagaaaaaatattataacgcgatgaaaaaactgggatccaaaaagccccagaagcctatcccacgaccactcaacaagtaccaaggattcattttcgacatcgtgactaaacaagcttttgatgttaccatcatgttcctgatttgcctgaatatggtcaccatgatggtggagactgacgaccagagtccggagaaaatcaatatcctggcaaagataaacttgttgtttgttgccatctttaccggtgagtgcatagtcaagctagccgccctgagacactattactttacaaactcctggaacatatttgatttcgtggtggtgatcctgagcattgttggcacggttctgtccgatattatccagaaatacttctttagccccaccctgtttcgggtgatccgactcgcaaggattggtaggattcttcggttgatccggggtgccaaggggattcgtactctactcttcgcactaatgatgtctctccctgcattgtttaacatcggacttctactcttcctcgtgatgtttatctactccatctttggtatggccaactttgcgtacgtgaagtgggaggctggaattgacgacatgttcaatttccagacctttgcaaatagcatgctctgtctttttcagattacaacttctgccgggtgggacggactcttgtcacctatcctaaatacaggacctccgtactgcgatcccacattaccgaatagcaatgggagtcggggagattgtggaagtccggcggtcgggatcctgttctttaccacctatattatcattagttttcttattgtggtcaatatgtacattgccatcatccttgagaacttttctgtggctaccgaagagtcaactgagcccctctctgaggacgactttgacatgttttacgaaatctgggaaaagtttgatcccgaggcaacccagtttatcgagtacagtgtgttaagtgactttgctgatgccctgtctgagcccttacggatcgctaagcccaatcaaattagcctgatcaacatggatttgccaatggtgtcaggcgacagaatccactgcatggacatactcttcgccttcaccaagcgggtgctgggtgaatcgggggaaatggacgcgttaaaaattcagatggaggagaaatttatggcagctaacccttccaaaatctcctacgaacccataactacaacactaaggaggaagcatgaagaggttagtgctatggtgatccagagggctttccgcagacatttacttcagaggagcttaaagcatgcctccttccttttcagacagcaggcgggttctggtctgtccgaggaggacgcaccagaaagggagggcctgatcgcctatgtcatgagcgaaaacttctcccggccactcgggccaccatccagctcttctatcagttccacctcattcccacctagctacgactccgtgactcgagcaacctctgacaatctccaggtccgagggtccgattattcacactctgaggatctagcagattttccgcccagcccggaccgagacagggagtccatagtgtag

SEQ ID NO: 205514 - DNA, 5889 bp, Artificial Sequence
  Description of Artificial Sequence: Synthetic coding sequence
atggccaacttcctgctgccccggggcaccagcagcttccggcggtttactagggagtcgctggcagcgatcgaaaagaggatggccgagaagcaagcccgtggctctaccacattacaggaatcaagagagggattaccagaggaggaggctcctagaccgcaattggacctccaggctagcaaaaaactccctgatctgtacggaaatccccctcaggagttgattggtgaaccactggaggacttggatcctttctattcaactcagaaaaccttcatcgtgttgaataaagggaaaaccatctttcgcttctcagcgaccaatgctctatatgtactgtcaccatttcatcccatccgccgagccgcggtcaagatcttagtgcattctctctttaatatgctgatcatgtgcacaatccttaccaactgtgtgtttatggcgcaacacgacccccctccatggacaaagtacgtggaatacacatttacggcaatctacacctttgaatcactagtgaaaatcttagccagaggattttgcctgcatgccttcacattcctccgtgatccatggaattggttggacttcagcgtgattataatggcctatgtttcagaaaatataaaactgggcaacctttctgccctcagaacttttagggtactccgtgccttgaagactatttccgtgattcctggtttgaagaccatcgtaggcgccctcatacaatcagtgaaaaagctagcagacgtcatggtcttgacggtgttttgcctgagcgtgtttgctctcataggattacagcttttcatgggaaacctacgacacaaatgcgtacgcaatttcactgctctgaatgggacgaacggaagcgtggaagctgacgggctcgtgtgggagagcctcgatctgtatctgtccgaccctgagaactacttacttaaaaatgggacatcagacgtgcttttgtgcgggaattccagcgatgccggcacatgccctgaaggatatcggtgcctgaaagctggtgaaaaccccgatcatggatacacatcctttgacagctttgcatgggctttccttgccctgttccggctgatgacgcaagactgttgggaaagactgtaccagcagactctgagaagcgctggtaagatttacatgatttttttcatgctcgtcattttcctgggatccttttatctcgtgaatttgatcttggctgtggtagcaatggcgtacgaagaacagaaccaggctaccatcgctgaaaccgaggaaaaggagaagcgatttcaggaggccatggaaatgctgaaaaaagagcatgaggcactaacaatacgcggagtcgacactgtctcacgatcatctctcgaaatgtccccactggccccagtgaactctcacgaacgccgctccaagaggagaaagcgtatgtcatcagggacagaggagtgcggcgaggaccgcctgccaaagtcagactcagaggatggcccaagagccatgaatcacctgagcttgactagaggactatctagaacctccatgaaacctcggagttccagaggcagcattttcacatttcgccgccgcgacctcgggtcagaggcagatttcgctgacgatgaaaattcaaccgctggcgagagtgaatctcaccacaccagtttgttagtgccttggccactcaggcgcacgtctgcacagggccaaccttcgcctggcacctctgccccggggcacgctctccatggcaagaaaaacagcacggtcgattgcaatggagtggtgtccctgttaggggctggtgatccagaagcgaccagccctggctctcaccttctgcgcccagtgatgctcgagcatcctccagatacgacaactcccagcgaggaacccggagggccacagatgctgacctctcaggcaccttgtgtcgatggcttcgaagaaccgggcgcgcggcagcgagccttgtccgcggtcagcgtgctcacatcggctctcgaggagctcgaagagtcaaggcacaagtgtcctccgtgctggaatagactggctcagcgctacctgatttgggaatgctgccctctgtggatgtccataaaacagggggtgaagctggtggttatggatcctttcactgatctgaccatcacaatgtgtatagttcttaatacattgttcatggcactagagcactacaacatgactagcgagttcgaggaaatgttgcaagtcggcaacctcgtgtttaccggtatctttaccgccgagatgaccttcaaaattatagccctggacccatactactatttccagcaggggtggaacatctttgactcaattatcgtgatcctgagtctgatggagctgggcctcagtagaatgtctaatctgtctgtgttacgctccttcaggttattgcgggtgttcaagttggctaaaagttggccaaccctgaacaccctcatcaaaattattggcaattcagttggagcacttggaaacctgactctcgtgttagctatcattgtattcatctttgccgttgtggggatgcagctctttggaaagaattattccgaattgcgagacagcgatagcgggctactgcccagatggcacatgatggatttcttccacgcattccttattatctttagaattctgtgcggagagtggattgagactatgtgggactgcatggaggttagcggccaaagtctgtgccttctggtgtttctgttggtgatggttattggcaacctagttgtactgaatttgtttctggcccttctgttatcgagcttttccgcggataacttaacagctccagatgaagaccgggaaatgaacaacctgcagctggcactggctcggattcaaagaggactgagattcgtaaagcggactacctgggatttttgttgtggtctgctcaggcagcgaccccagaaacccgcagccctggcagcccagggacagctacctagttgtatagctactccttactcccctcctccccccgagacagagaaagtgccccccacgcggaaagagacaagattcgaggagggcgaacagccaggccaaggaacccccggcgacccagaacctgtatgtgtccctatagccgtggcagaatctgataccgatgaccaagaggaggatgaagaaaactctctagggactgaagaggagagttccaagcagacccctgaggattcgtgctccgaaggatccacggccgatatgaccaataccgcagaacttctagagcagattccggacttgggccaagatgtgaaggatcccgaggactgcttcactgaaggctgcgtgaggagatgtccctgctgtgctgtggatactacccaggctcctggtaaggtttggtggagacttcggaagacctgttaccacatcgtagaacattcctggtttgagacattcataatttttatgattctgttatcatccggagctctggccttcgaagatatctatcttgaggaaagaaaaaccattaaggtcttgctagaatacgctgacaagatgttcacttacgtcttcgtgctggagatgctccttaaatgggtcgcctacggctttaagaagtacttcacgaacgcttggtgttggttagacttcttaatcgtcgacgtaagcttggtcagcctggtggccaacacactaggttttgccgagatgggccccatcaaaagcttgaggacgctgcgagccctcaggcccctgcgagccctgtcacgattcgagggaatgcgggttgtggtcaacgccttggtcggagccataccaagtatcatgaacgttttacttgtctgtttgatcttctggctcatcttcagtattatgggcgtgaacttgtttgccggcaaatttgggcgatgcattaaccagactgaaggcgatcttcctttaaactacacaatagtgaataacaagtcccagtgtgagtcactcaacttgactggcgagctgtactggactaaagtgaaggtgaactttgacaatgttggtgcaggttaccttgctctgctgcaagtggcaacatttaagggttggatggacataatgtatgctgctgtggacagcagaggttacgaagagcaaccacaatgggaatataatctatatatgtatatatactttgtgatctttataatctttggcagtttcttcactctgaatcttttcattggtgttatcattgataatttcaatcagcagaagaagaaattgggcggacaggatatcttcatgacggaagagcagaaaaagtattataatgccatgaaaaagctgggatctaaaaagccccaaaagccaattccacggccacttaacaagtatcagggttttatctttgatattgtcactaagcaggcctttgatgttaccattatgtttctcatatgtctgaatatggttacaatgatggtggagacagacgaccaatccccggaaaaaatcaacatcctggcgaagataaacttgctcttcgtggccatatttaccggagaatgtatagtaaagttagcagcactcaggcattattacttcaccaacagctggaatatcttcgacttcgtggtagtgatcctgtctattgtgggaaccgtcctgtctgatataatccagaaatattttttcagcccaacgctgttccgggtgattcggttagcccgaattggtaggatactgcgtctaataagaggagctaaaggcattcgaacgctgttgtttgcactgatgatgagcttgccggctctgtttaacatcggactcctcctgtttctggtcatgtttatctatagcattttcgggatggcaaattttgcttacgttaagtgggaggctgggattgatgacatgttcaacttccaaacttttgccaatagtatgctgtgtttgttccaaataacaaccagtgcagggtgggacgggctgctatcccccatactcaataccggacccccctattgtgaccccactctgccaaattcgaatgggtctcgtggagattgtggcagccccgccgtcgggatcctcttctttaccacctatattattatctcatttctgattgtggttaatatgtacatcgcaatcattctggagaatttctctgtagcaacagaagagtcaaccgaacccctttcagaggacgattttgacatgttctatgagatttgggaaaaattcgaccccgaagcaacgcagttcatagaatactccgtcctgtcagatttcgcggatgctctgtccgaaccactgcgaatagccaaacccaaccaaataagtctgattaatatggacttaccaatggtgtccggagaccggattcactgcatggatattctgtttgccttcacaaaaagagtactgggtgagagtggggaaatggacgctctcaagattcagatggaggaaaaatttatggcagcaaatccttccaagatcagttacgagccgatcaccaccaccctgcggaggaagcacgaggaggtcagcgccatggttatacagcgcgcttttcgccggcaccttcttcaaagatcactgaagcatgctagttttttgttcagacagcaagctggctccggactcagcgaggaagacgctccagaaagggaaggacttatcgcgtacgttatgtcggagaatttcagcaggcccctgggccccccgtccagctcgtcaatctcgagtacgagctttccgccgagctacgactcagtgacccgcgccacttcggacaatttgcaggtgcgtgggagcgactattcacattcagaggacctggcagatttccccccttcacccgatagggatcgagaaagtattgtgtag

SEQ ID NO: 205515 - DNA, 5889 bp, Artificial Sequence
  Description of Artificial Sequence: Synthetic coding sequence
atggccaacttcctgctgccccggggcaccagcagcttccggcggttcacacgagagagcctcgccgctatagagaagcgtatggcagagaaacaggcccgcggttcaacaacgctgcaagaatctcgagaaggattgccagaagaagaggcgccacggcctcagctggatctgcaagcgtcaaagaaactgcccgacttgtatggcaaccctccccaggagctgatcggagagccactggaggatttagatcctttttacagtacacaaaaaaccttcatcgtgttaaacaaaggcaagactatctttcgattcagcgccaccaatgcgctgtatgtgctgtctcctttccacccaatccggagagcagctgttaagatcttggtgcactccttgtttaatatgcttataatgtgcacaattctcaccaattgtgtgttcatggctcaacacgacccccctccgtggacgaagtacgtggagtacaccttcaccgcaatctacaccttcgagtcactggttaagatcctggcaagagggttctgtctgcacgcctttactttccttagggatccttggaattggctggacttcagcgtcattataatggcctacgtgagcgaaaacattaaactggggaacctgtcagccctcaggaccttcagggtcctgcgagctctgaaaaccatttccgtaattcctggactaaagacaatcgttggcgccctgatccaaagcgtcaagaagctggccgatgtgatggtacttacagttttttgcctctctgtatttgcactgataggcctgcagctgtttatgggcaatctgcgccacaagtgcgtgcgaaatttcactgcactaaacggtaccaacggtagcgtggaagcagacgggctggtgtgggaatccctggacctgtatctgagtgacccagagaactacctcttaaagaatggaacgagtgatgtactgctctgtggcaattcaagtgacgcaggcacatgtccagaaggttaccgatgtctgaaagccggtgaaaatcctgaccacgggtacacatcttttgattcatttgcctgggccttcctcgctctgttcaggttgatgacccaggattgctgggaaaggctgtatcagcaaacactccggtccgcaggaaaaatctacatgattttctttatgcttgtgatcttcctcgggagcttttacttggtgaatctgatccttgcagtggtggctatggcgtatgaggaacagaatcaagctacgatcgctgagacggaggagaaagaaaagcgcttccaagaagccatggaaatgttgaagaaggaacacgaggcactcacaattaggggcgtggatacggtcagccgatcctcgctggagatgtctcctctggccccagtcaattctcatgaacgacgtagcaagaggcggaagcgcatgagcagtggcacagaagagtgcggcgaagatagattgccaaaaagtgattctgaagacggtccaagagctatgaatcacctgtcattgaccagagggttatcgcgaacctccatgaaacctcgcagtagccggggcagcatattcacttttcgccggcgggacctagggtcagaggcggactttgcggacgacgagaattccacggccggcgagtcagagtcgcatcacaccagtctgttagttccttggcccctccgacggacctctgcccaggggcagccatccccaggtacttccgcacccggccacgccctgcacggcaaaaaaaattctacggtggattgcaatggtgtcgtaagcctgttgggcgcgggcgaccctgaagcaacaagcccaggctcgcatttgcttcggccagtgatgctggagcatccccctgacacgaccactccgagtgaggagccaggtggtccacagatgctaacctcacaggcaccatgtgttgacggcttcgaagagccgggagcccgccagcgggcactgtcggccgtgtctgtgctaacttctgcacttgaggaactagaagagtccaggcacaagtgtccaccctgttggaatagattggctcagagatatctaatatgggagtgttgtccactttggatgtcaataaagcaaggtgtgaagcttgttgtcatggacccatttaccgacctaaccatcactatgtgcattgtgctcaacacgctgttcatggccctggaacactataacatgacctcagagttcgaagaaatgcttcaagtaggcaacctagtgttcacagggatcttcacagccgaaatgacattcaagatcattgccttggatccatactactactttcaacagggctggaatatcttcgacagcattatcgtgattctcagtctcatggagctcggactcagccgtatgagtaacttgagtgtcctgcggagcttccgtctgctgcgcgtgtttaaactcgccaaatcctggcctaccttgaatactttaataaagatcattgggaatagcgtgggcgccctcggtaacctaacactcgtgctggccatcattgtctttattttcgccgtggtgggcatgcaactgttcggcaaaaactatagtgagctgcgcgattcagactcagggttacttcctagatggcacatgatggatttcttccatgcgttcttaattattttcagaatcttgtgtggtgaatggatagagaccatgtgggactgtatggaagtgtcgggtcagtcgctctgcctgctggtctttctgctagtgatggttattggcaatctcgtggtgctgaacctgtttttagcactgcttctgtcatcattctctgctgacaatctgaccgcccccgacgaagaccgagaaatgaacaatcttcagctggccctcgccagaatacagcgggggctcagattcgtgaagcggaccacctgggatttctgttgtgggctactgcggcaacgccctcaaaagccagcggccctggctgcacagggtcagttgccctcttgtatcgcaactccatactcaccaccgccgcccgaaaccgagaaagtaccaccaactcgcaaggaaacccgcttcgaagaaggagagcagcccgggcagggcacacctggtgatcctgagcctgtatgtgtgcccattgctgtggcagagtcagatactgatgatcaagaggaagatgaggagaattccttgggcactgaggaggaaagctcaaaacagaccccggaggactcctgtagcgagggctccaccgctgacatgactaatactgccgagttgttagagcagatccccgacttgggacaggacgtaaaggaccccgaagactgtttcacagaaggctgcgtgcggaggtgcccttgctgtgccgttgatacgacgcaggcgcctggcaaggtgtggtggcggctaagaaagacctgctatcatatcgtggagcatagttggtttgagacatttattatcttcatgatcctgttaagttcaggggcactggcctttgaagacatttacctcgaggagagaaaaacaataaaagtgctcttagagtatgctgataaaatgtttacctatgtgttcgttctagaaatgctgctcaaatgggtcgcctatgggttcaaaaagtactttacaaacgcttggtgctggttggattttctgatcgtggatgtgtcattggtctctttagtggccaatacgcttgggtttgctgagatgggccctattaaatctctcaggacccttcgagcactgagaccccttagagcattgagtcggttcgagggtatgcgagttgtcgtgaacgctctagtgggagccatcccttccatcatgaatgttttgcttgtgtgcctcatattctggcttatctttagcataatgggtgtaaacctgttcgcggggaaattcggtcggtgcatcaatcagacagagggtgacctcccattaaactacaccatcgtgaacaacaaatcgcagtgcgaatctctgaatctcacaggggaattgtattggacaaaggtgaaggtgaatttcgataatgttggggcaggatatctcgcattgttacaggtggccactttcaagggttggatggacattatgtatgcagcggtcgactcaaggggctacgaagagcagcctcagtgggaatataacttgtatatgtacatctatttcgtgatcttcattatctttggatcattttttactctaaacctgttcatcggagtcattatcgacaatttcaaccaacagaaaaaaaaactcggaggccaggatatttttatgacagaagaacaaaagaaatattacaatgctatgaagaagcttggcagcaaaaaaccgcaaaagccgataccacggcctcttaacaagtatcaggggttcattttcgatattgtgacaaagcaggcgttcgacgttaccatcatgtttctaatctgtctgaacatggtcacgatgatggtggaaaccgacgaccaatcgccagagaaaataaacatccttgctaaaatcaatctgcttttcgtggccatattcaccggagagtgcatcgttaaacttgctgctctgcggcattattattttactaattcctggaacatttttgatttcgtagtggttattctttccattgtcggcaccgtgctgagcgacataatccagaagtatttctttagcccaacactgttccgggtgatccgactcgcgagaatcgggagaatccttcgacttattagaggtgcaaaggggattaggacactgcttttcgccctcatgatgtcactgcctgccctgttcaatataggcctcctcctatttctggtgatgttcatttattccatttttgggatggcaaacttcgcttacgttaagtgggaggccgggattgacgacatgtttaatttccagaccttcgccaattcaatgctttgcttatttcaaatcactacttccgcaggctgggatggattgttaagtcccattctaaatactggaccaccctactgtgacccaaccttacccaattcaaacggttcaagaggcgactgcggatctcccgccgtggggattttatttttcaccacttacattattatctcattccttattgtagtgaatatgtatattgcaattattctggagaattttagtgttgcaactgaggagtcgactgagcccctttccgaagatgacttcgatatgttttacgaaatatgggagaaattcgacccagaagccacccagttcattgagtattctgtgcttagcgacttcgctgacgcactcagcgaaccccttcggatagcaaaaccaaaccaaataagtctcataaacatggacctgccgatggtgtccggagacaggatccattgcatggatatcctgtttgccttcacaaaaagggttctgggcgagagtggtgagatggacgcgctcaagattcagatggaagagaaattcatggccgcgaaccctagcaaaatttcatacgaacccatcacaacaactctccgccgcaagcatgaggaagttagtgccatggtgatccagagggctttccgccgacacttactccagcgtagtctcaaacatgctagtttcctctttcgccaacaagcaggatccggtctctccgaagaggatgcaccagagagagaggggctcatagcctatgtcatgtctgagaatttctctaggcccctcggacccccgtcttcctcaagcattagctccacctcattcccaccatcctacgactctgttactagagcgacttcagacaacctacaagttagaggatcagattacagccatagcgaggatctggccgactttcccccctcccccgacagggaccgagaaagcattgtctag

SEQ ID NO: 205516 - DNA, 5952 bp, Artificial Sequence
  Description of Artificial Sequence: Synthetic coding sequence
atggccaacttcctgctgccccggggcaccagcagcttccggcggttcactcgagagagcctggccgccatagaaaagcggatggcagaaaagcaggctcggggcagcaccacactacaggagtcccgcgaaggcctgcctgaagaagaggcccctcgccctcagttagatctgcaggcttctaagaagctgccagatctgtacggtaaccccccacaggagctcatcggagaaccgctggaggatctggatccattctattcgacacaaaagacattcatcgtcctgaataaaggaaaaactatcttcagatttagtgctactaacgcattgtacgtacttagtccctttcatcctattcgaagggcagcagtcaaaatcctggttcattcccttttcaacatgcttatcatgtgtacaattcttacaaattgcgtctttatggcgcagcatgatccgcccccatggacaaagtatgtggaatataccttcactgctatttacacatttgaatccctcgtgaagattctagctcgggggttctgtttgcatgcgttcacctttctccgcgatccatggaactggctcgacttctccgtgataattatggcctacgtttcagagaacataaaactcggaaacctgagcgctctccggaccttccgagtgctgagggccctcaagacgatctctgtcataccaggactgaaaacgattgtcggggcacttatacagagcgtgaagaagcttgccgatgtgatggtcctcacggtgttttgcctttctgtgttcgccctcattggacttcagctgttcatgggcaatctgcgccacaaatgtgtgcgcaatttcacagcacttaatggtacaaacgggtctgttgaggccgacgggctcgtgtgggagtcccttgacctatatctcagtgacccggaaaactatctcttgaaaaacggcacctccgatgtcctgctctgcggaaattctagtgatgctgggacttgccccgagggttatcgatgccttaaggcgggagaaaaccctgaccacggctatacgagtttcgatagtttcgcctgggcctttttggcactctttcggctaatgacacaggactgctgggagaggctataccagcagaccctgcgcagcgccggaaagatctacatgatatttttcatgcttgtgatttttctgggtagtttctatttagtgaacctcattctcgctgtggttgcgatggcctacgaggaacagaaccaggcaaccatagctgaaactgaagaaaaggaaaaacgcttccaggaggcaatggaaatgctcaaaaaggagcacgaggccctgaccatcaggggggtggacacagtgtctagatcttctctggaaatgtcgcctctagcacccgtgaattcgcacgagcggcgcagcaagaggagaaagcgcatgtcctccgggactgaagaatgtggtgaggacagactgccaaaatccgacagcgaggacggacctcgtgctatgaaccacttgtctttaactaggggcctgagcaggacctccatgaagcccaggagctctaggggctcaatcttcacctttagaaggcgcgacctggggtccgaagcagacttcgccgacgatgaaaattcaaccgctggcgagagcgagagccaccacaccagtctgctggttccttggcctcttagacgcaccagcgctcagggccagccttcaccaggcactagcgcacccgggcacgcattgcatggtaagaaaaacagcacggtggattgtaatggggtcgtatctctcctgggcgcaggcgaccccgaggccactagtcccggaagccacctgctcagaccagttatgctggagcatcctccagatactacaacgccctccgaagaacctgggggcccgcagatgctcacgagccaagcaccgtgtgtggacggatttgaggaacccggtgctaggcaacgcgctctgagcgccgtatccgtgctgacgtccgctctcgaggagctcgaggagagtcggcacaaatgcccgccctgctggaaccggttggcacagcggtatctgatttgggaatgctgtcccttgtggatgagcattaagcagggtgtcaaattagtcgtgatggacccgttcactgaccttacgatcacaatgtgcatcgtcctgaatacactgtttatggccctcgagcattacaatatgacatccgagtttgaggagatgttacaggtcgggaacttagtttttacggggattttcaccgcagagatgacgtttaagatcatagcccttgacccgtattactactttcaacaaggatggaatatcttcgattcgatcatcgtgatattgtctttgatggagctgggactgagtcggatgtccaatctcagcgtgctgcgctcatttcggctgttgcgggtgttcaaactggccaaatcctggcccaccctgaataccttgataaaaattatcggcaacagtgtgggcgctctgggaaacctgacactcgtcctagccattatagtatttatctttgccgtggtgggcatgcagctgtttggaaaaaattattctgagttgagggattctgattctggcctgctgccccgctggcacatgatggactttttccacgcctttctaatcatcttcaggattctctgtggagagtggatcgagaccatgtgggactgcatggaagtgtccggccagagtctctgtcttctggtgttcttgcttgttatggttataggtaatttagtggtgctaaacctgtttcttgccttactgctctctagtttcagcgcggacaatttaacagcaccagacgaggatagggagatgaacaacctgcaactcgcgttagcacgtattcagaggggtctacggtttgtcaaaaggaccacttgggacttttgctgtggcctgctgcgacagcggccgcagaaaccggccgcactcgcagctcagggtcagttgcctagctgtatcgctaccccctattctcctcctccccccgagactgagaaggtaccccccaccagaaaggagacgcgctttgaagaaggggaacagccaggccagggaactcccggcgatccagagccagtttgcgtcccgatcgctgtggcggaatccgatacagacgatcaggaggaagatgaggaaaactcattgggaacggaggaagagtcctcaaagcaggaaagccagcctgtcagcggaggtcctgaagccccccctgattccagaacctggagccaggtgtctgcaacagctagctcagaagctgaagcctcagcttcccaggcagattggaggcagcagtggaaggccgagcctcaagctcccggatgcggcgagactccggaggacagctgtagcgaaggatccactgccgatatgactaacactgccgaattgttagagcagatacccgatctaggccaggatgtgaaagacccggaagactgctttacagaggggtgcgtaagaagatgtccgtgttgcgcggtggatacaacccaggcgccaggcaaagtgtggtggcgcctccgtaaaacttgctaccatatcgttgaacactcttggttcgagaccttcattatctttatgattctgctcagcagtggcgcactcgcctttgaagatatttacctggaggaaaggaaaaccatcaaggtcctgcttgaatatgccgacaagatgtttacttatgtgtttgtgttagagatgctgctgaaatgggtggcctatggttttaagaagtacttcaccaacgcctggtgctggctcgattttctgatagttgacgtaagtctggtgtcactagtggccaataccttgggcttcgccgaaatgggccccattaaaagcttgcggacactccgcgccctgcgacccctgcgtgcgttatctaggtttgaggggatgagggtcgtcgttaatgccctcgtaggcgccattccaagcatcatgaacgtgttgttggtctgtctaattttctggcttatcttttctatcatgggtgtcaatctcttcgccggtaagtttggaaggtgcattaaccaaacagagggcgatctgccgttgaactacaccatagttaacaacaagtctcagtgtgagtctctgaatttaacaggtgagctgtattggactaaagtcaaggttaacttcgacaatgttggagccggttatcttgctctgctccaggtggccaccttcaagggatggatggatatcatgtatgcggccgtcgactcccgaggctatgaggagcagcctcagtgggaatacaatctttatatgtatatatactttgtcatcttcattatttttggatcctttttcactctaaacttgttcatcggcgtaattatagataatttcaaccagcagaaaaaaaaattgggagggcaggacatttttatgactgaagagcagaagaagtactataatgctatgaaaaaattggggtctaagaaacctcagaaaccgatcccacgtcccttgaataagtaccaggggtttatcttcgatatagttaccaagcaggcgtttgacgtcacgattatgtttctcatctgtttgaacatggtcaccatgatggtcgagacggacgaccagtcaccggagaagatcaacattctggctaagattaatctcttgttcgtcgctatcttcactggaactgtcctgagtgacataattcagaaatacttcttctcgcctacactcttccgtgtcattcggctggccaggattggtcgaatcctcagactaatcagaggggcgaaaggaatcaggacactgctgtttgccttgatgatgtcactcccagcgcttttcaatatcggcttgctgttattcctggtgatgttcatttattcgatttttgggatggcaaactttgcctacgtgaaatgggaagccggaatagacgacatgtttaatttccagacttttgcgaattccatgctatgtctgtttcaaatcaccactagcgctgggtgggatggcctgttaagccctattctgaataccggacctccgtactgtgacccaactctcccaaatagcaacgggagcagaggcgactgtggctcgcctgcagtgggcattctgttcttcacaacttatatcatcattagtttcctgatagtggtcaacatgtatatcgccattattctggagaacttttctgtggcgaccgaagaatctaccgagccactgtctgaagacgactttgatatgttttacgagatttgggaaaagtttgaccctgaagctacccagttcatcgagtacagcgtgctgtcggattttgcagatgccctatctgagccactgcggatcgcgaaacccaatcagatttctctcattaacatggatctccctatggtctctggtgatcgcatccattgcatggacatcttgtttgcttttactaagagggtgctgggagagagtggtgagatggatgccctgaagatccaaatggaggaaaaattcatggcagccaaccctagtaagatcagttacgaacctataacgacaacactaagaaggaagcacgaggaggtttctgccatggtaattcagcgtgcattcagaaggcatctcctgcagaggagcctgaaacacgctagcttcttgttccggcagcaggcaggatcaggactgtcagaggaggacgcccccgagagagaaggacttattgcttacgtgatgagcgaaaacttcagtcggcctttgggcccaccttcttcgtcatcaatctcttcaacgtcctttcctcctagttacgatagcgtgacaagagcaactagcgacaatctgcaagtccgagggagcgattattctcactccgaggacttggcagactttcccccttctcctgacagagatagagaaagcatcgtgtag

SEQ ID NO: 205517 - DNA, 5049 bp, Artificial Sequence
  Description of Artificial Sequence: Synthetic coding sequence
atgctggccagccccgagcccaagggcctggtgcccttcaccaaggaatcctttgaactgattaaacagcatatcgccaagacccacaatgaggatcatgaggaggaggatctgaaaccaacccctgatttagaagtgggcaaaaaactaccgttcatctacggtaatctgtcccagggcatggtgagcgagcccctggaagacgtcgatccctactactataaaaaaaagaacactttcatcgttctaaacaagaatcgcactatcttcaggttcaatgccgcctctatcttgtgcactttgtctccctttaattgcatccggcgcactactattaaggtcctggtgcaccctttcttccagcttttcatcctcattagcgtgttgatagattgcgtgtttatgtccctcaccaatttgccaaaatggcgacctgtactcgaaaatacattactcggtatctatacttttgaaatcctggtgaaattgttcgctaggggagtgtgggctggatcattttcttttctgggagacccctggaattggctagacttttctgtgaccgtgttcgaggtgatcatccgctacagccctctggattttattcctactttacaaaccgcaagaacgctcaggatcctgaaaataatacctctgaaccagggcctgaaaagcctggttggagtactgatacattgtttaaagcagttgatcggagttataatcttgaccctcttctttctcagtatattctccctcattggaatggggctgttcatggggaatctgaaacacaaatgttttagatggccacaggagaatgagaatgagaccctgcacaatcggacaggtaatccttactatatccgggaaaccgagaacttttactatctagaaggggagcgttacgcattgctctgcggcaatcgcaccgatgccggtcaatgcccggaaggatatgtgtgcgtcaaagcagggatcaaccccgaccaaggattcactaattttgacagctttggctgggcactcttcgctctcttcaggcttatggcccaggactatcccgaagtcctttatcaccaaattctgtacgcttcaggcaaagtctatatgatcttcttcgtcgtggtgtccttccttttctctttttatatggcatcactctttctgggaattttggccatggcctatgaggaggaaaagcagagggtgggagaaatatccaagaaaattgaaccaaaatttcaacagaccgggaaggaactccaggaggggaacgagactgacgaggctaagaccattcagattgagatgaaaaagcggtcacctatttccaccgacacttcgcttgatgtcctggaagacgcaaccctgaggcacaaagaggaactcgagaagtccaaaaagatttgccctctgtattggtacaaatttgcaaagacatttctaatttggaactgttctccatgttggctaaagctgaaggagtttgtgcacagaatcatcatggccccgtttaccgatcttttcctgattatatgtataattttaaatgtctgtttcctgactctggagcattaccccatgagcaagcagaccaacacgttgcttaacatcggcaatctggtgttcatcggaatctttacagccgaaatgattttcaaaattatcgctatgcacccatacggctattttcaggtcgggtggaacatttttgacagtatgatcgtgttccatggtctgattgaactgtgccttgcaaacgtggccgggatggctcttctgcgcctgttcagaatgttgcgtattttcaaactggggaagtactggccaacctttcagatcctcatgtggagcctgagcaactcatgggtggctctcaaggacctcgtccttctgctgtttacattcatttttttctcagccgcctttggcatgaagctatttggtaagaactatgaagagttcgtgtgtcacattgacaaagactgtcagctgccacgttggcacatgcacgacttctttcactccttccttaatgtgttcagaatcctgtgcggcgagtgggtagagacactgtgggactgtatggaagtggctggacagtcgtggtgcatccccttctacctgatggtaatcttgatcggaaatctcctggttctgtacctttttttagcccttgtgtcatcattctctagctgtaaggatgtgacggccgaggaaaataatgaagcgaagaacttgcagctggcagttgccaggataaagaaggggatcaactatgtactgctgaagattttatgcaagacacaaaacgtgccaaaggacaccatggatcacgtgaacgaggtgtacgtcaaggaggatatctcagatcatacactaagcgaattatccaatactcaggattttctgaaagacaaagagaagagcagcggcacggagaaaaacgccacagaaaatgaaagccagagtctcataccttctccttcagtgagcgaaacagttcccattgcaagcggcgagtctgacatcgaaaatttagataacaaagagatccagtctaaatccggagatggtggctccaaagagaaaataaagcagagctcttcgagtgagtgcagtactgtggacatcgcaatatctgaggaagaagagatgttttacggaggggaaaggtcaaagcacctcaagaatggatgtcgccgaggctcctctctcggacagatttccggagccagtaaaaagggcaagatctggcagaatatacgaaagacctgctgcaagatcgtcgagaacaattggtttaaatgctttatcggcctcgttacgctactgagcactggcaccctggcctttgaagacatatacatggaccagcgtaagaccattaagatcctgctggaatacgcagatatgatatttacgtacattttcattcttgagatgttacttaaatggatggcctacggtttcaaggcgtatttctccaacggatggtatcgcctggattttgttgtggtcatagttttctgcctgagcctgataggcaagactcgcgaggagctgaagcctctaatctcgatgaagttcctccggcccttacgggttctttcgcaattcgagcgcatgaaagttgtggtgagggccctcattaaaacgacactccctacacttaacgtcttcctcgtgtgccttatgatatggctgattttctccatcatgggcgtcgacttgtttgccggtcgcttctatgagtgcatagacccaacctccggggaacggtttccaagttctgaggtcatgaataaatctcgttgcgagtctctcttatttaacgagagtatgttgtgggagaacgctaaaatgaattttgacaacgtggggaatggattcctttcgctactgcaggtcgctacattcaatggatggatcaccatcatgaattccgcaatcgacagtgtggccgtgaatatccagcctcatttcgaagtgaacatatatatgtactgctactttatcaatttcataatcttcggcgtcttcctccccctgtctatgctcattaccgtgataatcgacaacttcaacaagcacaagatcaaactgggaggaagcaatatcttcattactgtcaagcagcggaaacaatacagacgactgaagaagctgatgtatgaggattctcagcgacccgtgccccgtccactgaacaaactccagggcttcatatttgacgtcgttacatcccaggcctttaacgtaatcgtgatggtgctgatctgcttccaggctattgctatgatgattgacacagatgtccagtccctgcaaatgtctatcgccctgtactggattaactctatcttcgtgatgctgtataccatggaatgcatcctgaaactcatcgccttcagatgtttctactttacgatcgcatggaatatatttgactttatggtggtcatcttctccataactggattatgccttccaatgacagtgggttcctacctcgtgccgccttctttagtgcagctaattctcctctcaaggataattcatatgctgcgcctggggaaaggtcctaaggtgtttcacaacttgatgctccccctcatgctcagtctcccagccctgcttaacattatcctgctcattttcctcgtgatgttcatatatgccgtatttggtatgtacaacttcgcttatgttaagaaggaggccggaatcaatgatgtttcaaacttcgaaaccttcggaaattctatgctttgcctttttcaagtcgctatattcgcgggctgggacggaatgctggacgccatcttcaactcgaagtggtcggactgcgatcccgacaaaatcaatccagggactcaggtgcgaggagattgcggaaatcccagcgttggaatcttctattttgtaagctacatcctaatttcttggctcattatcgtgaacatgtacatagtggtggtgatggagtttctgaacattgcctctaagaagaagaataaaacactctcagaggacgacttccgcaagttctttcaggtttggaaacgttttgatccagaccggacccagtatatcgacagctctaagttgtcagactttgcggctgcactggacccaccactattcatggcaaaaccaaacaaaggccagctgatcgctctggacctgccaatggcagtgggggaccgcattcactgtctagacatattgctagcctttactaaaagagtaatgggacaagatgtgagaatggagaaggttgtctctgagatagaatccgggttcttgctcgccaatccatttaagatcacttgcgaacccattacgaccaccctgaagcgcaagcaggaagcggtgtctgcgacaatcatccagcgggcctataaaaactatcgtctccgccgcaacgacaaaaatactagcgatatccacatgattgacggcgacagagatgtgcatgctaccaaggagggggcatactttgacaaagccaaggagaaaagccccattcaatcccagatatag

SEQ ID NO: 205518 - DNA, 5049 bp, Artificial Sequence
  Description of Artificial Sequence: Synthetic coding sequence
atgctggccagccccgagcccaagggcctggtgcccttcaccaaggaaagcttcgagttgataaagcagcacatcgcgaaaacccacaacgaggatcacgaggaggaggatctgaaaccaacccccgacctcgaagtcggcaagaaactcccgtttatttatggaaatctgagccagggaatggtctctgaacctctggaagacgttgacccttattactacaagaagaaaaacacctttatcgtgctgaataaaaaccgaactatcttcagatttaacgctgcaagcatcctttgcaccctgtccccattcaactgtatcagacggaccaccatcaaggtactggtccacccatttttccagctattcatcctgatttcggtcttgatcgattgtgtcttcatgtccctgaccaacttacccaagtggaggccagtgctggaaaacacactgctgggtatctatactttcgaaatcctggtgaaactattcgcacgcggcgtctgggctggcagctttagtttcttgggcgacccttggaattggttggactttagcgtgaccgtttttgaggtaatcatcaggtatagccccctggacttcattcccacactgcagacggccaggacactccgcatcctgaaaatcattccgcttaatcagggcctaaagagcctcgtgggggtcctgattcactgtctcaaacagctaattggggtgattattctgacacttttttttttatctatcttcagcctcattggtatggggctgtttatgggcaaccttaaacacaaatgcttcagatggccacaggagaatgaaaatgaaacactgcacaatcgcacagggaatccttactatataagggagaccgagaatttctactatctcgagggcgagagatatgcgttgctgtgtggaaatcggaccgatgctggtcaatgcccagaggggtatgtctgcgtgaaggcagggattaaccctgaccagggctttaccaacttcgactcctttggttgggccctctttgctctatttagattaatggcgcaggattatccagaagttctttaccaccagatcctgtatgctagtggcaaagtgtatatgatcttctttgttgttgtgtccttcctgttttccttctacatggcttctcttttcttaggaatcttggccatggcttacgaagaggagaaacagcgggtgggcgagatatccaaaaagatcgaacctaaattccaacagacaggcaaggaactgcaggagggaaacgagacagatgaagccaagaccattcagatcgaaatgaagaagcggagtcccatctccactgatacttctctcgacgttttggaagatgctaccctccggcacaaggaagaactagaaaaaagtaaaaagatctgcccactgtactggtataaattcgccaaaacatttctcatttggaattgttcaccttgttggctgaagctaaaggagtttgtgcatagaattatcatggccccatttacagatctgttcctgatcatatgcattattttaaacgtttgcttcctcacattggaacattaccctatgagtaagcagaccaatacactgctgaatatcggcaacctagtgtttattgggatattcactgctgaaatgatttttaaaattatcgctatgcatccatatggatactttcaggtggggtggaacatttttgacagtatgatagtattccacggactaattgagctgtgcctagctaacgtggccggaatggcgcttctgaggctgttcagaatgttgcggatctttaagctgggcaaatattggccaaccttccagattctgatgtggtcactctcaaacagctgggtggcccttaaggatcttgtcctgcttctgttcacctttatctttttcagtgcagcatttggcatgaagctgttcgggaaaaactatgaagaattcgtttgccatatcgataaagattgtcagttgccacggtggcatatgcatgacttttttcactcattcttgaacgtctttaggatcctgtgcggcgagtgggtagagacgctgtgggattgtatggaagtggctggccagagctggtgcattcccttctatctcatggtcattttgataggcaacctcctggtgctctacctgttcctggccttggtgagttcattttcttcatgcaaggatgtgacagcagaagaaaacaatgaagccaaaaatttgcagttggccgtggcgcgcattaagaaagggatcaattacgtgttactaaaaatcttgtgcaaaactcagaatgtccctaaggacacaatggaccatgtgaacgaagtatacgtcaaagaggatatcagcgaccatacactctctgagctaagtaatacacaggatttcctgaaggacaaggagaagagctcgggaacagaaaaaaatgcaacagagaacgaaagccagtcactcattccatcacctagtgttagtgagacagtgccgattgcctccggagagagcgatatcgagaatctagataacaaagaaatacagagcaagtctggggatggtgggagcaaggagaagattaagcagagtagctcgtctgaatgctcaacagtagatattgcgatctccgaagaagaagaaatgttttacggaggcgaacgatccaaacatctcaagaacgggtgtcgtaggggctcaagcttggggcaaatctccggggccagtaaaaaagggaaaatttggcagaacatccgaaagacttgctgtaagattgtggaaaacaactggtttaagtgtttcatcggcttggttacacttctgtccacaggcacgctggcctttgaggacatctacatggaccagaggaagactattaaaattctgttggagtatgccgatatgatcttcacatatattttcatcctggagatgctccttaaatggatggcatatggctttaaagcctatttcagcaatggatggtacaggctggactttgtagtggttatcgtcttttgcctgtcactcattggcaagacccgggaagagttaaagccacttatatcaatgaagttcctgcgcccactgagagtgctgtcacagttcgagcgcatgaaagtggtcgtcagagctctgatcaagacaacactgcccaccctgaatgtcttcctcgtgtgcctaatgatctggctgatcttctccatcatgggggtggatctcttcgccggaaggttttatgaatgtattgaccccacctctggtgaacgtttcccctcttctgaggtgatgaacaagagcagatgcgaatctctgctcttcaacgagtccatgctatgggagaacgctaagatgaacttcgacaacgtaggaaatggattcttaagcttgctgcaggtcgctacattcaacggctggatcacgatcatgaatagcgccatcgattcagtggcagtcaatattcagccacatttcgaggtgaatatctatatgtattgctacttcatcaattttatcatcttcggcgtctttctgcccctttccatgctgataacggtgatcatagataattttaacaagcataagattaagctgggtggttctaatatcttcatcaccgttaagcagcgcaagcagtataggcggttaaaaaaactcatgtatgaggacagccagagacccgtaccgagaccactcaataaacttcaagggtttatattcgatgtagtcacatcccaagctttcaacgtcatcgtgatggttttgatatgcttccaagccattgccatgatgatcgataccgacgttcagagtctgcagatgtccattgctctatactggatcaattctatctttgtaatgctctacacaatggagtgtatcttgaagctcatcgcattccgatgtttttatttcaccattgcatggaatattttcgatttcatggttgtgatctttagtattaccgggctctgcctgcccatgaccgtgggctcttacttggtgcctccttcgctggtacagttgatactgttgtctagaatcatccacatgctgcgactcggcaaggggcccaaggtcttccataaccttatgctccctctaatgctgtcattgccagctctattgaacatcatcctgctgatcttcttggtaatgtttatatatgcggtgtttggcatgtacaacttcgcatacgtgaagaaagaagcagggattaacgatgtttccaattttgagacttttggcaattctatgttatgcctgtttcaggttgcgatctttgccggctgggacggcatgctagacgcaatcttcaactctaagtggagcgactgtgaccccgataagattaaccccggaacacaggttaggggtgactgcggtaacccgtctgtcggaattttctacttcgtgtcttatatcctgatcagctggctaatcattgttaatatgtacattgtggtggtcatggagttcctcaatatcgcaagcaagaagaagaataagacgttatccgaggacgactttcgcaagttcttccaagtttggaagcgttttgatcccgaccggacccagtacatcgattcatccaagctttccgatttcgccgcagctctggaccctcctttgttcatggctaagccgaataagggccaactcattgctctggatctaccaatggctgtcggggaccggattcactgcctggacatactgttggcctttaccaagcgtgtaatgggacaggatgtgcggatggagaaggtagtgagtgaaatcgagagcggattcctgctggctaacccctttaaaattacctgcgaacccatcaccactactctgaagcgtaaacaagaagccgtatccgcaaccatcatccaaagagcctacaaaaactatcgcctaaggcggaatgataagaacacaagcgacatacacatgatcgatggggatagagacgttcatgcaaccaaggaaggcgcttactttgataaggcaaaggagaaaagccctattcagtcacaaatctag

SEQ ID NO: 205519 - DNA, 2592 bp, Artificial Sequence
  Description of Artificial Sequence: Synthetic coding sequence
atgctggccagccccgagcccaagggcctggtgcccttcaccaaggaatccttcgagctgattaaacagcatattgcgaagacccataatgaagaccacgaagaggaagatcttaagccaacacctgacctggaggtcggcaagaaattaccattcatctatggcaatctctcccagggcatggtcagcgagccactggaggatgtagacccgtactattataaaaagaaaaatacatttatcgtattaaataagaaccggaccatatttcgtttcaacgcagcgtcgattctgtgcactctgagtccgttcaactgcatccgccgaacaacgataaaggtgttggtccaccccttcttccagctgtttatactgatcagcgttttaatcgattgtgtgttcatgagtctgacgaatcttccaaagtggcggcctgttctggagaacaccttactaggcatttacacatttgagatcctcgtgaaactttttgcccgaggagtgtgggccggatctttctcatttttaggggatccgtggaattggttagacttctcagtcaccgtgttcgaggttatcattcgatattccccactggacttcatcccaacactacagactgcaaggactctacgtatcctcaaaatcatacccttaaaccaggggctgaaatcactcgttggggtgttaatacactgtctcaaacagctcatcggtgtaattatcttgacgctgttcttcctgagtatattctctctgatcggaatgggactgtttatgggcaacctgaaacataaatgttttcggtggccccaggagaatgagaacgagactctccacaataggaccgggaacccttattacattcgggaaaccgaaaatttctactatctggagggggagcggtatgccctactgtgcggcaaccgtaccgacgctggtcagtgccctgaggggtacgtgtgcgtcaaggctggaattaatccagaccagggcttcacgaactttgactctttcggctgggcactttttgctctgttcagactgatggctcaggattatccagaggtcctctaccatcagatcttatacgccagcggaaaggtttacatgattttcttcgtggtcgtctctttcctgttctccttttacatggcatctctctttctcggaattttagctatggcctatgaggaggaaaagcagcgcgtgggagaaatttctaagaaaatcgaaccaaagttccagcagaccggaaaagaacttcaggaaggcaacgagacagacgaggctaaaacaatacagattgaaatgaagaagaggtccccaatttccactgacacttccctagatgtgctcgaagacgccaccctgcgccataaggaggaacttgagaaatcaaaaaaaatttgtcctttatactggtacaaattcgcaaaaactttcttgatttggaattgctccccttgttggctgaagcttaaagaatttgttcacagaattatcatggctcctttcactgatctcttcctcatcatttgtattattctcaacgtatgtttcctgaccctagagcactacccaatgagtaagcaaaccaacaccctcctgaatatcggtaatcttgtctttatcgggatctttactgcagaaatgattttcaagattattgccatgcatccctacgggtattttcaggtcggatggaacattttcgatagcatgattgttttccacggcttgatcgaactctgcttagcgaacgtggctgggatggctctgttgcgactgtttaggatgctcaggatcttcaagctaggcaagtattggcccaccttccagatcctcatgtggtctctgtccaattcatgggttgccctgaaggatctggtgctgttgctatttaccttcattttcttttcggctgcctttggaatgaaactgttcgggaaaaactacgaagaatttgtgtgccacatcgataaagactgtcagttacccagatggcatatgcatgacttctttcacagttttcttaatgtgtttaggatcctttgcggggaatgggtagagacgctttgggattgtatggaggtcgccggccagtcatggtgtatccctttttacctgatggtgattcttatcggcaacctcctagtgttatatctgttcttagcactcgtcagcagcttttcctcatgtaaggacgtaactgctgaagagaataatgaggcaaaaaatttgcagctcgccgtcgctagaatcaaaaaagggataaattacgtactattgaagattttgtgtaagactcagaacgtaccgaaggacaccatggaccacgttaacgaagtgtatgtgaaagaggacatctctgatcataccctgtccgaacttagtaacactcaggattttttaaaggacaaagagaagtccagcggcactgagaagaacgcaaccgaaaacgaaagtcagagcctcatcccgtctccctcagtgagcgagaccgtacccattgccagtggggaaagcgacatagaaaatctcgacaataaggagattcaaagcaaatcaggcgatggaggcagtaaatag

SEQ ID NO: 205520 - DNA, 1209 bp, Artificial Sequence
  Description of Artificial Sequence: Synthetic coding sequence
atgctggccagccccgagcccaagggcctggtgcccttcaccaaggagtctttcgaactgattaaacagcatatcgcaaagactcacaacgaagaccatgaagaggaggatctgaagcctaccccagacctagaggtaggcaaaaagctccccttcatctacggcaatctgtctcagggtatggtgtcagagcctctggaagacgtagacccatattattacaagaaaaagaacaccttcattgtattaaacaagaaccggacgatcttcaggttcaatgcagcttctatcttgtgcaccctgtctccctttaactgcattaggcgcaccactataaaggtcctggtgcatccatttttccaactcttcattctaatctccgtactgattgactgtgtctttatgtcactcaccaacttaccaaagtggaggcccgtgctggaaaatacactgctcgggatctatacattcgagatcctcgttaaactgtttgcccggggcgtctgggctggtagctttagcttccttggggatccttggaactggctggacttctccgttaccgtatttgaggtgattatacgctactccccactggatttcatccccaccctgcaaacggcccgcacactgaggatcctcaaaataatcccactgaaccagggacttaaatccttggtaggggtgttgattcattgtctcaagcagcttattggggtcatcattcttacgctctttttcttgtctattttcagccttatcggcatgggcctatttatgggaaacctgaagcataagtgcttccgttggccccaggaaaatgaaaatgaaacgttgcataatcggaccggtaacccttactatataagggaaactgagaatttctactatctggagggggagagatatgcccttctctgtgggaatcggactgacgcgggccaatgtccagaaggttacgtttgcgtgaaggctggaatcaaccctgatcagggtttcacgaacttcgacagtttcggctgggccctgtttgcgctgtttcgacttatggcccaagattatcccgaagtactctaccatcagatcctgtacgctagcggcaaagtgtacatgattttttttgtcgtcgtttccttcttgtttagtttttacatggcctccctcttcctcgggatcctggcgatggcctatgaagaagagaaacagtag

SEQ ID NO: 205521 - DNA, 5871 bp, Artificial Sequence
  Description of Artificial Sequence: Synthetic coding sequence
atggagttccccatcggcagcctggagaccaacaacttccggcggtttactccagagagtctggtggaaatcgaaaaacagatcgctgccaagcagggaactaagaaggcacgcgagaaacatcgggaacagaaggatcaggaagagaaaccgcggccgcagctggaccttaaggcttgcaaccagctacctaaattctacggtgagctgccggctgagctcatcggagagccgcttgaagacttggatcccttctacagcactcacaggacctttatggtcctgaacaagggaaggacaatcagcaggttctccgcaacccgggccttgtggttatttagcccctttaacctaattagaaggacagccataaaggtgagcgtccattcttggttctcattgttcatcactgtcacaatcctggtgaactgtgtttgcatgacacggacagatttgcccgaaaaaatcgagtatgtctttacagtaatttataccttcgaagccctaatcaagatactagcacgtggattctgcttgaacgaatttacctacctaagggacccttggaactggcttgacttctccgtcattactttagcgtatgtcggaaccgctatcgatctacgtgggatttcagggctcaggaccttcagagtgctcagagctctgaagactgtgtccgtgattcccggcctgaaggtcatcgtgggtgccctcattcatagcgttaagaagttagccgacgtgacaatcctcacgattttctgcctatctgtttttgcattggtaggcctacagttatttaagggaaatcttaaaaacaagtgtgtgaagaacgatatggctgttaatgaaacaaccaattacagcagccacaggaagccagacatatacattaacaagcgcggtacctccgatccgctgctgtgtggaaatggatcagactctggccactgtcctgacggctacatctgtctgaagacgagtgacaatcctgacttcaactacacctcttttgatagttttgcttgggcttttcttagtctcttccggctcatgacccaggactcatgggagcggctctaccagcagactcttcgcactagtgggaaaatttacatgatcttcttcgtcctggttattttcctagggagcttttatctagtgaacttgattctggccgtggtgaccatggcatacgaagaacaaaatcaagctaccaccgatgagatcgaggcaaaagaaaagaagtttcaggaggcactagaaatgctcaggaaggaacaggaagtgcttgccgctttggggattgacaccacgtcgctccatagtcacaatggatctccgctgacttcgaagaacgcaagtgaaagaaggcatcggatcaagccccgggtctctgaaggctctacggaggataacaagtcccctcggagcgatccctacaaccagcgccgcatgtccttcttggggctcgccagtggcaagcgaagggcctcccacggctccgtgttccacttccgaagtcccggccgagatatttcactgccggaaggagtgactgacgatggcgtgttccctggtgaccacgagtctcataggggctcactactgctcggagggggcgccggacagcagggccccctgccacgcagcccgcttccacaaccttccaatcccgacagccgccacggagaggacgagcaccagcctccccctactagcgagttggcaccgggcgcggtggatgtgagcgcttttgacgccgggcagaagaaaactttcctctccgcagagtaccttgacgagccatttcgcgcccagcgggccatgtctgttgtttctattatcaccagcgtacttgaagaattggaagagtccgaacaaaagtgccctccttgcttaacctcacttagtcagaagtatttgatttgggattgctgtccaatgtgggtgaagctcaagactatactgttcggactggttaccgatccctttgctgagttgactataaccctgtgtattgtggtgaataccatctttatggccatggagcatcatggaatgtcacccaccttcgaggccatgctccagatagggaatatcgttttcactatcttctttaccgcagagatggtttttaaaataatcgccttcgatccatactactactttcagaaaaagtggaatattttcgactgtattattgtgaccgtgagtctgctcgaacttggagttgccaagaagggctccttgagtgtgcttcgaagctttcgtttgctcagggtgttcaagctcgccaagtcttggcctacattgaacacactcatcaagataatcggcaatagcgttggggcccttggaaacctgacaattattctggctattatagtgtttgtcttcgcactggtcgggaaacagctgctgggcgagaactacagaaacaatcggaagaacataagtgctcctcacgaagactggccgaggtggcatatgcacgactttttccattcctttttgatcgtgttccgtatactatgtggcgaatggattgaaaatatgtgggcctgtatggaggtcgggcagaaaagtatctgtttgatcctctttttgactgttatggtcttgggtaatctggtggtgttgaacctgtttattgcactcctgctaaattctttttcggccgataatcttaccgctcccgaggacgacggcgaagttaacaacctgcaggtagccttggcccgcatccaagtcttcggccataggaccaagcaggccctctgctccttcttctcccgctcctgccctttcccccaacctaaagccgagcccgaactcgtcgtaaagctccccctttccagcagcaaggctgagaaccacatcgcggcaaacactgcccgcgggtcttcagggggattgcaggctccccgcggacctagagatgaacattcggactttatcgctaatcctacggtttgggtgagtgtgcctatcgcagaaggtgagtctgatctcgatgacctggaggatgatggaggagaggacgcccagtcatttcaacaggaggtgattcctaaaggacaacaagagcagctgcagcaggtagagaggtgtggagaccacctgacaccgagaagcccgggaaccggaacaagctctgaagacctcgctcccagtcttggggaaacttggaaggacgagtctgtcccacaagtgcccgccgagggcgtggacgacacttcttcttccgagggttctactgtggactgtctggacccagaggagatactgaggaagatccctgagttggcagacgacctagaggaacctgatgattgttttactgaggggtgtatcagacattgcccctgttgcaaactcgacactacaaagtctccatgggatgtaggatggcaggtgcgaaaaacttgctatcgcattgtggagcatagctggttcgaaagcttcattatcttcatgattctgctgtcaagcggcagcctagcctttgaggactactacctagatcagaagcctaccgtgaaagcattgctggagtatactgatagagtgttcacctttatctttgtgtttgaaatgctgttgaagtgggtggcatacgggtttaaaaagtactttaccaacgcctggtgttggctcgattttctcatcgttaacatttcactcatctccctaacagccaagattctagagtattctgaagtggcacctatcaaggccctaagaacattacgtgctttgcgcccactgagggccttgtcaaggttcgagggtatgagggtcgtagtagatgctctggtgggtgcgattccgtccatcatgaatgtgctgcttgtctgtcttatcttctggctcatcttcagcatcatgggagtcaacctgttcgccggcaagttctggagatgcataaactacaccgacggggagttttcattagtgcccctgtccatcgtaaataataagtcggactgtaaaatccagaattccaccggctcttttttttgggtcaacgtgaaagtgaactttgacaacgttgcgatgggctacctggccctgcttcaggtcgctacattcaagggttggatggatattatgtatgctgccgtggattccagggaagtgaacatgcaacccaaatgggaagacaacgtttacatgtatctatacttcgtcattttcatcatctttgggggattttttacccttaacctgtttgtgggggtgataattgacaatttcaatcagcaaaaaaagaagttggggggacaggatatctttatgacagaggagcagaagaaatactacaatgctatgaagaagctgggatccaagaagccacagaaacctatccctagacccttgaataagtttcagggcttcgtcttcgacattgtgacacgccaggccttcgatataacaattatggtcctgatctgcttgaacatgatcacgatgatggttgagacggacgatcagagcgaagagaagaccaagatcctcggcaagattaaccaatttttcgtggcagtgttcaccggggaatgtgtgatgaagatgtttgccctgcgccagtattacttcacaaacggatggaacgtgttcgacttcattgttgtggttctcagcatagcaagcctgatctttagcgccatcctgaagagcctacagagttatttttcccctacgcttttcagggtcatcaggttggctcgtattgggcgaattctgagactgatcagagccgccaaggggatccggacgctcttattcgccctaatgatgtccctgcctgccttattcaacatcggtttgctgttgttcctagtcatgttcatttatagcatctttggcatgagttcttttcctcacgtccgatgggaagccggcattgacgatatgttcaacttccagacattcgccaattcaatgctctgtctttttcagatcaccaccagtgcgggatgggacggactgctcagtcccattctgaacaccggaccaccctactgcgatccaaatctcccaaatagcaacggaaccaggggcgattgcggctctccagcagttggaatcattttcttcactacatatataatcatttcgttcttgattatggtgaatatgtatatcgcggtcattttagagaacttcaatgttgccaccgaagagtcaacagagcccttatctgaagatgactttgatatgttctacgagacttgggaaaaattcgatcccgaagctacacagttcattacatttagcgccttgagtgacttcgcagacacacttagcgggcctctgcgcattcccaagccgaacagaaatattctgattcagatggatctgcctcttgtgcccggtgacaagatacactgtcttgacatactgtttgctttcaccaagaacgttctgggtgagtcgggtgaactggactctctaaaggcgaatatggaggaaaaatttatggccaccaacctatcgaaatcaagttacgagcccatcgcgaccactcttcgctggaagcaagaggacatctccgccactgtcattcaaaaagcctaccggtcttacgtgctgcacaggagcatggcactttctaacaccccttgtgtccctcgagcggaagaggaggccgctagtctaccagatgaagggttcgtggctttcacggccaatgagaactgcgtactacccgacaagtccgagacagcaagtgctacatcattccccccctcatatgaatcagtgaccagggggctcagcgacagagttaatatgcggactagtagttcgatccagaatgaggacgaggcaacttcaatggaactcattgccccaggtccttag

SEQ ID NO: 205522 - DNA, 5376 bp, Artificial Sequence
  Description of Artificial Sequence: Synthetic coding sequence
atggacgaccggtgctaccccgtgatcttccccgacgagcggaacttcagacccttcaccagtgacagcctggccgctatcgaaaaacgaatcgccatccaaaaggaaaagaagaaatctaaagaccagactggggaggtgcctcagccccgcccccagctggacctaaaagcgagccggaagctgcccaagttgtacggtgatatcccacgggaacttatcggcaagcccttagaagacttggaccccttctataggaaccacaagacattcatggtcttgaacaggaagcgcaccatctacagattctcggccaagcatgcgctgttcattttcggaccattcaatagcattcgctccctcgcaatccgcgtgtccgtgcactcactgttttctatgttcataatcgggaccgtgatcattaattgtgtgttcatggccactggccctgccaagaattccaatagtaacaacacggacattgcagagtgtgtctttaccggcatctatatttttgaagcccttataaaaatcctggccagaggcttcatactcgacgagtttagctttctcagagacccatggaattggctggattccatcgtaatcgggatagctattgtgtcttatatcccgggaattaccatcaagctgctgccactccgcacatttagggtattcagagcccttaaagctatctctgtggtgagccgtctgaaagtaatagtgggcgcccttctgcggtccgttaaaaaactcgtaaacgtgatcatactgacgtttttttgtctgagcatattcgcgttggtgggccagcagctctttatgggttccttgaacctcaagtgtatttcgcgggactgtaagaatatctccaaccccgaggcttatgatcactgtttcgagaagaaggaaaacagtcccgagtttaagatgtgcggaatatggatgggcaactccgcctgctcaattcagtatgagtgcaagcacacaaaaatcaaccctgattataattacaccaacttcgataatttcgggtggtcttttctcgcaatgttccgcctcatgacacaagacagctgggagaagctctatcaacaaaccctgcggactacaggattatattctgtgttctttttcattgtagtcatatttctgggttctttctacctgatcaatcttaccctcgccgtggtgacaatggcttacgaggagcagaacaaaaacgtggcagccgagatagaggcaaaagaaaaaatgttccaggaggcacagcagctcctgaaggaagaaaaagaagcgttggtggcaatgggtatagatagaagctctcttacatccctggagacgagctactttactccgaagaaacgaaagcttttcggaaataaaaaaagaaaatccttttttctcagggagtcgggcaaagaccaacccccgggatccgatagtgacgaagactgccagaaaaaaccccagctcttggagcaaacaaaaagactgtcccagaacctcagcctggaccactttgacgagcatggggatcctttgcaacggcaaagggccttatccgctgtctccatactgaccatcaccatgaaggagcaggagaaaagccaggagccatgcctcccctgcggcgagaatctggccagcaagtacctggtctggaactgttgccctcaatggctgtgcgtgaaaaaggtgttgagaacagtgatgactgatcccttcaccgaacttgccatcacaatctgcatcatcataaacaccgtgtttctggcgatggagcaccataagatggaagcatcattcgaaaagatgctgaatatcgggaaccttgttttcacctcaatctttatcgcagaaatgtgtctgaaaattatagcgttggacccttatcactactttcggaggggatggaatatattcgattctattgtcgccctactcagctttgcggacgtaatgaactgtgtgctgcaaaagaggagctggccatttctgcgaagcttcagagtcttgcgagttttcaaactagccaaaagctggcctaccctgaatacactcataaaaatcatcggcaactcagtgggggccctgggatcactcacagtagtgctggtaattgtaatctttatttttagcgtggtcggcatgcagttgttcggccgttcatttaacagccaaaaaagccccaaactctgcaatcccaccggacccactgtgtcctgtctgagacactggcacatgggagacttttggcattcgttcctggtggtgttccggatcctgtgtggggagtggatagagaacatgtgggagtgcatgcaggaagcaaacgccagtagttccttatgcgttatcgtctttatcctgatcacagtgatagggaaactggtcgtccttaatctcttcattgcattgcttctaaatagctttagcaatgaggagaggaacgggaatttggagggcgaggcccgcaaaaccaaagtgcagctggccctcgacaggttcaggagggcattttgcttcgttcgacatactttagagcacttttgccacaaatggtgcaggaaacagaaccttcctcagcagaaggaagttgcaggggggtgcgctgcgcagagcaaagacatcatacctcttgtgatggagatgaaaaggggaagcgagactcaggaagaacttggcattctcacatccgtgccaaagacgttaggcgtacgtcacgattggacctggctggctcctctcgctgaagaggaagatgatgtcgaattctccggcgaagataacgcccagcgaatcacccagcccgagcccgagcagcaagcctatgagctccatcaggagaataagaagcccactagccagcgcgtccagtctgtggagatagatatgtttagcgaggacgagccacatctgacaatccaggatccccgcaagaagtctgacgttaccagtattctcagcgaatgctccacaatcgatctgcaggatggatttggatggctgcctgaaatggtgcctaagaaacagcccgaacggtgcttgccaaaggggtttggctgttgttttccatgttgtagtgtggataagcggaaacccccctgggtaatctggtggaatttgcggaagacctgttaccagatagtcaagcactcttggttcgagtctttcattatttttgtgattttgctctccagcggggccctcatttttgaagacgtccacctggagaaccaacccaagatccaggaacttctgaactgcacagacattattttcacccacatctttatccttgagatggtgcttaagtgggttgcattcggcttcggtaagtacttcacaagtgcatggtgctgtctggattttatcatagtcatcgtgagtgtcactaccctgattaaccttatggagctgaagagtttccggactctgagagccctgcgcccacttcgggctcttagccaatttgagggtatgaaggtggtggtgaacgctttgatcggcgctattcctgccatcttaaatgtgctgctcgtctgtctgattttttggctcgttttttgtattttgggggtttatttcttcagcgggaagttcggcaagtgtattaatggcactgatagcgtgattaattatactatcatcacaaacaaaagtcagtgtgagagcgggaatttctcctggataaaccaaaaagtcaacttcgacaatgtggggaatgcatatctcgcccttcttcaggtggcgacttttaaagggtggatggacataatctacgccgccgtagattctacagagaaagaacagcaacctgagttcgagagcaatagcctgggctacatctattttgtggtgtttatcatttttggatctttctttacattgaatctgttcataggggtgattatagataactttaaccagcagcagaagaagctaggaggccaagatattttcatgacggaagagcagaagaagtactacaatgccatgaagaaactcggatctaaaaaaccccagaaacctattcccagacctttaaataagtgccagggcctggtttttgatatcgtgacctctcagattttcgatatcatcataattagtctgattatactgaacatgatttctatgatggccgaaagctacaatcaaccgaaagcgatgaagtcaattctcgatcacctgaattgggtgttcgttgtgattttcaccctggagtgtcttatcaaaatttttgccctgagacagtattacttcacaaatggctggaacctctttgattgcgttgtcgtccttttatctattgtgtccacaatgatttcaactctggagaatcaggagcacatccccttccctccgaccttgttcaggatcgtgagactggcaaggatcggccgcatactgcggctcgttagggcagcccgaggcattcggaccctgttgtttgcgctcatgatgagtctgccttcattgtttaatattggcctgctgctgtttctgatcatgtttatatatgcaattctaggtatgaattggttcagcaaagtcaaccctgagtctggcatcgatgatatcttcaatttcaagacattcgcttccagcatgctttgtctgttccaaatctccacatctgctggatgggactctctcttgtcaccgatgctcagaagtaaggagtcctgtaactcatcctctgagaactgtcacctgcctggaatcgccacgtcttacttcgtctcctacatcatcatcagctttttaatcgttgtgaacatgtatatcgccgtcatactggagaacttcaacaccgctacagaggagtcagaggacccactgggcgaagacgactttgacattttttatgaggtctgggagaaattcgaccccgaagccacccagtttataaagtattccgctttgtctgactttgccgacgctttaccggagccgctgagagtggcgaaacccaacaaataccagttcctcgttatggacctgcccatggtgagtgaagaccggcttcattgcatggacatcttgtttgcattcaccgctagagtccttgggggatctgacggactcgattctatgaaagctatgatggaggagaagttcatggaagcgaacccattgaagaaactttacgaacccattgtcactaccacaaaacgcaaagaggaggagaggggggcagccatcattcaaaaagctttccgcaagtatatgatgaaggtcactaagggggaccagggagatcagaatgatctcgaaaatggacctcacagcccgctgcagactctgtgcaatggcgacctgtcttctttcggtgtagctaagggtaaggttcactgcgactag

SEQ ID NO: 205523 - DNA, 4335 bp, Artificial Sequence
  Description of Artificial Sequence: Synthetic coding sequence
atggacgaccggtgctaccccgtgatcttccccgacgagcggaacttcaggccctttacgtcagactctctcgctgcaatcgaaaaacggattgcaatccagaaggaaaaaaagaagtccaaggaccaaaccggcgaagtgccccagccacgccctcaactcgacctgaaggcaagtaggaagctgccaaagctgtacggagacattccacgcgagctaattggtaagcccctggaagacctcgatcccttctataggaaccataaaacttttatggttctgaatagaaagcgtacaatttataggttctccgctaaacacgctctgttcatatttggcccgttcaacagcattaggtctttggcgattagggtgtccgtccactctctgttcagtatgttcatcatagggaccgtcatcattaactgtgtctttatggccacaggcccggctaaaaatagtaattcaaataataccgacattgcagagtgtgtcttcaccggtatctacattttcgaggccctcatcaagatcttagctcgtggcttcatcctcgatgagtttagcttcctgagggatccttggaattggctggactccatcgtcattggaattgctatcgtttcttatatccccgggattacaatcaaattactgccacttagaacttttcgcgtattccgggccttaaaggcaattagcgtggtctccaggcttaaggtgattgtgggtgcgttgctgcgatctgtcaaaaaattagtgaacgtgattatcttgacatttttttgcctttcaattttcgctctggttggacagcaacttttcatgggctccttgaacttaaaatgtatatctcgcgactgtaaaaatatatccaatcctgaggcttacgatcactgtttcgagaagaaagaaaattcacctgaattcaaaatgtgcggaatttggatgggtaatagcgcatgcagtatccagtatgagtgcaaacataccaaaattaaccccgactacaactacaccaatttcgacaacttcggctggtcttttctcgcaatgttccgcctgatgacccaagatagctgggaaaagttgtaccagcagaccctccggaccacaggcctgtactccgtgttcttttttatcgtggtaatcttcttgggcagcttttacctgattaatctgactcttgctgtggtcacaatggcatacgaagagcagaataaaaatgtcgccgccgagatcgaggctaaggaaaagatgtttcaggaggcccagcagctgctgaaagaggagaaagaggccctcgtcgccatgggcatcgatcgctcctctctaacaagcctggagacatcatattttacgcctaagaagagaaaattatttggaaacaaaaagagaaagtctttttttctacgcgagtccggcaaggaccagcctcctggcagtgatagcgatgaagattgtcagaaaaagccccagcttttggaacagaccaagcgattgtcacaaaacctgtccttggaccacttcgatgaacatggggatccattgcagagacagagggccctgagtgcagtttctatcctcacgattaccatgaaggagcaggaaaagtcgcaggagccttgtctgccatgcggagagaatctagcttcaaagtatctggtatggaactgctgcccgcagtggttatgtgtcaagaaggtgcttcgcaccgtgatgacagaccctttcaccgagttggctattacaatctgtatcattataaatactgtgtttctggccatggaacaccataagatggaggcctcatttgagaaaatgcttaacatcgggaatctcgtgttcacaagtatctttatagccgagatgtgcctgaagattatcgctctggacccttatcattacttcaggcgcggctggaatattttcgacagtattgtggccctgctttcgtttgcggacgtgatgaactgtgtactgcagaagagaagttggccctttctgagatcttttcgtgtactgcgtgtctttaagttggctaagagttggccgacactcaacacacttatcaaaatcatcgggaacagcgtaggggcattgggtagcctgactgtggttcttgtgatcgtgatatttatcttttctgttgtaggaatgcagctgttcggcaggtccttcaactctcagaaaagccccaaattatgtaaccctacaggacccactgttagctgcctgcggcactggcacatgggggacttctggcacagtttccttgtggtttttcgtattctctgcggcgagtggatcgaaaacatgtgggagtgcatgcaggaggcgaatgctagcagcagcctgtgcgtcatagtgtttatcctgatcactgtgattgggaaattggttgtcctcaacttgtttatagcacttctgttgaactctttctcgaacgaagagcgaaatggcaacctagagggtgaagcaagaaaaacgaaagtgcagcttgcgctggatcgcttcagacgcgcgttctgcttcgtgagacacaccttagagcatttctgccataagtggtgtcgaaagcagaatctgccacagcagaaagaggtggcaggaggatgtgccgcacagagtaaggatattatcccactggttatggagatgaaacgaggatccgagacccaggaagaacttggaatactgacctctgtcccaaagacactcggcgtgaggcacgattggacgtggctagcccccctggctgaagaggaggatgatgttgaatttagtggtgaggataacgcacagaggatcacacagcccgaaccagaacagcaggcctatgaactgcatcaggagaacaagaagcctacatcccagagggttcagtccgtggaaattgacatgtttagtgaagatgagccacatttgaccattcaggacccaagaaaaaaatcggatgtgacctccattctgagtgagtgctcgacaattgacttgcaggatggcttcgggtggctgcctgaaatggtgcctaagaagcagcctgaacgttgccttcctaaaggattcggatgttgctttccttgctgcagtgtggacaagagaaaacctccttgggtgatttggtggaacctacggaagacgtgttatcagatcgtgaagcattcttggtttgaatctttcattatcttcgtgatccttctgtctagtggtgccttaatttttgaggatgtgcacctggaaaaccaaccgaaaatccaggagctcctgaattgcactgatattatctttactcatatttttatcttggaaatggtattaaagtgggtagcttttgggttcggcaaatacttcacctcagcctggtgctgtctggactttattatagtgattgtgagcgtgaccaccttgattaacctgatggagctgaagtctttccgtactctacgcgccttgcggcccctgagggccttatcccagtttgagggtatgaaggttgtggtgaatgccctaattggggcaattcctgctatactaaacgttcttcttgtctgcctgattttttggttggtgttctgcatcctgggtgtgtactttttttctggcaagtttggtaaatgtataaatggaactgacagcgtgatcaactacaccatcattacgaacaaaagccaatgtgagagcggaaattttagttggatcaaccagaaggtgaatttcgacaatgtaggcaatgcctacctggccctgttgcaagtcgcaaccttcaaagggtggatggatattatctacgcagccgtggatagcacagagaaggagcaacagccagagttcgagtcaaattccctcggctatatctattttgtggtttttattatatttgggtcattttttacgcttaacctgtttatcggggtgattattgataattttaatcaacagcagaagaaactgggggggcaagacatctttatgacagaagagcagaaaaagtactacaacgccatgaaaaagttaggctccaagaaacctcagaaacccatccctaggccactgaataagtgtcaggggctggtcttcgacattgttacctcgcagatcttcgacattataatcatctctttaataatcctcaacatgattagtatgatggccgagtcctacaaccagccaaaggccatgaagagcatcctggaccatctaaattgggtgtttgtagtcatattcacgctcgaatgccttatcaaaatcttcgccctgcgacagtattacttcaccaatggctggaatcttttcgattgcgtggtggtgctgctgtccattgtctcaaagtag

SEQ ID NO: 205524 - DNA, 5376 bp, Artificial Sequence
  Description of Artificial Sequence: Synthetic coding sequence
atggacgaccggtgctaccccgtgatcttccccgacgagcggaactttaggccgtttacttcggacagtcttgctgctattgagaaacgcatcgcaatacaaaaagagaagaagaaaagcaaggaccaaaccggcgaggtccctcagcctcggcctcagctggaccttaaggccagcagaaaactgcccaagctctatggtgatatcccacgcgaactgattggcaaaccgttggaggacctggaccccttctatcgcaatcataagacgtttatggtcctgaatcgaaagcgtaccatctacagattctcagccaagcatgctctgtttatctttggaccctttaattcaatacggagtcttgctatccgcgtgtccgtgcactcccttttcagcatgttcataataggcactgtcatcatcaactgtgtgttcatggccactggtcccgctaaaaattcaaattccaacaataccgacatagcagagtgtgtgttcactgggatatatattttcgaagcactgataaaaatcctagcgagggggtttatcttggacgaatttagcttcctccgagacccatggaactggctggattccatcgtcatcggtattgctatcgtgtcctatatcccaggcataaccattaaactcctccccttgcggactttcagagtcttccgggccttgaaggcaatatccgtggtttcccgcctcaaagtaatagtcggcgcactgttaaggagtgtcaaaaagcttgtaaatgtcataatcttaacctttttctgcctaagcatctttgcgttggtggggcagcagctgtttatgggatcacttaatttaaaatgtataagccgggactgcaagaatatctctaacccagaggcctacgaccactgctttgagaagaaggagaacagtcccgagtttaaaatgtgtggaatctggatgggcaattccgcctgcagtatccagtacgagtgtaaacacacaaagattaatcccgattataattataccaattttgataatttcggctggtccttcctggccatgtttcgactcatgacccaggatagttgggagaagctgtatcagcagaccctgcggaccactgggctgtattctgtatttttctttatcgtggttatattcctgggcagcttttatctcatcaacttgactcttgctgtcgtaacaatggcgtatgaggaacagaataagaatgtggccgcggagatcgaggccaaggagaagatgtttcaggaggcccagcaactcctcaaggaagagaaagaggctcttgttgccatgggcatagacaggtcatctctgacttccttggagacaagctacttcacgcccaagaagagaaagctgttcggaaacaagaagcgtaaatcctttttcctgcgggaaagcggcaaggatcagcccccagggtctgatagtgacgaggactgtcaaaagaagcctcaactactcgagcaaacgaaaagactgtcacagaacctttccctcgatcacttcgacgaacacggggatcctctgcagaggcaacgggcgctgtccgcagtgagcattctgaccattactatgaaagaacaggagaagagccaggaaccttgcttgccgtgtggggagaacctggcatcaaagtacctcgtctggaattgttgtccccaatggctgtgcgtcaaaaaggtgctgcggacggtcatgacagatccttttacggagctcgcaattacaatctgtattattatcaacaccgtcttcttggctatggagcaccacaaaatggaagcctctttcgaaaagatgctgaatattggtaatctagtgttcaccagtattttcattgctgaaatgtgcttgaaaataatcgcactcgatccctaccattattttagacgtggctggaatatattcgactcaatcgttgcgctgttgagtttcgccgacgtgatgaactgtgtcctgcagaagcggtcttggccattcttgagaagcttccgagtccttcgagtttttaagttagccaaatcatggcctactcttaataccctgatcaaaatcatcggtaacagtgttggcgctctaggttcattgacagtcgtcctggttatcgtgatctttatctttagtgtggtgggcatgcagctatttggacggtcgttcaattctcaaaagtccccgaaactctgcaacccaactggccctaccgtcagttgtcttcggcactggcacatgggagatttctggcatagcttcttggtggtgttccgcattctgtgtggagagtggatcgagaacatgtgggagtgtatgcaggaggccaacgctagctcctctttgtgcgttattgtctttatcctgatcactgttatcggaaagctggtggtgctgaatctgttcatcgctctcctcttgaacagtttctctaacgaagaacggaacggtaacttggagggtgaggctcgaaagaccaaagtccagttagctctagaccggtttcggcgcgctttttgttttgtgaggcataccctggaacatttttgccacaagtggtgtcgaaagcagaacctgcctcagcagaaagaggtggcagggggatgcgccgcccagagtaaggatatcatcccccttgtgatggaaatgaaacggggcagtgagacccaggaggagttagggatcttgacctccgtgccgaagactctgggcgtgcggcacgactggacatggcttgccccacttgccgaggaagaagatgatgtcgagttttctggggaggataatgcccagaggatcacgcaaccagagcctgaacagcaagcctacgagctgcatcaggagaataaaaaacctaccagtcagagggtccaaagcgttgagattgatatgttcagtgaagatgagcctcatttgaccatccaagatcctaggaagaagtccgacgtaacatccatactgagcgaatgctccaccattgacctgcaagacggcttcggctggctgcccgagatggtgccaaaaaaacagcccgagcgctgccttcctaagggattcggctgttgtttcccatgttgctcggtcgataaacgcaaacctccgtgggtgatttggtggaacttacgtaagacatgttatcagatcgttaagcacagttggttcgaatccttcattattttcgtcatcctgctgtcgtctggcgcgcttatattcgaggacgttcatctggaaaatcagccgaaaattcaggaactcctcaactgcacagacataattttcactcatatattcatcctggagatggtgctaaagtgggttgcatttggtttcggtaagtatttcacctccgcgtggtgttgtctcgacttcatcatagtgattgtgtccgtgaccacccttatcaatctgatggaactgaagtccttccgaacccttcgcgccttacgtccgcttagagcgctgtctcagtttgaagggatgaaagtcgtggtaaacgcgctgatcggggctattccagccatcttgaatgtgctgctggtttgtctaatcttttggctggtcttctgtattcttggcgtgtacttcttctctggtaaattcggcaaatgtataaatggaaccgacagcgtgatcaattacacaatcatcactaacaagagccagtgcgagtccggcaatttctcttggattaatcagaaggtgaatttcgataatgtcggaaacgcatatctggctctcctgcaagtggccacgttcaaggggtggatggatataatttatgctgccgttgactctacagagaaggaacaacagccagaattcgagagcaattccctaggctatatttactttgtggtcttcatcatcttcgggtcattcttcaccctgaacttgtttattggcgtcatcatagacaacttcaatcagcagcagaagaaactcggcggtcaagacatatttatgaccgaagaacagaaaaagtactacaacgccatgaaaaaactcggctccaaaaagccacaaaaacccattcctcgccccctaaacaaatgtcaggggctcgtgttcgatattgtaacctcacagatattcgatattattatcatctctctgattatattgaatatgatttctatgatggccgagagttacaaccaacccaaggcaatgaaaagcattctggaccacctgaactgggtgtttgtggtgatttttacattggagtgccttattaagatcttcgcccttcggcagtattatttcacgaacggttggaatttgttcgattgtgtggtggtcctgctgtctatagtgtcaaccatgatcagtaccctggaaaaccaagagcacattccatttccccccactttgttccgcatcgttagactggctcggatcgggaggattctgagactggtccgagccgcacggggcatccgtacactcttgtttgcccttatgatgagcctgcctagcctctttaacatcggactgttgctctttctgattatgttcatttacgccattcttggcatgaactggttctcaaaagtcaaccccgaatccggaattgatgacattttcaactttaagacattcgcctctagcatgttgtgtttattccaaatctcaactagtgcaggctgggatagcctcctctcaccaatgctgcggtcaaaggagagctgcaactctagttctgagaattgccacttgcctggcattgccaccagctattttgtgtcctacatcattataagcttccttatcgtggtgaatatgtacattgctgtgatcctggagaacttcaacacggcaaccgaggagagtgaagaccccctaggggaagacgattttgacattttctatgaggtctgggaaaagttcgacccagaagcaactcaattcataaaatactcagccttgagcgattttgctgatgcgcttcccgagcccctgcgcgtggctaaaccgaataagtatcagttcctggtcatggatctgcctatggtcagcgaagaccgcctgcactgtatggacattctgtttgcatttaccgctcgagtgctcggaggaagcgacgggctggacagcatgaaggctatgatggaagagaagttcatggaggccaatcctctgaaaaaactctacgagcccattgttacgaccactaagaggaaagaagaggagagaggcgctgcaatcatacagaaagcctttagaaagtatatgatgaaggtgacaaaaggagaccagggcgaccagaacgatttggaaaacggccctcattccccccttcaaaccttgtgcaatggcgacttatcatcatttggagtagctaaaggtaaagtgcactgcgactag

SEQ ID NO: 205525 - DNA, 5217 bp, Artificial Sequence
  Description of Artificial Sequence: Synthetic coding sequence
atgctgaagcggaagcagagcagccgggtggaggcccagcccgtgacagatttcgggccagacgaatcactgagcgacaatgccgacattctgtggatcaataaaccttgggtacatagcttgctgcgcatttgtgccatcatttcggttatctccgtttgcatgaataccccaatgacttttgaacattacccaccattgcagtatgtcacatttacactggataccctgctgatgttcctctatacggctgaaatgatcgctaaaatgcatatcagaggaattgtgaaaggcgacagttcttacgtcaaggaccgctggtgtgtgttcgatgggttcatggtgttttgtctttgggtatcccttgtgctccaggtttttgagattgccgacatcgtggaccaaatgtcgccatggggcatgttgaggattccccggccgctgattatgatcagggcctttcggatatactttcgctttgagctgccccgcacccgcatcactaacattctaaagaggtcaggagaacagatctggtctgtgagtatcttcttgctgttctttctgctcctgtacgggattctcggcgtgcagatgttcggcactttcacatatcactgtgttgtgaatgatacaaaacctggtaacgtgacttggaatagtttggccatccctgacacccattgcagtccagagcttgaggaaggctaccagtgcccaccaggatttaaatgtatggatttggaggatctgggcctgtcccggcaggagctgggctatagcggctttaacgagatcggcactagcatctttactgtctacgaagctgcctcacaggaggggtgggtgttcctgatgtatcgcgcaattgactcttttccgcggtggagaagttatttttactttataaccctcatatttttcctagcttggttggtgaaaaacgtattcatcgcagtcataatcgaaacctttgcggagatccgtgtccagttccagcaaatgtggggcagccggtcttccaccacaagcacagccaccacccagatgtttcacgaagacgctgccggaggctggcagcttgtcgctgtggatgtgaataagccccagggaagagctcccgcctgtcttcagaaaatgatgcgatcttctgtcttccacatgttcatactgtccatggtgacagtagacgttatagtcgccgcctcaaactactacaaaggcgagaactttaggaggcagtacgacgagttttacctcgcagaggtggcttttacagtgttattcgatctcgaggccctgttgaaaatctggtgtttgggattcacgggttacatttcctcatccctccataagtttgagcttctgctcgtgatcggcactacactccacgtttacccggatctataccatagccagttcacttacttccaggtcctgcgtgtggtgaggctaatcaagatctctccagctctagaggacttcgtgtacaagattttcggccccggtaagaagttgggttcactggttgtgttcactgcctccctgttaatcgtaatgtcagcgatctctctccaaatgttctgtttcgtagaggaacttgataggttcactacattccctcgggcatttatgtcaatgttccagattctcacgcaggaaggctgggtggatgtgatggaccagactctgaatgctgtgggccatatgtgggccccagtggtggctatttacttcattctgtaccacctgtttgccaccttgattttgctctcgctgttcgtggctgtgattctggacaacctcgaactcgacgaagatttgaagaagctcaagcaactcaaacagtcagaagccaacgctgacactaaagaaaaactgcctctccgtttgagaatatttgagaagtttcccaacagacctcagatggttaagattagtaagctgcctagcgattttacagtgcccaaaatccgcgaaagtttcatgaagcagtttatagaccgccagcagcaggacacctgctgtctcctccgctcacttcctacaacttccagttcatcctgcgatcactccaagcgttctgctatagaggacaacaaatatattgaccagaaacttcgaaagtctgtgttttctatccgggctaggaatctgcttgaaaaagaaacggcagtgacaaagatactcagagcttgcacaaggcagagaatgctgtcaggctcattcgaagggcagccagccaaagaacgctctatactcagtgtgcagcaccacattcgtcaggagagacgctctctaaggcacggtagtaactcccagcggatttcacggggcaaatctctagaaacgctcacccaggaccacagtaacactgtccgatataggaacgcccagcgggaagatagcgagattaaaatgattcaggaaaagaaagagcaagccgagatgaaacggaaggttcaggaagaagaacttcgcgaaaaccacccatactttgataaacctctctttatcgtcggccgagagcaccgcttccgcaatttttgcagggttgtcgtaagagctcggttcaacgcttccaagactgacccagtgacaggcgcagtcaagaataccaagtatcaccaactgtacgacctgttgggtctagtgacatatctggactgggtcatgatcatcgtcacaatatgctcgtgcatttccatgatgtttgagtcaccttttcggcgggtgatgcacgcccccacccttcagattgcagaatacgtctttgtaatcttcatgtcaattgagctgaacctgaaaataatggccgacggccttttcttcaccccaacggcggtgattcgggattttggtggggtcatggacatctttatctatttggtgtccctgatctttctttgctggatgcctcagaacgtccccgcggaatctggggctcagttactcatggtcttgagatgcctgcgtcctctgcgcatcttcaagctcgtgccacagatgcgaaaggtggtgagagaactgtttagcggctttaaagagattttcctcgttagtatattgctcctgacccttatgctcgtcttcgcctcttttggagtgcagctcttcgcaggcaaacttgctaagtgcaacgatccaaacattatcagacgggaagactgcaatggcattttcagaatcaatgtctcagtctcgaagaatctgaaccttaagcttagacccggagaaaagaaacccggtttttgggtaccccgcgtgtgggcaaatcccagaaattttaactttgataatgtgggaaacgcaatgttagctctgtttgaggtgctgtctctgaaaggatgggtcgaagtgcgcgatgtgatcattcaccgcgtcggccccattcacgggatctacattcacgttttcgtcttccttggctgcatgattggcctgactctcttcgtcggcgtggtgatagcgaactttaacgaaaataaaggcactgcattgctcaccgttgatcagagacggtgggaggatctgaagagtaggctcaaaatcgcccaaccgcttcacctacctcctcgtccggacaacgacggttttagagccaagatgtatgacatcacccagcaccccttctttaagcggacgatcgccctgctcgtcctggcacaaagtgtgctactctctgtgaagtgggacgtcgaggatcccgttaccgtgcccctagcaaccatgtcagtcgtgtttacattcatcttcgtgctggaagttacaatgaagataatcgccatgtcgcccgctggtttttggcaaagtcgtaggaatcgctacgatctgctggtgactagcctgggagtggtgtgggtggttctgcattttgccttgttaaacgcatatacgtacatgatgggcgcatgtgtaatcgtgttccggttcttctctatctgtggtaagcacgtcacccttaagatgttgctgctgacagttgtggtatctatgtacaagtcattctttatcatcgtgggaatgttcttattacttctttgctatgcttttgcaggtgtggttctgtttggtacagttaaatacggcgaaaatattaacagacatgcgaacttttcttcagctggtaaagcaattaccgtcttatttcgcattgtgacaggggaggattggaacaagatcatgcacgactgtatggtgcagccccctttttgtactcccgatgagtttacctactgggctactgattgtggtaactacgccggggctctcatgtatttctgctcattctacgtgatcatcgcttacataatgctgaatctgctggttgctattattgtggagaatttcagcctgttttacagtaccgaggaggatcagctgctctcctataacgatctcaggcactttcagataatctggaacatggtagacgacaaacgcgagggcgtgattcctaccttcagggtgaaattcctgctccggcttctgagaggtcggctggaggtagacctggataaagacaagctgctgtttaaacatatgtgttatgaaatggagagactgcacaatggcggcgatgtcacgtttcatgatgtcctaagcatgcttagctatcgttcagtggacatccgcaaatccctgcagttggaggagttactggccagggaacaattagaatatacaatcgaggaagaggtggccaaacagactattcggatgtggctgaaaaagtgcttaaaacgaatcagggccaaacaacagcagagctgttccatcatacattctctgcgcgagtcacagcaacaggagttatcacggttcctgaacccaccatctattgagacaacgcagcctagtgaggacaccaatgcgaatagccaggacaattctatgcagcccgaaacatcgagccagcagcagctgctatccccaacgctttctgaccgcgggggctctcgacaggatgcagcagatgcgggaaaaccccagcggaagttcgggcagtggcggctaccttctgcccctaagccaattagccactcggtttcctcagtcaacttgaggttcggaggtcgcactactatgaagagcgtcgtgtgcaagatgaatcctatgacagacgcagcctcatgtggatccgaggtgaagaagtggtggactcgacaacttacagtagagtcagacgagtctggagatgatctcctggacatctag

SEQ ID NO: 205526 - DNA, 2007 bp, Artificial Sequence
  Description of Artificial Sequence: Synthetic coding sequence
atgctgaagcggaagcagagcagccgggtggaggcccagcccgtgaccgactttggccccgatgagagtctgtccgacaatgctgatatcctctggatcaacaagccttgggtgcacagcctactgagaatatgcgctattataagcgtgatttctgtttgcatgaacaccccgatgacttttgagcactaccctcccctccagtatgttacctttactttggacaccctgctcatgttcctctatactgcagagatgatcgccaagatgcacatccgaggtatcgtaaagggagattcaagctacgtgaaagatagatggtgtgttttcgatggcttcatggttttctgtctgtgggtgagcttggtgcttcaggtgttcgaaatcgcagacattgtggaccagatgtccccctggggcatgctccggattccaaggccgctcataatgatccgggcttttcgaatctatttcagatttgaactgcctcgcacccggataacaaacatactcaaacgcagcggggaacaaatttggagcgtgtcaatctttctgcttttcttcctccttctctacggaattctaggagtccaaatgtttggcacatttacatatcactgcgtcgtcaatgacacaaagcctggaaatgtgacttggaactcccttgccatacctgatacccattgtagccccgaacttgaagaaggctaccagtgtcctcctgggtttaagtgcatggacttggaagatcttggattatctcgccaggaattgggatactcgggcttcaacgagataggcacatccatttttaccgtgtacgaggctgcaagccaggaaggatgggtatttctgatgtatagagccatagattcctttcctcgttggagaagctacttctacttcattacactcatcttctttctcgcctggcttgtgaagaatgtttttattgccgtgataatcgagacatttgctgaaataagagtgcagttccagcagatgtggggcagtcgctctagcactacttctactgctacgacccaaatgtttcatgaagacgccgccggggggtggcagttagtggctgtggatgtaaataagccccaaggccgcgcccctgcttgtttgcagaaaatgatgaggtcctccgtgttccatatgttcattctgagcatggttacagtagatgttatcgtggccgcgtcaaactactacaaaggcgagaactttcgcaggcagtacgacgagttttacctggccgaagtagcctttaccgtactctttgacctcgaggctctgcttaaaatatggtgtttagggtttaccgggtatattagttcaagcctacataagttcgagttactgctcgtaatcggaaccacattacacgtgtatccagacttatatcatagccagttcacttattttcaagtgctgcgagtggtgcgtctgataaaaatctcccccgcacttgaggacttcgtgtacaaaatatttgggccgggcaagaaactaggcagtctagttgtgtttactgcatctctgctgattgtcatgtctgccatttctttgcaaatgttttgcttcgtggaggagttggatagatttaccacgtttcctcgcgcattcatgagcatgttccaaatcctgactcaggaggggtgggtggacgtgatggatcagacactgaacgcagttggtcacatgtgggctccagttgtggccatctactttatactgtaccacctcttcgctacattacctccaagccttatccgggacttatgcggtacacaagacgcatgcccatcctgcctaccgctgcagcctcccaaccccctacctggtagccagactttggctcgcctgactcaccaggcgcttactacccctcccgggatgagaagttcccagctctttagtaaaatctctcttctgttaggaatctgtgtcgcatgggagtcaatactgggctctctcagtctgtcccacaacctaagatag

SEQ ID NO: 205527 - DNA, 657 bp, Artificial Sequence
  Description of Artificial Sequence: Synthetic coding sequence
atgctgaagcggaagcagagcagccgggtggaggcccagcccgtgacagactttggccctgacgagtctctctcagataacgcagacatactttggattaataagccttgggtgcactcattactgaggatctgtgccattataagcgtgatatccgtttgtatgaacacacctatgacgtttgaacactaccccccactgcagtacgtcacatttactctggatactcttctgatgttcctgtacacagctgagatgatcgctaagatgcacattagaggcattgtcaaaggggattcaagttacgttaaggaccgttggtgtgtgtttgatggattcatggtcttctgtctttgggtgtcgttggtgctccaagtgttcgaaatagccgacatcgtagatcagatgtcaccatggggcatgttgcgcattccccgccctctaatcatgattcgcgcattcagaatctattttcggtttgagttgcctcgaactcgaatcacgaatattctgaaacgtagtggagagcagatctggtcagtgtccattttccttttgttctttttgctactatatgggatattgggtgtgcaaatgtttgggacatttacataccactgtgtcgttaacgataccaaacccggcctgtctctctag

SEQ ID NO: 205528 - DNA, 657 bp, Artificial Sequence
  Description of Artificial Sequence: Synthetic coding sequence
atgctgaagcggaagcagagcagccgggtggaggcccagcccgtgacggacttcgggcctgacgagagcctaagtgacaatgccgatattctctggattaataagccatgggtacacagcctgcttcgtatatgtgccataatctcggttattagtgtctgcatgaatacccctatgacgttcgagcattatccccctctgcagtacgtgaccttcactttggatacactgctgatgttcctgtacactgcggaaatgatcgccaaaatgcatatacggggcatcgttaaaggggactcctcctacgtgaaggaccggtggtgcgtgttcgacggattcatggtgttttgcctgtgggtctctctggtgctgcaggtcttcgaaattgctgatatcgtggatcagatgagcccgtgggggatgcttaggattccacgccctctgattatgatccgcgcgtttcggatctacttccgcttcgaactgccacgaacacgcatcaccaatattcttaagcgttccggggagcagatctggtctgtctccatcttccttctctttttcctccttttgtacggcattctgggggtgcagatgtttgggacgtttacataccattgcgtcgtgaacgacaccaaacccggcctgagcatttag

SEQ ID NO: 205529 - DNA, 1725 bp, Artificial Sequence
  Description of Artificial Sequence: Synthetic coding sequence
atggccagcaccgagggcgccaacaacatgcccaagcaggtggaggtccgcatgcacgattctcatctggggagcgaagaaccaaaacaccgccacctgggactccgcttatgcgacaaacttggaaaaaatctcctactcacattaaccgtgttcggagtcatcttgggcgcggtttgcggagggctcctcagattggcatccccaatacacccagacgtggtaatgctgatagcatttccaggagacatcctgatgcgcatgctgaaaatgctgatactgcctctaatcatctcatcattgatcaccggccttagcggcctcgacgccaaggctagcggacggctcggtacccgcgccatggtttactacatgagtactaccattatcgccgccgtgctgggggtcatccttgttttggctattcatcctggcaaccccaagttgaaaaaacagcttggacccggcaaaaagaacgatgaggtaagcagcctggacgccttcctcgatcttattcgaaacctatttcccgaaaatctcgtgcaggcctgctttcagcagatccagacagtgaccaagaaagtcctggtggcacccccaccggatgaggaagctaatgcaaccagtgcagtggtctccctgttgaacgaaactgtgacagaagtccctgaagaaacaaaaatggtgattaaaaaaggcttggagttcaaagacgggatgaatgtcttgggacttatcgggttttttatcgcctttggaattgcaatgggaaaaatgggcgatcaggccaaactcatggttgatttttttaacattctgaatgagatcgtcatgaagttggttatcatgattatgtggtatagtcccttggggatagcttgcctgatctgtggaaagatcattgctattaaggaccttgaggtcgttgctcggcagctcggtatgtacatggtgactgtgataattggcttaataatccacggaggcatatttttgcccctgatttattttgtggtgaccaggaaaaacccattcagtttctttgcaggcatttttcaggcttggattaccgcactgggtacggcctccagcgcaggaactttacccgtgacttttcgatgtctggaggaaaaccttggaatcgacaaacgggtcacccgcttcgtattgcctgttggggcgacaattaatatggatgggactgccttgtatgaggccgtggccgcaatctttatcgcacagatgaacggggttgtattagacggcggacagatcgtgaccgtgagtctgacggccacattagccagtgtgggggcagctagtattcctagcgctggactggttactatgctgcttatcctgacggcagtgggacttcctacagaggatatatcgttattagtggccgtcgactggctgctggaccgcatgcggacatctgtaaacgtcgttggggacagcttcggtgccggtatcgtgtaccacttgtctaaatcagagcttgacaccatagattctcagcatcgcgtgcatgaggatatcgaaatgacaaagactcagtcgatctatgatgatatgaagaatcaccgagaaagcaattctaatcagtgtgtctacgctgcacacaacagtgtgatcgtggacgaatgtaaagtgaccttggcagcgaacggaaaatcagccgactgctcagtcgaggaggagccatggaaacgtgaaaaatag

SEQ ID NO: 205530 - DNA, 1698 bp, Artificial Sequence
  Description of Artificial Sequence: Synthetic coding sequence
atgcccaagcaggtggaggtgcggatgcacgacagccacctgggctccgaagagccaaagcatcgacatctgggtctccgcctttgcgacaaattaggaaagaatctcctgctcaccctaaccgtgtttggagtgattttgggagctgtatgtggcggtttattgcgcttagccagtcctatacatccagatgttgttatgctgattgcctttcctggcgacatcttgatgagaatgctgaagatgctgatcctgcctctcataatctcctccctgatcacagggctctctgggctcgacgcaaaggcgagcggaagacttgggacccgggccatggtgtactacatgagcacaactataatagcagccgtcctgggagtcatcctggtcctcgcaattcacccaggtaatccgaaactgaaaaagcagcttggccctgggaagaaaaatgacgaagtgagctcactcgacgccttcctggatctcatcaggaatcttttcccagaaaatttagtgcaagcttgcttccaacagattcagacggtgactaagaaagtcttagtggcccctccgccagacgaggaggccaacgcaaccagtgccgtagtttccttgctgaatgaaactgtgacagaggtccccgaggagactaagatggtcataaaaaagggactcgagttcaaggacgggatgaacgtattggggttgataggtttcttcattgcttttggaatagcgatgggcaaaatgggcgaccaggccaaactgatggtggatttctttaacattctgaatgaaattgtgatgaagcttgtgatcatgatcatgtggtacagccccttgggaatcgcctgcctcatctgcggcaaaatcatcgccatcaaagatcttgaggtcgttgcacgtcagctgggaatgtacatggttactgtgatcatcggccttatcatccacgggggcatctttctgcccctgatctacttcgtcgtgacgcgaaaaaaccccttctctttctttgccggcatctttcaagcatggattaccgcactgggcacggcctcgagcgccgggacacttcctgtgacattcaggtgcctggaggaaaatctcgggattgataagagggttaccagattcgttctgcctgttggcgcgactattaatatggatggcactgccctgtatgaggctgtggcggctatttttatagcgcaaatgaacggggttgtgttggatggcggccagattgtgactgtgtcactgactgctactctagcaagcgtaggagccgcctccataccatctgctggcctggttacaatgctcctgatccttactgccgttggcctgcctacagaggatatcagcttactggtggccgtcgactggctgctggaccgtatgcgcacatctgtcaacgtggtaggggactctttcggagctggaattgtttaccatctcagcaaatctgagcttgacaccatagactctcagcaccgcgttcatgaggatattgagatgacgaaaacacagagcatttacgatgatatgaagaatcacagggaaagcaactctaaccaatgcgtctacgctgctcataacagtgtgattgtggatgaatgcaaggtaacgctggccgcgaacggcaagagtgccgactgttccgtggaggaggaaccgtggaaacgagagaaatag

SEQ ID NO: 205531 - DNA, 1698 bp, Artificial Sequence
  Description of Artificial Sequence: Synthetic coding sequence
atgcccaagcaggtggaggtgcggatgcacgacagccacctgggctctgaagagccaaagcaccgccatttaggtttacggctctgcgataagctgggcaaaaatctgctgctgactctaactgtgttcggggtaatacttggagccgtgtgcggaggccttctccggttggcatcccctatacacccagacgtagttatgctaatcgcttttccaggggatattttgatgcgtatgctcaaaatgctgatcctgccactgataatttcatcactcatcacaggcctgtctggactggacgcaaaggcctctggaaggctcgggactcgcgccatggtgtactatatgagcacgaccattattgccgccgttctcggggtgatcttggtactggccatccatcctggaaaccccaaattgaaaaaacagctgggaccgggcaagaagaatgatgaggtgagctcactggacgcctttcttgatctgatccgaaacctgttcccagaaaacctggtccaggcatgcttccagcaaatccagaccgtgaccaaaaaagtgctcgtggcgcctcctccagacgaggaagcaaatgcaacttccgcagtggtctcactactgaacgaaaccgttactgaggtgccagaggaaacgaaaatggttatcaagaaaggactcgaatttaaggacggcatgaacgtcctaggtctgattggttttttcattgcttttgggatcgccatgggcaaaatgggggatcaggcgaagctgatggtcgactttttcaacattctaaacgaaattgtgatgaagttggtaataatgatcatgtggtattcccccctcggcattgcttgcctgatttgcggtaagataattgccatcaaggatcttgaagtagtggctaggcagttggggatgtacatggttaccgtcattatcggtctgattatccatggagggatcttcctgcctttgatctatttcgtggtcactagaaagaaccccttctctttttttgccggaattttccaggcttggatcacggcgcttggtaccgcgagctccgccgggacacttcccgtaacgttccggtgcctggaagaaaatctagggattgataagcgcgtgactaggttcgttctgccagtcggagcgacaatcaacatggatggaaccgctttatatgaggccgttgcagctattttcatagctcagatgaatggggttgtgctggacggtgggcagattgttaccgtctcactgacagcaacactcgcgtctgtaggggctgcatccatccctagtgcaggcctggtgacaatgttgctcatactaacagcggtaggactcccaactgaggatatttctctcctggtggccgtagattggttactggatagaatgcgcacttcagtcaacgttgtaggcgactcttttggcgctgggatagtctaccatttgagcaaaagcgagctcgacactatcgatagccaacatagagttcatgaagatatcgagatgacaaagacgcagtctatttacgatgatatgaaaaatcatcgagagagcaatagcaaccagtgcgtgtatgccgcccacaattctgttattgtagacgagtgcaaagtgactttagctgcaaatgggaagtccgccgactgttcagtggaagaagagccttggaaacgcgaaaaatag

SEQ ID NO: 205532 - DNA, 1629 bp, Artificial Sequence
  Description of Artificial Sequence: Synthetic coding sequence
atgaccaagagcaacggcgaggagcccaagatgggcggccggatggagcgttttcagcagggagtccgtaagaggacattgttagctaagaaaaaggtccaaaacattacgaaggaagatgtcaaatcatatctgtttagaaatgccttcgtgctgctgacagtgacagcggttatcgtgggcaccatactggggttcacactgcggccttatagaatgagctatagagaggttaagtattttagcttccctggtgaattacttatgaggatgctgcagatgctggtcctgccacttattatcagttctctcgttacaggaatggctgctctggactctaaagcctctgggaagatggggatgcgggccgtcgtgtattacatgacgactactattattgcggtggtgattggcattatcatcgtgatcattatccatccaggcaagggcacaaaggaaaatatgcacagagaaggaaagatcgtaagggtcaccgccgcggatgcatttttggatctgattcgaaatatgtttcccccgaatttggttgaagcctgcttcaaacagttcaaaaccaactacgagaagcggtccttcaaggtgcctattcaggccaacgaaacactggtcggtgccgtgattaacaacgtcagtgaagctatggagactctgacaagaatcaccgaagagctggtgccagtgcctggcagcgtgaatggcgtgaacgctctgggactggtggtgttcagcatgtgtttcggctttgtgatcggcaacatgaaagagcagggccaggccctgagagagttttttgactcactcaatgaagctataatgagactggtggccgtgataatgtggtacgctccggttggcatcctatttctaatcgcgggcaagattgtggagatggaggacatgggcgtgattggcggtcagctcgcaatgtacacggtcacagtcatcgtgggactcctgatccacgccgtgatcgtccttccattgctttacttcctggtcacccgcaagaacccgtgggtgtttattgggggattacttcaggcactgatcaccgccttgggcacatcttctagctcggcgaccttgccaataacttttaagtgcctggaggagaataacggcgttgataagagggtaacacgattcgtccttcctgtaggggcgaccattaatatggatgggaccgcgctgtatgaggcgctggccgcaatcttcatcgctcaggtcaacaacttcgagcttaattttggccagattattactatttccatcacagcaacagcagcgagcatcggggcagcgggcatcccacaggccggtctggtgacaatggtcattgtactgacatctgtgggtcttccaactgacgacattacactcatcattgctgtagactggttccttgacagactgcggactactaccaacgtgctgggagacagcttgggggccggcattgttgagcacctgtcacggcatgagcttaaaaacagggacgtcgagatgggtaacagcgtgattgaagagaatgagatgaagaagccatatcagctgattgcccaggacaatgagaccgagaagcccattgacagtgaaacaaaaatgtag

SEQ ID NO: 205533 - DNA, 1494 bp, Artificial Sequence
  Description of Artificial Sequence: Synthetic coding sequence
atgaccaagagcaacggcgaggagcccaagatgggcggccggatggagcgcttccagcagggcgtaaggaaaagaaccctgctggctaagaagaaggtccagaatattactaaagaagacgtgaagtcatacctcttcagaaatgcgtttgtcctcctgactgtgactgcggtaatcgtcgggaccattctaggcttcacactgaggccttataggatgagctatcgggaagtcaagtatttctcatttcccggagaactgctgatgaggatgctgcagatgctcgtacttcccctaatcatcagctctctggtcaccgggatggcggcgctggactccaaagcttctggcaaaatgggtatgagggctgttgtctattacatgacaacaaccattatcgctgtggtcatcggtatcattatcgtgattatcatccatcccgggaagggcaccaaggagaatatgcaccgagaagggaaaattgtacgcgtaacagccgccgatgcctttttagacttgatcaggaacatgtttcccccaaatctggttgaggcttgcttcaagcagtttaagacaaactacgaaaaaaggagctttaaagtcccaatccaagccaatgagactctcgtcggtgccgttataaataacgtttcagaggctatggagacattgacccggatcactgaagaattagttcccgtacctggtagcgtcaacggcgtgaatgccttgggactggtagtttttagtatgtgcttcggttttgttattggaaatatgaaagaacaaggtcaagccctccgagagttcttcgattcactcaacgaggcgattatgagattggtggccgttatcatgtggtacgctcccgtcggcattctctttcttattgcaggaaaaatagtcgaaatggaagacatgggggtcattggagggcaactggcaatgtataccgtgactgtgattgtggggctgctgatccacgctgtgatagttttaccactcttgtattttcttgtgaccaggaaaaatccatgggtgttcataggcggcctgcttcaggcattgattactgcgctgggtaccagttcctcatctgccactctgcccatcacctttaaatgtttggaagagaataacggggtggataaaagggtcactaggttcgtgctacctgtcggcgctacgataaacatggacgggactgccttgtacgaagccctggcagctatattcatcgcacaagtcaataattttgagctcaacttcgggcagattataactatccgggatagattgagaaccaccacaaatgtgctgggagactctcttggggccggaatagtggagcatctgtccagacacgagcttaagaatcgggatgtggaaatgggaaattccgtcattgaggagaacgagatgaagaagccctatcagttgatcgcacaggataatgagacagaaaaacccatcgattcggagaccaaaatgtag

SEQ ID NO: 205534 - DNA, 348 bp, Artificial Sequence
  Description of Artificial Sequence: Synthetic coding sequence
atgaccaagagcaacggcgaggagcccaagatgggcggccggatggaacgattccagcaaggtgttcggaaacggactctgttagcaaaaaagaaggtccagaatattacaaaggaggacgtgaagagctacctctttagaaacgccttcgtgctcctgacagtcaccgccgtaatagtcgatgagaagaccgaggcacaaattctgaccactcagctgatgaataccgagtgggactctaacccaccttttagactgcaagtcctgatccatcataccgtccttggcgccatcacaccgatcctggcactgctacagcagtttgccgaaggtcttcccgaggtgtag

SEQ ID NO: 205535 - DNA, 1473 bp, Artificial Sequence
  Description of Artificial Sequence: Synthetic coding sequence
atgaccaagagcaacggcgaggagcccaagatgggcggccggatggaacgttttcaacaaggcgtccgaaaaaggaccttactagccaagaagaaagttcagaacatcaccaaagaggacgtaaagtcctacttgtttcgcaacgccttcgtactgttgaccggaatggctgccctggactccaaagcttccgggaagatgggcatgcgtgcagtggtctattacatgaccaccactatcatagcagtggttatcggaattattattgtcatcataattcaccccggcaaggggactaaggaaaatatgcatcgtgaaggaaaaatagtgcgggttaccgctgccgacgcatttcttgacttaatccgcaatatgttcccaccaaatctggttgaagcctgtttcaaacagtttaagacaaattacgaaaagcggtccttcaaggtgccaatccaggcaaacgagaccttggttggggccgtgatcaataatgtgagcgaagccatggagactctgacaagaatcaccgaggagttggtacctgtgccaggcagcgttaatggggttaacgccttgggtctggtggttttttccatgtgtttcggatttgttataggcaacatgaaagaacagggccaggctttaagagaattctttgacagcctgaatgaggcaatcatgcgccttgttgccgtcattatgtggtacgccccggtaggtatcctgttcttaatcgctggaaaaatagtggagatggaggacatgggggtcattggtgggcagctcgccatgtacacggtgactgtcattgtgggtttgcttatacatgcggtgatcgtactgccccttctttattttttggtgaccaggaagaacccatgggtattcatcggcggtttactgcaggccctgattactgctttggggacatcttcgagctctgcaacactaccgattacctttaaatgtctggaggaaaacaacggcgttgacaaaagggtgactagatttgttctccctgtcggggccacaatcaacatggacggaaccgctctttatgaggctctcgccgcaatttttattgcccaggttaacaatttcgagcttaacttcgggcagataatcacaatatccattacagccaccgcggcctcaatcggcgccgctgggataccacaggcagggctggtcaccatggtgatcgtactaaccagcgtgggcctgccaacagatgatatcaccctgattatcgcagtggattggtttttggacaggctgcgcaccacgaccaacgtgctcggcgattcactgggcgcaggaatcgtggaacacctcagcagacatgagttaaagaaccgggatgtcgagatgggtaattctgtcattgaggaaaacgagatgaaaaagccttatcagcttatagcccaggataacgaaaccgaaaagcccatagattccgaaacgaaaatgtag

SEQ ID NO: 205536 - DNA, 324 bp, Artificial Sequence
  Description of Artificial Sequence: Synthetic coding sequence
atgaccaagagcaacggcgaggagcccaagatgggcggccggatggagcgcttccaacaaggggtgaggaaacgcacactgctggctaaaaaaaaagttcagaatataacgaaagaggacgtaaagtcctatctatttcggaacgcgtttgtcttgcttacagttaccgcagtgatcgtgggtaccattctgggtttcaccctaagaccttatcgcatgtcatatcgcgaagtgaagtacttcagctttcctggcgagttgcttatgaggatgctccagatgctggtgctccctctaattatttcaagccttgtgaccggatag

SEQ ID NO: 205537 - DNA, 324 bp, Artificial Sequence
  Description of Artificial Sequence: Synthetic coding sequence
atgaccaagagcaacggcgaggagcccaagatgggcggccggatggagcgttttcaacaaggcgtacggaagcgtaccttactcgccaagaaaaaggttcaaaatatcactaaagaagacgttaaaagttatctcttcaggaacgcctttgtgctgcttaccgtgactgccgtgatcgtgggaacgatcctgggttttacgttgagaccctaccgcatgagttatcgtgaggttaaatacttttccttccccggggagcttctcatgagaatgcttcagatgttagtgcttccactgattatatcaagtctcgtaacagggtag

SEQ ID NO: 205538 - DNA, 306 bp, Artificial Sequence
  Description of Artificial Sequence: Synthetic coding sequence
atgaccaagagcaacggcgaggagcccaagatgggcggccggatggagcggttccagcagggcgtgagaaagcggaccctcctggctaaaaagaaggttcagaatatcaccaaagaagatgtcaaatcgtatctgttcagaaacgcctttgtgctgcttaccgtgacagctgttatcgtgggaacaatactaggatttacgctccgcccttacaggatgtcataccgagaggtcaaatacttctcatttccaggagagctattaatgagaatgcttcaaatgttggtgctgccactcattatctag

SEQ ID NO: 205539 - DNA, 987 bp, Artificial Sequence
  Description of Artificial Sequence: Synthetic coding sequence
atgaccggcgtgttcgacagcctggtggccgacatgcacagcacccagatcgctgccagtagtacataccatcagcatcaacagcccccaagcggggggggagcgggcccagggggcaactcaagttcctcttcatccctacacaaaccacaggagagtcccactctccccgttagcactgctaccgattcctcttattacactaaccaacagcacccggcggggggcggcgggggcggagggagcccctacgcccacatgggatcctaccagtaccaagccagcggtcttaataacgtgccctatagtgcaaaatccagctacgatcttggttatacggccgcttatacctcctacgcaccatacggaactagttcctctcctgccaataacgaaccggaaaaagaagacctcgagcctgaaatcaggatagtgaatgggaagcccaagaaagttcgaaaaccccggacaatttattcctcttttcagctcgcggctctgcaacggcgttttcagaagacacagtatctggctcttcccgagagggcggagcttgcagccagcttagggctaacgcagacacaggtgaagatctggtttcaaaacagaaggtctaaatttaagaagatgtggaagtccggggaaataccgtcagagcaacatcctggcgcttcggcctcccccccctgtgctagcccccctgtgagcgctcctgcttcctgggatttcggtgtgccacagaggatggcaggcggggggggccctggttcgggcggttcaggcgccggttcaagcggctcaagtccttcttccgcagcttcggcctttctgggtaattacccatggtaccaccaaactagcgggagtgcaagccacctccaggccactgctcccctgttgcatcctacgcagacgccgcagcctcatcaccaccatcaccaccatggcgggggcggggcaccagtgtccgccggcactatcttttag

SEQ ID NO: 205540 - DNA, 1359 bp, Artificial Sequence
  Description of Artificial Sequence: Synthetic coding sequence
atgctgctgcggatgctgcggatgatcatcctgcccctggtggtgtgttcacttgtttctggcgctgcatccctggatgccagttgcctgggtaggttggggggcatcgcggtcgcctattttgggctcacgaccctgtctgctagcgcgcttgccgtggcactcgccttcattatcaaaccagggagtggagcccagactctgcagagctcagacctggggctagaagatagtggaccccccccagtgccaaaagagaccgtagattccttcctggacctggcccgcaatttattcccatctaatttggtggttgccgccttcagaacttatgccacagactataaagtcgtgacacagaacagtagctcaggcaatgtgacacacgaaaagattcctatcggaacagagattgaaggcatgaacatcctggggttggtgctattcgcactcgtgcttggcgtggctctgaaaaaactgggatccgagggcgaagaccttatccgtttcttcaatagccttaacgaagcaacaatggtgctggtatcatggattatgtggtatgtgcccgtaggaatcatgtttctggttggttcaaaaatcgtggagatgaaggacatcatcgtcctagtcaccagcctgggaaagtacattttcgcctccatactcggacacgtgatccacgggggcatagttcttcccctgatatacttcgttttcacacggaagaatccattcaggttcttgctcggcctactggccccctttgccacggcttttgccacctgttccagctccgcaacactgccaagcatgatgaagtgcatagaggagaataacggcgtggataagaggatcagccgctttattctgcctattggagccacggtgaacatggacggtgcagccatttttcaatgtgtagccgctgtgtttattgcacaactgaacaatgtggaactgaatgctggacagatctttactatccttgtgaccgccactgcatcttcagtaggtgcggccggcgtgcctgctggaggcgtgctgactattgctattatccttgaagcaatcggccttcctacccatgatcttcctctcatactggcggtggactggatagtggatcgcactactaccgtggtcaatgttgagggggacgcgcttggggccggaatcctgcatcacttaaaccagaaggctaccaaaaaaggcgaacaggagttggctgaggtgaaggtcgaagccataccaaattgcaagagcgaagaggagacctcccctctggtcacccaccagaatcccgcaggtccagttgcatcagcaccagagttagagagtaaagaaagtgtgttgtag

SEQ ID NO: 205541 - DNA, 705 bp, Artificial Sequence
  Description of Artificial Sequence: Synthetic coding sequence
atgaacatcctgggcctggtgctgttcgccctggtgctgggcgtggcattgaagaaactcggctcagagggagaagacctaatcaggttttttaactctctcaacgaggcgaccatggtgttggtgagttggatcatgtgcagcgctactctgccgtctatgatgaaatgcatagaggagaacaatggggtggataagcgaatcagtcggtttattctgccaattggtgctacggtgaatatggatggcgcagcgatattccagtgcgtggcggctgtgttcatcgcacagctaaataacgttgaactcaatgctggacagattttcactattctggttaccgccacagctagttccgtgggggcggccggagtgcctgctggcggggtactgaccatagccataattcttgaggctatcgggttaccaactcatgacctaccccttatcttggcagtcgactggatagtcgacagaactaccacagttgtcaatgtcgagggggacgctttgggtgccgggattctacaccacctgaaccagaaagcaacaaagaagggtgaacaggagctggcagaggttaaagtagaggcaattccgaattgcaagtccgaggaagagaccagcccacttgtgactcaccaaaaccccgccgggcccgttgcatcagcccctgagctggagtccaaggagagcgttctgtag

SEQ ID NO: 205542 - DNA, 1575 bp, Artificial Sequence
  Description of Artificial Sequence: Synthetic coding sequence
atgggcaagcccgcccggaagggctgcgagtggaagcggttcctgaaaaacaactgggtgctcctctccactgtggcagccgtcgtcctaggcatcacgacaggagtgctggtcagagagcactcaaatctgagcacgctggaaaaattttacttcgcatttcccggggagatcctgatgcggatgctgaagctgataattcttcctttaattattagcagcatgattacaggtgtggcggcgctggatagtaatgttagtggtaaaatagggctcagggccgttgtgtattacttctgtaccaccttgatagcggtgatcctcggaatagtgctggtcgtgtccatcaagcccggtgtcacacagaaggttggtgagattgctcgaacaggtagtacacctgaggtgtccactgttgatgccatgctggatctcattcgcaacatgtttccagagaacctggtccaggcctgctttcaacaatacaagacaaaaagagaggaagtgaagccccctagtgatcccgaaatgaatatgacagaggaatctttcacagcagtgatgaccaccgccatctccaagaacaaaactaaagagtacaaaattgtgggcatgtactcagatgggattaatgttctgggcttgatcgtgttttgcctcgtatttggactggtgatcggaaagatgggggaaaagggccaaatccttgtggatttcttcaacgccctgtctgacgcgacaatgaaaatcgtccagatcatcatgtgttacatgcccttgggaatcctgttccttatcgctgggaaaatcatcgaggttgaagactgggaaatctttcgaaagctaggtctgtacatggcaacagtgttaacgggcctcgccatccattcaatcgtgattctccctttaatttacttcatagttgtccgaaagaatccctttcgcttcgctatggggatggcccaggcgctcctcactgcactcatgatatcttcatcatccgcaacattgcccgtgacctttaggtgcgccgaagagaacaaccaggtcgataagaggattacacggtttgtcctccctgtcggtgctaccatcaacatggatggtaccgccctgtacgaagctgtggctgcggtcttcatagcccagttaaacgatctggaccttgggataggccagattatcactatttcaatcactgcgacaagcgctagcattggggctgctggggtgccccaagctggactggtaaccatggtgatcgtcctatcggctgtcggactccctgcagaggatgtgactctcatcatagctgttgattggttgctggacagattcagaacaatggtcaatgtacttggggacgctttcgggactgggatagtcgaaaagctctctaagaaggaacttgaacagatggatgtgagtagtgaggttaacattgtgaatcccttcgccctggaatccacgattctcgacaacgaagacagtgacaccaaaaaaagctacgttaatggagggtttgccgtggacaagtccgacactatctcttttactcagactagccagttttag

SEQ ID NO: 205543 - DNA, 729 bp, Artificial Sequence
  Description of Artificial Sequence: Synthetic coding sequence
tgattcttcaacgccctgagcgacgccaccatgaagatcgtgcagattatcatgtgttacatgccactgggcatcctgttcctgattgctggaaagattattgaagtagaagactgggagatttttcgaaagcttgggttatacatggcgactgtgctcacaggcctcgccatccacagcatcgtgatactgcccttgatctatttcattgtagtgcgcaagaaccccttccggtttgcaatgggcatggcgcaggccctgttgaccgcccttatgatatcttcctcctcagccaccctacctgtgactttccgttgtgctgaggagaataaccaggtagacaaacggataaccaggttcgttctgcccgtgggggcaaccatcaatatggacggaactgcgctgtatgaggccgtggctgccgtgtttattgctcaacttaatgatttggatctcggtatcgggcagatcatcacaattagagatcggtttcggaccatggtcaatgtgctgggggatgcgttcggaaccgggattgtggagaagctttccaaaaaggaacttgaacagatggatgtgtcctctgaagtcaacatcgtgaaccctttcgctctcgagtccacaatcctagacaatgaggattcagacaccaagaaatcatacgttaacggggggttcgctgtggacaagagcgatacaatctcatttactcagacgagccagttttag

SEQ ID NO: 205544 - DNA, 1647 bp, Artificial Sequence
  Description of Artificial Sequence: Synthetic coding sequence
gagacccccgtgctgcccatcatggtggccgaccccccccgggactcgaagggcctcgctgctgctgagccaacagcaaatggaggcctggccctcgcatcaattgaagaccaaggcgcagccgctggcgggtactgcggtagtcgagaccaggtgagacgctgcctgcgagcaaatcttcttgtgttgctaaccgtcgtggccgtagtggcgggggttgccctggggctgggcgtgtctggggcgggaggcgcactcgcactgggccccgagcgactgagcgcattcgtctttcccggagagctgttattacgcctgctgcggatgatcatactacccctggtcgtgtgttctctgatcggaggcgcggcttcacttgaccccggggccttgggccgcttaggagcctgggccttgctgttctttctggtgacgactctgctggcttctgccctgggtgtgggtctagctctggctctgcagcccggagctgcgtccgcagccattaacgcctctgtgggcgcggcagggagcgccgagaatgctccaagtaaagaggtgctggattccttcttggacttggctcggaacatttttccttcaaacctggtatctgctgcattccggagctacagcactacctacgaggaacggaatatcacgggaaccagggtgaaggtccccgtcggccaggaagtagaggggatgaacatcctggggctggttgtcttcgccatcgtctttggcgtggccttaaggaaactgggccccgaaggggagctgttaattaggttttttaactctttcaacgaagcgaccatggtcttagtctcctggattatgtggtacgcacccgttggtattatgttcctggttgctggcaaaattgtcgagatggaagacgtgggcctgctgtttgcaaggttggggaaatacattctctgttgtttgctcgggcatgccattcatggtcttctggtgttgcccctcatctatttcttatttacaagaaagaatccctacaggttcttgtgggggatcgttactcctctggctacagcgtttggcacctcaagtagcagcgcgacattgcccctgatgatgaagtgtgtggaggaaaataacggcgtggctaagcatatttcacggttcatcctgccaataggagccactgtaaacatggatggagcggccttgtttcagtgtgtggcggcggtgtttattgcccaactctcacagcagtctctggactttgtgaagatcatcaccatcttagtaactgccacagccagcagtgtgggagctgctggaatccccgccggcggcgtgctaaccttggcgatcattctcgaggccgtgaatctgccagtggaccacatctccctcatccttgctgtggactggcttgtcgacaggtcatgcactgtcctgaatgtcgagggggatgccctcggggctggcctcttgcagaattacgttgaccggaccgagtctaggtcaacagaacccgagcttatccaggtaaaaagcgaactgcccctcgatccactgcccgtcccaacagaggagggcaacccactcttgaagcactatcggggtcccgctggtgatgccacggtggcttcagagaaggagtctgtgatgtag

SEQ ID NO: 205545 - DNA, 942 bp, Artificial Sequence
  Description of Artificial Sequence: Synthetic coding sequence
atgaacatcctgggcctggtggtgttcgccatcgtgttcggcgtggctctgcgcaagctgggcccggagggagaactattgattcgctttttcaatagttttaacgaggcaacaatggtactcgtcagctggattatgtggtatgctccggtcggcatcatgttcttggtggcaggcaaaatcgttgagatggaggatgtgggacttctgttcgccagactgggaaagtatatcctgtgctgtctacttggccatgccatccatggattgcttgtgctgcccctgatatatttcctctttacacgcaagaacccctaccgattcctctggggaattgtgacacccttggcaactgcgtttggtaccagctctagcagcgccaccttgcccttgatgatgaagtgcgtcgaggagaataacggcgtcgccaaacatatcagtcgttttatactacccataggtgcaaccgtgaatatggatggagctgcactatttcagtgtgtagccgctgtgttcattgctcagctgtcccagcaatccctagactttgtcaaaattatcaccatacttgtcacggccactgcttcatccgtgggagcggcgggtattccagcagggggagtgctgacactggcaataatactcgaagccgtgaatctgcccgtggatcatattagcctcatcctggccgtcgactggctcgtggatagatcctgcactgtcctcaatgtcgagggggatgcgttaggcgccggcttattacagaactatgttgaccgaaccgaatcacggtccactgaacccgaattgatccaggtcaagagcgaattaccgttagatcctctgcctgtgccaaccgaggagggaaacccactccttaagcattatcgcgggcccgcaggcgacgctactgtggctagcgaaaaggaaagcgtgatgtag

SEQ ID NO: 205546 - DNA, 1020 bp, Artificial Sequence
  Description of Artificial Sequence: Synthetic coding sequence
atgtacagcaccacctacgaggagcggaacatcaccggcacccgggtcaaggtacctgtgggccaggaagtggaaggaatgaatattttggggctggtggtctttgcaatcgtattcggggttgcgctcaggaagcttgggccggagggagaacttttgatcaggtttttcaatagctttaatgaggccacaatggttttagtgtcctggattatgtggtatgccccagtggggattatgttcctggtggccggtaagattgtcgaaatggaggacgtcggccttttgtttgcccgcctgggaaagtacattctctgttgtctgctggggcatgctattcacggactgcttgtgctgcccctgatttacttcctgtttactagaaaaaacccctaccggttcttgtggggcattgtgaccccacttgcaaccgctttcggaacatcatctagttcggccacactgccactgatgatgaaatgcgtggaagaaaataatggtgtcgccaagcacatcagcagattcatacttccaattggggcgaccgttaacatggacggagcagcactgttccagtgtgtggccgccgtattcatcgcccagctctcccagcagagtcttgatttcgtcaagatcatcacgatactggtcaccgctactgcatcttcagttggcgcggcaggaatcccagccgggggagttctcaccctggccattatcctggaggctgttaacctccccgtcgaccatatttctctcatccttgctgtcgattggctggtggaccgctcctgtacagtgctgaacgtggagggagatgctctgggcgcgggtcttctgcagaactacgtggaccgcaccgagtccaggagcaccgagcctgaactgatccaggtcaaatccgagcttccgcttgacccactccccgtgccgactgaagagggaaatccactgctcaagcactaccggggtccagcaggagatgctaccgttgcctcagaaaaagagtctgtaatgtag

SEQ ID NO: 205547 - DNA, 1626 bp, Artificial Sequence
  Description of Artificial Sequence: Synthetic coding sequence
atggtggccgaccccccccgggacagcaagggcctggccgccgccgaacccacggccaacggcggacttgctttagcatctatcgaagatcagggagcagccgccggcggttattgcggcagcagagatcaggtgcgccgctgtctgcgggccaacctcttagtgctgttgactgtggtggcggttgtggcaggagtcgctctggggcttggagtctccggggcgggcggagctcttgcactgggccccgagcgcctctctgcctttgtgttccctggggagctcctgctgcggcttctgcgcatgatcatactgccactcgttgtctgtagcctgatcgggggtgcagccagtttagaccctggcgctctcggacggctgggtgcctgggccctactcttctttttggtgaccacactcctggcaagcgccctgggcgtggggcttgcacttgcccttcagcccggggcggcctctgccgccatcaatgcatccgtcggggcagcaggctctgcagagaatgccccatcgaaagaagtgctggacagttttctggaccttgctcggaacattttccccagtaacctggtgagcgccgctttcagaagctactctaccacatacgaagaacgcaacataacaggaactagggtaaaggtgccagtaggccaggaagtcgaaggcatgaatatactggggctagtagtgtttgcgatcgtctttggagttgcactcagaaagctggggcctgaaggggagttgcttatcagattcttcaatagctttaatgaagccactatggtcctggtgagttggatcatgtggtatgcccccgtgggaatcatgttcctggtcgccggcaaaatcgtggaaatggaggatgtgggacttttgtttgcccgcctgggcaagtacatcttgtgttgcctcttaggacatgcaatccacggactgctggtgctccccttaatttacttcctgtttacacggaaaaacccttatcgctttctatggggcatcgtcactcctttggctaccgccttcggaacgagtagcagttctgccaccttgcccctgatgatgaaatgtgtcgaggaaaacaatggagtcgctaagcatattagcagattcattctgccaatcggggctaccgtaaacatggacggagctgccctgtttcagtgcgttgctgccgtgttcatagcacagttgagccagcaaagtctcgactttgtgaagataattactatcttagtgaccgccaccgccagctccgtgggagcagccgggattccagccggcggcgtgctgaccctggccatcattttggaggcagtaaatttaccggttgaccacatttctcttattttagcagtcgactggcttgtggacagatcgtgcaccgtgctcaatgttgagggggatgctctgggcgcaggactgcttcagaactacgtcgaccgcaccgagtcccgcagtactgaacctgaacttatccaagtgaagtctgagcttccattggatccgctgccagtccctacggaagagggtaatccactgttgaaacactaccgggggcccgccggggacgccaccgtggcatcagaaaaggagtccgtaatgtag

SEQ ID NO: 205548 - DNA, 1308 bp, Artificial Sequence
  Description of Artificial Sequence: Synthetic coding sequence
atggccgagagcagcagcgagagcgaccacttccggtgccgggaccgcctgtctccatgggccgcacgctcaactcataggggtactcgttccctaccaacagtagaagtgacggaaaaagttaacactattactagcacacttcaggacacctcacggaacttgagacaggtggatcagatgcttggaaggtacagggagtacagcaacggccaggccggcgccatcgagcacctcaaggaaagccttgaacagagcatcgaccagctaagatcccagcggcttttgcgcaactcaggcggccgctccatcagtgtgacttctctctctgctagcgaccttgatggaggaaccggaagcgaacttcaccacttcccaccaaccagccctttaaaggattacggcgatcctcaagggattaaacgaatgagaagccgcaccggcgttcgcttcgttcaggagacagacgacatgacccagctgcatggattccatcagagcctgagggacctgtcctccgagcagatccggctgggagacgatttcaatcgcgagctgtcgaggcggtcaagatcagatgcggaaaccaaaagggccctggaggagctgactgagaaattgaatgaggcacagaagcaggaggtggtatccgaccgcgtggagaggcggttacaggaactggaacgggagatgcggacagagcgggagcttgtggaacggagacaagaccagctggggctgatgagcttgcagctacaggaggctcttaaaaagcaggaggccaaggccgatgagcatgaaggtgcaattaagaataagcttagacagactgagacagaaaagaaccaattggaacaggagctcgagctttctcggagacttctgaaccagagcgagggcagccgcgagacgctgctgcatcaggttgaggagctgaggacccagctcacgaaagccgaaggcgataggaaggggttacagcaccaggttagccaaattagcaagcaacagtccaactatcaagatgagcagggagaggactggcgattcagacggggagtagagcgcgagaaacaggatctggaaaagcagatgtccgatctccgcgtgcagttgaatttcagcgccatggcatcagaacttgaagaggtgaaacggtgtatggaacgcaaggacaaggagaaagcacacctggcctcccaagtggaacacatcaatcggaaatgtctccttaacctcgtacaggatctggattgcaaggataacgagattctgacatactcacttcagagtcccttacacgtgtag

SEQ ID NO: 205549 - DNA, 1047 bp, Artificial Sequence
  Description of Artificial Sequence: Synthetic coding sequence
atgaacgaccccaacagctgcgtggacaacgccaccgtgtgcagcggcgcctcctgcgtggttcccgaaagcaatttcaataatattctgtctgtagtgttgtctaccgtcctgactatattgctggctctggtgatgttttccatgggctgcaatgtggagataaagaaattcttgggacacattaagaggccatgggggatctgcgtggggttcctttgccagttcggcattatgcccctgacgggcttcatcctctccgtcgccttcgatattctcccactgcaggcagtggttgttcttattatcggatgctgccccggcggcacagcatccaatatcctggcttactgggtggatggagacatggacttgtccgtgagcatgaccacctgctccacactccttgccttgggcatgatgcctctttgcctgttgatctacaccaaaatgtgggtggattccggttcaatcgtgattccctatgacaacattgggacttctcttgtgtctcttgtggttcccgtctccataggtatgttcgtgaatcacaagtggcctcagaaagcaaaaataattctgaagattggatccatcgccggtgcaatattgatcgttctaattgccgttgtgggagggattctctaccagtccgcctggattattgcccccaagctttggatcattgggaccatcttcccggtcgcgggctactcactgggttttctcctggcgaggattgccggtctcccctggtatcggtgtagaacggtagcttttgaaacaggaatgcagaatacccagctgtgctccaccatagtgcagctgtcctttacaccggaagaactgaacgtggtgttcacattcccccttatctactcaatttttcagttagccttcgctgcaatttttttgggcttctatgtcgcttataagaaatgccatggcaagaataaggcagagattcccgagagtaaggagaacggtactgagcctgagtccagtttttacaaagccaacggaggctttcagcccgatgagaaatag

SEQ ID NO: 205550 - DNA, 1434 bp, Artificial Sequence
  Description of Artificial Sequence: Synthetic coding sequence
atggtgctgatgcaggacaagggcagcagccagcagtggcccggcttgggcggagagggcggagggactggaccgcttagcatgctgcgggccgcccttcttctgatcagcctgccatggggagcccagggtacagcatccacctctctgagcaccgctggtggacacactgtgcctcctaccggaggccgttacctgagcattggcgatggcagtgtgatggagtttgaatttccggaggacagcgaaggcattattgtcatatcatctcagtatccgggacaggcaaataggacagcacccggccccatgctgcgagtgacatccctggatactgaggttctcaccatcaagaatgtctctgccatcacttggggagggggtggggggtttgtggtctccatccattccggactggccggtttggcccctctgcacatacaactcgttgacgcccacgaagcccccccgaccttgatcgaggagcgccgggacttttgtatcaaggttagtcctgcagaagacacacccgcgacacttagcgccgatctcgcccatttttctgagaacccaattctatacctccttttaccacttatatttgtgaataagtgctcttttggatgcaaagtggaattagaggtgctcaaaggtctaatgcagagccctcagcctatgttactggggttgctcggtcagttcctcgtaatgccgctatacgctttcctaatggccaaagtttttatgctgcctaaggccctcgcgcttgggctcataatcacatgctccagcccaggtggtgggggctcctacctgttctccttactgctgggcggggacgtgactctggcaatcagcatgacattcctttcgactgtggctgccacaggcttcctgcccttgagcagcgccatctactctaggttgctgagtatccatgagactttgcacgttcccattagcaagattctcgggaccttgctgtttatcgccattcctatcgctgtgggcgtgttgattaagtctaagctgcccaagttttcacagctcctgctgcaggtagtgaaaccgttctctttcgtgttgctcttagggggtctatttcttgcatatcgcatgggcgtcttcatcttagccggcatccggctgcctatcgtccttgtaggaatcacagtgcctttagtgggcctccttgtgggctattgcctcgcgacctgcctaaagttgcccgtcgcgcagagacgaactgtgtcaattgaagtgggggttcagaatagtctactggccttggccatgctgcagctttcactcagacgattacaggccgattatgcctcacaggcgcccttcattgtggccctgtctggtacaagtgagatgctcgcacttgttataggacactttatctattcttcactgtttccagtaccctag

SEQ ID NO: 205551 - DNA, 1347 bp, Artificial Sequence
  Description of Artificial Sequence: Synthetic coding sequence
atggtgctgatgcaggacaagggcagcagccagcagtggcccggcttaggcggggagggcggcggcactgggcctctgtccatgttacgcgctgccctgcttctgattagcctcccctggggcgctcaggggactgcaagtacatcgctgagcacggcagggggccataccgttccacctaccggtggacggtacttgtctataggtgacggctccgtcatggaattcgagtttcctgaagacagcgaagggataatcgtgatctcttctcagtatcccggacaggcaaaccggacggcccccgggccaatgctccgagtaacaagtctagataccgaagtgctgaccataaaaaacctggtcgacgcccacgaggctccacctacgctgattgaggagcggcgagacttttgtattaaggtgagtccagctgaggacaccccagccacactttccgctgacctggcacactttagtgagaatccaatcctctatcttttgttgcctctcatcttcgttaacaagtgtagcttcggctgcaaggtcgagctggaagtgctgaagggacttatgcagagcccccaacccatgttgcttggcctgctggggcagtttctggtgatgccactctacgcctttctgatggccaaggtgtttatgctgcccaaagccctggcactggggttgatcattacctgctcgagtcctggaggcgggggttcatatctgttctccctgctgctaggcggagacgtgaccctggcgatctccatgacattcctctcgacagtggccgcaactggctttctccctttatccagcgcaatctatagtcgacttttaagcatccacgagacactgcacgtcccgatttccaaaattctgggcacactgctcttcatcgccataccgatcgccgtcggcgttctgattaagtctaagctacccaagttctcacagctgctactgcaggtggtcaagccatttagtttcgtccttctcctcggaggtctgttcctcgcttacaggatgggagtctttattctggccgggattcgacttccaatcgtgctggttggaatcactgtgcccctcgttggccttctcgtgggatattgccttgctacatgcctgaagctccccgtggcccaaaggcgtaccgtgagcatcgaggtgggcgttcagaatagcctgctcgctttggccatgctccaactctccctgagaaggctccaggccgactatgcctctcaggctccatttatcgtagccctctctggcacctctgagatgctggccctggttattggacatttcatttattcgtcactcttccccgtaccatag

SEQ ID NO: 205552 - DNA, 1599 bp, Artificial Sequence
  Description of Artificial Sequence: Synthetic coding sequence
atggccggcccccggccccccggcgacagccccgccatcaaggaggattccactggcctgggccccactcatgagccattttctggtcaaccaaacagtacgagtggcgatgttctgctgtcaagaagaggacctgggcacgccatccgccccccagggagagccatggtgctaatgcaggacaagggatcatctcagcaatggcccggcctcggcggggagggtggagggaccgggcccctcagtatgctaagagccgcccttctgttgatctctcttccctggggcgctcagggcaccgcctccacctcccttagcaccgctggtggacacactgtaccccctactgggggccgctatcttagcatcggagatggaagcgtcatggaattcgagttccccgaagactcagaaggaatcatcgtcatttccagtcagtacccaggacaggctaataggacagcccccgggccgatgctgagagtgacatctttagatacagaggtcctgacaatcaagaacgtgtctgccatcacctggggtggcggcggagggtttgtggtgagcattcatagtggactcgcggggcttgctcctctccatattcaactcgtggatgcccacgaagctcccccaactctgattgaagagcgcagggatttctgtatcaaagtgagtcctgccgaagacacaccagcgacactgagtgccgaccttgcacatttctccgaaaatcctatcctatacctcctgctgccacttatttttgtaaataaatgttcctttggttgcaaggtcgaactagaagtactcaagggcctgatgcaatcacctcagcctatgttgctgggactgctgggccagttcctggttatgcctctctatgcgtttctgatggccaaggttttcatgctgcccaaagccctcgcccttggtctcattatcacatgtagctctccaggtggcggtggaagttacttattctctctgctcttgggcggcgacgtgaccctggctattagcatgacattcctaagtacagtggcagccactggtttcctgcccttgagtagcgcaatctatagcagactgctctctatacatgagaccctccatgtgccaattagcaaaattctcgggaccttactgttcatcgcgattccgatcgctgtgggagtattaatcaagagcaagctgcccaagttctcccagctcctgcttcaggtcgtcaaacctttcagttttgttctccttctcggggggctttttcttgcttacaggatgggcgtcttcatccttgctgggattcgattaccaattgtgctggtgggcataactgttccactcgtaggtctcctagtgggctactgtcttgcgacatgcctcaaactccccgtcgcgcagcggcgaacagtgtccatcgaagtcggagtccagaattcactccttgcgctggcaatgctccaactgagccttcggagactccaggccgattacgcatcacaagcgcctttcattgtcgccctgtccggaacgagcgaaatgttggctctggtcatcggtcacttcatatactcctcgttatttccagtcccctag

SEQ ID NO: 205553 - DNA, 1434 bp, Artificial Sequence
  Description of Artificial Sequence: Synthetic coding sequence
atggtgctgatgcaggacaagggcagcagccagcagtggcccggcctgggaggcgaaggaggtggaactggcccccttagcatgctgcgagccgcgctgctgctcatctcattgccctggggggcccagggaacagcgtcaacctctttgtctacagccggtggacacaccgtgccacccacaggtgggcgctatctcagcattggggacggctccgtcatggaattcgagtttcctgaggatagtgaaggcattattgttatttccagccaatatcccggccaagcgaacaggactgcccccggaccaatgttgagagtgacctcgctggatactgaggttctcaccattaagaatgtcagtgctatcacctggggcggcggaggaggcttcgtggttagtatccattccggactagcgggtctggcccctctgcatatccagctcgtggatgctcacgaggctcccccaaccttgattgaggaacgtcgcgatttctgcattaaggtctcccccgccgaggacactcccgcaaccctgtcagccgaccttgctcacttcagcgaaaatcccattctgtatctgctgttgcctttaattttcgtcaataagtgttcatttggctgcaaagtggagctcgaggtcttgaagggccttatgcagagcccacagcccatgttgttgggattgttgggtcagtttttggtgatgcccttgtacgcatttttgatggctaaggtttttatgttacctaaggcattagccttaggtctgatcatcacatgctcttcccccgggggtggcggcagctatcttttttcccttctcctgggcggggacgtcactctggctatttccatgacttttctaagcaccgtggcggcaactggctttctgcccctgagcagtgccatctattcccgcctcttgtctatccacgaaaccctgcacgtaccaatcagcaagattctgggaacacttctgttcatcgccatcccaatagcagtcggggtcttaataaagtcaaaactgccaaagttttcacagctcctgttgcaggtggtcaaacccttctcttttgtgctcttgctcgggggcctttttctggcctacagaatgggggtgttcatactggcaggcatacggttaccgattgtgctggttgggatcaccgtccccctcgtgggcctgctggtgggctactgtctggcaacatgtcttaaactgcctgtcgctcaaaggcgtactgtctcgattgaggttggagtgcaaaattctctactcgctctggccatgctacagctaagcctgcgcagacttcaggctgattatgcctctcaggcacccttcatagtggcacttagcggtacaagtgaaatgctcgccttagtcatcggccacttcatctactcttcgctgttccctgttccatag

SEQ ID NO: 205554 - DNA, 657 bp, Artificial Sequence
  Description of Artificial Sequence: Synthetic coding sequence
atggtgctgatgcaggacaagggcagcagccagcagtggcccggcctgggcggggagggtggcgggactgggccactttctatgcttagagcggccctgctgctcatctcccttccctggggggctcagggaaccgcgtctacatctctctctacagccggggggcatacggtgccacccaccggtggtcggtacttaagcataggcgatggaagtgtaatggaatttgagtttcctgaagacagcgaaggtatcattgtgatcagttctcaataccccgggcaagccaacaggactgcccccgggcccatgctccgtgtgactagtctggataccgaggtactgaccatcaaaaatgtttccgctattacctggggcggagggggtggtttcgtggtgagcatccacagcggcctagctggcttagcgccactccatatccagttggtcgacgcccatgaagcacccccaactttgatcgaggagaggagagatttctgcataaaagtcagccctgccgaggatactcccgccacactgagtgccgacctggcacacttttccgaaaaccccatattgtacctgctattgccgttgatatttgtcaataaatgctcctttggatgcaaggttgagctcgaagtgctcaagggttag

SEQ ID NO: 205555 - DNA, 1314 bp, Artificial Sequence
  Description of Artificial Sequence: Synthetic coding sequence
atggacggcaacgacaacgtgaccctgctgttcgcccccctgctgcgcgacaattacacactcgccccgaatgcaagcagcttgggacctgggacagatctggcgttggctccagcaagctccgccggaccaggccccgggttgtccctcggcccgggtccatcgtttgggttttcacccgggccaacacctaccccggaacctaccaccagcggattggctggcggcgctgcctcccacggtccctcccctttcccccgcccgtgggccccgcacgctttacccttttgggacactcctttaaatcacgggttaaacgtcttcgtgggagctgcactgtgtatcaccatgctgggtttgggctgtacagtggatgtcaaccattttggagcccatgtacgccgtcctgtgggcgccctgctagccgccctgtgccagttcggcctcctccctctgttagcgtttctgttagctcttgccttcaaactggacgaagtggcagctgttgcagtgctgctgtgcgggtgctgtccaggcggtaacctatcgaaccttatgtccctgctcgttgacggggatatgaacctatctatcatcatgaccatctcatctacactgctggctcttgtgttaatgcctttgtgcttatggatctatagctgggcctggatcaacacgcctatagtgcaactgctaccattgggaaccgtgaccctgacgttgtgtagtacattgatacctattggcttgggagtgtttatccgttataaatacagcagggtcgctgattatatcgtaaaagtgtccctgtggagcctcctggtgacgctggtagttctgtttattatgaccgggaccatgcttggccccgaactactggcttctatcccagccgctgtttacgtgatagccatattcatgccgctagccggctacgctagtggatacggtctggccaccctgtttcatttgccccctaactgcaagagaacagtttgtcttgagacgggttcccagaacgtgcagctctgtactgccatcttgaaactggctttccccccccagttcatagggagcatgtacatgttccccctcctttacgctttatttcagtccgccgaggccggcatcttcgtgctgatatataagatgtatggctctgaaatgttgcacaaacgggaccccctggacgaggatgaggatactgatatcagctacaagaagctcaaagaagaggagatggccgacactagctacggaactgtgaaggcggagaatatcatcatgatggaaacagctcagacttctctgtag

SEQ ID NO: 205556 - DNA, 1134 bp, Artificial Sequence
  Description of Artificial Sequence: Synthetic coding sequence
atgcgggccaactgcagcagcagcagcgcctgccccgccaacagctccgaggaggaactccccgttggactggaggttcatggcaatttggagttggtgttcaccgttgtgagtacggtgatgatggggctgctgatgtttagcctggggtgtagtgtcgagatcaggaagctctggtcccacatccgtagaccatggggcatcgccgtggggctcctttgtcagttcggtttgatgccctttacagcttacctcttagcaatatccttttctttgaagccagtgcaagccatcgcagtgctgataatggggtgttgccctggtggtacaatttcaaacatttttacattctgggttgacggtgatatggacctctcgatctcaatgactacttgttctactgttgccgctctcggcatgatgcccctatgtatttacctttacacctggagctggagcctccaacagaatttgaccattccctaccagaatataggtataacacttgtgtgcctcacaatacccgtggcatttggcgtttatgtcaactatcgctggcccaaacagtcaaagatcatactgaaaattggcgccgtggtcgggggagtacttctgcttgttgtggccgtggcgggagtagtgttggccaagggtagctggaactcagacatcacactgctgactatctcatttatattccctctgatcgggcatgtcacagggttcttactggcattgttcacacaccagagttggcagcggtgtcgcacaatcagtttagagactggagctcaaaatatacagatgtgcatcacgatgctgcagctctcctttactgccgagcacctagtgcaaatgttgagctttccccttgcttatggcttattccagctgatcgatgggttcctcattgtggccgcgtatcagacctacaaacgccggctgaagaacaagcacggaaagaaaaactccggttgcacggaggtttgtcatacacgcaagtctacttcttctcgggagacaaatgcttttctcgaagtgaacgaagaaggagccattacaccaggcccccccggtcctatggactgtcatcgagccctagaacctgtcggtcacatcacatcgtgtgaatag

SEQ ID NO: 205557 - DNA, 2184 bp, Artificial Sequence
  Description of Artificial Sequence: Synthetic coding sequence
atgctgcggatccccgtgcggaaggccctggtgggcctgagcaagtcccccaagggatgcgtgcgcacaactgcaacggccgcgtcgaatctgattgaagtctttgtcgatgggcagagcgtgatggtggagcccggaacaaccgtgcttcaggcctgcgagaaggtgggcatgcagatcccacgcttttgttatcatgaacgtctgagcgtcgctggcaattgtaggatgtgtttggtcgagatcgaaaaagcacctaaggtggtggcagcctgcgcgatgccggtaatgaaaggctggaacattctcactaactcagaaaaaagcaaaaaggcgagggagggagtgatggaatttctactcgctaaccaccctctcgattgccctatttgcgaccagggcggcgaatgtgatttgcaggaccagagtatgatgttcgggaacgaccgtagcaggttcttggaggggaagagggccgtggaggacaagaacatcggccccttggttaagacgataatgactcggtgcattcagtgcacaaggtgtatacggttcgccagcgagatcgccggtgtcgacgatctgggtacaacagggcgaggtaatgacatgcaggtcggtacatatatcgagaaaatgttcatgtcagagctttctggtaacatcattgacatttgtccagtgggcgctctcactagtaaaccgtacgcattcaccgcccgaccctgggagacccgcaagacagagagcatcgacgtgatggatgctgtggggagcaatatcgtggtgagtaccaggactggtgaggtgatgcgtatccttccacgcatgcatgaggacataaacgaggaatggatttctgataagactagattcgcctacgatggccttaagcgacagcgcctaacggagccaatggtgaggaacgagaagggactgcttacctatactagctgggaggatgctctgtctagggtcgccggaatgctgcagtcctttcagggcaaggatgtggccgctattgccggtggactggtggacgctgaggcactcgttgccctcaaagacttactcaacagagtggacagcgacaccctatgcaccgaggaagtgttcccaaccgcaggtgcaggtaccgatctgagatccaattacctgctgaacactacgattgccggggtcgaagaggccgacgtcgtattactcgtgggcaccaaccctaggtttgaggctcctctctttaacgcccgaattaggaagtcttggctccataatgacttgaaagtggctctcattggctcgccagtggacctgacctacacatatgatcacctcggggacagccccaaaattctgcaggacattgcatcaggatctcacccattctcgcaggtgttgaaggaagctaaaaaacctatggtggtactgggcagttcagccctgcagaggaacgacggagctgccattctagcggccgtatcttcgatcgcccagaagatcaggatgacctccggagtcaccggcgattggaaagtgatgaatattctgcataggatcgcgagtcaagtggcggcactggacttggggtacaaacctggagttgaggccatcaggaaaaatcctccaaaggttctcttcctactgggggccgacggcggctgtatcactaggcaggacctcccaaaggattgttttataatataccaaggacatcacggggacgtgggagccccaatcgcagatgttatcctacccggagctgcttatactgaaaagagcgcaacctacgtgaacaccgaagggcgagcccagcagactaaagttgccgtgactccccccgggctggcacgggaagattggaagataatacgtgctctgagtgaaattgcaggcatgactttgccctatgacacgttagaccaagtaagaaataggctcgaggaagttagtccaaatctggtgcgctacgacgatattgagggtgcaaattatttccagcaagccaatgaacttagcaaactcgtaaaccagcagctgctcgcagacccgctggttccaccccagctgacaatcaaagacttctacatgactgattcaatttcccgggcatcacaaactatggcaaaatgtgtcaaagcagtgactgaaggcgcccaagccgttgaagagccctccatctgttag

SEQ ID NO: 205558 - DNA, 492 bp, Artificial Sequence
  Description of Artificial Sequence: Synthetic coding sequence
atgaccggcgacaagggcccccagcggctgagcggcagcagctacggctccatcagttcccccactagcccgacttctcccggaccacaacaggctccaccgagggagacatatctatccgaaaaaatccccattcctgacaccaaaccaggtacgttcagtctccgtaaactttgggcgttcacggggccggggttccttatgagtatcgcatttctggacccgggcaacatcgagtcagacttgcaggccggggctgtggcaggattcaagttgctgtgggtgctgttatgggccacagttctcggtctgctctgccaacgattggccgcgcggctgggggtggttacgggaaaggatctgggagaagtctgtcacctgtactatccgaagagcgagtctcggagcgtggctcagagcggtgttcagtggtgtgatgtgtccagtttacagcctttacctccaaggtgtccagccccctccagtgggtag

SEQ ID NO: 205559 - DNA, 1299 bp, Artificial Sequence
  Description of Artificial Sequence: Synthetic coding sequence
atggtgcggtgccagctgaccgccaccagcaccagccaggtgcccagaacggttctctggttgaccatagagcttgccatcgttggaagcgatatgcaggaggtcatcggcacggccatcgcctttaatctcctttccgccggacggatacctctgtggggaggggtgctgatcacaattgtagatacatttttcttcctctttttagacaactatggcctgcgcaaactggaagctttctttggcctcttaatcactataatggccctcactttcggttacgaatatgttgtggcccggcccgaacagggagccctgctgcgcgggctgttcttgccaagttgcccaggatgtggacatcccgaattgctgcaggctgtgggcattgttggcgcaattattatgcctcacaatatttacctccatagtgcactggtgaaatctagagagattgaccgggcaaggcgcgctgatatacgcgaagctaacatgtactttctaatcgaggcaactatcgccttaagtgtttcttttattatcaatctcttcgttatggctgtgttcggccaggccttttatcagaaaacaaaccaggcagcctttaacatctgcgcgaacagctctctgcatgattatgcaaagatcttcccgatgaacaatgcaacggtagctgtggatatctaccagggtggggtgattttgggatgtttattcggaccagctgccctgtatatatgggccattggactgctggctgctgggcagtccagcaccatgacgggcacctatgcagggcaattcgttatggagggctttttgagactgcggtggtccagattcgcccgcgtcttactgacacgctcctgcgccatcctgccgacggtgttagtggccgttttccgcgatctgcgggacctcagtggattaaacgacctgctgaacgtgctccagtctttgctgcttcccttcgcagtgctccccattctcacttttacctcaatgcccactctaatgcaggaattcgccaacggattactgaataaggtggtgacctcttccattatggtcctcgtctgcgccatcaatctgtacttcgtggtgtcctacctcccctcattgcctcacccagcctacttcggccttgcagcattgctcgcagcagcatatctgggccttagtacctacttggtttggacttgctgcctggctcacggcgcaacttttctagcccactccagtcaccaccatttcctgtatgggctgctcgaagaggaccagaaaggagagactagcggctag

SEQ ID NO: 205560 - DNA, 3351 bp, Artificial Sequence
  Description of Artificial Sequence: Synthetic coding sequence
atgctgaacaacctgaccgactgcgaggacggcgacggcggcgccaacccaggggacggtaatccaaaagagtcctccccctttatcaacagcaccgacactgaaaagggcaaggaatacgatggcaaaaatatggctcttttcgaggaggagatggataccagtcctatggtatcctcactgctgtcaggactggcaaactacaccaaccttcctcaaggctcacgagaacacgaggaggccgagaataatgaggggggtaaaaaaaaacctgtgcaggcgcccaggatgggcacttttatgggagtctacctcccgtgtctgcagaacatcttcggcgtgatcctcttcttacggctgacttgggtcgtgggaatcgcgggtattatggaaagcttttgcatggtgttcatttgttgctcttgcaccatgctcactgctatttcaatgagcgcgattgccactaatggcgtggtgccagcaggcggcagctattacatgataagtagaagcctcggccccgagttcggaggtgccgtcggtctctgtttctatttgggcactaccttcgcgggtgctatgtatatcctgggtactatagagattctgctcgcctaccttttcccagctatggcgatttttaaggctgaagacgcgtcgggcgaagccgcagccatgctgaacaacatgcgtgtctatggaacttgtgtgttgacatgcatggccactgtcgtgttcgtgggagtcaaatacgttaacaagtttgccctcgtgttcctgggctgcgtgattctgtcaattctcgccatatatgctggggtcatcaagagcgcctttgaccctccgaacttcccgatttgcttgctggggaatcggactctgtcacgtcacggatttgatgtgtgtgccaagctcgcctgggaagggaacgagaccgttacaacaaggctctggggactgttttgcagcagccgtttcttaaatgctacctgtgacgagtatttcaccagaaataatgtgaccgagattcaaggaataccaggcgctgcctccggcctcattaaggagaatctgtggagctcataccttaccaaaggggtcattgtagagcggagcggtatgacttctgtagggctagcagatggcacccccatcgatatggaccacccatacgtgttcagtgatatgacatcatacttcacactgctggtgggcatttattttccatctgtgacaggtattatggctggctccaatcgctcaggtgacctccgggatgcccagaaatccatccccactggcacgatacttgctattgcaaccactagtgcagtttacatttcctctgtggtccttttcggcgcctgtatcgaaggagtcgtcctgagagacaagtttggcgaggccgtgaatggcaatctggtggtgggcaccctggcctggcctagcccgtgggtcatcgttattgggtctttcttcagcacctgtggggctggcctgcagtctctgacaggcgccccacgacttctgcaggccataagccgtgacggcattgtcccttttttgcaggtgtttggacacggcaaggcaaatggtgagcctacgtgggccttgctgctgactgcctgcatctgtgagatagggattctcattgcaagtctcgacgaggtcgcacctatccttagcatgttttttttgatgtgctatatgttcgtgaatttagcctgcgccgtccagactctcttaaggacccccaactggcggcccaggtttcggtactatcactggaccctttcatttctcggcatgtcactgtgtcttgccttgatgtttatttgcagctggtactatgcccttgtggcaatgctcatagcaggcttgatctataaatatattgagtatcgcggagcagagaaagaatggggggatggaatccgcggcctgtccctctccgccgcccggtacgccctgctgcgccttgaggaagggccacctcacacaaaaaactggcgccctcaactgttagtgctcgtacgtgtcgaccaagatcagaatgtggtccatccccagcttctgagtttgacctcgcaattgaaagcagggaagggattaacgattgtggggagtgtactcgaaggtactttcctggagaaccatccccaggcccagcgcgcagaggaaagtatccgtaggctaatggaagctgaaaaggtgaaaggattctgtcaggtggtgatcagtagcaatttacgggacggggtatctcatctcattcagtccggaggacttgggggcctgcagcataacacagtgttggtcggttggccaagaaattggagacagaaagaagatcatcagacatggaggaatttcatcgagctcgtgagggagaccacagcggggcatctggccctcctcgtaactaagaacgtcagtatgttcccaggaaaccctgaacgcttctctgagggatcgattgatgtgtggtggatcgttcatgacgggggtatgctcatgctgttgccatttctcctgcgccaccacaaagtgtggagaaagtgcaagatgaggatattcaccgtggcccagatggatgacaatagtatccaaatgaaaaaggacttgactacgtttctctaccatttacgtatcactgccgaggtcgaggtggttgagatgcacgagtcagacattagtgcttacacctacgaaaaaacacttgtgatggaacaacgtagccagatcctgaagcagatgcacctcactaaaaacgaaagagagcgggagattcagtcgattactgacgaaagcaggggaagtatcagacgcaaaaaccctgctaacacccgcctgcgtctgaatgtacccgaagagactgccggagattccgaggagaagcctgaggaagaggtccaattgatccacgaccaatccgcgcctagctgccctagttcctccccctctcctggggaagaaccagagggcgagggggagacggatcctgagaaagttcaccttacttggacaaaggacaagtctgtagcagagaagaacaaaggccccagtcctgtgagctctgagggaataaaagattttttcagtatgaaacccgaatgggaaaatttaaaccaatcaaatgtgagaaggatgcatactgctgtacggctgaacgaggtgatcgtcaagaagtcccgtgatgccaagttggtgctgcttaatatgcctgggcccccacgtaacagaaacggagatgaaaactatatggagttcctggaagttctcaccgagcacctcgatcgggtgatgctggtacgcggcggagggagagaagttattaccatctactcatag

SEQ ID NO: 205561 - DNA, 858 bp, Artificial Sequence
  Description of Artificial Sequence: Synthetic coding sequence
atgctgaacaacctgaccgactgcgaggacggcgacggcggcgccaaccctggcgatggaaatcccaaagaaagttcaccatttatcaattcgacggatactgagaaaggaaaagagtacgacggcaaaaacatggccctgtttgaggaagagatggatacatctcctatggtttccagcttgctgtcaggcttggccaactacactaacctcccccagggcagccgggagcatgaagaagccgagaacaatgagggaggcaaaaaaaagcccgtccaagcacccagaatgggcaccttcatgggggtttacttgccctgcctgcagaatatttttggggtgatcctgtttctgaggttaacatgggtggtcggcatcgctgggatcatggagagcttctgcatggtttttatctgttgctcgtgcactatgttgactgccatctcaatgtccgcaatcgccaccaacggtgtagttccagctggtgggtcgtactacatgatttcccggagcttaggccctgagttcggaggcgcagtcgggttgtgcttttatctaggtacaacctttgccggggccatgtacatccttggcaccatagaaattctcctcgcatacttatttccagccatggcgatattcaaagcagaggacgcaagtggcgaggccgcagcaatgctgaataatatgagagtgtacggcacttgcgttctgacctgcatggcaactgtggtgttcgtcggcgtcaagtacgtgaacaagtttgctctcgtattcttgggatgtgtaattctgagtatcctggccatctatgccggtgtgatcaagtcagccttcgaccctcctaatttcccctag

SEQ ID NO: 205562 - DNA, 3420 bp, Artificial Sequence
  Description of Artificial Sequence: Synthetic coding sequence
atgagccggcggttcaccgtgaccagcctgccccccgccggccccgcgaggagccccgatcctgagtccaggcggcactctgttgctgatcctagacatctgccgggtgaggatgttaagggggatggaaacccaaaagagtccagcccctttataaattcaactgatactgagaagggcaaagagtatgacggcaagaatatggctctgtttgaagaagaaatggatacctcacctatggtgtcctccctgcttagcggcctcgctaactatactaatctgccacagggatcccgggagcatgaggaggcggagaacaacgagggaggcaaaaagaagccagtccaagccccacgaatgggtactttcatgggcgtatacctgccgtgtctgcagaatattttcggggtgattctctttctgcgcctgacatgggtcgtgggaatcgctgggattatggaaagcttttgcatggtgttcatttgctgcagttgcactatgctgaccgctatcagcatgtcagccatagccactaatggggtcgtgccagctggggggtcgtactacatgatctctcgatcccttggccctgaattcggtggggctgttgggttatgtttctacctgggaactacctttgccggggcaatgtatatcctcgggaccatcgagatcctgctggcctacttgtttcccgccatggccatcttcaaggccgaggatgcttcgggagaggccgctgccatgttaaataatatgcgcgtttacggaacctgtgtactcacttgtatggctaccgtggtgtttgtgggggttaagtacgtgaacaagttcgccctcgtgttcctgggttgtgtgattctgtctatcctggccatctacgccggggtcattaagagcgcctttgatcctcccaacttccccatatgcttgcttggcaaccgcacactctcacggcatgggttcgacgtttgcgctaaactggcgtgggaggggaacgagacagtcaccacaaggctgtggggtctgttctgctcaagcaggtttttaaacgccacctgtgatgaatactttacacggaacaatgtgacagaaattcaggggattcctggcgcagccagcggcttgatcaaagaaaatctttggtcctcgtacctgacaaaaggcgttattgtggagcggtccggaatgacaagtgtgggactggccgatggcacccccatcgatatggatcatccttacgtgttctccgacatgactagttattttaccctattggtgggcatctatttccctagtgtcacaggcatcatggccggctcaaacaggtcaggagatcttcgggacgctcagaaatctatccccacgggcaccatcctggctatcgctaccacgtccgccgtttacatctcttcggtcgtgctctttggggcctgtatcgaaggggtggtcctcagggacaagtttggggaggccgtcaacgggaacctggtggtggggaccctggcatggccttccccttgggtcattgtgatcggatcctttttctctacgtgcggcgccggtctgcagtccctgaccggggcacctcgccttttgcaggccatttctagggatgggatcgttcccttcctccaggtgtttggccacggcaaagccaatggcgaaccaacatgggccctactgcttaccgcctgcatctgtgaaattggcattctgatagctagtttggacgaagtcgcccccatcttgtccatgttctttttgatgtgttacatgtttgtcaatctagcttgcgcggttcaaaccctcctacggacgccaaactggagaccacggtttagatactaccactggacgctgtcgttcctgggaatgtcactgtgcctcgccctcatgttcatctgctcctggtattatgccctggtggcaatgctcattgccggcctgatttacaagtacatagagtatcgtggggccgaaaaggagtggggtgatggcataagaggcctgtctctatccgcagccagatacgccttactgcgacttgaagaaggcccccctcatactaaaaactggaggccgcaactccttgtgctggtgcgagttgatcaggaccaaaatgtcgtgcatcctcaactgctgtctctcacaagccagctgaaagccggtaagggcctgaccatcgttggcagcgtcctggaagggacattcttggaaaatcaccctcaggcgcagcgtgccgaggagagcatccggaggctcatggaagctgagaaggtgaagggcttctgccaggttgtcatttccagcaacctgagagacggagtttcccatctgatccagtccggtgggttgggcgggctgcagcacaacacagtactggtgggatggcctcgcaactggcgacaaaaggaagatcaccagacttggcgtaattttatcgagctcgtgcgcgaaaccaccgctggccacctggctctcttggtgaccaaaaacgtcagcatgtttccaggaaacccagaaaggtttagcgagggttccatagatgtgtggtggatagtgcacgacggcggaatgctgatgctgctaccattcctgctccggcaccacaaagtttggaggaagtgtaagatgcggatctttactgtggcacagatggacgataactcaatccagatgaaaaaagatttgaccacttttctttaccacctgcgtatcaccgccgaggtggaggtggtggagatgcacgagtcagacatttcagcctatacatacgaaaaaacccttgtcatggagcagcggagccagatcctgaaacaaatgcatctcactaagaatgagagggaacgggagatacagagcatcactgacgaatcccggggcagcatccgcaggaagaatcctgccaatacccgacttagattgaatgtacccgaagaaacagctggcgactctgaggagaagcctgaagaggaggtccaactgattcatgatcagagtgcccctagctgccctagctccagtccatcccctggcgaggaaccggagggggaaggtgagaccgatcctgagaaggtgcatctgacgtggacaaaggacaaaagcgtggcagagaagaataagggccccagcccagtctctagcgaagggattaaagatttcttttcaatgaagccagaatgggaaaaccttaatcaaagtaacgtgcgtcgaatgcataccgctgtgaggctcaatgaggtcatcgtgaaaaagtccagagacgccaaactggttctgctcaacatgcccggaccaccaaggaataggaatggagacgagaattatatggaatttcttgaggtcctgacagagcatctggaccgcgtgatgctggtgcgaggcggcggacgagaggtgattaccatttacagctag

SEQ ID NO: 205563 - DNA, 561 bp, Artificial Sequence
  Description of Artificial Sequence: Synthetic coding sequence
atgctgaacaacctgaccgactgcgaggacggcgacggcggcgccaacccaggggatggcaacccaaaagagagctccccctttatcaacagcacggacactgagaagggtaaagaatacgacggcaaaaatatggcactctttgaggaagagatggatacaagccctatggtgtcaagtcttttgagcggactagcgaactatacaaatttacctcaggggagcagggagcacgaggaggccgagaataatgagggcggaaagaagaagccggtccaagcccctagaatggggacctttatgggagtctatcttccttgccttcagaatattttcggcgtaattttgttcctgagattaacttgggtggtaggtatcgcaggtatcatggagtcgttctgcatggtgtttatttgctgcagctgcacgatgcttaccgcaataagtatgtccgccattgccacaaacggggtggtccccgctggaggaagctattacatgatcagtagaagccttgctatggctaggcctatggagtcaagaccaggaccctgctcttag

SEQ ID NO: 205564 - DNA, 3258 bp, Artificial Sequence
  Description of Artificial Sequence: Synthetic coding sequence
atgccccacttcaccgtggtgcccgtggacggcccccggcggggcgattacgacaatctcgaaggacttagttgggtggactacggagaacgggctgagttggatgactcggatggccatggaaatcaccgcgagtcatctcccttcctgagtcctctggaggcttcccggggcattgactattacgatcgtaacctcgcactgtttgaagaagagttggacatccgaccaaaagtgagtagcctgcttggcaaattagtttcttacacaaatctgacccagggagccaaggaacatgaagaggcggaaagcggggagggaactagaaggcgcgctgcggaagcaccaagtatgggcacacttatgggtgtttatctcccttgcctccagaacatattcggagtcattctttttctgcggctcacctggatggtgggcactgccggagtgctccaggccctgctgattgtgctcatttgctgctgctgtactctgttaacagctatctccatgtccgccatagccacgaatggtgtagtgcctgccggcggaagttattttatgatctcacgaagcctaggccccgagttcgggggggccgtcggcctgtgcttttatctgggtacgaccttcgccgccgcaatgtatatcctcggagccatagagatcctgctcacgtacatcgcaccgccggcggctatcttttacccttcgggcgcacatgacacttccaacgccacccttaataatatgagagtctacggaaccatatttcttacttttatgacactggtggtctttgtcggagtcaaatatgtcaacaagttcgcctccctgttcctagcgtgcgtcatcatttccattcttagcatctatgctggcgggatcaagtcaatctttgacccccctgtttttccagtgtgtatgctgggaaacaggaccctctcacgcgatcagttcgacatttgtgcgaaaacagctgtggtggacaacgaaaccgtggcaacccagctgtggtccttcttctgtcattctcccaatctgaccacggacagttgtgacccatactttatgctcaacaatgtgacggagattccaggcatcccaggtgctgctgccggagtgctgcaggagaatctttggtctgcgtacctggaaaaaggagacatagtagagaagcacggactgccaagcgccgatgcaccaagcctcaaagagtccctgccactctacgtagtggccgatatcgcaacctccttcactgttcttgtggggatttttttccctagcgtgactgggattatggccggctcgaataggagcggcgacctgcgggacgctcagaaatccatcccggtgggcacaatcctcgccatcatcacaacatctctggtgtatttctcctccgtggtacttttcggtgcctgcatcgaaggcgtggtgctgagggataagtacggcgatggagtctcacgtaacctcgtggtcggaacactggcttggcctagtccatgggttattgttatcggtagttttttctccacctgcggagctggcctgcagtctcttacaggagcccccagactactccaggcgattgcaaaggataacatcatccccttcttgagggttttcggacacggaaaagttaacggcgagcccacatgggcactcttgctcactgcgctgatcgctgagctgggcatcctgattgcttctctggatatggttgcaccaattctttccatgttctttcttatgtgttatctgttcgtgaaccttgcttgtgctgtccagacattgctgagaactcccaactggaggcctagatttaagtattatcactgggctttgtcatttctcggcatgagcctctgcctggctctcatgttcgtaagcagttggtattatgctctggtcgccatgctcattgccggcatgatctataagtacatagaataccaaggcgccgagaaagagtggggcgacggaattagaggattaagtctctctgcagcaaggtacgcccttctcagactggaggagggaccaccacacaccaagaattggaggccacagctcttggtgctgctgaagcttgacgaggacctgcacgtcaagtacccacggctgctgaccttcgcaagccagctaaaggccggtaaaggcttgaccattgtcgggtcagttatccaagggtcatttctggagtcctatggcgaggcacaagccgccgagcagacaattaagaacatgatggaaattgagaaagtcaaagggttctgtcaagtggtggtggctagcaaagttagagaaggattagcacacctaattcagagctgcgggctcggagggatgaggcataacagcgtggtgctgggatggccctatgggtggagacagtcagaagacccccgggcttggaagacatttattgacacagttaggtgtacaactgctgcacacctcgctctgctagttcccaaaaatatcgcattctatccttcgaatcatgaacggtatttagagggccatatcgacgtatggtggattgtccacgacggcggcatgttaatgttgctgccctttcttctccggcagcataaagtgtggcgcaagtgtcggatgagaatctttactgtggcacagatggatgataattctattcagatgaagaaggatcttgctgtgttcctctatcacctgcggctggaagcagaggtggaagtcgtggagatgcacaacagtgacatatccgcgtacacttacgaacgaaccctgatgatggaacagcgttcacagatgctcaggcagatgcggctgacaaagacagagagggagcgtgaggcacagcttgtgaaggaccgccatagtgcattgaggctggaatccctgtactccgatgaagaagacgaatctgcggtcggagcagataagattcaaatgacctggacaagagataaatatatgacagaaacatgggacccctcacacgcccctgacaatttccgcgaactggtgcacatcaaacccgaccaaagcaacgttaggcggatgcatacagccgtgaaactgaatgaagttattgtgactcgctcccatgatgccagattggtcctgcttaatatgccggggccccccaggaacagcgagggtgatgagaattatatggagttcctcgaggttctgactgaggggctagaaagggtgttgctagttcggggggggggccgcgaggtcatcacgatatacagttag

SEQ ID NO: 205565 - DNA, 2343 bp, Artificial Sequence
  Description of Artificial Sequence: Synthetic coding sequence
atgccccacttcaccgtggtgcccgtggacggcccccggcggggcgattacgataatctggaaggcctgtcttgggtagattatggagaacgagcagagttggatgatagtgacgggcatgggaaccatcgggagagttctccttttttgagcccactggaagcctcacgcggaatcgattactatgatagaaacctggcactgttcgaggaggagttagacatccgccccaaagtgtcctccctgttgggaaagctagtgtcctatacgaacttgacccagggtgccaaggagcacgaggaagccgagtcgggagaggggacccgccggagagcggctgaggctccaagtatgggaacgcttatgggcgtgtatctcccttgcctgcagaatattttcggagtgattttgtttctgcgtcttacatggatggtcggtaccgcaggcgtgcttcaggcgctgttgatcgtgttaatatgctgttgctgcacgctccttacggctataagcatgtccgctatcgcaacgaatggtgtggtacccgccggcggatcctatttcatgatttctaggagcctggggccggagttcggaggagcagtgggcctgtgtttctacctaggcaccaccttcgctgccgcaatgtatatcttgggagccatcgagatcttactgacctacattgcgccaccagcagccatcttttatccgtcaggcgcacatgataccagcaacgctacgctgaacaacatgcgggtgtatggcaccatcttcctgacattcatgaccctggttgtgttcgtgggtgtgaaatatgtgaataaattcgctagcctattcctggcctgcgtgatcatctctatcctgtccatttacgccggggggatcaagtctatattcgatccccccgtcttcccagtgtgtatgctcggaaatagaactttgtccagagaccaattcgatatttgcgcaaagactgctgtggtggataacgaaacagtcgcaacccagttatggtcttttttctgccacagccccaatcttactacggacagttgcgacccttattttatgctaaataacgtaacagagattcccggcattccaggggccgccgccggagttctgcaggagaatttgtggagcgcttatctggaaaagggagacattgtcgagaagcacggattgcctagcgctgacgctccctcgttgaaagagagtctgcccctgtacgtggttgccgacattgcgacaagctttaccgtgctggtgggaattttctttcccagcgtgacgggaatcatggctggaagcaatcgttccggcgacctgagagatgcccagaagtccatcccggtaggcactatcctggctatcattaccacgagtcttgtgtacttttcctcagtggttttgttcggggcatgcattgaaggcgttgttctaagggacaaatacggggatggagtgtctagaaacctggtggtggggactctcgcatggccctctccctgggtgatcgtgatcggatctttttttagtacttgtggtgccggactccaaagtctgaccggggccccaaggttattgcaggccattgctaaggataatattatccccttcttgcgcgtgttcgggcacggaaaagtcaatggagagcccacatgggccttgctgctcacagccctgattgcagaactcggtatattgatcgctagtctggacatggtggcaccgatcctgagcatgttttttcttatgtgctatttattcgtgaatcttgcctgtgccgtgcagaccctgttgcgaacaccaaattggagaccaagattcaaatactaccactgggccttgtcctttctgggtatgagcctttgcctggctctgatgtttgtgtctagttggtactatgcgctcgtcgccatgcttattgctggcatgatttataagtacattgaatatcaaggtgctgaaaaagagtggggagatggcattcggggccttagccttagcgccgccagatacgctctgcttcggttggaggagggccccccccacacaaaaaactggaggccacagctcttggttctcctgaagctcgacgaggacctccacgtcaaatacccccggctgcttacattcgcctcccaactaaaagccgggaaaggtctcaccatagttggttccgtcatccagggctccttcctggagtcctatggtgaagctcaggctgccgagcagacgccttgcgctgctttgagactgcccacttggccgtgctcatgccccagaacatctccgtctactccagcaaccacctccgccacctggcgagcgacctag

SEQ ID NO: 205566 - DNA, 3264 bp, Artificial Sequence
  Description of Artificial Sequence: Synthetic coding sequence
atgcgggccggcggcgcctgccggcccggcgccgccggcaccgccgctgggactgctgctggcggatgggacggcggctgtggcggcgctgagcccgccagatgtttgaccagcccctggtgccagtggactgggcgcggcgcggccacaatgactaccagccgcggcagcgtgggctggacgaccgggagcgcaccttcctggatgactcggacagaagagttagatattcgccccaaagtttccagtctgctgggcaagcttgtctcttatacaaatctgactcagggtgcaaaggagcacgaggaagccgaatcgggcgaggggacacgtcgccgtgcagccgaggctcctagcatgggcacgctcatgggggtgtaccttccgtgtctccagaatatcttcggcgtgatcctgttcctgagactgacgtggatggtgggtacggccggtgtgctgcaggccctgctgattgtcctgatctgttgctgttgtaccctactgaccgccatttcaatgtctgcaatagccactaatggcgtggtcccggccggcggctcctatttcatgatcagtcgtagcctgggtcccgaatttgggggtgccgtaggtctgtgcttctatctcggcaccactttcgctgcggcaatgtacattctgggggccattgagatactcctgacctatatcgctcccccagctgctatcttctatccttccggggcccacgacactagtaacgctacactcaataatatgagggtatacggcaccatcttcctcacattcatgaccctggtggtgtttgtcggcgtcaaatatgtaaacaaatttgcaagtctcttcctggcctgtgtcatcatctctatcctcagcatctatgccggaggcattaaaagtatcttcgacccgcccgttttcccggtgtgtatgttaggaaacaggaccttgtctagggatcagttcgatatctgcgcaaaaacggccgtcgtagataatgaaacggtcgccacacagctgtggagtttcttttgccactccccaaacttgactaccgacagttgtgacccctattttatgctgaataatgtgacggagataccaggtattccaggggccgccgccggcgttcttcaggaaaatctttggtccgcctacctcgaaaagggtgacatcgtggagaagcacggcctgcccagtgctgacgccccatcgctaaaggagagcctccctctgtatgttgtagctgacatagctacgtcatttaccgttctagtcggcatcttctttccgtccgtgaccggaataatggcgggaagcaacagatccggcgatctcagggacgcccagaagagcattcctgtggggactatactggctatcattacaaccagcctggtttatttctctagcgtggtcctcttcggagcttgcatagaaggtgtagttttgagagacaaatacggcgatggagtcagtagaaatctggtcgttggcacccttgcttggccttccccctgggttattgttatcggcagctttttcagtacttgcggagccggcctgcaatctctgaccggagctcctcgcctactgcaggctattgcaaaggacaacattatccctttccttcgcgtgtttgggcatggaaaagtgaatggcgagcccacttgggcactgcttctaaccgcacttatcgctgaattgggcatactgatcgcttcactggacatggtcgcccctatactgagcatgttctttctcatgtgctacctgtttgttaatctcgcttgcgcagttcagactctgcttcggactccaaattggaggccccgttttaaatactatcactgggcgctttcattcttgggtatgagtctttgcttggctctgatgtttgtgtctagttggtattacgccctagtggctatgcttattgcaggaatgatctacaaatacatcgagtaccagggggccgagaaagaatggggtgacgggatcaggggtctgtccttgtccgccgccagatatgctctcctccggctcgaggagggtccaccacacacaaagaactggcgcccccagctgcttgttcttctgaaactggatgaagacctgcatgtcaagtatcctagactacttacatttgcctcccagctgaaggctggcaaaggacttaccattgttggtagtgtgatacaaggctcatttctggaaagttacggcgaggctcaggccgccgaacagacaattaaaaacatgatggagattgaaaaggtgaaagggttttgccaggtggtggtggcttcgaaggtgcgcgaaggtctagcccacctgatccagtcctgtggactgggagggatgcgccataactcagtggtgcttggctggccatatgggtggcgacagtctgaagatccacgtgcatggaagacctttatcgacacagtgagatgcaccaccgctgcccacctggcacttctggtacccaagaacattgcattttacccaagcaaccatgagcgatacctggaaggtcacatcgatgtgtggtggatcgtgcacgatggcggtatgcttatgctgctgccatttttacttagacagcacaaggtgtggcggaaatgcagaatgcgcattttcactgttgcacagatggacgacaattccattcagatgaaaaaagaccttgccgtgtttttataccatctcaggctggaagccgaagtcgaggtggtcgagatgcataattccgacatttctgcttatacctacgagcgcaccctgatgatggaacaacgctcccagatgttgagacaaatgagattaaccaaaaccgagagggaaagagaggcccagcttgtgaaggaccgccattcggccctgagactggagtctctgtactccgacgaggaggatgagtccgccgtcggagcagacaaaatacagatgacgtggactagggacaagtacatgacagagacctgggatcccagtcacgccccagacaattttagggagctggttcacatcaagccagaccagtccaacgtaaggcgaatgcataccgccgtgaagctaaacgaggtgattgtgaccagatctcatgacgcacggctggtgcttctgaacatgcccggacctccacggaacagtgaaggcgacgagaattacatggaattcctggaagtcctgacagaaggacttgagcgggtgctgctggtacgagggggtgggcgcgaggtaatcactatttactcatag

SEQ ID NO: 205567 - DNA, 3240 bp, Artificial Sequence
  Description of Artificial Sequence: Synthetic coding sequence
atggccgccgagggcgccgtgtgcggcttcgtgtacctggagggcacggcatgggccgtgccggaagacaccgagccgttggcttcctgtaccttagggcacggcaatcatcgggagtctagccccttcctgagccccctcgaggccagtagaggtattgattactacgacagaaatctggccctgtttgaggaagagctcgacatccgccccaaagtgagctctctgctcggcaagctcgtgagttacaccaatctgactcagggagcaaaggaacatgaggaagccgagtctggcgagggcacccggaggcgggctgccgaagcccccagtatggggacactcatgggtgtgtacctcccctgtctccagaatatctttggcgtgatcctttttctccgccttacatggatggttggcactgccggggtccttcaggctctgcttatcgtgctcatttgttgttgctgcactctgctgacagcgatctccatgtcagccatcgcaaccaatggtgttgtcccggccggcggctcatattttatgatctctcgcagcttggggccggagtttgggggcgcggtggggctctgtttctacctggggacgaccttcgccgcagccatgtacattctcggcgccatcgaaatcctgttgacatatattgcaccacctgcggctatcttttacccctccggtgctcacgacacctccaatgctaccctgaataacatgagagtctacggtacaattttcctcaccttcatgaccctagtcgtgttcgtgggtgtgaagtacgtaaacaagttcgcctccctgttcctcgcctgtgttatcatttctattttatctatttatgccggagggataaagagcatctttgacccgccagtcttccccgtttgtatgctcggaaacaggaccctgtcaagagaccagttcgatatttgcgctaagactgcggtggtggacaacgagacggtggccacacaattatggtcattcttttgtcacagcccaaacttgactactgatagctgtgatccttattttatgctgaataatgtcactgaaattccgggaatccccggagcagccgccggagtgctccaagagaatttgtggagcgcttacctggaaaagggcgatattgtggaaaagcacggtctgcctagtgccgatgctccctccttgaaagagtctctgccactgtatgttgtggccgacattgcaacatcattcacagtgctggttggaatattcttcccttccgtgacgggcatcatggccggttccaatagatctggcgatctgcgcgatgcacagaagtcgatccccgtggggaccatcttggctatcattacaacgtccctagtgtacttttcttcagtggtcctgtttggtgcctgcattgagggcgtggtgttgagggataaatatggggatggagtgagtaggaatctggtggtcggcacactggcatggcccagtccttgggttattgtgatcggttctttcttttcaacctgtggggccgggctccagagcttgaccggtgctccccggttgctgcaggctatcgcaaaagacaatattatccccttcctgagggtttttggtcatggaaaagtgaacggggagcccacctgggcactcctgttaaccgccctcattgctgagctcggaatattaatcgcctcattggatatggtggcccccatcttgtccatgttctttctgatgtgctacctctttgtgaaccttgcctgcgccgtccagactcttctgagaactcctaattggaggcccagattcaaatattaccactgggctctgtctttcctgggtatgtcactgtgtctcgccttgatgttcgtttcgtcctggtattatgccctcgttgccatgctgatcgccgggatgatttacaagtatatcgagtaccagggcgcagagaaggagtggggcgacggcatccggggcctctctctctctgccgcccggtatgcccttctgcggttggaagaggggcctccccataccaagaattggaggcctcaacttctggtcttactgaagttagatgaggaccttcacgtgaagtaccctcggctcttgacttttgcatctcaactcaaggcaggcaaggggttgaccattgtgggctccgttatccagggctcttttctagaaagctacggtgaggcccaggccgctgaacagaccatcaagaacatgatggagattgagaaagtaaaagggttttgccaagttgtggttgccagtaaggttagggaaggcctcgcccatctgattcagagctgcggcctcggtggcatgcggcataatagcgtagtgctgggatggccttatggctggcgccaatctgaggatccacgcgcctggaagacatttatcgatacagtcaggtgcaccaccgccgctcatctcgccctgttagttccaaagaacatagctttttatccctccaaccacgaaaggtatctagagggacacatcgacgtgtggtggatcgtgcatgacggcggcatgctcatgctgctgccgttcctgctccgtcagcataaggtttggagaaaatgtcggatgcgtatcttcactgtcgcccagatggatgataattcaattcaaatgaaaaaggaccttgccgtcttcttgtatcatctgagattggaggctgaggtggaagtggtggaaatgcataatagcgacatatcagcctatacgtacgaaagaacgctcatgatggagcagagaagccagatgttacgacagatgcggctcacaaagacggagagagagagggaagcccagctcgtcaaggacagacactcggcactgcggctggaatctctatatagtgacgaggaggatgagagcgcagtgggcgcagacaaaattcagatgacttggacacgggacaagtacatgacggagacctgggatccctcacacgccccagataattttagagagctggtgcacataaagcccgaccagtctaatgtgcggaggatgcataccgctgtgaagctgaacgaagtgattgtgactagaagccatgacgccaggctagtgcttctgaacatgccaggcccacctcggaattcagagggcgatgaaaattatatggaattcctggaagtcctgactgaagggttagagcgcgtcctgctggtgcgcggaggcgggcgcgaagtgataacgatttatagctag

SEQ ID NO: 205568 - DNA, 3165 bp, Artificial Sequence
  Description of Artificial Sequence: Synthetic coding sequence
atgggcgacaccctgagccccggccacggcaaccaccgggagagctcaccctttttaagcccacttgaggcgtcacgagggattgattactacgaccgaaaccttgccctatttgaggaggaattagatatccgccccaaggtgagtagcttgctggggaagctggtgagttatactaatttgacgcagggcgctaaggaacacgaggaggcggagagtggtgagggcactcggcgacgcgccgctgaggctccatccatgggaacattgatgggagtttaccttccgtgcctccagaacatttttggtgtaatcttattcctgcgcttgacctggatggtcggtaccgctggtgtgcttcaggcactcctgattgtgctcatttgctgttgctgtacactgctgactgccataagtatgagtgcaatcgccacaaatggcgttgttccagccggaggcagctacttcatgatatctcgatcactggggccggagttcggaggagccgtaggactgtgtttctatttagggacaacattcgccgccgccatgtatatactgggggcaatcgaaatcctgctgacatacatagcccctcccgctgctatcttctaccctagcggggctcatgacaccagcaacgccaccctgaataatatgcgagtgtatggtacaattttcctgacctttatgactttagtcgtgttcgtaggcgtgaagtacgtgaacaagttcgcgagtctgttcttagcgtgcgtcataattagtatcctgagtatatatgccggggggatcaagagcattttcgatcccccagtatttcccgtgtgtatgcttggtaacagaaccttaagccgggatcagtttgacatttgtgccaagaccgccgtcgtggacaacgagacggtggccacccagttatggagttttttttgccattcacccaatctgacaaccgactcttgtgatccttatttcatgctgaataatgtgacggagatccccggtattccgggagccgccgcaggagttctgcaagagaacctgtggtcagcttacctagaaaaaggcgatatcgtcgagaaacacgggctgccctccgccgacgccccatcactgaaagagtcattgccactctatgtggtggctgacattgccacaagcttcactgtgctagtgggcatatttttcccctcggtgaccggcatcatggctggcagcaatcgcagcggagatcttcgcgacgcccagaagtccatccccgtgggtaccattttggcaattatcacgaccagtctggtatacttttctagcgtggttctattcggagcatgtattgaaggcgtggtgctgcgggataaatatggagatggcgtgtcacgcaatctggtggtgggcactttggcctggccatcaccgtgggtgatagtgataggaagtttcttctccacttgtggcgctggactgcagagccttacaggagccccccgtctgctgcaggccatagctaaggacaatatcattcctttcctgcgcgtgttcggtcacggaaaagtgaacggagagcctacttgggccttgctgttgactgctttgatcgccgaattaggcatcttaatagctagtctggacatggtggctccaatcctgtcgatgtttttcttgatgtgctacctgtttgtgaacctggcttgcgcagtccagacactcctcagaaccccaaattggagaccccgttttaagtactaccactgggctttgtccttccttggcatgtccctgtgtttggccctcatgtttgtcagttcctggtattacgccctcgtggccatgctgatcgcaggcatgatttacaaatacatagaatatcagggcgcagagaaggagtggggtgacggaatcaggggactgagcctatcagctgcccgctatgctctgctgaggctagaggagggacccccacacactaagaactggaggccccaactcctggtgctgctgaaactggacgaagacttacacgtgaaatatccccggctcctgacatttgcatcacagctgaaagctggcaaggggcttaccatcgttgggagtgtgattcagggatcgtttcttgagtcgtacggagaagcacaggccgcggaacagacgataaaaaatatgatggagattgaaaaggttaaggggttctgtcaggtcgtggtagcatcaaaagtgagggaagggcttgcccacctgattcagtcctgtggtctgggcgggatgcggcacaattccgtggtcctggggtggccttacggttggaggcagtctgaggatccccgcgcctggaaaacgttcatcgacaccgtaaggtgtaccaccgcagcgcatcttgcccttctggtgccaaaaaatatcgccttctacccttcgaaccacgaacggtatctggaaggacatattgatgtgtggtggattgtgcatgatggaggcatgctcatgttgctccctttccttttgcggcagcacaaggtctggcgcaagtgcaggatgagaattttcacggttgctcaaatggatgacaacagtatacagatgaaaaaagatttagcagtatttctgtaccatcttaggctagaggctgaggtggaggttgtggaaatgcacaattccgacatctcggcttacacctacgagagaaccctaatgatggagcaaaggtctcagatgttaagacagatgaggttgacgaaaacggaacgagaacgcgaggcccaactcgtgaaggaccggcactctgctctcaggttggagtctctatattctgacgaggaggatgagagcgcggtgggtgcagataagatccagatgacctggacgcgcgataagtacatgactgaaacatgggacccctctcacgctcccgataattttagagaactggtccatattaaacccgaccaaagcaatgttaggcgcatgcatactgctgtgaagctgaatgaggtgattgtgaccaggtcccacgatgctaggcttgttcttctgaacatgccggggccaccgcgcaattccgaaggagatgagaattacatggaatttctcgaggttctgactgagggccttgaaagggtgcttctcgtgaggggaggcggcagagaggttattaccatctattcctag

SEQ ID NO: 205569 - DNA, 3300 bp, Artificial Sequence
  Description of Artificial Sequence: Synthetic coding sequence
atgccccacttcaccgtgaccaaggtggaggaccccgaggagggcgcagccgcttcaatttctcaggagcccagcctagccgacatcaaggcacggattcaagatagcgacgaacctgatctcagccagaacagtatcacaggcgaacatagtcaattacttgatgacgggcacaagaaagctcgcaacgcctacttaaacaacagcaattatgaagaaggtgatgaatacttcgacaagaatctggccctgtttgaggaggagatggacacacggccaaaggtatcttctctgctgaatcggatggccaattatactaatctgacccagggcgccaaggaacacgaggaggctgagaatataactgagggcaagaaaaaaccaaccaaaaccccacaaatgggtacatttatgggagtgtacctcccttgtttacaaaacatttttggcgtgatcctgtttctcagactgacttgggtggtaggaacagcgggcgtgctgcaggcgtttgctatcgtgctcatctgctgctgttgtacaatgctcaccgccatctctatgtctgctattgccactaacggcgttgtgccagccgggggctcatacttcatgatctcccgggctttgggcccagaatttggcggtgcggtaggactgtgtttctacctgggcactacattcgccgctgcaatgtacattctgggagctatcgagattttcctagtgtacatagtgccaagagcagcaatcttccatagtgacgacgccctcaaagagagcgctgccatgctgaataatatgagagtttacggcaccgcattcctggtactaatggttctggtagtcttcataggggtacgctatgtgaacaagtttgctagtctttttttagcttgtgtgatagtgtctatcctggcgatttacgccggggccattaaaagcagtttcgcaccaccccacttcccagtctgtatgctaggaaatagaactctgtcctctcgacatatagacgtatgttcaaaaaccaaagagattaacaatatgacggtgccctccaagctgtggggctttttttgcaactcctcgcagttcttcaacgcaacctgcgacgagtacttcgtccacaataacgtgacctccattcagggtatcccgggtttagcaagcggcatcattaccgagaatctatggtcgaattatctgccaaagggcgagataatagaaaagccatcagccaaaagttccgacgtgttaggtagtctgaatcacgaatacgtgctagtggacatcacaacaagcttcaccctactggtcggcatcttctttcccagtgtgaccgggataatggctggatcaaacagaagtggggacctgaaagatgctcagaagtctattccaatcgggacgattctggcaatcctcacaacctcattcgtgtatctgtccaatgtcgtgctgttcggggcttgtattgagggagtcgtgcttagagataaatttggggatgccgttaaggggaatcttgtggtaggaaccctatcctggccctcaccctgggtgatcgtcattgggagtttcttttccacttgtggggcggggctgcagtctctgacaggcgccccaagactgcttcaagctattgcgaaagacaatattatcccattcctccgcgtgttcggccatagcaaagcaaacggcgaacccacctgggcgctgctgctcactgctgccatagcagagctaggaatattgattgcatccctggacctcgtcgcccctattttatccatgttcttcctgatgtgttacttgtttgtcaatctggcctgcgcactccaaaccctcctgcgaactcctaactggcgaccccgcttccgttactatcattgggcccttagcttcatggggatgagtatctgtctggctctgatgtttatctcttcctggtactacgccatcgtcgccatggtcattgccgggatgatctacaagtacattgagtatcagggagccgagaaggagtggggtgatggaattcggggcctctcactgagcgctgctagatttgctctcttgaggctcgaggaaggtcccccacacactaaaaattggcgcccccagctgctagtcctgctgaagctggacgaggacctccacgtgaagcatccgcgcctcttgacttttgcttcacagctgaaagctggcaaaggactgaccatagtagggtcagtaattgtgggaaacttcctcgagaattacggagaagccctcgcagccgagcagacaataaaacatttgatggaagcagagaaggtcaaaggcttttgccaactggtagtcgcggccaaactcagggagggaatcagccatcttatacagtcttgtggacttggcgggatgaagcacaataccgtcgttatgggatggcctaatggctggaggcagtctgaggatgcacgggcttggaagacctttattggtactgtgagggtcaccactgcagcacacctggccctcctggtagctaaaaatatttcattcttcccaagtaatgtggaacaatttagcgagggaaatatcgatgtttggtggattgttcacgacggcggcatgctcatgttgttaccctttctcctgaagcagcataaagtgtggcgcaagtgctcaatccgtatctttacagtagcacagttagaggacaactcaattcagatgaagaaagatctagctacattcttatatcatctgagaattgaagccgaggtggaagttgtggagatgcacgactcagacatttccgcctatacctacgagcggacccttatgatggagcagcgctctcaaatgctccggcacatgaggttaagtaagactgaacgagatcgggaagctcaactggtcaaggatcggaactcaatgttgcgccttacttctattggatctgacgaggatgaggagaccgaaacttaccaggaaaaggttcacatgacgtggactaaagacaagtacatggcatctagaggacagaaggccaaatctatggaggggttccaagaccttctcaatatgcgcccggaccagagtaacgtcaggaggatgcatacggccgtgaaactgaatgaggtgatcgtcaacaaatctcatgaggcaaagctggtgctgctcaacatgcccggcccccctcggaacccagaaggcgacgagaattacatggaatttctggaggtgctcacagagggccttgaacgcgttttgcttgttcggggcggcggatcggaggttattacaatttactcttag

SEQ ID NO: 205570 - DNA, 3453 bp, Artificial Sequence
  Description of Artificial Sequence: Synthetic coding sequence
atgcacccccccgagaccaccaccaagatggccagcgtgcggttcatggttacgccgactaagatcgatgacattcctggattatcagacacatccccagacctgtcaagccggtcatcgtcacgcgtcaggttctcctcccgggaaagtgtaccggagacttcccgtagcgaacctatgtcagagatgtctggggccaccacatcgcttgctactgtagctctcgatcctccaagtgatcgaaccagtcaccctcaggacgtgatagaggacctgtctcagaatagcatcactggggaacactcgcaattgctcgacgacggtcacaagaaggctaggaatgcatacctaaataatagtaactatgaggagggcgatgagtattttgacaagaatctagctctgttcgaggaggagatggacacaaggcccaaagtgtcctccctcctaaaccgtatggcgaattatacgaacctaacgcagggcgccaaggagcatgaagaagctgaaaacatcaccgaggggaaaaaaaagccaaccaaaacaccccaaatgggcacgttcatgggtgtgtatctcccatgccttcagaatatcttcggagtcattttgttcttgcgcctcacctgggtggtgggaactgcgggtgtactgcaggcctttgcaattgtgttaatatgctgttgttgcactatgttgactgccatttcgatgagcgcgattgccaccaatggggttgtcccagccggagggtcctactttatgattagcagggctctgggaccagaatttggaggagcagttggcctttgcttctatcttggaaccactttcgctgctgccatgtatatactcggagccatagagatatttctggtctacatcgtcccccgggctgcaattttccactccgatgacgctttaaaagagtcagcagccatgttgaataacatgagggtctacggcacagctttcctggtcttgatggtgcttgtggtgttcattggtgtgcgctacgtgaacaagtttgcctccttattcctggcctgcgtgatcgtctctatcttggccatttatgcaggggccatcaagagcagtttcgcaccacctcacttccccgtgtgtatgttgggaaaccgtacactatcttcccggcatatagacgtgtgctccaagaccaaggaaattaacaatatgactgtaccatccaagctgtggggcttcttctgcaactcctcacaattcttcaacgcaacttgtgatgagtactttgttcacaacaatgtcacctctattcagggcatccctggactcgcgtctggcattatcaccgaaaatttatggtctaactaccttcctaagggcgagatcatcgagaagccttctgcgaaaagttcagacgtgctggggtcacttaatcatgagtacgtgctggtggacattacgacttcctttaccctcctcgtgggaatatttttcccctctgtgacgggcattatggcgggctcaaatagaagtggagatctcaaagacgcgcagaagagtatcccgattgggaccatccttgctattctgactacttcatttgtgtatctgagcaacgtcgtgctgttcggagcctgcattgagggggtggtcttgcgggacaagtttggggatgctgttaaaggcaacttagtggttggcaccctgtcatggccttctccttgggtgatcgtgatcggtagcttctttagcacctgtggcgcaggcctccaatctctgactggggccccgcggctgctgcaggctatcgctaaggacaatatcattccattcctgcgggtctttgggcacagtaaggcaaacggagaacccacatgggcgttgttactgaccgccgcaattgccgagttagggatcctcattgcaagtcttgacttggttgcaccaatattatctatgttttttttgatgtgctatctgttcgttaatctggcctgcgcactccagacattactgcgtacccctaattggagacctaggttccgctactatcactgggctctgagctttatggggatgtctatctgcttggccctcatgttcatcagctcctggtactacgccatcgtagctatggttatagccggaatgatttacaagtatatcgagtaccagggagccgagaaggaatggggggacggcatacggggtctctccctgtcagctgcgagattcgccttgttacggcttgaggaaggccccccacacaccaagaattggagaccccaactccttgtgttattgaaactggatgaggacctccacgtcaagcatccccgcttactaacttttgctagccagctcaaagctgggaagggattgaccatcgtgggcagtgtaatcgtgggtaacttcctagagaactacggcgaggcgctggctgccgaacaaaccatcaagcatctcatggaagctgagaaggtgaagggcttttgccagctggtggtggccgccaaattacgagaaggaatatcccacctcatacagtcatgcggcctgggaggaatgaagcacaacacagtagtgatggggtggcccaatggctggcgacaatccgaggatgcgcgggcgtggaagactttcataggcactgtaagagtgaccaccgccgcacatttggcccttttagtcgccaaaaacatttcattcttcccctcgaatgtagagcaatttagcgaaggtaatatagacgtttggtggattgtccatgacgggggaatgctgatgcttctgccttttctcctcaagcagcataaggtctggcgaaaatgctcaatacggatttttactgtggcccagctggaggacaacagtatacaaatgaagaaggacctcgccaccttcttgtatcacctgcggatcgaggcggaagtggaagtggtggagatgcacgatagtgacattagtgcgtacacatatgaacgaaccctcatgatggagcagcgatctcagatgctcagacacatgcgactctcaaagacagaaagggaccgcgaggcgcagctggtaaaggaccgcaactcaatgctgcgactgacttccattggcagcgatgaggacgaagaaactgagacataccaggagaaggtacacatgacatggaccaaggacaagtatatggcctctcggggccagaaagcaaagagtatggagggatttcaagatctgctgaatatgcgtcctgatcaatctaatgtgcggcggatgcacacggcagttaaattgaatgaagtcattgtgaacaaaagccacgaagccaaacttgttctgctgaacatgccagggccaccaaggaacccagagggcgacgagaattacatggagttcctggaggtgctcaccgaggggctggaacgagtcctcctggttaggggtggcggcagcgaggtcatcaccatctactcgtag

SEQ ID NO: 205571 - DNA, 3276 bp, Artificial Sequence
  Description of Artificial Sequence: Synthetic coding sequence
atgagcgagatgagcggcgccaccaccagcctggccaccgtggccttggatccgccttccgaccgtacttcccaccctcaggatgtcatcgaagacctaagccagaattcgatcactggcgaacacagccagttgctggacgatgggcacaaaaaagcaaggaatgcttaccttaataactctaactacgaagaaggggatgaatatttcgacaagaacctcgccttattcgaggaggaaatggatacccgaccgaaagtttcctcgttgctgaatcgtatggctaattatactaatctaacgcagggggccaaagaacacgaggaagcagaaaacattacagaaggcaagaaaaagcctaccaagacaccacagatgggtaccttcatgggcgtgtacctgccttgtctgcagaacatcttcggcgtaatattgttcctcagattgacctgggttgtgggcactgccggggtcctccaagcttttgcaatcgtgcttatctgctgttgctgtaccatgttgacagccatcagtatgtccgccatagcaaccaatggagtggtccccgcggggggatcctacttcatgatctccagagcgctgggccccgaatttggcggggccgtaggactctgtttctatctgggcaccacttttgccgccgccatgtatatcctcggcgcgattgagatttttttggtttacatagtgcctagggcagccatcttccactctgacgatgctctgaaggagtcagctgcaatgctcaacaatatgagagtatacggaaccgctttcctcgtgctcatggtccttgtggtctttataggggtccggtatgtaaacaagtttgcttctctgtttctcgcctgcgtaatagtatctattctggctatctacgctggcgccataaaaagtagttttgcccctccccattttcccgtttgcatgcttggaaacagaacccttagctcacgacacatcgatgtctgttccaaaacgaaagagataaacaacatgaccgttcctagcaagttatgggggtttttctgcaattcttcccagtttttcaatgcaacgtgtgatgaatacttcgtgcacaacaacgtgacctctatccagggcatccctgggttagcctctggcatcataactgaaaatctatggagtaactacttgcccaaaggtgaaattatcgaaaaaccctccgcaaaatcctccgatgtcttaggatcactgaaccacgaatatgtactggtggacattacaacctcattcacactgctcgtgggcattttctttccgtcagtgacggggatcatggcaggatctaatcggagcggagatttgaaggatgctcagaaatcaatccccattggaacgatcttagcaattctgacaacctcctttgtgtacttgagtaatgtggtcctgtttggagcctgcattgagggggtggtcctccgggacaaattcggggatgctgtaaaggggaacctcgtggtgggcaccctgagttggccgtccccttgggtcatcgttattggatctttcttctctacatgcggagcaggcctccagtctctaacaggtgcgcctcgcttgctgcaagcaatcgcaaaagataatatcattccctttctgcgcgtctttggccattctaaagcaaacggcgaacccacatgggctctgctgctgacagctgcaatcgcggagttaggcatcttgattgcgagcttggacctggtcgccccaatcctgtctatgttcttcttgatgtgctatctgttcgtcaacttggcctgtgccctgcagaccttactccgcactccaaattggcgccctcgatttcggtattatcattgggctctcagcttcatggggatgtctatctgtctggccctgatgttcatatcaagttggtattacgccatagtggctatggtcattgcgggcatgatctataagtatattgagtatcagggtgcggagaaagagtggggcgacgggatcagaggacttagtctgagcgcagcccgcttcgctctgctgcgactggaggagggacctcctcatactaagaattggcggcctcagctgttggttctactcaagctggatgaggacctccatgtgaagcaccccaggctccttacgttcgccagccagttgaaggccggcaagggactgaccattgtggggtctgttattgtgggaaatttccttgagaattatggtgaagctcttgcggcggaacagaccataaaacatttgatggaggccgagaaggtgaagggcttctgtcagctagtcgtcgcagccaaactccgcgaaggaatttcccatctgatacagagttgtggactgggtgggatgaagcacaatactgtggtgatgggatggcctaacggttggaggcaatctgaagacgcgagagcctggaagacatttatcggcactgtgcgcgtgacaaccgccgcccatctcgctctgctggttgccaaaaatatcagctttttcccgagcaatgttgagcagttttcagaaggcaatatcgatgtctggtggattgttcacgatggcgggatgctaatgttgctccccttcctgctaaagcaacacaaggtttggaggaaatgctccatccgtatcttcactgtggcacagctggaggataacagcatacagatgaagaaagatctcgccaccttcttatatcacctgcggatcgaggcagaagtagaagttgtggaaatgcatgattctgatatcagcgcttacacttatgaaaggactcttatgatggagcagcgaagtcagatgctcagacatatgcggctgtcgaagaccgagagggaccgggaagcacagctggttaaggacaggaattccatgctccgcttaacatcaattggctcagacgaagacgaggagactgaaacctatcaggagaaggtgcacatgacttggacaaaagacaaatacatggcctcccggggccagaaggcgaagtcaatggaaggcttccaggacctgctgaacatgcggccggaccagtctaacgtgagacgaatgcacacagcagttaagcttaatgaggtgatcgttaataaatcacatgaagccaaactcgttctgctgaatatgccgggcccaccacgtaacccagagggggacgaaaactacatggagttcttggaagtcctgacagaaggtctcgaacgggtgttactggtgcgaggcggcggcagcgaagttatcactatttacagctag

SEQ ID NO: 205572 - DNA, 3408 bp, Artificial Sequence
  Description of Artificial Sequence: Synthetic coding sequence
atgcacccccccgagaccaccaccaagatggccagcgtgcggttcatggtgacacctacgaaaattgacgacatcccgggtttgagcgacacatccccagatctgagcagccgctcatcatctcgggtgcgcttctcttcgcgggagtcagtgcccgagacatccaggtcggagcccatgtctgagatgagtggcgcaactacctccttagcaaccgttgctttagaccccccaagcgaccgcacaagccacccacaagatgtgatcgaagacgatggacataagaaagctcgcaatgcctacctgaacaactctaattacgaagaaggcgacgagtactttgataagaatttggccctgtttgaggaggaaatggacacacggcctaaagttagcagcctgttgaaccgtatggctaactacactaatctgacccagggagcaaaggagcatgaagaagccgagaacatcactgaaggcaagaagaagccgacgaaaacaccacaaatggggacttttatgggcgtgtacttgccctgccttcagaatatctttggagttatcttgtttcttaggctaacctgggtcgttgggactgccggcgtgctgcaggccttcgccattgttctcatctgctgttgttgcacaatgctaactgcaatttccatgtctgccattgctactaatggagtagtgccagctggaggatcgtatttcatgatctcccgtgctcttggaccagaatttggtggggccgtgggattgtgcttttatctgggaaccacctttgcagcggctatgtacatcctcggcgcaatcgagattttccttgtttacatagttccccgcgcggctattttccactctgacgacgccttgaaggagtccgcagctatgctgaacaacatgcgggtctatgggactgccttcctagtactgatggtgctggtcgtatttatcggcgtgcggtatgtgaataagtttgcatcgttgtttctggcttgtgtaattgtgtcaattctcgcaatctatgcgggagccataaagtcatcattcgctcccccccattttccagtgtgcatgttgggtaataggacgcttagctccagacacatcgatgtgtgcagtaagacaaaggaaatcaataatatgacggtgccatcgaagctctggggattcttttgcaatagctcccaattcttcaacgccacatgtgatgaatactttgtccacaataatgtcacttctatccagggtattcccgggctggcgtctggaattattacagagaatttatggagtaactacttgccaaagggagaaatcatcgagaaaccgtctgctaaatctagtgacgtcctcggctcacttaatcatgaatatgttctagtcgacatcaccacctcgttcactcttttggtgggtatcttcttcccgtcagtcaccggtattatggctgggagcaacagaagcggagacctgaaggatgcccagaagagcatacccatagggacgatattagccattttaaccaccagtttcgtttatctctctaacgtggtgttgttcggcgcttgcattgaaggcgtggtcctacgggacaaattcggagatgctgttaaaggaaatctcgtggtcggaacactttcatggccatccccttgggtcatcgtgattggtagctttttcagcacgtgcggcgcgggtctgcagagtctcaccggtgcaccaaggcttctacaagccattgccaaggataacattattcccttcctgcgcgtgttcggacactctaaagctaatggggagcccacatgggccctcctgcttacagctgccattgccgaactcggcatccttattgccagtctcgatttggtggctccaatactcagcatgtttttcctgatgtgttaccttttcgtaaatctcgcttgcgctctccagactctcctgaggactcccaattggcgacccaggttccggtattaccattgggccctgagctttatgggtatgagcatttgtctggccttaatgtttataagctcgtggtactacgcaatcgtcgccatggttattgccggtatgatttataagtatatcgaataccaaggggccgagaaagagtggggcgacgggatcaggggtcttagtctgagcgccgccagattcgcactcctgaggctcgaagagggacctccccacaccaagaactggcgcccccagctgctggtcctgctcaagctggacgaggacttgcacgtgaagcacccacgcttacttaccttcgccagtcagctgaaagctgggaaaggtctcacaatcgtcgggtcagtgattgtcggtaatttcctggagaattacggtgaagcactcgccgccgagcagaccattaagcaccttatggaagctgaaaaggtgaaagggttctgccaactggtggtggctgccaagctgcgagagggtatctcacacttaatccagtcttgtggactcggaggcatgaagcacaatactgtagtgatgggctggcctaacggatggcgccaatctgaggatgctagagcttggaagactttcataggaacagtgagagttaccactgcggctcacctggcactgctggtcgccaagaatatctcttttttccctagcaacgtggagcagttctcagagggcaatatcgacgtctggtggattgtgcacgacggagggatgttaatgttgctccccttcctgctgaagcaacataaggtttggcgaaagtgcagcatcaggatctttaccgtggcgcaactcgaggataacagcatccaaatgaaaaaagacctggctacattcttataccatctccgcatcgaggctgaagtcgaagtggtcgagatgcacgactccgatatcagtgcttatacatatgaacgtaccctgatgatggaacagcgatcgcagatgcttaggcacatgagattaagtaaaacggaacgggatagggaagcccagctcgtcaaggaccgtaatagcatgcttagactaacatctatcgggtcagacgaggatgaggagacagaaacatatcaggagaaagttcacatgacctggactaaggacaagtatatggcaagccgaggccagaaggctaagtccatggagggttttcaggacctgcttaacatgagacccgaccaaagcaatgtgagacgcatgcacaccgccgtgaagctgaacgaggtgatcgttaacaagagccatgaggctaagctggtgctcctgaatatgcccgggcctcccagaaaccccgaaggcgacgaaaactacatggaattcctagaggtattgaccgagggcctggaaagggttctgctggtgagaggcggcggctcagaggtaatcacgatctactcatag

SEQ ID NO: 205573 - DNA, 2889 bp, Artificial Sequence
  Description of Artificial Sequence: Synthetic coding sequence
atggacacccggcccaaggtgagcagcctgctgaaccggatggccaactacactaatctgactcagggggccaaggaacacgaggaggccgagaatataaccgaaggcaaaaagaagccaaccaagaccatgctcactgccatcagcatgtctgctatcgctacaaatggagttgttcccgcggggggaagctatttcatgattagtagagctctgggacccgaattcggtggagcagtgggactgtgtttctatcttggaactaccttcgcggccgcaatgtacattctgggggctatcgaaatctttctggtgtacattgtgccccgtgccgcaatctttcattcagatgacgccctgaaagagtccgctgctatgctgaacaacatgagagtttacgggaccgctttcctcgtattgatggtgctagtcgtgttcataggagtgagatacgtgaataagttcgcatcactgttcttggcatgcgtgattgtgtcgattctggcaatctatgccggcgcgattaagagcagtttcgccccacctcatttccccgtgtgcatgctggggaaccggaccctcagcagtaggcacatcgacgtatgctcaaaaactaaagaaattaacaacatgaccgttccttcaaagctgtggggttttttttgtaattcttctcagttcttcaacgccacatgtgatgaatacttcgtacataataatgtgactagtattcagggcattccaggcctcgcgtccggaatcataactgaaaatttatggagcaactacttgcccaagggggaaatcatcgaaaaaccttcagccaagtcttccgacgtactgggatccctcaaccatgaatacgtgttagtggatatcaccacatcctttacccttcttgtaggcatattcttccctagcgtgactggaattatggctggatctaataggtccggagatctgaaggacgcccaaaagagcatcccgatcggcacaatcttggccattctgaccaccagcttcgtctacctctccaatgtggttctctttggagcctgcattgaaggagtggtccttcgggacaaattcggtgacgccgtgaagggcaacctcgtggtcggtacactgagttggccttcaccttgggtgatcgtaatagggtccttcttcagcacctgcggcgcggggttacagtctctgaccggagcaccgcgcctcctgcaggctatcgccaaggataacattatcccgttcctgagggtattcggccattcgaaagctaacggcgagccgacatgggccctgctgctgacagccgcgattgccgagctgggcatcctcattgcaagtctggacctggttgctccaattctgagcatgttcttcctgatgtgctacctgttcgttaacttggcatgtgccctccagacattgttacgcactcccaattggagaccacgtttccgatactatcattgggcactgagcttcatgggcatgtctatttgtctagcattaatgttcatcagcagctggtactacgccatcgttgcaatggtcattgccggtatgatttacaagtatatcgaatatcaaggagctgaaaaggaatggggagatggcattaggggcctgagcctctctgccgccagatttgctttacttagattggaggaggggcctccgcatacaaaaaattggaggccgcaactccttgttctcctgaagctggatgaagacctccacgtcaagcatccccggttactgacgtttgccagccagctgaaggctggaaagggcctgactatcgtgggtagcgtcatagtaggtaacttccttgaaaattatggggaggcactagcggcggaacaaacaatcaagcatctgatggaggcagagaaggtgaaaggcttttgccagttggtggttgccgcaaaactgcgcgagggcatttcacatctgattcaatcttgcgggcttggcgggatgaaacacaatacagtggtgatgggatggcccaacggctggagacaaagcgaggacgccagagcttggaagacattcataggcacagtgcgcgtgaccaccgctgctcatctcgcactgctcgtcgccaagaatatctcctttttcccatcaaatgtggaacagtttagcgagggcaatattgatgtgtggtggatcgttcatgacggagggatgctcatgctgctgccatttctgctgaagcagcacaaagtgtggcgtaaatgctctattaggatctttaccgtggcccagctcgaggataatagcattcagatgaaaaaagatctagccactttcctttatcatctgcgcatcgaagccgaggtcgaggtagttgagatgcacgactctgacatcagcgcttatacttacgaacgcaccctgatgatggaacagcgatcccagatgctgaggcacatgcgcctcagtaagacagagcgtgatcgagaggcccagcttgtgaaagaccgcaattctatgcttaggttgacatcaattggtagcgacgaagatgaggagaccgagacatatcaggaaaaagttcacatgacatggaccaaagacaagtacatggcgagtcgaggacagaaagctaagagcatggagggattccaagaccttctgaatatgcgcccagaccaatcaaatgtgagacgcatgcacacggctgttaaactgaacgaggtcatcgttaacaagtctcacgaggccaaactggtactcctgaacatgccgggaccgcctaggaaccccgagggggacgagaactatatggaattcctggaggtgttgactgaaggactggagcgcgttttgctcgtgagggggggtggctccgaggtgataacaatatactcttag

SEQ ID NO: 205574 - DNA, 3276 bp, Artificial Sequence
  Description of Artificial Sequence: Synthetic coding sequence
atgagcgagatgagcggcgccaccaccagcctggccaccgtggcccttgatcccccttctgatcgaacttcacatccgcaggatgtgattgaggatctctcgcagaactccataacgggcgaacacagccagctgctcgacgacggtcacaaaaaggcgcgcaacgcttacctgaacaattcaaattatgaggagggggatgagtacttcgacaaaaacttggctcttttcgaggaggaaatggatacccgcccaaaggtttcctcacttctcaacagaatggcaaattatactaacctgactcagggtgcgaaggaacacgaggaggctgaaaacatcaccgagggaaaaaagaaaccaactaagacacctcagatgggcacttttatgggagtctatctgccttgtctccaaaatatattcggtgtgatcttatttttaaggttaacgtgggttgtgggcaccgctggggttctacaggcttttgccatcgtgctgatctgctgttgctgcaccatgctgaccgccatctcaatgagtgccatcgcaacaaacggagttgtccctgctggggggtcttacttcatgatctctagggctctggggcctgagtttggaggggctgttggcctatgcttctatctgggtaccacttttgctgctgccatgtacattctgggtgctatcgagattttcttagtgtatatcgtgcctcgggctgcaatcttccacagcgacgacgctctcaaagagagcgccgctatgctcaataacatgcgcgtatatgggacagcctttctcgtgttgatggtgcttgtcgtctttatcggagtgaggtatgtgaacaagttcgcctcgctcttcctggcctgcgttatcgtctcgatccttgccatttacgctggggctatcaagtccagtttcgcaccaccacattttcccgtctgtatgctgggcaaccggacattatcttcccggcacattgatgtttgctctaaaaccaaagagataaataatatgaccgttccatcgaagctatggggcttcttttgtaattctagccagttcttcaatgcgacttgcgatgagtatttcgtgcacaataacgtgacctctatccaggggatcccagggctggcaagcgggatcataactgagaatctttggtctaattatctgcccaaaggagaaatcatcgagaagccctcagccaaaagctccgacgtgctcggctccctcaaccacgaatacgtactcgttgatataacaacctcctttaccttgctggtcggtatattctttccctcggtcacaggaattatggcaggctccaaccgttccggcgacctcaaagacgcccaaaagtccatccccattgggaccattctggcaatcctcaccacctcatttgtctatctgtccaatgtggtcctgttcggggcctgtatcgagggggtggttctccgcgacaaattcggtgatgccgtgaagggcaacctagttgttggtaccttgtcttggccttcaccctgggtaattgtgattggatctttcttttcaacctgtggtgcaggattacaatctttaacgggggccccaaggctgctccaggcaattgccaaggacaacataatccctttccttagggtgtttggacacagcaaggccaacggggagccgacttgggccctgttgttaaccgccgcgattgcggaactcgggatcctcattgcatccctagacctcgttgcacctatactcagcatgttcttcctaatgtgttacctgttcgtcaatctcgcttgtgccttgcagacactgttacgcacccccaattggcgcccccgatttaggtattaccactgggcgttatccttcatgggcatgagcatctgtttggccttgatgtttatctcgagctggtactatgctatcgttgcaatggtcattgccggtatgatttacaagtacatcgagtatcaaggggccgagaaagagtggggcgacggtatccgggggctctctttgagcgcagcacgcttcgctctactgcggctcgaggaggggccaccccatacaaagaactggaggccacagctgctggtgctgctgaaactcgatgaggatctgcacgttaagcatcctaggctgttgaccttcgcgtcacaactaaaagcgggcaagggtctgaccatcgtcggtagtgtaatcgtcggtaactttctcgagaactatggcgaagcactcgcggccgagcagacaatcaagcacctgatggaagccgagaaggtgaagggcttctgtcagttagtcgtagctgctaaacttcgcgagggcatttcgcacttgatccagtcatgtgggctaggtggaatgaaacataacaccgtcgttatgggctggcccaacggctggcgccaaagcgaggatgcaagggcgtggaagaccttcataggtaccgtgcgcgtcaccactgctgctcacctggcactgttggttgccaaaaatatttcattcttccccagtaacgtggagcaattttctgagggaaacattgatgtgtggtggattgtgcacgacgggggtatgctcatgctcttgccttttttattgaagcaacacaaggtgtggagaaaatgctccattagaatttttacagtcgcccagctggaagataacagcatccagatgaagaaggaccttgctacctttctgtatcacctcaggatcgaggctgaggtggaggtggtcgagatgcacgattcggatatttccgcctacacgtacgaacgaacattgatgatggagcagcgtagccagatgttacggcacatgaggttaagcaagaccgaacgcgacagggaggcgcaactggtgaaagatcgcaatagcatgttgcgccttactagcattgggtccgacgaagatgaggaaacggagacctatcaggagaaggtgcacatgacctggacaaaggacaaatatatggcttcgagaggacagaaggccaagtcaatggaagggttccaggaccttctgaatatgcggccagaccaaagtaatgttcggagaatgcataccgcagtgaagctgaacgaggttatcgttaataaatcccatgaagccaaattagtcctgctgaacatgccaggccctccacgaaatcccgaaggcgacgagaattatatggaatttcttgaagtgttgacggagggactagagagggttttactggttcgcggggggggttccgaagtgatcacaatatactcctag

SEQ ID NO: 205575 - DNA, 3426 bp, Artificial Sequence
  Description of Artificial Sequence: Synthetic coding sequence
atggccagcgtgcggttcatggtgacccccaccaagatcgacgacatccctggtttgagcgatacctcaccagatctgagctctagatctagcagccgtgttaggttcagttcacgagaaagcgtgcccgaaacatcaagaagcgagcctatgagcgagatgagtggtgccacaacgtcgctagcaacagtcgcgctggaccctccgtctgacagaaccagtcaccctcaggacgtgatcgaggatctgtcgcagaactccattaccggggagcactcacaactactcgacgacggccataaaaaagccagaaatgcttacctcaataactctaactacgaagagggagacgaatacttcgataaaaatctcgcactcttcgaggaggaaatggataccaggccaaaagtgtcatcgctgctgaacagaatggccaactacaccaatttaacacagggagccaaagagcacgaagaggcggagaatattacagagggtaaaaaaaagcctacgaagactccacaaatgggaacgttcatgggcgtgtatcttccgtgcctccagaatatatttggtgtgatcttgtttctgaggttaacatgggtcgtcggaactgcaggagttttacaggcattcgcgattgtcctgatttgctgctgttgtacaatgctcacagctatatctatgagcgcaatcgcaaccaatggagtcgtacctgcgggcggcagctacttcatgatcagcagggctcttggccccgagttcggcggcgcggtcgggctttgcttttacttaggcaccacgtttgccgccgcaatgtatatattaggggctatagagatcttcctggtatacatcgtgccccgagccgctatttttcatagtgacgatgcccttaaggagtccgcggcaatgctgaacaatatgagagtgtacgggaccgcttttcttgtcctgatggtcttggtggtttttattggcgtgcgatatgtgaacaagtttgcaagcctgttccttgcctgtgtgatcgttagcattctggcgatctacgccggagctattaagagctccttcgcccctccccactttccagtttgcatgctgggcaaccggacactgtcctctcgccatatagatgtgtgctcaaaaacgaaggaaattaacaacatgactgtgccatctaagctgtggggatttttttgcaactcgtcacagtttttcaatgccacctgcgacgaatatttcgtccacaacaatgtgacgtcgatccagggaatcccgggcctcgcttccgggattattactgagaatttgtggtcaaattacctgccaaaaggtgagataatcgagaaaccatcagcaaagagcagcgacgtattgggcagccttaaccatgagtatgtgcttgtagacatcactacttcctttactcttctagtagggattttcttccctagcgttacaggcatcatggcgggtagcaaccgctccggggatttgaaggacgctcaaaagagcataccgatagggaccatcctagctatactgaccacaagcttcgtgtatctcagcaatgttgtcctgtttggggcatgcatagaaggggttgtcctgcgtgataagttcggggatgccgtaaagggcaatctggttgttggcaccctgagctggccatccccctgggtgatcgttatcggttctttctttagcacatgcggagccggtcttcagagtctgacaggagctccaagactgctccaagctatcgccaaggataacatcataccatttctaagggtatttgggcacagtaaggccaacggggaacctacctgggccctattgctgaccgccgctattgccgagttgggcatcctgatcgcctctttggatttggtcgcacctatactctctatgttttttttgatgtgctatctgttcgtgaatctggcctgcgccctgcagacactcctgaggactcctaactggcggcccagatttcgctactaccattgggccctttctttcatgggcatgagcatttgcttggcgcttatgttcatttcaagttggtattatgccattgttgccatggtcatcgctggaatgatatacaagtatattgagtatcagggcgccgaaaaggaatggggagacggcatccgcggcctgagcttgagtgccgcccgcttcgcactgttgagactggaagaaggccctccacacacaaaaaattggcgcccgcagcttctggtcctcctcaagctcgacgaggatctacatgttaaacacccaagactcctcacttttgcctcccagctgaaagccggtaaaggattgacaattgtggggagcgtgattgtgggcaattttctcgaaaactacggagaggccctagcggctgaacagaccatcaaacacctaatggaagctgagaaggtgaagggcttttgccagctggttgtggcagcaaagcttcgcgaggggatctcccacctcatccagagctgcggattgggtggcatgaagcacaacaccgtggtgatgggctggcccaacggctggcgacaatctgaagacgcccgcgcctggaagactttcataggtaccgtcagggttaccaccgccgcccacctcgccctcttggtggctaagaatatctcgttctttccatctaatgtcgaacagttctctgagggcaatatcgacgtttggtggattgttcatgacggaggtatgctcatgctgctgccattcctattgaaacaacataaggtgtggcgtaaatgtagcattagaatttttactgtagcacaacttgaagacaatagcatacagatgaaaaaggatctggcaacgtttctgtaccatcttcggatagaggcagaggtggaggtggtcgagatgcatgattccgatatatcagcatacacatatgagcgtactcttatgatggagcagcggagtcagatgctgcggcacatgcggttgtctaagacagagagggatcgcgaggcacagctggttaaggacaggaattccatgctgagactaacaagcatcggtagcgacgaagatgaggagacggaaacctatcaagagaaggttcacatgacctggacaaaggataagtacatggccagccggggacagaaggctaagtccatggaagggtttcaggatctgctgaatatgcgccctgatcagtctaatgttcgcagaatgcatacagcagtgaagctcaatgaggtaatagtcaacaagtcccatgaggccaagctggttctcctcaacatgccagggccaccacgaaacccagaaggggatgagaattatatggaattcctagaggtgttgactgagggactggaacgcgtgctgctggtcagggggggcgggagtgaagtcatcacaatctactcatag

SEQ ID NO: 205576 - DNA, 3453 bp, Artificial Sequence
  Description of Artificial Sequence: Synthetic coding sequence
atgcacccccccgagaccaccaccaagatggccagcgtgcggttcatggtaacgcccacaaaaatcgacgatattcccggactttccgacacatcacctgacctcagctctcggtccagctcccgggtccggttcagtagcagagaatcagtgcctgagacctcccggagtgagcccatgagcgagatgtctggggcgaccacctcccttgctactgtcgcactggatccacccagcgatagaacatctcacccgcaggacgtcatcgaggatctgagccagaattctattacaggagaacactcgcagttgcttgatgacgggcataagaaagcaaggaatgcatatctcaataatagcaactacgaggagggcgacgaatattttgataaaaacctggcactgtttgaagaggagatggacacccgccctaaagtgagctcccttctgaaccgcatggccaattataccaatctaacacagggcgccaaagagcatgaagaggcagaaaacatcactgaaggcaaaaagaagcccacaaaaacgccccaaatgggaaccttcatgggggtgtatttgccctgtctgcaaaacatttttggtgtcatcctgtttttgaggttgacctgggtggttggaaccgcaggagttttgcaggcgtttgcaatcgtgttgatttgttgttgttgcacgatgctgactgcaatatcaatgtcagccattgcaacaaacggcgtggttccagcgggcggttcctactttatgatttctagagcactgggcccggagtttggcggcgccgtgggcttatgcttttatctcggcacaacatttgcagcagctatgtacatcttaggagctatcgaaatatttctggtttacattgtgccgcgggccgccatctttcactctgatgatgctctgaaggagtctgctgcgatgcttaataatatgagggtgtacggaaccgccttcctcgtcctcatggtgctggtcgtcttcatcggcgttagatatgtgaataaattcgcaagcctcttcctcgcctgcgttattgtaagcatcctggcaatatacgccggcgctatcaagtcctcatttgctcctccacattttcccgtgtgtatgctgggaaataggaccctctctagtcgccatatcgacgtgtgttccaagaccaaagaaatcaataatatgactgtcccttctaagctgtgggggtttttttgtaatagcagccaattttttaacgccacttgcgacgagtatttcgtccataacaatgtaacttcaattcaaggaattcccggactggctagtgggatcatcactgagaacctgtggtcgaattatctacctaaaggagaaatcatcgagaaaccttctgcaaagtcgtccgacgtactggggtccctgaatcacgagtacgttctggtggacatcaccaccagttttactcttctagtggggatcttttttccttcagtgaccgggataatggccgggagcaatcgcagcggggacctgaaagacgcgcagaagtccataccaatcggtacaattctagctattctgacaacgagctttgtttacctgtctaacgtggtgttgtttggtgcctgcattgagggcgtcgtgctgcgagacaaatttggggacgccgtcaaaggcaacttggtggtgggaacactctcatggccatccccttgggtgatagtcattggtagtttcttctccacttgtggagcaggcctgcagagcttgactggcgcccctcgcctgctccaagctattgcaaaggataacattattccttttctgcgagtgttcggccatagtaaagcgaatggagagcctacttgggccctgctgttgactgctgctatcgctgagctgggtatcctcatcgccagtctggatttagtggccccaattttatctatgttttttcttatgtgctacctgttcgtcaatctagcctgtgcccttcagacactgcttaggaccccgaactggcgaccaaggttccggtactaccattgggccttatcattcatggggatgtccatctgccttgctctcatgttcatttcatcctggtattatgccatcgtggcaatggttatcgccggcatgatctacaagtacatcgagtaccagggcgccgaaaaggagtggggggatggaatccgagggctctcgctgagcgccgcgcggttcgccctcctgcgcctagaggagggccccccccacacaaaaaactggaggcctcagctgcttgtgttgttgaagttagatgaagacctgcatgtcaagcatcctcgcctgctcacctttgcaagccagcttaaagcaggcaagggactgaccatcgtaggaagtgtcattgtgggcaattttttggagaattatggcgaagcactcgccgctgaacaaacaatcaagcatctgatggaggccgagaaggtgaagggcttttgtcagctggttgtagcggcaaagctccgagaaggaatcagtcaccttatccaaagttgtggactcggggggatgaagcataacactgttgtaatgggctggccaaacggctggagacaaagtgaagatgcgcgtgcctggaaaacattcatcggaacagtgcgcgtgacgacagcagcccatcttgccctgctcgttgctaagaatattagctttttcccatctaatgtggagcagttctcagaggggaatatagacgtctggtggatcgtgcatgatggcggaatgctgatgctcctcccgttcctgctcaagcagcataaggtctggagaaaatgcagcataaggatatttaccgtagcccagttggaggataatagcatccagatgaaaaaggacttagccactttcttataccacttgaggatcgaagccgaggtggaagtggttgagatgcacgatagcgacatcagcgcttatacctatgaaaggacgcttatgatggagcagagatctcagatgctgagacacatgcgcctgtccaagaccgagagagacagggaagctcagctcgtgaaggatagaaattccatgctgcgactaacctccattggtagtgacgaagacgaggagaccgaaacctatcaagagaaagtccacatgacatggacgaaagacaaatatatggccagcagaggccagaaggctaaaagcatggagggctttcaggatttgttaaacatgcgccctgaccagtccaatgtgagacgcatgcatacagcagttaaactcaacgaggtgattgttaacaagtcccacgaagcaaaactggtcctcttaaacatgccagggccccccagaaaccctgagggcgatgaaaattatatggaatttctggaagtgctgacagagggtctggagagggttttgttagtacggggcggcggatcagaggttatcacgatatactcctag

SEQ ID NO: 205577 - DNA, 186 bp, Artificial Sequence
  Description of Artificial Sequence: Synthetic coding sequence
atgagcgagatgagcggcgccaccaccagcctggccaccgtggccctggacccccctagtgatagaacctcacatccacaggatgttattgaggacctgagccagaattcaattacaggggaacatagtcagctgctcgatgatggtcataagaaagccaggaacgcttacctaaacaactcctag

SEQ ID NO: 205578 - DNA, 2889 bp, Artificial Sequence
  Description of Artificial Sequence: Synthetic coding sequence
atggacacccggcccaaggtgagcagcctgctgaaccggatggccaattacactaatcttacacagggcgccaaggagcatgaggaggctgagaatatcaccgagggaaagaaaaaaccaactaagacgatgcttaccgcaattagcatgagcgccattgcgaccaatggggttgtgccagccggcggttcttactttatgatttcccgggcccttggcccagagtttgggggtgcagttggtctctgtttctacctggggaccacttttgcagctgctatgtatattctgggcgcgattgaaattttcttagtgtacatcgtacctagagcagccatcttccactctgatgatgctctgaaggaatcagcagccatgttaaacaacatgagggtgtatggtacagcctttctggttctaatggttctcgtggtgttcatcggggtgcgatatgtgaacaaattcgcatctcttttcttagcatgcgtgatagtgagtatcctcgctatttacgcaggtgccataaaaagctcctttgctcctccccatttccccgtgtgtatgctggggaatcggaccttaagctcccgccacatcgatgtgtgctcaaaaacaaaagagatcaataatatgaccgtgccctccaaattgtggggatttttttgtaactccagccaattcttcaacgctacatgtgacgaatactttgtacataacaacgtgacatcaatccaaggaatccctggactcgcatccgggatcatcacagaaaacctctggtccaactatcttccaaagggcgagattatcgaaaagccttctgcaaagtcatccgacgtgttgggctccctgaatcatgagtacgtgctcgtggatattacgacttccttcacactgctggtgggtatattttttcctagcgttactggaattatggcgggatcgaacagaagcggtgatctgaaggatgctcagaaaagcattcccatagggaccattctggccatccttaccaccagtttcgtgtacctctctaacgtcgtgctgttcggcgcctgtatagaaggtgtcgtcttacgagacaagtttggcgatgcagtcaagggcaaccttgtagtgggtactttaagctggcccagtccctgggtcattgtcatcggatctttcttctctacctgcggcgccgggctgcagtcactcaccggagctcccaggctgctacaggcaatcgccaaggacaatattatcccatttctccgggtctttggacactccaaagcaaatggcgaaccaacgtgggcactgctcttgaccgcagctatcgccgagcttggcattctgatcgcttccctggacctcgtcgcacctattctgagcatgttcttccttatgtgctacctgtttgtgaacctggcctgcgcactgcaaacccttttaagaacaccaaactggcgccccagattccgatactatcactgggcccttagcttcatgggcatgagtatatgcctggcccttatgtttatttcttcttggtactacgccatcgtcgcaatggtgattgctggtatgatttacaaatacatagaatatcaaggggccgagaaggaatggggggacggtattagaggcctgagcctgtccgcggcccgattcgccctccttagactggaggagggcccgccgcacacaaagaattggaggccccagctccttgtgcttctcaagttggacgaagatctacacgtcaagcatcctcgccttctgacctttgcaagccagctcaaggccggaaaagggttgaccatagtgggctccgtgatcgtgggtaatttcttggagaactacggagaagcactggccgctgagcagacaattaagcaccttatggaagccgagaaggtaaagggtttttgtcagctggtcgtggcggcaaagctgagggaggggatttcccatctgatccagtcatgtggacttggtggtatgaagcataatacagtggtgatgggatggcctaatggatggcgtcagtccgaagacgctagagcctggaagacgttcatcggcaccgtgagagtcacaaccgctgcccatttagccctccttgtggccaaaaacatctcttttttcccttcgaacgtggaacagttttccgaggggaatatagacgtgtggtggatagttcacgacgggggcatgctgatgcttctgccatttcttttgaagcagcacaaagtttggaggaagtgctccatccggattttcactgtcgcacaattagaggataacagcatccagatgaaaaaagatttggcaactttcctgtatcatctgcggatcgaagccgaggttgaggtcgtcgaaatgcacgacagcgatatttccgcgtatacctatgaacgaaccctaatgatggagcagcgatcgcaaatgttgcgccacatgcgtctgagcaaaaccgaaagagacagagaagcacagttggtcaaggaccgcaattcaatgctccggctgacctctataggaagtgacgaggatgaggagacagaaacgtatcaagagaaggttcatatgacatggacaaaggacaaatacatggccagcagaggccagaaagccaagtcaatggagggcttccaagatctgctcaatatgcgacctgatcagagcaatgtgcggcgaatgcacacagctgtgaagctaaatgaggtcattgtaaataaatcccatgaggcaaagctggtgttattaaatatgcctggacccccacgcaatcccgaaggggacgaaaattacatggaattcctggaagtactgaccgagggtttagagcgtgtgctcctcgtgcgcggaggcggatcagaggtgataacaatttactcttag

SEQ ID NO: 205579 - DNA, 3453 bp, Artificial Sequence
  Description of Artificial Sequence: Synthetic coding sequence
atgcacccccccgagaccaccaccaagatggccagcgtgcggttcatggtgacccctacgaagatcgatgatattcccggactgagtgacacatcccccgatctcagttctcggtcctcctcacgagttagattttcctcccgagaaagcgtgccagaaacatctcgcagtgagccaatgagtgagatgtcgggcgccactacctcccttgcgacagtagccctagacccaccttccgaccgcacaagccacccgcaggacgtcattgaggatctgtctcagaactctatcacaggggagcactctcagttgctagatgatgggcacaagaaggctcgtaacgcctacctaaacaattctaattacgaggagggcgacgagtacttcgataagaatctcgctctcttcgaagaggagatggacaccagacccaaggtgtcatctttgctgaatcgcatggctaattataccaatcttactcagggcgctaaagaacacgaggaagcagaaaatataacagaaggaaagaagaagcccacaaagacaccccagatgggaacgttcatgggagtgtatttaccatgtctccaaaacatttttggcgtgattctttttctgagactcacctgggttgtggggacggcgggcgtgcttcaagcctttgccattgtgctcatttgctgctgttgcactatgctaacggcaatatccatgtcagccatagctacaaatggcgtagtgcctgcagggggttcttactttatgatttccagagctctggggcccgaattcggcggtgccgtcggtttgtgcttctacttgggaacaacatttgccgccgctatgtacattttgggcgcgatcgagattttcctggtgtatatagtgccgcgcgccgcaatatttcattctgacgatgccctgaaggagtccgcggccatgctgaacaatatgagagtttacgggactgcgttcctcgtgttgatggtgttagttgtttttattggtgtacggtacgtgaataaattcgcgtccctcttcctcgcctgtgtgatagtttcgatcctggctatctatgctggcgccattaagtcaagcttcgccccccctcattttcctgtgtgcatgcttgggaacaggactctttcgtcacgccatattgatgtctgcagtaagaccaaggaaatcaacaatatgaccgtcccctccaaactgtgggggttcttttgcaattcaagccaattttttaatgcaacgtgtgatgaatattttgtgcataataacgtcacatcaattcagggcattccgggcctggcaagcgggatcattaccgagaatctatggagcaattatctcccgaaaggagagattattgaaaaaccgtccgcaaagagctctgacgtcctgggaagtctcaaccatgagtatgtgctagttgacatcaccacgtcttttactctattagtcggcatcttcttccctagcgttactggaataatggctgggagcaacaggagcggggatctaaaggatgctcagaaatctatcccaatcggtacgattcttgctattctgaccacatcttttgtttacctcagcaatgttgtcctcttcggcgcttgtatagaaggtgtggtgctgcgggacaaatttggcgacgccgtcaagggaaatcttgtggttggtaccctgtcctggccgagtccatgggttattgttataggatccttttttagcacgtgcggagcagggctgcaaagtttaaccggcgctccacggctgttacaggcgattgccaaagataatatcattccattcctgcgcgtgtttgggcacagtaaagcaaacggtgagccaacctgggctctgctacttactgcagcgatcgctgagttaggaattttgatcgcttccctggaccttgtagcccccatcctgtccatgttttttcttatgtgttacctttttgtaaacctcgcctgcgcactccagaccttgctccgcactcctaattggcggcctcgcttccgctattatcactgggcactgagcttcatgggaatgtctatttgcctggcactcatgttcatctcctcctggtattacgcaatagtggctatggtgatagccggaatgatatataaatatatagagtatcagggtgcagaaaaagagtggggcgatgggatccgcggacttagcttgagcgccgctcggttcgccttgctgcgcttggaggagggccctccccataccaaaaactggaggccacagctgttggtactcctcaagcttgatgaggaccttcacgtcaaacacccacgcctgctgacatttgcctcacaattaaaggctgggaagggactgaccattgtcggcagcgtgattgtgggcaattttctcgaaaattatggggaagcgcttgcagctgaacagacaatcaagcatctcatggaggccgaaaaggtgaaaggattctgtcagttggtcgtggccgccaaactaagggaaggtatcagccatctgattcaaagctgtggcctgggggggatgaagcataataccgtcgtaatgggctggccaaatgggtggaggcagagcgaagacgctcgggcttggaaaacattcattgggaccgtacgagtgaccaccgcggctcatttagcccttctggtggcgaagaacattagcttcttcccctccaacgtagagcagttctcggagggcaatatcgatgtgtggtggatcgtgcatgacggcgggatgctgatgctgctcccctttctccttaaacagcataaagtctggagaaagtgctccattcgtatcttcacggtggcccagctggaggataactccattcagatgaagaaggacctggccacatttctctatcacttgcgcatcgaagccgaagtggaagtggtggagatgcacgatagcgacatctcggcatacacatatgagagaacacttatgatggaacagcggagccagatgcttcggcacatgaggttgagtaaaacagaacgagatagggaagcacaattggtgaaggacagaaacagtatgctaagattgaccagcatcggctctgatgaggacgaagagactgagacttaccaggagaaggttcatatgacctggacaaaggataagtacatggcgtcgaggggtcagaaagccaaaagtatggaaggctttcaggacctcttgaacatgcgtccggaccagtccaatgtacggagaatgcacaccgccgttaaactgaatgaagtgattgtaaacaaaagccatgaggcaaaactcgtgctcctgaacatgcctggcccccctcgaaaccccgaaggtgatgagaattatatggaatttctggaagttctgaccgaagggctagagagggtgctcttggtaagaggaggggggtccgaagtgatcaccatctattcatag

SEQ ID NO: 205580 - DNA, 459 bp, Artificial Sequence
  Description of Artificial Sequence: Synthetic coding sequence
atggccagcgtgcggttcatggtgacccccaccaagatcgacgacataccaggcttgtctgatacaagccccgatctgagctcccgttcctcctctcgtgtgcggtttagctctcgggagagcgtccccgagactagtcgaagcgagcctatgtctgaaatgtctggggcaactacatcacttgccactgtagcactcgacccccccagtgaccggacctctcatccacaggatgtgatagaggatctgtctcagaactcgatcacgggagagcattcgcaacttctggatgatggacataagaaggcccggaatgcctaccttaataattctaactacgaagagggcgacgaatacttcgataagaacctggccctatttgaggaggagatggataccaggcccaaggttagtagcctgttaaaccggatggcaaactacaccaatttgactcagtag

SEQ ID NO: 205581 - DNA, 3252 bp, Artificial Sequence
  Description of Artificial Sequence: Synthetic coding sequence
atgcccaccaacttcaccgtggtgcccgtggaggcccacgccgacggcggtggcgacgaaacagcggaaagaactgaggcaccaggcactcccgaaggacctgagcccgagcgaccgagccccggcgatgggaatccgagggagaatagccctttcctcaacaacgtggaggtggagcaggagtcgttcttcgaaggcaaaaatatggccctcttcgaggaggagatggacagcaatcccatggtgagctcgttgttgaacaagctcgcaaactacacgaacttgtcccaaggagttgtcgagcatgaggaagatgaagagtcccggaggcgcgaagccaaggccccgcggatggggacattcatcggtgtctacttgccctgcctgcaaaacattctgggcgttatcctcttccttagactgacatggattgtgggagtggccggtgtgttagaaagcttcctgattgttgccatgtgttgcacgtgcaccatgctcactgcaatctctatgtcagcaattgcgaccaacggagtggtgcctgccggcggcagttattatatgataagtaggtctcttggcccagagtttggcggtgccgtaggtctatgtttttacctcgggacaacctttgcgggggcaatgtacattctcggcactattgagatctttctgacttacatctctccgggggctgcaatctttcaagctgaagccgccggaggcgaggcagccgccatgctccacaatatgcgcgtgtacgggacttgcaccttggtgctcatggccctcgtggtgttcgtaggggtcaaatatgttaataagctggcccttgtttttctggcttgcgttgtgttgagcatcctggccatctatgctggggtgattaaaagcgccttcgatcctcccgacatccccgtttgcttgctgggcaacagaactttatcaaggcgctctttcgatgcttgcgtcaaggcttatgggatccacaataattccgcaacaagtgccctctggggcctgttttgtaacgggtcgcagcctagcgccgcctgtgacgagtatttcattcaaaacaatgtcaccgagatacagggaatacctggagctgccagtggagtcttcttagaaaatctttggagcacatacgcccacgccggcgcctttgtggaaaaaaaaggtgtgcctagtgtccctgtcgctgaagaatcccgggcgtccgcactcccatatgtgctaaccgacatagccgcttccttcacactgcttgtaggcatctacttcccttctgtaaccgggataatggccgggagtaatcgcagcggtgatctgaaggatgcccagaagtcaatccctacaggcacaatactggccatcgtgaccacatccttcatctatttgagctgtatcgtcctgttcggcgcctgcatcgagggggttgtattgcgcgataagttcggcgaggccctgcaaggtaacctcgtcatcggcatgctggcctggccttccccatgggttattgtaattggcagttttttctcaacttgtggcgcaggtcttcagtccctcactggcgctccccggttgctccaggcaatagcccgcgacgggattgtgccatttttgcaagtgttcggtcatggaaaagccaacggggagcccacatgggcactgctgttaactgtgctgatctgtgagaccggcatcctaattgcaagcctcgactccgtggcacccatactcagcatgttctttctcatgtgctatctgttcgtgaacctcgcttgcgcagtacagaccctgctgaggactcctaattggaggccgcgttttaagttctatcactggaccctgagcttccttgggatgtcactgtgcctagccttaatgttcatctgctcttggtactatgccctgtcagcaatgctgattgccgggtgcatatataagtacatcgaatataggggagccgagaaggaatggggggacggaattcgcggactgtccttaaacgcagcccgctatgcactgttaagagtcgagcacggaccacctcatactaaaaattggagaccacaggtgttagtcatgcttaatctcgatgcggagcaagctgtgaagcacccacgcctactgagttttacaagtcaattgaaggccggaaaaggccttactatagtagggagcgttttagaggggacctatcttgataagcacatggaggcccagcgagcagaggagaatatccgaagcctgatgagcacggagaagaccaagggcttttgtcagttggtagtgtcatcatctctgagagatggaatgagccacctcatacagagcgctggactgggcgggttgaagcataacacagtgctaatggcctggccagcctcctggaagcaagaggataatccctttagttggaagaattttgtagacacggtgagggacactaccgccgcccaccaggcgctcctcgtggctaagaatgtcgactcctttccgcaaaaccaggagcgatttggcggaggccatatcgacgtatggtggattgttcacgatggaggcatgcttatgctgttgcccttcctgctgcggcagcataaggtatggcgcaagtgccggatgaggatcttcactgtagcacaggtcgacgacaactccatccaaatgaaaaaggatctccagatgttcttgtaccaccttagaatttctgctgaggttgaagtagtggaaatggtggagaacgatattagtgcattcacctacgagagaactttaatgatggaacagagatcacagatgttaaaacagatgcagctaagtaaaaatgagcaggagcgggaagcgcagctgattcatgaccgtaacacagccagtcatacggccgccgcggctagaactcaggcccctccaacaccagataaggttcaaatgacatggactagagaaaaactcatcgcagagaaatacaggtcacgggacacttccctgtcaggcttcaaggatttgttctcaatgaagcccgatcagtccaacgtccggaggatgcacactgccgtcaagctgaacggggtggtacttaacaaatcgcaggatgcccaattagtccttcttaacatgcctggaccacctaagaacagacagggtgatgagaattacatggaattccttgaagtgcttactgaaggtctgaaccgggttctgctggtacggggcgggggacgggaggtgattaccatttactcctag

SEQ ID NO: 205582 - DNA, 801 bp, Artificial Sequence
  Description of Artificial Sequence: Synthetic coding sequence
atgcccaccaacttcaccgtggtgcccgtggaggcccacgccgacggtggtggagatgaaactgcagagcgaacagaggcccctggtacaccggaaggtcctgaacccgagaggccgtcccccggtgatgggaacccacgcgagaactcgcccttcctgaataacgttgaggtcgagcaggaatcttttttcgagggcaagaatatggctttgtttgaagaggagatggattcaaatcccatggtgtcatctctcctcaacaagctggcaaactatacgaacctctcccaaggagtggtggagcatgaagaggatgaagagagcaggagacgcgaggccaaagcaccacggatgggtacatttatcggggtgtatttgccctgcctgcagaatattctaggtgtgatcttgttcctccgattaacttggatcgtgggagtggcgggggtcctggaaagcttcttgattgtggccatgtgctgcacgtgcacgatgttaaccgccatttctatgagcgccatcgccacaaatggagttgttcccgccggtggatcctattatatgataagtagaagtctagggccggagttcggcggcgcggtgggtttgtgtttttacctagggacaacatttgctggggcaatgtatatccttgggactattgagatttttcttactggaaccgaagacggcgtggggtcactgggtctaggcctggcccaaggtaaccggagacagacccacctttccccctccgacgcagcacaggccgcccatggcgcctcatacggctcgttctag

SEQ ID NO: 205583 - DNA, 3066 bp, Artificial Sequence
  Description of Artificial Sequence: Synthetic coding sequence
atggccgagctgcccaccaccgagacccccggcgacgccaccctgtgtagcggtcgctttactattagcactctgctctcatctgatgagcctagcccacctgctgcctacgattccagccacccgagccatctgacacactcttcgacattttgcatgcgaacttttggctataacaccattgacgtagtaccgacctatgaacattacgcaaatagtactcaacccggcgagccaaggaaagtaaggcctacattggccgatctgcattcttttttgaaacaggaggggaggcatctgcatgccctggcttttgatagccggccctctcatgaaatgaccgacggcctggtagaaggcgaagctggcactagtagtgagaagaatcccgaagagcctgtacgatttgggtgggtgaaaggcgtgatgatccgctgcatgctgaacatctggggcgtgatactttacctcagactgccctggatcactgctcaggcaggaatcgtgctgacatggatcataatcctccttagcgttactgtaacctctataaccggcctgtctatttctgctataagcacgaacggaaaggtaaagagcggggggacatattttctgatttcacgatccctggggccagaactaggtggaagtattggattgatttttgcctttgctaatgcggtcggcgtggctatgcatacggtaggctttgcagaaaccgtgcgagacctgttgcaagagtatggcgcacccatagttgaccccataaatgatattcgcattatcgctgtcgtgagcgtaactgtgctcctggcaatctccctggccggcatggaatgggagagtaaagcccaggtattattttttcttgttataatggtgtccttcgccaattacctggtaggcactttgattcctccttccgaagacaaggcttccaaggggttcttctcctaccgcgcagatatcttcgtgcagaacctggttcccgactggagaggacccgatgggactttttttggcatgttcagtatctttttccctagtgctactgggatactcgctggcgctaatatatccggcgaccttaaagatcccgctatcgcgatcccaaaggggaccctgatggccatcttttggactaccattagctatctggccatctccgcaaccatcggttcctgcgtcgttagggatgcctcaggggtcctgaacgacaccgtgacaccagggtggggcgcttgcgaggggctggcctgctcgtacggatggaacttcaccgagtgtactcaacaacattcatgccattatgggcttataaattactatcagactatgtccatggtgtcggggttcgcacccttgattaccgctggaatcttcggagccacactgagctcagccctggcctgcctggtgtctgccgcaaaagtgtttcaatgtctctgtgaagatcaactgtatcccttaatcgggttctttggcaaggggtacggcaaaaacaaggagccagtccggggatatctgttggcatatgctatcgctgtggcttttataattatcgccgaactgaataccattgcacccattataagtaacttctttctctgtagctacgccctgataaatttttcttgcttccacgctagtattaccaattccccaggatggagaccatccttccagtattataataaatgggccgccttgtttggtgccattatttctgtggtgattatgttccttctgacatggtgggccgccctgatcgcgataggggttgtgcttttcctgctgttgtacgttatttacaaaaaaccagaagtgaattggggtagcagcgtgcaggccggcagttacaatttggctctcagctactcagtgggtctgaacgaagtggaagatcacatcaaaaattatcgcccccagtgtttggtgctcacaggaccccctaattttaggcccgccctggtggattttgttggcaccttcactcgaaatcttagcttgatgatctgcggacacgtgcttatcggtccgcataaacagcggatgccagaactccagctgattgcaaacggacacaccaagtggctaaacaagagaaaaataaaggccttctacagcgatgtgatagccgaggacctgcgccgaggcgttcaaatcctcatgcaagctgctgggctgggacggatgaagcccaatattctcgtggtcggtttcaaaaaaaattggcagagcgcccaccccgccaccgtggaagactatatcgggatccttcacgacgccttcgacttcaactacggggtttgtgtgatgcgcatgcgggagggccttaacgtgtccaaaatgatgcaggcacacataaacccagtcttcgaccctgccgaggacggcaaggaagcctctgcccgggtggaccctaaagcactagtcaaggaggaacaggccactacaattttccagagcgaacagggcaaaaaaaccatcgatatttactggctattcgatgacggtggactcacacttctgatcccctacctgctaggacgcaagagacggtggtccaagtgcaaaatcagggtattcgttggtgggcagatcaacaggatggatcaagagaggaaggcaattatatctttgctaagcaagttccggttaggctttcacgaggttcacattctgcctgacatcaatcagaaccccagagctgaacatactaagaggttcgaggacatgatcgctcctttcaggctcaatgacggctttaaagatgaagccacggtcaatgaaatgaggcgggattgcccctggaaaatatccgacgaggagattaccaagaatagagtcaagagcctgcgacaagtccgtctgaacgagattgtgctcgattacagtcgggatgcggcgctcatcgtcattacgcttcccatcgggcgcaagggtaaatgccctagttcactgtacatggcatggctggaaaccctctctcaggatctgaggccccctgttatcctaatccggggaaaccaggaaaatgttcttacgttttattgtcagtag

SEQ ID NO: 205584 - DNA, 3090 bp, Artificial Sequence
  Description of Artificial Sequence: Synthetic coding sequence
atggccgagctgcccaccaccgagacccccggcgacgccaccctgtgcagcgggagatttacaatctcaaccctgctgagtagcgacgagccgtctcccccagccgcctatgattctagtcaccctagccacttgacccacagcagtaccttttgcatgcgtacctttggatacaatacaatagatgtcgtgcccacttatgaacactacgccaattccacccagcccggggagcctcgcaaggtgcgtcctaccctcgccgatctgcattcttttctcaaggaaggcaggcacctgcatgccctggcatttgactcgaggccctcccacgaaatgactgacggtctggttgagggtgaggccggcacttcttcagagaaaaatccggaagagcccgtcaggttcggctgggtcaagggggttatgatcaggtgcatgctcaatatctggggcgttatcctgtatctgcggttgccgtggatcaccgcccaggctggtattgttctgacttggattattatcctcctcagtgttaccgttactagcataaccgggttaagtatctcggccatatccaccaacggcaaggtgaagtctggtggtacctattttctgatctctcgcagcctcgggccagaactgggcggctcgattggactgatatttgcctttgccaatgccgtaggggtggctatgcacacagttggtttcgccgagaccgtcagggacctcctgcaagagtatggtgctccgatcgtcgatcctattaacgacattaggatcatcgcagttgttagcgttaccgtcctgctggcgatttctctggcaggcatggaatgggagtccaaggcccaagtgctgttttttctcgtgatcatggtatctttcgctaactatctcgtgggcaccctcatccctcccagtgaagacaaggcaagtaaaggattcttttcttatagagccgacatttttgtgcaaaatctagtgcccgactggcgcggccccgatgggacctttttcggcatgttcagcatcttctttccatccgccaccggcattctggcgggtgcaaatattagtggcgatctgaaggaccctgccatcgccatcccaaaagggactctcatggctatattttggacaaccattagctatttggcgatctccgccacaataggttcgtgcgtagtcagagatgccagtggggtgctgaatgacacggttactccagggtggggggcatgcgagggtctggcctgctcctacggctggaatttcacagagtgcacgcagcagcactcgtgtcactatggcctcattaactattatcagacaatgtcaatggtgtccggatttgccccgttgatcactgcaggcattttcggtgcgacgctctcgtccgcccttgcatgcctggtctcggccgctaaggtgttccagtgtctgtgtgaggaccagctttaccctctcatcggcttcttcgggaagggctatgggaagaataaagagcccgttaggggttatctcctggcctatgcaattgccgtggcgtttattatcattgctgagctgaatacaatcgctccaatcatatccaatttctttctctgcagttatgctctgattaatttttcttgtttccacgcatcgatcacgaatagccccggctggaggccatccttccaatattacaacaaatgggctgctctgtttggagccatcatctccgtggtcatcatgtttcttttgacgtggtgggccgctctcattgccatcggcgtcgtgctatttcttctcctgtacgtcatctataaaaagcccgaagttaattggggctccagcgtacaagcaggcagttataatttagcgttgagttattctgtcggactcaacgaagtcgaggatcacatcaagaactaccgtcctcagtgtctggttctcacaggacccccaaacttcagacctgctctcgttgatttcgtgggaacgttcaccaggaacctttcccttatgatctgcggtcacgtactgattggaccacataaacagcggatgcccgagctccaactgattgctaatggacataccaagtggcttaacaaaagaaaaattaaagctttttacagcgatgtgatcgccgaagatctgcgcaggggcgttcagatccttatgcaggccgccggcctcggccgcatgaaaccaaacatactcgtggtcgggttcaagaagaactggcagtccgcgcaccctgccacggtggaggattacatcggaatcctacacgacgcctttgatttcaattatggcgtgtgtgtaatgcgcatgcgcgagggcttgaacgtctcaaagatgatgcaggcgcacatcaacccagtttttgacccggctgaagacgggaaggaggcaagcgcacgaggcgccaggcccagcgtttcgggcgccctggacccaaaggcactcgtgaaggaggaacaggccaccacaatttttcagagcgagcagggaaagaaaacaatagacatctattggctcttcgacgatggaggccttacgctgctgattccttacctcctgggccgcaagcggcgatggagcaaatgtaaaatcagggtgttcgtgggagggcagataaatcgtatggatcaggagaggaaagctatcatttcgctgctgagcaaattccggctgggcttccacgaggtgcatatcttgcctgatatcaaccagaatcctcgagccgagcatactaagaggtttgaggacatgatagctccattcagactcaatgacggcttcaaagatgaggcaacggtgaatgagatgcggagagattgtccttggaagatctcagacgaggaaatcacgaagaatcgggttaagtccttaaggcaggtaagactgaatgaaatagtgcttgactatagtcgagacgctgccctaattgtgataactctgccaattggaaggaagggcaaatgtccatcttctctgtatatggcttggttggagacactgagccaggacttgaggccaccagtgattctcattcgcgggaatcaggagaatgtgctgactttctactgtcagtag

SEQ ID NO: 205585 - DNA, 3093 bp, Artificial Sequence
  Description of Artificial Sequence: Synthetic coding sequence
atggccgagctgcccaccaccgagacccccggcgacgccaccctgtgctccggccgctttacaatatcgacactgctatcctcagatgaaccaagcccgcctgccgcatatgatagttctcatcccagtcaccttacgcactccagcaccttctgtatgaggacgttcggatacaataccatagatgtggtgccaacctacgagcactatgccaactccactcagcccggagagccccggaaggtgcgtcccacactcgccgatttgcattcgttcctcaaacaagaggggcgccatctgcacgcactcgcctttgatagcagaccttctcatgaaatgactgacgggctcgtcgagggcgaagccgggaccagctccgagaaaaacccagaagaacctgtcagatttggatgggtaaagggcgttatgatcaggtgcatgttgaatatctggggggtgatcctgtatttacgactgccgtggataacagcccaggccggaattgtgctcacatggataatcatactgttatccgtgaccgtcacatccatcacgggcctgtccatatctgcaatatcaacaaacggcaaggtgaagtccggcgggacatactttctcatcagtcggagtctcggccccgagttggggggctctattggcttgatcttcgcgtttgccaatgctgttggcgttgccatgcacaccgtcggttttgccgaaactgtaagagacctactccaagagtatggagcccctatcgtggaccctattaacgatatacgcatcattgccgtagtctcggtaacagtgctgttggccatcagcttggcaggcatggagtgggaaagcaaggcacaggtgctcttcttcctggtgattatggtgtcctttgcgaattacctggtaggcacattaattccgccaagcgaagacaaagcctccaagggcttctttagctatcgggctgatatctttgtccagaacttagtccccgattggcgtggacccgacggcacatttttcgggatgtttagcattttctttccttccgccactggaattctggccggtgccaacatttctggtgacttaaaggacccagctatcgccatccctaaaggaaccttgatggcaatcttttggaccacaatatcctacctggccatatcagcgactatcgggtcctgtgtagtgagggatgcaagcggagtgctgaacgatactgtgacccctggatggggcgcttgcgaaggcctggcgtgtagctatggctggaatttcaccgaatgcacccagcagcattcctgtcactatgggctcatcaactactaccagactatgagtatggtgtctggctttgcccctttgattactgcaggcatttttggagctactctgtcctccgcactggcgtgcttagtatccgcggctaaggtctttcagtgtctatgtgaagaccagctctatccactgatcggtttttttggaaaaggatatggcaagaataaagagcctgtgaggggctatctgttggcctacgctatagcggtagcctttatcattattgccgagctgaatactatcgcaccaataatctcaaatttttttctctgtagctatgccctgattaacttttcttgtttccacgcttcgataactaacagccctggctggcgccccagcttccagtattataacaaatgggccgcgctcttcggcgctatcatctctgtggtgattatgttcctgttaacatggtgggctgccctgatcgccatcggagtcgtcctctttttactgctgtacgttatctataaaaagcccgaagtgaattgggggtccagcgttcaggccggatcctataacctcgcgctgagttattctgtgggccttaatgaagtggaagaccacataaagaattataggccccagtgccttgtgcttaccggtcccccaaactttaggcctgccctcgtggattttgtggggacattcacgagaaatctgagcctcatgatttgcggccatgtgctcatcggaccccataagcaacgtatgcctgagcttcagctgatcgctaacggtcataccaagtggcttaacaaaaggaaaatcaaagcgttttactccgatgtgatcgcagaagatttgcgacggggggtgcagatcttgatgcaagccgccggcctcgggcgcatgaagcctaacatcttagtagtcgggttcaaaaagaactggcagagcgcccaccccgctacggtcgaggactacatcgggatactgcatgatgccttcgactttaattacggggtgtgtgtgatgcgtatgagggaggggttgaatgtgagtaaaatgatgcaggcacacatcaaccctgttttcgatccagccgaagatggtaaggaggctagcgccagaggcgccagaccaagtgtttctggggctctcgaccctaaggcactggtgaaagaggaacaagctaccacaatctttcagagcgaacagggcaaaaaaaccattgacatttactggctgttcgacgatggcgggctgacactgctcatcccttacctattggggcgcaaacgcaggtggagtaaatgcaagatcagagtgttcgtcgggggtcaaattaatcggatggaccaggaacggaaggctattatcagtctcttgtctaaattccgtctcgggttccacgaagttcacatattgcccgacatcaatcagaaccctcgagcagagcacacgaagagatttgaagacatgattgctccatttcggctgaacgacgggtttaaggatgaggccactgttaacgaaatgagaagagattgcccttggaagatcagtgatgaggagattacgaagaaccgcgttaagtccctaagacaggtgcgacttaacgagatcgtattagactactctagagacgccgctctcatcgtgataacccttcctatcggtaggaagggcaagtgccccagctctctgtacatggcttggctcgaaacgctgtcacaggatctgcgcccacccgtcattctaataaggggaaaccaggagaatgtcctgaccttttactgtcagtag

SEQ ID NO: 205586 - DNA, 3090 bp, Artificial Sequence
  Description of Artificial Sequence: Synthetic coding sequence
atggccgagctgcccaccaccgagacccccggcgacgccaccctgtgctcagggcgatttaccatatccaccctcctgtctagtgacgagccgagccctcccgctgcctacgactcttcccacccgtctcacctcacacacagctctacattttgcatgcggacattcggatacaacacaattgacgtggtccctacctacgagcattacgccaactcaacacagccaggcgaaccaaggaaggtcaggccgacgctggctgatctccactcatttttaaaagagggtcgacatcttcacgcgctggcgttcgactcgagaccaagtcatgagatgacggacggactggtcgagggggaagccgggacaagcagcgaaaaaaatcccgaggagcccgtgagatttggatgggtaaaaggtgtgatgattcggtgtatgctgaacatctggggtgtcatattataccttaggctaccctggatcaccgcccaggcaggtatagtcttgacttggatcataatcttactctcggtaactgtaacgagcattactggactttctatttccgcgatatctaccaacggaaaagtcaaaagcggtggaacctactttctgataagccgatcactcgggccagagctgggtggtagtataggactcatcttcgctttcgctaatgcagttggagtcgcaatgcataccgtcggcttcgccgaaacagtccgggacttgttgcaggagtatggcgccccgatcgtcgaccccattaatgatattcgcattattgccgtggttagtgtaacggtcctgttagccattagtctcgcaggaatggaatgggaaagcaaagctcaagtgttgtttttcttggtgatcatggtatccttcgcaaactaccttgtaggaaccctcatacccccaagcgaggacaaagcctcaaagggtttttttagttatcgcgctgacatctttgtgcagaatcttgtgccggactggagaggacccgatggaaccttctttggaatgttcagtatcttttttccatcagctacaggaatcctggccggggcaaacatctccggtgacctgaaggatcctgcaatcgccattccaaaaggcacgctgatggcaatcttttggacgactatttcctacttggctatttctgcaacgatcggatcatgtgttgtgagagacgcctccggcgttctcaacgatactgttacgcccggttggggcgcctgcgaagggctcgcctgttcatacggctggaatttcactgagtgcacccagcaacacagctgccactacggtcttataaactattatcagaccatgagtatggtgtcgggttttgcccccctcatcaccgcaggaatcttcggggccaccctgagctccgccctggcatgtctggtgagcgccgccaaagtgttccagtgcctgtgcgaagaccagctctacccactgattgggtttttcggcaaagggtacgggaagaataaagagcctgttcgaggatacctactcgcatatgctattgccgtagcatttatcattattgccgaactcaatactattgctcctattatctccaatttcttcctttgcagctatgcccttatcaacttttcctgcttccatgctagcatcacaaattctcctggatggcgcccatccttccagtattataataaatgggcggcactgtttggggccatcattagcgtggtcatcatgtttctgctcacctggtgggcagcgcttattgcaataggggttgtgctgttcctccttttgtatgtcatttacaagaagcctgaagttaattgggggtctagtgtgcaggccggcagctataacttagctcttagttactccgtgggcttgaatgaggtcgaggaccacattaaaaactaccgccctcaatgtcttgtactaacggggccacctaacttcaggccggcgctcgtagatttcgtgggcaccttcacgcgtaacctctctctcatgatctgtgggcacgtcttaattgggccgcataaacagaggatgcctgagctccagctgatcgctaacggccataccaagtggctgaataagcgtaagatcaaggctttttactccgatgttatagccgaggatttaaggagaggcgttcagattctgatgcaagccgcaggcctgggccgaatgaaacctaacattctggtggtcgggtttaagaagaactggcaatccgctcaccccgccactgtggaagattacatcggcatcctccacgacgccttcgatttcaactatggcgtctgtgtcatgcggatgcgggagggactaaacgtgtcgaaaatgatgcaagcacatattaacccagtgttcgatcccgccgaggacgggaaggaggctagtgccaggggcgcacgcccttctgtgagcggagccctggaccccaaggcccttgtgaaagaagagcaggccacgaccatattccagtctgaacagggaaaaaagacaatcgacatttattggctctttgacgatggaggcctcaccctcttgatcccctatcttctcggtaggaaaagacgttggagcaaatgtaaaatccgcgtcttcgttggagggcaaatcaaccggatggaccaggagcgcaaggccatcatctctttgctatcaaaattccggctggggttccatgaagtgcacattctgcctgatattaatcaaaacccgcgcgcagagcatacgaaaaggttcgaggacatgatagccccatttagactcaatgatgggtttaaagacgaggccaccgttaacgaaatgcggagggattgcccctggaaaataagcgacgaagaaattaccaaaaacagggtaaagtccttgcgacaggtcagattaaatgagattgtgcttgattacagcagagatgctgccctgatcgtgatcaccttgccgatcggcaggaaagggaaatgtccatctagcctgtacatggcctggcttgagacactgtcacaggatcttaggccacccgtgattctaatccgggggaatcaggaaaatgtcctgacattctactgccagtag

SEQ ID NO: 205587 - DNA, 1293 bp, Artificial Sequence
  Description of Artificial Sequence: Synthetic coding sequence
atgagcctgaacaacagcagcaacgtgttcctggacagcgtgccctctaacactaataggtttcaggtgtcggttatcaacgagaatcatgaaagtagcgccgctgctgacgataacaccgaccccccacattacgaggaaacaagtttcggagatgaggcccagaagcggcttcgtatctcattcagacccggcaaccaggaatgctacgacaattttctacagtccggcgagaccgccaaaacagacgcctcatttcatgcctatgactcccatacaaatacatattacctacagacatttggacataatacgatggatgccgtgccgaagattgagtactatcggaatacagggagtatcagcggcccgaaggtgaacagaccttccctgctggaaattcacgagcagctggccaagaatgtggccgtgacaccatctagtgctgaccgtgtggccaatggcgatggcatcccgggggacgaacaggccgaaaacaaagaggacgatcaggccggcgttgtgaagttcgggtgggtgaaaggcgtacttgtgcggtgtatgctcaacatttggggcgtgatgttgtttattcgtctcagctggatcgtcggggaggctggaattggtctgggagtcctcataattctgctgtccaccatggtcactagcataacagggctaagtacttctgcaatcgcgactaatgggttcgtcaggggcggcggagcatattaccttatttcaagatcattgggacccgaattcggcggcagcattggcttgatctttgctttcgccaatgctgtcgcagtcgctatgtacgtggtcgggtttgccgagaccgtggtggatcttcttaaagagtccgacagcatgatggttgaccccaccaacgacatccgcattataggcagcataaccgtggtgatcttactgggcatctccgtcgctgggatggagtgggaagcgaaggctcaggtcatcctgctggtgattttgctgatcgcaattgcaaatttttttatcgggacggtgattcccagcaacaatgagaaaaaatccagaggtttctttaattatcaagcatccatcttcgctgaaaatttcggcccgaggtttacaaagggcgagggttttttttcagtcttcgcaatcttttttcccgcagctacagggattctggccggggcgaatatttccggggatcttgaggcgttgagaaaacagggagcttcacccctgcctcagggagcccagtcaagacgcagacgccagacctcccttatctag

SEQ ID NO: 205588 - DNA, 3300 bp, Artificial Sequence
  Description of Artificial Sequence: Synthetic coding sequence
atgagcctgaacaacagcagcaacgtgttcctggacagcgtgccctctaatactaaccgcttccaggtcagcgtgatcaatgaaaaccacgaaagtagcgcggccgctgacgacaacacagaccctccccattacgaggagacctctttcggagatgaggcccagaaaaggctgagaatatcttttagacctggcaaccaggagtgctatgacaactttctgcaatcaggggaaacagccaaaactgatgcctcttttcatgcctacgattcccatacgaatacatattacctgcagacttttggtcacaataccatggatgccgttcccaaaatcgaatattatagaaatactgggagcatctccgggcccaaggtaaaccggcccagcctgctggaaattcacgaacaactcgctaaaaatgtggctgtaaccccctcttccgccgaccgagtggcaaatggggatgggatacctggtgacgaacaggccgagaacaaggaggatgatcaggcaggcgtggtaaagtttggctgggtgaaaggagtccttgtccggtgcatgctaaacatctggggcgtgatgctgtttattagattgtcatggatcgttggcgaggctggtatcggattaggtgtgcttatcatcttacttagcacaatggtgacctctatcacaggcttgagcactagtgctattgccacaaacggcttcgtgcgcggaggcggagcctattatcttatcagcaggagtttagggcccgagtttggcggatcaatcggattgattttcgcctttgcaaatgccgtagccgtcgcaatgtatgttgttgggttcgctgagacagttgtcgacttactgaaagagtctgactctatgatggtcgaccccacaaacgacatccgaatcataggtagtattaccgtcgtgatcttgctgggaattagcgtggccgggatggaatgggaagctaaagcccaggtgatactgctagtgatccttctgatagctatcgccaacttcttcattggaaccgtgatcccctctaataatgagaaaaagtcgagaggcttctttaattaccaggctagtatattcgctgaaaactttggtccaaggttcaccaagggagaggggttcttcagtgtatttgctatcttttttccagcagccactggaatcctcgctggcgcgaacatcagcggggatttagaagacccgcaagatgccatccctcggggtacaatgttggccatctttataacaaccgtggcctatctgggtgtcgctatttgcgtgggggcctgcgtggttagagacgccacaggaaatatgaatgatactatcatctcaggcatgaattgtaatggttcagcagcctgcggtttgggctacgatttttctaggtgcaggcatgaaccctgccagtacggacttatgaataactttcaagttatgagcatggtttccggattcggcccccttattacagccgggatcttctccgccaccttgtcgtccgctttagctagtctcgtcagcgcccccaaagtgtttcaggccctatgcaaagataacatttacaaggccctgcaattttttgctaaagggtatggaaagaacaatgagcccctgagaggatatatcttaacctttttgatcgccatggccttcatactcatcgctgaacttaatactatagcaccaatcatttctaactttttcctggcatcatacgcgctcataaatttttcatgtttccatgccagttatgcaaagagtcccggctggaggcctgcatacgggatatataatatgtgggtgtcattgtttggcgccgttctatgttgcgctgtaatgtttgtgatcaactggtgggcggctgtcattacatacgtgatagagttctttctgtacgtctatgtgacttgtaagaagcctgatgtgaactggggctccagtacacaggccctcagttacgtctctgccctggataacgccctggagctgacaaccgtggaggatcacgtaaagaactttcgcccccagtgtatcgtactaaccggtggaccaatgactcggcccgccctcctcgatatcactcacgcctttaccaaaaatagtgggctctgtatttgttgcgaggttttcgtagggccacgtaagctgtgcgtaaaagagatgaatagcggcatggctaaaaagcaggcctggctgattaaaaataagataaaggcgttctacgccgcagtggctgccgattgcttccgcgacggggttcggagcctgcttcaggctagtggcctaggcaggatgaagcccaataccctggtgatcggctacaaaaagaattggcgcaaagcgccactgactgagattgaaaactacgtcggcattatacacgatgccttcgatttcgagataggcgtggtgatcgtgagaataagccaaggcttcgacataagccaggtgctccaggtgcaagaggagctggagagattggaacaagagaggttagcgctggaggccaccattaaagataatgagtgtgaggaagaaagcggtggtatacgcgggcttttcaaaaaagctggcaaacttaacatcaccaaaactactcctaagaaggatggttctattaatacgagccagtccatgcatgttggcgagttcaaccagaagctggtcgaggcgtctactcagtttaagaagaagcaggagaaagggacaatcgatgtctggtggctattcgacgacggcgggctcactctcctgattccctacatcctaaccctgcgcaagaagtggaaagactgtaagcttcgtatttacgttggtgggaagattaatcggatcgaggaagagaaaatcgttatggcctctctgctgtcgaagtttcgcattaagttcgctgatattcatattatcggtgacataaacattaggccaaacaaggagagctggaaggtgttcgaagagatgattgaaccctatcgactgcacgaaagctgcaaggacttgactaccgcagaaaagctaaagagagagacgccctggaagataacagacgccgaactggaggcggtgaaggaaaagagctatcgccaggttcggcttaatgagctgctgcaggagcacagccgcgcagccaacctcatcgtgctgagcctgccagttgcacgcaaaggaagcatctctgatttgctgtatatggcttggctagagattctcaccaagaatttgcctccagtgctgctcgtgagaggcaaccataagaacgtcctcactttctactcctag

SEQ ID NO: 205589 - DNA, 3300 bp, Artificial Sequence
  Description of Artificial Sequence: Synthetic coding sequence
atgagcctgaacaacagcagcaacgtgttcctggacagcgtgcccagcaacaccaataggttccaggtcagtgtaattaatgaaaatcatgagtcttcggccgccgctgacgacaatacagatcctccgcactacgaggaaaccagctttggagatgaggcccaaaagcggttgcgtattagctttaggcctggcaaccaggagtgctacgataattttctgcagtctggggagaccgcaaaaacagatgctagctttcatgcctacgactctcacacaaacacgtactacctgcagacttttggacataacaccatggacgcagtgccaaaaattgaatattatagaaacacaggctcaatctcaggtcctaaggtcaatagaccgtcccttctggaaattcacgagcaactggcaaagaacgtggcagtcactccctcttccgcagaccgtgtggccaacggggatggcattcccggagatgagcaggcagaaaacaaggaggatgatcaggctggggtcgtgaagttcggttgggtcaaaggtgtcctagttcgctgtatgctcaacatctggggggttatgctcttcattcggctttcgtggatcgtgggcgaggccggaataggtctgggggtgattataattggactgtccgtggtggtgaccacactcaccgggatcagtatgtctgccatctgcacaaacggagttgttagggggggtggtgcctattaccttatatcacgatctctaggccccgaattcggcggttccatagggttgattttcgcgttcgctaacgccgttgccgtagctatgtatgtggtcgggttcgctgaaactgtcgtcgatttgctgaaggaatcggattccatgatggtagatcccacaaacgacatcagaatcattggttcaatcacagtggtcatccttctcggaatctcagtggccggcatggagtgggaggccaaggcacaggttatcctgttagtgatcctcctaatcgctatcgctaacttctttattgggacggttataccaagcaacaatgagaagaagagcagaggtttcttcaactaccaagccagtattttcgccgaaaacttcggtcctcgctttaccaagggagaagggtttttttctgtttttgccatattctttccagctgcgacaggcatcctggctggcgctaatatcagtggcgaccttgaagatccccaagacgccattccaagaggtactatgctggctatcttcattaccaccgtggcctacctgggcgtagccatttgcgtgggtgcatgtgtggtgagagacgctactgggaatatgaatgacactattatcagcgggatgaattgtaatggatctgccgcctgtggcctagggtatgatttttcaagatgccggcatgagccttgtcaatatggtctgatgaacaactttcaggtcatgtcaatggtatccggcttcgggcctttgattactgccggtatcttcagcgctactctgtctagcgctctagcctccctcgtgagcgcacccaaggtatttcaggccctgtgtaaggataatatttataaagcccttcaattcttcgccaaagggtatgggaaaaacaatgaacctcttcgtggatacatacttaccttcctaatcgcgatggctttcatcctgatcgccgaattaaacactatcgctccaatcatttctaatttttttctggcctcctacgccctcattaatttttcctgtttccatgcctcttacgccaagtcacccggatggagaccagcttacggcatttataatatgtgggtcagtcttttcggcgcagttctttgttgtgccgtcatgtttgtgatcaactggtgggcagctgtgatcacttacgtcattgaattttttctgtatgtctatgtcacatgcaagaaacctgatgtgaattgggggagtagcacacaagccctaagttatgtgagcgctctcgacaatgccctcgagctgactacagtagaagaccacgtgaaaaatttccggccacagtgcatcgtgctcactggcggacctatgacgagaccggcactactggatattacccacgcatttacgaagaatagcgggctatgtatctgttgtgaagtctttgtcggcccgcgaaaattatgtgtgaaagagatgaattccggcatggcaaaaaagcaagcttggctcatcaaaaacaaaatcaaggctttctacgccgctgttgcagccgattgttttcgcgacggcgttcggtcactgctgcaggcaagcggattggggcgtatgaagcccaacacactggtcatcggatacaagaaaaattggaggaaggccccgctgactgagatagaaaattacgtggggatcatccacgatgcatttgactttgaaataggggtggtaatcgtcaggatatcccaagggtttgatatttcccaggttctgcaagtgcaggaagaattggagagactggaacaggaacgcctggcgctggaggcaaccattaaggataatgagtgcgaagaggagtctggcggaattcggggtcttttcaagaaagccggaaagctgaacataaccaaaacaaccccaaaaaaggatggatccatcaacacaagtcagtcgatgcacgtcggcgaattcaaccagaaactggttgaagcttccacacagttcaaaaagaagcaggaaaaaggcacaatcgatgtctggtggctatttgatgatggcggtctcacacttttgattccctacatcctgaccctgcggaagaagtggaaagattgcaagcttcggatttacgtcggcgggaagatcaaccggattgaagaggagaagatagtgatggcaagcctcttaagtaaattccgtattaagttcgcagacattcacattattggggatattaacattcgccccaacaaggaatcgtggaaagtcttcgaggagatgatagaaccgtatcgcctccacgagtcgtgtaaggatttgaccactgctgagaagctcaaaagggaaactccctggaaaattacagacgccgagctggaggctgtgaaggagaagtcctacaggcaggttagactgaatgagctgttgcaagaacactcccgcgcagctaatctcatcgtgctttctctacctgtggctcggaagggttccatctctgacctgctgtatatggcatggctcgagatactcactaaaaacttgcctccagtcctactagtgcgtggtaaccataagaacgttctgaccttttattcttag

SEQ ID NO: 205590 - DNA, 1782 bp, Artificial Sequence
  Description of Artificial Sequence: Synthetic coding sequence
atgctgaacatctggggcgtgatgctgttcatccggctgagctggattgtaggggaggctggcattggactaggggtgttgattatccttctctcgacaatggtcacctctattaccggactgtccacctccgcaattgccaccaatggtttcgtgcgcggtggaggcgcctattacttaatctctagatctctcggcccggagttcggcgggtctattggactgattttcgcgtttgctaacgctgttgcggttgccatgtacgtagtgggattcgcagaaactgtagtcgatctcctgaaggaaagtgattctatgatggtggatccaactaatgatattcgtatcattgggagtatcaccgtggtgatcctactgggtattagcgtcgccggcatggagtgggaagctaaggcgcaggtgatactcctggtcatccttctcattgccattgccaacttctttattggcaccgtcatcccctctaataatgaaaaaaaatctcgcggcttctttaactaccaggctagcatatttgccgagaactttggacccaggttcaccaaaggggagggcttctttagcgtctttgctatcttctttcccgctgcaactggcatcctggccggggcaaacataagcggagacctggaggaccctcaggatgccataccacgcggtaccatgcttgctatcttcataaccactgttgcttacctgggagttgcgatttgtgttggagcatgcgtggtcagggatgcgactggaaatatgaacgacaccatcatctcaggaatgaattgtaatgggtctgcagcttgcggtttggggtatgatttcagcagatgcagacacgagccttgccaatacgggttgatgaacaactttcaagtcatgagcatggtttcaggatttggtcccttgatcactgcgggtatcttctcggcgaccctgagcagtgccctggctagcctggtgtcagcccctaaggtatttcaggccttgtgcaaggataacatctacaaggcccttcagttttttgctaagggatacggaaagaacaacgaacccctccgaggctatatcttgacgtttctcattgcaatggctttcatcctaatcgccgaactgaacacaatcgcaccgataatctcgaatttctttctggcttcatatgccttgataaactttagctgctttcacgctagctacgccaaatcccctggttggcggccagcctatggcatctacaatatgtgggtcagcctgttcggcgcggtgctttgctgcgccgtgatgtttgtgataaactggtgggccgccgtgatcacctatgttatagaattttttctctatgtgtatgtgacttgtaaaaaacctgatgtgaattgggggagttccacacaggccctgagttacgtttcagcactcgataatgctctcgagttaacaacagtagaggaccacgtaaagaacttccggccacaatgcatcgttctgaccgggggccccatgacgcgaccagcccttttagatataactcacgcatttactaaaaattcagggttatgtatctgttgcgaggttttcgtgggcccgaggaaactgtgtgtcaaggaaatgaatagtggtatggccaaaaccggtctggcatataaagagcagaatcagggtttcctgtgctgtagtggtgggcgcctgttccagggctggtgccctaaatctagctccggcctgcggctcagaaaaaacgagaccaagcatagcggcgattggatctag

SEQ ID NO: 205591 - DNA, 540 bp, Artificial Sequence
  Description of Artificial Sequence: Synthetic coding sequence
atgcggaccatgcgggccgtgcagctgcagatgaccatcctgacccatcatattatgaaaaagcccctgcttggcatgaaactgcggaaggatagcgagagtgcactgggtctggggattcgttctgctatgaccattagcagcaagcaggccctgtcgtatgtgtctgcattagacaatgctttagagcttacaacggttgaggatcacgttaagaatttccgcccacaatgcatagtccttacgggtggacccatgacaaggcccgctctgttagatatcactcacgctttcacaaagaactcaggtctgtgcatctgctgtgaagtgtttgtggggccacggaagctttgtgtcaaagagatgaactcagggatggcgaagaagcaggcatggctaattaagaataaaatcaaagctttttacgctgcagtcgcagccgattgctttcgtgacggcgtgcgcagtctcctgcaggcctccggtttaggaagaatgaagccaaacaccctcgtgatcggttataaaaaaaattggtag

SEQ ID NO: 205592 - DNA, 3300 bp, Artificial Sequence
  Description of Artificial Sequence: Synthetic coding sequence
atgagcctgaacaacagcagcaacgtgttcctggacagcgtgcccagtaacacaaacaggtttcaggtgagcgtgattaatgaaaaccacgagtcctccgctgctgccgatgacaataccgatcctccccactacgaggagacttcttttggcgacgaagcgcagaagagactgcgcataagttttaggccggggaatcaggagtgctacgacaactttttgcagtccggagagactgccaaaaccgatgcttcttttcacgcctacgactcccatactaacacctactatctgcaaacgttcggtcacaatacaatggatgccgtacctaaaatagaatactacagaaacactggaagcatctctggacccaaagtcaaccgcccctctctcctcgagatccatgagcagttggccaagaacgtggcggtcaccccatctagtgccgatagagtggccaatggagacggcattcctggggatgaacaggccgagaataaagaagatgatcaggcaggtgtagtgaaattcggatgggtgaagggcgtgcttgttaggtgtatgctgaacatctggggagtgatgttattcatccgcctgtcctggattgtgggagaagctgggattggcctcggagtcctgatcatactactttcgacaatggtcacttcaattaccggtctgtccacctctgcaattgccaccaatggctttgtgagagggggcggggcctattatctgatttctcgcagtttagggcccgaatttggcggttctattggccttattttcgccttcgccaacgcggtcgccgttgcaatgtacgtggttgggtttgccgaaacagtagttgatcttttgaaggaaagcgatagcatgatggtcgaccccaccaacgacattcgaattatcggtagtattacggttgttattttactcggtatctctgtggccggcatggagtgggaagccaaggcccaggtcatcttacttgttatactcctcattgcaatagccaacttcttcatcggcaccgtcatcccttctaataacgagaaaaaatctagaggcttcttcaattatcaggcatcgatcttcgctgagaactttgggccccgatttactaaaggcgaggggttctttagtgtcttcgcaatcttctttcctgctgcaaccggcatcctggccggagcaaatatttctggggacctggaagaccctcaggatgccattcctcgggggaccatgcttgccatatttattacgaccgtggcttacttgggggtggccatctgtgtgggagcctgcgtggttcgtgatgccactggtaacatgaacgatacaatcataagcggcatgaattgtaatggttccgccgcatgcggcttagggtatgacttctccagatgtcgccacgaaccttgtcagtacgggttgatgaataattttcaagtgatgtctatggtaagcggcttcggccctctcattacagcaggcatcttctccgctacgctgagtagcgcactcgccagtttggtctccgctccaaaggtgttccaggcactttgcaaggacaacatttacaaggccctccaatttttcgccaaagggtacggtaagaataacgagccgctgcgcggatacatccttacattcctgatagccatggccttcatcttgatcgccgagctgaacacaatcgctccaatcatttccaattttttcctggcaagctacgctctgatcaactttagctgctttcatgcgtcttatgccaagtccccgggatggagacccgcatacggaatctataacatgtgggtaagcctattcggggccgtgctatgctgtgccgtgatgttcgtcattaactggtgggcggctgtaattacctatgtcattgaattttttctatatgtctatgtaacctgcaaaaaacccgacgtaaattggggaagctctactcaggcactgtcatatgttagcgccctggataacgcgctcgaactgaccactgtggaagatcatgtcaaaaactttcgcccacagtgtattgttctcactggaggtccaatgaccagaccagccttactagatattacacatgcatttaccaaaaacagcggtctttgtatctgctgtgaggtgtttgtgggaccacgaaagctgtgtgtgaaggaaatgaattccggtatggccaagaagcaggcctggctcattaaaaacaaaattaaagcattctacgccgcagtcgccgccgattgttttagagacggagtccggtcactcctgcaggcaagcgggctgggccggatgaagccaaatacactagtcatcggctacaagaagaactggcgaaaggctccccttaccgagatcgagaactacgtggggatcatccacgacgcgtttgattttgaaattggagtagttatcgtccggattagccaaggtttcgacatctctcaggtgctccaggttcaggaggagcttgagaggttggagcaggagcggttggctctggaggctactatcaaggacaatgaatgtgaagaggagtccggtgggatacgcgggttattcaaaaaagctggcaagctcaatatcactaagaccacaccaaaaaaagatggttctataaatacgagccagtccatgcacgtcggtgagtttaaccagaaattggtggaggccagtactcagttcaagaaaaagcaagaaaaaggcacaattgatgtttggtggctgtttgatgatggagggttgaccctgctgataccatacatacttaccctgcgcaagaagtggaaagactgtaagctgcgcatttatgttggcggaaaaataaaccgaatcgaagaagagaagatcgtgatggcgagcctgcttagcaaattccgaatcaagttcgctgacattcacattattggagatatcaacattcgcccgaacaaggaatcatggaaggtctttgaggagatgatcgaaccttatcgcctgcatgagtcatgcaaggatctgactaccgccgaaaaactgaagcgcgaaacgccttggaagataacagacgcggaactggaggcggtcaaagaaaaaagttaccgccaggtgcgtctcaatgagttattgcaggagcactcccgcgcagcaaacctgatcgtgctgtcattacccgtcgcacgcaagggaagcatcagtgacctgctgtacatggcgtggcttgagatcttgactaagaacctcccgccagttctcctggttagaggaaaccataaaaacgtgcttactttttactcatag

SEQ ID NO: 205593 - DNA, 1947 bp, Artificial Sequence
  Description of Artificial Sequence: Synthetic coding sequence
atgctgaacatctggggcgtgatgctgttcatccggctgagctggattgttggcgaagcagggattggtctcggcgtgttgataattttgctcagtaccatggtgacttcaatcactggtctctctactagcgcaatcgccacaaacggatttgtgcgcggggggggggcctactaccttattagtagatccctgggaccggagtttggaggatccataggtctgattttcgcgttcgccaatgcagttgccgtggccatgtatgttgtgggctttgcagaaactgtggtggatctgctaaaggaatccgacagcatgatggtggaccctacaaatgacatacgcatcatcggcagcattacagtggtgatcctattaggcatcagcgttgccggtatggagtgggaggcaaaggcccaagttattctcctggtcattcttctcattgctatcgccaatttttttataggtacagtgataccaagtaacaatgaaaaaaagagccgcggattttttaattaccaggcatcgattttcgcggaaaacttcggcccccgattcactaaaggggaaggcttcttttccgtgttcgcaattttctttcctgccgcgactggcatcctcgcaggcgccaatatctccggtgatctggaagacccccaggatgctatccctcggggaaccatgcttgctatctttatcaccaccgttgcatatttaggcgtcgccatctgtgttggggcgtgtgtggtccgagatgctactggtaacatgaatgacaccatcatttccggaatgaattgcaatggttcggcagcgtgtgggctaggctatgatttcagtaggtgccgtcatgagccatgtcagtacggactgatgaacaatttccaggtgatgtcaatggtgagcggttttggacccctcattactgcaggtatcttctctgccactctgtcatctgctctggcctcccttgtatccgctccaaaagtgttccaggcgctctgcaaagacaacatttacaaagccctccagttttttgcaaaaggatatgggaaaaataacgaaccgttacggggttatatacttaccttcctgattgctatggcatttattctcattgccgagttgaatactattgcccctatcatcagtaacttcttcctggcctcatatgcgctgattaatttctcttgctttcatgcttcttatgcaaagtcacccggttggagacctgcttatggcatttacaacatgtgggtatcgctgttcggtgctgttctgtgctgcgccgtgatgttcgtgattaactggtgggccgcggtgatcacttatgtgattgaattcttcctttacgtatatgtgacttgtaaaaaacctgatgtaaattggggatcaagcacccaggccctgtcctatgtttcagctctggataacgccctcgagctgaccacagtcgaagatcatgtcaagaattttagaccgcagtgtatagttttaacgggtggtccgatgacccgacccgctcttctggacatcacccacgcttttaccaagaacagcggactgtgtatctgttgtgaggtttttgtcgggccgcgcaaactgtgcgtcaaggaaatgaactccggaatggctaagaagcaggcctggctgataaagaacaaaattaaagcgttctatgccgcagtggccgccgactgttttagagacggcgtgaggtcactgttgcaggcttcgggactaggtcgtatgaagccaaatacactcgttatcggctataaaaagaactggaggaaggcaccactgaccgaaatcgagaattacgtcggtatcattcatgacgctttcgatttcgagataggcgtcgttatcgtgcgaatcagccagggttttgacattagccaggtattgcaagtgcaggaagagttagaacgcttggagtag

SEQ ID NO: 205594 - DNA, 3639 bp, Artificial Sequence
  Description of Artificial Sequence: Synthetic coding sequence
atggagccccggcccaccgcccccagcagcggcgcccccggcctggcaggggtaggggagacaccatccgccgccgcactggctgccgctagggtggagcttccaggaaccgctgtcccctctgtgccggaagatgcggcccccgcctctcgcgatggaggcggggtacgggatgagggtcccgctgcggcaggggatggactgggtagaccattgggccccacgccttctcaatcaaggttccaagtggacctcgtgtccgagaatgctggtagggccgcggcggccgctgctgcagccgctgccgctgcagcagctgccggagctggtgcaggcgccaagcagacacctgcagacggagaagcctctggggaaagcgaaccagctaagggatcagaggaggctaagggaaggttccgagttaattttgtggaccccgctgcctcgagttctgcagaggactcgcttagtgatgccgctggagtgggggtggatggtcctaatgtgagttttcagaatggtggtgatactgtgctcagtgagggttctagcctgcatagcggtggcggaggagggagtggtcatcatcaacactattactacgacacacataccaatacctactacttacggacattcggacacaatacaatggatgccgtaccccgaattgatcactaccgccatacagccgcacagctcggcgaaaagttgctaagaccctctctagcagagttacacgacgagttagagaaggagccttttgaggatggctttgctaatggagaggagtccacaccaacgagggatgctgttgtgacatataccgccgagagcaaaggggtcgtgaagtttgggtggattaaaggcgttctggtgagatgcatgctcaatatttggggcgtcatgctcttcatcagactgagttggatcgtcggccaggcagggataggtctaagcgttctcgtaattatgatggcaaccgtagtcaccacaattactggcctgtctacctcagcaattgccacaaacggtttcgtacgcgggggaggggcatactatttgatctcccggtcactaggtcctgagtttgggggcgctatcgggctgatctttgccttcgctaacgccgtggcggtggccatgtacgttgtgggcttcgctgaaactgtggtggaactcctcaaagagcattctattctcatgatcgatgagataaacgacatccgcatcataggggccatcacagtggtgatcctgctggggatctcagttgccggtatggagtgggaagccaaggcccagatagtccttctcgttattctgctgttggccatcggtgactttgtgatcggtacatttatcccactggagtctaagaaaccaaagggctttttcgggtataagtcagaaatcttcaacgaaaactttgggcccgactttcgtgaggaagagacctttttttctgtatttgctatctttttcccggcagccacaggcatcctggcgggcgcaaacattagcggcgatctagctgacccacagtccgccatcccgaaaggaaccctgctggccattctaataacaacattggtgtatgtgggtattgcagtttcggtaggcagttgtgtggtcagagatgcaactggaaacgtgaacgacacaatcgttactgaactgacaaattgcacatcagcagcttgtaagctcaacttcgacttttcttcttgcgaaagctcaccctgttcttacggactgatgaacaatttccaagttatgagcatggttagcggctttacgcctttaatctcggcggggattttcagcgctacgctgtcctctgctctggcctcgctggtttcggcccccaaaattttccaggcactttgcaaagataatatctatcctgccttccaaatgttcgctaagggttacggaaagaataacgaacctttaagaggttatatcctgactttcctgattgctctggggtttatcctcattgcagaattgaatgtcatagcccccattatttccaacttctttctggcctcctacgctcttatcaattttagcgtcttccacgcatcactcgccaagtcccccgggtggagaccagctttcaagtactataacatgtggatcagtctgctcggagctattctctgctgcatagtcatgttcgtcattaattggtgggctgccctactgacatatgtaatcgtattggggctgtatatctatgtgacttacaaaaaacccgatgtgaattgggggtcttccacccaggcactaacctacctaaacgcgctgcagcattctatcaggcttagtggggtggaggatcatgtgaagaatttcaggccgcagtgcctcgtcatgacaggggctcctaacagcagacccgcccttctgcatcttgtgcacgacttcactaaaaatgttgggcttatgatctgtggacacgtacacatgggccctaggagacaggcaatgaaggaaatgtcaatcgatcaagccaaataccagcggtggcttattaagaacaagatgaaggctttctacgcccctgtgcacgccgacgacctccgcgagggggcacagtaccttatgcaggccgccggcctggggcggatgaagcccaacaccctggtgctggggttcaaaaaggactggttacaggccgatatgagagacgtggacatgtacattaacctattccatgatgcctttgacatccagtacggcgtcgttgtgatccgcctgaaggagggactcgacatcagtcatctgcagggacaggaagaactgctgagttctcaggaaaagtccccgggtacgaaagatgtggttgtttcagtagagtatagcaagaaatctgatctggacactagcaaaccactcagcgagaagccaattacacataaagtggaggaagaggatggaaaaaccgcaacccagcccttgttgaaaaaagaatcaaaggggcccatcgtccctctgaatgtagcagaccagaaactcctggaagcctccactcagtttcagaagaaacaggggaaaaatacaattgatgtttggtggctatttgacgatggtggtctaacgctgctgattccctacctgctgacaaccaaaaaaaaatggaaagactgcaagattcgcgtcttcatcggcggcaaaatcaatagaatcgaccacgaccggagagcaatggccacacttctgtctaagttcaggatcgattttagcgacataatggttctcggtgacattaatactaaacccaaaaaggagaatataatcgcatttgaagagatcattgagccatatcgacttcacgaggatgacaaggagcaggacattgccgataaaatgaaggaggacgagccatggcgcatcaccgacaatgaactggagctgtacaaaaccaagacataccgacagattcgccttaacgaactgctcaaggagcacagcagcacggcaaatatcatcgtgatgtctctccccgtggcaagaaagggagcagtctcatccgccctgtatatggcatggttggaggctctgtcgaaggacctcccacccattctcttagtacgcggtaatcatcaatcggtcttgacattctacagttag

SEQ ID NO: 205595 - DNA, 3591 bp, Artificial Sequence
  Description of Artificial Sequence: Synthetic coding sequence
atggagccccggcccaccgcccccagcagcggcgcccccggcctggctggggtcggtgaaacaccatccgctgctgccttagcggccgccagagtggaactgccgggcactgctgtgccctccgttcccgaagacgcggctcccgctagccgcgatggaggcggcgttagagatgaaggcccagctgctgccggggatggactggggcgtcctttaggaccaacaccatctcagagccggtttcaggtggacctggtctcagaaaacgccggtagggctgcggccgctgctgcggcagccgccgccgccgctgccgccgccggtgctggggcgggtgccaaacagacccctgccgatggggaggcttctggggagtccgagcctgccaagggaagcgaggaggctaaagggagattcagggtgaacttcgtggatccagccgcaagctcctccgccgaagactctttatccgacgccgccggcgtaggcgtcgatggccccaatgtaagtttccagaacggtggtgacacagtcctctccgagggttcgtcactgcactccggcgggggaggcgggtctgggcaccatcagcactattattacgatactcatacaaacacctattacctgagaacctttggccacaacactatggatgccgtgcctcggatcgatcactataggcatacggccgcccagctcggcgaaaagttgttgcggccgtctctggctgagctacatgacgagctcgaaaaggaaccattcgaagacgggtttgccaacggggaggaatcaactcccactcgcgatgctgtggttacttacacagcggagagtaagggcgttgtcaagtttggatggatcaagggtgtcctcgtccgctgtatgttgaacatttggggcgtgatgctcttcatcagactgtcctggattgttggccaggccggaatcggactctctgtgttggtaatcatgatggccacggtggttactaccattactggattgtccacctcggccattgctacaaatggcttcgtgagaggcgggggtgcttactatctgatatctcgctcgctggggccggagttcggaggggctatcgggcttatctttgcattcgcaaatgctgtggccgtggccatgtatgtcgttggatttgcagaaactgtggtggaactgttgaaggaacactctatcctgatgattgatgagatcaacgatatacgcatcatcggcgccatcactgtggtgattctgctagggataagcgtggccggcatggagtgggaagcaaaggcccagattgtgctactggttattctgctgttagccataggcgatttcgtgatcggtacttttatcccgctggagtctaaaaaacctaagggtttcttcggctataaaagtgaaatttttaatgagaacttcggcccagactttcgggaagaagaaactttcttctctgtcttcgctattttcttcccggcagcgacaggaatcctggcaggtgctaatattagcggggacctggctgatcctcagtccgccatccctaaaggcacattgttggcaattctgatcacaaccctggtctatgtcggaatcgccgtgtcagttggctcctgcgtggtacgggacgctacaggcaatgtcaatgacacaatcgttactgagctgaccaactgtacgagtgccgcttgcaagttgaactttgatttcagctcatgtgagagtagtccttgctcctacggactgatgaataacttccaggtgatgagtatggtaagcggtttcaccccgcttatctcggctggaatcttcagtgccacacttagttccgccttagcaagtcttgtatctgcacctaagattttccaggcactctgcaaagataatatttatcccgctttccagatgttcgctaaaggctatggaaaaaataacgaacctctcagagggtacattctgacgtttctgatcgccctaggctttattctgatcgccgaactgaacgtgattgcccctatcatttccaatttcttcctcgccagctacgcgctaatcaacttctcagtctttcacgcatccctggctaaatccccggggtggcggcctgcgtttaaatattacaatatgtggattagtctgttgggcgcgattctgtgttgcatagttatgtttgtgattaattggtgggcggccttgctgacttacgttattgtcctcgggctgtacatctacgtgacttacaaaaaaccagatgtaaattggggaagctctacacaggcgctgacctatttaaacgccctgcaacatagcattagactgtccggcgtagaggaccatgttaaaaacttcaggcctcagtgtttagtaatgaccggcgctcctaattcccggcccgccctccttcacctcgtgcacgacttcactaagaatgtagggctgatgatctgtggtcacgtgcatatgggacccagaaggcaggcaatgaaagaaatgtcaattgatcaggctaagtatcaaagatggcttattaaaaataagatgaaagcattctatgctcccgtgcacgcagatgacctccgggaaggagcccagtacctgatgcaggccgcaggcctgggccggatgaagcctaatacactggtgcttgggttcaagaaggattggttacaagccgatatgagggatgtggatatgtacattaacctgttccacgacgctttcgatatccagtacggagttgtcgtaatacggcttaaggagggactggatatctcccacctgcagggccaagaagaattactgtcctcacaggaaaaatcgcctgggacgaaggacgtggtggtcagtgtagagtactccaagaaaagcgacctggatacaagcaaaccactgtctgaaaaacctatcacacacaaagagtcaaagggccccattgtgccgctgaacgtcgctgatcagaagttactggaagccagtactcagttccagaagaaacagggcaaaaacacaatagacgtgtggtggttgttcgatgatggtggactgacgctgctgataccttacttgctgaccacaaaaaagaagtggaaggattgtaagatacgggtcttcatcgggggaaaaattaatagaatcgatcacgatcgaagagccatggctactttgctgtccaaatttcgcatcgattttagcgatatcatggttttaggggacatcaatactaaaccaaagaaggagaacattatagcctttgaagagataatcgagccctacaggttacatgaggatgataaggaacaggacatcgcagacaagatgaaggaggacgaaccctggagaatcacggataatgaactggagctgtacaaaacaaagacatataggcagattcgcttaaacgagctcctgaaagaacatagctctacagccaacataattgtgatgtctctcccggttgcaaggaaaggtgcggtctcctcagcactgtatatggcatggctcgaagctctctctaaggacttaccacctatcctgttggtacgcgggaatcatcagtccgtcctcacattctatagctag

SEQ ID NO: 205596 - DNA, 1788 bp, Artificial Sequence
  Description of Artificial Sequence: Synthetic coding sequence
atgaagttcttcagctacatcctggtgtaccggcggttcctgttcgtggtctttacagtgctggtccttctgccgctccctatagtgctacatacaaaggaagcagagtgcgcttatacgctctttgtggtcgctacattctggctgacggaggcactgcctctgagcgtcactgcactcctccccagcctgatgcttcccatgttcggaatcatgccgagtaagaaggtggcatccgcatacttcaaagattttcacctgctgctcatcggcgttatctgcttagctacttcaattgaaaagtggaacctccataaaagaatcgcgttgaaaatggttatgatggtaggagtgaacccagcctggctcacactcggcttcatgtcttccaccgcttttctttccatgtggctctccaatacatcaacagcagccatggtcatgcctatagcagaagccgtagtgcagcagataatcaatgcagaggccgaggttgaggccacacagatgacatatttcaatggcagcacaaaccacggcctcgaaatcgatgagtccgtcaacggacacgagataaatgaaaggaaagagaaaaccaagcccgtgccgggctataacaatgacacaggaaagatatccagcaaagtcgagcttgagaaaaattccggcatgcggaccaagtatcggaccaaaaaagggcacgtcacaagaaaactgacctgtttatgcatcgcttattctagtactattggcggccttaccaccatcaccggcacttccacaaacctcatcttcgctgaatactttaacacccgctacccggattgccggtgcctgaattttggaagttggtttacgttcagtttcccggccgcgctcatcattctgttgttaagctggatatggctgcagtggctcttcctggggtttaacttcaaggaaatgttcaaatgcgggaaaaccaagactgtgcagcagaaggcttgcgccgaagtgattaagcaggagtatcagaaactgggcccgattcgctaccaggagatcgttacattggtattgttcattattatggccctgctgtggttctcacgcgatccaggctttgtacccggctggtccgccctgttctccgaatatcctggcttcgccaccgatagcactgtggccctgcttattggattactcttttttttgatcccagccaaaacgctcacgaaaacaacgcctacgggcgagatagtggccttcgactatagtccactgattacatggaaagaatttcagtcttttatgccctgggacatagctattctggtggggggtggcttcgctctggcagatggatgtgaagagtctggcctgtccaaatggatcggaaacaaactctctccattaggatccctgcccgcttggctgattatcttgatctcatctctgatggtcacttcccttacagaagttgcatcaaaccctgcgacaatcaccctgttccttccaatccttagtccactggctgaggcaatccatgttaatcccctctatattctcattccttcgaccctctgcacctcattcgcctttttgcttcccgtagctaatccaccgaatgccatcgtgttctcttacggacatcttaaggttattgatatggtcaaggccggactcggggtgaatatcgtgggcgtcgccgttgtcatgctggggatctgtacttggatagttcctatgttcgacctgtacacctacccctcctgggctccagccatgtctaatgaaactatgccgtag

SEQ ID NO: 205597 - DNA, 486 bp, Artificial Sequence
  Description of Artificial Sequence: Synthetic coding sequence
atgctgcccatgttcggcatcatgcccagcaagaaggtggccagcgcttactttaaggatttccacctgctgctgatcggtgtcatctgcctggctacgtctatcgaaaaatggaatttgcacaagcgcatagccttgaaaatggtgatgatggtcggagtgaacccagcctggctgacgctgggctttatgagctccaccgcattcctaagcatgtggctgagtaataccagtactgcggccatggttatgcccattgcggaagccgttgtgcagcagattatcaacgcagaggctgaagtggaggccacacagatgacatactttaatggctctaccaaccacggcctagaaatcgatgagtcagtgaacgggcatgagatcaatgaaaggaaagaaaaaactaaacccgtgcccggctacaacaatgatacaggaaagatcagttccaaggtggaattggaaaaatacctccaagtgaggtag

SEQ ID NO: 205598 - DNA, 1881 bp, Artificial Sequence
  Description of Artificial Sequence: Synthetic coding sequence
atgggcctgctgcagggcctgctgcgggtgcggaagctgctgctggtcgtgtgcgtccccctgctcctgctcccactccccgttctccatccatcctccgaggcttcctgtgcatatgtgttaatcgttactgccgtgtattgggtgtccgaagcggtacccctcggggcggcagccctagtcccagcatttctgtaccccttcttcggcgtgctgcgcagcaatgaagtggccgccgagtacttcaagaacacaactctgctcctggttggagtaatctgcgttgccgccgccgtggagaagtggaatctccataagcgaattgcactgcggatggttttgatggccggagccaaacctggaatgctgcttctgtgcttcatgtgctgtactacacttctgtccatgtggctcagcaacacttccacgaccgcgatggtaatgccaatcgtggaggccgttcttcaggagctggtgtccgccgaggatgagcagttggtggctggtaactcgaataccgaggaggcagagccaatcagtctggacgtgaagaactcccagccaagcctggagctaatctttgtgaacgaagagtcgaatgctgaccttaccactctgatgcataacgaaaatctgaacggtgttccttctataactaaccccattaagacagccaatcaacatcagggcaaaaagcagcacccctctcaggagaagcctcaggtcttgacccctagccctcggaaacaaaagctaaatcgaaaatacaggagccatcacgatcagatgatctgtaaatgtctctctctgtcaatttcttatagtgctacaatcggtggtctgactaccatcatcggtactagcacaagtctgatattcctggagcactttaacaaccagtaccctgccgctgaagtggtcaacttcgggacttggtttttattctcctttcctatatccttgattatgttggtggtgtcctggttctggatgcattggcttttcttaggttgtaacttcaaggaaacatgctctctgtcaaaaaagaagaaaaccaagcgagagcagctctcagaaaagcgtatacaggaagaatacgagaagttgggagatatttcctatccggagatggtgaccgggttctttttcattctcatgactgttctgtggttcacacgcgaaccaggcttcgtgcctggctgggactcattcttcgaaaagaaagggtatcggacagatgctaccgtgagtgtgtttcttggcttcctactctttttgatccctgctaaaaagccctgttttgggaaaaagaatgatggcgagaatcaggagcactctctgggcacggagccaatcattacctggaaggactttcagaagaccatgccctgggaaattgtcatcttggtgggcggtggttacgccctggcgtcaggttccaagtcgtctgggctaagcacttggatcggaaatcagatgctgtctctgtcaagcctgcccccttgggccgtgactttactcgcctgcattctggtaagcattgtcaccgagtttgtgtccaatcccgctactattactatttttctgcccattctttgtagtcttagcgagactctccacatcaaccctctctataccctgatcccagttactatgtgcataagcttcgctgtcatgctgccggtggggaaccctcccaacgcaatcgtgttcagttacggccattgccagattaaagacatggtcaaggcaggactcggcgtaaacgtgatcggcctcgtgattgtcatggttgctatcaacacctggggggtatcattgttccacttagacacctaccccgcctgggcacgggtgtccaacattaccgaccaagcttag

SEQ ID NO: 205599 - DNA, 1569 bp, Artificial Sequence
  Description of Artificial Sequence: Synthetic coding sequence
atggccagcgccctgagctacgtgagcaagttcaagagcttcgtgattctgttcgtaacacctctccttcttttgccacttgtaatcctgatgcctgccaagtttgtgcggtgtgcctacgtgatcatcctcatggcgatctattggtgcactgaggttatcccactcgcagtcaccagcctcatgcctgtcctcctattcccactgtttcagattcttgatagtcgacaggtgtgcgtgcagtacatgaaggacactaacatgctgttcctcgggggcttgattgttgccgttgcggtagagcggtggaatctccacaagagaattgcactgaggactctgctgtgggtaggggccaaacccgctaggttaatgttagggtttatgggcgtcacagcactactctctatgtggatttctaacaccgctaccacagccatgatggttcctatagttgaagcaattctgcagcagatggaagccacctccgccgctactgaggccgggctcgaactggtagacaaggggaaggctaaagaactcccaggctcccaggtcatcttcgagggacctactctgggccagcaagaggaccaagagcgcaaacgcctctgcaaagctatgacactttgcatctgctatgccgcaagcattggcgggactgccacactgacaggtacaggaccaaacgttgtgctgctggggcagatgaatgaactcttccctgatagcaaagacctcgtaaacttcgcttcctggtttgcctttgcatttcccaacatgctcgtgatgctcctgtttgcctggctctggctacaatttgtgtacatgcgcttcaattttaaaaagtcctggggttgcggacttgagtcaaagaaaaatgagaaagccgctctaaaagtgttacaggaggaatatcggaagctggggccactttcctttgcagagattaacgtgctaatatgtttttttctgcttgtcatcctttggtttagtcgcgaccccggctttatgcccggatggttgacagtcgcttgggtcgagggagaaacgaagtacgtgtccgatgctacggtcgcaatcttcgtcgcaacattgctgtttatcgtcccttcacagaagcccaagttcaatttcaggagtcaaacagaggaagaaaggaaaacccctttttatccccccccactcctggattggaaagtgacacaggaaaaggtcccgtggggcattgtgcttctacttggaggcggctttgcgctggctaaggggtcggaggccagcggcctgtcagtgtggatgggcaaacaaatggaaccactgcatgcagttccccctgccgccatcacgctgatcttgagcctcctcgtggccgttttcacagaatgcacatccaacgtcgccacaacaacactgttcctccccattttcgctagcatggttaagactggcgtgatcatgaatataataggtgtattctgtgtgtttcttgctgtgaacacgtgggggcgagctatcttcgacttggatcatttcccagattgggcaaatgtaactcatattgaaacatag

SEQ ID NO: 205600 - DNA, 1707 bp, Artificial Sequence
  Description of Artificial Sequence: Synthetic coding sequence
atggccagcgccctgagctacgtgagcaagttcaagagcttcgtgatattgtttgtgactcctctcctccttcttccacttgtgatcttaatgcccgccaagtttgtcagatgtgcctatgtcattatattgatggcaatatattggtgcacagaggtcatccctctcgccgtaacttctttgatgcctgttctgctcttcccattatttcagatactagacagtcggcaagtgtgcgtgcaatatatgaaagatactaacatgctgtttttgggaggactgattgtggctgtagcagttgagcggtggaatcttcacaagagaatcgctctgcgcacactgctatgggttggtgcgaagccagccagactaatgctgggctttatgggcgtgactgcgcttttaagcatgtggatctcaaacacagctacaaccgcgatgatggtgccaattgtggaggcaatccttcagcaaatggaagccaccagcgcagccaccgaggcagggctggaactcgtcgataagggcaaggctaaagagctgcctggtagccaggtcattttcgaaggccccactctgggtcagcaagaggaccaggaaagaaagaggttatgcaaggctatgactctgtgcatctgttacgctgccagcattggcgggaccgcaacactgaccggaaccgggccaaacgtggtgcttctgggtcagatgaatgagttgttcccggattcaaaagatctggtaaactttgcatcgtggttcgcatttgcgtttccgaatatgctggtgatgctgctattcgcgtggttgtggctgcaatttgtttatatgagatttaatttcaagaagtcatggggttgcggcctcgaatcaaaaaaaaacgaaaaagctgcccttaaggtgctgcaggaggagtatagaaagctgggacctctttccttcgcggaaatcaatgtgctcatttgtttttttctgctggtaattttatggttctcccgggaccctggttttatgcccggatggttgaccgtggcgtgggttgagggggaaacgaaatacgtgagcgacgccacggtcgccatcttcgttgcaactctcctttttatagttccatcacaaaagcccaaatttaatttccggtcccagaccgaagaggaacggaagacgccattttatccccctccactcctggattggaaggtgacacaagaaaaagtgccttggggtattgtattgctgcttggcgggggattcgcccttgccaagggcagcgaagcatcaggtctgtctgtgtggatgggaaagcagatggaacccctccatgccgtcccccccgccgccataactctgatcctgagcctgctcgtggccgttttcacagagtgtactagcaacgtggccactaccacactctttcttccaattttcgctagcatgtcgcgctctattgggctgaatccactctacataatgcttccatgcaccctctccgcatcctttgcattcatgctgcccgtggcaactccccctaacgctattgtatttacctacgggcatcttaaagttgcggacatggtgaaaactggggtgatcatgaatattatcggggtcttctgtgtattcttagctgttaatacctgggggagggccatttttgatctggaccatttccccgattgggcaaacgtgactcacatagagacgtag

SEQ ID NO: 205601 - DNA, 1578 bp, Artificial Sequence
  Description of Artificial Sequence: Synthetic coding sequence
atggccagcgccctgagctacgtgagcaagttcaagagcttcgtgattttgtttgtcacaccattgctgctcctacctcttgtgatactgatgccagctaaagtgtgcgtacaatacatgaaagatacgaacatgttatttctggggggcctcatcgtagcagtggctgtggagcgatggaatctgcacaaacgcattgcgcttcgcaccttgctgtgggtgggcgctaaaccagcaagactgatgttagggttcatgggagtcaccgccctgctcagcatgtggatcagcaacaccgccacaaccgcaatgatggttccaatcgttgaagctatcctgcaacagatggaggctacttctgcggcgactgaagccggcttagagttggtggacaaaggaaaagctaaagagctgcccgggtcccaggtgatctttgagggcccgacccttgggcagcaggaggaccaggaaagaaagcgcctttgcaaagccatgacactctgcatttgttacgctgccagcattggtggcacagccaccctgacaggcaccggcccaaacgtcgtactgctgggtcagatgaatgaactatttccagacagtaaagacttggtcaactttgcatcttggttcgcgtttgccttcccgaatatgctggtcatgttattgttcgcatggctctggcttcagttcgtatacatgcgatttaatttcaaaaagtcatggggttgcgggttagaatctaaaaagaatgaaaaggccgccctcaaggtcttgcaagaagagtacaggaagctgggcccactgtcatttgcagaaattaacgtgctgatctgtttcttcttactggtgatcctctggttttcccgggaccctgggtttatgcctggctggctgaccgtcgcttgggttgagggagagacaaagtacgtcagcgacgcaaccgtagccattttcgtagctacactgttgttcatcgtacccagtcagaaaccaaagtttaacttcaggtctcaaaccgaagaggagaggaagacgccattctatccacctcccctgttggactggaaggtcacacaagaaaaggttccatggggcattgtcctgctcctcggtggcggcttcgctctcgccaaagggtccgaagcaagtgggttatccgtctggatggggaagcagatggaaccactccacgctgtgccccctgctgcaattaccctgattctgtccctgctggtcgccgtgtttacagagtgtacatctaacgtggccactaccacactgtttctgccaatatttgcttccatgagtcgcagcatcgggctgaatcccctctatatcatgctaccatgtacacttagcgccagctttgccttcatgcttcctgtggcaactcccccaaacgcaatcgtcttcacatatggccatctgaaggtagcggatatggttaagactggcgttatcatgaatatcattggagttttttgtgtgtttctggccgtcaatacctggggtagggctatattcgacttggaccactttccagattgggcaaacgtcacccatatcgagacttag

SEQ ID NO: 205602 - DNA, 1569 bp, Artificial Sequence
  Description of Artificial Sequence: Synthetic coding sequence
atggccagcgccctgagctacgtgagcaagttcaagagcttcgtgatactattcgtgaccccactgctcctgctgcctttagtgatactgatgcccgctaagtttgttagatgcgcctatgttatcatcttgatggccatttattggtgcactgaggtcatacccctggcggtgacctctttgatgccggtgctgctcttccctctgttccagatactggatagccgccaagtgtgtgtgcaatacatgaaggacaccaatatgctctttctcggcggactgatcgtggcagtggcggtggagcggtggaacctgcacaagcggatagcgctgcgtaccttgttgtgggtgggagctaagccggctcgcctgatgttgggttttatgggcgttaccgccctcctgagcatgtggataagtaataccgccacaaccgccatgatggtgcccattgtggaggctatccttcaacaaatggaggcaacttctgctgcaaccgaggctggattggaactggtcgataaaggaaaagcaaaggaactgccagggtcccaggttatttttgagggacctacacttgggcagcaggaagaccaggaaaggaaaaggctgtgtaaagccatgacactgtgtatctgctatgctgcttctatcgggggaaccgctaccctcactggcaccggacccaacgtggtcctgcttgggcagatgaatgaactgttccccgactcaaaggacctagtgaatttcgcatcttggttcgcatttgccttccccaacatgctggttatgcttttgtttgcatggttatggctccagtttgtctatatgcggttcaattttaagaagtcgtggggctgcggcctggaaagtaaaaagaatgagaaggcagcccttaaagtcctgcaggaggagtaccggaaattaggtccccttagcttcgcagaaatcaacgttctgatctgtttcttcctgctggtcatcctctggttctcgcgggaccccggtttcatgccgggatggttgaccgtagcttgggtggagggagagactaaatatgtttctgacgccacagtggctatcttcgtcgctacgctactgtttatagtcccatcccagaagccgaagtttaacttccgaagccagaccgaagaggagcgtaagacccccttttatccaccccctctgctcgactggaaagttactcaggagaaggtcccatggggcatagtgctgttgctggggggcgggttcgcactcgctaaaggaagtgaagcatcggggctgtctgtatggatgggcaaacaaatggagccactccacgcggttccgcctgctgcgattactcttatcctcagtttactggtggccgttttcaccgagtgcacgagtaacgtcgctacaaccacactctttctacctatcttcgcttccatggtcaagacaggcgtgatcatgaatataatcggggtgttttgtgtgtttttagccgtgaatacctggggaagagctatctttgacttggaccacttcccagattgggcgaatgttacccacattgagacgtag

SEQ ID NO: 205603 - DNA, 1779 bp, Artificial Sequence
  Description of Artificial Sequence: Synthetic coding sequence
atggccacctgctggcaggccctgtgggcctaccggagctacctgatcgttttcttcgtacccatcctactattgcctctgccaatactagtccccagtaaggaagcttactgcgcatacgccattattctgatggcactgttctggtgcacagaggccctgccactggcagtaacagccctgttcccactgatcctgttcccaatgatgggcatagtagatgcctccgaagtggcagtggagtacctgaaagattccaaccttctgtttttcggcggattattggtggccatcgcggtggagcactggaacctgcacaaacggatcgcattacgagtgctgttgatcgttggcgtacggcccgcccctctgatcctaggatttatgttggtcacggcatttctgagtatgtggataagtaatacagccacatccgccatgatggtgcctatcgcccacgctgtgctcgatcagttacactcatcacaggcctcctccaacgtggaggaggggtcaaataatccaacctttgaacttcaagaaccttccccacaaaaggaagtcactaaactagataacggtcaagcacttccggttacctctgcatcaagcgaaggtagagctcacctgagccagaaacatctgcaccttacacagtgtatgagtctgtgtgtttgctacagtgcttccatcggcggcattgccacactcacgggaacagcgccaaacctcgttctgcagggtcaaattaacagcttatttccccagaatggcaacgttgttaactttgccagctggtttagcttcgcttttcccacgatggtgattcttttgctcttagcctggctgtggctgcagatcttattcctgggttttaacttccgaaaaaactttgggattggcgagaagatgcaggaacagcagcaggcagcatactgcgtgatccaaacagaacataggctcctgggacccatgacattcgccgagaaggcgattagtatcctgttcgtgatcctggtactgctgtggtttacacgggagccggggttcttcctgggatggggcaacttggcattccctaacgcgaagggtgagtcgatggtcagcgatgggaccgtggcaatctttatcggaatcattatgtttatcattccaagcaaatttccgggactgacgcaggatcctgaaaaccctggcaagctgaaggcgcccctgggcctgctggattggaagactgtaaaccagaaaatgccttggaacattgtcctgcttctgggcgggggttatgctctggccaaagggtctgagcgtagtggactgagtgagtggcttggtaataaattgacgccactacagagcgtcccagcgccagccattgctattattctgagtttgctcgtcgccactttcaccgagtgcacctcaaacgtggccactaccacaattttcctgccaatcctggctagtatggcacaggccatatgccttcatccactctatgtaatgcttccctgtaccctggctacatctctggccttcatgttgcccgtggccactcctccaaacgccatcgttttttcgtttggagatttgaaggtcctcgatatggcccgagccgggtttctgcttaatatcatcggggtgctgatcatcgccctggcaataaattcatggggaatacctttattcagcctccattctttcccatcctgggcccagagtaatactaccgcccagtgtcttccttcacttgctaacacaacaacgccctccccatag

SEQ ID NO: 205604 - DNA, 1926 bp, Artificial Sequence
  Description of Artificial Sequence: Synthetic coding sequence
atggccacctgctggcaggccctgtgggcctaccggagctacctgatcgtcttctttgtcccgatcttgttgctccccctcccaattctcgttccttcaaaggaggcatactgtgcttacgctattattcttatggccttattctggtgcacagaggccttacccctggcagtgacggcattgttccccttgattctgtttcccatgatgggcattgtggacgcctcagaaatcatacaacgacctttccccagctcatttgagtcccccggagagtgccaatccgtgggaatgagcgtcaccgcttcccacaatctagggggcactgtgggtgactctagagtgtttccacctctctcacatgtcagcacgtgccaggtggctgtagaatacctgaaggacagtaatctcctattttttggtggcctgcttgtcgccatcgctgtcgaacactggaatctccacaagcgcatcgcgctgcgggttctgttgatcgtaggcgtccgtccagcccccctgatcctgggattcatgctggtgacagcttttctgtcaatgtggatcagcaataccgcgacttcagcaatgatggtacccatcgcgcacgctgtgctggatcaactgcattcttcccaggcatcttccaacgtggaagagggttcaaacaatcccacatttgaattgcaggagccttcaccacagaaagaagtgacaaagcttgacaacggccaggctctgcctgttacatctgcctcctctgaaggaagagcacacctcagtcaaaaacatctgcatttaacacaatgtatgtctttgtgcgtatgctacagcgcgtccattggcggcatcgcaaccctaactggaactgcccccaatctggtcctgcagggacagatcaactccctgttcccccagaacggcaatgtggtgaactttgccagttggtttagttttgctttccccaccatggttattcttctgctgctcgcgtggctgtggctgcagatcctcttcctggggtttaactttcgcaagaattttggcattggtgagaagatgcaggagcaacagcaggccgcctactgtgtaatacagacggaacaccggttgcttggacccatgacattcgccgaaaaggcaatatccatcctttttgtgatactggtgctgttgtggtttactagggaaccggggttcttcctgggctggggtaatctggcgttccctaacgccaaaggggaatctatggtttccgatggtactgttgctatttttattggaattatcatgttcataatcccctctaaatttcccggattgacacaggacccggagaatccagggaaactcaaagcaccgctcggactgttggattggaaaactgtcaatcaaaaaatgccttggaatattgtgctcctgctaggagggggttacgccttggcaaaaggatccgaacgaagcggtttaagcgagtggttgggaaacaagctcacccctctacagagcgtgccagcccctgccatagcgattatactgtctctgctggtagcaacattcactgagtgtacatcaaatgtggcgactaccactattttcctccctatccttgcatctatggcacaggcaatatgtctgcaccccctctatgtgatgctaccatgcaccctggcaacttcactggcctttatgctcccagtcgccacaccccctaacgctatcgtgttcagttttggcgacttgaaagtactcgacatggcacgtgccggctttctcctcaatatcattggcgtgttaattattgccttagctatcaactcatggggaattcctcttttttccctccattcctttccatcctgggcccagtcaaatactactgcccagtgcctcccatccctcgctaacactactactccaagcccttag

SEQ ID NO: 205605 - DNA, 1566 bp, Artificial Sequence
  Description of Artificial Sequence: Synthetic coding sequence
atgcccgtgtgcggcaacgtggccgtggagtacctgaaggacagcaacctgcttttttttggcgggctgctggtggcaatcgctgtcgaacactggaatctgcacaagcgcatcgcactccgggtactgctaatcgtcggcgtgcgccctgctccgctgattctgggattcatgctggttactgcatttctatcgatgtggatctctaataccgccacgtctgctatgatggtgccaatcgcccacgccgtcctggaccagttgcactcctcacaagccagctccaacgtcgaggaaggatcgaataaccccacgtttgagctccaggagccaagtcctcagaaagaagtgactaagctggataacggacaggctctccccgttacgagcgccagcagtgaggggcgcgcacatcttagtcagaagcaccttcatctgacacagtgcatgtccctgtgtgtttgttacagcgcgtccatcggtggaatagctactctcactgggacggctccgaatcttgtcctccagggccagataaacagccttttccctcagaacgggaacgtggtcaatttcgcctcctggttttccttcgcatttccgactatggtcatcctgttgctcttagcttggctctggctccagatcctgtttctggggtttaacttcaggaaaaatttcggtattggcgagaagatgcaggagcagcagcaggcagcctactgtgtgatccagaccgagcatcgtctgctcggcccaatgacattcgccgagaaagcaattagcattctgttcgtcatcctggtcctgctgtggtttacgagggagcccggcttttttcttggctggggaaacctcgcatttcctaatgcaaagggtgagtcaatggtgtcagatgggacagttgctattttcatcgggatcattatgttcattatccccagcaagtttcccggattgacccaggatcccgaaaaccccggaaagctcaaggcccccctggggctgctggattggaagacggttaaccaaaagatgccctggaatattgttctgctgctaggcggggggtatgcactcgcgaaggggtcagaacgatccgggttgtcggagtggctgggtaataagcttacacccctgcagtctgtcccagcccccgctatagcaatcatcttatctctcttagtcgctacgttcaccgagtgcacttccaatgtggccaccacaacaatctttctccccatacttgcatcaatggctcaggccatctgcttacaccctctgtacgtgatgctgccttgcaccctagctacttctctggcgtttatgctcccagtcgccactcccccaaacgccatcgtattttccttcggggacctaaaggtcctagacatggcccgtgccggattcctgttgaatataatcggcgtgctgatcattgctttggcaattaactcttggggcattcctttattctccctgcacagcttcccctcatgggcacagtccaataccactgcccagtgtcttccatctctggcgaacacgaccaccccctcaccctag

SEQ ID NO: 205606 - DNA, 1035 bp, Artificial Sequence
  Description of Artificial Sequence: Synthetic coding sequence
atggccctgttctggtgcaccgaggccctgcccctggccgtgaccgcacttttccccctgatcttattcccaatgatggggatagttgacgcctcggaagtggccgttgaataccttaaagacagcaatctgctcttttttggaggactgctcgtggcaatcgcagttgagcactggaacctgcataaacggatagcccttcgagtgttactgattgtcggcgtgcgcccagcgcccctgattctgggatttatgctggtcacagcatttctttcaatgtggatttcaaatactgccactagcgcaatgatggtcccaattgctcatgcggtgttggatcagctgcactcctctcaagcttctagcaacgtcgaagaggggagcaacaatccaacatttgagctgcaggaacccagtccccagaaggaagtcaccaaactagacaatggtcaggcactccccgtcacaagtgcctcttccgaagggcgcgcccacttgagccagaaacacctgcaccttacccagtgcatgtccctgtgcgtttgttattctgcaagcatcggcggaatcgccactcttaccgggaccgcccctaacctggttctgcaggggcagatcaactcactctttccccagaatggtaacgttgttaatttcgcctcgtggttcagttttgcgtttcccaccatggtaattttgttgttgctggcttggctatggctgcagattctgttccttggcttcaatttcaggaagaactttggcattggagagaaaatgcaggagcagcaacaggccgcatactgtgtcatccagactgagcacaggttactgggaccaatgacatttgccgaaaaggcgatttccatattgttcgttatcttagtactgctgtggttcaccagggaaccaggattcttctggctgggtcagtttggattctcacaatgtcaaggcggagaagtgagagtggctggggtcggaagacgaacgcatttgggcctcacgtgttcagggaggagagaaggctattag

SEQ ID NO: 205607 - DNA, 1650 bp, Artificial Sequence
  Description of Artificial Sequence: Synthetic coding sequence
atggccacctgctggcaggccctgtgggcctaccggagctacctgatagtgtttttcgtgcccatcttgctgctgcccttgcctatcttggtaccgagcaaggtcgccgtagaatatctcaaggattcgaatttactgtttttcggggggctcttggtggcaatcgccgttgaacactggaatcttcataagcggatcgccttgcgtgtgctgttgatcgtcggagtgcggccagctcccttgattctggggttcatgctggtcacggcatttctgtccatgtggatctccaacaccgccacatccgccatgatggtgcccattgcccacgccgtgctggatcagctccactcgtctcaggcctcatccaatgtcgaggaagggagcaacaacccaacttttgaactgcaagaaccctccccacagaaggaagtgaccaagctcgataatgggcaagccctgccagttacatcggcctcatcggaaggcagggcccatctgtctcaaaagcacctgcatctgactcagtgcatgagcttatgcgtgtgttattcagcaagcatcggtggcatcgctactctgactggaaccgcaccaaatttagttctacaaggccagatcaattctctgttcccccaaaatggcaacgttgtcaactttgcttcttggttttcctttgccttcccgacaatggtgatactcctcctgttggcatggctgtggctgcaaattcttttcctgggctttaatttccggaaaaactttggcatcggcgagaaaatgcaggagcaacagcaggcagcctactgcgtgatccagaccgaacacagacttctgggacctatgactttcgcggaaaaagctatatctattctatttgtcattctggtgcttctctggttcacaagagagccaggattcttcctcggttggggcaacttggccttccccaatgctaaaggggaaagcatggttagtgacggcacagtcgctatcttcatcggaatcataatgttcattattccgtcaaagttcccgggtctgacacaggacccagagaaccccggtaagctaaaggcccctctgggtctcctggactggaagactgtgaaccagaaaatgccttggaacatcgttctcttactgggcggagggtatgcactcgccaaaggttcggagagaagcggtctcagtgaatggttaggcaacaagctgactcctttgcaatcagttcccgctcccgccatcgccatcatcctgagtctccttgtcgccacatttactgaatgcaccagcaatgttgccactacaactatttttctcccaattttagccagcatggcacaagccatctgcctgcatcccctttacgttatgctgccttgcaccttggctacctctctagcttttatgctccctgtggctacccctcctaatgccatagtgtttagtttcggcgaccttaaggtactggacatggcaagagcgggctttttactgaacatcataggcgtactgatcatcgctttggccataaacagctggggtatccccctgtttagtctgcactccttccccagctgggcccagagcaatactaccgcccagtgtctcccaagcttggccaacactacaactccctcgccatag

SEQ ID NO: 205608 - DNA, 1809 bp, Artificial Sequence
  Description of Artificial Sequence: Synthetic coding sequence
atggccgccctggccgccgccgccaagaaggtgtggagcgcccggcggctgctggtgcttctgtttacacctctcgcattgctgcctgtcgtgtttgctctcccacccaaagaaggacgatgtctttttgttattctgctcatggccgtctactggtgtaccgaggctctgcccttatcagtcacagccttgctgccaattgtgttattcccatttatgggcatcctgcctagcaacaaagtttgcccacagtacttcctggacactaatttcctgtttctgtccggtctgatcatggcatcagcgattgaggaatggaacctccaccgtagaatcgccctgaaaatcttgatgctggttggcgtgcagcctgcaagactgatcttgggaatgatggtgactacgtccttcctgagcatgtggctgagtaacactgctagtaccgcaatgatgctgcccattgctaacgctattctcaagtccctgttcgggcagaaagaggtgcgcaaagaccctagtcaggagtccgaggagaatacagctgccgtacgaaggaacggcctgcatactgtgccaacggagatgcagttcctggcgtcgaccgaggctaaggaccacccaggggagacagaggtccctctcgatctacccgccgactctcggaaggaggacgaataccggcggaacatttggaaaggcttcctgatcagcatcccttacagcgcaagcattggcggcaccgctacgttaaccggaactgcaccaaatttgatactgctggggcaactgaagagtttctttccccaatgcgacgtggttaattttggttcctggtttattttcgcatttccactgatgctcctcttccttttggccggctggctgtggatttcttttctgtatgggggactgagcttccgcggttggcgaaagaataaatcagaaatccggacaaatgctgaggaccgagctagagctgtgattagagaggagtatcaaaacctaggccctatcaaattcgcagaacaggcggtctttatcctgttttgcatgttcgctattttgctgttcacgcgagaccccaagttcattcccggctgggccagtctgtttaaccctggcttcctgtcagacgccgttaccggggtagctattgtcaccatactgttttttttcccctcccagcgccccagcctgaaatggtggttcgacttcaaggcacccaataccgaaactgagccgctcttaacatggaagaaggcccaggagacggtcccatggaacatcatactgctgttgggcggaggattcgccatggcaaaaggctgtgaggaatctggattgtctgtttggatcggaggccaattgcacccactggaaaacgtgcctcctgctcttgccgttctcttaataaccgtggtaattgccttcttcaccgagtttgctagcaatacagctaccatcattatttttctgcctgtcctggccgagttagccatccgcctgagagtccatcccttgtatctcatgatacccggcaccgttggctgttcctttgcctttatgctcccagtgtctacaccaccgaatagtattgcctttgcctcagggcacctgttggtgaaagatatggtacgcacaggccttctgatgaacttaatgggcgtcttactgttgtccttggccatgaacacttgggcccagacaatcttccagctcggaacattccccgattgggcagatatgtactccgtgaacgtgaccgcactgcctccaactttagccaatgacacctttaggaccctgtag

SEQ ID NO: 205609 - DNA, 1668 bp, Artificial Sequence
  Description of Artificial Sequence: Synthetic coding sequence
atggccgtgtactggtgcaccgaggccctgcccctgagcgtgaccgccttactgcctatcgtgctgtttccctttatggggattctgccatccaacaaagtgtgtccccagtactttctggacacaaacttcttgttcttgagtgggttgattatggcctctgccattgaagagtggaacctgcaccgacggatagcgttgaagatcctgatgctcgtgggggtgcagcccgccaggctgatcctgggaatgatggtgaccacatctttcctgagtatgtggctctccaacaccgcaagcaccgcaatgatgctgccaatcgccaacgccatactcaaaagcctgtttggacagaaagaggtgagaaaggatccctcccaggagagtgaggagaacacagctgcagttcgacgcaacggcctgcatactgtgcctacagaaatgcaattcctggcttcaaccgaagcaaaagatcatcctggcgagaccgaggtcccactcgacctgcctgcagacagtaggaaagaggacgaatatcgccgcaacatttggaaaggcttcctcatctccattccttactctgcatccatcggaggcacggcaaccttgactggtacagccccaaatctcattctgctcggccagctgaaatcttttttcccacaatgcgacgtcgtcaacttcggatcctggttcattttcgcattcccgctgatgcttctgtttcttctggccggctggctgtggattagtttcctttacggcgggctgtctttccgcggctggagaaaaaacaagagtgaaattcggacaaacgctgaggatagagcccgagcagtaattagagaagaatatcagaacttaggtccaatcaaattcgccgaacaagctgtctttattttattctgtatgtttgccattctattgttcaccagagatcccaagttcatccctgggtgggcgtccctattcaatcccgggttcctgagtgacgctgtcaccggagttgctatcgttaccattctgttcttctttccatctcagcggccaagcctgaaatggtggtttgactttaaagcacccaacaccgaaacagaaccactattgacatggaaaaaggctcaggagaccgttccatggaatatcatcttgctactcggggggggtttcgccatggcaaagggctgcgaggaaagcggactctccgtgtggatcggcggccagctgcatcccctggaaaatgtcccccctgcacttgccgtgctgttgattacagtagtaatcgccttctttacagaattcgctagcaacactgctacgataatcatcttccttcccgtgctggcagagctggccattcggctaagagtgcatcctctgtatctgatgatccctggtactgtgggctgcagctttgcgttcatgctcccagtctctacccctccaaactcgattgcctttgcttccggccatctgttagtcaaggatatggtgaggaccggtctgctgatgaatcttatgggggtcctgttgctgagcctggccatgaacacttgggctcagacaattttccagctcggtacctttccggactgggcagatatgtactcagtgaatgttactgcactcccacctacactagccaacgatactttcagaactctgtag

SEQ ID NO: 205610 - DNA, 699 bp, Artificial Sequence
  Description of Artificial Sequence: Synthetic coding sequence
atggccgccctggccgccgccgccaagaaggtgtggagcgcccggaggttactggtcctcctgttcactcctctggccctgttgccagtggtgttcgccctcccccccaaagaaggaagatgcctgtttgtcattctgctgatggcagtgtactggtgtactgaagcgctgccactgtcagtgactgccctgctgcccatcgtactatttccattcatgggcatcttaccgagcaacaaggtgtgcccccagtacttcttggacacaaacttcttattcctaagtgggctgataatggcttcagccatcgaggagtggaacctgcataggaggatagcactcaagattctcatgcttgtaggagtacagccggcccggctgattctaggcatgatggttacgacctctttcctgtctatgtggctcagcaatacagcatcgaccgctatgatgttgcccatcgctaatgctatcctcaagtctctgtttggccagaaggaagtccgtaaggatcctagccaggagagcgaggaaaacacaggcattgaaccaaacaccttcctttctgaggagcgcctaaagctgcaggctcccctggtcattcgcttgggacagatcaccgaaagtgggcagtggaacatgtccggcaacgatgtctgtaattttagagtgctgtccttccttccaggggggatgtag

SEQ ID NO: 205611 - DNA, 1017 bp, Artificial Sequence
  Description of Artificial Sequence: Synthetic coding sequence
atggccgccctggccgccgccgccaagaaggtgtggagcgcccggcgcctgttagtgctcctattcaccccattggcactgctccctgttgtgtttgccttgcccccaaaagaaggccgctgcctgtttgtcattctgctgatggccgtttactggtgcaccgaggcgctccctttatccgtcacggctcttttacccatcgtgttatttccattcatgggcattttgccatcaaacaaagtttgccctcagtatttcctggacacaaatttcctcttcttaagcgggctcataatggcttcagcaatcgaagagtggaatctgcaccggcgcatcgcgctcaagatcctcatgctggtcggggtacagcctgctagacttatactgggcatgatggttaccacgtcatttttatccatgtggcttagcaataccgcttccactgccatgatgttgcctatagcgaatgccattttgaagagcctgttcggtcagaaagaggtgaggaaggaccccagtcaggagtccgaggaaaataccgcgaaaactacactgggacgtcagcgatttcactggatttgccgactcactcccgggaggagaatgaatatcgtcggaacttccgggagagcaagtagctctccctctccaacacagcctgtgttgggggcacagccccatagccgcgctcagccattgacgagttcgtgtcttgcgtcatctcgggggtggctctggatctcatttttgtatgggggattgagtttccgaggttggaggaagaataaatccgagataaggacaaatgctgaggatcgagcaagggccgtgatccgggaggagtaccaaaatctggggcctataaaattcgccgaacaagccgttttcattttgttttgcatgtttgctattctcctttttactcgggaccctaagtttattccgggttgggcatccttgtttaatccaggttgcaagatggggattattagcatttctacaattcaaaaaatgtag

SEQ ID NO: 205612 - DNA, 1563 bp, Artificial Sequence
  Description of Artificial Sequence: Synthetic coding sequence
atggccgtgtactggtgcaccgaggccctgcccctgagcgtgaccgctctcctgcctatcgtattgttcccattcatgggcatcctgcctagcaacaaagtgtgcccccagtactttctggatactaactttctttttctgtcaggcctgatcatggctagcgccatcgaggaatggaatttacatagaaggattgcgctgaagatcctgatgctggtgggggtgcagcctgcaagactcatcctgggaatgatggtaacaacctcctttctctccatgtggctgagcaacactgcttcaactgccatgatgctgcctatcgcaaacgctattttaaaatccttatttggccagaaggaagtgcggaaagatccctcgcaggagtcggaagagaatacagcagccgtcaggaggaacggtctacatacagtgcccactgaaatgcagttccttgcgtctacagaagcaaaagaccacccaggtgagacagaagtgccacttgatctgcctgcggattcacgaaaagaggacgagtataggcgcaacatttggaagggcttcttaattagtatcccgtactcagcgagtattggagggaccgcgactttgactggcacggccccgaacctgattttgttgggccagcttaagtcatttttcccgcaatgcgacgtggtgaactttggttcctggttcatcttcgcctttcccctgatgctgctcttcttgctagctggatggctctggatcagcttcttgtatggcggactctcattccggggatggcgcaaaaataagtctgagatccgcacaaacgctgaagaccgggctagagccgtgatccgagaggagtaccagaacctcggccccataaagttcctgtccgacgccgtgactggggtggctattgtgactatattgtttttctttccttcccagcgcccatcacttaagtggtggtttgacttcaaggcccccaacactgagacagagcccctgctgacatggaaaaaggcgcaggaaactgtgccatggaacatcatcctgttgctgggcggtgggtttgctatggccaaagggtgtgaggagtctgggctgtctgtttggattggaggacaactgcaccccctggagaatgtcccacccgctctggcagtgttgctcattaccgttgtcatcgcctttttcacagaattcgctagcaacaccgcaactattattattttcctgccggtcttggcggagctcgcaatcaggctgcgggtgcaccccctctacctcatgatccctgggaccgtgggatgttccttcgcttttatgctgcccgtgtctacaccccctaattctatcgccttcgcctctggacatttgctggtcaaggatatggtccgaactggcctgctaatgaacctgatgggcgttcttctgttaagcctggcaatgaatacctgggcccaaacgatttttcagctgggcacattcccagattgggcggatatgtacagcgtcaacgtgacagccctacccccgacccttgccaatgacacctttcggaccctctag

SEQ ID NO: 205613 - DNA, 1659 bp, Artificial Sequence
  Description of Artificial Sequence: Synthetic coding sequence
atggccgccctggccgccgccgccaagaaggtgtggagcgcccggcggctcctcgtcctgctgtttaccccattggctctcctgcctgtggtattcgctctgccccctaaagagggaaggtgcctgttcgtaattctcctgatggcggtgtactggtgtacggaggcccttccactcagtgtcacagccctgttgcctatcgttctgttcccctttatggggatcctgccgagtaacaaggtttgcccacagtatttcctcgatacgaattttctgtttctctccgggctgatcatggcatctgccatagaggagtggaacctgcatcggagaattgcactgaagatcctcatgctggtcggagtgcagcccgccagactgatactggggatgatggtgacaacttcctttctgtctatgtggctctctaatactgcctcaaccgctatgatgctgcctattgctaatgcaatcctgaagagccttttcggacaaaaagaggtccgcaaagatccgtcacaagaatctgaggaaaacactgccaaaactacactagggaggcagcggtttcattggatttgtagactgactcccggaaggaggatgaacatcgtcggcaccagcggaagagctagctctagtcccagcccaactcagcctgtgctgggggctcagcctcactccagagcccagccactcacctcatcttgtttggcgagtagtaggggatggctgtggatttcgtttctctacgggggcctgtccttccgtggttggaggaagaacaaaagtgaaattcgtacgaacgctgaggaccgcgcgcgggccgttatcagggaggagtatcaaaacctgggtcctatcaagtttgctgaacaggctgtattcattcttttctgtatgttcgccatcctgcttttcacacgggatcccaagtttattccaggatgggcctcactctttaaccccggcttcctgtccgacgccgtcacaggggtagctattgtgactatattgttctttttccccagtcagaggcctagccttaagtggtggtttgattttaaggctccaaacactgaaaccgagcctctgctgacatggaagaaggcccaagaaaccgtcccctggaatatcatccttcttctggggggcggatttgctatggcaaaaggctgcgaggagtccggattatccgtttggatagggggtcaattgcatcccctcgagaatgtgccacccgcactggcggtcctcctgatcacggtggtaatagcatttttcactgaatttgcctccaatactgctaccattatcatatttttacccgtcctggccgagctggctatcaggctgagagtgcacccactgtacctcatgatccctgggaccgtggggtgctcattcgcattcatgctgccagtgagcactccccccaattcaattgccttcgcaagcgggcacctgttggtcaaggatatggtcagaacggggctgctgatgaacctgatgggcgtcttgctcctttctctggcaatgaacacatgggcacaaactatcttccaattgggcacgtttccagactgggccgatatgtactctgtgaatgtcactgcactgcctcctacactagctaatgacacctttcggacattatag

SEQ ID NO: 205614 - DNA, 558 bp, Artificial Sequence
  Description of Artificial Sequence: Synthetic coding sequence
atggccgtgtactggtgcaccgaggccctgcccctgagcgtgaccgctttgctgccaatcgttctattcccattcatgggaatcctaccaagtaataaggtatgtccgcaatattttttagatactaatttcctcttcctctcaggccttatcatggcatctgcgattgaggaatggaatctgcatcgtcgtatagctctaaagattctcatgctggtgggcgttcagcccgcccggcttattctggggatgatggtgaccacaagctttctgtccatgtggctgtctaatacagccagtactgcaatgatgctcccaatagcgaatgcaatcctgaaatctctgtttggacagaaagaggtgcggaaagatccgtcacaggagagcgaagagaatacgggcatagaaccaaacacgtttctcagtgaagaacgactcaagctacaggcaccactggttatcagactggggcagataacagagtctgggcagtggaatatgtctggcaatgacgtttgtaattttcgcgttttgtcatttctgcccgggggcatgtag

SEQ ID NO: 205615 - DNA, 564 bp, Artificial Sequence
  Description of Artificial Sequence: Synthetic coding sequence
atgctgagccccgcctggctgctgagccccagctgcagcagcagcagaccgaaggggcccttgagcagcggtgggcttaccagtaaggagagtggactcagtgtttggataggcggccagctccaccccctggagaatgtgccgcccgctttggccgtgctgctaatcacggtcgtgatcgccttttttactgaatttgcaagcaataccgctaccattattatttttttacctgtgttagccgaactagctatacgtttgcgcgttcacccattgtacctgatgattcccggtacagtcggatgctcttttgccttcatgctgccagtgtccacccctccaaacagcatagcgtttgctagcggccacctgcttgtcaaggacatggttcgaactggattgctgatgaacttaatgggcgtgttacttctgagcctggctatgaacacctgggcccagaccatcttccagcttggcactttccctgactgggcagatatgtacagcgttaatgtgaccgccctgccccctacattggctaatgatactttcaggacattatag

SEQ ID NO: 205616 - DNA, 1230 bp, Artificial Sequence
  Description of Artificial Sequence: Synthetic coding sequence
atggccgtgtactggtgcaccgaggccctgcccctgagcgtgaccgcactgcttccaattgttctctttccttttatgggcattttaccaagcaataaagtttgtccgcaatactttctggataccaactttctctttctgagcggactcattatggcttccgccattgaggaatggaacctccacagacggatagcgctgaagatcctgatgcttgtaggcgtccagcccgctaggctcatcttgggaatgatggtgactacaagcttcttatctatgtggttgtcaaacactgccagtaccgccatgatgctgcccattgcgaatgcaattctcaagtccctcttcggtcagaaggaagtgcggaaggatccatcccaagagagcgaggagaacactgccgccgtgcgacgcaacggactgcacacggtgcctaccgagatgcagttcctggctagcacagaagccaaagaccacccgggggagaccgaagttcctctggatcttccggcggactctagaaaagaggacgagtatcggcggaacatttggaaggggttccttatcagcattccttactcagccagcatcggagggaccgcgacactgaccggcaccgcacccaatctgatcctcctcgggcagctaaagtcctttttcccgcagtgcgatgtagtgaacttcggcagttggttcattttcgcattccccctcatgttactgtttctcctagccggctggctttggatctccttcttgtatggtgggctgtccttccgcggatggagaaaaaataagagcgagatccgcactaacgccgaagatcgcgctcgcgccgtaatacgcgaggagtatcaaaatttaggcccaatcaagttcgccgagcaagccgtgttcatcctcttctgcatgttcgctatcttgctattcactcgcgatcctaagttcatcccaggatgggcctccctgtttaacccagggttcctttcagacgcagttacgggtgtggccatcgtgacgattctgttctttttccccagccaacgaccgagtttaaagtggtggttcgactttaaggcccccaacaccgaaacagaacccctgcttacgtggaagaaggcccaggagaccgtgccgtggaatatcatactcctcttgggaggcggattcgcaatggcaaaggggtgcgaggagtctgggttgtccgtgtggatcggtgggcagttgtag

SEQ ID NO: 205617 - DNA, 1668 bp, Artificial Sequence
  Description of Artificial Sequence: Synthetic coding sequence
atggccgtgtactggtgcaccgaggccctgcccctgagcgtgaccgccttgctcccaatcgttttgttcccatttatgggtatattaccaagcaacaaggtctgtcctcagtacttcttggacacaaattttctttttctctctggcctgattatggcctcagccattgaagagtggaacctgcacagacgcatcgccttgaagatcctgatgctcgtgggggtgcagccagccagactgatcctcggtatgatggtgaccacatctttcctgtcaatgtggctgtccaacacagctagcaccgctatgatgctgcccatcgccaatgccattctcaagagtctgttcggccaaaaggaggtgcggaaagatccttcgcaggaaagcgaggagaatacagctgcagtcagaaggaacggcctgcacacagtccctaccgagatgcagtttctcgccagcaccgaggcaaaagatcacccaggagagacggaggtgcccctcgacctgcccgccgattccagaaaggaggacgaatatcgcaggaacatttggaaaggatttctgatttcaatcccttattccgcctccataggaggaacagcgaccctgacgggtaccgcaccaaatcttatccttctaggccaattgaaatcttttttcccccagtgcgatgtggtaaattttgggtcttggtttatttttgcgtttcctctgatgctgctgtttctgttagctggatggctatggatcagtttcctctatggcggactctcgtttagggggtggcggaaaaacaagtctgagatccgcactaatgctgaggatcgtgcccgtgcagtgatccgagaagagtaccagaatttggggccaattaagttcgccgagcaggcagtcttcatactcttttgcatgtttgccatactgctgtttaccagggatccaaagttcattccaggctgggcctccctgttcaatccagggttcctatcagacgctgtgactggagtggcaatcgtcaccatcctctttttcttccctagccagaggccctctctcaagtggtggttcgattttaaagcccctaatacggagacagaaccattgctaacctggaagaaagcacaggaaaccgtgccttggaacatcatcctattgcttggaggcggttttgccatggcgaaaggttgtgaggaaagtggactctccgtctggatcgggggacagctccacccactggagaacgtgcctcccgccctagctgtgctgctgatcactgtggtaattgctttcttcactgaatttgcctcaaatacggccactataattatatttttacccgtcttggccgagcttgcgataagactgagggtgcacccactgtacctaatgataccagggaccgtgggatgctcgtttgcttttatgctgccagttagcacaccaccgaactctattgcatttgctagtgggcatctgctggtgaaagacatggtgaggaccgggttgctgatgaatctgatgggtgtgctgttgctgtccctggctatgaatacctgggcgcagacaatattccagcttgggacatttcccgactgggctgacatgtactccgtgaatgtgactgcccttcctcccaccctcgcaaatgataccttcaggactttgtag

SEQ ID NO: 205618 - DNA, 2763 bp, Artificial Sequence
  Description of Artificial Sequence: Synthetic coding sequence
atgagcgacccccacagcagccccctgctgcccgagcccctgagctcacgctataagttatatgaggccgaatttacaagccctagctggccctctacatctcctgacacacatcccgccctgcctctgctggaaatgcctgaggaaaaagacctgagatcttcaaacgaagactcacatatagtcaagattgaaaagctgaacgagcgctccaagcggaaagatgatggcgtcgctcatagggattctgccggccagaggtgcatttgcctctctaaggccgtcggttatctgaccggagatatgaaggagtatcgcatctggctcaaagacaagcatctcgcactacagttcatcgactgggtgctccgcggtacggcacaggtcatgttcattaacaatccattaagtgggttgatcatctttatcggcttgctcatacagaacccatggtggaccattacaggcggccttggcaccgtcgtatccactctgacagcgcttgcactggggcaggatcggtctgctattgctagcggtctgcatggttataacgggatgctggtggggctcttaatggccgtattctctgaaaaactggattattattggtggctgctgttccccgtaaccttcaccgcaatgtcttgcccagttctgagctcagccctgaacagcattttctcgaaatgggacctacctgttttcacactgccctttaatatagctgtaacactatatcttgcagccaccggccactataacttattcttccccacgaccttggtcgaaccagtttcaagtgttccaaatattacttggaccgaaatggagatgcccctcctgctgcaggccatccccgtaggtgtggggcaagtgtatggatgcgacaacccctggacggggggagtgttcctcgtagccctgttcataagcagtcccttgatttgtttgcatgcggctatcggatccattgtggggttactagcggcactgtcagtggccacacccttcgaaacaatctataccgggctgtggtcttacaattgcgtactgtcctgtatcgcgatcggagggatgttttacgccctcacctggcagacacacctgctggccctgatctgtgctttattttgtgcgtatatggaagcagccatttctaacattatgagcgtagtcggggtgcctcctggcacctgggcattttgtctggctacaatcatcttcctgttactcacaacaaataacccagctattttccgcctcccactttcgaaagtgacttacccagaggcaaataggatctattacctgactgtcaagagcggggaggaggagaaggcccccagcggaggagggggagagcatccaccaactgcaggacccaaggttgaggaaggttccgaggcggtgttgagtaagcacaggagtgtattccatatagagtggtcgtcaatccgcagacgaagtaaagtgttcggcaagggcgagcatcaggagcggcagaacaaggacccatttccctaccgatacaggaaacctactgttgaactactcgacttggacactatggaggaatccagcgagatcaaggtcgaaacaaatatatcaaagacttcttggattcgctcatccatggccgccagtgggaagcgggtgtctaaagcactcagttatatcactggagaaatgaaggagtgcggtgaagggctcaaagataagtcccctgtgttccagttctttgactgggttctcagaggtacgagtcaggtgatgtttgttaataaccccctcagcggaatacttattattttgggcctctttatacagaacccctggtgggcaatctctggatgcctgggcaccatcatgtctaccctgaccgcactgattttatctcaggataaatccgcaattgctgctgggttccacggctacaacggagttctggtaggattattaatggcggtcttctctgataaaggggattattattggtggttgctgttgcctgtaatcatcatgagtatgtcctgtcccattctctctagcgccttgggcaccatcttctcgaagtgggatttgcccgtatttacccttccatttaatatcacagtgacgctttatctcgctgcaacagggcattacaatctgttcttccctacaaccttactgcagcctgctagtgcaatgcccaatataacctggagcgaggtacaggtgcctctcctgctcagagccatccctgtcggtattggtcaggtctatggctgcgataacccttggaccggtggaatcttcttgatcgcactcttcattagtagtcccctcatatgcttgcatgccgccatcggttccacgatgggtatgctagccgccctgaccattgcgactcctttcgattccatttattttggtctgtgcgggttcaattctactttggcttgcatcgccattggcgggatgttttacgtcatcacatggcagacgcatctgttggccattgcctgcgctctcttcgctgcttacctgggcgccgcgctggctaacatgttgtcggtcttcgggctgccaccctgtacctggcccttctgcctgtctgcacttactttccttctacttacaactaacaaccctgccatatacaaactccctctgtccaaagtgacttaccccgaggccaacaggatatactacctgagccaggagaggaatcgccgggcatccattataacaaagtatcaggcttacgatgtgagctag

SEQ ID NO: 205619 - DNA, 1170 bp, Artificial Sequence
  Description of Artificial Sequence: Synthetic coding sequence
atggaggacagccccaccatggtgcgggtggacagccccaccatggtccgcggcgagaaccaagtctcaccatgccagggaaggcggtgcttccccaaagccctgggatacgtgaccggggatatgaaagagctggcaaatcagctgaaagacaaacctgtggtgctccagttcattgactggattctgcgcggcatctcacaggtggtcttcgtgaacaaccccgttagcggaattttaatattagtgggcctccttgtccagaatccctggtgggctctaactggttggctcggaacggttgtgagcactttgatggcactgctgctctcccaagatcggtctctgatcgcatctggcctgtacggttacaatgccacactggtgggtgtgctcatggcagttttcagcgacaaaggcgactacttttggtggcttctgttaccagtctgcgctatgtctatgacttgccccattttctcatccgcacttaactcaatgctgtccaagtgggatctgccggtgttcacactgccatttaatatggccctttcgatgtaccttagtgccaccggccactacaatccgttcttcccggcaaagttagtgattccaatcacaacggcaccgaacataagctggtcagatctcagcgcactggaactgctcaagagcatacccgtaggtgtgggacagatatacggctgcgacaacccctggactgggggtatctttctgggggcaatccttctcagcagtcctctcatgtgcttacacgcagccattggcagtctgctggggatcgctgcaggactctctctgtcggccccgtttgaggatatttacttcggcctgtggggcttcaattcaagcctggcctgtattgcaatgggggggatgttcatggctctgacatggcagacacacttgttggccttaggctgcgcactcttcactgcttacctgggtgtgggtatggccaatttcatggcggaagttggactgcctgcatgtacatggcccttttgtctcgctactctgctatttctgatcatgaccacaaaaaactccaatatctataagatgcccctctccaaggttacatacccagaagagaatagaatcttctatcttcaggccaagaagcgcatggttgaatctccactttag

SEQ ID NO: 205620 - DNA, 855 bp, Artificial Sequence
  Description of Artificial Sequence: Synthetic coding sequence
atggccctgctgctgagccaggaccggagcctgatcgccagcggcctctacggatacaatgcaactttggtcggcgtgctgatggccgtgttctctgataagggagattacttttggtggctcctcctacccgtttgcgctatgtcaatgacctgcccaatcttcagtagtgcactcaactcgatgttgagtaagtgggaccttcccgtgtttacgctcccattcaatatggcgctcagcatgtatctgagcgccacaggacactataaccccttttttcccgcaaagctggtgatcccaatcacaaccgctccaaatatctcatggtccgacctgagcgccttggagcttctgaaatccattcccgtgggcgtgggtcaaatttatggatgcgacaacccctggaccggcggaatattccttggggctatcctcctttcctccccattaatgtgtctgcacgcagcaatcggctcattgctggggatcgccgctggactgtctctttctgccccattcgaggacatctatttcggactgtgggggttcaatagcagcctggcttgtatcgccatgggcggcatgtttatggccctcacatggcagacccatctgctcgctctgggctgcgctctgttcaccgcctatttaggtgtgggcatggcaaattttatggctgaagttggacttcctgcctgtacttggcctttctgtctcgcaactctgctgtttttgatcatgactaccaagaactcaaacatttataagatgcctttgtctaaggtgacttaccccgaggaaaataggatcttttacctacaggctaaaaagaggatggtcgagtcccctctgtag

SEQ ID NO: 205621 - DNA, 1338 bp, Artificial Sequence
  Description of Artificial Sequence: Synthetic coding sequence
atgaacggccggagcctgatcggcggcgccggcgacgcccggcacggccccgtgtggaaagaccctttcggcacaaaagcgggggatgccgccagacgaggaatcgctaggttatcactggctttggcggatggaagccaggagcaagagcctgaggaagagatagccatggaagatagccccacgatggtgagggtcgactcaccaaccatggtgcgtggcgagaatcaggtctccccctgtcaggggaggcgttgcttccctaaggctcttggctacgtcaccggcgatatgaaggagctggcaaatcaactgaaggataagcctgtggtcctgcagttcatcgattggatcctccggggtatctcccaggtggtgtttgtaaataaccctgtgagcggaatcctgattctggttggactgctggttcagaacccgtggtgggccctcaccggatggctgggaactgtcgtgagcactttgatggcactgcttctttctcaggatcgctccctcatagcctccggactgtatgggtacaatgccacccttgtcggggtcttaatggctgtcttctctgacaagggcgattacttctggtggttgctgttgcccgtgtgcgccatgtcaatgacgtgccccattttctcgtccgcactcaactccatgctgagcaaatgggacctgccagtcttcaccttgccatttaacatggctctgagtatgtatctgtccgccaccggtcattataatccattctttcctgccaaattggtgattcccatcacaacagctccaaacataagctggtccgacctctctgccctggaactgcttaagagtatccccgtcggtgtgggccagatctatggctgcgataacccatggactggcgggatcttcttgggtgcaattctgctctcgagcccccttatgtgtctgcacgccgccatcggttcacttcttgggattgccgcagggctgagtctgagcgctcctttcgaggacatctattttggactgtggggttttaactcttctttagcttgcatcgccatgggggggatgttcatggctttaacttggcagactcatctgttggccctagggtgtgccttgttcactgcttacctcggcgtcggcatggccaactttatggcagaggtgggtctcccagcctgcacatggccgttctgtctcgctacactactcttcctcatcatgacaaccaaaaattccaacatttacaaaatgccccttagtaaggtcacttaccctgaggaaaaccgtatcttctatctccaggccaagaagcggatggttgaatcccccctttag

SEQ ID NO: 205622 - DNA, 1338 bp, Artificial Sequence
  Description of Artificial Sequence: Synthetic coding sequence
atgaacggccggagcctgatcggcggcgccggcgacgcccggcacggaccagtctggaaagaccctttcggcacgaaggccggggacgccgcgaggagggggatcgcccgcttgtctctggccctggctgatggtagccaagaacaggagcctgaggaagagattgccatggaagattcacctacaatggtcagagtggattctccaactatggttaggggagaaaaccaggtcagcccctgtcagggtcggcgctgcttcccaaaagcattaggctatgtcactggtgatatgaaggagctggcaaatcagctgaaggacaagcccgtggtccttcagttcattgactggatcctgcgggggatcagtcaggttgtgttcgttaacaaccctgtgtccggcattttaatcctggtgggactactagttcagaacccgtggtgggcgcttacagggtggctcggtactgttgtgagcacactcatggctctgctgttgagccaggatcgcagcctcatcgcctcaggcctgtacggctacaacgcaacactagtgggggtgctcatggccgttttcagcgataaaggagattatttttggtggctgctcctccccgtgtgcgctatgtccatgacctgtcccattttcagctccgctctgaatagtatgctgtccaaatgggacctgccagtatttaccctgccttttaatatggctctgtctatgtatctgtccgcaacggggcactataatcctttctttccagctaaactcgttatacccattacaactgctcccaacatatcgtggagcgacctctctgccctggaacttctgaagtccatccctgtgggcgtggggcagatctatggttgcgataacccatggactggcggcattttcctcggggcaatcctgctatccagcccgcttatgtgcctgcatgctgctatcggaagtttgctaggaatcgccgctgggctgtctctgtctgccccgtttgaggacatttatttcggtttgtggggattcaattctagcctggcgtgtatcgcgatgggtggcatgttcatggccctcacttggcagactcatcttcttgctttggggtgtgcattgtttactgcctatttgggcgtgggcatggcgaattttatggccgaggtggggttgccggcctgcacctggccgttctgtctggccaccctcttgtttctgatcatgaccacaaaaaattcaaatatctataagatgccactcagtaaggttacctatcccgaggaaaatagaatattttacctccaagccaagaagagaatggtggaatctccactgtag

SEQ ID NO: 205623 - DNA, 645 bp, Artificial Sequence
  Description of Artificial Sequence: Synthetic coding sequence
atgaacggccggagcctgatcggcggcgccggcgacgcccggcacggccctgtgtggaaggacccgttcgggaccaaagcaggtgacgccgctaggcgaggtatagctcgactctcactggctctggcagatggttcccaggaacaagagccggaggaggaaatcgctatggaagatagtcctaccatggtacgggtggatagcccaaccatggttcggggagagaaccaagtttcaccctgccaaggacgccggtgtttcccaaaagcgctcggttacgtgaccggcgacatgaaggagctcgcaaatcagctaaaggataagcctgtggttttgcaatttattgactggatcctgcggggaatttcacaggtagtcttcgtcaacaaccccgtttcgggcatcctcatactggtgggactcctagtgcaaaacccatggtgggcgctgaccggatggttaggcacagttgtcagtaccctgatggcacttctcctcagccaagatcggagccttatcgcttcaggtctgtacggatacaacgctactctggtgggcgtactcatggctgtgttttctgacaaaggggactatttttggtggttgctgctgccagtgtgtgccatgagcatgacctgctgctag

SEQ ID NO: 205624 - DNA, 846 bp, Artificial Sequence
  Description of Artificial Sequence: Synthetic coding sequence
atgggccggcggaaccggagcctgatcgccagcggcctgtacggctataacgccacattggtcggggtgctcatggctgtgttttcagataagggtgactacttctggtggctactgctgccagtgtgtgccatgtctatgacctgtccaatcttctcctccgctctgaatagtatgctctctaagtgggatttgccagtgtttacgctgcctttcaatatggccctgtcaatgtacctgagcgcaaccgggcattataacccattcttcccagctaaactcgtgataccgatcactacagcaccgaacatttcatggtcagatctttcggcgttagaacttttaaaaagcatccccgtgggcgtgggccagatatacgggtgcgacaacccgtggacgggcggcatctttttgggtgcgattcttttgagttccccactgatgtgtctccacgctgctattgggagcttgctgggaattgccgcggggctgtctctcagcgccccgtttgaagacatatatttcggcctttggggcttcaattcaagcctcgcctgtatcgctatgggcggtatgttcatggccctgacttggcaaacccatctgctcgcgctgggctgcgccctctttactgcttatctgggtgtcggcatggccaacttcatggctgaggtggggcttccagcctgcacctggccattctgtctggccacgctgctgtttttaataatgaccacaaaaaattcaaatatctacaagatgccccttagtaaggtcacataccctgaggagaatagaatattctacttgcaggccaagaaacgcatggtggagagccctctatag

SEQ ID NO: 205625 - DNA, 774 bp, Artificial Sequence
  Description of Artificial Sequence: Synthetic coding sequence
atggccgtgttcagcgacaagggcgactacttctggtggctgctgttaccagtgtgcgcaatgagcatgacttgcccaatattctcctctgccctgaattccatgctctctaagtgggacctacccgttttcacgcttcctttcaacatggcactgtccatgtacctgtctgcgaccggtcattataacccatttttccctgccaagctcgtgattccaataacaacagcccccaacatttcctggtcagacctttcagcactggagcttttgaagagcattccagtgggagtggggcaaatctatgggtgcgataacccatggactggaggtatcttccttggcgccattctcctctcatccccccttatgtgtctgcacgctgcaattggtagtctcctgggaatcgctgccgggctgtcgctgagcgcccctttcgaggatatctatttcgggttgtggggcttcaattcaagcctggcctgtattgcgatgggcggcatgttcatggccctgacctggcagacccatctactggctttagggtgtgccctcttcacagcatacctgggagtgggaatggcaaatttcatggcggaggtgggtctcccggcctgtacgtggccattctgcctggccacactgctatttttaatcatgactactaagaactccaacatttacaagatgcctttatctaaggtcacgtatcccgaggaaaaccgaatcttctatttgcaagccaagaagcgtatggtggagtcacctctgtag

SEQ ID NO: 205626 - DNA, 2763 bp, Artificial Sequence
  Description of Artificial Sequence: Synthetic coding sequence
atgagcgacccccacagcagccccctgctgcccgagcccctgagctccagatataagctgtatgaggccgagtttacaagcccgtcatggccaagcacttcaccagatactcatccagccctacccttgttagaaatgccagaagaaaaggacttacgctcctctaatgaggacagtcacatcgtcaaaattgaaaagctgaacgagcggagcaaaagaaaagacgacggcgtggctcatcgcgactccgcaggacagagatgtatctgtttaagcaaggcagtcgggtacctgaccggggacatgaaagaatatcgcatttggttaaaggacaaacacctggctctacaattcattgattgggtgttgagaggaaccgcacaggttatgttcattaataacccactttccggtcttatcatcttcataggtctgcttatccagaatccttggtggaccataactgggggcctgggaacagtggtgtccactctcaccgctctggcgctgggccaggatcgctccgctatagcaagcgggctccacggttataatggaatgctcgtgggactacttatggccgttttctctgagaagctggactactactggtggctcctttttcctgtgacgtttaccgccatgagttgtcccgtgcttagtagtgctctgaatagcatattctccaaatgggatctgcctgtctttaccctgccttttaatatagccgtgacactgtatctcgccgctaccgggcactacaacctgttctttcctacaaccttggtggagcctgtgtcttccgtccctaatatcacatggactgaaatggagatgcctctcctgctccaagccatccctgtgggcgtgggacaggtttatgggtgtgataatccttggacagggggagtctttcttgtggcactttttattagcagtccgctcatctgtctccacgctgccatcggttccatcgttgggctgctggcagccctcagtgttgccactccttttgaaaccatctacactggtctgtggagttataattgtgtcctctcctgcattgccatcgggggcatgttttatgccctgacttggcagacccatcttttggcgctgatttgcgccttgttttgcgcctacatggaggccgctataagcaatattatgagtgtagtgggagtgcccccaggcacttgggctttttgcctggctaccattatttttctgttgctgacaacaaacaaccccgctatcttccggctgcctctgtcgaaagtgacttaccctgaggccaatcgaatctactacctgaccgtgaagagcggggaggaggagaaggcaccctccggcggcgggggggagcatccccctacagctggccctaaagtggaagagggaagtgaggccgtcctctccaagcatagatctgtgttccacatagaatggagctcaattcgcagaaggagtaaagtgttcggaaaaggggaacaccaggagcgtcagaataaggatccttttccctatagatacagaaaaccaaccgtggaactgctcgatttggacacaatggaggaaagtagcgaaatcaaagtcgaaacaaacatcagcaaaaccagttggatccggtccagcatggcagcaagcgggaagcgcgtgtctaaggctctgagttacatcacaggtgagatgaaggagtgcggagaggggcttaaagacaaatcccctgtgtttcaattctttgactgggtcctgaggggcacgtctcaagtgatgtttgtgaacaacccattatcagggatcttgatcattctggggcttttcatccagaatccttggtgggccatcagcggatgtctgggtactattatgtcaaccctgacagcccttatactgtcccaggacaaatccgctatagccgccggatttcacgggtataatggcgtgttagtgggcctgctgatggctgtgttctctgacaaaggagactactattggtggctgcttttgcctgtaattattatgtccatgtcatgccccattttatcgtcagctttgggtaccatctttagcaagtgggatctaccagtgttcacgttgccattcaatattacagtaaccctctacctagctgccacgggacattacaatcttttcttccctactacccttcttcagccggctagcgccatgccaaacattacctggtccgaggtccaggtccccttgctgctgcgcgccataccagtgggcattggacaggtgtatgggtgcgacaacccttggactggcggcatctttctgattgcgctgtttatttcttccccactcatctgcctgcacgctgctattggaagcaccatgggcatgctggccgccctgactatcgccactcccttcgattccatttacttcggactttgtggtttcaattctacccttgcctgtattgcaatcggagggatgttttatgtcatcacctggcagacacatcttctggccatcgcctgtgctttattcgccgcttatctgggcgccgctttagccaatatgcttagtgtgttcggtctgccgccttgcacttggcccttctgtctatccgccctgactttcctccttctgaccacgaataaccccgcgatttataagttgccactatccaaagtcacttaccccgaggcaaataggatttattatctaagccaggagcgaaaccgcagagccagcattataaccaagtaccaagcctatgacgtctcatag

SEQ ID NO: 205627 - DNA, 708 bp, Artificial Sequence
  Description of Artificial Sequence: Synthetic coding sequence
atgagcgacccccacagcagccccctgctgcccgagcccctgagcagccgatataagctttatgaagccgaattcacatcccccagctggcctagcacgtccccagacacacaccctgccctgccgctgttggagatgcctgaagaaaaggatctgcgctcttctaacgaagactctcacatcgttaaaatcgaaaagctgaatgagcggagtaagcggaaagatgatggtgttgctcaccgcgacagtgccggccagagatgtatatgtctttctaaggcagtagggtatcttacaggtgatatgaaagaatacagaatttggctcaaggataagcacttggctctgcaattcatcgactgggtacttaggggcaccgcacaggttatgttcatcaacaatccgttgtccggcttaatcattttcattggcctgttaatccagaacccatggtggactattacaggaggcctcgggaccgtggtaagtaccttaaccgctcttgccctgggccaagaccgctcggccatcgcgtccggcctgcacggatacaatggcatgctggtagggctgcttatggccgtgttctctgaaaaactcgactattactggtggcttttatttcccgtgacctttaccgccatgtcttggatggagacagattttaactggtccaagagcgggtgctggaagcatttactccagtag

SEQ ID NO: 205628 - DNA, 627 bp, Artificial Sequence
  Description of Artificial Sequence: Synthetic coding sequence
atggaccagtggggcgtgtacttcaaccccgtgctggtgagcttctgccagtccttttttgggtatcctctaagcatattcttcatagtcgttaatgaattttgtgaacgcttctcctactacgggatgcgggccattctaattttgtacttcactaacttcattagctgggatgacaatcttagcaccgccatctatcataccttcgtggccttgtgttatctcaccccaatattaggagccctgatcgctgacagttggctgggaaaatttaagaccatcgtttcgctgtctattgtctacaccatcgggcaggccgtgacatctgtgagctctattaacgatcttactgaccacaaccacgatggaactcccgattctttgccagtgcacgtggtcctgtccctgatcggcctagccctgatcgctttgggcaccggcggcatcaaaccctgcgtgtccgcattcggaggagaccagttcgaagaaggccaggagaagcagcggaatagatttttttcaatcttttatttagcaatcaatgcgggctcattactctcaacaataataacacccatgctgcggggaaaacgctacttgaagggtacatcggttggccttttttag

SEQ ID NO: 205629 - DNA, 849 bp, Artificial Sequence
  Description of Artificial Sequence: Synthetic coding sequence
atgcgggccatcctgatcctgtacttcaccaacttcatcagctgggacgacaatttaagcacagccatctaccacacattcgtggccctttgttacttgaccccgatcttaggggcgttgatcgccgactcatggctggggaaatttaagacaatagtctcactaagcatcgtgtacacaatcggccaggccgtgaccagtgtgtcatcaatcaatgatttgacggaccacaatcacgacggaactccggattctctgcctgtccacgtggtgctatcattaatcggtctcgcacttattgccctcggtactggtggaattaagccttgcgtgtccgcattcggaggagatcagttcgaggagggacaagagaagcagaggaacaggtttttctccattttttacctggcaatcaatgcgggctcacttctctctaccattattacacccatgctcagaggtaaaagatatctcaaaggtacctccgttggtctctttctggtgagaccatcgccttgcctactgcgattcgtgctcttcttcccctccgctttgttttccagttgtcagttacatgctggcatgcacgtcggcatttggagcaagtgcttcctgccatgcgagttccacctactgttcgtcctgttcaagtccctaatccctgttactacgggtgagagcaaaccaagcctcgcatgggcttcaatctttctgaattgttactcatgtaaggttatgctggtggtcagggggaaacgccaggagcggtgtctgggaagccaagccggcggtcggagctgccacttctcccttcaagcattactgccatccgacatctcagtgacgtag

SEQ ID NO: 205630 - DNA, 2127 bp, Artificial Sequence
  Description of Artificial Sequence: Synthetic coding sequence
atgggcatgagcaagagccacagcttcttcggctaccccctgagcatattttttattgtggttaatgaattttgtgagcggttcagctattacgggatgcgggccatcctcatcctctactttaccaactttatttcctgggatgacaatttgtccactgccatctaccacacctttgtcgcactgtgctacctaacccccattcttggtgcactcatcgctgattcgtggttaggtaagtttaaaaccatagtatctttgtcaatcgtctacacaatcggacaagctgttaccagtgtgtctagcataaacgacctgaccgaccacaaccatgatgggactcctgactcattacctgtccatgtagtgctctcccttatcgggcttgccctgatagctttgggcacgggcggcatcaagccctgcgtctctgcattcggaggagaccagttcgaggaaggtcaggagaagcagagaaatcggttcttttcgattttctacttagccatcaatgcaggctccctactctctacaatcataacgcccatgctgagagtgcagcagtgtggcattcactcaaaacaggcttgctatccactggcatttggagtccctgcggccctcatggctgtggcgttgatcgtttttgttctgggtagcgggatgtataaaaagttcaaacctcagggcaatattatgggaaaggtggcaaaatgcatcgggtttgctattaagaaccgcttccggcatagatcaaaagccttcccgaagagagaacactggcttgattgggcaaaagaaaagtacgatgagcggttgattagccagattaaaatggtaacccgagtaatgtttttgtatattcctctacctatgttctgggctctctttgaccaacagggaagccgttggacacttcaggcgaccactatgtccggcaaaatcggggctctggagattcaaccagatcagatgcagacagtgaacgctatcctgatcgtcattatggtgccgatctttgacgccgtcctctatccgcttattgccaaatgcggattcaactttacatcccttaaaaaaatggctgtcggcatggtactggcttctatggcctttgtggtggctgccatcgttcaggttgagattgataagactctgccagtatttcccaaaggtaatgaagtccagattaaggttcttaatatcggaaacaacactatgaatatctctctgccaggggaaatggtcacgcttgggcctatgtctcagaccaacgctttcatgacctttgatgtcaataaactgacccggatcaacatttcctctccaggaagtcccgtgacagccgtcactgatgactttaagcagggacagcgccatactctcttggtatgggctccaaatcactatcaggtcgtgaaggatggactgaatcagaagcccgaaaagggggaaaatgggatcagattcgtgaacaccttcaacgagttgataactataaccatgtcaggaaaggtgtatgccaacatttcttcctataacgcgtcaacataccagttcttccccagcggtatcaaaggctttacgatatcctctacagaaatacccccacaatgtcaaccaaatttcaacacattctacctggagtttgggtcagcctatacatacattgtgcaacgcaagaacgattcatgtcccgaagttaaggtttttgaagacatctcagcaaacacagtgaatatggcactgcaaattccccagtatttcctccttacatgtggggaagtggtctttagcgtgacaggactggagttctcttactcacaggcccctagcaatatgaaaagtgtgctgcaggccggatggctcctgactgtagccgttggtaacattatcgtattgatcgtggcgggcgccgggcagttttcaaagcagtgggcagagtatattttattcgctgccctgctgctggtggtctgtgtaatctttgcgattatggcaagattttacacatatattaacccagccgagattgaggcgcagtttgatgaagacgagaagaagaatcgcctcgaaaagagtaatccatacttcatgtccggcgctaattcacagaaacagatgtag

SEQ ID NO: 205631 - DNA, 1503 bp, Artificial Sequence
  Description of Artificial Sequence: Synthetic coding sequence
atgccccccgccgtgggcggccccgtgggctacaccccccccgacggcggatggggttgggccgtggtgatcggggcatttataagtattggattttcctacgctttccctaagagtattaccgtgttcttcaaggagatcgagggcatcttccatgccacaaccagtgaggtgtcttggataagcagcatcatgctggcagtgatgtatgggggcggcccgattagcagcatcctggttaacaagtacgggagccgaatcgtgatgattgtaggaggctgcttaagcggatgcgggttgatagcggcatccttctgtaataccgtgcagcagctgtatgtgtgtataggggtcattggcggactcgggctggcctttaacttgaaccccgccctgaccatgattggcaaatacttttacaagcggagacctcttgccaacgggctcgcaatggccggttctccagtgtttctgtgcaccttagcacctcttaaccaggtcttctttggcatcttcgggtggagaggcagcttcttgatacttggggggctgctcctgaactgctgtgttgctggggctctgatgagacctatcgggcccaaacctacaaaggccggaaaggacaaatccaaagcatctctggaaaaagctgggaagtcgggcgtcaaaaaagatctccacgatgccaataccgatctcatcggaagacatcctaagcaggagaaacgcagcgtgtttcagaccatcaatcagttcctagacctcaccctgttcacacacagggggttcctcttgtatctctctgggaatgtgataatgttttttggcctctttgccccactcgtttttctttcttcatatgggaagtcgcaacattacagcagcgagaagagcgctttcctgctgtctatcctggccttcgtagacatggtcgccaggccttctatgggccttgtcgcaaatactaaacccatccggccaagaatccagtattttttcgcagcatctgtcgttgcgaatggagtctgccacatgctggctcccctgtcaactacctacgtcggtttttgtgtctacgctggctttttcgggttcgccttcggctggctttcctccgtgttgtttgagactctgatggacctcgtggggcctcagaggttttcatctgccgtcgggctagtaacaattgtcgaatgttgcccagtcttacttggcccaccattgcttgggcgtcttaatgacatgtatggcgactacaagtacacttactgggcctgcggggtggtccttatcattagcggcatttacctgttcatcgggatgggaataaactacaggctgcttgccaaagagcaaaaggcaaacgaacagaaaaaggagagtaaggaagaggaaacctctatcgacgttgccggaaagccaaatgaggtaacgaaggccgccgagagtccggaccagaaggataccgatggcggacctaaagaggaggaatcccctgtgtag

SEQ ID NO: 205632 - DNA, 648 bp, Artificial Sequence
  Description of Artificial Sequence: Synthetic coding sequence
atgccccccgccgtgggcggccccgtgggctacaccccccccgacggcggctgggggtgggcagtggttatcggcgcttttatctccatcgggttttcatatgcattcccaaaaagcataacagtattctttaaggagattgaggggatcttccatgccaccacaagcgaggtcagttggatatcttctatcatgttggccgtgatgtatgggggcggccctatctcctctatccttgtgaataagtatggatcccgcatcgtcatgatcgtcggaggctgcctatccggctgtgggttgatcgctgcatccttttgcaatactgtgcagcagctctacgtgtgtatcggtgtcatcggcgggttgggattggcattcaaccttaacccagcccttactatgatcggcaaatatttttacaaacgcaggcccttggcgaatggcctggcaatggccggatcacctgttttcttgtgcacacttgcccccctgaaccaggtcttctttggaatcttcggctggagagggtcattcttgatcttagggggactgttgttgaactgctgcgttgccggcgcactgatgaggccaatcggacccaagccaaccaaagctggcaaagacaagtctaaagccagcctggaatag

SEQ ID NO: 205633 - DNA, 1293 bp, Artificial Sequence
  Description of Artificial Sequence: Synthetic coding sequence
atgccccccgccgtgggcggccccgtgggctacaccccccccgacggcggatgggggtgggcagtggtgattggggcttttatctccatcggctttagctacgcattccctaagagcatcactgtgttctttaaggagatcgagggtatatttcatgccacaacaagtgaagtctcttggatatcctccattatgctcgcagttatgtatgggggcggacccattagtagcatactggtgaataagtatggatcccgaattgttatgattgtgggcggatgcctgagcgggtgcggtctgatcgctgccagtttctgcaataccgttcaacaactctatgtgtgtattggagtcattggaggacttggcctggcttttaacctaaatcctgcattaacaatgattggcaaatatttctacaagaggcgccctttggctaacggcttggcaatggcaggctcaccggtcttcctgtgtaccctggcccccctgaatcaggtgtttttcgggatcttcggctggagagggagctttctgatcctgggtgggcttctgctcaactgttgcgtagcaggggcgctgatgcgtcctatcggtcccaagcccacaaaggctggcaaggataagtctaaggccagcctggaaaaagctggtaagtccggcgtgaagaaggacctccatgacgcaaacacagacctgatcgggaggcatcccaagcaagagaagagatctgtgtttcagactatcaaccaattcttggatctgaccctcttcacccataggggtttcctcctctatctgtctggaaatgtgatcatgttcttcggcttatttgcccctcttgtgttcctttcatcgtatgggaagagccagcactatagcagtgaaaagtctgcttttctgctttctattcttgcctttgttgatatggtggctagacctagtatgggcttggtcgccaatacgaaaccgataagaccccgtatccagtacttctttgccgcctccgtagtggcaaacggcgtctgtcacatgctagccccactgtcaaccacctacgttggcttctgtgtatatgcgggttttttcgggtttgcttttggctggttaagcagcgtactctttgagacattgatggatctcgtcggaccccagcggttctcctccgccgtgggactcgtaaccattgttgagtgttgtccagtcctcctcggccctcctctcttaggcatagtgtatcttcccactaacgttgggttactgcaaaacaagcatgtccggtgggaatgttag

SEQ ID NO: 205634 - DNA, 891 bp, Artificial Sequence
  Description of Artificial Sequence: Synthetic coding sequence
atgccccccgccgtgggcggccccgtgggctacaccccccccgacggtggttggggctgggcagtagtgattggagcgtttatcagcattggctttagctatgccttccccaagtcaatcactgtgttcttcaaggagattgagggcatcttccacgccactactagtgaggtttcctggatctcttccattatgctcgcagtcatgtatgggggaggcccgatttcgagcatcctcgtgaataagtacggatccaggatcgtgatgatcgtcggcggatgtctctccggctgtggtctcattgctgccagcttttgtaacaccgtgcagcagctttatgtttgtatcggcgtgatcggcggtctgggcctagcattcaacctcaatccagctctgacaatgatcgggaaatacttctacaagagaaggcccctagccaatgggttggccatggccggttctcctgtcttcctctgcacccttgcgccattaaaccaggtcttttttggaatttttggttggcgagggtcttttttgatcctgggcggtctactgcttaattgctgtgtcgccggtgccctgatgcgtcctatcgggccaaaacccacaaaagctggtaaagataagtcgaaggcctccctcgaaaaagcaggcaagtctggggtcaaaaaagacctccacgatgccaatacagacctgatcggacgccatccaaaacaggagaagcggtcagtattccagactattaatcagtttcttgacctgacattattcacccatagaggctttctgctgtacctgtcaggtaacgtaataatgttctttggcctcttcgctcccctcgtgttcctgtcctcctatggcaagtctcagcattattcgtcggaatag

SEQ ID NO: 205635 - DNA, 1371 bp, Artificial Sequence
  Description of Artificial Sequence: Synthetic coding sequence
atgccccccgccgtgggcggccccgtgggctacaccccccccgacggtggctggggctgggccgtggtcattggcgcctttatctctatcggattttcatacgcatttcccaagtctatcacagtgttctttaaagaaatcgaggggatatttcatgcaaccacgtctgaggtgtcctggatcagttcaataatgctcgcagtgatgtatggcgggggtccaatctccagcatcctcgtgaacaaatatggatcccgcatcgtgatgattgtgggcgggtgtctcagcgggtgtggattaattgctgcatccttttgtaacactgtccagcagctctacgtttgcataggcgtgatcgggggcctaggcttagcattcaaccttaatccagccctgacgatgatcgggaagtatttctacaagagaaggccgctggctaatggcctggcaatggccgggagcccagtctttctgtgtaccctggctccactaaaccaggtgttttttgggatttttggctggaggggaagtttcctgattttgggcggactgctcctgaactgctgtgtggcgggtgcgctcatgcggccaatcggaccgaagcctactaaggccggcaaagataaaagtaaggccagtttagagaaggcaggcaagtccggcgtgaaaaaggatttgcatgatgccaataccgatctgattggcagacatccaaaacaggaaaaacgaagtgtgttccaaactattaaccaattcttggatctcactctgtttacgcaccggggatttctcctttatctgagcgggaacgttatcatgtttttcgggcttttcgctcctctagtgtttctgagttcatatggaaagtctcagcattacagttctgaaaagtctgcctttttgttgtctatactggctttcgttgacatggtcgcccgacctagtatgggcctggtagcaaatacaaagcctattaggcccagaatccagtacttctttgccgctagcgtcgtcgccaatggcgtgtgccacatgctggccccactgtccactacatacgtcggattctgtgtgtatgccggctttttcggcttcgcattcggttggctcagttccgtcctatttgaaacgcttatggatttagtgggaccacagcgtttttcgtccgcagtggggctcgtcaccattgttgagtgctgcccagtgctactgggacctcctttgctggggcgcctgaatgacatgtatggcgattacaagtatacatactgggcgtgcggggttgtactgatcatcagcggcatttatctgttcattggcatggggatcaattaccgcctgctagctaaagagcagaaggccaatgaatag

SEQ ID NO: 205636 - DNA, 1503 bp, Artificial Sequence
  Description of Artificial Sequence: Synthetic coding sequence
atgccccccgccgtgggcggccccgtgggctacaccccccccgacggcgggtggggctgggccgtggtgattggggcctttatttctataggcttcagttacgccttccctaagagcatcacagtgtttttcaaagaaatcgagggaattttccatgccaccacttctgaggtgagttggattagttccatcatgcttgcagtcatgtacggtgggggccccatcagctcaattctagtgaacaagtatggatcacgcatcgtgatgattgtcgggggttgcctctccggatgtggtctcatcgccgcctctttttgtaacaccgtgcagcagttatacgtctgtattggcgtcatcggcgggctgggactggcattcaacctgaaccccgccctgacaatgattggaaagtacttttacaagcggagacctcttgccaatgggctggcaatggctggaagccccgtgtttctgtgcaccctcgcccctctgaatcaggtgttcttcggtatcttcgggtggcgtgggtctttcctcatcctgggcgggcttctgctgaactgttgcgtcgccggtgccttgatgcgacccattgggcccaagccaaccaaggcagggaaggacaagtctaaggcatccctggagaaagctggtaaatcgggggtgaagaaggatctacatgacgcgaacaccgatttgattggaagacaccccaaacaggagaagcgttctgtcttccagaccattaaccagttcctggacctgacattgttcacccatcgcggatttcttctttacctgtctgggaacgtcatcatgtttttcggtttgttcgctccactggtgtttctgtcttcctacggtaagagccagcattatagctcagagaagagcgccttcttactttcaattctggctttcgttgacatggtcgcgcggccaagcatgggcctagtggccaatacaaagcccatcaggcctagaattcaatactttttcgccgccagcgttgtcgccaacggcgtgtgccacatgttagctcctctttccaccacttatgtcggcttctgcgtttatgccgggtttttcgggttcgccttcggttggctctcctctgtgctcttcgaaaccttaatggacctcgttggaccgcagagattttcttctgctgtggggctggtcacaatagtcgagtgttgccctgtgctgctcggcccaccactattagggcgtttgaacgatatgtacggggattacaagtacacctattgggcttgcggagtcgtgcttatcatctcgggaatatatctattcattggtatgggcatcaattataggctgctggcgaaagaacaaaaagccaacgagcaaaaaaaagagtcgaaggaagaggagacatctatagacgtcgcaggtaaacctaatgaggtcactaaagctgctgagtccccagaccagaaagatactgacggcggccccaaagaagaggaatctccagtttag

SEQ ID NO: 205637 - DNA, 606 bp, Artificial Sequence
  Description of Artificial Sequence: Synthetic coding sequence
atgaagcacgtgaacgagcggttccaggacgagaagaacaaggaggtggtcctgatgtgtatcggggtgacaagcggagtcggaagactcctgttcggcaggattgcagattacgtccccggcgtcaaaaaagtctaccttcaggtgcttagcttttttttcattgggttaatgagcatgatgattcctttgtgtagcatattcggcgcactcatcgcagtgtgtctgattatgggcctctttgatggctgttttatctctattatggcacccatcgcctttgaactggtgggagcgcaggacgtctcacaggccatcggcttccttctcggctttatgtctataccgatgaccgtggggccacctatagcggggcttctgagggataagctgggatcttacgatgttgctttttacctggccggcgtgccaccattgattggtggcgccgtactatgttttatcccttggattcattccaaaaaacagagagaaatctccaaaacgactggcaaggaaaaaatggagaagatgctcgagaatcaaaactcgctgctatcaagctctagcgggatgtttaagaaggagagcgactcaatcatctag

SEQ ID NO: 205638 - DNA, 1548 bp, Artificial Sequence
  Description of Artificial Sequence: Synthetic coding sequence
atggtgctgagccaggaggagcccgacagcgcccggggcaccagcgaggcccagccactcggacccgcacccacaggtgccgcacctccgccgggtcctggaccaagcgattcaccagaggccgcagttgagaaagtggaggttgaactcgcggggccagccaccgcagaacctcacgaaccccccgaacctccagagggcggctggggttggctggtcatgcttgctgccatgtggtgcaatggctccgtcttcggcatccagaacgcttgtggggtcctgttcgttagcatgctcgaaaccttcggatctaaggatgatgataaaatggtttttaaaactgcctgggtcggttccctttcaatggggatgatttttttttgttgtcctatcgtgtccgtgttcaccgatttgtttggatgtcgcaagaccgcagtagtaggggccgcagtgggcttcgttgggctcatgtcctcctccttcgtctcttccattgaaccgttgtacttaacttacggtataatcttcgcatgtggctgttcgtttgcctatcagccctctctcgtgattttgggccattactttaaaaaacgcttgggtctcgtcaacgggattgtcacagccggctccagtgtttttactatcttgttacccctgctgttgcgggtgttaatcgattcagtaggcctcttctacaccctgagagtcctttgtatcttcatgttcgtgctgttcctggccggatttacgtaccgccctttggccacttctaccaaagacaaagagtccgggggctccggaagttcactcttcagccgcaagaaatttagccctcccaagaagatcttcaactttgctatcttcaaggtaacagcctatgccgtgtgggctgttggcatccccctggcactgttcggctactttgtgccctacgttcacctcatgaagcacgttaacgaaagatttcaggatgaaaaaaacaaggaggtcgtccttatgtgtatcggagtgacctctggagtggggcggcttttgttcggtcggatcgcagactacgtgcccggtgtcaaaaaggtgtatctacaggtcttatcctttttctttatcggcctcatgtctatgatgattccgttgtgcagtatctttggggccctcatagccgtgtgtctgattatgggtctttttgacggctgctttatttcaatcatggctcccattgcgtttgagctggtcggggctcaagatgtgtcccaggctattggtttcctcctgggtttcatgagcatccccatgaccgtaggacctccgattgccggactacttcgcgacaagctgggcagctatgacgttgctttttacctagcaggcgtcccaccacttataggcggagctgtactgtgtttcatcccatggattcattccaaaaaacagcgagagatctctaagaccaccggaaaagaaaagatggaaaagatgttggagaatcagaactccctgctcagtagcagcagcggaatgttcaagaaggagtcagactcaataatctag

SEQ ID NO: 205639 - DNA, 651 bp, Artificial Sequence
  Description of Artificial Sequence: Synthetic coding sequence
atggtgttcaagaccgcctgggtgggcagcctgagcatgggcatgatctttttttgttgccccatcgtgagtgtgtttacagacttgtttggatgccgtaaaaccgctgtagtgggggctgcagttggtttcgtgggactgatgtcctccagtttcgtcagttctatcgagccattgtatctaacctatgggataatttttgcttgtgggtgttccttcgcttaccaaccctccttggtgattctgggacattacttcaaaaagaggcttggacttgtgaacggaatcgtaacagctggatcttctgtgtttaccatcctattgcctcttctacttcgggtcctgattgatagcgtagggctgttctacactctgagggtcttgtgcatattcatgttcgttttattccttgcggggttcacctatagaccgctcgccacgagcacaaaagacaaagagtctggcggaagtgggtcctctctcttttccaggaaaaaatttagccctccaaagaagattttcaactttgcaatctttaaggtaacggcatacgcagtgtgggccgtggggattcccctcgccttgtttggctatttcgttccctacgtgcacctggctaagttctcctttgtgattctgaaatatgaatag

SEQ ID NO: 205640 - DNA, 636 bp, Artificial Sequence
  Description of Artificial Sequence: Synthetic coding sequence
tgatgggtgggcagcctgagcatgggcatgatcttcttctgctgccctatcgtgagcgtattcacggatctgtttggctgtagaaagacagctgtcgtcggggcagcggtcgggtttgttgggctgatgtcgtcttcgtttgttagctccatagagccactatacctaacctatggaattatattcgcctgcggatgcagctttgcttatcagcctagtctcgtcatcttagggcattacttcaaaaagcgtcttgggctggtcaacgggatagtgacagctgggtcttccgtgttcactatcctgctgcccctgctgctccgagtcctgattgattcagtagggctcttttacactcttagggtgctctgtattttcatgttcgtactcttcctcgcgggatttacctatcgacctcttgctacatccacaaaggacaaagagagcggcggttcaggctcaagcctgtttagcaggaaaaaattctctcctccaaaaaaaatattcaatttcgccatatttaaggtcaccgcatatgcagtttgggccgtggggattccattggccttgttcggttacttcgtcccttacgtacacctggctaaattctccttcgtcattctgaagtacgagtag

SEQ ID NO: 205641 - DNA, 621 bp, Artificial Sequence
  Description of Artificial Sequence: Synthetic coding sequence
tgatgggtgggcagcctgagcatgggcatgatcttcttctgctgccctattgtgtctgtcttcaccgacctgtttggctgtagaaaaactgcagtggtgggggccgctgttgggttcgtggggttgatgagcagtagttttgtgtcaagcattgagccgttgtatttgacttatggtatcatcttcgcttgtgggtgctccttcgcctatcaaccttccctggtgatcctaggccactatttcaagaaacggcttggactcgtaaatggaattgtgactgcaggatccagcgtctttacaattctgctcccgttgttgttgcgtgttctgattgacagcgtgggattgttctatacactgcgggtgctgtgcatcttcatgtttgtgctattcctagctggcttcacgtatcggcccctagctacttcgacaaaagacaaggaatcaggtggcagcgggtcatcactttttagcaggaaaaagttcagtccacctaagaagatattcaactttgccatattcaaggtcacggcttacgctgtctgggccgtcggcatacccctcgcgctgttcggctactttgtgccatatgtgcacctcgtgagtatgcttctccattag

SEQ ID NO: 205642 - DNA, 981 bp, Artificial Sequence
  Description of Artificial Sequence: Synthetic coding sequence
atggtgctgagccaggaggagcccgacagcgcccggggcaccagcgaagctcaacctcttggccctgcaccgaccggagctgcccctccacccggtccagggcccagtgatagcccagaagccgctgttgaaaaggttgaagtggaacttgccggccctgccacggcggaaccccacgagccgcctgaaccaccggaggggggatggggctggttggtgatgctggccgcaatgtggtgtaatgggtcagtcttcgggatccaaaatgcatgcggcgttctgtttgtgtccatgctagagacgttcggatccaaggatgatgataagatggtattcaaaacagcttgggtgggcagtctgagcatgggaatgattttcttttgctgtcccattgtgagtgtgtttaccgacctgttcggttgccgcaagactgccgttgtgggcgcagccgtaggcttcgtgggcttaatgagctcaagttttgtaagctccattgagcctttatatctcacctacggcatcatatttgcatgtggttgctcctttgcttaccagcccagtctcgtcatccttggccattacttcaaaaagcgtctgggattggtaaacggcatagttactgctggctcctctgtgtttacaatcctgctgcctctactactgagggtgctcattgacagtgttggacttttctatactctaagagtcctgtgtatcttcatgttcgtcctgttcctagccggcttcacataccgccctctagccacatcaacaaaggataaggagtccggcggatcaggtagttctctgtttagcaggaaaaagttcagtcccccaaaaaatttccaattctgccacctgcagggtgattctctgtgttccgtgggatcgtggaacaccacttgcacgttctggatcctttgcgctctgtgttctctgggcgagtatgctccaagtctgatcatgaatataacaatctag

SEQ ID NO: 205643 - DNA, 1461 bp, Artificial Sequence
  Description of Artificial Sequence: Synthetic coding sequence
atggccaaggtgaaccgggcccggagcaccagcccccccgacggcgggtggggatggatgatagttgctggatgctttctggtaaccatttgcacccgggccgtgactagatgtatttcaatcttctttgtggagtttcagacctatttcactcaggactacgcccagaccgcctggattcactctattgtagattgcgtcaccatgttgtgcgccccccttgggtctgttgtatccaatcacctgagttgccaggtaggcatcatgctgggtggcctgctggcttccacaggacttattctgagctcgttcgctaccagtcttaagcatctctacctgacactgggcgttctaacggggctcgggttcgctttatgttacagtcctgcaatcgccatggtcggtaaatatttttcgagacggaaagctttggcatatgggattgcaatgagtggctcaggaattgggactttcatattggcccccgtcgtccagctgctgatcgagcaattctcttggagaggtgccttgttaattttgggcgggtttgtcttgaacctgtgcgtgtgtggggctctcatgcgtcccataactctaaaagaggaccatacaacccctgagcagaatcacgtctgccggacacaaaaagaagacatcaagagagtgagcccttatagtagcctcactaaagagtgggcacagacctgtttgtgttgctgcctccagcaggaatattcattcctgctcatgagcgactttgtggtcctggccgttagcgtgctctttatggcctacgggtgctctcccctctttgtctacctggttccatatgccctctctgtgggggttagtcatcagcaggccgcattcctgatgtccatcctgggagtcattgacattatcggcaatattacattcggctggctgaccgataggaggtgccttaagaattatcagtacgtgtgttatcttttcgcagtagggatggatggcttgtgttacttgtgcttacctatgctgcaaagccttcctttacttgtgccatttagctgcacgtttggctatttcgacggggcctacgtgacgttgatccctgtcgtgaccacagaaattgtggggaccacatcactctctagcgccttgggagtggtgtactttctccatgctgtgccctacttggtgagtccacccatagcaggtcggctggtcgacaccacagggtcatacactgcagcattcctattgtgtggctttagcatgatcttctcttcagtgctgctagggttcgccagactaattaaaagaatgcggaagacacaattgcaattcattgccaaggagagcgacccaaaactgcagctctggaccaacggcagcgttgcttacagtgtagcgagagagctggaccagaaacatggagagcccgtcgccacagccgtgcccggctatagcctcacctag

SEQ ID NO: 205644 - DNA, 1551 bp, Artificial Sequence
  Description of Artificial Sequence: Synthetic coding sequence
atgcccagcggcagccactggaccgccaacagcagcaagatcatcacctggctgctggaacagccgggcaaagaagagaagcgcaaaactatggctaaggtcaaccgggcccgttccactagccctccagatggcgggtggggatggatgattgttgcgggctgtttcctggtcactatctgtaccagggcagtcacgagatgcatctcaattttcttcgtggagttccagacatactttacacaggattatgctcaaacagcttggatacactccattgtggactgtgtgaccatgctgtgtgccccgcttggctccgtcgtgtcaaatcatctgtcctgccaggtggggattatgctgggcggcctcctcgccagcaccggcctgattcttagcagcttcgcgactagcctgaaacacctctatctcacccttggtgtgctcaccggcctgggatttgctttatgctattcccctgcaattgcaatggtcggaaaatacttttcccggcgcaaagctctcgcgtatggcatcgctatgtctggttccggtatcggaacttttatccttgctcctgtggtgcagcttctgattgagcagttttcttggcgcggagccttgctcatactgggggggtttgtgctcaatctgtgcgtttgcggagccctgatgagacctatcacccttaaggaagatcacaccaccccggaacagaaccacgtgtgcagaacgcagaaggaggacatcaagagggtgagcccctactctagtttgactaaagaatgggcgcagacttgtctgtgctgctgcctgcagcaagaatacagcttcttattaatgagcgactttgtggttctcgcagtcagtgtattgtttatggcttacggatgcagcccactctttgtctacctggtgccttacgcactgtccgtgggcgtgagccatcaacaggccgccttcctcatgtcaatattgggagttattgatattatcggcaatatcaccttcggctggctcaccgatagaagatgtctcaaaaattatcaatacgtgtgttacctcttcgctgtggggatggacggattatgctacttgtgtctacctatgttgcaatcactgcctctgctggtcccattttcttgcacatttggatatttcgacggtgcgtacgtaacactgatccctgtggtgacaacggagatagttggcaccaccagcttgagctcagctctgggagttgtgtactttctccacgccgtcccatacctggtctctcctcccatcgcaggccggctggttgacacaacagggagctacacggccgccttcttgctatgcggtttctctatgatctttagcagtgtactgctgggcttcgcccggctaattaagcgaatgcgaaagacacagcttcaatttatcgctaaagagtctgacccaaaactgcagctatggaccaacggaagcgtggcctatagcgtggccagagaactcgaccagaagcacggtgaacctgtggcaacagcggtccctgggtatagcttgacttag

SEQ ID NO: 205645 - DNA, 78 bp, Artificial Sequence
  Description of Artificial Sequence: Synthetic coding sequence
atgcccagcggcagccactggaccgccaacagcagcaagatcatcacatggttgctggagcagccgggcaaagaatag

SEQ ID NO: 205646 - DNA, 453 bp, Artificial Sequence
  Description of Artificial Sequence: Synthetic coding sequence
atgcggcccatcaccctgaaggaggaccacaccacccccgagcagaaccacgtgtgtaggacacagaaggaggacattaagcgggtgagtccctactcttcccttacaaaagaatgggcccaaacatgcctgtgctgctgtctgcagcaagagtatagttttttactaatgtcagactttgttgtgctggcagtaagtgtactattcatggcctatggctgcagccccctttttgtttatttagtcccctatgctctcagcgttggagtctcccaccagcaggccgcgttcttaatgtctattctaggagtcatcgacataatcggcaatattaccttcgggtggttgacagacaggaggttctgcataaagacgttcggaatattccggaaatcagtgagaaagatgtacatcctgcgaagtaccattttacatttctacacggaattctag

SEQ ID NO: 205647 - DNA, 1842 bp, Artificial Sequence
  Description of Artificial Sequence: Synthetic coding sequence
atgggccggggcggcggcggcctggacgtgggcggcggcggcgaggggagccgcgatcggttatcacgtgacgggttggctagttggggcgctgagccaggtggcggaggttctggatctggctcttctagtccacccagttcctcttcatgttcatcaagaaataaatatcagccccagtctgggtccagtggcccctctagtcactctccaccagccgctatggcccttcagtcacaggcttcagaagaggcgaaaggaccttggcaggaggccgaccaggagcagcaggagcctgtgggatctcctgaaccagaaagcgagccagaacctgagccagagcctgagcccgtccccgtccctccacctgagccgcagcccgaaccccagcctctccctgatcccgcacccttaccggagctcgagttcgagtctgagcgcgtgcatgagcctgagcctacacctacagtggagacccgaggcacagcccgcggcttccagccccctgaggggggattcggctgggtggttgtgtttgctgcaacatggtgcaacgggtcgatctttggaatccataatagtgttggcatcctatatagcatgcttcttgaggaggaaaaggagaagaatcggcaagtggagttccaggcagcttgggtgggcgctctcgctatgggcatgatctttttttgcagtcctatcgtatcaattttcacggatcggctgggttgcaggatcaccgctactgccggggccgccgtggcgttcatcggtctgcatacatccagctttactagcagcctcagtttgaggtattttacttacggtatcctgttcggctgcgggtgttccttcgcgttccagcccagcctggtcattctgggccactactttcagagaagattaggactcgccaatggagtcgtgtcggccggcagttccattttcagcatgagttttccttttctgattaggatgttaggggacaaaattaagcttgcccagacattccaagtactgtcaaccttcatgttcgtgttaatgctgctgtcgttgacttacagacctctgcttccatcttctcaggataccccttctaagcgaggcgtcagaaccttgcatcagcgattcctggctcagctcagaaaatactttaacatgagggtttttagacaacgcacataccggatctgggcttttggcatcgccgccgcggctctcggctattttgtgccctacgtccatctgatgaaatacgtagaagaagagttctcagagattaaagagacatgggtccttctagtttgcatcggggccacaagcggattggggagactggtatctggccatattagcgattccatcccaggtctgaagaaaatttatcttcaggtgctgtcttttctgctgctggggctgatgtctatgatgatcccgctgtgtagagattttgggggactaatcgttgtgtgcctgtttctgggcctctgcgatggattttttatcacgatcatggctccgatagcattcgagctcgtagggcctatgcaggcctcacaagccatagggtacttactcggaatgatggccttgcctatgattgctggaccacctattgcgggactgctgaggaactgcttcggtgactaccacgtggctttttacttcgcgggggtacccccaatcattggggcggttattctgttcttcgtgccattaatgcaccagagaatgttcaaaaaagagcagcgtgactcgtcaaaggataagatgcttgcaccggacccagatccaaacggtgagttgctgccaggcagcccgaaccccgaggagccgatctag

SEQ ID NO: 205648 - DNA, 1437 bp, Artificial Sequence
  Description of Artificial Sequence: Synthetic coding sequence
atgccccccatgcccagcgccccccccgtgcaccccccccccgacggcggatggggttggattgttgtgggcgccgccttcatttctatcggttttagctacgccttccccaaagcggtcactgtcttcttcaaagaaatacaacagatctttcatactacatactctgaaattgcctggatctcatcaattatgctcgccgtgatgtacgcaggcggcccagtgtcgagcgtgctcgtgaataaatacggaagcagacctgtagtgatcgccggcgggcttctgtgttgtctgggcatggtccttgcttccttttcaagtagtgtggtccagctttacctgactatgggcttcattactggcctgggactcgcattcaacttgcagcctgccttgaccattatcggcaaatatttctacaggaagcgacctatggctaatggacttgctatggcggggtcaccagtgtttttgagctccctcgccccttttaaccagtatctgttcaacacattcggttggaagggatcgtttcttattctcggatctttactgctcaatgcatgcgtagcggggtctctgatgaggcccctcggccctaaccagacgacatcaaaatcaaagaacaaaaccggcaagaccgaagatgactcaagccctaaaaagatcaagactaaaaagagcacctgggagaaagtgaacaagtatctggactttagccttttcaagcatcgcgggttcttgatttacttgtcaggcaatgtgatcatgttcttaggtttctttgccccgatcattttcctggccccatacgccaaggaccagggtatcgacgaatattccgctgctttccttctgtcggtcatggcttttgtggacatgtttgctaggccctcagttggccttattgcaaacagcaaatatatccggcccaggatccagtatttcttttccttcgcaatcatgttcaatggagtctgtcacctgctgtgtcctttggctcaggactatacaagccttgttctctacgctgtcttcttcgggctcggctttggcagcgttagctccgtgctgtttgagactctcatggatctcgttggtgccccgcggtttagctctgctgtgggcttagtgacaattgttgagtgcggccccgtgctcctggggccacccctggccgggaaattagttgatttgactggcgagtataagtatatgtacatgagctgcggcgccattgttgtggctgcgtcggtgtggttgctcatcggtaacgcaatcaattaccgcctgctcgcaaaggagaggaaagaggaaaatgcaaggcagaaaacacgggagtcagaacccctgagcaaatccaaacatagcgaggatgtaaacgtgaaggtgtcaaatgcccagtccgtcacgtccgaaagagagactaatatctag

SEQ ID NO: 205649 - DNA, 1140 bp, Artificial Sequence
  Description of Artificial Sequence: Synthetic coding sequence
atggtgctggccagcttcagcagcagcgtggtgcagctgtacctgacaatgggattcattaccggcctgggattagcgtttaatctacagcccgctctcacaatcatcggcaaatacttttatcgaaagaggccaatggcaaatggactggccatggcaggcagtcccgtgttcctttcctccttggcgccatttaatcagtatctttttaacactttcggctggaagggcagtttcttgatcctgggtagcctgctgcttaatgcatgcgttgcaggaagcttgatgcgcccgctgggcccaaatcagaccacatccaagagcaaaaataagaccggtaagacagaagacgattcctcccccaaaaaaatcaaaaccaagaagtccacctgggagaaggtcaacaaatatctcgacttcagcttgttcaagcatcgagggtttttaatttatctgtccggcaacgtgatcatgttccttggcttttttgctcctataatctttttggctccgtacgctaaggatcaaggaattgatgaatacagcgcggcattcctcctctccgtaatggcattcgtcgatatgttcgctcgtccctcagtaggactcatcgctaactccaagtatatccggccacgcatccagtacttcttcagttttgctataatgttcaatggcgtctgccacttgctatgccccctggcccaagattacactagtctcgtcctgtatgctgtcttcttcggactgggctttggcagcgtgtcctccgtgcttttcgaaacactgatggacctagtgggagctccccgtttctctagtgctgtcggtctggtgacaatagtggagtgcggacccgtgctgttgggcccccccctcgccggcaaactcgtagatttaaccggggaatataagtatatgtacatgagttgtggtgccatcgtggtagccgcctcagtgtggctgcttattggaaacgcgatcaactatcgcctcttggccaaggagagaaaggaagagaatgcgagacaaaaaactagagagtctgagcccctttccaagtccaagcattctgaagacgtcaatgtaaaggtctccaacgcccagagtgtgacgtccgagcgcgagactaatatctag

SEQ ID NO: 205650 - DNA, 1437 bp, Artificial Sequence
  Description of Artificial Sequence: Synthetic coding sequence
atgccccccatgcccagcgccccccccgtgcaccccccccccgacggtggctgggggtggatagtcgtgggcgcagctttcattagcattggcttttcctatgccttccccaaggccgtgaccgttttttttaaggagatccagcaaatatttcacactacttatagcgaaattgcatggatttctagcatcatgctcgccgttatgtatgcgggcggccccgtctcatctgtgctcgttaataaatacggatctcgaccagtggttatcgcgggtggacttttatgctgcctgggaatggtcctggcttccttcagctcctccgtggtgcagttgtacctcactatggggtttataaccggcctgggcttggccttcaatctgcagcctgctctgactattatcggtaaatacttttatcggaaaagacccatggccaatggcctcgccatggctgggagtccagtttttctttcgtcactggccccttttaaccagtacctctttaacactttcggttggaagggttcatttctgatccttggatccctgctgctgaacgcctgcgttgctggtagcctaatgaggcccctgggtcctaatcaaaccacttcaaaatccaaaaataagaccggtaaaactgaggacgactctagtccaaaaaagattaagactaagaaatccacctgggagaaggtgaataaatacctcgactttagcctttttaagcacagaggatttctgatttatctgagcggaaacgtgattatgtttctgggcttcttcgcaccaatcattttcctagccccttacgcgaaagaccaggggatcgacgagtactccgctgctttccttttgtccgtgatggccttcgtggacatgttcgccaggccatcagtgggcctgattgcgaatagcaaatatattcggccccggattcaatacttcttctccttcgccattatgttcaatggggtgtgccacttgctctgtccactggcccaggactacacctccctggtgttatacgccgtgtttttcggcctcggattcgggagcgtctcaagcgtgttgtttgaaaccctcatggatctggtgggagctccacgcttcagctcagcggtgggtttagttactatagtggagtgcggccccgttctgcttggaccacccctcgcgggaaagctcgtagatctcactggggagtacaagtacatgtacatgtcttgcggagctattgtcgtggccgctagtgtgtggttgctgatcgggaacgccatcaattatcgcctgttagcaaaagaacgaaaggaagagaacgcaaggcagaagacgcgagaaagcgaaccactgagcaaaagtaagcacagcgaagacgtgaacgtgaaagtgtcgaatgcccaaagcgtgacctcagaacgtgagaccaacatctag

SEQ ID NO: 205651 - DNA, 1437 bp, Artificial Sequence
  Description of Artificial Sequence: Synthetic coding sequence
atgccccccatgcccagcgccccccccgtgcaccccccccccgacggtggctggggatggattgtcgttggcgccgcattcataagcatcggatttagctatgctttcccaaaagccgtgacggtctttttcaaagagatccagcaaatcttccatacaacatactccgagatcgcatggatctctagtatcatgctggctgtcatgtacgccggggggcccgtgtcttcagtgctcgtgaataagtacggaagcaggccggttgttatcgccggtggactgctctgttgtctcggaatggtattagccagcttttcttcttcagtcgtccagctgtacctaacaatgggattcatcactggactcggcctggcattcaatctgcaaccggccctgactataattggcaagtacttttatcgcaagcgaccaatggcgaacgggcttgccatggctgggtctccagttttcctgtcctctttggctccgttcaaccagtatttatttaacacattcggttggaaaggcagttttctcatcttaggaagcttactcctgaacgcttgtgtagcgggcagcctcatgcggcctttaggccctaatcagaccactagcaaatcaaaaaacaaaaccgggaaaaccgaggatgactcatcccctaagaaaattaaaaccaagaagtcaacttgggagaaagtgaataagtatctggattttagtctttttaaacatcgggggttccttatctatctgtccggaaatgtgatcatgttcctcgggttctttgctccaattatctttctcgccccatacgctaaggaccagggcatagatgagtattctgctgccttcctgttgtccgtcatggcgtttgtggatatgttcgcgcgacccagtgtgggactcatcgctaattctaaatatatcaggccgcggatacaatacttctttagcttcgccatcatgtttaatggtgtgtgccacctgctctgtccattggctcaggattatacgtcgctggtcctctatgctgtgtttttcggcctgggctttggcagcgtctcctccgttctctttgaaactcttatggatctggtcggcgcaccacgattctcttccgctgtcgggctggtgactatcgtggagtgtgggcccgttttgttaggccccccactggccgggaaactggttgatctaactggggaatacaagtatatgtacatgagctgtggagccattgtggtcgccgcctccgtctggctgctgattggtaacgccattaattaccgcttactggccaaagagcgcaaagaggaaaatgcacgtcaaaaaacccgcgagtcagagccactcagcaaatccaagcactcggaggacgtgaacgtgaaagtcagtaatgcacagtccgtcacatccgaacgggaaacgaatatttag

SEQ ID NO: 205652 - DNA, 1437 bp, Artificial Sequence
  Description of Artificial Sequence: Synthetic coding sequence
atgccccccatgcccagcgccccccccgtgcaccccccccccgacggaggttggggctggattgtggtgggtgcagccttcatcagtatcggtttttcctatgcctttcccaaggccgtgacagtgtttttcaaagaaattcagcaaatattccacacaacgtatagcgagatcgcctggatcagctctataatgctggccgtcatgtatgcagggggacctgtgtcttccgtacttgtgaataagtatgggagccgccctgtggtgattgcagggggcctattgtgttgcttgggcatggtgctcgcttcttttagcagtagcgtggtccagctttatctgaccatgggcttcattacaggcctcggtcttgcattcaatctgcagcccgctctgacaattattggcaagtacttctatcggaaaagacctatggccaacggactcgcaatggcaggttctcccgtgtttctcagtagtctggcaccgttcaaccagtacctcttcaacaccttcggttggaaaggaagcttcctgattctgggtagcttgcttctcaatgcatgcgttgccggaagcctcatgagacctctcggccctaatcaaacaactagcaaaagcaaaaacaagacgggcaaaaccgaggacgactcttctcctaagaagatcaaaaccaagaagtcaacgtgggagaaggtgaataagtatctggatttttctctgttcaagcatcgtggatttctgatttacctttccggtaatgttattatgtttttagggttttttgcgcctatcatcttcttagccccatacgctaaggaccagggcatcgatgagtattcagcggcatttcttctgtccgtgatggctttcgttgacatgttcgcccgtccctccgtcggtctgatagcaaactccaaatacatacgccctagaatccagtattttttttcattcgctattatgtttaacggagtctgtcatcttttatgtccactagcacaggactacacatctctggtgctgtacgcagtgtttttcggcctggggttcggaagcgtatcatcagtactcttcgaaacattaatggacctggtgggtgcccctaggttctcttcagcggtggggctggtgaccatagtggagtgcgggcccgtcctattaggacctccactagcaggcaaactggtggacctaaccggcgagtataagtacatgtatatgagttgtggagctatcgtggtggcagcctcggtatggctgcttattgggaatgcaatcaattataggcttctggccaaagagcggaaagaggaaaacgcacgccagaagacgcgggaatccgaaccactgtcaaagtccaagcatagcgaggatgtaaatgtgaaggtgtctaacgctcaaagcgtcacttcggaaagggaaacaaacatttag

SEQ ID NO: 205653 - DNA, 1530 bp, Artificial Sequence
  Description of Artificial Sequence: Synthetic coding sequence
atggagctgaagaagagccccgacggcggctggggctgggtgatcgtattcgtgagcttcctgactcagttcctgtgctacggatccccccttgctgttggcgtgttgtacatcgagtggctcgacgcttttggcgagggcaaagggaagactgcctgggtggggtcccttgcttctggagttggactgctggcgtccccagtgtgcagtctttgcgtcagttcctttggggcacggccagtcaccatcttttctggcttcatggtcgccggcgggctaatgctgtccagttttgcccctaatatctactttttgttctttagttatgggatagtcgtaggattgggctgtgggctgctatataccgcgactgttacgattacttgccagtacttcgatgaccgccgagggctggctttaggtctgatcagtactggatctagcgttgggctgttcatttacgccgctctgcagcgcatgctcgtggaattctacggcctcgacggctgtttgctgattgtcggggccctggctttgaacatccttgcatgtggctctctgatgaggccactacaatcaagtgattgccccttacccaaaaaaatcgctcccgaagaccttcccgacaagtactccatctataacgaaaagggaaaaaatctggaagagaacatcaacattctggacaaaagttattctagtgaagaaaagtgtagaatcacattagccaatggggattggaagcaggactccctactccacaagaacccgacagtaacccacactaaggagccagagacatacaaaaagaaggtggccgagcagacatacttttgtaaacagcttgctaaacgaaagtggcagctgtacaagaactattgcggcgagactgtggcactgttcaaaaacaaggtcttttcagctctgttcattgcgatattactttttgatattggaggcttccccccaagtctactcatggaggacgtggctaggagctccaacgtaaaggaagaagaatttattatgcctttaatctccattatcggaatcatgacagctgtgggaaaacttctccttggtattctggcggactttaagtggatcaatacgctgtacctctacgttgctactctgatcatcatgggtctggctctgtgtgcgattccttttgccaaaagctatgtcaccctggccctgctgtccggtatcctcggtttcctcactggaaactggagcattttcccgtacgtgactacaaagactgttgggattgagaagttagcccacgcctatggaattctgatgtttttcgccggactgggaaacagcctcgggcccccaattgtcggctggttctacgattggacacagacatacgacatagccttctatttctctgggttttgtgtgctgctgggagggttcatcctgttattagcagcattacccagctgggatacctgcaataagcaactgcctaagcccgctccgacaacattcctgtataaggtcgcgagtaacgtatag

SEQ ID NO: 205654 - DNA, 1530 bp, Artificial Sequence
  Description of Artificial Sequence: Synthetic coding sequence
atggagctgaagaagagccccgacggcggctggggctgggtgatcgtgtttgtatccttcctgacacaatttctgtgttacggcagcccactagccgtgggtgtgctctatatcgagtggcttgatgcgtttggagagggtaagggcaagactgcctgggtgggctctctcgctagtggagtcggcctgttggcatcccccgtctgtagcctctgtgtgagctcctttggcgcccgtcctgtaacgatttttagcggcttcatggtcgccggcggactgatgctctccagctttgcccccaatatttattttctctttttcagctatggaatcgttgtgggtctagggtgcggtctgctttatacagccactgtgactataacctgtcagtatttcgatgatcgccgggggttggcactgggactcatcagtacgggcagcagcgttggtttgtttatttatgccgccctccagaggatgctcgttgagttctacgggctggatggttgtctgctgattgtaggggctctggccttgaacattcttgcgtgtggttctttgatgaggcctcttcaaagctctgactgccccctccccaagaagatcgcacctgaggaccttccagacaagtattccatttataatgaaaagggaaagaatctggaagagaacataaatattctggacaaatcatatagcagcgaagaaaagtgtagaataacgctggccaacggagattggaagcaggattctttgttgcataaaaaccccacagtcacacacacaaaagagccagagacatacaagaaaaaagttgcagagcagacctacttttgcaagcaattggcaaaacgcaagtggcagctatataaaaattactgcggcgaaacagtcgccttgtttaagaataaggtgttctctgctttatttattgctatacttctgtttgatattgggggcttccctccctctctgctgatggaagatgttgcacgttcatcaaacgtcaaggaggaggagttcatcatgcccttgatttcaatcatcggaatcatgacagcagttggaaaactgttgctgggcatactggccgacttcaaatggatcaacaccttgtacctatacgtggcgacacttattataatgggcttagccttgtgcgctatccccttcgctaaaagctatgtcacactcgcgctcttgtccggaattctcggctttctgacgggtaattggagtatctttccctacgtgactactaagaccgtgggcatcgagaagttggcccacgcttacggcatcctgatgtttttcgcggggcttggcaacagtcttggccccccaattgtgggctggttctatgattggacccagacgtacgatatcgccttctacttctcaggtttttgcgttcttctgggtgggttcatactgttattagccgcactgccttcatgggacacatgtaacaaacagctacctaaacctgcaccgaccacttttttatacaaggtggcctcaaacgtgtag

SEQ ID NO: 205655 - DNA, 198 bp, Artificial Sequence
  Description of Artificial Sequence: Synthetic coding sequence
atggagctgaagaagagccccgacggcggctggggctgggtgatcgtattcgtctcgtttctcacacagtttttgtgctatgggtctcctctggcggtgggtgttctctatattgagtggctcgatgcgttcggagaggggaaagggaaaacggcttgggtgggttccctcgcaagcggggttggccttctggcttag

SEQ ID NO: 205656 - DNA, 1488 bp, Artificial Sequence
  Description of Artificial Sequence: Synthetic coding sequence
atgcggagccccgtgcgggacctggcccggaacgacggcgaggagagtaccgataggacacctttgctacctggcgcgcctcgcgctgaggctgcccctgtatgctgcagcgccaggtacaatttagctatcctcgcattctttggtttttttatagtctacgcactccgcgtgaacctttccgtagcactggtcgacatggtggacagtaacactacactggaagacaatcgaacatccaaagcttgtcccgagcactccgccccaattaaggtgcaccacaatcagacgggtaagaagtaccaatgggatgccgaaacgcagggctggatactcggtagcttcttctacggttatattattacacagatcccaggcggctatgtggcctccaaaatcggcggcaaaatgttgctgggcttcgggatactgggcaccgctgtgcttactctcttcactcccatcgctgcagacctcggcgtaggccctctcattgtgctgagagcactcgagggactgggggaaggtgtaacattccccgctatgcacgctatgtggagtagttgggcgccaccgctggaaaggtctaagctactgtcaatctcatatgctggggcacagctcggaactgtaattagcttgcctctatctggcattatatgttattatatgaattggacttacgttttttacttctttgggaccatcggcattttctggtttctcctgtggatctggctagtctccgacacaccccagaagcataaacgcataagtcactacgagaaagagtacatactgtccagtcttagaaaccagttgagctcccagaaatctgttccttgggtacccatacttaagtccctgccactctgggctatcgtggttgctcactttagttacaattggacattttataccctccttacactgttgccaacttacatgaaggaaattctgaggtttaatgttcaggaaaatggcttcctgtctagcctgccctacctgggatcctggttatgcatgatcttaagcggacaggctgccgataacctgagagccaaatggaatttttccaccctctgtgttcggcgaatcttcagtctgatcgggatgatcggccctgccgtgtttctagtggccgccggatttataggatgtgattattcattggccgtcgcctttcttactataagcactacactcggcgggttttgtagcagtgggttctctatcaatcacttggacattgccccatcctatgccggaatcctcctggggatcacgaacaccttcgctacaataccgggcatggtgggaccggtgatcgcaaaatctctcactcctgacaacaccgtcggagagtggcagacggtcttttatatcgctgcggccattaatgtcttcggcgctatattcttcacactgtttgccaagggagaggtgcaaaactgggccttgaacgaccaccatggacacagacattag

SEQ ID NO: 205657 - DNA, 546 bp, Artificial Sequence
  Description of Artificial Sequence: Synthetic coding sequence
atgcggagccccgtgcgggacctggcccggaacgacggcgaggagtctacagatcgaaccccactgcttcctggtgcgccgagagccgaagccgctcccgtctgctgttcggccaggtataatctcgccatccttgctttctttgggtttttcattgtgtacgccctcagggttaatctttcagtcgcactggtggatatggtggattctaacaccactctagaagacaaccgcacttctaaagcatgccctgagcatagcgcccccatcaaggtccatcacaatcagactggcaaaaagtaccagtgggatgctgagacacagggatggatcttgggaagcttcttctacggctacatcattacccagattcccggaggctatgtagcatcaaaaatagggggcaagatgctgctgggctttggtattttaggaaccgctgtgttaacattgttcacccctatcgccgccgatctcggcgtggggccacttatcgtccttagagctctggaagggcttggcgaggaacattccctgggacagtag

SEQ ID NO: 205658 - DNA, 1404 bp, Artificial Sequence
  Description of Artificial Sequence: Synthetic coding sequence
atgcagatggacaaccggctgccccccaagaaggtgcccggcttctgcagttttagatatggtctgagcttcctggtgcattgttgtaacgtgataattacagcacagagagcatgcctcaatttgaccatggtcgtgatggtgaactccactgacccacacggcttgccaaacacatcgaccaaaaagttactggacaacatcaaaaaccccatgtacaactggtcccctgacattcagggaatcatcctgagtagtacatcttacggcgtaatcattattcaggtgccagtcgggtacttttccgggatatacagtactaagaagatgatcggcttcgcattgtgtttatcatccgtgctctcactgctgatccccccggccgctgggatcggtgtcgcctgggttgtcgtgtgtagagccgtgcaaggcgcagcacaaggaatcgtcgctactgcccaatttgagatttacgttaagtgggctccacctctggagagagggcggttaaccagcatgtctacttctggattcctgttggggccatttatcgtgctgcttgtgactggcgtgatctgtgaaagcttaggatggcctatggtattttacattttcggagcttgcggatgcgccgtctgtctgctatggtttgtcctgttctatgacgaccccaaggaccatccatgtattagcatcagtgagaaggaatacatcacctcttccctcgtacaacaagtttcaagcagtcgacagagcctgcccatcaaggcaatccttaagtccctgcccgtgtgggccattagtactggatcgttcacattcttttggtctcataatataatgactctctacacccctatgttcattaacagcatgttgcatgtaaatattaaagagaatggcttcctgagttctctcccttacctgttcgcatggatttgtggaaatctggcaggccaactttctgatttttttctgacacggaacatcctgtctgttatcgccgtgagaaaattatttacggctgctggtttccttcttccggcaatctttggggtgtgcctaccctatctgagttcaaccttctattccatcgtgatttttctgattctcgcaggcgccaccggttctttttgcctgggaggggtgtttatcaatggactcgacatcgcacccaggtacttcggctttatcaaagcatgcagcacgcttactggcatgatcggcggtctgatcgctagcacattaaccgggctgatcttaaagcaggatcccgaatccgcctggtttaaaacctttatactcatggccgcaatcaatgtcacaggcctaatcttctacctcattgtggctaccgcagagattcaagattgggcaaaggagaagcagcacactcgcctctag

SEQ ID NO: 205659 - DNA, 630 bp, Artificial Sequence
  Description of Artificial Sequence: Synthetic coding sequence
atgcagatggacaaccggctgccccccaagaaggtgcccggcttctgcagtttccgatacgggttgtccttcctggtccattgctgcaatgtgattatcaccgctcagagggcgtgtctgaacttgacgatggtagtgatggtgaactccacagatccacatgggctcccgaacacatctacaaaaaaactactcgataatattaagaaccccatgtataactggagcccagacattcagggaatcattttgtccagtaccagttatggtgtgatcatcatacaggtccctgtcggctacttcagtggcatatattcgactaaaaagatgatcggcttcgctctgtgtctgtcttcagtgttaagcctactgatccccccagctgccggtattggggtagcgtgggttgtggtctgcagagctgttcagggcgccgcccagggaatcgttgccacggcccaattcgagatttatgtcaagtgggcccccccgctggagcggggaagactgacatctatgtcaacctccgggtttctgttaggtccgttcatcgtgctactggtaacaggcgttatttgcgagtctctcggatggccgatggtattttatatcttcggtcagttcaaatag

SEQ ID NO: 205660 - DNA, 1242 bp, Artificial Sequence
  Description of Artificial Sequence: Synthetic coding sequence
atgcagatggacaaccggctgccccccaagaaggtgcccggcttctgttccttcagatatggccttagtttcctggttcattgttgcaatgtgatcattactgcacagcgggcatgcttgaatctgaccatggttgtgatggtgaatagcacagaccctcacgggctcccaaacacctccacgaaaaaactgctggacaacattaaaaaccccatgtataattggagtcctgatatacagggtatcattctcagttccacatcatacggtgtaatcattattcaggtgcccgtcgggtattttagtggaatatattcaacgaagaagatgatcgggttcgccttgtgtctatccagcgttctttccctgttgattcctccagctgcagggatcggagtcgcctgggtagtcgtgtgtagagccgtacagggtgcagcgcaaggcattgtcgccaccgcccagttcgagatctacgtcaaatgggcaccacctttggagcggggtcgactgacatctatgagtacctctgggtttctgcttggaccattcatcgtgctgttggtgactggagttatttgtgagagccttggttggccgatggtattttacattttcggcgcttgtggctgtgctgtgtgtctcctctggttcgtgctcttctacgacgatcccaaggaccatccttgcatcagcatctccgagaaggagtacatcacgagctccctcgtacagcagaatggctttctgtccagcctgccttacttatttgcctggatttgcggcaacctagctgggcagctgagcgactttttcttgaccagaaatattctgagcgtgattgctgtgagaaaattatttaccgcagcgggcttcctgttgccagctatctttggggtttgtctcccatacctatcttcaacattttacagtatcgtcattttcttgatcctggccggcgccacgggaagcttttgcttaggcggcgttttcattaacggcctggatattgctccccgatacttcggctttataaaggcctgctcgaccctgacaggaatgatcggagggctaatcgcatccacattgactggtcttatcctgaagcaggatcctgaatctgcgtggttcaagactttcattttgatggccgccatcaatgtcacgggacttattttctacctgatagtggccaccgctgagatacaggattgggccaaagagaagcagcacacgcgtttgtag

SEQ ID NO: 205661 - DNA, 1242 bp, Artificial Sequence
  Description of Artificial Sequence: Synthetic coding sequence
atgcagatggacaaccggctgccccccaagaaggtgcccggcttctgctccttcaggtacggtttgtcatttctcgtacactgttgtaatgtcattataaccgcacagcgggcctgcctcaacctgacgatggtggtgatggttaactccacggaccctcacgggttacctaacacctctacgaaaaagttactggacaacattaaaaacccaatgtacaattggagccccgacatccagggcattatcctcagctctacttcctacggggtcataatcattcaagtgcccgtaggctattttagcggcatttactccacgaagaagatgatcggcttcgccctgtgcctgtcctccgtgctgagcctcctgatcccgcccgccgctggcattggagtggcatgggtagtggtatgccgcgccgtacaaggtgcagctcagggaattgtcgctacagcacagtttgagatctacgtgaagtgggccccgcctctagagagaggcagactgactagcatgtctacttccggattcctgctcggcccgtttattgtgcttctagtgacgggggtgatttgcgaaagtttagggtggcctatggtgttctatatttttggagcgtgcgggtgtgccgtgtgtctcttatggttcgtcttgttctacgatgatcctaaggatcacccctgtatctcgattagcgagaaagaatatattacatcgagtttagtgcagcagaatggctttcttagctccctgccttacctattcgcctggatttgtgggaatctggcgggccagttgtccgactttttcctcactaggaatatattgtcagtcatcgcagtacgcaagctatttaccgccgctggcttcttgctcccagcaatatttggggtttgtctgccttacctgtccagcacattctattccatcgtaatattcctgattcttgccggagccacaggatcattttgtctcggaggcgtttttattaacggactcgacattgctccccggtacttcggtttcataaaggcttgttcaactctcacgggcatgattgggggccttattgcaagtacgctaactggactgatcctcaaacaggaccctgaatccgcttggtttaagaccttcattcttatggcagccattaacgtgactggcttgattttctacctgattgtggccactgccgagatacaggattgggcaaaggaaaagcagcatacccggctgtag

SEQ ID NO: 205662 - DNA, 1404 bp, Artificial Sequence
  Description of Artificial Sequence: Synthetic coding sequence
atgcagatggacaaccggctgccccccaagaaggtgcccggcttctgctccttcaggtatggtctgtctttcttggtgcactgttgcaatgtgatcatcacagcccagagagcctgcctgaacctcaccatggtcgtaatggtcaacagcacggacccacacggtcttcccaacactagtactaaaaaactcctggacaacataaagaacccaatgtataattggtctccagacattcagggcatcattttatcgagtacctcttacggcgtgattattattcaggtgcccgtcggttatttttccggcatttactccaccaagaagatgattgggttcgccctatgtttatctagcgtcctgtctttattgattccccccgccgccggtattggcgttgcctgggtggtggtctgtagggcagtgcagggagcggcgcagggcatcgtggccacagcacaatttgaaatttacgtcaagtgggcccctcctctagagaggggacgcctgacaagtatgagcacatctggttttttgttagggccattcatagtactgttagtgacaggagtgatttgtgagtccctgggttggccaatggtgttttatatattcggagcatgcggttgcgccgtgtgtctactgtggttcgtgctgttctacgatgacccgaaggaccatccatgcatcagcattagcgagaaggaatacatcacctctagtctggttcaacaggtctctagctcccggcaatccctcccaataaaggcaattctgaagagcctgccagtttgggcgatttccacaggcagcttcacctttttttggagtcacaatataatgactttgtacacacccatgttcatcaactccatgttacacgtgaatataaaggagaatggttttctctcttctcttccttatctgttcgcgtggatttgcgggaacctcgcgggccagctatccgattttttcctgacaagaaatatcctgtccgtaatagcggtcagaaagctcttcacggcagcaggcttcctgctccctgccatttttggcgtgtgtctcccctatctgagctcaactttttacagtatcgtgattttcctcattctggccggggccaccggatccttttgtctgggtggagtctttatcaacggtctggatatcgctcccagatactttggcttcatcaaggcttgcagcaccctgactggcatgatcggcggccttatcgcctcaaccttaaccgggttgattcttaagcaagacccagagtccgcctggttcaagacgtttattttaatggccgccattaatgttacgggtcttatattttatctcattgtggccacagccgagatccaggactgggcgaaagagaaacagcacactagactgtag

SEQ ID NO: 205663 - DNA, 1320 bp, Artificial Sequence
  Description of Artificial Sequence: Synthetic coding sequence
atggacggcaagcccgccacccggaagggccccgacttctgcagcctgcggtacgggttggccttgattatgcactttagcaattttaccatgattactcagcgcgttagcctatcaattgctatcattgccatggtgaatacaacccaacagcagggcctgagcaacgcctcgaccgaagggcctgtggcggacgcctttaacaactccagtattagcattaaagagtttgacacaaaggcctctgtttatcagtggtctccagaaacccagggcatcattttctctagtatcaattatggtatcattctgaccctcatcccctcagggtacctagccggaatctttggagcaaaaaagatgcttggtgccggcctactcatttccagtctcctcacactctttacccccttggctgcagatttcggagtgatactggttatcatggtgcgcaccgtccaggggatggcacaggggatggcttggactggacagttcacaatctgggccaagtgggcccctcccttggagcgaagcaaactgacaaccatcgctggttctggctcagctttcggttccttcattattctctgtgtgggaggattgatttcccaggctctgtcatggccctttattttttatatcttcggctccacaggttgcgtgtgctgcctgctgtggtttactgtaatatacgatgaccctatgcatcacccgtgcatctccgtcagggagaaggagcatattcttagttctttggcgcaacagccctcaagcccagggagggcagtccctataaaagctatggtgacctgcctgcccctgtgggccattttccttggcttttttagccacttctggctatgcactatcatcttaacttacctgcccacctacatctctacattactgcacgtgaacatccgggatagtggagtgctgagtagtctgccgttcatcgctgccgcttcatgcacgattctgggcgggcagcttgctgatttcctgttgagccggaaccttctgcgcctcatcacagtgaggaaactgttttcttctctaggactgctgctgccatctatatgcgccgtggccctgccttttgtggccagctcatacgtcattaccattatcctgctgatcctcatcccaggtactagtaacctttgcgattcagggtttataattaataccctagatatcgcaccacgttacgcttccttcctcatgggaatcagccgtgggtttggactgattgctggcattattagttcaacagcaaccgggtttcttataagtcaggtcggcccagtttactag

SEQ ID NO: 205664 - DNA, 1311 bp, Artificial Sequence
  Description of Artificial Sequence: Synthetic coding sequence
atggacggcaagcccgccacccggaagggccccgacttctgcagcttgcgctacgggctagccctaattatgcatttctcgaattttacaatgataacacagcgcgtaagtctgagcatcgcaataattgccatggtgaatacaacccaacagcagggtttatcaaatgccagtaccgaaggaccggtcgcggatgcatttaataattccagcataagcattaaggaattcgacacaaaggcctccgtgtatcagtggagccccgaaacccaaggcattatcttctctagcatcaattacggcattattctcactctgattccatccgggtatctcgccggcatcttcggtgcaaagaaaatgcttggcgccgggctgctgataagcagcttactgacgctctttacaccactggctgccgatttcggagttatcctggtgatcatggtgagaactgtacaaggcatggctcagggaatggcctggacaggacagtttactatctgggccaagtgggcgcctcccctcgagagatccaagcttacaacgattgcgggctcaggaagcgcttttgggtcattcattatactttgcgtagggggactcattagccaggcgctgtcctggcctttcatcttctatatcttcggcagcacagggtgcgtctgttgcctgttgtggttcactgtgatctatgacgaccccatgcatcatccatgcattagtgtgcgcgagaaggagcatatccttagttcactcgctcagcagccctcctctcccgggcgcgccgtccccattaaagcaatggtgacatgcctgcccctctgggccattttcctggggtttttcagccacttttggctctgcacaatcatcttgacttatctgcctacgtacatctcgactctcctgcatgttaatattcgcgatagcggtgtcctcagttccctcccttttattgccgctgcatcatgtacaatcctgggcggacagctcgcagactttctgctgagtagaaatctgctgaggctcatcaccgtcaggaaattattctctagcctagacatgcaagtatctagctgggaatcccaaggagacctgggatctagccaggaaagtagtctgccactgccgctggactcatctagtgtcagaattctgagcttagtcggtggtatgtccttctcttgcttacttcagtccacatgcctggcttggagctttactagtaggcttgataagcaaaacttcaagactggacccaaaagagggccactaccagcgagcgaggacataaaactgcaaacttag

SEQ ID NO: 205665 - DNA, 1437 bp, Artificial Sequence
  Description of Artificial Sequence: Synthetic coding sequence
atggacggcaagcccgccacccggaagggccccgacttctgcagcctgcgctacggcctagctttaattatgcatttttccaactttacaatgataacccagagggtctcgttgtctatcgccatcattgctatggtgaataccacacagcaacaagggcttagcaacgcaagcaccgaggggccagttgccgacgcttttaacaactcttctatctctataaaagaatttgacacaaaggcgagtgtttaccagtggagtcccgagacccaaggaatcatcttttctagcattaactacggcattatccttaccctcattccatcaggctacctggccggcatcttcggggccaagaaaatgctgggggctggccttctcatcagcagcttgctgacactgtttactcccttggccgctgactttggcgtgattctggttattatggttagaacagtacagggtatggcgcaggggatggcctggacagggcagttcacaatttgggccaagtgggcaccacctctcgagcgctccaagctcaccaccatcgccggttcggggtccgcatttggaagtttcatcatactgtgtgtgggagggctgatcagccaggcactgtcctggcctttcatattttatatctttggctctaccggctgtgtgtgctgtctgctgtggtttacagtaatctacgatgatccaatgcatcacccatgcataagtgtccgcgagaaagagcacatcttgagtagcttggcccagcagccttcatcacccggtcgggcagtgccaattaaggctatggtgacatgcctccccctgtgggccatctttctgggatttttctcccatttctggttatgcacaataatactgacatatctgccaacctacattagcactctgctccacgtgaatatcagagactcgggcgtgctgagcagcttaccctttatcgcggcagcctcatgcaccattctggggggacaacttgccgacttcctgctgagtcgcaacctgctacgattgatcacggtgcgcaaactgttcagcagcctgggcctgttacttccaagtatctgcgctgtggccctcccttttgttgcttcgagttacgtgatcaccatcatattattaatcctcatccctgggacgtcaaacctgtgtgactcaggttttattatcaataccctggatatcgcacctcgttatgccagcttcctgatgggaatctctcgtggttttggtcttattgcagggataataagctctaccgcaacagggttcctgatctctcaggacttcgaatccggatggaggaacgttttctttctgtctgcggctgtaaatatgtttggcttagttttttacctcacatttggacaagcggaactgcaggactgggctaaggagaggacattgaccagactttag

SEQ ID NO: 205666 - DNA, 1263 bp, Artificial Sequence
  Description of Artificial Sequence: Synthetic coding sequence
atggccaccaagaccgagctgagccccaccgcccgggagagcaagaatgcccaggacatgcaagtggacgaaactctgatcccccgcaaagtcccctcactatgcagcgctagatatgggatagccttggtcctccatttttgcaactttactaccatcgcacagaatgtcataatgaacatcacaatggtggctatggtgaattccacttcaccccagtcccaactgaacgatagttcagaggtactgcccgtcgattcgttcggcggactgtccaaagctcccaaatctttgccagctaaaagcagtatcctcgggggccagtttgcaatttgggaaaagtgggggcctccacaggagagaagccgactatgctcgattgctttaagtggcatgctgttggggtgtttcaccgccatactcattgggggattcattagcgaaacactgggatggcctttcgtgttctatatctttggaggtgtgggctgcgtgtgttgtctgctgtggttcgtggtgatttatgatgaccctgttagctacccatggatatccacgagcgaaaaagagtacattatctcctctctgaaacaacaagttggttcatccaagcagcccctgcctataaaagccatgctgaggagcttgcccatatggagcatatgtctgggctgtttctcacaccaatggttggtctcaacaatggtagtatatatccccacatatatttcatcggtttaccacgtcaatatcagggacaacgggctgcttagcgccctgcccttcattgtcgcctgggttatcggaatggtgggcggctacctggctgactttttgctgacaaaaaaattcaggcttattacagtccgtaaaatcgctactattttgggctccctcccatcttcagccctgattgtctccttaccctatcttaactcaggctacatcacagccactgccctcctgaccctgagctgtggtttatctacattatgtcaatccggcatctacattaatgtgctggacatagcccccaggtattcttcttttctcatgggcgcctctcgtgggttttcctccatcgcccccgtcattgtccctaccgtctcaggatttctactcagtcaggaccccgaattcggttggcggaatgtattttttttactgttcgctgtgaacctgttgggtttgctcttttatctcatcttcggagaggctgacgttcaggagtgggcaaaagagcgaaagctgactcggttgtag

SEQ ID NO: 205667 - DNA, 1263 bp, Artificial Sequence
  Description of Artificial Sequence: Synthetic coding sequence
atggccaccaagaccgagctgagccccaccgcccgggagagcaagaacgcgcaggacatgcaggtggacgagaccctgatccccaggaaagtaccctccctgtgttcagcccggtatggcatcgcactggtcctccacttctgtaattttaccacaattgcacagaacgtcatcatgaacatcacaatggtcgctatggtgaattctacttccccgcaaagtcaactcaacgacagttctgaggtgttgcccgtcgactcattcggagggctgagtaaggcgcccaaatcacttcccgctaaatcctcgattttgggcgggcagttcgctatctgggagaagtgggggcctcctcaagagaggtcccgcctctgttccatcgccctgtcgggtatgttgctcggatgcttcactgccatcttaataggaggttttattagtgagacactgggttggcccttcgtgttttatatttttgggggcgtcggctgtgtgtgctgtctcctctggtttgtggtcatctacgacgacccggtgtcttatccatggatctccactagtgagaaggaatatattatatcatctctgaaacagcaggtgggttcaagcaagcagccactgccgatcaaggccatgcttcggagtctgccaatctggtcaatatgcctgggttgcttttcccaccagtggctggtgtccaccatggtggtgtatattcctacctacatttccagtgtataccatgtcaacataagagataacgggctcctgtccgctctgccctttatcgtcgcatgggtaataggtatggtgggcggatatctggcggatttccttctgaccaaaaaattccgcttaattactgttaggaagatagctacaatcctaggcagcctcccctcttctgcactgatagtttcacttccctacctgaacagcggatacattacagcaaccgccctgctgaccctgtcctgtgggctgtctaccctctgtcagtcaggcatttatattaatgtcctagacatcgccccccggtattcgagctttttaatgggagcatctagaggctttagtagtattgcacccgttattgtgccaaccgtgagcggattcctgttgagccaggaccctgaatttggttggcgcaacgtgttcttcctgctgtttgccgtgaatctattagggctccttttttatctgatattcggggaagcagacgtccaggagtgggctaaagaacggaagctcaccagactctag

SEQ ID NO: 205668 - DNA, 1497 bp, Artificial Sequence
  Description of Artificial Sequence: Synthetic coding sequence
atggccaccaagaccgagctgagccccaccgcccgggagagcaagaacgcccaagacatgcaggttgatgagactcttatacctagaaaggtaccaagtctgtgcagtgccaggtatggaattgccctggtgctacatttttgtaattttactactattgctcagaacgttatcatgaacataacaatggttgcgatggtgaactcaacatcaccacagagtcagttaaacgactcctccgaagtactgccagtagatagctttggtgggctttccaaggcacctaaatcgctgcccgccaaggccccagtgtacgattggtcgccccaaatccagggaatcatcttcggagccgtgggatacggggggatactaaccatggccccatctggctacctggccggcagagtcggtaccaagcgcgtagtgggtatcagcttgtttgccacttcatttcttacattatgcattcctctagcgacagattttggaattgtcctgctcatcgtgacccgaatagtccagggactgtcacagagctctatcctgggggggcagtttgcaatctgggagaagtggggaccacctcaggagagatcacggctgtgcagcatcgcactgtcaggaatgctcttgggttgcttcacagccatccttattggtgggtttataagcgagactttaggctggcccttcgttttttatatctttggaggggtcgggtgtgtctgctgccttctctggttcgtggttatctacgatgaccctgtgtcttacccctggatatctacatccgagaaggagtacatcatcagtagcctgaaacagcaagtcggaagtagcaaacagcctctccccattaaggctatgttacggagccttcctatttggagcatttgccttggctgtttttcacatcagtggctcgtcagcaccatggtggtctatattcccacatatattagttcagtttaccacgtcaacattagagataatggattgctttcagctctgccttttatcgtcgcctgggttattggcatggtgggcgggtatcttgccgactttttgcttacaaaaaagttcaggctaataacagtgcgaaaaattgcgaccatcctgggctcccttcctagctcagcccttatcgtgtctctcccttatctgaacagtggctatatcactgcaactgcactcctcactctgtcctgtggactttctaccctttgccaatcaggaatatatatcaacgtccttgatatagcaccaaggtacagttcttttcttatgggggcctcacgggggttttcctccatcgcccctgttattgttcccaccgtgtcagggttcctattgtcacaggacccagagttcggatggaggaacgtcttcttcctgttgttcgccgtgaacttgctgggactgctgttctatttaatttttggtgaggcggatgtgcaggagtgggcgaaagaacgtaaacttacacgcctgtag

SEQ ID NO: 205669 - DNA, 300 bp, Artificial Sequence
  Description of Artificial Sequence: Synthetic coding sequence
tgaaccctgagctgcggcctgagcaccctgtgccagagcggcatctacataaacgtcttagacattgcccctaggtatagttcctttctaatgggtgcaagtagaggattcagctccatcgccccagtgattgtccctaccgtgtctggtttcttgctgagccaggatcctgaatttggatggcgcaatgtatttttcttgctgttcgccgtcaacttattggggctgctgttctaccttatatttggggaagccgatgttcaggagtgggcaaaagaacgcaaactgacaaggttgtag

SEQ ID NO: 205670 - DNA, 156 bp, Artificial Sequence
  Description of Artificial Sequence: Synthetic coding sequence
agcggcttcctgctgagccaggaccccgagttcggctggcggaacgtgtttttcctgttgtttgctgtaaatttgctggggctcctgttttacctcatatttggcgaggccgatgtgcaggagtgggccaaggagaggaagctgaccagactttag

SEQ ID NO: 205671 - DNA, 1494 bp, Artificial Sequence
  Description of Artificial Sequence: Synthetic coding sequence
atgagcaccggccccgacgtgaaggccaccgtgggcgacatcagctctgacggaaacctgaatgtcgctcaggaggagtgttcccgtaagggattttgttccgtccggcatggcctcgccttgatcctacaactgtgtaactttagcatctacactcagcagatgaatctgtctattgccattcctgccatggtgaataacaccgctccaccttcacagccaaatgctagtactgagcggccctcaactgacagccagggctactggaacgaaacacttaaagagttcaaggcgatggcaccagcctacgattggtcccccgaaatccaagggattatactcagctctcttaattacggctcttttctggcacccattccatctggctacgtggcaggaatcttcggcgccaagtacgtcgtgggcgcagggctctttatcagtagctttcttaccctgttcattccccttgcagctaacgccggcgtggccctcttgattgtacttcgaatcgtgcaggggatcgcccaggtaatggttttgaccggccaatattcgatttgggtaaaatgggccccgcccctcgaacggtcacagctgaccactattgctgggagcgggtccatgctcgggagttttattgttttgctcgccggggggttgttgtgtcaaactattggttggccctacgttttctatatcttcggaggaattggttgcgcctgctgtcccctgtggtttccactaatctacgatgacccggtaaaccaccctttcatctcagccggcgaaaaaaggtatattgtgtgtagcttagcccaacaggattgttcccctggctggagcctgccgatacgggccatgatcaaatccttgcccctgtgggccatactggtctcctacttttgcgagtactggctattctatacaattatggcttacacacctacgtacatttctagcgtgctgcaggcgaatcttagggactcaggtatcctcagcgccttgcctttcgtcgtcggctgcatctgtattatcctgggtggactgcttgcggactttttactgtcccgcaagatcttacggttgattacaatccgtaagctgttcacagccatcggcgtgctgttcccatccgtcatcctggtgtcattgccctgggttcggtcatcacattccatgacaatgactttcctggtgctcagtagcgcaataagctccttttgtgaatcaggcgcgctggtgaacttccttgatatagctccacggtacactgggttccttaaggggttgctgcaggtcttcgcccacatcgcgggggctatttcaccaacagctgccggcttctttatctctcaagacagtgaatttggttggcgcaatgtgttcctactttccgctgctgtcaatatcagcggcttggtcttctacctcatatttggtagagccgatgttcaggactgggccaaggagcagacctttacccacctgtag

SEQ ID NO: 205672 - DNA, 666 bp, Artificial Sequence
  Description of Artificial Sequence: Synthetic coding sequence
atgaacctgagcatcgccatccccgccatggtgaacaacaccgcccccccgtcccagcccaatgcttctacggaacgtccatccactgactctcaaggatactggaatgaaaccttaaaggaattcaaagccatggattgctcaccagggtggagccttccaatcagggcaatgattaagagcctgccgttgtgggcaatcctggtaagctatttctgcgagtattggcttttctacacaattatggcttacacccccacatatatttctagtgtcctgcaagccaacttacgcgacagcggcattttgagtgcactgccattcgttgtcgggtgcatctgcataatcctgggtggcttactagcggattttctgctgagtagaaagatccttcgcctcattaccatccgcaagttgttcaccgctattggcaagggggagaccggccacaggggagaacgaggtaagttgagagcagccttttcactcctgtgcgtgtgccccccaacccctggagtgctctttccatccgtgattttggtatccctaccatgggtacggtcttcccattctatgacgatgacctttcttgtactgagtagtgcaattagcagcttctgcgagtccggggcgctggtgaattttctagacattgcaccccggtag

SEQ ID NO: 205673 - DNA, 804 bp, Artificial Sequence
  Description of Artificial Sequence: Synthetic coding sequence
atgagcaccggccccgacgtgaaggccaccgtgggcgacatcagctcagatggcaatctcaatgtggcccaggaggagtgcagtcgcaagggtttctgcagtgtgcggcatggcttggcgctgatcctacagctttgtaatttctcaatctatacccaacagatgaatctttccatcgccatcccggcaatggttaacaacaccgccccccccagccagccgaacgcctctacggagaggcccagtacggactcccagggctactggaatgaaacactcaaagaatttaaagctatgtcggggatcctctccgcccttccttttgtggtggggtgcatttgcattatcttgggagggctgcttgccgacttcttgctcagccgaaagatcctgaggttgattacgatcaggaagctgtttactgctatcggtgtgctgttcccatctgtcattttggtttcactgccttgggtgagaagctcacatagtatgacgatgactttcctggtattgagctccgcaatttcaagcttctgcgaaagcggcgccttagtgaactttctcgacatcgcaccacgatacaccggctttctgaagggtctgctgcaggtctttgcccacatcgcaggagccatatcccccaccgccgccgggttctttatatcgcaggattccgaatttggctggcgcaatgtgttcctgctgagtgccgcggtcaatatcagtggcctcgttttctatcttattttcggccgcgctgatgttcaggactgggctaaagagcaaacctttacccacttgtag

SEQ ID NO: 205674 - DNA, 1749 bp, Artificial Sequence
  Description of Artificial Sequence: Synthetic coding sequence
atggagagcgtgaagcagcggatcctggcccccggcaaggagggcttgaagaatttcgcaggaaagagcctcggccagatctacagagtcttggaaaagaagcaggacaccggagagaccatcgagttaacagaagacggaaagccacttgaggtcccggagaggaaagcaccactgtgtgactgtacctgcttcggtttgccgcggcggtacattatcgccattatgagcggtctgggtttttgcatcagctttggtattaggtgtaatttaggggtagctatcgtcgatatggtcaataactctactatacacaggggcggtaaggtgataaaggaaaaggccaaatttaactgggacccagagactgtgggaatgatccatgggagttttttctggggatatattattacccagatccctggcggttacattgcgagtagattggccgccaaccgggtttttggtgccgccatccttcttacctcaactctgaacatgctcattccgtctgccgccagagtgcactatggctgcgtaatcttcgtgaggatcctccagggtctagttgagggcgttacttacccagcatgtcacggcatctggagcaagtgggcccccccattagagcgcagcagactcgctaccacttctttttgtggcagctacgccggcgccgtgatcgccatgcccctcgccgggatccttgtccaatacacaggttggtcaagcgtgttctacgtgtatggctccttcgggatggtgtggtatatgttttggctgctagtctcttatgaatctccggccaagcatccaaccatcaccgacgaggagcggagatacattgaggagtcaatcggtgaatccgctaatctactgggagctatggagaaatttaaaaccccctggcgcaaattctttacatctatgcctgtgtacgcaatcatcgtggccaacttctgcagatcctggactttctacctgctgctgatttcacagcccgcctactttgaagaggtttttgggtttgagatctccaaggtgggaatgttatctgctgtgcctcacctggtgatgaccatcattgttcccattgggggccagatcgccgatttccttcggagcaagcagattttgtcaacaactacagttcgcaagatcatgaattgcggcggcttcggaatggaggccacactcctgttagtggtgggttacagccacacacgtggtgtggccatcagctttctggtgctggcggtcggattctctgggtttgccatatcgggtttcaacgtcaaccatctggacatcgcccctcgatatgcgtctatcttgatgggcattagtaatggtgttgggaccctgagcgggatggtctgtccaattatcgtgggtgctatgacaaaaaataaatccagggaagagtggcagtatgtatttctgattgcagccctcgtccactatggaggtgtgatcttttacgcgatctttgcgagtggggaaaagcagccttgggccgatcccgaagagacatcagaggagaaatgcggattcattcacgaagatgagctggacgaggagaccggggacatcacacaaaactacattaactatggaacgacaaaatcgtatggcgctaccacacaagccaacggcggctggccctccggatgggagaaaaaagaagaattcgtccaaggcgaggtccaggatagccactcttacaaggaccgagtcgattatagctag

SEQ ID NO: 205675 - DNA, 1413 bp, Artificial Sequence
  Description of Artificial Sequence: Synthetic coding sequence
atgaaggccaagttcaactgggaccccgagaccgtgggcatgatccacggcagtttcttctggggctatatcataacacagatacccggggggtacattgcatcccgccttgccgctaatagggttttcggagcggccattttactgacctcaaccctgaatatgcttatcccttcggcagcaagggtacattacgggtgtgtcatttttgtgcggattctgcaggggttggtagaaggggtcacctacccggcctgccatggcatatggtctaaatgggcccctcccctcgaacggagccgtctggccaccacctcattttgcgggtcgtatgccggagctgtgatcgcgatgcccctggctggtatcttggtgcagtacaccgggtggtcctcagtcttctacgtctatgggagttttgggatggtctggtacatgttttggctcctggtctcatacgagtcccctgccaagcatcccactattaccgacgaggagcgcagatacattgaagagagcattggcgaaagtgccaatctgctcggagctatggaaaaattcaaaacaccatggaggaaattcttcacttctatgccagtgtatgccattattgtggctaatttctgtaggagctggaccttttatctcctattgatctcacagccagcatatttcgaggaagtgtttggattcgagatcagcaaagtaggaatgcttagtgctgtcccacatttagtgatgactatcatcgtgccaatcggcggacagattgctgacttcctgagatctaagcagattctaagtactacgaccgtccgcaagattatgaactgcggaggcttcggtatggaagccacactgctcctggtcgtgggctactcgcatacacgcggggtagccattagctttctggtcttggcggtggggttcagtggatttgccatctccggcttcaacgtaaaccacctggacatcgcaccccggtatgcctccattctcatgggcattagtaacggtgtggggacattaagcggaatggtgtgtccgattatcgtaggcgctatgacaaagaacaaatctcgtgaggagtggcagtatgtcttcctgatcgccgccctggtccactacgggggagttatattttatgccatttttgcctctggtgagaagcagccttgggcggaccccgaggagacttctgaggaaaaatgcggatttattcacgaggacgaactagacgaggaaacgggagacataacccagaattatatcaactacggaacaaccaagtcctacggggccacgactcaagctaatggcgggtggccctccggctgggagaaaaaggaagaatttgtgcagggagaggttcaagactcccattcctacaaggaccgcgtagactattcatag

SEQ ID NO: 205676 - DNA, 5223 bp, Artificial Sequence
  Description of Artificial Sequence: Synthetic coding sequence
atgggcgagaagctggagctgcggctgaagagccccgtgggcgccgaacccgctgtgtatccctggccactgccagtgtacgacaagcaccacgacgcggcgcatgaaataatcgagactatccgctgggtgtgcgaggagattcccgatttgaaacttgccatggagaactacgtgctcatagattatgacaccaagtcatttgagagcatgcagcgactttgtgataagtataatcgggccattgacagcatccaccagctctggaagggaacaacgcagcctatgaaactcaacacccgaccctccaccgggttgctccggcatatcctccagcaggtgtacaaccactctgtaacagatcccgagaagctgaataattatgagccattctctcctgaggtgtacggggaaaccagtttcgacttggtcgctcagatgattgacgagattaagatgaccgatgatgatttgttcgtggacctggggtctggcgttggccaagtagtgcttcaagtcgccgctgccacaaattgcaagcatcattatggcgtggaaaaggccgacattccggccaaatacgcagaaactatggacagggaatttaggaagtggatgaagtggtacggtaagaagcatgccgagtatactctggagcgaggagactttctgtcagaagagtggcgcgagaggatcgcaaatacctctgtaatatttgtgaacaattttgcattcggcccggaagtggatcatcagttaaaagaacgcttcgctaacatgaaggagggcggcaggattgtatccagcaagccttttgctcccctgaacttccgaatcaacagcagaaacctgtccgacatcggcaccattatgcgtgtggtagagctttcaccactgaaaggttccgtcagctggaccgggaagccagtctcttattatcttcacacaattgacaggaccatcctggagaactatttctcttccctgaaaaacccaaaactcagggaggagcaggaagccgccaggaggcgccaacagagagaatcaaaatccaatgcggccaccccaacgaagggccctgaaggaaaggtcgccggcccggccgacgcaccaatggactctggggcggaagaagagaaggctggggctgcaactgttaagaaaccaagtccaagcaaggccagaaaaaaaaagctcaataaaaaaggccggaagatggctggtcggaaacgcgggagacccaaaaaaatgaataccgccaaccccgaacgaaagcccaaaaagaatcagaccgccttggatgctttgcacgctcagaccgtgtctcagacggccgcttcatcgcctcaggacgcgtatagatcacctcactcgccgttttaccaattaccaccgagtgttcaaaggcacagccccaatcccttattagttgctccaactcctccagcattacagaaactcctggaaagcttcaagattcaatatttacagtttcttgcttacactaagactccgcaatacaaagccagcctgcaagaactgctgggtcaggagaaagaaaaaaacgcacagctgttgggggctgcacagcaactactctctcactgtcaagctcagaaagaggagatcaggcgactgttccagcaaaaactagatgagctgggggttaaagccctaacatataacgaccttattcaagcccaaaaagagatcagcgcccacaaccagcagcttagagaacagagtgaacagctggagcaagataaccgagccttgcgaggacagtccttgcagctgctgaaagctagatgtgaagagctccagctggactgggctaccctcagtttggaaaagctgctgaaagaaaagcaggccctgaagtctcagatttcagagaagcaacggcactgtcttgaactacagatatcgatcgtcgagctggaaaagtctcagcgccagcaggaattactccaactgaagagttgcgtccctccggacgatgccctctctttgcatctcagggggaagggagccctggggcgcgagcttgaacccgacgcctctcgcttgcatctagagttagattgtaccaaatttagccttccacacctatcctctatgtctcccgagttgagcatgaatgggcaggccgcgggttacgagttgtgtggagtcctgagccgaccttcctccaaacaaaatacaccacagtacctggccagccccctcgatcaggaggttgtgccttgcaccccgtcccacgtaggccgaccaagacttgagaagctctcaggcctggccgcccctgattatacccgcctgagccctgctaagattgtgttgaggaggcacctttctcaggaccatacagtccccgggaggccagcagccagcgaactgcatagccgagccgagcacacaaaagagaatggtctcccatatcagagtccctccgtgcccggctccatgaaattgagcccccaggacccaaggcccttgagtcccggagctctgcagctggcgggcgaaaagtctagcgagaaaggactgcgtgagcgcgcatacgggtcctccggggaacttattacttccttaccaatatccattccgctgtctacagtgcagccaaataagctcccagtgtcaatcccccttgcttcagtagtgctaccaagtcgggccgaacgggctcggtcgactcccagcccagtgttgcagccacgagatcctagctctactctcgaaaagcagatcggagccaatgcacatggtgccggttcacgctcactggctctggccccagcgggattttcgtacgctgggtccgtggccatatccggagctctggctggcagtcccgcatctttaaccccaggcgctgagccggcaactctggacgaatcctcctcctctggcagtctgttcgcaaccgtgggttctcggagtagtaccccccagcatccactgctgctggctcagccacgaaattcgcttcccgccagccctgcccaccaattgtcctcaagcccacgtctgggtggcgcagcgcagggacccttaccagaagcgagcaagggcgatctgccttctgactcaggcttctccgaccctgaatccgaagccaaacgccggatcgttttcactatcaccaccggagcaggcagcgccaagcaatcacctagtagcaagcacagcccgctcacagcctccgcgagaggagattgcgtccctagccatggacaggacagtcgtcgtcgcggcagaagaaaacgagctagcgccggtacgccatcactgagcgccggcgtttctcctaaaaggcgcgcccttccttctgtcgcaggcctgttcacacagccctcgggaagccctctcaacctgaactcgatggtctcaaatattaaccaacctctcgaaatcaccgccatctcaagtcctgaaacctccctgaaatcatcccccgtgccgtaccaagaccacgatcagccgcccgtcctcaagaaagaacgccccctctcgcagacaaatggagcccattactcccccctgacatctgacgaggaacccggctcggaggatgagccctcgtcagcaaggattgagaggaaaatagctacaatctcactcgaatcaaaatcccctccgaaaaccctcgaaaatggtgggggactcgcgggcaggaaacccgcccccgctggggagcccgtgaattcctctaaatggaagagcaccttttctcccatctccgatattggtctcgccaaaagcgcggacagtccattgcaggccagctccgcgctatcacagaacagtctgttcacatttaggcccgctctcgaagagccttctgcggacgccaaattggccgcccaccctcgcaagggatttccaggatctctgagtggggcagacggtttgagtcctggcaccaaccctgcaaacggctgcactttcggcggagggcttgcagcagatttgtcacttcacagtttctcagacggggcgagcctgccccacaaggggccagaggctgccggactcagttcaccattgtcttttccgtcacagagggggaaagagggatccgatgcgaacccattcttgtcaaagagacagctggacggactggctggccttaagggagaagggtcgcgaggcaaagaggccggtgagggtggactccccctgtgtgggccaacagataagacccctctcctaagcggcaaagccgccaaggcgcgggacagagaggtggatctcaagaatggccataatctgtttatttccgctgccgccgtgcctcccggttccctcctgtcaggcccgggtctggcccctgccgcctcctccgctgggggagcagcttcctccgcacagacacatcgcagcttccttgggccctttccaccagggcctcagttcgccttagggccgatgtccctgcaggcaaacttaggtagtgtcgcagggagcagcgtgctccagtctctgttttcaagcgtgccggccgccgccggtcttgtgcacgttagcagcgccgctacccgccttaccaactctcatgctatggggagtttttccggtgttgcgggcggtacagtgggagccgggggcgtgttcaatcatgctgtcccttccgccagcgctcacccctttggcgcgcgggtgggtcggggcgctgcctgcggctccgcaaccctaggcccttcccctctgcaggcagccgctagtgcctccgctagttctttccaggctcccgcaagtgtcgagacgcggcctccgcctcctccacctcctccaccccctccactgccacctccagcccacctgggaaggtctcccgcgggcccgcctgtccttcacgccccccctccccccaatgctgccctgccccctcctccaacactgctggcctcaaaccccgaacccgcattgctccaatcactggcctcactcccccctaaccaagccttcctcccacccacaagcgccgcatccctccccccggcaaacgcctccctttccatcaagcttactagcctcccgcacaaaggcgctcgaccatcgtttacagtacaccatcagcccctgccccgactggcccttgcccaggctgcccctgggatcccccaggcatccgctacgggccccagtgcagtgtgggtgtccctcggaatgccgcccccttacgccgctcatttatccggagtgaaacctagatag

SEQ ID NO: 205677 - DNA, 1647 bp, Artificial Sequence
  Description of Artificial Sequence: Synthetic coding sequence
atgggcagccagctggccctggccggcctgctggagaagcggcaggaaggggcggagacccttgaactgagcgctgatggccggcccgtaaccacacaaactagggaccctcccgtggtcgactgtacgtgtttcgggctgccacggcggtatatcattgcgatcatgtctggtctgggtttttgcattagcttcggcattcgctgtaatcttggcgtggccatcgtgagtatggtgaacaatagtaccactcatcgcggtggccacgtcgttgtccaaaaggcccaattttcgtgggacccggaaaccgtggggctcattcacggaagttttttttggggatatattgttactcagattcctgggggttttatctgtcaaaaattcgccgccaatcgagtatttggcttcgccatagtagccacgagtactctgaacatgcttattccaagcgccgctcgggtgcattacggctgcgtgattttcgttagaattctccagggcctagtggagggcgtcacctatcctgcttgccacggcatctggtctaaatgggctccacccctggaaaggtccagacttgcaacaactgccttttgcggcagctacgcgggtgccgtcgttgctatgccactcgcaggagtgctggtgcaatatagcggatggagtagcgtgttttatgtgtacggaagcttcggcattttctggtatctgttctggttactggttagctatgaaagccccgccctccacccatcgattagcgaggaggagcggaagtatatcgaagatgcaatcggggaatccgcaaagctaatgaaccctttaacaaagttctcaacaccctggaggcgattctttacgtccatgcctgtatacgcaatcatcgtggcgaatttctgtaggtcttggaccttctatttgcttttaatttctcagccagcctattttgaagaggtctttggatttgagatcagcaaggtgggtctagtttccgctctgcctcatttagtcatgaccatcattgttcccattggcggtcagatcgccgacttccttcgctcccggcggatcatgtcgaccactaacgtgcggaagttgatgaactgtgggggatttgggatggaggcaaccttactgctcgtcgtgggctactctcacagcaaaggggtggccatctcttttctggttctcgcagtcggatttagcggcttcgccatcagcggattcaacgttaaccacctggatatagctcctaggtacgcctcaatcttaatgggtattagcaacggagtggggacattgagcggaatggtctgcccaattattgtgggggccatgacgaagcataagacacgcgaagaatggcagtatgtctttctgatcgcttctctcgtccattatggtggagtgatcttctacggggtattcgcctcaggtgaaaagcagccctgggccgaaccggaggagatgagtgaagagaaatgtggcttcgttgggcacgaccaattggcaggatccgacgacagcgagatggaggacgaggcggagccacctggcgctccaccggcaccaccaccgtcttatggcgcaactcacagcacattccaacctcctaggccacccccccccgtgagagactattag

SEQ ID NO: 205678 - DNA, 1770 bp, Artificial Sequence
  Description of Artificial Sequence: Synthetic coding sequence
atgcccttcaaggccttcgacaccttcaaggagaagatcctgaagccaggcaaggaaggcgtgaagaacgcagttggcgattcactcggcatactccagcggaagattgacggcaccaccgaggaagaagacaacattgagttaaatgaggagggccgacccgtgcagaccagtagaccaagcccccctctgtgcgactgtcactgctgtggtctgcctaaaaggtacatcatcgccattatgagcggcttggggttctgtatcagctttgggataagatgtaatctgggagtcgctatagtggagatggtgaataactcaactgtttacgtcgatggcaagcccgagatccaaaccgcgcaattcaactgggaccccgaaaccgtgggcctaattcacggctccttcttttgggggtacatcatgactcagatccccgggggatttatcagcaacaagtttgctgctaacagggtcttcggcgcagcaatctttctcacttcaacactgaatatgttcatcccttctgctgcacgcgtgcattacgggtgcgtgatgtgcgtcagaatccttcagggtctggtagagggagtgacctatcctgcatgtcacgggatgtggagtaaatgggcaccgcctctggagaggtccaggcttgctacaacttcattttgcgggtcatacgcaggcgccgtggtagcaatgccccttgcaggcgtacttgtccagtacatagggtggtcatcagttttttatatatacgggatgttcggaattatttggtatatgttttggctgttgcaggcttatgagtgccctgcagcccatcccactattagcaacgaagagaagacatacattgagacctccatcggagaaggcgcaaacgtagtttctctgagtaagttctccaccccatggaagcgattcttcacctctcttccggtatatgccattatcgtcgcaaacttttgtcggagctggactttttacttacttttgatcagccagcctgcttacttcgaggaggtatttgggttcgctattagcaaggttggtttgctgtccgccgtgcctcacatggtgatgaccatcgtagtgcccatcggcgggcagttggccgactacctaagatctcggcaaatcctgactacaacagcggtccgcaaaataatgaactgcggtggtttcgggatggaggctacactcttactcgtggtcggattttcccacacaaaaggagtggccattagtttcctggtgctggccgtgggattctcggggtttgctatctctgggtttaacgttaatcatctcgatatcgcgccgcgctacgcctccattctgatgggcatctctaacggcgtcgggaccctcagtggcatggtctgccccctcatcgtgggagccatgacacgccataaaactcgggaagagtggcaaaacgtgtttctgattgcagctctggtgcactatagtggcgtcattttttatggtgtttttgcctcaggtgaaaagcaggagtgggcggaccccgaaaacctgagcgaagagaagtgcggtattattgatcaggacgagcttgccgaggaaatcgagctgaaccacgagtcctttgcaagccctaaaaagaagatgtcctacggtgcaactagtcagaattgcgaggtccagaaaaaagagtggaaaggacagcgcggggctaccctggacgaagaagaactgacttcttaccagaacgaagaaaggaacttttctacgatatcctag

SEQ ID NO: 205679 - DNA, 1620 bp, Artificial Sequence
  Description of Artificial Sequence: Synthetic coding sequence
atgcccttcaaggccttcgacaccttcaaggagaagatcctgaagccgggaaaggagggcgtcaagaatgcagtgggcgattcactcggcattcttcagcgtaagattgacgggactacagaggaagaagataacattgagctgaatgaagagggacggccagtccagacttcacggccttctcctcccttgtgtgactgccattgctgcgggcttccaaagaggtatatcatcgccattatgagcggcctagggttttgcataagtttcggaatccgctgtaatttgggagtcgcaattgtggaaatggtcaacaactccactgtgtatgtggacgggaaacccgagattcagaccgcccagtttaactgggacccagaaacagtggggctcattcatggcagcttcttttgggggtacatcatgacgcagatcccgggcggttttatctccaacaagttcgccgcgaacagagtatttggggcggccatctttttaacaagtaccttaaacatgttcatcccctcagccgcacgagttcactacgggtgtgtgatgtgtgtacgcatactgcagggactggtggagggggttacttacccagcctgccatggaatgtggtccaaatgggcacctcccttggaacgttcaagactggccacaacttccttttgcggtagttatgccggcgctgtggtggctatgccgttggccggagtgctggtccagtatataggttggtcctccgtgttttacatttacggaatgttcggaataatctggtatatgttctggctcttgcaggcctacgagtgcccagccgcgcatccaaccattagcaatgaggaaaaaacttatattgaaacatctattggcgagggagctaatgtcgtttctctatcagtgggactcttatctgccgtgccacatatggttatgacaatcgtggtgccaatcggcggacagctggccgactacctgcgcagccggcaaatactgactactactgccgtcagaaagatcatgaactgtggtggtttcggaatggaggccacgcttctactggtagttgggttttcgcacacaaaaggagtggcgatcagcttccttgtactggcagttggtttttcaggctttgccatatccggctttaatgtaaatcatctcgacatagctcccagatacgcatcaatactcatgggaatttccaatggggtgggcactctgtcgggcatggtctgcccactgatcgtaggagccatgaccaggcacaagacaagagaagagtggcagaatgttttcttgattgccgcactggtccactatagcggcgtgatcttctatggggtgtttgcttcaggggagaaacaagagtgggccgaccccgaaaacctgtccgaggagaagtgtggaatcattgatcaggacgaattagctgaggagattgagctgaatcatgaatctttcgcttcacctaaaaaaaagatgagctatggtgcgacctctcagaattgtgaagtgcagaagaaagagtggaaggggcagagaggggccaccttggatgaagaagaattaaccagctaccagaatgaggaaagaaatttctcaaccatctcctag

SEQ ID NO: 205680 - DNA, 1293 bp, Artificial Sequence
  Description of Artificial Sequence: Synthetic coding sequence
atgaccctgaccagccggcggcaggacagccaggaggcccggcccgagtgccaagcgtggacaggaaccctgctcttgggcacctgtctgttgtattgtgcccggtcttcaatgccaatatgtacagtgtctatgagccaggacttcggatggaataagaaggaggctggtatcgtgctgtctagcttcttctggggatactgcctcacacaggtggtgggcggccatctgggagacaggattgggggtgaaaaggtgattttgcttagcgctagcgcctgggggtcaatcacagcagtgactccattgctggcgcatctctcgtccgctcacttggccttcatgaccttttctcgaattctaatgggacttctgcaaggcgtctattttccagccctgacatcattgttgtcacagaaggttagagagagtgaacgggccttcacatactccatcgtcggagccgggtcacagtttggaacgctgctaaccggagcagtgggatcattactgctcgaatggtacgggtggcagtccatcttctacttttccggcggtttgaccctattgtgggtgtggtacgtgtaccgatacctgcttagcgagaaagacctgatcctggccctgggcgttctggcacaaagccgccccgttagccgccacaaccgcgtgccttggaggcgattgtttagaaagcctgccgtgtgggctgcggtggtttcgcaactctctgctgcctgttcatttttcatcctgctttcctggcttcctacattcttcgaagagacctttcctgacgccaaaggctggatctttaatgtggtgccttggcttgttgctatccccgcatcattattcagtggttttctcagtgaccatttgataaaccaaggatacagagcaatcactgttagaaagcttatgcagggaatgggactcgggctcagctctgtcttcgcactgtgtctgggccacacctcaagcttttgcgagagtgttgtgttcgcttcagctagtattggcctgcagacgttcaaccactccgggatctcagttaatattcaggacctcgcccctagctgtgccggcttcctgttcggggtcgccaatactgctggcgcgcttgcaggggtggtgggggtatgtctgggcgggtacctgatggagacgaccggctcttggacctgtctgtttaaccttgtggccattatctccaaccttgggttatgcaccttcttagtcttcggtcaggctcagagggtggatctgtcatcgacgcacgaggatctctag

SEQ ID NO: 205681 - DNA, 1311 bp, Artificial Sequence
  Description of Artificial Sequence: Synthetic coding sequence
atgcagcccccccccgacgaggcccggcgggacatggccggcgacacccagtggtccaggcccgaatgccaggcttggaccggcacgcttttactggggacctgtctactttactgcgctaggagcagcatgccaatctgcacggtcagcatgagccaggattttggatggaataagaaagaggccggcattgttctgagttcattcttctgggggtattgcttgacccaagtagttggtgggcacctgggcgacagaatcggcggcgagaaagtgatcttattgtcagcttcagcttggggtagtatcacggccgtcacacctctgctggcgcacctctcctcagcccaccttgcctttatgacatttagtagaattctgatgggattgctgcagggcgtgtactttcccgcccttactagcctactatctcaaaaagtccgcgagtccgagagggctttcacatattccattgtgggggccggctcccagtttgggacactgttgacgggggcagtcggctccctgctattagagtggtatggttggcagtcaattttttacttctctggaggactgactctcctttgggtttggtacgtgtataggtatctgctgagcgaaaaggacctcatccttgctctaggagtgctggcccaaagccggccggtatctaggcacaaccgagttccatggcgccggcttttcaggaaacctgccgtgtgggcagccgtggtctcccagctgagtgccgcgtgttctttctttatactgctatcatggctacccaccttctttgaagaaaccttcccagatgcaaaagggtggatttttaacgtcgttccttggttggtggctattccagccagtttgttcagcggtttccttagcgaccacctgatcaaccagggatacagagcaatcaccgtcagaaagctcatgcagggtatgggcctgggcctaagttctgtgttcgctctctgcctgggacatacaagctccttttgcgaaagtgtggtattcgcttctgcgtccatcggcctccagacgttcaaccactctggtatcagtgtcaacatacaggatcttgcgccctcttgcgctggtttcctatttggggttgccaacactgccggggcgttagcaggagttgtgggcgtgtgcctgggaggttatcttatggagacaactgggagctggacgtgcctcttcaaccttgtagcaatcatctcaaatttaggcctatgtacgtttctggtgtttggccaagcccaacgagtcgacttaagttcaactcacgaggatttgtag

SEQ ID NO: 205682 - DNA, 459 bp, Artificial Sequence
  Description of Artificial Sequence: Synthetic coding sequence
atgttcccccggcccggcgccctgagctggaccgtgcggcggcacactcctagacaagtggagccaccatgtgtatgtatgacccttacttctagacgtcaggattcgcaagaagctcggccggagtgtcaggcatggacaggtacgttactgttaggaacctgcctgctttactgtgccagatccagtatgccgatttgtactgtgtctatgtcccaggatttcgggtggaataagaaggaggccggtattgtcctgtcttcctttttctggggctattgccttacccaagtggtgggcggacacctgggggacaggatcggcggagagaaggtcatcctgctttcagcgtctgcttggggctctattacagcagtgacccccctgctcgcacatctgtcttccgctcatctggccttcatgacattctctagaattctgatgggtctccttcaatag

SEQ ID NO: 205683 - DNA, 1599 bp, Artificial Sequence
  Description of Artificial Sequence: Synthetic coding sequence
atggagagcgccgagcccgccggccaggcccgggccgccgccaccaagttgtcagaagctgtgggggcagctctacaggagcctagacgccagagacgccttgttttggttatcgtttgcgtagccctattgcttgacaatatgctgtacatggtgattgtgcccatagttcccgactatattgcccacatgcgtggcggcggggaggggcccactcggacacccgaagtttgggaacccacccttccactgcccaccccagctaacgcctctgcttataccgcaaatactagcgcctcccctacagcagcttggcccgcaggatccgccctgagacctaggtaccctactgagagcgaggatgtcaagatcggcgtgttatttgctagtaaggctatattgcaactgctggtcaatcccctatcaggcccttttattgaccggatgtcctacgatgtgcccctcctgatcggtctgggtgttatgttcgcttcaacagtcctgtttgccttcgccgaagattacgccaccctgtttgcagcccggtctctgcagggactgggttccgcattcgcggatacctccggcatcgctatgatagcagacaagtacccagaggaaccagagcggtcgcgggccctcggggttgcactggcatttatttccttcggcagcctggtggctcctcccttcggaggaattctttatgagtttgcaggcaagagagtaccattcttggtgctagcagccgttagcctgttcgacgctctactgctccttgccgtcgctaagccgttttccgccgcagcccgcgcacgggccaacctacccgtgggcacgccgatccacaggcttatgttggatccctatatcgcagttgtggctggggccttaaccacctgcaacattcctctggccttcctcgaacctaccattgccacatggatgaaacacacaatggctgcttcagagtgggaaatgggaatggcttggctgccagcgtttgtaccacatgtcctcggcgtgtacctgaccgttcgccttgcagcacgttatccacatctgcagtggctctacggagccctcggcctagccgttatcggagcttcatcatgtatcgtcccggcctgtcggtctttcgcccccctggttgtttcgctttgcggtctgtgttttggcatagcattggtcgataccgccctgctgccaaccctggcttttcttgtcgacgtccgacacgtcagtgtctacggatctgtgtacgccatcgcagacatatcctacagcgtggcttatgcgttggggccaattgtggctggccacatcgtccacagcctgggtttcgagcaactgagtcttggtatgggactggcaaacttactttacgcgcctgtgctcctcttgctcaggaatgtcggacttctcactcgttccagatctgaacgcgacgtgctcttggacgagccaccccagggcttatacgacgccgtgaggctgagagaaaggcctgtctccggtcaagatggagagccccgttcaccccctggacctttcgacgcatgtgaggacgactacaactactactacacccgttcgtag

SEQ ID NO: 205684 - DNA, 1482 bp, Artificial Sequence
  Description of Artificial Sequence: Synthetic coding sequence
atgctgcggaccatcctggacgccccccagcggctgctgaaggaggggcgagcgtctaggcagttggtacttgtggtggtcttcgtcgcgctgctcctagacaatatgttgttcactgtggtggtgcctattgtgcccaccttcttatacgatatggaatttaaggaggttaacagttccttgcatctgggacatgctgggagttctccccacgctcttgcaagccccgcttttagtacaatattcagcttcttcaacaacaacaccgtagccgtggaggagtccgtgccttccggcatcgcttggatgaatgacaccgcctccacgattcctcctccggccaccgaggccataagcgctcacaaaaataactgtttacagggaacgggcttccttgaggaagaaattacccgtgtcggagtgctttttgcctctaaagcagtcatgcagttgttagttaaccccttcgtgggtccactgacaaacagaattggttaccacataccaatgttcgccgggttcgtaattatgttcctaagtaccgtaatgttcgcattctctgggacatacaccttactgttcgtggccagaacgctgcagggaatcggcagttctttttccagcgtcgccggcttaggtatgctggcctcagtctatactgacgatcacgaaagagggcgagcaatgggaaccgcccttggcggcctagcactggggctcctggtgggagcccctttcggctctgtgatgtatgagttcgtgggcaaatccgcgccgttcctgatcctcgcgtttctagcactcctcgacggcgctctgcaactttgcatcctgcaaccatccaaggtgtcccccgagtcggctaaggggacacccctcttcatgctgctgaaggacccctacatcttagtggcagctggattggctttcctaccagcctctgtttcctatctcatcggcactaacctgtttggcgttctggctaataagatgggcaggtggttatgctctctcattgggatgctggtagtgggcacatcccttctttgcgttccattggcgcataacattttcggactgatcggacctaacgcaggactcggactagctatcggaatggtggactctagtatgatgcccatcatggggcacctcgttgacctcaggcacacatccgtgtatggctcggtctacgccattgcagacgtggcgttctgtatgggctttgccattggtcctagcacaggaggagctatcgtgaaggctatcggttttccttggctcatggtgatcaccggcgtgatcaacatcgtctatgcccctctgtgttactacttgaggtcaccaccagccaaggaggaaaaattggccattttgagccaggactgtcctatggagacccgtatgtatgcgacccagaaacccactaaagaattccctcttggggaggacagtgacgaagagcccgaccacgaggagtag

SEQ ID NO: 205685 - DNA, 1578 bp, Artificial Sequence
  Description of Artificial Sequence: Synthetic coding sequence
atgctgcggaccatcctggacgccccccagcggctgctgaaggaggggagggcctccagacagctggtactggtggtggtcttcgtagctctgctgttggataatatgctgttcaccgttgttgtgcccatcgtgcccaccttcctgtatgatatggaatttaaagaggtcaattctagtctccacttgggacatgcaggtagttctccacacgcgctcgcatcccctgctttttcaaccatcttcagcttctttaataataatactgttgctgtggaagaatctgtgccatccgggattgcctggatgaatgacaccgcgagcaccatacccccacctgcgaccgaggcaatctccgcacataaaaataattgtctacaggggacaggattcttagaggaagagataacacgagtcggggttctgttcgcttccaaagccgtcatgcagttgctggtcaacccctttgtaggccccctgactaatcgcattggataccacattccgatgttcgctggttttgtcattatgttcctcagtacagtgatgtttgctttctccgggacatataccttactgttcgtcgctagaacactccagggaattggcagctccttctcaagcgtcgcaggcctaggcatgctcgcttctgtctataccgacgaccacgagcggggccgggctatgggcacagcactggggggcctggccttgggtctcctggtgggtgctcccttcggctctgtgatgtatgagttcgtgggcaaaagtgcccctttcttgatcctggccttcctggccctgcttgatggggccctccagttgtgtatcctccagccttctaaggtatcgcctgaatcagccaaagggactccactattcatgctcctgaaagacccgtatatcttggtggctgctggcagtatctgtttcgccaatatgggcgtcgctatcctggagccaactttaccgatctggatgatgcagacgatgtgttctcccaagtggcaactggggctcgcctttttgccggcgtcggtgtcatatctcattggtaccaatttgtttggcgttctggccaacaaaatgggccggtggctgtgctcccttatcgggatgctggttgtgggaaccagtttgctgtgcgtgccactggcccacaatatttttggcctgattggccccaatgcggggctggggctggccatcgggatggtggattccagcatgatgcccatcatgggacatcttgttgaccttaggcacacttctgtgtatggctccgtgtacgcaatcgctgacgtcgctttctgcatggggtttgcaatcgggcccagtacagggggcgccatcgtcaaagcaattggtttcccatggctaatggtgatcacgggagtcatcaatatcgtctacgcgcctctatgctactacttgcgctcgccccctgcaaaagaagagaagcttgcaatcctgagtcaggactgccctatggagacaagaatgtatgcaactcagaaacccacaaaggaatttccactcggggaggatagcgatgaggaacccgaccacgaggagtag

SEQ ID NO: 205686 - DNA, 1419 bp, Artificial Sequence
  Description of Artificial Sequence: Synthetic coding sequence
atgctgcggaccatcctggacgccccccagcggctgctgaaggagggacgggcctctcgacagctcgttttggtggtcgtgtttgttgcgctcctacttgataacatgctcttcactgtcgtcgtgccaatcgtgcccacctttctgtacgacatggagtttaaagaggtcaattctagtctgcacctaggccacgctggtagtagcccccacgcattggctagccccgcattctcgactatcttttccttttttaataacaacaccgtcgcggtggaggagtcggtgccaagtggtatcgcctggatgaatgacacagcttctaccatcccccctccagccaccgaggctattagcgcacataaaaacaactgtctgcagggtacggggtttctggaggaggaaataacaagagttggcgtgctattcgcctccaaggccgtgatgcagcttttggtcaatccttttgtgggacctctgacgaatcgcattggatatcacattcccatgttcgcagggtttgtcattatgttcctctctacggttatgttcgcattttcagggacctacacactgctgtttgtggcccgcactctgcagggcataggtagtagtttttcatctgttgccggcctgggcatgctggccagcgtttacaccgatgatcacgagcggggtcgagccatggggacagctttgggggggctcgcacttggattgctggtgggtgcaccattcgggtctgtgatgtacgaatttgtgggcaagtccgccccctttctaatcctggcatttcttgcgcttttggacggtgctctgcagttatgcattctgcaaccaagtaaagtttctcccgaatccgctaaagggacccccctcttcatgctacttaaagacccttacattctggtagcggctggctctatctgcttcgccaatatgggggttgcaatactggaaccaacgctgcccatatggatgatgcagaccatgtgtagccctaaatggcagctgggcttagcatttctaccggcaagcgttagctacctgataggtacaaacctgtttggcgtacttgctaacaagatggggcggtggctctgctccttaatcgggatgcttgttgttggtacatcccttctatgtgtgcctctggcgcataacatttttggtctcataggtcccaacgccgggctgggactcgctattggaatggtggattcgagtatgatgccaattatgggccacctggtggatctgcggcacacgtccgtgtacggctccgtgtacgctatcgccgatgtcgcgttctgcatgggtttcgctatcggttatagcgaaagcggcctgcctcatggcgaccctgatgtgtgcaatccagaggcccatgagggcatatcaagcggtggcggtcaatag

SEQ ID NO: 205687 - DNA, 1578 bp, Artificial Sequence
  Description of Artificial Sequence: Synthetic coding sequence
atgctgcggaccatcctggacgccccccagcggctgctgaaggagggacgggcgtcaagacagcttgttctggtggtggtttttgtcgctctgctcttagataatatgctcttcactgtcgtcgtcccaattgtgcctactttcctttatgatatggagttcaaggaggtgaattcatcactccatctgggtcatgccggatccagccctcacgcgctggcatcacctgctttcagcacaatcttctccttttttaataataataccgttgcagtagaggagtccgtcccatcaggaatcgcatggatgaatgatacggcaagtaccatcccccctcccgctaccgaggcgatctcagcccacaagaataactgtctccaaggaaccggctttctcgaggaggaaatcacacgggtgggggtgctgtttgcaagcaaagccgtcatgcagttgctagtgaatccttttgtgggtccactgaccaacaggattggataccacattccaatgtttgccggtttcgtaattatgttcttgagcactgttatgttcgctttcagcgggacttataccctgctcttcgttgctcggacattgcaagggatcggtagctcattttcctcagtggctggcctcggtatgttggcctccgtgtacacggatgatcacgaaaggggcagagcaatgggcacagctctggggggactggcactgggactgctcgtgggagctccgttcggctccgtgatgtacgaattcgtggggaaatccgctccattcctgattctggccttccttgccctgctagatggcgcattgcaattatgcatcctgcagcccagtaaagtgtcgcccgagagtgcaaagggcacaccactgtttatgcttctaaaagatccttatattctggtggccgccggttctatttgtttcgccaacatgggagtagctatcctcgaacccactttacccatttggatgatgcagacaatgtgctcccccaagtggcaactggggcttgcctttctccccgcttccgtctcgtatctgattggcactaaccttttcggcgtgctcgctaataaaatgggacgctggctgtgcagcctcatcggaatgctcgtggttggcacctctctcttgtgcgtgcccctcgcccataacatctttgggctaattggcccaaacgccggcctgggattggctatcggaatggtggattctagcatgatgcctatcatgggtcatcttgtagacctacggcacacctcagtatatggatctgtgtatgcgatagccgatgtcgctttttgtatgggtttcgccatcggcccttcgacgggcggcgcgatcgttaaagcgatcggatttccttggcttatggtgattaccggggttatcaacatcgtctacgctccactgtgttactaccttaggagcccgcctgccaaagaggaaaagctcgccattctgtcgcaggattgccccatggagacacgcatgtatgccacccaaaagccaacaaaggaatttcccttgggcgaggattccgatgaagagccggatcacgaagagtag

SEQ ID NO: 205688 - DNA, 1158 bp, Artificial Sequence
  Description of Artificial Sequence: Synthetic coding sequence
atgctgcggaccatcctggacgccccccagcggctgctgaaggagggacgcgcttccagacaattagtgctggttgttgtattcgtcgccctcctgctggacaacatgctcttcactgtggtggtgccgatagtgccgacgtttctttacgatatggagttcaaagaggtaaattcatctctgcacctgggccacgcaggctcctctcctcacgcactcgcctcacccgccttttccactatctttagtttctttaacaataacaccgttgcagtggaggaaagcgtaccttcgggaatcgcatggatgaacgatacagcatctaccatcccccctccagcgacagaagctattagcgcacacaagaataattgcctgcagggcaccggctttctggaggaggagattactcgggtcggggtactgtttgcatctaaagccgtgatgcagctactcgttaatcccttcgttgggcccttgaccaacagaatcggatatcatataccgatgtttgccggatttgtgatcatgtttctctctacggttatgttcgcatttagtggaacttacacactgctcttcgtggcgagaaccctccagggaataggctccagctttagttctgtggctggactggggatgcttgcttccgtgtatactgatgaccatgaacgcggccgagcaatgggaaccgcactgggggggctcgcgcttggcctgctcgtcggggccccgttcggcagtgtaatgtatgaattcgttgggaaaagtgctccattcctgattctggcattcctggccctgcttgacggcgccctgcagctgtgcatcctgcagccctctaaagtcagccctgagtcagctaagggcactcctctctttatgctgctgaaggacccctacatcctcgtggcagccggtagcatatgcttcgcgaacatgggggtggcaattctggagcccaccctccctatatggatgatgcagacaatgtgtagcccgaagtggcagctgggactggccttcctccctgccagtgtcagctacttgatagggacaaatctgtttggagtgctggccaataaaatggggaggtggctgtgtagtcttattggaatgttggtcgtcgggacttccctgctgtgcctcccttcttag

SEQ ID NO: 205689 - DNA, 1482 bp, Artificial Sequence
  Description of Artificial Sequence: Synthetic coding sequence
atgctgcggaccatcctggacgccccccagcggctgctgaaggagggccgggcaagtaggcagctggtgctggtcgtggtctttgtggctcttttacttgacaacatgctgttcactgtggttgtgccaattgtgccaacattcctatacgacatggaatttaaagaagttaacagttcacttcacttgggccatgctgggagttctccacatgcattggcatcccccgcgttttctacgatcttctctttttttaacaataataccgtcgccgtcgaggaatcggttccttctggcatcgcatggatgaatgataccgcttcgaccattccccctcccgcgacagaagccatctcggcccataaaaataattgtctccagggcactggtttcttggaagaggaaattacaagagtgggcgtgttattcgctagcaaagcggtgatgcagttgttagtgaatcccttcgtgggtccactgacaaacagaataggctatcatattcccatgttcgccggttttgtgataatgttcctctcaacagttatgtttgctttctccggcacgtataccctgctgtttgttgcaaggactctgcaggggattggcagctcctttagctcggtggcgggccttggcatgttggcctcagtctacactgacgatcatgagcggggtcgagcaatgggaacagcgctgggaggcctggcattaggcctgctggttggagcgcctttcggctccgtcatgtatgagtttgtgggcaagtctgctccatttctcattcttgcgttcctggccctgctggatggtgccctccagttgtgcatcctgcagccaagtaaggtatctcccgagagtgcaaagggcactcccctgttcatgcttcttaaggatccatatatcctggtggcagctggccttgcgttcctgccagcaagtgtgtcatatctgatcggaaccaatctttttggagttctcgccaataagatggggcggtggctgtgctctttgataggaatgcttgtggttggcacatcgctcttgtgcgtacccctggcacacaacatattcggcctgatagggcctaacgcgggattaggattagcgatagggatggtggactcctccatgatgccgattatgggtcatttggtggatctcagacatacgtcagtgtacggatcagtttacgccatcgccgatgtcgctttctgcatgggcttcgctatcggccccagcacaggaggagctatcgtgaaggcaattggtttcccttggcttatggtcatcactggagtgattaacattgtttacgcgcccctgtgctattatcttaggtcacccccggccaaagaagaaaaactcgctattctgtcccaggactgccctatggagaccagaatgtacgccacccagaagccaacgaaagagttcccgctgggcgaggattcagatgaagagcccgatcacgaagagtag

SEQ ID NO: 205690 - DNA, 1545 bp, Artificial Sequence
  Description of Artificial Sequence: Synthetic coding sequence
atggccctgagcgagctggccctggtgcggtggctgcaggagagccggcggtcgaggaagctgattctgtttatcgttttcttagcactcctccttgataatatgcttctcaccgtggtcgttcccatcatcccttcttacctctatagtatcaagcatgaaaagaatgccacagagattcaaacagctcgccccgtacataccgcatcaatctccgatagcttccagtccatcttttcttattacgacaattcaacaatggtcacaggcaatgccacacgtgacctgacactgcaccagactgccacccagcacatggtcaccaacgcctcggcggtccccagcgactgcccgagcgaagataaagacctcttgaacgagaatgtacaagtcggcttactctttgcctcaaaagctaccgtacagctaatcactaacccgttcattggacttctgacaaaccggatcggctacccaatacccatctttgctggcttctgtattatgttcgtgagcaccattatgttcgccttttccagcagctacgccttcctcctaatcgcaaggagcttacaagggatcggatcatcttgctcttcagttgccgggatgggaatgctggctagtgtctatacagacgatgaggagaggggaaacgtcatgggcattgctctaggcggtctggcaatgggtgtgttggttggccccccattcggatcagtgctatatgagtttgtgggaaagacagcaccttttctggtgctcgccgccctggtgctgctggacggagcgatccaactgttcgtgctgcagccgagccgggttcaacccgaatcccagaagggcacgcccctgactactctgttgaaagacccatatatcctcatcgccgccggaagtatatgtttcgccaatatgggaatcgcgatgcttgagcctgcccttccgatctggatgatggagactatgtgctcccgaaaatggcagctcggagttgcttttctgccagcaagcatatcctatctgatcggaaccaacatcttcggtatcctcgcacataagatgggtaggtggctgtgtgccctgctcggcatgatcatagtgggagtgagtattttgtgcatcccatttgctaaaaatatttatggtcttatcgcaccgaacttcggtgtaggttttgctatcgggatggttgacagttctatgatgcccattatgggctacctggttgaccttcgtcatgtgagtgtttatgggtctgtgtatgccattgccgacgtcgctttctgcatggggtacgccattgggccttcggcagggggagcgatcgccaaggccataggttttccctggttgatgacgattatcggcattattgacatcctgtttgccccattgtgcttcttcctgagaagcccgcctgcaaaagaagagaaaatggccattctgatggaccacaattgtccaatcaagaccaagatgtatacgcagaacaatatacagtcttacccaatcggggaagatgaggaatcagaatcagattag

SEQ ID NO: 205691 - DNA, 1494 bp, Artificial Sequence
  Description of Artificial Sequence: Synthetic coding sequence
atggacgtgcccggccccgtgagccggcgggccgccgccgccgccgccaccgtgttattaaggaccgctcgcgtccgcagggagtgctggttcttgcccaccgctcttctttgcgcatatggcttcttcgccagtcttaggcccagcgagcctttcctgaccccgtacctgctcggccctgataagaatctcaccgaacgggaagtctttaacgagatttatcctgtgtggacttattcctatctggtgctgctgttccctgtttttttggctacagattacttgcgctataagcccgttgtcttgctacagggactgtccttgattgtgacatggttcatgctgttatatgcccagggcctattggcgatccaatttctcgagttcttttacggaattgctacagccacagaaattgcttattactcctacatttactctgttgttgacctggggatgtatcagaaagtgacaagctattgtagaagcgctactcttgttggctttacagtgggctctgtgttaggccagatcctcgtcagcgtagctggttggtccttatttagcctgaatgttattagcttaacttgtgtctccgtggccttcgccgtcgcgtggtttctgccgatgccccagaagtccttgttcttccaccacattccctcaacttgtcagcgggtgaacgggatcaaggtccagaatggcggcatcgtgaccgataccccggcaagcaatcatttgcccggctgggaagacattgagtcgaagatccccctgaacatggaagaaccacctgttgaagagcccgagcccaagcctgacagactgctcgtgttgaaggtcctgtggaatgactttctgatgtgttacagcagccgtcccctcctgtgttggtcagtgtggtgggcgcttagcacctgtgggtattttcaagtggtcaattacactcagggtctttgggaaaaggtgatgccttcaaggtacgctgcgatatacaacggcggcgtcgaggccgtgtccacacttctgggcgccgttgccgtttttgctgtgggctatatcaagatatcctggagcacatggggcgaaatgacactttctctcttttcattactcatagctgctgctgtctacattatggatacagtagggaacatctgggtatgttacgcttcctatgtcgtattccgtatcatctatatgctcctgataacaatcgctacatttcagatcgcggcgaacctcagcatggaacggtacgccctggtttttggagtgaataccttcattgccttggctctgcaaacactgctgacccttattgtcgtggatgcctcaggtctagggctggaaatcacgacgcagttccttatctatgcctcttattttgctctcattgcagtggtctttctggcaagcggcgccgtttcagtgatgaagaagtgccggaaactcgaggacccccagagtagtagtcaggtcaccacatcatag

SEQ ID NO: 205692 - DNA, 1380 bp, Artificial Sequence
  Description of Artificial Sequence: Synthetic coding sequence
atggacgtgcccggccccgtgagccggcgggccgccgccgccgccgcaaccgtgctgctacgcactgcccgcgttagacgcgagtgttggttcttacctacagcactactgtgcgcttatggtttcttcgcatctctgagaccaagtgagccctttttgacaccatacctattgggcccagacaagaacctgacagaacgagaagtgtttaacgagatctatccggtgtggacctacagctacttagttcttctttttccagtcttcctcgccacagactatctacgctataaacctgtggttctactgcagggattgagtttgattgtgacatggttcatgctgctgtatgcacaaggtctcttagccatccagttcctcgagttcttctatggcatagctactgctactgagatcgcttactactcctatatatattccgtggtggatctgggtatgtatcaaaaagttacatcctattgcagatctgccactctcgtaggcttcactgtggggagcgtcctggggcagatcctggtgagcgtggcagggtggagtttgttcagcctcaatgtaatcagtttgacatgtgtgtctgttgccttcgcagttgcttggtttttgccaatgcctcagaagagtctattttttcaccacattcccagtacgtgccaaagagtgaatggcattaaggaaccaaagccagacaggctgctagtgctgaaagtgctttggaacgattttttaatgtgctatagctcgcgccctctgctgtgctggagtgtgtggtgggctcttagtacttgcggttacttccaagttgtgaactacacccagggcctgtgggagaaggtgatgccttcacgatacgcagccatttacaatggcggcgtggaggccgtgagcaccctgctgggtgccgtagcggtcttcgccgtgggttacatcaaaatatcctggagtacgtggggtgaaatgacgctcagtctgtttagcctcctgatcgccgccgctgtatatataatggatacagtggggaacatttgggtgtgctatgcaagctatgtggtgttccggataatttatatgcttttgatcaccatcgccaccttccagattgctgcaaacctatcaatggaaaggtatgcccttgtattcggtgtgaatacattcattgccctggctctgcaaacactcctgaccctcattgttgtagacgcttctgggcttgggctggagataactacccagtttcttatatacgccagctatttcgcactgatcgcggtagtattcttggcaagtggggcggtgtctgttatgaagaaatgtcgaaaactcgaggatccccaatcctcctcccaggtgacaacgtcttag

SEQ ID NO: 205693 - DNA, 891 bp, Artificial Sequence
  Description of Artificial Sequence: Synthetic coding sequence
atggacgtgcccggccccgtgagccggcgggccgccgccgccgccgccactgttctgttgaggacagcccgcgtgaggcgggaatgttggtttttgcctacagccctgttgtgcgcctatggtttctttgcatcactgagacctagtgagccatttctgacaccttatcttctggggcctgataagaatctcaccgagcgagaggagccaaaacccgaccggctgctggtcctaaaggtgctgtggaatgactttctgatgtgttacagctcacgtcccttactctgttggtccgtttggtgggcgctttcaacatgcggctattttcaagtggtgaattatacccagggcctgtgggagaaagtcatgccaagtagatacgccgccatctacaacggtggagtggaggctgtgtctacgctgttgggagcggtcgccgtcttcgccgtggggtatatcaaaatctcatggtccacctggggagagatgacactgtccctgttcagcctcttaattgcagctgccgtctacatcatggacaccgtcggcaacatctgggtgtgttacgcaagctacgtcgtctttagaattatctatatgctgttgattacaatcgcgacgtttcagatcgctgccaatctatcaatggagcggtatgcactggttttcggcgtcaatactttcattgcgttggcgcttcaaacgctactcactctgatcgtagtggatgcatccggattaggattagagattacgacacaattcctgatctatgcgagttattttgcgttgatcgctgtggtttttctggcctccggggccgtaagcgtgatgaaaaaatgtagaaagttagaagatcctcagtctagctcccaggtgacgacatcctag

SEQ ID NO: 205694 - DNA, 1491 bp, Artificial Sequence
  Description of Artificial Sequence: Synthetic coding sequence
atggactgctaccggaccagcctgagcagcagctggatctaccccactgtcatcttatgtctgtttggtttcttcagcatgatgagaccctccgagccctttctgatcccgtacctatctgggcctgacaagaacctgacctctgcagagataactaacgagatattccccgtgtggacttacagctatctagttctgctcctccctgtctttgtacttaccgattacgtcaggtacaagcccgtcatcatattacaggggatttcattcatcattacatggcttctgctgttgtttggacagggcgtgaaaaccatgcaggtcgtggagttcttttacgggatggtaaccgctgccgaggtggcgtactacgcctatatatattccgtcgtttcccctgagcactatcagagggtctctggatattgccggtctgttactctcgcagcatacactgctgggtcagtgctcgctcaactgctggtgagcctggctaacatgagttatttctaccttaacgtcatttccctggcctcagtgtccgtcgcttttctgttctctttatttctccctatgccgaagaagagcatgttctttcacgccaagccgagcagggagatcaagaagagtagctccgtgaacccagtgctggaggagacccacgagggggaagctcccgggtgtgaagagcagaagcctacatccgaaatcctcagcaccagcggtaagctcaataaaggacaactaaattcactcaaaccatcaaacgttaccgtggatgtttttgtgcagtggtttcaggacttaaaggagtgctactcttcgaagcgtctgttctactggtccctatggtgggcttttgctacggcaggatttaatcaggttcttaattacgtccagatactctgggactataaagcccctagtcaagactcctccatctacaacggggctgttgaagctatagctacttttggaggtgccgttgcggcattcgcggtggggtacgtcaaggtcaactgggacctgttgggggagcttgctctggtagtcttctctgtcgtcaatgcggggtctctgtttctcatgcactataccgcgaatatatgggcctgctatgccggatatctgatattcaagtctagctacatgttactaatcactattgccgtgttccagatcgccgttaatttaaatgtcgagcggtatgccctggtattcggaattaacacatttatcgccctggtgatccaaaccatcatgacagtcatcgtagtggaccagcgtggcctaaacttgcccgtgagtatccagttccttgtctacgggagctacttcgcggtcattgctggtattttcctgatgcgctctatgtatattacttattccaccaagtcacagaaggacgttcagtctcctgctccaagtgaaaatcccgacgtctcccatcctgaggaggagagcaatattattatgagcaccaagctctag

SEQ ID NO: 205695 - DNA, 165 bp, Artificial Sequence
  Description of Artificial Sequence: Synthetic coding sequence
atggactgctaccggaccagcctgagcagcagctggatctaccccaccgtgatactttgcctgtttgggttcttctcgatgatgagaccaagcgaacccttccttattccttacctcagtgggccagacaagaacctgacctctgccgagatcaccaatgagtag

SEQ ID NO: 205696 - DNA, 195 bp, Artificial Sequence
  Description of Artificial Sequence: Synthetic coding sequence
atggactgctaccggaccagcctgagcagcagctggatctaccccactgtgatcctctgcctgtttggcttcttctccatgatgaggccgagtgagccatttctgatcccatacctgtcaggaccagacaaaaacctcacatctgcggagatcactaacgaaatttttccggtctggacctacagctacctatag

SEQ ID NO: 205697 - DNA, 1491 bp, Artificial Sequence
  Description of Artificial Sequence: Synthetic coding sequence
atggactgctaccggaccagcctgagcagcagctggatctaccccaccgtaatcctttgtctgttcggcttctttagcatgatgcgaccttctgaacccttcttgatcccttacctgtccggccccgacaaaaatttgaccagtgccgaaatcacaaatgagatatttcccgtgtggacatacagttaccttgtgttactgctgccagtgtttgttctaaccgattatgtcaggtacaaacccgtcatcatcctgcaaggaattagcttcatcattacatggcttctcctgctgttcggtcagggagttaagacaatgcaggtggtcgagtttttctacggcatggtgactgccgccgaggtggcctactacgcttacatttacagcgttgtgagccctgagcactaccaacgcgttagcggctattgtagaagcgtgacactcgccgcttatacagctgggtcggttttagcgcagctcctggtgtctctcgccaatatgagctatttctacctgaacgtcatctctcttgctagcgtgtcagtggcattcctgttctctctatttcttccaatgccaaagaagagtatgttcttccatgccaaaccatctagggaaatcaaaaaatcaagttctgtgaaccccgtgctggaggagacccacgagggcgaagcaccaggctgcgaagaacagaaaccgacctccgaaatattgtccactagcggcaagcttaacaagggccaattgaatagcctgaagccaagcaatgtcactgtggatgtgttcgtccagtggttccaggacttgaaagagtgttattcaagcaaaagactcttttactggagcctctggtgggctttcgcaacggcgggctttaatcaggtactgaattatgtgcagatcctttgggactacaaggctccctcacaggactcctccatttacaatggggcagtcgaggctattgcaaccttcgggggcgctgtggctgcgtttgctgttgggtacgttaaggttaactgggaccttttgggcgagcttgctctcgtagttttttccgtagtgaatgctggttcccttttcctgatgcactataccgccaacatctgggcatgctacgcaggctatctgatatttaagtcctcctatatgctcctcattacgattgctgtcttccaaattgccgtaaacctgaacgttgaacgatacgctctggtgtttggcattaacacctttatcgccctggtgatacagacaatcatgactgtgatcgtggtcgatcagaggggtttgaacctgccagtctcgatacaattccttgtgtacggaagctactttgccgtgattgctggcatcttcctcatgcgtagcatgtacatcacttacagtaccaagagtcagaaagacgtgcagtcacccgctcctagcgagaatcccgacgtgtcacacccagaggaggaaagcaacattattatgtcgacaaaattatag

SEQ ID NO: 205698 - DNA, 399 bp, Artificial Sequence
  Description of Artificial Sequence: Synthetic coding sequence
atggactgctaccggaccagcctgagcagcagctggatctaccccaccgtgattttatgtctttttgggttcttctccatgatgagaccaagcgagccgtttttaatcccctatttaagcgggcccgataagaacctcacttcagcagagataacgaacgaaatctttccggtgtggacttatagctatctcgtgctgttgctcccggtctttgtcctgacggactatgttaggtacaaacccgttatcatcctacagggaattagcttcatcatcacttggctgctgctgctgtttggacagggggttaagacgatgcaggtggtggagtttttctacggcatggtgaccgccgccgaggtggcttactacgcctacatctattctgtcgtgagttag

SEQ ID NO: 205699 - DNA, 1479 bp, Artificial Sequence
  Description of Artificial Sequence: Synthetic coding sequence
atgaaccccctgggcagcgccagccgggccaccgtggaccagctgacagacctcccctccaaagaacagctcagctgcgtggtgtttgctctctggccacctgctttttcctccaatctgtccgaccccggagttaaaatcaccaatgagatctttcctgtgtggacttacagctatctggtgctgttgcttcctgtctttgttctcaccgactacgtgcgatacaagcctgtcatcatcctgcaagggatctcatttataattacatggttgctgttgctgttcggtcaaggagtgaagaccatgcaagtggtggaattcttttacggcatggtgacggccgcagaagtggcttactacgcctacatttacagcgtggtatctcctgaacactaccagcgggttagcggttattgcagatctgtgaccctcgcagcttatacagctggatcagtcctcgcgcagctgctagtgagcctcgccaacatgagttacttttacctaaacgttatctcattggcgagcgtgagtgtcgccttcctgttcagcttgtttcttcccatgcccaagaaaagcatgtttttccatgcgaagcccagcagggagattaagaaatccagcagcgtcaatcctgtcctggaggaaacacatgaaggcgaagcgcctggctgcgaggagcaaaagcccacttctgagattctttcaacctcgggaaagctcaacaagggccagctgaactcactcaaacccagcaacgtgaccgttgacgtgtttgtccagtggtttcaggacctgaaggaatgctactcttctaagcgtctattttactggtcactgtggtgggcttttgcaactgcggggtttaaccaggtgctgaactacgttcagatcttgtgggactacaaggcaccttctcaggattctagtatctacaacggggcagtggaagcaattgctacgttcggtggagcggtggctgcctttgccgtcgggtatgtgaaggtgaactgggacctcctgggggaactagcacttgtggttttttctgtagtgaatgccggatccctgttcctcatgcactacacagcaaacatctgggcgtgctacgcggggtacctgatatttaaaagctcatacatgctgctcataaccatagcagtattccagatcgccgtgaatcttaatgtagaacgttacgcactggtgttcggcatcaacacttttatagctctagtgattcagactattatgactgtaattgtggtggaccagaggggccttaatttgccagtaagcatacagtttctagtgtacggctcctacttcgcggttatcgctggcatcttcttgatgagatcaatgtatattacatactccaccaagagtcagaaagatgtgcagagccccgctccctctgaaaacccagatgtttcccatccagaggaggaatcaaacatcatcatgtccacaaaactgtag

SEQ ID NO: 205700 - DNA, 1626 bp, Artificial Sequence
  Description of Artificial Sequence: Synthetic coding sequence
atgggccacagcccccccgtgctgcccctgtgcgccagcgtgagcctgcttggcggcctcacattcggctacgagttagctgtgattagcggtgcgcttcttcccctgcagctcgactttggtttatcctgcttggagcaggaattcctcgtcgggagcctgttgctgggagccctgctcgcttctttggtgggggggttcctcatagactgttacggaagaaaacaagcaatcttggggtccaacctcgtgctgttagccggcagcctgacactgggtctggcagggtccctggcgtggcttgtgttgggaagagctgtggtggggttcgcgattagtcttagcagtatggcttgttgtatctatgtgtcggagctcgtgggtcctagacagaggggggttctcgtctccctctatgaagccgggatcactgttggcattctgctgtcctatgcactgaattacgctttagcaggcactccatggggttggagacacatgttcggttgggctacagctcccgccgtgttgcagtcattgtctcttctgttccttcctgccgggactgatgagactgccacacacaaagacctgatacctttacagggaggagaggctcccaaactggggcccggtagaccccgatacagctttctggatctatttcgcgctagggataacatgcgcgggcgcacaacagtcgggctcggcctggttctttttcagcagctcacaggccaacctaacgtgctctgctacgctagcaccatcttttccagcgtgggctttcatggcggcagcagcgccgttcttgcttctgtcggactgggcgcggtgaaagtggctgcaaccttgacagctatggggctggtggaccgcgccggccgaagggcactgctcttggccgggtgtgccctgatggcccttagtgtcagcggcatcggattggtgtcctttgcggtccctatggatagtggaccttcttgcttggcagtacccaatgccacaggacaaactggcttgcccggagattccggcttactccaggacagttctttacctcccatacctcgaaccaatgaagatcaacgagaaccaatattatctactgccaagaaaactaaaccacatccgaggagcggcgacccatccgccccgcccagattggctttatcaagcgcccttccgggaccccctctcccagcccgcggccacgccctgctccgctggactgcattgctatgcttgatggtgtttgtctccgcattcagcttcgggttcggccccgtcacatggttggtccttagcgaaatctacccagttgagatcagaggaagagcatttgctttttgtaattcattcaactgggcagcaaatctgttcatttctctctcctttctggatcttatcgggacgattggccttagttggacctttcttctatacgggctgaccgctgtgctgggtctaggttttatctacctcttcgtgccggaaacgaaggggcagagcttagccgagatagatcagcagttccagaaaaggcgttttacattgtcctttggtcaccgccaaaactcaaccggaattccttactctaggatcgagatttccgccgctagttag

SEQ ID NO: 205701 - DNA, 1947 bp, Artificial Sequence
  Description of Artificial Sequence: Synthetic coding sequence
atgagccggaaggccagcgagaacgtggagtacaccctgcggagcctatcctctctcatgggagaaagaaggcggaaacagcctgagcctgatgccgcaagcgctgctggcgagtgttccctgctggctgcggccgaatcatccacttctcttcagtccgccggcgcgggtggcgggggtgtgggtgacttagaacgagccgcccgcaggcaatttcagcaggacgaaactcccgctttcgtctacgtggtcgctgttttttcagctctgggtggatttctctttggatacgacactggcgtggtcagtggagcaatgctgctgctgaaacgacagctgagcttggatgcactgtggcaggagctgctagtttccagtacggtgggcgcggctgccgtgtccgcactggcaggcggggcacttaacggcgtttttggtagacgggcggccattctgttggcatctgcgctattcacagctgggagcgcggtcctggccgctgctaataacaaagaaactctgcttgccggaaggctcgtggtaggcctgggtattgggattgcttccatgaccgtgccggtctacatagctgaggtctctcccccaaatctccgaggtagactcgtcactattaacacactgtttattaccggcggccagttttttgctagtgtggtggatggagcgttctcatacctgcagaaggacggctggagatacatgctgggcctggccgctgtgccggcagtcatccagtttttcggatttctcttcctccctgagtctcctcgatggcttatccaaaagggtcagacccaaaaagcacgcagaattttgtctcagatgagaggaaatcagactatagatgaagagtatgacagcattaagaataacatagaagaagaggagaaggaggtcggcagcgctgggcctgtgatatgtcgcatgctgtcttacccgcccacccgaagagccttgattgttgggtgtggcttacagatgttccaacaactaagcggtattaacaccattatgtattattccgcgaccatcctccagatgtcaggagttgaagacgaccgcctggccatatggcttgctagtgtgactgcttttactaactttatctttactttagtcggcgtctggctagtagaaaaagtcgggagacggaaattgactttcgggagcctagctggaacaactgtagccttgataatactggcactcggctttgtgctcagtgcacaggtgtcgcccaggatcaccttcaagcccattgccccttcgggacagaatgcgacatgcacgcgctatagctattgcaatgaatgcatgctggaccctgactgcggcttctgctacaagatgaataagagtactgtgatagactcctcttgcgtgcccgtcaataaagctagtacgaacgaggcagcttggggccgatgcgagaatgagaccaagttcaagactgaagacattttctgggcttacaatttttgccctactccttactcgtggactgccctgctcggacttatattatacctagtattctttgctccaggaatgggcccaatgccatggacagtgaatagcgaaatctaccctctctgggcccggtctactggcaacgcttgttctagtggaatcaattggattttcaatgtgctcgtgtcacttactttcctacacaccgctgagtatttgacttactatggagccttcttcttgtacgcagggttcgcagccgttggacttctgttcatctacggatgtctgcctgagactaaaggtaagaagctcgaagagatcgaaagtctgttcgataatcgtctgtgtacctgtggcacttctgatagtgacgaaggacgctacatcgaatacatcagggtgaaagggagcaattaccacctcagcgacaatgacgctagcgatgtggagtag

SEQ ID NO: 205702 - DNA, 1074 bp, Artificial Sequence
  Description of Artificial Sequence: Synthetic coding sequence
atgagccggaaggccagcgagaacgtggagtacaccctgcggagcctgtcctctttgatgggggaacggagaaggaaacaacccgagcccgatgctgcctcggccgccggggaatgtagcttactcgccgctgcggagtctagcacatccctccagtctgcgggggctggcggcggaggggtcggggacctggagcgagccgcacgtcgtcaatttcaacaagatgagacaccagcctttgtgtacgtggtggctgttttttccgccctgggcggctttctttttgggtacgatactggagtcgtaagcggagctatgctactgctcaagcgccagttgtctttagacgcgttgtggcaggaactcctggtgagttccacagtgggcgcggccgccgtgtccgccctcgccgggggcgcattgaacggagtgtttgggcggcgagccgccatcctgctcgcctcagcactgtttaccgctgggtcagctgtcctcgcggccgccaacaataaagagaccttactggcaggacgcctggtcgtggggttgggtattgggatcgcctccatgacagtgccggtgtacatcgcagaggtgagtccgccaaacttgaggggccgcctcgtcactatcaacacattatttatcaccgggggtcagttttttgccagtgtagttgatggcgcgttttcatatctgcagaaggatggctggaggtatatgctgggtctggctgccgtccccgcagttatccaattctttggattcctgtttttacccgaatcccctaggtggctgatccagaagggacagacacagaaagccaggagaatcctcagccagatgagaggtaatcagactatcgacgaagaatacgattctattaaaaataatatcgaagaggaggagaaagaagtgggtagcgccggtccagtcatctgtcggatgttgagctaccctcccacaaggcgggccctgatcgttggctgtggcttgcagatgtttcaacagctgtccggcataaacaccatcatgtacgtgttcctatcaggatttttgttgaaaaggctctag

SEQ ID NO: 205703 - DNA, 1494 bp, Artificial Sequence
  Description of Artificial Sequence: Synthetic coding sequence
atggacaaccggcagaacgtgacccccgccctgatcttcgccatcactgtagccaccatcggatcattccagttcggatacaataccggagtaatcaacgcccccgagacaatcatcaaagaatttatcaataaaacactcacggataaggcgaatgctccacccagtgaggtcctgcttacaaacctgtggtcactctccgtggctatatttagtgtgggaggaatgatcggctcttttagcgtagggctgtttgtcaaccgtttcggtcgtaggaactcaatgttaattgtcaatctgctggcggcaaccggtgggtgcctgatgggcctgtgcaagatcgcagaatcagtcgaaatgctgattctcgggaggctggtgatcggccttttctgcggtctgtgcacgggatttgtgcccatgtatatcggggagattagtcccacagccctgcgaggagcttttggcacattgaaccagttaggaatcgtcataggaatcctggtggctcaaatctttggactggagttaatcctgggctcagaagaactgtggcccgtgctcctggggtttaccatcctccctgcaatactgcagagcgccgctctcccctgttgtcctgagtctcctcggttccttctgattaataggaagaaggaagaaaatgccacacgaatattgcagagactgtgggggacacaggatgtgtcacaagatattcaagaaatgaaggatgagtcggcccgcatgtcacaggagaagcaagtgaccgtgctcgaattatttagggtaagcagttatagacaacctattatcatatccatagtgctgcagcttagccagcagctttctggaattaacgctgtattctactattctaccggaatatttaaggatgctggagtccagcagcccatttacgctaccatctcggctggcgtagttaatacgatatttactctcctgtcactattcctcgttgaacgggcgggaaggagaaccctccatatgatcggattgggggggatggccttttgttcgactctgatgaccgttagcttactcctgaagaaccactacaacgggatgtccttcgtttgtataggcgccatcctcgtattcgtggcatgctttgagattgggcccggacctatcccttggttcattgtggcagaactcttcagccaaggtcctcggcctgccgctatggcagtggccggctgcagcaattggaccagcaattttttggtgggcctcctgtttccaagtgccgcctattacctgggcgcttatgtgtttatcattttcacaggctttctcattactttcctcgcctttacgttcttcaaggttcccgagacaaggggacgcacattcgaggacatcacccgcgcctttgaagggcaggcccacggcgccgatcgcagcggaaaagatggcgtcatgggcatgaacagcatcgagcctgcaaaggaaacaactactaacgtctag

SEQ ID NO: 205704 - DNA, 1563 bp, Artificial Sequence
  Description of Artificial Sequence: Synthetic coding sequence
atggagttccacaacggcggccacgtgagcggcatcggcggcttcttagtgtctctgacctccaggatgaaacctcatactcttgccgttactccagccctgatatttgccatcaccgtggccactatcggctcatttcagtttgggtacaatactggggttattaacgcccccgaaactataatcaaggagttcatcaataagaccctcacggacaaagcaaacgccccaccttcggaggtcctgctgaccaacctctggtcacttagcgttgccatttttagtgttgggggtatgatcggatccttctctgtgggactgtttgttaaccggtttgggagacggaattctatgttgattgtgaaccttctcgcggccactggcgggtgcttgatgggcctgtgtaaaatcgccgaaagtgttgagatgctcatcctaggccgacttgttattggtttgttttgtgggctatgcacagggttcgtgccaatgtacattggggaaatatccccaacggccttgcgtggtgccttcggtaccctcaatcagctcgggatcgtgattggcattctggtagcacagatttttggcctcgagctgatcctgggatcagaagaactgtggccggtcttgttgggattcacaatcctgccagcaatcctccaaagtgcggccctgccatgttgtcctgagtccccacgattcttattgataaacaggaagaaggaagaaaacgcaacccgtattttacaacggctgtgggggacccaagacgtgagccaggatatacaggagatgaaggatgaatccgctaggatgtcacaggagaaacaggtaacagtcctggagctctttcgtgtgtccagttacaggcagcccattatcatatctatcgtactccagctgagccagcagttatctggaattaacgcggtcttttactactctactggaatcttcaaggacgcaggggtccagcagcctatctatgcgacgatctccgcaggcgtcgtaaacactatatttacactactcagcctgttcctggttgaaagggccggacggcggacactgcatatgatcggtttgggggggatggccttttgtagcacactgatgacggtatcactcctgctcaaaaaccactacaatggaatgtcattcgtatgcataggagctatcctggtgttcgtggcgtgttttgagattgggcccgggcccattccctggttcatcgtggctgagctgttcagtcaaggacccagaccagccgctatggcagtggctggatgtagtaactggaccagcaatttcctagtggggctgctttttccctcagcagcttactacttgggagcctacgtgttcattatctttactgggtttttaatcacttttctagcattcaccttctttaaggtccctgaaacacgagggcgcactttcgaagatataaccagggccttcgagggccaggcacacggcgccgataggtcaggcaaggacggagtcatggggatgaacagtattgagccagccaaggagaccacaacaaatgtttag

SEQ ID NO: 205705 - DNA, 1494 bp, Artificial Sequence
  Description of Artificial Sequence: Synthetic coding sequence
atggacaaccggcagaacgtgacccccgccctgatcttcgccatcacggtcgctacaattggatccttccaatttggctacaatacaggcgtgattaatgcccccgaaactattatcaaggaattcattaataaaactttgaccgataaggctaacgcaccaccgtcagaggtgttgctaacaaacctttggtccttgagcgtggctatttttagcgtcggcgggatgatcggctcattcagtgtcgggcttttcgttaatcgttttgggcggaggaactctatgctgatcgtaaacctcctggccgctaccggggggtgcctcatgggcctgtgtaaaatcgccgagtctgtggaaatgctcatacttggccggctggtcatcggtctattttgtggtctctgtactggcttcgtacctatgtacattggggagatcagcccaaccgccctgaggggcgcttttggaacactcaaccaactcggcatcgtcatagggattctggttgcacagattttcggactggagttgattctgggcagtgaagagctctggcccgttctgctggggtttacaatcctgccagccatcctgcagtccgccgctctcccctgctgtccagaatctccgcgctttcttctgatcaacaggaagaaggaagaaaatgctaccaggattctgcagcgattatgggggacccaggatgtgagccaagacatccaagagatgaaggatgaatccgcaaggatgtcacaggaaaagcaggttacggtgttggagctgttcagagtcagctcataccgacagcctattatcatttctatagttttacagctgtcccagcagctatcaggtatcaacgctgtgttctactactccaccggaatatttaaagacgccggggtgcaacagccaatctacgctaccatttccgccggtgtggttaatacgatttttacactgttgtcgctgttccttgttgagagagcaggtcgaagaaccttgcacatgatcggactcggagggatggccttttgctctacccttatgaccgtgagccttctactgaagaaccactacaacggaatgtccttcgtgtgcattggtgcaatcctcgtgttcgtcgcctgtttcgaaattggtcctggacccatcccatggttcatcgtcgctgagcttttttctcagggccctaggcccgccgctatggccgtggctggttgctccaactggacgtcaaactttcttgtaggcctgctcttccccagcgccgcttactatctgggggcctatgtgtttattatttttacaggctttttgataacctttctggcctttacctttttcaaagtcccagagacgcggggccgcacatttgaggatattacgcgagcattcgagggtcaggcccatggagctgaccgtagcggcaaggacggggtgatgggcatgaacagcatcgagcctgccaaagagactaccacaaatgtgtag

SEQ ID NO: 205706 - DNA, 363 bp, Artificial Sequence
  Description of Artificial Sequence: Synthetic coding sequence
atggagttccacaacggcggccacgtgagcggcatcggcggcttcttggtttctttaacatctaggatgaaaccccacactctggctgtgacaccagcgcttatatttgcgatcaccgtagcaaccataggaagcttccaattcgggtacaacacaggtgtgatcaacgcgcccgaaacaatcataaaagaatttattaataagacactgaccgacaaggcaaacgctcctcccagtgaagtattgctcaccaacctgtggtccctgagtgtggccattttttccgtgggcggaatgataggatcattcagcgtgggcctgttcgtgaacaggttcggaagaaggaactcaatgctgatctag

SEQ ID NO: 205707 - DNA, 1236 bp, Artificial Sequence
  Description of Artificial Sequence: Synthetic coding sequence
atgctgctgcggcggcggaacagcatgctgatcgtgaacctgctggcagccaccgggggttgcctgatgggcctgtgcaaaatcgccgagagcgtcgagatgcttatcttaggcaggttagtgataggtttgttttgtgggctgtgcaccggattcgtgcctatgtacatcggtgagatttctccgaccgctctccgaggggcattcggtaccctgaatcaacttggcatcgtgattgggatcttggtagcgcagattttcgggctggagttgattctggggagcgaagaactgtggccagtcttgctgggcttcactatcctgcccgccattctgcagagtgcagcacttccctgctgccctgaatctcctcgctttctgttaatcaaccgcaagaaggaggaaaacgctaccagaattctacagaggctttggggcacacaagacgtcagccaggacatccaagagatgaaggacgagtccgccaggatgagccaggaaaagcaggtgacagtcttggagctattccgggtttcttcctatcggcagccgattatcatctcaatagttctgcagctgagccaacagctgtctgggatcaacgctgtcttctactattcaactggcatcttcaaggatgcaggggtgcaacagcccatatacgctacaatcagtgctggagttgtgaacacaatcttcaccctcctgtccctatttctggttgagcgtgccgggagacggacactgcacatgataggactggggggaatggcgttttgcagtactctgatgacagtctctcttctgttaaagaaccattacaatggtatgtctttcgtgtgcattggggcaattctcgtttttgttgcttgtttcgagattggccccggaccgatcccatggttcatcgttgctgaactgttctcacagggcccgcgaccagctgcgatggcagtggccggctgttccaattggacaagcaacttcctcgtggggctgttgttcccatcggcggcatactacctaggggcatacgtgttcataatcttcaccgggtttcttattacgttccttgcgttcaccttctttaaggtgccagagactaggggcaggactttcgaagacattacacgagcatttgagggccaggcccacggcgccgacagaagtggtaaggacggtgtgatgggaatgaactcaatagagcctgctaaggaaacaaccacaaatgtttag

SEQ ID NO: 205708 - DNA, 426 bp, Artificial Sequence
  Description of Artificial Sequence: Synthetic coding sequence
atggacaaccggcagaacgtgacccccgccctgatcttcgccatcaccgtggccaccataggctcattccagtttggatacaacacaggggtaattaacgccccggagaccatcattaaggagtttattaacaagactcttaccgataaagctaatgcacccccaagcgaggtcctgctgaccaatctctggtccctatccgtggccatctttagcgttggcggaatgatcggttccttctccgttggactgttcgtcaaccgattcggccggcgaaacagtatgcttattgtcaatttgctggcggcgaccggaggctgtctgatgggcctgtgcaaaatcgcagagtccgtcgaaatgcttatcctgggccgcctcgtaatcggactcttctgcggcctctgtacgggttttgtaccaatgtag

SEQ ID NO: 205709 - DNA, 144 bp, Artificial Sequence
  Description of Artificial Sequence: Synthetic coding sequence
atggacaaccggcagaacgtgacccccgccctgatcttcgccatcaccgtggccacaattgggagcttccagttcggctacaataccggggtaatcaatgcccccgagactatcataaaggaattcattaataaaacactatag

SEQ ID NO: 205710 - DNA, 69 bp, Artificial Sequence
  Description of Artificial Sequence: Synthetic coding sequence
atggacaaccggcagaacgtgacccccgccctgatcttcgccatcacggtggccacaatcggctcgtag

SEQ ID NO: 205711 - DNA, 426 bp, Artificial Sequence
  Description of Artificial Sequence: Synthetic coding sequence
atggagttccacaacggcggccacgtgagcggcatcggcggcttcctggtcagcctgacctcacgtatgaagccccacactctagctgtcacaccggcactcatatttgccatcaccgtggcgactatcgggtctttccagttcgggtacaacacaggtgtgatcaacgcaccagaaactataatcaaagaatttattaacaagaccctcaccgataaagccaatgcaccccccagcgaagttctgttaaccaacttgtggtcattgtccgtggccatattctcggtcggggggatgattgggtcattctctgtaggtcttttcgttaacaggttcggccggcggaactctatgctgattgtgaatctgctggctgccaccggagggtgtctcatgggtctttgcaaaattgccgagtctgtgtag

SEQ ID NO: 205712 - DNA, 1608 bp, Artificial Sequence
  Description of Artificial Sequence: Synthetic coding sequence
atgcagcggctgcagctgctgcgggtggaggtgctgctgggcgtgaagcagggagacgagatgcgtcattttttcttcagctcacagaccagcaccctggagaaatcccagaacggcggagtgggcgaggaggtcacgccagctctcatatttgctataactgtcgcaaccataggctcctttcagtttggctacaataccggggtgatcaacgcccctgagacgattatcaaagaatttatcaacaagacattaacagacaaggctaatgcaccaccatcagaagtgctcctgaccaacctgtggtcactttccgtggcaatcttcagcgtgggcggaatgattggttcgtttagtgtagggctcttcgtgaatagattcggaagacggaattctatgcttattgtgaatctgctagccgctaccggaggatgcttaatgggactttgcaagatcgccgagagtgtggagatgctgattctgggtcgtctggtcatagggctgttctgcgggctatgcacgggtttcgtgccaatgtatataggcgagatctcccctacagccttacgcggagcattcgggaccctaaatcagctcggtattgttatcgggatcttagtggctcagattttcggtctcgaacttatcctgggttcagaagagctttggccggtattattgggattcacgatacttcccgccatcctgcagtccgccgccctcccgtgctgtcccgagtctccacggttcctccttattaataggaagaaagaagaaaacgccactagaatcctgcagcgactgtggggcacacaggatgtctctcaagacattcaggagatgaaggacgagagcgcccgtatgagtcaagaaaaacaagttaccgtgttggagctgtttagggtctcctcgtaccggcaacccataattatcagtatagtgcttcagttgtcccagcagttatcaggaattaacgcggttttctactattctaccggtatctttaaagatgctggcgtgcagcaacccatttacgcaacgatttctgcaggcgtggtgaacaccatctttacactgctgagtctgtttttggtggaaagggccggcaggaggaccctgcacatgataggactgggggggatggccttctgctccactcttatgacagtctcccttctgctcaagaaccactacaatggcatgtcatttgtatgcatcggcgcaatccttgtgtttgtggcttgtttcgagattggtccgggaccaatcccctggttcattgtggcggagctttttagtcaggggcctcgcccagcagccatggcagtggcgggctgcagtaactggacctccaacttcttagtcgggcttcttttcccctctgccgcatactacttgggggcatacgttttcatcatcttcacaggttttctcattacctttctggcttttacattctttaaggtgcctgaaacaagggggcgtacttttgaggatattacacgagcctttgagggacaggctcacggggcagaccgatcaggaaaagatggggtgatgggcatgaattcaatcgagcctgcaaaggagaccacaaccaatgtctag

SEQ ID NO: 205713 - DNA, 486 bp, Artificial Sequence
  Description of Artificial Sequence: Synthetic coding sequence
atgatcggcctgggcggcatggccttctgcagcaccctgatgaccgtgagtctattgcttaagaaccactacaacggcatgtctttcgtctgcatcggcgccatcttggtcttcgtagcctgcttcgaaattggacccggtccaatcccttggtttatcgtggccgagttgttctcccaaggtccgagacctgccgcaatggctgtggccgggtgttctaattggacgagcaatttcctggtgggcctactcttccccagtgccgcctactatctgggtgcctacgttttcatcatttttacaggctttctcataacattcctggcatttactttttttaaggttcctgagacaaggggacgaacattcgaagacatcacgcgggccttcgaaggccaggcccatggcgccgaccgatcaggaaaggacggagttatgggaatgaacagtattgaacctgcaaaggaaacaaccactaacgtctag

SEQ ID NO: 205714 - DNA, 1236 bp, Artificial Sequence
  Description of Artificial Sequence: Synthetic coding sequence
atgctgctgcggcggcggaacagcatgctgatcgtgaacctgctggctgctacaggaggatgcctcatggggctgtgcaagatcgcagaaagtgttgagatgctcatactgggaagactcgtgatcgggcttttctgcggactgtgcaccggattcgtcccaatgtatatcggtgagataagccctacagccctgagaggggcctttgggaccttaaatcagcttggtatagtaattggcatcctcgtggcacagatttttggcctggagttgattctcggctccgaagagctgtggccagtgttgctcggattcaccattctgcccgccatattgcagtccgctgctctgccctgttgccctgagagccctcggttcttgctaatcaaccgaaaaaaggaggagaacgcaactcgcatcttacaacggttgtggggaacccaggatgtatctcaggatattcaggaaatgaaggatgaaagcgcacgtatgtcacaagaaaagcaggtgaccgttctggaattattccgagtgtcctcttacagacagccaattattatttcaatcgtcttacagttgtctcaacagctgagcggaatcaacgcggttttctactacagtaccggcattttcaaagatgccggcgttcagcagccaatttacgctacgattagcgccggcgtagttaataccatctttactttactttctctgttcctcgttgaacgtgccggccgccggaccctgcacatgatcgggctgggaggcatggctttttgctctacgttgatgacagtgagtttactgctgaaaaaccattataatgggatgagcttcgtgtgcattggtgcaatcttagtgttcgtcgcatgctttgagataggccccggcccgattccctggtttatagtagcagaattattttcccagggccctcgcccggctgccatggctgtcgcgggctgctctaattggacaagcaattttctcgtcgggcttctgttcccttcagctgcttactacctgggcgcatatgtcttcataattttcactggttttcttattaccttcttggccttcacgttctttaaagtccccgagactcgaggcaggacttttgaagacataacccgcgccttcgagggccaggcacacggtgccgacagatcaggtaaagacggcgtgatgggcatgaatagcattgaaccagctaaggagacaactacaaacgtctag

SEQ ID NO: 205715 - DNA, 459 bp, Artificial Sequence
  Description of Artificial Sequence: Synthetic coding sequence
atggacaaccggcagaacgtgacccccgccctgatcttcgccatcaccgtcgcaacaatcggatctttccagtttggttacaacacaggggttatcaacgcccctgaaaccatcattaaagaatttatcaacaaaacgctcacggataaagccaatgcccccccatccgaagtgctcctgaccaacctgtggtccctgtccgtagcaatttttagcgtagggggcatgataggatctttctctgttggcttattcgttaacagatttggaagacggaacagcatgctaatcgtcaacttgctcgctgcgactggtggttgcttgatgggcctgtgtaaaatcgccgagagcgtggagatgcttattttaggtagattagtgatcggcctgttctgcggactctgtacaggatttgttccaatgtatattggcgagatttccccaacagctctgagatag

SEQ ID NO: 205716 - DNA, 255 bp, Artificial Sequence
  Description of Artificial Sequence: Synthetic coding sequence
atggacaaccggcagaacgtgacccccgccctgatcttcgccatcaccgtcgcaaccattggatctttccagtttgggtacaacacaggggtgattaacgcccccgaaacaatcatcaaagagttcatcaacaagacgctcaccgataaagccaacgctcccccttcggaggtgctgctcactaacctgtggtccttgagcgtggcaatctttagcgtcggcggaatgattggaagcttttccgtgggactgtag

SEQ ID NO: 205717 - DNA, 1563 bp, Artificial Sequence
  Description of Artificial Sequence: Synthetic coding sequence
atggagttccacaacggcggccacgtgagcggcatcggcggcttcctcgtctccttgacttctcgtatgaagccccacaccctcgccgtaacccccgctctcatttttgccataacagtggccaccatcggctcttttcaatttgggtataataccggcgtaattaatgccccagagactattattaaggaattcatcaacaagacgctaaccgacaaggccaacgcaccaccatcagaagtcctcctgactaatttgtggtctctctcagtcgcgatattctccgtaggcggcatgataggcagcttttcagtaggtcttttcgtaaaccgtttcggcaggagaaacagcatgttgatcgtaaatctcctggccgccacaggggggtgcttaatgggcctgtgtaaaattgcggagtccgtcgaaatgctgattttggggaggctggtgattggactgttctgcggactctgtactgggttcgtaccaatgtatatcggagagattagcccaacagccctgcggggcgcgttcggcacactgaaccagttaggaattgtcatcggcattctggtggcccagatttttggcttggaattaattctgggctccgaggagctgtggccagtcttactgggatttaccattctccccgcaatcttgcagtccgcagcccttccttgttgccccgaaagtccaaggtttcttttgattaaccgcaagaaggaagaaaacgcaacaaggattttgcagcgactttggggcacacaggacgtcagtcaggatatccaagaaatgaaggacgaatctgcgaggatgtcccaggagaagcaggtgacagtgctagagctcttcagagtctcctcttataggcaacctatcattatttccattgtactgcaactgtcacagcagctatcagggataaacgccgtattttactatagtactgggattttcaaggacgcaggcgtacaacaacccatttacgcaacgataagtgcgggcgtggtcaacaccattttcaccttactcagcttgtttctcgtcgagcgggctgggcgccgtactctccacatgatcggacttggcgggatggcgttttgttccactctgatgacggtatccctgttacttaagaaccactacaacgggatgtcttttgtttgtatcggggcgattctagtctttgtcgcctgtttcgagatcggaccggggcctatcccatggttcatcgtagccgaactgttcagccagggaccaaggcccgcagctatggctgtcgcgggttgcagcaattggacttccaatttcctagtcggactgctgttcccttcggctgcatactacctgggtgcttatgttttcataattttcacagggttcttgatcacgttcctggcattcacattcttcaaagtgcccgagacaagaggacggactttcgaggatatcacccgtgccttcgagggccaggcccatggagccgacaggtctgggaaagacggggtcatggggatgaattcaattgaaccagcgaaggagacaaccacaaatgtgtag

SEQ ID NO: 205718 - DNA, 510 bp, Artificial Sequence
  Description of Artificial Sequence: Synthetic coding sequence
atggacaaccggcagaacgtgacccccgccctgatcttcgccatcacagtcgccaccatcggatccttccagttcgggtacaacacaggggtaatcaacgcaccagaaaccatcatcaaggaattcataaacaaaacccttacagataaagctaacgcgccaccatctgaagtattgttgaccaacctctggtctctctctgtggcaattttcagcgtcgggggcatgatcggctctttctctgtgggtctatttgttaatcggtttggccggagaaactctatgttaattgtcaatcttttggctgctactggcggctgcctgatgggactttgcaaaattgccgaaagtgtggaaatgctgatacttgggcggctggtcattggactgttttgcggcctgtgtaccggatttgtgcctatgtatatcggcgagatttcacccaccgcgctgagaggggcctttggaacactcaaccaactcggcatcgttatcggcatcctggtctag

SEQ ID NO: 205719 - DNA, 1491 bp, Artificial Sequence
  Description of Artificial Sequence: Synthetic coding sequence
atgggcacccagaaggtgacccccgccctgatcttcgccatcaccgtggcaaccattggaagtttccagtttgggtataacaccggggtcatcaatgcgcccgagaagattatcaaggagttcataaacaaaactttaacagataaagggaacgcccctccgagtgaggtcctgctgacatctctgtggtcattgtccgtggccatcttttctgttggtggcatgataggctctttctccgtgggattgtttgtgaataggttcggcaggcgcaattcaatgcttatcgtgaatctcctggcagtgaccggaggctgctttatgggcctgtgtaaagtcgcaaagagcgtggagatgctgatcttaggacggctggttatcggcctgttctgcgggctctgcacggggtttgtgccaatgtacatcggggagatttcccctacagccctgaggggcgcgtttggcacattgaaccagctcggaatcgttgtcggcatactggtcgcccagatctttggactggagttcatcctgggatcagaggaactctggccattactactgggtttcaccattctgcccgcgatcctgcagtcggctgccttgccattttgtccggagtctcctcggttcctgttgattaaccggaaagaggaagaaaatgccaagcagattctgcagcgattatgggggacacaggatgttagtcaagatatccaagaaatgaaagacgagtccgctcgcatgtcgcaggagaagcaagtcaccgtcctcgagttgttcagagtgtcctcttacagacagcctatcattatcagtattgttttacagcttagtcagcagctgagtggcatcaacgcagtgttttactacagcactgggatcttcaaggacgctggggtgcaggaacctatctatgcaaccatcggagccggggttgtgaatacaattttcaccgtggtctcccttttcctggtggaacgggctggccggcggacactccatatgataggacttggcggaatggctttttgctcaacccttatgaccgtgagcctcctgctcaaagacaactacaatgggatgtcatttgtatgcataggggcaatcctggttttcgtcgcgtttttcgagatcgggcctggtcccattccctggttcattgtcgccgaactgttctcacaagggcctcggccagccgctatggcagtagccgggtgctccaattggacttccaattttctagtgggcttgcttttcccatctgccgcacactacttaggggcttacgtgtttatcattttcacaggcttcctaatcacattcctggcctttaccttcttcaaggttcccgagacgagaggaaggacatttgaggacatcacccgcgctttcgaagggcaggcccatggggccgataggtctggtaaggatggggtgatggagatgaactctatagaaccagcgaaagagaccaccacaaacgtgtag

SEQ ID NO: 205720 - DNA, 1269 bp, Artificial Sequence
  Description of Artificial Sequence: Synthetic coding sequence
atgatcggcagcttcagcgtgggcctgttcgtgaaccggttcggccgaagaaatagtatgctgattgtgaacttactagctgttacaggcgggtgcttcatgggcttgtgtaaggttgcaaagtccgtggaaatgctgatcctcggcagacttgtgattggtcttttctgcggactttgcactgggttcgtccctatgtacatcggggagatttcccctacagccctccgaggtgcgttcggcactctgaaccagctcggaatcgttgtggggatcctggttgctcagattttcggccttgaattcatcctgggcagtgaggagctctggcctttgttgctcggatttactattctgcccgccatactgcaatccgccgccctgcctttttgtccagagtcgccgcgctttcttttgattaaccgcaaggaggaggagaatgcaaagcagatcctacagaggctctggggtacccaggacgtgagccaagacatccaagaaatgaaggacgaaagcgccaggatgagccaggagaagcaggtcaccgttttagagttgttccgtgtcagttcgtatcgccagcccattattatttccattgtattgcagctctctcagcaattatctggcattaatgcagtcttctactacagtaccggaatattcaaagacgcaggtgtgcaggagcctatctatgccaccatcggggcaggggtggttaatacaattttcactgtagtcagtttgttcctggtggagagagctggaagacggacactgcacatgatcggacttggcggtatggccttctgttccactctgatgacggtgtcactcctgctcaaagacaactataacggtatgtccttcgtatgcatcggcgccattctggtcttcgtggctttctttgagatagggcccggcccaatcccatggtttattgtggctgagttattcagtcagggccccaggcctgccgccatggccgtggcgggttgttctaactggacgagcaactttctggtcggcttgctgtttccctcagccgctcactacctcggggcctacgttttcattatcttcacaggttttctgattacatttctggccttcaccttctttaaagtccccgagacacgcggacgaacattcgaagacattacccgggcatttgagggtcaggcccacggagcagaccgctccggcaaggacggcgtcatggagatgaactctatcgagcccgctaaggagaccactacaaatgtctag

SEQ ID NO: 205721 - DNA, 1530 bp, Artificial Sequence
  Description of Artificial Sequence: Synthetic coding sequence
atgcccagcggcttccagcagatcggcagcgaggacggcgagcccccgcagcagcgggtcaccgggacgttggtgctggccgtgttcagcgctgtcctgggatcgctccagttcgggtacaacataggagtcatcaatgcaccccagaaggttatcgagcagtcatataacgagacttggcttggtaggcaggggccagaagggccctccagcataccacccggcacactgactacattgtgggctttaagcgtggctatcttcagtgtcggcggaatgatctctagctttctcattggtataatcagccagtggctggggagaaaacgggccatgctggtcaacaacgtacttgcagtccttggcgggtccctgatgggccttgcgaacgcggccgcttcctacgaaatgctcattctgggcaggttcctaattggcgcatactccggactaacaagtggtctggtgcccatgtacgtgggcgagatcgcccctacacacctacgtggtgcgctgggaactctgaaccaattggcaatcgtcattggcatcttaatagcgcaggtcctgggcttggagtctctgctgggcaccgcctcactgtggccactgctgctgggtctcacggtactgcccgctctcctgcaacttgtgctgttacccttttgccctgagagtcccaggtatctctacattattcaaaacctcgaagggcctgctcggaaatccctgaaacggctcacgggctgggccgatgtttctggagtgcttgctgagcttaaggacgaaaagcgaaagttggaacgggagcggcccctgagcctgttgcagctcttgggatctcgtacccaccgacaacccttgattatcgcagtggtgcttcagctgtctcagcagctctctggcattaacgctgtgttctattacagcacttctatcttcgaaaccgccggggtaggccagcctgcttatgcaacgatcggggccggtgtcgtgaatactgtgtttaccctcgtctctgtgttgttagtggaaagggctggtcggcgcaccctccatctcctcgggctggccgggatgtgtggttgcgccatcctcatgaccgtggctctccttctgcttgaacgagtgcccgccatgtcttacgtgtctattgtcgcgatcttcggcttcgtagcttttttcgagattggccctggacccataccatggtttatcgtggccgaactgttcagccagggacctaggccagccgctatggcagtggctggtttttccaattggaccagtaattttatcataggtatgggattccagtacgtggccgaagcaatgggaccatatgtgtttctcttattcgctgtgctgctgctgggcttctttattttcacatttctgcgagtgccggaaacacgcgggcgtacatttgatcaaatttctgcagcttttcatagaacccctagcctcctggagcaagaggtgaaaccctccaccgaattggagtatcttgggcctgacgagaacgattag

SEQ ID NO: 205722 - DNA, 1356 bp, Artificial Sequence
  Description of Artificial Sequence: Synthetic coding sequence
atggacggcgagcccccccagcagcgggtgaccggcaccctggtgctggccgtttttagcgccgttctgggatcactacagttcggatataatattggagtaataaatgctcctcaaaaggtcatcgaacagagttataacgaaacctggctgggccggcaggggcctgaaggccccagtagcattccaccgggaacactgaccaccttatgggcgctcagtgtggccatcttctcagtcggcggaatgatatcctctttcctcattggcataatatcccagtggcttggccggaagagagccatgctcgtcaataacgtgctggctgtgttggggggaagcctgatgggcctggctaatgcggccgcttcctacgaaatgttgatactcggcaggtttctcatcggtgcctactcaggactgacctcaggacttgtacccatgtatgttggcgaaatcgcccccacgcacctccggggagctctggggacactgaaccagctggccatcgtgattggcattttgattgcccaggttctgggactggaatctctgttgggtaccgccagtctctggcctcttttgcttgggctaaccgtgctcccagccctgttgcaacttgtgttgctgcccttttgtccagagtcccctcggtacctttatatcatacaaaatttagaaggtcccgctcgcaagtcgctaaaacggctgaccggctgggccgacgtctcaggtgtgcttgcagagttaaaggatgagaaaagaaagcttgaaagagagagaccactgtccctcctgcaattactgggttccaggacgcacagacagcctttaatcatcgcggtggtgctgcagctctcacaacagctgtcgggtattaatgctgtcttttactatagcacatcgatcttcgagactgctggggtcgggcaacccgcatatgctactattggagcaggggtggtgaacaccgtttttacactggtttccgtacttcttgtggaaagagctggccgacggacactccacctgctgggcctcgcaggtatgtgtggatgtgcaatcttaatgaccgtcgcgctgctactgctagaacgtgtgcctgctatgagctatgtgtccatcgtagcaatcttcgggtttgtggcctttttcgagatcggacctggaccaatcccctggttcatcgtcgcagaactgttcagccaggggccccgtcccgctgcaatggcggtggctggtttctccaattggacaagcaatttcattatcggaatgggcttccagtatgtggcagtgggacctccagctcccgcgtcacacacagtgggacagaggtgggctagccatagttag

SEQ ID NO: 205723 - DNA, 1338 bp, Artificial Sequence
  Description of Artificial Sequence: Synthetic coding sequence
atgcaggagcccctgctgggcgccgagggccccgactacgacacctttccagagaagccacctccatctcccggggatagagctcgagtaggaactctgcagaacaaaagagtctttctcgcgactttcgccgccgttttgggcaatttttcgttcggatacgccctggtgtacacatctcctgtgattccggccctggaacgatctttggatccagatctgcatttaactaagtcacaggcttcctggttcgggagcgtatttactctcggcgcagccgcaggtggcctctccgcaatgatactcaacgatctgctcggacgaaagttgtcaatcatgttctctgccgttccctctgctgcaggctacgccctcatggctggggcccacggcttgtggatgctcctgttaggccggactctgaccggattcgcaggtggtctgaccgccgcttgtatacctgtgtacgtgtcagagattgcccccccgggggtgaggggagcgctgggtgcaaccccccaattgatggctgttttcggttcgttatcattgtatgctctcggccttctcctgccatggcgatggctggccgtggctggcgaagctccagtcctcatcatgatccttttgctgtcatttatgccaaactctccgcgattcctgctaagccggggccgagatgaggaagcactcagggcattagcatggctgagaggcactgatgtcgacgtccactgggagtttgagcagatccaagacaacgttagaaggcagagttcaagagtgtcatgggcggaggcacgagctcctcacgtttgtcggcctattactgtcgctctccttatgcgactcctccagcagttgacaggcattacgcctatcctggtgtacctccagagtatttttgatagtaccgcggtgctactgccgcctaaagacgacgcggctattgtgggagctgtgagattattatctgttttgatagccgccctgacaatggacctcgcaggacgaaaagttctgctcttcgtctccggatacgcagtgggatggggcccaattacgtggttgctgatgagcgaagtgctccccctcagggccagaggagttgcctcaggactatgcgtgttagctagctggctcaccgcattcgtgctcaccaaatccttcctgcccgtggtgagtactttcggtctgcaagttcccttcttcttttttgcagcaatttgcctcgtgtccctcgtcttcactggctgctgtgtgcccgaaacaaaggggcgtagccttgaacagatagagtcattcttcagaacaggccgtagatcttttctccgctag

SEQ ID NO: 205724 - DNA, 1524 bp, Artificial Sequence
  Description of Artificial Sequence: Synthetic coding sequence
atgcaggagcccctgctgggcgccgagggccccgactacgacacctttcctgagaaaccgcctccctctccgggcgacagggcacgagttgggaccctgcagaataaacgtgtcttcctggctaccttcgctgcagtgctcggtaacttttcattcggctacgctctagtttacacttcacctgtgattcccgctctagagaggtcgcttgaccctgaccttcacctaacgaagagccaggctagttggtttgggagcgtgtttacacttggcgcggcggccgggggcctcagtgcaatgattctgaacgatttgctgggccgtaagctttccatcatgttttccgctgtgccttccgcagcaggctacgctttgatggcgggtgcacatggtctgtggatgctactcctggggaggactttaaccggattcgccggcggtcttactgctgcatgtatacccgtatacgtgtccgagatcgctccacccggcgtccggggtgccctgggggctaccccccagctaatggctgtgtttggaagcttaagcttatacgctttgggacttctcctcccttggaggtggcttgcagtcgctggggaagcccctgtcctgattatgatcctcctgttgtcttttatgcccaactctccacggtttcttctcagtcgcggaagagacgaagaggctctgcgggccctggcatggctccgggggacagatgtagacgttcactgggaattcgagcaaattcaggataatgtgaggaggcaatccagcagggttagctgggctgaggcccgggccccccatgtttgcagaccaattaccgtggcgcttctgatgcgcctacttcagcagttgaccggtattacccccattcttgtttatttacagagcatcttcgacagcaccgcggtgctgctgcccccgaaggatgacgcagccatcgtcggcgctgtgcggctgctctcagtgctgatcgccgccctgacgatggatctggccggcagaaaggtgctcctgtttgtgagcgccgcaatcatgttcgctgccaaccttacactcggactgtacatccactttggtcctagacccctcagccccaactcgaccgccggcctggagtctgaaagctggggggatctggcccagcccttggcggctcctgcaggatacctcactctcgtcccattgctggctacgatgctctttatcatgggctatgcggtcgggtgggggcctatcacttggctgttgatgtctgaggttcttccactgcgcgctagaggtgtcgcctccggtctgtgcgtgctggcttcatggttgactgcatttgttctgacaaaaagcttcttaccagtggtttccacgttcggactccaggtgcctttttttttttttgccgccatttgcctcgtttctcttgtgttcaccggttgctgcgtacctgaaacaaaaggaaggagtctggaacagatcgaaagcttcttccgcaccggccggaggagcttcttgagatag

SEQ ID NO: 205725 - DNA, 441 bp, Artificial Sequence
  Description of Artificial Sequence: Synthetic coding sequence
atgatcctgaacgacctgctgggccggaagctgagcatcatgttctccgctgtgcctagcgctgcgggctatgcccttatggcaggggctcacggcttatggatgctgctcctcgggaggacactaacaggttttgccggcggactaacagcagcttgtattcctgggctgactctgccttcccggcctggcctcggtacctccatcttttctaaaacgtggtgcggggggtgcgtacttcaggtttacgtatccgagatagcaccaccgggcgtgcggggggctctcggagcgactccccaattgatggcggtgtttggcagcctctccctttatgcactagggaaggacgaggaggccttgcgggccctcgcgtggttacgcggaactgacgttgacgtgcactgggagttcgaacagatccaggacaacgtcagatag

SEQ ID NO: 205726 - DNA, 660 bp, Artificial Sequence
  Description of Artificial Sequence: Synthetic coding sequence
atgcaggagcccctgctgggcgccgagggccccgactacgacacctttcccgagaagcctccgccatcccccggcgaccgagctcgagtgggaacactgcagaacaagcgtgtgttcctggcaaccttcgccgccgttctgggcaatttcagcttcggatacgccctggtttatacttcgcctgtgattcccgccctggaacggagcttggaccccgacctccacctgaccaagtcacaggcgagttggtttggaagtgtgtttactctaggtgctgcagccggcggcctgagtgctatgattctcaacgacctgctgggtcgaaaactgtctatcatgttttctgctgtgccttccgccgccggatacgcactaatggctggcgcccatgggctgtggatgctcctgctgggaagaacgttgactggattcgccggaggcctgacagccgcttgcatccccgtatatgtaagtgaaatcgctccgccaggcgtgcgaggagcattgggcgccacaccccagctgatggccgtattcggctctctgtctctgtatgccctgggcacgaagaggccatgtggccgttggcctggttgcgtgggacgtacttccatgagcacggggtcaagctcacgttctcgtacaacaagcggagactag

SEQ ID NO: 205727 - DNA, 1539 bp, Artificial Sequence
  Description of Artificial Sequence: Synthetic coding sequence
atggagaacaaggaggccggcacccccccccccatccccagccgggagggcaggctccagcctactcttctccttgcaaccctcagcgctgcatttgggtccgccttccagtacggatacaacctaagtgttgtgaacaccccacacaaggtgttcaagagtttctacaatgaaacgtactttgagaggcatgcgacattcatggacgggaagctgatgctcctattatggtcctgcaccgtgagcatgtttcctctgggaggactgttgggttccctgttggtgggcctgctggtcgatagctgtggccggaaaggcaccctactgataaacaacattttcgccataatccctgcaatcctaatgggcgtgtcaaaggttgcaaaggctttcgaactgatcgtgttctccagggtggtactaggcgtttgcgccggtattagctactcagcactccccatgtacctgggtgaactggcacccaagaacttgagaggaatggtgggcaccatgaccgaggtgttcgttatagtgggtgtattcctggctcagatattttccctccaggcaattctcgggaatcccgctggctggcccgttctactcgcactgaccggggtccccgcacttctgcagcttttaacccttcctttttttccagaatcgcctagatactccttgattcagaagggagatgaagcgacagcccggcaggccctgaggagactcagagggcatacagacatggaagccgaactggaggacatgagagctgaggcacgggccgagagagctgagggacatctgagcgtcttgcacctgtgtgccttgaggtctttacggtggcagttgttgagcattatcgtactcatggcgggccaacagttaagtggtattaacgctataaattactatgctgacaccatttacacatctgcaggagtcgaggcagcacactctcaatatgttactgtgggatccggcgttgtgaacatagtgatgacaatcactagcgctgttctggtagagaggcttggccgacggcatctcctgttagccggttacggtatctgcggctctgcttgtctggtgctgacagtggtattactgtttcagaacagagttcccgagctgtcttatttagggataatttgtgttttcgcttacatcgccggccatagtatcgggcctagccctgtgccctctgtcgtcagaaccgagatttttctgcagagctcccggcgtgccgcttttatggttgacggagcagtacattggctcacaaacttcattattggcttcttattcccgtctattcaggaggccatcggagcatacagcttcattattttcgctggtatttgcttgcttaccgccatatacatctatgtagtgataccagagaccaagggtaaaaccttcgtggagataaaccgaatcttcgcaaagcgaaatagggtgaaactccctgaagaaaaggaggaaacaatcgatgccggacctccaaccgccagcccagcaaaagagacgtccttctag

SEQ ID NO: 205728 - DNA, 804 bp, Artificial Sequence
  Description of Artificial Sequence: Synthetic coding sequence
atgacctgcagcctgggcaaggtgtacatcagcgagatcgcctaccctgctgtgcgcggcctcctgggatcatgcgtccaactgatggtggttgtaggaatcctgcttgcctatctggctggttgggtgctggagtggcgctggctggcagtcctgggatgtgtgcccccttccttgatgctgctgctgatgtgcttcatgccagagacgcccagatttttgcttacccagcatcgacgtcaggaagctatggccgcgttgaggttcctgtgggggtcagaacagggctgggaggatcctccaatcggagccgaacagagttttcatcttgctttactgcgtcagccaggtatatataaaccgtttattattggagtgagtttgatggccttccagcaactctccggcgtcaacgcagtgatgttttacgctgagaccatttttgaagaagccaagtttaaagatagcagcctggcgtctgtggtagtcggggtgatccaggtgctattcaccgccgtcgcggccttgataatggatcgcgccggtcggagattactgttagtactgtccggtgtcgtgatggtcttttccacctccgccttcggcgcctactttaagctcactcagggcggtccaggcaattccagccacgtggccatctctgctccagtgagcgcacagccagtcgatgcctccgtgggacttgcatggctcgccgtgggcagcatgtgtctgttcattgccggcttcgcggtggggtgggggcccataccatggctgctaatgtcggaaattttcccgtag

SEQ ID NO: 205729 - DNA, 645 bp, Artificial Sequence
  Description of Artificial Sequence: Synthetic coding sequence
atggccttccagcagctgagcggcgtgaacgccgtgatgttctacgcagagactattttcgaggaagcaaaattcaaagactcatccctcgcgagtgtggtggttggggtcatccaggtcctgtttaccgcggtcgcagctctgattatggaccgcgctggcagaagactcttgttagttttgtccggcgtggtgatggtttttagcacaagcgcatttggcgcttatttcaagttaactcagggcggcccaggaaactcctcccacgtggcgatttccgcccctgtttccgcccagccagtcgacgcgtctgtgggcctggcgtggttggctgtgggcagtatgtgcttatttatagcgggatttgcggtcggatgggggccaatcccatggctgctcatgtctgagatcttccccctccacgtcaaaggggtggctactgggatctgcgtgttaacgaattggttaatggcttttctggtgacaaaggaattctcatcattaatggaggtgctccggccctatggcgcattttggctggctagcgcattttgcattttttctgtccttttcacactgttttgtgtgccagaaactaaggggaagacactggaacagatcaccgctcacttcgagggacggtag

SEQ ID NO: 205730 - DNA, 1236 bp, Artificial Sequence
  Description of Artificial Sequence: Synthetic coding sequence
atgacccccgaggaccccgaggagacccagcccctgctgggcccccccggaggtagcgcgcccagaggaaggcgggtctttctggctgcattcgccgccgctttgggcccactgtcttttggctttgccctgggctatagctctccagccattccaagcctccagcgagctgccccaccagctccccgattagatgacgcagccgcatcatggttcggtgctgttgttaccctcggtgccgctgctgggggagttttgggtggatggctcgtggaccgcgccggtcggaaactttcactgctcctgtgttcagtgccctttgtagccgggtttgccgttatcaccgctgcccaggatgtgtggatgcttctcggtggccgtctcctgactgggttagcctgcggtgtggcgagccttgttgctccagtctacatttcagaaatcgcctatccagctgtgcgggggctcctggggagttgcgtccagctgatggttgtggtgggtattctcctggcctacctagccgggtgggtgctcgagtggcgctggctcgccgtgttgggctgtgtacccccttcactgatgttactcttaatgtgtttcatgcccgagacacctcggttcctgttaacacagcatcgcagacaggaggccatggccgcactcagatttctctggggctcagagcaggggtgggaggaccctccgattggagccgagcagtcctttcatctagctctcctcaggcagcctggcatttataagccttttatcataggggtgtctctgatggcgttccagcagctctcaggcgtgaatgcggtcatgttctatgccgagacaatatttgaagaggcaaagtttaaggatagctctctggcgtcagtcgttgttggtgtgattcaggtgcttttcaccgcggtggctgccttaattatggatcgagccggaaggcgattgttgcttgttttgtcgggtgtggtgatggtgtttagcactagcgcctttggcgcatatttcaagctgacccagggaggtccaggaaactccagtcatgtggcaatcagcgcacccgtgagtgcacagccggtggacgcttccgtcggactcgcttggcttgccgtaggcagcatgtgcttgttcattgcaggcggcccccaggccttatggtctctcctggcttgcctgagatttttgcaccttcagtgcccttttcactttgttctctgtccctag

SEQ ID NO: 205731 - DNA, 1434 bp, Artificial Sequence
  Description of Artificial Sequence: Synthetic coding sequence
atgacccccgaggaccccgaggagacccagcccctgctgggcccccctggaggctcggctcccagaggacgccgcgtctttttggcggcctttgcagccgcattgggcccactgagcttcggcttcgcactggggtattcttcgccagccataccaagtctgcagcgcgctgcccctcccgcacccaggctagatgacgccgctgcctcttggtttggcgctgtggtgacactgggagccgccgcaggcggggttttggggggctggctggttgaccgcgccggacgaaaattgtctctcctgttgtgttcggtaccattcgtggccgggttcgctgtgatcacggctgcccaggacgtttggatgttgctagggggcaggcttctaacagggcttgcctgtggggtagcctccctggtggcccctgtgtacattagcgagatcgcttaccctgccgtgcgcggtcttttaggctcttgtgttcagcttatggtagtcgtgggtatcctcctggcctatctggctggttgggtgcttgagtggagatggcttgctgtgctgggatgcgtgccaccgtcattgatgctactcctgatgtgtttcatgccagaaacacctagattcttgctgactcagcatcgacgccaggaagctatggcggcattgaggttcctgtgggggagtgaacagggttgggaggaccctcccattggagcggagcaatcattccatctggccctgttacggcagccgggcatttataagccatttataattggcgtcagtctgatggccttccagcagctttcaggagtaaacgcggttatgttttatgccgagacaattttcgaggaggccaagtttaaggactcttcactagccagtgtggttgttggagttatacaagtactgtttactgctgtggctgccctgattatggatagagctggacgaaggctgcttctggtgctttcaggggttgtaatggtattttctacatccgccttcggtgcatacttcaagctgactcagggtggcccaggaaattcttctcatgtggctatctccgctccagtcagtgctcagccagtcgatgcctccgtcggacttgcatggttggcggtggggtctatgtgcttgtttattgccggtttcgctgtgggatgggggcccataccttggttgctgatgagtgaaatctttccactccatgtgaagggcgtcgcaactgggatctgcgtcttgactaactggttgatggccttcctggtgaccaaagagtttagcagtttgatggaagttttgcggccttatggtgccttttggctcgctagcgccttctgcatcttttccgttctgttcacactattttgtgtgccggagaccaaggggaagactctagaacagattactgcgcacttcgagggcagatag

SEQ ID NO: 205732 - DNA, 510 bp, Artificial Sequence
  Description of Artificial Sequence: Synthetic coding sequence
tgaggccggcgggtgttcctggccgccttcgccgccgccctgggccccttaagtttcggtttcgctctcggttacagctctcccgctatccccagcctgcagagggctgccccaccagctccgaggctggacgatgcagcagcgagctggttcggggtgtacatatcagaaatcgcctaccctgcagtcaggggcctcctcggtagctgtgttcagctgatggtagtggtgggcatccttctcgcttatctggccggatgggtgttagaatggcgctggctggctgtactcggttgcgtgccaccctccttgatgttgctcctgatgtgctttatgcctgagacacctcgctttttgcttactcaacacagaaggcaagaggctatggcagctctgcggttcttgtggggcagcgaacagggatgggaagacccgccaatcggcgcggagcagcagctgagcggcgtgaatgctgttatgttctatgcagaaaccatcttcgaggaatag

SEQ ID NO: 205733 - DNA, 771 bp, Artificial Sequence
  Description of Artificial Sequence: Synthetic coding sequence
atgacccccgaggaccccgaggagacccagcccctgctgggccccccgggcggaagtgcccctagagggagaagggtgtttctggctgctttcgctgctgctttagggcccctgagcttcgggttcgctttgggctactcatctccagctattccatcattgcagcgggcagcacctccagcccctcgactggacgatgccgcagcttcctggtttggagtatacatctccgagattgcctatccagctgttcgtggcctactgggttcgtgcgttcagctgatggtggttgtcgggatactgctagcttatttggccggatgggtcctcgaatggcgttggcttgctgttttagggtgtgtacccccgagcttgatgctgctgctgatgtgcttcatgcccgaaactccccgctttttgctcacccagcatcgcaggcaggaggccatggctgctctgagattcctctggggttctgagcagggatgggaggacccacctattggtgccgaacagagcttccacctcgccctgttacggcagcctggaatttacaagcccttcataatcggcgtgagtctgatggctttccagcagctgagcggggtgaacgcagtgatgttttacgccgaaaccatcttcgaggaagccaagttcaaggactcctccttggcaagtgttgtcgtaggcgtgatccaggtcctctttacagccgttgccgcactgattatggaccgagcgggaaggcgtctgctgcttgtgttgtcttag

SEQ ID NO: 205734 - DNA, 804 bp, Artificial Sequence
  Description of Artificial Sequence: Synthetic coding sequence
atgacctgcagcctgggcaaggtgtacatcagcgagatcgcctacccggcagtccgtgggctgctgggcagctgtgtgcaactgatggtcgttgttggcattctcctggcttaccttgctggatgggtgctggaatggaggtggctggcagtgcttgggtgcgtgccgccctccttgatgctgctactcatgtgttttatgcctgaaacaccccgattcttactgacacagcaccgaagacaagaggcaatggctgccttgaggtttttatgggggtctgagcagggctgggaggaccctcccataggcgccgagcagtcattccacctggctcttttgagacaaccaggaatctacaaaccgtttatcattggtgtcagtttgatggccttccagcagttgagtggcgtcaacgccgtcatgttctacgccgaaacaatatttgaggaggccaaattcaaggattccagtctggcgtccgtggtcgttggcgtgattcaggtcctgtttactgcagtagcagctctcatcatggatagagctggacggagactgctcctggtgctttcaggagtcgttatggtcttttcaactagcgcctttggagcttactttaagttgacccaaggggggccaggcaatagttctcatgtcgctatcagcgctccagttagtgcacagcctgtggatgccagcgttggcctggcatggctggccgtgggttcgatgtgtctgttcattgctggctttgctgttggatgggggccgattccttggctcctgatgtcagagatcttcccctag

SEQ ID NO: 205735 - DNA, 831 bp, Artificial Sequence
  Description of Artificial Sequence: Synthetic coding sequence
cagctgatggtggtggtgggcatcctgctggcctacctggccggctgggtcctcgagtggaggtggctggcagtgctggggtgcgtgcctccaagccttatgcttttactgatgtgctttatgcctgaaactccacgtttcctacttacccagcatcgcagacaggaggccatggcggccctgaggttcctctggggctcagagcaaggttgggaagatcccccaatcggcgccgagcagtcctttcaccttgcgttgttaagacaacctgggatctacaagccgtttattatcggagttagcctgatggccttccaacagctcagcggagttaatgccgtcatgttctacgccgagacgatcttcgaagaggcaaaattcaaggactcttctctggcatctgttgttgtgggggtgatccaggtgttgttcaccgcagtggcagctctcattatggatcgggcaggtcggcggctgctgttggtgctttcgggtgttgtgatggttttcagcaccagtgccttcggagcatactttaaattgacgcagggtgggccagggaattccagtcacgtcgccatttctgcccctgtcagcgctcaacccgtcgacgccagcgtaggattggcgtggctggccgtgggctcgatgtgcctgttcatcgcagggtttgctgtggggtgggggcctattccatggttgctcatgagtgagattttcccactgcacgttaagggcgtagctacaggaatttgcgttctcactaattggttgatggcgttccttgtcacaaaagagtttagttcactgatgctgttacttctgctgtag

SEQ ID NO: 205736 - DNA, 726 bp, Artificial Sequence
  Description of Artificial Sequence: Synthetic coding sequence
atgacctgcagcctgggcaaggtgtacatcagcgagatcgcctacccagccgttcggggcctgctgggaagctgtgtgcagctcatggtcgtggtcgggatactgttggcttacctggcaggatgggtcctcgaatggcggtggctggcggtgctggggtgtgtacctccatctctcatgctgttgcttatgtgcttcatgcctgagactccacgcttcttattaacccagcacaggaggcaggaagccatggcagccctgcggtttctgtggggctcagagcaggggtgggaggatcccccaattggcgccgagcagcaattgtccggggtcaacgcagtgatgttctacgctgagacaatctttgaggaggctaaatttaaagacagctctctcgcatctgttgtcgtaggggtgatccaggtactgttcacagcggtggctgccctcatcatggacagagccggaagacgattacttctggtgcttagtggcgtggtgatggtgttctccacgtctgcattcggtgcctatttcaagcttacacaaggcggccccggaaacagcagccatgtggcaatctccgcgcccgtgtccgcccagcccgtggatgcatccgtaggtctggcctggctcgccgtgggctccatgtgcctattcattgctggattcgccgttggctggggccctattccctggctgcttatgagcgaaatttttccctag

SEQ ID NO: 205737 - DNA, 798 bp, Artificial Sequence
  Description of Artificial Sequence: Synthetic coding sequence
atggtggtggtgggcatcctgctggcctacctggccggctgggtgttagagtggcgctggctggcagtgctgggttgcgtccctccatcactgatgctgctactgatgtgtttcatgcccgagactcctcgttttctcctcacacagcataggcgccaagaggctatggccgcactcagatttctgtggggtagcgagcaggggtgggaggacccaccaattggcgcagagcaatccttccacctggcgctactgcggcagcctggaatctataagccattcatcattggagtgagcttgatggcctttcaacagctctccggagtcaatgccgtgatgttctacgccgagactatattcgaggaggccaagttcaaagattcaagtttggcttccgtagtcgtcggcgtcatccaggtactattcacagccgttgccgccttgattatggacagggccggtcgtcgactgttgctggtgttgtccggcgtggtgatggtcttttccacatctgcatttggcgcctatttcaagcttacacagggggggccgggaaattcaagtcacgtggctatttctgcccccgtgtcagcccagcccgtcgatgcttcggttgggctggcatggctggcagtcgggagtatgtgcctgttcatcgccggctttgctgtagggtggggcccgattccatggctgttgatgtctgagatcttccctctgcatgtgaaaggagtcgctactggtatatgtgtattaaccaattggttaatggcgtttctggtcaccaaggaattctag

SEQ ID NO: 205738 - DNA, 1623 bp, Artificial Sequence
  Description of Artificial Sequence: Synthetic coding sequence
atggcccggaagcagaaccggaacagcaaggagctgggcctggtgccattaacagacgacacaagccacgctggtcccccagggccaggtagggcattactggaatgtgatcatctccgctcgggtgtacctggcggacggcgccgtaaagattggagttgctccctcctggtcgctagcctcgctggagcatttgggagtagcttcctgtatggctataatctgagcgtggtgaacgcccccacaccctatataaaagctttctacaacgagtcctgggagcgccgccatggacgtcccatcgatccagacacactaactcttttgtggagtgtgaccgtcagtatctttgccattggaggacttgtgggtactttgatcgtgaagatgatagggaaggtccttggacgcaaacacacactgctggccaacaacggtttcgctatttccgcagccctgctaatggcctgttctcttcaagcgggggccttcgaaatgctcatcgtgggtcgatttatcatggggatcgatggtggagtggcactctctgtgctccctatgtacctgtccgagataagccctaaggagattagaggaagcctgggacaggttactgccattttcatctgcattggagttttcacggggcagctgctcggactccctgaactgctgggtaaggagagcacatggccttacctctttggtgtgattgtcgtcccggccgtggtgcagctcctgagcctgccttttctgcccgatagccctagatacctgcttctggaaaagcataacgaagcccgagccgtcaaggcctttcagaccttcttgggcaaggccgacgtgagtcaggaggtggaagaggtactggccgagagcagagtccagaggagcataaggctggttagtgtgctggagctcctcagagcaccatacgtgagatggcaagtagtcacagtgatagtgacaatggcctgctaccaactttgcggactgaacgccatctggttctataccaatagcatcttcgggaaggccgggattcctccggccaaaatcccttacgtgactctcagtaccggaggcattgagacgctggccgcagtcttttccggactagtgattgagcatctaggacggaggccgcttctcatcggtgggtttggcctgatgggtctctttttcggtacactgacaattaccctgactttacaggatcacgctccttgggtgccatacctgtcgattgtgggcattctggccatcatcgcctccttctgctcaggccccggcgggataccatttattctcaccggggaattctttcagcaaagccagcgccccgcagcgttcattatcgctggcacagtaaactggttgtcaaacttcgccgtgggactgctatttccatttatccagaagagcctggacacttactgtttcctggtgttcgccacaatctgcatcacaggggcaatttacctatactttgtacttcctgagactaaaaaccggacatacgcagagatttctcaagctttctcaaagcgcaataaggcctatccacctgaggaaaaaatcgactcagcagtgaccgatggaaaaatcaacggccggccttag

SEQ ID NO: 205739 - DNA, 1536 bp, Artificial Sequence
  Description of Artificial Sequence: Synthetic coding sequence
atgaagctgagcaagaaggaccggggcgaggacgaggagagcgactccgctaagaagaagctcgattggagttgctccttgctggtcgcttccttggccggcgccttcggtagtagctttctgtatggctataacttgtccgttgtgaacgctcccactccatatattaaggcgttttataacgagtcctgggagcggcgccacggcagaccaattgaccctgacaccctcaccttattgtggtccgtgactgttagcatctttgccattggtggattggttggaacactgattgttaagatgatcggaaaggtactaggccgaaagcatacgttgttagccaataacgggttcgctatttccgcagcacttctgatggcctgctcgctgcaagcgggcgcgttcgagatgctgatcgtggggagattcatcatgggaatcgacggcggggttgccttgagcgtactgccgatgtacttgagtgagatcagtccaaaggagatccgggggagtctggggcaagtgaccgccatttttatctgtatcggtgttttcacaggtcagttgctcggactgccagaacttctgggcaaagaaagcacatggccttacctcttcggcgtaatcgtggtgcctgctgttgtccagctgctgtcccttccttttctgcccgactcccccaggtatcttttgctggaaaagcacaacgaagctagggccgttaaggcattccagacgttcctggggaaggcagatgtgtcacaagaggtggaagaggtgctggctgaatctcgcgttcagaggagcatccgcctcgtaagcgtcctggagcttcttagggccccctatgtgcggtggcaggtcgttaccgtgattgtgaccatggcttgctatcagctgtgcggcttgaatgctatttggttctacacgaattcaatattcggaaaggcggggatccccccagccaaaattccctacgtcaccctgagcacagggggaattgagactctggccgcagtgttttccggccttgttatagaacacttggggcgaaggcccctgttaatcggcggttttggcctcatgggactgtttttcgggaccctgaccatcactctcaccttacaggaccatgctccgtgggtgccctacctttcaatcgtgggtattctcgccataatcgcatccttttgttctgggcctggaggcataccgtttattctgactggggagttctttcaacaaagccaacgacccgcagctttcatcatagcagggacagtcaactggctgtcaaacttcgcagtgggcctgctgttcccattcatacagaagagccttgacacctactgttttctggtgtttgctacgatttgcataaccggagctatctacctgtacttcgtgctgcctgagactaagaacagaacgtacgccgagatatctcaggcattctccaagcgtaacaaagcttaccctccggaagagaagattgacagcgcggtcactgacggcaagattaatgggcgcccatag

SEQ ID NO: 205740 - DNA, 1536 bp, Artificial Sequence
  Description of Artificial Sequence: Synthetic coding sequence
atgaagctgagcaagaaggaccggggcgaggacgaggagagcgactccgcaaaaaaaaagctggactggtcttgctcactgttggtggcctcactggccggggccttcgggagtagttttctctacggctataacttgagtgtagtgaatgcgcctacaccctatatcaaagcgttttataatgagagctgggagagacgtcacggtcggccaatcgatcctgacactctgacactgttgtggtccgtaactgtcagtattttcgctattggcggtctggtcgggaccctgattgtgaagatgataggcaaagtccttggacgcaaacacactctgttggcaaataatggattcgctatctctgccgcactgctgatggcctgttccctgcaagccggcgcattcgaaatgctgatcgtcggtcggttcatcatgggtattgacggcggggtggctctgagcgtactcccaatgtacctgagtgagatctccccaaaggagattagggggagtctgggccaagtgactgcaatcttcatctgtatcggcgtttttacagggcagctcctggggctcccggaactgctcggaaaagagagcacgtggccttatctgttcggagttatcgtggttcctgccgtcgtgcagcttctctcactgccatttcttccggactcacctagatatctcctgctggaaaagcataacgaggcacgtgccgttaaagcattccaaacattcttgggtaaggctgatgtgagccaggaggtggaggaggttctcgcggagtcgagagtccagaggtccattcggttggtcagtgtgctcgaactactccgagccccctatgtacggtggcaagtggtcacagtgattgtcacaatggcatgctaccaactttgcggcctgaatgcgatctggttttacactaattctatttttggaaaggccggaataccccccgcgaagatcccatacgttactctctccacgggaggcatcgaaacactcgccgccgtgttctctggactggtgatcgaacacctgggccggcgtcctcttcttattggcggcttcgggctgatgggcttgtttttcgggacccttactattactctgaccctacaggatcacgccccctgggttccatacttgtctatcgttggtattcttgctataattgcgagtttctgcagtggtccaggcgggattcctttcatcctgacgggagagttttttcagcaatctcagcggcccgctgccttcataatcgcgggtacggtgaattggctttccaacttcgcagtgggccttctgttcccatttatccagaagtcgctcgatacgtactgttttttggtgtttgctacaatatgtattaccggggccatttacctctacttcgtactgcccgagaccaagaacaggacatacgcagagatttcccaggccttcagtaagcgcaacaaggcatacccccctgaagagaaaattgatagcgcagttaccgacggtaagataaatggtcggccctag

SEQ ID NO: 205741 - DNA, 597 bp, Artificial Sequence
  Description of Artificial Sequence: Synthetic coding sequence
atgaagctgagcaagaaggaccggggcgaggacgaggagagcgactcagcaaagaagaaactggactggagctgtagtctcctcgtagcctcgctggcgggggccttcgggtcctccttcctctacgggtacaatctgtcggtagtgaatgcccccaccccatatatcaaggctttctacaatgaatcctgggagagacggcatggtcgcccaattgatccggacactctcaccctgttgtggtcggttaccgttagtatctttgccatcgggggcctcgtgggaaccttgatcgtcaaaatgatcggaaaggtcttaggcagaaaacatacgttactggccaacaatggatttgccataagtgcagctttactgatggcttgttccctccaggccggagctttcgagatgctaattgtggggcgcttcataatgggcatcgatgggggggtggccctcagtgtgctgcctatgtatctttctgagatctctcccaaagaaattagagggtcccttggacaggtgacggcaatctttatttgtattggcgtgttcactgggcagctgctgggtttgcctgaattgctaggcaagtag

SEQ ID NO: 205742 - DNA, 735 bp, Artificial Sequence
  Description of Artificial Sequence: Synthetic coding sequence
atggagcagcaggaccagagcatgaaggagggccggctgaccctggtcctcgctttagctaccttaatcgccgcgttcgggagttccttccagtacggctacaatgtagccgcagtgaatagccccgccctgcttatgcagcagttctacaatgagacctattacgggcgaactggggaattcatggaagacttccctctgactcttctgtggtccgtgaccgtgtctatgttcccatttggcggcttcatcggaagccttctggttggccccttggttaacaagtttggcaggaaaggtgccttactcttcaacaacatcttctccatcgtacctgccattctcatgggatgttcgagggtggcaacaagctttgaattgattatcatttcccggctcttggtggggatttgcgcgggcgtgagttccaatgtagtcccaatgtacttgggcgaactggcacccaaaaacctgaggggggccctgggtgttgttcctcagctgttcatcaccgtgggaatccttgttgctcagatctttggcctgagaaatcttctggctaatgtagatggcgaattccggaccagtagggagcacccccatccattcactactactctgggaccattgttagtttttcagagccatcatcatcgcacagggctgtcagccgattggtctctcctgacaggatggatgagcttgggagggcccagctgccccgagcctacatag

SEQ ID NO: 205743 - DNA, 1506 bp, Artificial Sequence
  Description of Artificial Sequence: Synthetic coding sequence
atggagcagcaggaccagagcatgaaggagggccggctgaccctggtgttggctttggctacacttatagctgcgttcggaagctcttttcagtacggctacaatgtcgcagctgtgaatagcccagcattgctgatgcagcagttttataacgaaacttactacggcaggacgggcgaatttatggaagattttccactgacactgctatggtcggtaactgtgagcatgtttccatttgggggctttatcgggagccttttggtcgggcccttggtgaacaagtttggccgtaaaggggccttgctattcaacaacattttttctattgttccagctatccttatgggctgctctagagtggctacatcctttgaactaatcatcattagccggctgctggttggcatttgcgctggagtgtcgtcgaatgtcgtgcccatgtaccttggagaactggcgccaaagaatctgcgaggcgccctcggggttgtccctcagctgttcataaccgttggcatactagtcgcacagatttttggtcttagaaatctcctggccaacgttgatgggtggccaatactcttaggattgactggcgtgccggctgctctccagctgctgctactgcctttcttccctgagagcccccggtacctcttgatccaaaagaaagacgaagcagcagccaagaaagcgctgcagaccctgcgtggctgggatagtgtggatcgagaagtggccgagataaggcaggaagacgaggccgagaaagctgctgggttcattagcgttcttaaactgttccgtatgcgtagccttcgttggcaactcctctctataattgtgctgatgggaggccagcagctttcaggcgttaacgccatttactattatgcggaccaaatctacctgtcagcgggggttccagaagagcacgtgcagtatgttaccgcaggaacaggggctgtcaacgtggtgatgaccttttgcgccgtctttgtggttgaactcttgggacgccgccttctgctcttgctgggcttcagcatctgtctcatcgcatgctgtgtgctgactgccgcccttgccctccaggataccgtgtcatggatgccgtacatctccatcgtgtgcgtcatatcttatgttatcggccatgctctgggacctagccccatccctgctcttctcatcactgaaatttttctgcaaagcagcagaccgtctgctttcatggtcggtggatccgtccattggctgagcaattttaccgtcggtttgatttttcccttcatccaggaaggtctgggcccttattctttcatcgtcttcgctgtgatctgcctgctgaccaccatatacatattcctgatagtcccagaaactaaagcaaagacattcatcgaaattaatcagattttcactaagatgaacaaggtctcagaagtctatccagaaaaggaagagttgaaagagttgcctccagtcacatctgagcaatag

SEQ ID NO: 205744 - DNA, 1455 bp, Artificial Sequence
  Description of Artificial Sequence: Synthetic coding sequence
atggagcagcaggaccagagcatgaaggagggccggctgaccctggtcttggccctagcagccgtcaacagcccagccctgctcatgcagcagttttataacgagacatattatgggagaaccggggaatttatggaggattttcccctgacccttctctggtctgtaactgttagcatgtttccgtttggtgggttcataggatctctgctagtaggaccgctggtgaacaaattcgggcggaagggagcattactcttcaacaatattttttctatcgtgcctgctatcctgatgggatgttcccgtgtggccacaagtttcgagctgataattattagccgcctgctggtgggcatctgtgcaggcgtgagctccaatgtggtgcctatgtatctcggagaactagctcctaagaacctgagaggagctctgggggtcgtgccacagctgtttattacggtgggtattctcgtggcacagatatttggcctccgtaatcttctagcaaatgttgatggttggccaatattgctgggacttacgggcgtgcctgctgccctgcagctgctgctgctgcccttctttccagaaagccctaggtacctgcttatccagaaaaaggatgaggctgctgccaaaaaggccttgcagaccttgagaggctgggatagcgtggatagagaggtggccgagataaggcaggaagacgaagcagagaaggcagccggctttatctctgtgctgaaactgtttcgcatgaggtccctgagatggcagctcttgagcatcatcgtgctcatggggggtcagcagctcagtggggtgaatgcaatctattactatgccgaccagatctacttatccgctggagtacccgaggagcatgtccaatatgtgaccgctggcacgggggctgttaacgtggtgatgaccttttgcgctgtgttcgtggtggagctcttgggtcgtagacttctgctgctcttggggttcagcatttgtctgatcgcttgttgtgttctgactgcagccctggctctgcaggatactgtctcttggatgccatatatatcaattgtgtgtgtgatctcatatgtgataggccacgctctcggcccaagcccaataccagcattactcatcactgaaatcttcctccaatcctcccgcccttccgccttcatggttgggggaagcgttcactggttaagcaacttcactgtgggtttgatcttcccatttatacaggaagggctggggccttattccttcattgtgtttgcagtcatctgcctcctaacaaccatctacatctttctcatcgtcccagaaacaaaagctaagacatttatcgagattaaccagatattcaccaaaatgaacaaggtgtctgaggtgtaccccgaaaaagaggagctcaaagaattgcccccagtgaccagcgagcagtag

SEQ ID NO: 205745 - DNA, 1161 bp, Artificial Sequence
  Description of Artificial Sequence: Synthetic coding sequence
atgggctgcagccgggtggccaccagcttcgagctgatcatcatctctcgattgctcgtgggaatttgtgccggagtaagcagtaacgtggtgcctatgtatctcggtgagctggcgcccaaaaacctgcggggggccttaggggtggtaccacagctatttattacagtaggcattctggtggcccaaatctttgggcttaggaacctcctggccaatgtggacggctggcctattctgctggggctgactggcgtgccggccgctctgcagttattgcttctgcctttttttcctgaaagtcctcgctacctgcttatccaaaagaaggatgaagctgccgccaaaaaggcattgcagactctaaggggatgggactctgttgacagggaggtcgctgagatccgtcaggaggacgaagccgaaaaggccgccggcttcattagtgtgctcaagctgttccggatgaggtcattgaggtggcagcttctgtcaataattgtgctcatgggagggcaacaactcagtggagtgaatgccatctattactacgcagaccagatttacctgtcagctggtgtgcccgaagaacatgtgcaatatgtcacagccggtaccggcgctgtgaatgtcgtgatgacattttgcgccgtgttcgtggtcgagctgttgggccggcggctgctccttcttctggggtttagcatctgcttgatcgcctgttgcgtgctgacagcagctctggcactgcaggacacagtgtcctggatgccgtatattagcatagtgtgcgtcatctcttacgtcattgggcacgccttggggcctagtcctataccagccctgctgatcacggaaatcttcttacaatccagccgccctagcgcctttatggttggtgggagcgtgcactggctgtctaactttacagtaggcctcatctttcctttcatccaggagggcctgggaccctacagcttcatcgtcttcgctgtcatttgccttcttaccacgatctacatctttctcattgtcccagaaaccaaggccaagacttttatcgaaattaatcagatttttacgaagatgaataaggtgtctgaagtataccccgaaaaggaagaattaaaagagctaccccctgttacttccgagcagtag

SEQ ID NO: 205746 - DNA, 1329 bp, Artificial Sequence
  Description of Artificial Sequence: Synthetic coding sequence
atgctggagctgcacagcctgaccgccagcagcatcatgcgggtgttaattatgcgggccccactgcgcgaggctccacccgaaaagtttgcactgctgctgagtggatcccccgggaaaggagccctactgtttaacaacatattttctattgtccccgcaatcctgatgggatgctcccgcgtggcaacctcatttgagctgattataatttcccgcctgctggtgggcatttgcgccggagtttcttcgaacgtggttcccatgtatctaggagagctcgcccccaagaacttacgtggcgcccttggcgtcgtgcctcaactctttatcaccgtcggtattctggtagcccagatcttcggcctgagaaacttgctggccaatgtagatggatggcctatactcctaggcctcaccggtgtacccgccgcactgcaattactgttgttaccttttttccccgagagtccaaggtacttacttattcagaaaaaggacgaggcggccgcaaaaaaggcgctacagactctgcgcggctgggattctgttgaccgcgaagtcgcagagattcgccaggaggatgaagccgagaaggccgcgggctttattagcgtgctgaagctctttcgcatgcgctcactcagatggcagctgttaagcatcatcgtgctcatgggcggccagcagttgagcggtgttaatgctatatattactacgccgatcaaatctatctgagtgctggcgtacccgaggaacatgtgcagtatgtgactgctggcaccggggctgtcaatgtggtaatgacattttgtgctgttttcgtggttgaactgctaggtagaagattgctgctgttactcggcttctccatttgtttgatcgcctgctgtgtgctgaccgctgccctggcattacaggacacagtgtcctggatgccgtacatctcgatcgtgtgtgtaatctcttatgtcatcggccacgcactgggcccgtctcccatcccagctctgcttattactgaaatttttcttcagagctctcgtccttccgcttttatggtggggggatccgttcactggctatccaactttaccgtcggcttaatttttccctttatacaggagggcttgggaccttatagcttcattgtgtttgccgttatatgcctgttgactacaatctacattttcctgatcgtgccggagactaaggctaaaacttttatcgagatcaaccagattttcaccaaaatgaacaaggttagtgaagtctaccccgagaaggaggaactcaaggagctgccacctgtcaccagtgagcagtag

SEQ ID NO: 205747 - DNA, 2040 bp, Artificial Sequence
  Description of Artificial Sequence: Synthetic coding sequence
atggccaccctgatcaccagcaccaccgccgccaccgccgccagcggacctctggtggactacctgtggatgctgatcttaggatttattattgcgtttgttctggccttcagcgtgggcgctaacgatgtggccaactctttcggcacagctgtcggctcaggagtggtgacactgaaacaggcctgcattctggcgtcaatcttcgagacagtgggctctgtgctgctaggggccaaggtgagtgaaacaatcaggaagggattaattgatgttgagatgtataactccactcaaggcctgctgatggcagggagcgtttccgccatgttcggctcagccgtctggcagctggtagccagctttctgaaactgcccataagcggcacacactgtatcgtcggtgcgactataggattttcgctggtggctaaaggccaggagggcgtgaaatggtctgaattgatcaagattgtgatgtcctggttcgtcagtcctctcctttctggcattatgagtggcatccttttttttctggtgagagcctttatcctgcacaaggccgatcctgttcctaacgggcttcgggctcttcctgtgttctatgcatgtacggtcgggatcaacctgttctcaataatgtacaccggcgcccccctgctgggtttcgataaattacccctgtggggtactattctgatttccgttggttgtgcggtgttctgcgcactgatcgtttggttttttgtgtgtccgcggatgaagaggaagatcgaacgcgagatcaaatgctcaccgagtgaatctccattgatggagaagaagaattctctaaaggaggaccacgaggagactaagttgtccgtcggggatatcgaaaataaacaccccgtgtctgaagtgggcccagcaactgttcccctgcaggcggttgtcgaagagcgcacagtctcttttaagctcggagacctcgaggaagcgcctgaacgcgaaaggctcccttctgtagaccttaaggaagagaccagtattgactccactgtgaacggcgcagtccagctccctaatggaaacctggtacagttttcccaggccgtttccaatcagattaacagctctggtcattaccagtaccatacagttcataaggacagcggactctacaaagaactcctccacaaactccatttggcgaaggtgggggactgcatgggggactccggcgacaaacctctgcggcgcaataattcctacacatcatatacaatggcgatttgcgggatgcccctggactctttccgcgccaaagagggagaacagaaaggcgaagagatggaaaaactgacctggccaaacgccgactccaagaagaggattcgcatggacagttatacatcctactgtaacgccgtttctgacctacactccgcttccgagatcgatatgtccgtgaaagccgaaatggggctgggagaccggaagggcagcaacggctccctggaagagtggtatgaccaagataagcccgaagttagtttgttgttccagttcctgcaaatactgactgcctgctttggctccttcgcgcacgggggtaatgatgtgagtaatgccattggtccgctggtggccttgtacctcgtctacgacacgggtgatgtttcatcaaaagtagcgacacccatatggctccttttgtacgggggcgtcgggatatgtgtgggtctatgggtctggggacgccgggtcatccagaccatgggcaaggacctcacgcctattacaccctcttcaggtttcagcatcgagcttgccagtgctcttaccgtggtaattgcatccaatatcggtttgccaatttctacgacccattgcaaggttggctcagtcgtgagcgtggggtggctcaggtcaaaaaaagctgtcgactggagattgtttcggaacattttcatggcttggttcgtgacagtgccgataagcggcgtcatatctgccgcaataatggccatattcaggtatgtgattctgagaatgtag

SEQ ID NO: 205748 - DNA, 1137 bp, Artificial Sequence
  Description of Artificial Sequence: Synthetic coding sequence
atgggcaaccccagcgtgccccggggcggcttcacccagtactgccggggccttctcccatggggcttccaagatgctccgttctacctgctggtcctggggttcgacaaattgccgttatggggcaccatcctgattagcgtgggatgcgcagttttctgtgctttgatcgtgtggtttttcgtgtgtcccaggatgaagagaaaaatagagcgcgaaataaagtgttccccctcagagtctcccctcatggaaaaaaagaatagcttaaaagaagatcacgaggagaccaaactgtccgttggagacatcgagaacaagcatcccgttagcgaggtgggccctgcgacggtgcccctgcaagctgtcgtggaagagcgtacagttagttttaaattaggggaccttgaagaggctcccgaacgcgaaaggttgccatcagtggatttgaaagaggaaacatccatcgacagtactgtcaacggcgctgtacagcttcctaacggcaatctcgtgcagttctcgcaggccgtctctaaccaaatcaattccagtggacattatcagtatcacacagtacataaagattccggcctgtataaagaactactgcataagctacacctcgcgaaagtaggcgattgcatgggagattctggagacaagcccctccgtcgaaataattcgtacacatcctacacgatggctatttgtgggatgcccctagacagctttcgagctaaggagggtgagcagaaaggagaggagatggaaaaattgacttggcctaatgctgactcgaagaagcggatcagaatggacagctacacatcctattgtaatgcagtgagcgatctgcactcagcgtctgaaatcgacatgtcagtaaaagccgaaatgggcttgggagataggaagggcagcaatgggagtcttgaagaatggtacgatcaagacaagcctgaggtcagcctattgtttcagttccttcagattcttaccgcatgctttgggtctttcgcccacggaggcaatgatgtgtccaatgctattggtccactggtggctttgtacttggtctacgataccggtgatgtgtccagcaaggtggccaccccgatctggctgttgtgttag

SEQ ID NO: 205749 - DNA, 1959 bp, Artificial Sequence
  Description of Artificial Sequence: Synthetic coding sequence
atggccatggacgagtacctgtggatggtgatcctgggcttcatcattgccttcatcctggccttttctgtgggcgcaaacgatgtggcaaacagtttcggaacagcggtaggctccggcgtcgtaactctccggcaagcttgcattctggcgagtatctttgagactactgggtctgttctgttgggagcaaaggtgggggagactatacggaagggcattatcgatgtgaacctgtataacgagacagtagaaaccctgatggcgggggaagtctcggctatggtcggctcagcggtgtggcagttaatcgcttcctttctccgcttgccaatcagtggcacgcattgcatcgttggtagcacaattgggttttcgttggtcgccatcgggaccaaaggggtgcagtggatggaactggtgaaaattgttgcttcatggttcatcagccccctcctcagtgggttcatgagcgggctgctgttcgtgctgattcgaatttttatcctgaagaaagaggatcctgtccccaacgggctgcgcgcactgcccgttttttatgcagccactattgccatcaatgtcttctccatcatgtatacaggcgcaccagtcctgggacttgttctccctatgtgggcgatagcattgatcagttttggggtggcgctgctttttgccttcttcgtctggctcttcgtctgtccttggatgaggaggaagataacgggcaagttacaaaaagagggggctctgtctcgagtgtccgatgaatcacttagtaaagtgcaagaagctgagagcccagtgtttaaggaacttcctggcgctaaagccaatgatgacagcacaatcccattgacaggcgccgccggggagacactggggacatccgagggtacatccgcagggtcccatccacgcgccgcatacgggcgcgcactgagcatgactcacggatctgttaaatctccaatttccaacggcacgttcggctttgatggccacactagaagtgacggtcacgtctaccatactgttcacaaagattctggactgtacaaggatctccttcacaaaatccatatcgacagagggccagaggaaaaaccagcacaagaaagtaattaccgactgctgagacgcaacaacagctacacctgttacacggctgctatctgcgggctgcccgtccatgcgacgtttcgagcggctgactccagtgcaccagaagactcagagaaattggtcggggatacagtaagctactccaaaaaacggctcaggtacgatagctatagttcttattgtaatgcagtagctgaggccgaaatcgaggcagaggagggaggagtggaaatgaaactcgcaagcgagttggcggatcccgaccagccccgggaggaccccgctgaggaagagaaggaagaaaaagatgctccagaggtacatctgttattccattttctgcaggttctgactgcgtgtttcgggtccttcgcccatggcggaaacgatgtgtctaatgcaattggacccctcgtggcgctgtggctaatctataagcaaggcggcgttacacaggaagccgccacccctgtgtggctgttgttctatggtggtgtgggaatttgcacagggttatgggtgtgggggaggcgggtgatccaaacaatgggaaaggatctgacgccaattaccccctcatccggattcacaattgaactcgcaagcgcgttcaccgtggtgatcgccagtaatatcggactgcctgtttccaccacccactgtaaggtagggagcgtggttgccgtcggctggatacggagccggaaagctgtcgattggcgcctttttcggaatatcttcgtggcttggtttgttactgtgccagtggcaggcttgtttagtgcagcggtgatggccctcctcatgtatggcatactgccctatgtgtag

SEQ ID NO: 205750 - DNA, 216 bp, Artificial Sequence
  Description of Artificial Sequence: Synthetic coding sequence
atggccatggacgagtacctgtggatggtgatcctgggcttcatcatagcatttatcctggcatttagcgtcggcgcaaacgatgtggcaaactccttcggcactgctgtcgggtccggagtagttacactccgtcaggcttgcattctagcgtccatctttgagaccaccggcagcgtgcttcttggcgccaaggttggcgaaactatcaggtag

SEQ ID NO: 205751 - DNA, 87 bp, Artificial Sequence
  Description of Artificial Sequence: Synthetic coding sequence
atggccatggacgagtacctgtggatggtgatcctgggcttcatcatagctttcatactggcattctcagtcggggctaacgactag

SEQ ID NO: 205752 - DNA, 237 bp, Artificial Sequence
  Description of Artificial Sequence: Synthetic coding sequence
atggccatggacgagtacctgtggatggtgatcctgggcttcatcatagcttttatactcgcctttagcgttggggctaacgacgtggctaattccttcggtaccgctgtcggctctggggtcgtgaccttaaggcaagcctgtatcctggcctccatctttgaaacaacaggctcagttcttctgggcgcaaaagtgggtgaaaccatccgcaaggggattatcgatgtgaattag

SEQ ID NO: 205753 - DNA, 1959 bp, Artificial Sequence
  Description of Artificial Sequence: Synthetic coding sequence
atggccatggacgagtacctgtggatggtgatcctgggcttcatcatcgccttcattctggccttttccgtgggagctaatgacgtcgctaactccttcggcacggccgtcgggtccggcgtggtgactctgcgacaggcttgtattctggccagcatatttgagactactggcagcgtactcctgggtgctaaggtcggtgagaccatcagaaagggaatcatcgacgtgaatctgtacaacgaaactgtggaaacactgatggcaggagaagtaagtgcaatggtgggtagcgcagtgtggcagctgatcgccagttttctgcgattacctatatccgggacacattgcatcgtgggatcaaccattggcttctcactggttgctatcggcacaaaaggagtgcaatggatggagttggtgaagatcgtggcctcctggttcatttccccactgttaagcggttttatgtctgggctcctgttcgtcttgatcaggatcttcatccttaagaaagaggatcctgttcccaacgggctgcgggctctcccagtgttctatgccgcgacgatcgccatcaatgttttctcgattatgtatacaggcgcgcccgtactgggcctagtattacctatgtgggcaatcgccttgattagtttcggtgtggctctcctgttcgctttctttgtgtggcttttcgtgtgtccatggatgcgtaggaagataactgggaagctccagaaggaaggtgctttgtcccgtgtgagtgacgaaagcctcagtaaggtacaggaggcagagtccccagtgtttaaggagctgcccggagccaaggccaatgatgacagtactattccccttaccggtgcagccggcgaaaccctaggcacatccgaggggaccagcgccggttcccacccacgagcggcatatggcagagctctgtcaatgacccacgggtctgtcaaaagcccaatctctaacgggaccttcggcttcgatggccacactcggagcgatggccatgtgtaccataccgtacataaagattccgggctctacaaggatctgttacacaagatccacatcgacagaggccccgaggaaaaacctgcccaagaatctaactatcggttacttcgccggaataattcgtacacgtgctacacagctgccatttgcggcctccccgtccatgccacgtttagggctgccgattcatcggcccctgaggatagcgagaagctggtcggggacacagtgtcttacagcaaaaagaggctaaggtacgatagctattcaagttactgcaatgcagttgctgaggctgaaatcgaggcagaggagggcggagtggagatgaagctggccagtgaactggctgatcctgatcaaccaagagaggaccccgctgaggaggaaaaggaagaaaaggatgcccctgaagtgcacctgcttttccactttctgcaagttctgaccgcctgtttcggcagttttgcccatggtggcaatgacgtgtcaaatgcgattgggcccctggtggccctctggctaatatacaagcaggggggggtaacccaggaggcagccaccccggtgtggctgttgttttacggtggcgttgggatctgtaccgggctgtgggtatgggggagacgcgtcattcaaactatggggaaggatcttacacccatcacgccaagttcgggatttactatcgagctggccagtgccttcaccgtggtgatagcgagtaacataggcttacccgtgtcaacaacacactgtaaggtcgggagtgtggtcgctgttggatggattagaagcagaaaagcagtagattggagactattcaggaatattttcgtcgcatggtttgtgactgtgcccgtggcgggcctttttagtgctgcggtgatggcccttcttatgtatgggattctcccttacgtatag

SEQ ID NO: 205754 - DNA, 1959 bp, Artificial Sequence
  Description of Artificial Sequence: Synthetic coding sequence
atggccatggacgagtacctgtggatggtgatcctgggcttcatcatcgctttcatcctggcattttccgtcggcgccaacgatgtggccaactcctttggtacggcagtaggctctggggtagtcacacttaggcaggcctgtatccttgcatcaatttttgagacaacaggcagtgtccttctcggcgctaaggtcggcgagactatcagaaagggcatcattgacgtgaacctttacaacgagaccgtggagactctgatggctggggaggtgtcagctatggtagggtcagccgtctggcagctcattgcttctttccttcggctcccaatatccggcacccattgcatcgtcggaagtacaataggctttagtctcgttgccattggcaccaagggggtccagtggatggaactggtgaaaattgtggcaagctggtttatcagcccattactttccgggttcatgtcgggtcttctctttgtgctgatccgaatcttcattctgaaaaaagaagaccctgtccccaatggcctcagggctctccccgtgttttatgctgcaacaatcgcgattaatgtcttttctataatgtataccggcgcccccgtgttaggtctggtattacccatgtgggcaatcgcactcataagctttggcgtcgccctactttttgcgtttttcgtttggttgtttgtgtgcccttggatgcggagaaaaatcaccggaaagttgcaaaaagaaggcgcgctgagtcgggttagtgatgagtcactttctaaggtgcaggaggcggagtcgcccgtttttaaggaactgccaggtgctaaagctaacgacgactcaacaataccactgactggtgcggccggtgaaaccctgggcacctccgaaggaacatccgctggctcccacccacgggcggcctatggacgtgccctgtcaatgacccacggatcagtcaagtctcccatcagcaatggcacctttggatttgacggccacactaggtctgatggccacgtgtaccatacagtccacaaggattccggcctgtacaaagatcttctacataaaattcacatcgacagggggccagaagagaagccagctcaggagtctaattatcgattgctacgtaggaacaatagttacacatgctataccgcagccatttgtggcttgcctgtgcacgctactttccgcgctgctgactcgtctgcacccgaggattctgaaaagttagtgggggacacggtgagctactctaaaaagcgtctgagatacgacagctactcctcatactgcaatgccgtagccgaggccgagatcgaagccgaagagggaggcgtagaaatgaagctcgcttctgagctggctgatcccgatcagccacgggaggatcctgcggaggaggaaaaggaggagaaagacgctccagaagtgcatctgttgttccactttctgcaggtattaactgcctgttttggatcatttgcccatggggggaacgatgtgagcaatgccattgggccgctggtggcattgtggctgatctacaaacagggaggcgtgacccaggaggccgctactcctgtttggttgttattctacggtggagtaggcatatgcacgggcctatgggtgtggggaaggagagtgattcagaccatgggaaaggatctgactccaattactccatccagcggtttcaccatcgagctcgctagtgcgtttaccgtcgtgatcgcgagcaatataggacttccagtatcaaccacacactgcaaggtggggagcgtggtcgcagtgggatggatcaggagcaggaaggcagtggactggcgcctgtttaggaatatctttgtggcatggttcgtcacagtgcccgttgccggcctgtttagtgccgcagttatggccctacttatgtacggcatactcccttacgtgtag

SEQ ID NO: 205755 - DNA, 144 bp, Artificial Sequence
  Description of Artificial Sequence: Synthetic coding sequence
atggccatggacgagtacctgtggatggtgatcctgggcttcatcattgccttcattctagcctttagtgttggggcgaacgatgttgctaatagttttggcaccgccgtgggcagcggagtggtcaccctgagacaggcctag

SEQ ID NO: 205756 - DNA, 1260 bp, Artificial Sequence
  Description of Artificial Sequence: Synthetic coding sequence
atggcccagagcatcttcatggccggcatcctgatcggcggcctggtactgggagatctgtccgatagattcggcaggagacccatcctgacatgtagctacctgttgctggccgcatcaggcagcggtgccgccttcagcccgacctttcccatttatatggtcttcagattcctgtgtggctttggaatctctgggatcactcttagcactgtgattctgaacgtggaatgggtccctacccggatgcgtgccattatgtcaactgcattaggttactgctacacctttggtcagtttatactcccggggctggcctacgcaatcccgcagtggaggtggctccagctcacagttagcatccccttctttgtgttctttctcagctcctggtggacaccagagagtatcaggtggctggttctgagtgggaagagttcaaaagccctaaaaatcctgagacgggtcgcagtatttaacggcaaaaaagaggagggtgagcgactttctctggaagaactgaaattgaatttgcagaaagagatttctctcgccaaggcaaagtatactgcatcggatttatttcgtattcctatgctccgccgaatgacgttttgtctcagtttagcttggtttgcaactggattcgcctattatagcctggccatgggcgttgaggaatttggcgttaacttgtacatactccagattatcttcgggggggtcgacgtgcctgcaaaattcatcacgattcttagcctgtcatacctggggcgtcatacaacacaggctgctgctcttttactggcagggggggcaatcttggccttgactttcgtaccattggatctacaaacagtgagaaccgtgcttgccgtatttgggaaaggctgcctgtcatcctccttcagctgcctattcctttacacttccgagctttaccccactgtcattcgccaaaccgggatgggagtttctaacttatggaccagggtgggtagcatggtgtctcccctggtgaaaattaccggcgaggtacagccttttatccctaatatcatctacggtatcacagccctgctcggtggctcggccgccttattcctgccagagaccctaaaccagccactgcccgaaaccattgaggacctcgaaaactggagtctgagggccaagaagcctaagcaggagccagaggtcgaaaaggccagccagagaatcccactgcagcctcacggacctgggttgggaagctcgtag

SEQ ID NO: 205757 - DNA, 1356 bp, Artificial Sequence
  Description of Artificial Sequence: Synthetic coding sequence
atggagccctgcctggacggctgggtgtacaacagcaccaaggacagcattgtgaccgaatgggacctggtctgtaatagtaacaaactaaaggaaatggcacagagcatcttcatggctgggattctcatcggtgggttggtcctaggagacctgagcgataggttcggaagaaggcctatcctgacctgctcctatctgctgttagctgcctctggatccggtgctgccttcagtcccaccttccccatttacatggtttttagatttttgtgtggattcggaatttccggtatcacactgtctacagttatactcaatgtagagtgggtacccacacggatgcgagctataatgtcgactgcattggggtattgttacaccttcggtcaattcatactgcccggactggcgtacgcaatccctcagtggcggtggcttcagctcaccgtatcgattccgtttttcgtatttttcttatcttcctggtggacgcccgaaagcattagatggctggtcctgtccgggaagtcctcaaaggcgttaaaaatcttaagaagagttgcagtgtttaacgggaagaaggaagaaggcgagcgcctctcattagaggaactcaaactcaatctacagaaggagatatccttggctaaggccaaatatacagcgagtgatctttttaggatcccaatgcttagacgcatgacgttttgtctcagcttggcttggtttgcaactggattcgcgtattatagtttggcaatgggagtggaggagttcggcgtgaacctttacatacttcaaattattttcggcggagtagatgtgccggccaagtttattactatactgtctctgtcttacttgggtagacatacgactcaagccgccgcacttctgctggctgggggagccatcctggctctcacgttcgtaccactggaccttcagacagtgcgcactgttcttgcagtgttcggaaaagggtgtctctcctctagtttttcctgcttgttcttatacacttccgagctgtaccctaccgttattcgccagacaggaatgggcgtgagcaacctgtggacacgtgttggttctatggttagcccactcgtcaagatcaccggcgaagtgcagcccttcatacctaacatcatatatgggattacagccctccttgggggttctgcagcactgttcttacccgaaacgttgaaccagccactgcctgagaccattgaagacctggagaactggtccctccgggcaaagaaaccaaagcaagagcctgaggtggagaaggcctcccagaggatcccactgcagccccacggccccggcttgggctctagctag

SEQ ID NO: 205758 - DNA, 1653 bp, Artificial Sequence
  Description of Artificial Sequence: Synthetic coding sequence
atggccttcaacgacctgctgcagcaggtgggcggcgtgggccggtttcaacaaatacaggtgacacttgtggtcctgcctctgctcctgatggcttctcataatactcttcagaatttcaccgccgctatacccacgcatcattgccgacctcctgctgacgccaacctgtccaagaatggtggactggaggtatggctaccccgcgaccgccagggtcagcccgagagctgccttagattcacgtcgccacagtggggccttccctttctgaacggaactgaggccaatggcaccggtgctaccgagccttgtacagacggttggatctatgacaactctactttcccctcaaccatcgtgactgagtgggatctcgtgtgtagtcaccgggcactgcgtcagctcgcccagagcctgtatatggtgggagtgttacttggggccatggtcttcgggtaccttgcagataggctggggcgaaggaaagtgctcatacttaattatctgcagaccgccgtgtctggcacttgtgcggctttcgcacccaatttccccatctactgcgccttccgactccttagcggcatggcattagcaggaatctcccttaactgcatgacccttaacgtagaatggatgccaatccacaccagagcctgtgtgggaacccttattggatatgtgtactccctcggtcagttcttgcttgccggcgtagcctacgccgtccctcattggcgccacctgcagctcctcgtgagcgcccctttcttcgcattttttatttattcctggtttttcatcgaaagtgcccgatggcactcttcgtcaggccgactcgacttgacacttagggcattgcagagagtggcccgaataaatggcaagagggaagagggggccaaactgtctatggaagtactgcgggcctctttgcagaaagaattaacaatgggtaaaggccaagcatcagcgatggaactacttaggtgcccaacacttcggcatctctttttgtgtctgtctatgctgtggttcgccacctcattcgcttactacgggctggtgatggacctgcagggattcggagtgagcatctaccttatccaagtgatatttggggcggttgacctgcccgccaaactcgttggattccttgttatcaatagcctgggtcgcagacctgcacaaatggctgcacttctgttagctgggatctgcatcttgctcaacggcgtaataccacaggatcagagcattgtgcgaacgtccctggcagtgctggggaaagggtgtttggccgcctcttttaattgcatttttctttatacgggtgaactataccctactatgatcagacaaacaggaatgggcatggggtctacaatggctcgggtgggtagcatagtcagcccactggtttcgatgacagctgaactgtatccttctatgcccctgtttatctacggcgccgtgcccgtagctgcctcagccgtgactgttctgctgcctgagaccttggggcaaccgcttcccgacacagtccaagacctcgagagccggaaagggaaacagacaagacagcagcaggaacatcagaagtatatggtgcccttgcaggctagtgcccaggagaaaaatggtttgtag

SEQ ID NO: 205759 - DNA, 1692 bp, Artificial Sequence
  Description of Artificial Sequence: Synthetic coding sequence
atggccttcaacgacctgctgcagcaggtgggcggcgtgggccggtttcagcagattcaggtaaccctagtggtactccccctgttgctaatggcgagtcacaacaccctccaaaactttacagcagcaatccctactcatcactgccgcccgcctgccgatgccaacctctccaagaacgggggccttgaggtgtggcttccccgcgacaggcagggacagccagagtcatgcctgagatttactagccctcagtggggcttaccctttctgaatgggacagaggcaaatggcactggcgccactgagccttgcaccgacgggtggatatacgataacagcacattcccatctacaattgtgaccgaatgggacctggtatgttcgcacagggccctgcgccagttagcacaatcattatacatggtcggagtgctcctgggggcgatggtcttcggctacctcgccgatcggctcggacggcggaaggtgcttattctaaactacctgcagactgcggtctctggcacttgcgccgcattcgctccaaactttcctatctactgcgctttccggcttctgagtggcatggctctcgcagggattagcttgaattgcatgacactcaacgtagaatggatgcccatccatacaagggcttgcgtcggcactttaatcggctatgtgtactcacttggacaattcctcctggcgggcgtggcctatgcggtgcctcactggaggcacctacaactgctcgtttctgcaccattcttcgcctttttcatctattcctggttctttatcgaatcagcacggtggcacagttccagtggtcgcttggacttaacattacgagcgcttcagcgggtggcaaggataaatggaaaacgagaagagggggccaaacttagcatggaagtacttcgtgcatctctgcagaaggagctcaccatgggcaaaggccaggcctccgctatggagcttcttagatgtcccacgttgaggcacctgtttctgtgtctgtctatgctttggtttgccacctctttcgcctactatggcctcgtgatggatctccaggggttcggagtttccatctatttaatccaggtgatcttcggggcggttgatctccctgcaaagttggtgggctttcttgtgatcaacagcctggggcgtagacctgcacagatggcagccctgctccttgcagggatctgcattctgttgaacggagttatcccacaggaccaatctatcgtaagaacctcccttgccgtgctgggaaaagggtgcctcgctgccagctttaattgtatattcctatacacaggagagctgtaccctaccatgatacgccagacagggatgggcatggggagcactatggcacgcgtggggagcattgtttcccccctggtgtccatgactgcagagctgtatcccagtatgcccttatttatttacggcgccgtacccgttgcagcctccgccgtgaccgtgctcctgcccgagactctcggccagccactgccagacaccgtacaggacctggagtcccgctgggcacccacccagaaggaagcgggcatttacccaaggaagggaaaacagaccaggcagcagcaggaacaccaaaagtacatggttcccctgcaggccagtgcccaagagaagaatggcctatag

SEQ ID NO: 205760 - DNA, 1590 bp, Artificial Sequence
  Description of Artificial Sequence: Synthetic coding sequence
atggccttcaacgacctgctgctgctgatggccagccacaacaccctacagaactttactgctgccataccaacccatcactgtaggcctccagccgatgcaaatctgtccaagaacgggggcctggaagtgtggctccctagagacaggcaggggcaacccgagtcatgcttgcgctttacttcgccccagtggggtcttccatttctcaacggaaccgaagcaaatgggactggcgcaacagaaccttgtaccgatgggtggatttacgacaattccactttcccctccaccatagtgactgagtgggacctggtgtgctcacaccgggccctgcgccagctcgcccaatctctctacatggttggggtgctgttgggtgctatggtttttggatacttggctgacagactcggaagaaggaaggtgctaatactaaattacctacaaaccgccgtatcaggcacctgtgctgctttcgcacctaactttcccatctactgtgcctttaggttactgagtgggatggccctggcaggcatatcccttaattgcatgaccctcaatgtagagtggatgcccatacacacccgagcatgcgtggggacactgatcggctatgtctacagcttgggtcagtttctcctggcaggggtcgcgtacgccgtaccccactggcgacacctgcagctcctggtctctgcacctttctttgcattctttatctactcttggttttttattgaaagtgcaaggtggcacagttctagtggccgtctagatctgacccttagggctctgcagcgagtggcacgtattaacgggaagcgggaagagggcgctaagcttagcatggaggtgctgcgcgccagtctccagaaggagctcaccatgggtaaaggccaggccagcgcgatggaactgttgagatgtcccacactgaggcacctcttcctgtgtttatcaatgctgtggtttgccacctcttttgcctactacgggcttgtgatggaccttcagggtttcggcgtcagtatatacctgattcaagtcatctttggtgccgtcgacctgcctgccaaattggtagggttcctcgttattaattccctaggaagacgccccgctcaaatggccgctctgcttttagcgggaatatgcattttactgaatggcgtcattccacaggaccagtcaatagtgcggacttccctagcagtcctaggcaaggggtgcctggcagcttctttcaactgtatattcctttacaccggcgagctgtaccccaccatgatccgccagacaggcatgggcatgggatccaccatggcacgagtgggatccatagtgtccccactggttagcatgacagctgaactctatccgtccatgcctctttttatttacggggccgttcccgtcgcggctagcgccgtgacagtgctgctccctgaaaccctgggtcaaccactgcctgacactgtccaagacttggaatcaaggaaaggtaagcaaacgcggcaacagcaagagcaccagaaatacatggtgcctttacaggcttccgcccaagagaagaatggactgtag

SEQ ID NO: 205761 - DNA, 1560 bp, Artificial Sequence
  Description of Artificial Sequence: Synthetic coding sequence
atggccttcaacgacctgctgcagcaggtgggcggcgtgggccggttccagcagattcaagtcactctggtggttctgcctttacttctgatggcaagtcacaatactctacagaacttcactgcagccattcccactcaccattgtcgcccacccgctgatgctaatctctcaaagaacgggggcttggaagtctggcttcctagagaccgccagggacagccggaatcctgtctgagattcacctcccctcagtggggtttaccctttttgaacggaactgaagccaatggaactggcgctactgaaccgtgcacagatgggtggatctacgacaattccactttcccctccacaatagtgactgagtgggatctggtgtgtagccaccgcgctctgcgtcagttggctcagtccttatatatggtgggggtgctccttggagctatggtgttcggatatctggctgacaggttaggccgacggaaagtcctcattctgaactacctccagaccgcagtgtcgggaacgtgcgcagccttcgctcccaacttccctatatattgtgcattccgtcttttgtcgggcatggctttagccggaattagcttgaactgtatgacactcaatgtcgagtggatgcctatacacactcgtgcatgtgtgggcactcttatcggctacgtgtatagtctgggacaattcctgctggccggagtggcctacgcagtgcctcactggagacacctccagttgctggtgagcgccccattttttgcattttttatctactcatggttcttcatcgaatcagcccgctggcacagcagttccggcagattggatcttacacttcgggccctccagagggtcgcgaggataaacggcaaaagggaagagggagctaagctaagcatggaggtgctgcgtgcttccttacagaaggagctgactatgggaaagggccaagcaagcgccatggaacttctcaggtgcccgaccctgcgtcatctgtttttgtgtctttctatgctgtggtttgctacaagtttcgcatactatggtctggtgatggacctacaagggtttggagtgagcatctatctgatccaggttatttttggagctgtggacctgcccgctaaacttgtcggatttctggtgatcaattcactggggagacgcccagctcaaatggccgccttgcttctggcgggcatttgcatcctcctgaatggcgttatcccacaggaccagagcattgtgcgtacgtcgctcgcggtgcttggcaagggctgtttagccgcaagtttcaattgcattttcttgtataccggcgaactatatcctaccatgattagggcagtcacagtgcttctgcctgagaccctggggcagcccttgcccgatactgttcaggatctggagtctcgctgggctcccacacaaaaagaggcgggaatttatccccgtaaaggaaagcaaacgcgccagcagcaagagcaccagaagtacatggtacccctgcaggcaagcgctcaagaaaaaaacggcctgtag

SEQ ID NO: 205762 - DNA, 1521 bp, Artificial Sequence
  Description of Artificial Sequence: Synthetic coding sequence
atggccttcaacgacctgctgcagcaggtgggcggcgtgggccggttccagcaaattcaagtgaccttagtggtgctgccgttgttgctcatggcctctcacaatacgctgcagaacttcacagcggctataccaacccatcattgtcgccctcccgctgatgctaacctctcaaagaatggtggcctggaggtctggctccccagggatcgtcagggccagcccgagtcctgtctcaggttcacgagcccacaatgggggctcccatttctgaacggcaccgaagccaacggcactggagcaaccgaaccctgtaccgatgggtggatctatgataactctaccttcccctcaaccattgtgaccgagtgggatctagtttgttcccacagagccctgcgtcagctggcccagagcctttacatggtgggcgttttgctgggtgccatggtgttcgggtacttggcagataggctgggcaggagaaaggtacttattttgaattacctacagacagctgtgagcggcacatgcgcagcgttcgcccccaattttccaatctactgtgccttcagacttctcagcggaatggctctcgcagggataagtctcaattgtatgacactgaatgtggagtggatgcccattcatacacgagcctgcgtcgggactctgattgggtacgtgtactctttgggacaattcctgttggctggggttgcttacgcggtccctcactggcgacacttgcagcttttggtgagtgcccctttctttgccttctttatttatagctggtttttcattgagtccgcaaggtggcactcttcttccggacgtttagatctcacactccgggctttgcagcgcgtagccagaattaacggtaaaagggaagaaggcgcaaagctgtcaatggaagttctgagggcatccctgcagaaagaacttactatgggaaaaggccaggcaagtgcaatggaattgctgaggtgccccaccctccgccatctattcctctgtctaagcatgttgtggttcgcaactagctttgcatactacgggttggtcatggatctgcaagggtttggcgttagtatttacctcatccaggtcatatttggggccgttgaccttcctgctaaattggttggattcctggtgatcaactccttggggagacggcctgcccagatggctgcactcctgcttgcgggcatctgcattctcctgaatggagtgatccctcaggaccagtctatagtcagaacttcacttgccgtgctcggtaagggttgtctcgctgccagtttcaattgtattttcctgtataccggtgagttgtaccccaccatgatccgcgccgttacagtattactgccagagacactcggacagcccctgcctgacacagtgcaggatctggagagcaggaaaggcaagcagaccaggcagcagcaggagcatcagaaatacatggtgcctctccaagcaagcgcgcaggagaagaatggactgtag

SEQ ID NO: 205763 - DNA, 1620 bp, Artificial Sequence
  Description of Artificial Sequence: Synthetic coding sequence
atgggcttcgaggagctgctggagcaggtgggcggcttcggcccctttcaattgaggaacgtagcactgcttgccctgcccagagtactcctcccattacacttcctgctgcccatctttctggccgccgtgccggctcatcgatgtgctctccctggcgccccagcgaacttctcacaccaggatgtgtggcttgaagcccacctgcccagagagccggacggaaccctgagctcctgcctgcgatttgcctatccccaggcactgcccaatacgactttgggcgaagaacggcagagccggggcgagctcgaggacgagcctgctacggtgccttgtagtcagggctgggaatacgatcactctgaattcagtagtaccatagccactgaatgggaccttgtgtgcgagcagaaaggtctgaaccgcgctgcatcaacgttttttttcgccggagtcctggtgggtgccgtggccttcggctatctgtcggatagattcggacggagacgcttgttgctcgtggcttatgtttccactctggtgcttggtttagcttctgccgccagcgtgagctacgtcatgttcgccattacccgcacacttaccggttctgccctggccgggttcacaatcatcgttatgcccctggagcttgagtggctggatgtggagcaccgaacagttgcgggagtcttgtctagcactttctggaccggaggagtaatgctgctcgcgctggtcggctatctaataagagactggagatggcttctattggcagttactctcccctgtgcacctggtatcctgtccctctggtgggttcccgagagtgcccgatggcttctgacacagggacacgtcaaggaggcacatcgctacctactccattgcgccaggttgaatggacgccccgtgtgcgaagacagcttcagtcaggaggcagtttctaaggtagcggctggcgagagagtggtccggcgcccctcctaccttgatctttttaggaccccccgcctccgacacatttccctgtgttgcgtggttgtatggttcggagttaacttttcttattacggactatccttggacgtatcaggcttgggactgaatgtgtatcagacccagctgctgttcggcgctgtcgaactgccctcgaagcttctcgtctacctgagcgtgcgttatgcaggtaggcgcctgactcaggccgggacactgctcggcacggctctagcatttggcactcggcttctggtgtctagcgatatgaaatcttggagtacagtactggccgtaatggggaaagcctttagcgaggcggcctttacgactgcttacctcttcacatccgaactttaccccacagttctgcgtcagaccggaatgggcctgaccgctctggttgggcgcttagggggatcactcgctcctctcgcggccttactggatggtgtgtggctgagcttaccgaaactgacatacggtggaatcgctttgctggcagccggcaccgccctcttgctgccggagaccaggcaagcccagctacccgaaacaatacaggacgttgagaggaagagatgcgtgcaccggacagttagcgtatacgtttag

SEQ ID NO: 205764 - DNA, 1647 bp, Artificial Sequence
  Description of Artificial Sequence: Synthetic coding sequence
atgggcttcgaggagctgctggagcaggtgggcggcttcggcccctttcagctgaggaacgtggccctgttagctctgcctagggtgcttctgcccttgcactttctgctgccaattttcctggccgcagtccccgcccacaggtgcgctctgcccggtgcacccgctaatttttcacaccaggatgtgtggcttgaggctcacctcccccgcgagcctgatggaactctctcaagctgcctgcgatttgcctacccccaggccttgcctaatacgacattgggggaggaaagacagagcaggggagaactggaagacgagcccgccactgtcccatgcagccagggttgggagtacgaccatagtgagttcagttccaccatcgcgaccgaatcacagtgggacctggtgtgcgagcagaaagggctgaaccgggctgcctcaaccttttttttcgctggcgttcttgtgggagcggttgctttcgggtatctaagcgatcgctttggccggcgccgactgctgttagtcgcctatgtgtctacgctcgtattaggcctcgcgagtgctgcgtctgtctcatacgttatgtttgcaatcacccggaccctcacgggcagcgcacttgctggcttcacaattatcgtgatgcctctagaactggagtggctggacgtagagcacagaacagtagctggtgtgctgtcctcaactttctggaccggtggagtcatgttgctggccttggtaggttatctgatcagggattggagatggcttttactcgcggtgacactgccatgtgctcctgggatactgtccctgtggtgggtgccagaaagtgcccgctggcttctcacccaaggccatgtgaaggaggcccaccggtatcttcttcactgcgcacggctgaatgggcgccccgtttgcgaggattcctttagccaggaggcagtgtccaaggtggctgccggagaaagggtagtgcgacgcccatcgtaccttgatttgtttaggacgccaagactccgtcatatctcactgtgctgtgtcgtcgtctggtttggagttaatttctcttattatggactaagcctggatgtaagtgggcttggtctaaacgtgtatcagactcaactgctgttcggcgctgtggagttgcccagtaaactgctcgtatacctcagtgtaaggtacgccggacgcagactgacacaggcgggcacgctcctgggtaccgcactggcgtttggcactaggctgctggttagctcggatatgaagtcatggtctacagttctggcagttatgggtaaggccttcagcgaggcagcatttaccaccgcctatctctttacaagtgagttgtaccccaccgtacttagacagaccgggatgggccttaccgctttggtcgggcgcctaggtggaagtctcgctcccctggcagctctgctggacggcgtgtggctctcgctccctaaactcacctatgggggaatcgcattactggcggctggtacggcactgctgttgcccgagacccgccaggcccagctgcctgaaactatacaggacgttgagcggaagagcgcccccacttccctgcaggaagaagagatgcccatgaagcaggtccagaactag

SEQ ID NO: 205765 - DNA, 1641 bp, Artificial Sequence
  Description of Artificial Sequence: Synthetic coding sequence
atgggcttcgaggagctgctggagcaggtgggcggcttcggcccctttcaattgaggaatgtcgcactgctggccctcccaagggtcctgctgccattgcacttccttcttccaatcttcctcgccgctgttcctgctcatcgttgcgcgctgcctggcgctccagcaaacttctcccatcaggatgtgtggttggaggcccacttgccaagagaaccggacggcaccctgtcctcctgcctgaggttcgcatacccgcaggccctgcccaatacgactctcggtgaggaacgccagtcgcgaggagaactggaggatgaacccgccaccgtgccctgttctcaaggctgggagtacgatcattcagaattttcgtccaccatagcaactgaatgggacctggtgtgcgaacaaaaaggccttaaccgagctgcaagtacctttttctttgccggggtgctggtgggtgccgtagccttcgggtatctcagcgatagattcgggcggcgcaggctgctgctagttgcttacgtgagtactcttgtgcttgggctagcttctgctgcctctgtcagctacgttatgttcgccattactcgtaccctgactggcagtgccttggctggtttcactataattgtcatgcctttagagctcgaatggttagatgtcgagcaccgcaccgttgccggagtcctcagttccacgttctggaccggcggcgttatgctattagcgctggtggggtaccttattcgggactggcgatggctgcttttggccgtcacactcccttgcgccccaggtattctgtctctttggtgggtgccagagagcgctagatggctcctcactcagggacatgtgaaagaggcacaccggtacctcctccattgcgcccgcctgaacgggcgaccggtgtgcgaggactcgtttagtcaagaggccgtttccaaagttgctgccggggaacgggtggtaagacgaccttcctacctggatctgtttcggacaccgcgtttaaggcatattagtctgtgttgtgtggtagtgtggtttggcgtgaacttctcttactatggactgtccctggatgtatccggtctcggcctgaatgtctaccaaacccaactgctctttggcgctgttgagctgccctccaaactgctcgtgtacctgagcgtgagatacgctgggcgcagactgactcaggctggcactctcttggggaccgccctggcttttgggactcggctccttgtatcttcggacatgaaatcatggtctacagtgctcgcagtgatgggaaaggcattcagtgaagccgcattcacaacagcctacttgtttacctctgagttgtaccctaccgtgttaaggcagactggaatgggtttgaccgcactagtcgggaggttgggtggcagcctggcccctcttgcagctctcctggatggtgtgtggctgtcacttccgaaattaacatacgggggcattgcactgctggccgccggcacagccttactcctgccggagacaagacaagcccagctccctgagacgattcaggatgttgagcggaaatcagctcctacttccctgcaggaggaggaaatgcccatgaagcaagtccagaactag

SEQ ID NO: 205766 - DNA, 636 bp, Artificial Sequence
  Description of Artificial Sequence: Synthetic coding sequence
atgctgcagccccacctgctgccctaccaggccgtgagcaaggtggcagccggggagcgggtcgtgcgtaggccatcgtacctggatctgtttcggactccccgactccggcacatcagcttatgttgtgtcgttgtctggtttggtgtcaacttttcatattacggcttgagtctggatgtgagcggtttggggctgaacgtctatcagacacagctcctgttcggggccgtcgagttaccatctaaactcctggtctatctgagtgtcaggtacgcgggcaggcgacttacacaggccggcaccttgctgggcacagctctggcctttggtacccggctgttggtatcctctgatatgaagagttggtctacagtgctcgctgtcatgggcaaagcgttttcagaagctgcctttacaacggcttatctctttacaagtgagttatatccgacagtgctacgccaaacaggcatgggcttgacagcattagtggggagactgggaggcagtctcgccccactggcagccctgctggatggtgtttggttgagtctgcccaaactaacttacggaggcattgccctccttgccgcagggactgctctgttattacccgaaaccaggcaggcctag

SEQ ID NO: 205767 - DNA, 837 bp, Artificial Sequence
  Description of Artificial Sequence: Synthetic coding sequence
atgggcttcgaggagctgctggagcaggtgggcggcttcggccccttccaattacgcaacgtggccctgctcgcgctaccgagggttcttcttcccctccactttctgcttcccattttcctcgcggctgtcccggcacacagatgcgctctccctggggcgcctgcaaacttttcacatcaggacgtctggttagaggcacacctgcctagggaacccgacggcactctgagcagctgtctaaggttcgcctacccccaggctctccccaataccaccctgggagaggagcgccagtcccggggagagctggaggatgaacctgcaactgttccatgctcacaaggttgggaatatgaccatagcgagttcagctcaactatagcaacagaaagccaggtcgggatctatataatccacctggaggtagaatgtcgatggagacagagtccttgggaggctgccgggagaggcctgccttgggaagaggcagaggccgctggacttggtcgtgacaaagtctcctattctccttcatggagagaatcactgggcggtctgctgagcggaatggaatgggatctggtctgtgagcagaaaggactgaacagggccgccagcaccttcttttttgcaggagttctggtaggagcggtggcattcggctatcttagcgatcgatttggccgtcgccgcctacttctcgtggcctatgtgagcactctagtgctgggactcgcaagcgcagccagtgtgtcctacgtgatgttcgctattacccgcactcttacaggcagcgctctggccggattcaccatcatcgttatgcccctatag

SEQ ID NO: 205768 - DNA, 444 bp, Artificial Sequence
  Description of Artificial Sequence: Synthetic coding sequence
atggagtgggacctggtgtgcgagcagaagggcctgaaccgggccgctagtaccttcttttttgccggtgtcctggtcggcgctgtcgccttcggctacctgagtgatcggtttggaagaaggcgcctgctgctggtggcctacgtcagtactctggttttgggactagcatccgctgcctccgtgagctatgtgatgttcgccataactcgcaccctaaccggcagcgctttagcaggctttactatcatcgtaatgccgctaggggaggccgaacttgaatggctggatgtggagcatcggaccgtggccggcgtcctgtccagcacgttctggacagggggagtgatgctccttgccctggtgggatacttgatcagggattggaggtggcttctgctggctgtaaccctgccgtgcgcaccaggaattctttcactctag

SEQ ID NO: 205769 - DNA, 1629 bp, Artificial Sequence
  Description of Artificial Sequence: Synthetic coding sequence
atgaccttcagcgagatcctggaccgggtgggcagcatgggccactttcagttcctgcacgtggccatcttgggcctgccaatcttgaacatggccaaccataatctgctccagatctttactgcagcaacacccgtgcaccactgcaggccgcctcataatgcctctactgggccgtgggtcttgcctatgggtcccaacggaaagcccgagaggtgtctgagattcgtgcacccccccaatgccagtttaccaaatgacactcagagggccatggagccgtgcctagatggatgggtctacaatagtaccaaagattccattgtcacggaatgggacttagtgtgtaattctaacaagcttaaggagatggcacagagtatatttatggccggcatcctgattggtgggctagttttgggtgacttgtcagaccggttcggaaggcgccccattctgacctgctcatatttgcttctagcagcctctggaagtggcgctgcattttcccccacatttcccatctacatggtctttagatttctgtgcggctttggaattagtggcatcactttatccactgtgatcttaaatgtagagtgggtcccaaccaggatgcgagcgatcatgtcgaccgctctaggctactgctatacgtttggccagttcatcctgcccggcctggcctacgctatcccccagtggagatggctacagctgaccgtgtcaattccattctttgtattcttcttgagctcttggtggacacccgagagcatacgctggttagttttatctggcaaatccagcaaggcactaaagatcctcagaagagtggcagtttttaacggcaaaaaggaggaaggagagaggctaagcttggaggaactgaagctcaacctccaaaaggaaatcagtctagccaaagccaaatatactgcgtccgacctctttcgaatcccaatgctgcgacgaatgacattctgtctgtcccttgcctggtttgctaccggattcgcctactattcactagccatgggcgtagaggagtttggagtgaacctttacatcctccagataatcttcgggggtgtggatgtgcctgctaagtttataaccatcctgtcactgtcctacttgggccggcatactacgcaggctgctgcgctgctgctagctggaggagcgatattagcccttacatttgttcccctagatttacagaccgtgcgtacggtgctggccgtgttcggtaaggggtgtctgtctagctctttcagctgcttgtttctctatacctccgaactctatccaacagtcattagacagaccggcatgggggtcagtaatttgtggacccgagtcggcagcatggtgagcccattggtgaagataaccggtgaagtgcagcctttcattcccaatattatatatggaataaccgccttgcttggaggctctgctgcccttttcctgcctgaaacactgaaccagccactcccagagactatcgaggatctggagaattggtccttgagagccaagaaacctaaacaggaaccagaggtcgagaaggcctcccagcggattcccctccagcctcacggccctggcctggggtcctcctag

SEQ ID NO: 205770 - DNA, 1629 bp, Artificial Sequence
  Description of Artificial Sequence: Synthetic coding sequence
atgaccttcagcgagatcctggaccgggtgggcagcatgggccacttccagttcctgcacgtcgctatcctcgggctgcccatactgaacatggccaaccataatctcctccaaatcttcaccgccgccacacccgttcaccactgtcgaccaccccacaacgcctctacgggtccctgggtgctgcctatgggcccaaacgggaagccagagaggtgcctcagattcgtgcacccaccaaacgcttccctgcccaatgatacacagcgcgccatggaaccttgcctggacggatgggtttataactcgaccaaagattcaattgtgacagagtgggacctagtgtgtaattctaataagctgaaggagatggctcagtctattttcatggcagggattttgatcggcggtctggtgttgggtgatctatccgatcgatttggacgaaggcccattctgacctgcagctaccttctcctggccgcgtccggctcaggtgccgccttcagcccgaccttccccatatacatggttttccggtttctgtgtggctttggcattagcggaatcaccctgtctaccgtgattttaaatgtagagtgggtgccaacccgcatgcgcgccattatgtccaccgccctcggctactgttatactttcgggcaattcattcttcccggactggcctacgccatcccacagtggcgctggcttcagttaacagtgagcattccatttttcgtttttttccttagctcctggtggactccagaatctattagatggctggttctcagtggtaaaagttccaaggctctcaagattctgagacgggttgcagtgttcaatggcaaaaaagaggagggcgaaagattgtcccttgaggaactgaaactgaacctgcagaaggagatttcccttgcaaaggctaagtatacagcctctgacctgtttagaatccccatgcttcggcgcatgaccttctgcttgagtttagcatggtttgctaccggctttgcttattactcactggcaatgggggtggaagagtttggagtaaatttatacatcctgcagatcatttttggcggtgtggacgtgcccgccaagtttatcactatcctcagcctgagctatctcggccgccacaccactcaagctgccgcccttctactggccggaggggctattctcgcactaactttcgtgcctctggatctgcaaactgtgcgcaccgttttggctgtgttcgggaagggatgtcttagcagttcattcagttgcctttttctgtacaccagtgagttataccctacggttatcagacagacaggcatgggtgtttctaatctttggaccagagtaggatctatggtctctcctctggtgaagataactggagaggtccaaccctttatccctaacatcatttatgggataactgctctcctgggcggatccgccgctctttttctccctgaaactttaaatcaacctctgcctgaaacaattgaggatttggagaactggagtttacgtgcaaagaaaccaaagcaggagccagaggtggagaaagctagtcagagaatacctctgcagccccacgggcctgggctgggatccagctag

SEQ ID NO: 205771 - DNA, 1587 bp, Artificial Sequence
  Description of Artificial Sequence: Synthetic coding sequence
atgaccttcagcgagatcctggaccgggtgggcagcatgggccactttcagttcctgcatgtggcgattctcggcctgccgatactcaacatggctaaccactgtcgcccaccccacaacgcaagtacgggcccatgggtcctccctatgggacctaatggcaagccagaacgttgtttacggtttgtccatcccccaaatgccagtctgccaaacgacacacagagagccatggagccctgccttgacggatgggtttacaatagtactaaggacagtattgtcaccgagtgggatctggtctgtaacagtaataaactgaaggaaatggctcaatcgatttttatggccggaatccttattggaggactggtgcttggggacctgagtgatcggtttggcaggcgcccgatcctcacctgtagttacttattgcttgccgcatccggctctggagcagcatttagtcccaccttccccatctacatggtttttcggtttctctgcggatttggcatcagcgggatcacgcttagtactgtcatcctgaacgtggaatgggtccccacccgtatgcgcgctatcatgtcaaccgccctgggctactgctacacattcggccagtttatccttcccgggcttgcttacgcaatccctcaatggcgctggttgcagctgacagtgagcatccctttcttcgtgttcttccttagctcctggtggacgcctgagagcatacgttggcttgtgctcagcggcaagtcctcaaaggcactcaagatcctgcgtcgggtggctgtgttcaatgggaaaaaagaagaaggcgagaggctgtcgctcgaggagctgaagctcaatctccagaaagagatcagccttgcgaaggccaaatacaccgctagcgacctttttagaatccccatgttgaggaggatgactttttgcttatcacttgcgtggtttgctacaggctttgcttattatagcttggccatgggcgtagaagaattcggggtgaatctctacatccttcaaattatcttcggaggcgtggacgttcctgctaagtttataactattctgtccttatcctacctggggaggcacacaacacaggcagctgctctgctcctggccggaggggccattcttgccctaacctttgttcctttggatcttcagacagtgaggaccgtcttggcagtgttcggtaagggttgcctcagcagcagcttctcatgtttatttctctatacaagcgaactgtatcccacagtgattagacagaccggcatgggagtcagcaatctttggacgagggtcggatctatggtgtcccccctggttaagatcaccggcgaggttcaaccatttattccaaacattatatatggaattaccgctctcctggggggatctgcagccctgtttttgccagaaaccctaaatcagccattaccagaaactatcgaagatcttgagaattggtccttgagagcaaaaaaacccaagcaagagcctgaagtcgaaaaagcatctcagcggattcccctccagcctcacgggccaggcctggggagcagttag

SEQ ID NO: 205772 - DNA, 1653 bp, Artificial Sequence
  Description of Artificial Sequence: Synthetic coding sequence
atggccttcagcaagctgctggagcaggccggcggcgtgggcctgtttcaaacgctgcaggtgctgacctttatcctcccgtgcctgatgattcccagccagatgctcctggaaaacttttcggccgccatccctgggcaccggtgttggactcatatgctggacaacgggtccgcagtgtctaccaatatgacccctaaggcgctactaactatttccatccctccggggcccaaccagggaccacaccaatgcaggcggtttcggcagccccagtggcagctgctcgacccgaacgctacagctactagctggagtgaggcagataccgagccctgtgtggacggctgggtctatgatcgtagcgtgttcacttcaacaatcgtagcaaagtgggatctggtatgcagcagccagggactgaagccactctcccaatccatctttatgagcggcattctggtcggatccttcatttggggactactttcataccggttcggcagaaagccaatgttgtcttggtgctgcttacaactggccgttgccggtacctctaccatctttgcacctactttcgttatatactgtggccttcgcttcgtggctgcattcggcatggcaggcattttcctgtccagtctgacactgatggtggaatggactaccacctcccgccgcgccgttacgatgaccgtggtgggatgcgctttctctgctggccaggcggccctgggcggtctcgccttcgccctgcgagactggcgcacgttacagttagccgcctcagttcctttttttgctatctctctgatttcatggtggctaccggaatccgcaaggtggctcatcataaaagggaaacccgaccaggctctgcaggaattaagaaaggtggcacgcatcaacggtcacaaggaggccaagaaccttaccatagaggttctgatgtctagtgtgaaagaggaagtggcgagcgccaaagagcctcggtctgttctcgacttgttttgtgttcctgtcttgagatggcgctcctgtgctatgctcgtggtcaactttagtcttttaatcagctactatgggttagtctttgacctgcaaagcctagggcgggacatattcctgctgcaggctttatttggtgctgtggatttcctggggcgagctactacagcactgctgctgagtttcctgggcaggcggactattcaggctggctcacaagccatggccggactggccatactagcaaatatgcttgtaccacaggatctgcaaacactgcgagtggtttttgctgtcttgggtaaaggttgcttcggcatctctctcacttgtctgaccatctacaaagctgaactgtttccaacgccagtgagaatgactgccgatggcatcctgcacacagttgggcggttaggcgctatgatgggccctcttatccttatgtctaggcaggcactgccactcctgcccccgctgctgtacggtgtgatcagtatcgcgagcagtctggtggtattgttcttcctcccagagacacaaggactgccactgcccgacaccatccaggacctcgagtcccagaagtcgaccgccgctcagggcaatcgtcaggaggccgttacagtcgagagtacctcactgtag

SEQ ID NO: 205773 - DNA, 1338 bp, Artificial Sequence
  Description of Artificial Sequence: Synthetic coding sequence
atggccttcagcgagctgctggacctggtgggcggcctgggccggttccaggtgcttcaaacaatggcactgatggtgagcatcatgtggctgtgtacccagtcgatgttggagaatttttccgctgctgtgccctcacaccggtgttgggcacctcttctcgataattccactgcccaagcttcaattctgggttctctgtcccccgaagcacttttggccatcagtatcccccccggcccaaaccagaggcctcatcaatgtcggaggttccgacagcctcagtggcagttactagaccccaatgctaccgccacctcctggagcgaggccgacaccgagccttgcgttgacgggtgggtctacgatcggtctatttttacttcaaccattgttgcaaagtggaatttggtctgcgactcccatgccttgaaacctatggcccagtcaatctacctggccggcattcttgttggggctgccgcgtgcggaccagcttccgaccgctggttggctgagtcagctagatggctcctgaccactggtcggctcgactggggacttcaagaactgtggcgggtggccgcaatcaatgggaaaggggccgtgcaggacaccctaacaccagaggtattgttgtcagctatgagggaggagctgtcaatgggacagccccccgcgtcactcgggactctgcttaggatgccaggtctgaggttccgaacctgtatctctacactgtgctggtttgccttcggtttcaccttcttcggcttggcgctagatctgcaggctctgggctctaatatctttctgttgcaaatgttcataggagtggtggacattccagccaagatgggcgctctcctattgctctcccacctagggaggaggccgacgctggctgcgtccctgttgctggctggcctatgcatccttgctaatacgttagtcccccacgagatgggcgcccttagatccgctctggccgtactcggactgggaggggtaggagctgcctttacctgcattacaatctattccagcgaactatttccgacggttctgcggatgaccgcggttggccttgggcagatggccgctaggggcggagccatccttggcccactggttcggctgctcggggtccacggcccttggctgcccctgctggtgtacggaacggtgcccgtcctgagtggactagcggccctgctgctgccggaaacacagagcctgcccctccccgatacgatccaggacgtgcaaaatcaagctgtcaaaaaggcgactcacggaacattgggaaactcagttcttaaaagcactcagttttag

SEQ ID NO: 205774 - DNA, 1662 bp, Artificial Sequence
  Description of Artificial Sequence: Synthetic coding sequence
atggccttcagcgagctgctggacctggtgggcggcctgggccggttccaggtcctccaaactatggctttgatggtcagtatcatgtggctctgcactcaaagtatgctggagaattttagcgccgctgtgccaagtcatcgctgttgggccccattgctggacaacagcacggcccaggcatccattctaggaagcctgtcccccgaggctttgctggcgatctctattcctcccgggcctaaccaacggccacatcagtgccgtcgctttaggcagccgcagtggcagttattagaccctaacgctaccgccactagctggagcgaagccgatacagagccatgtgttgatggatgggtctatgatcggagtatttttacatctaccatcgtggcaaagtggaacctggtgtgtgattctcatgcgctcaagcccatggcccagagcatctatctcgcaggtattctggtcggcgccgctgcctgcgggcccgcctctgatcgattcggccgccgactggtcttgacatggtcttacttgcagatggccgtaatgggcaccgcggctgcatttgccccagcattccccgtgtactgtctgttccgattcctgctagcattcgccgtcgccggcgtcatgatgaacactggcacgctcctgatggagtggactgccgcccgcgcacgccccctcgtgatgactctgaacagtctggggttcagcttcggccacggactgaccgctgcagttgcatacggtgtcagagactggactctgttgcagctggtggttagcgtacctttctttctgtgcttcctttattcatggtggctggcggagagcgcaaggtggctgctgaccacggggcggctcgactggggactccaagaactctggagagtggctgccattaatgggaagggggcagtacaggacacccttacgccagaagtactgctgtctgccatgagagaagaactcagcatgggacagcccccagcgtcactggggactcttctgagaatgccaggcttgagattccgtacgtgtatcagcactctgtgctggtttgccttcggctttaccttctttgggctggccctggacttacaagctctaggaagcaacatcttcctcctacagatgttcatcggggtggtcgatattcctgcgaagatgggagcgctgcttctcttgagccatctgggtagaaggcccaccctggctgcctctcttctactcgctggcctctgcatcctggctaacacgcttgtgcctcacgagatgggggcgctgcgaagcgcactcgccgtgttggggctgggaggggtcggtgccgcttttacctgtatcactatctacagcagtgaactgttccccactgtgctgcgcatgactgccgtgggtctggggcaaatggcagctcgtggcggcgctattttgggtcctctcgttaggttattgggcgtgcacggcccttggctccccctgctggtttatggcacggtcccagttttgtcaggtctggcagcgcttctgcttcctgagacccagtctctccctcttccggacactatacaggacgtccaaaaccaagccgtgaagaaggcaacacacggaactttggggaacagcgtgctaaaatctactcagttctag

SEQ ID NO: 205775 - DNA, 999 bp, Artificial Sequence
  Description of Artificial Sequence: Synthetic coding sequence
atggagtggaccgccgcccgggcccggcccctggtgatgaccctgaactccctgggtttctcctttgggcacggcctcacagccgctgtagcctatggagtcagagattggactttgctgcagctggtggtgtccgtgccattttttctgtgctttttatatagctggtggctggccgaaagtgccagatggttgctcaccactggccgcctggattggggtctgcaggagctttggcgagtagctgccatcaatggaaaaggagccgtccaggacactctaacacccgaagtcttgctgagcgcgatgagagaggagctttccatgggccagccccccgcaagtctcgggaccctgctacgcatgcctggactgaggtttagaacctgcatttctaccttgtgctggttcgctttcggatttaccttttttggcttggcccttgacctccaggcgttggggagtaatatctttctgctgcagatgttcattggagtggtggacatccccgctaagatgggtgcacttttgctgctttctcacctggggagacgtccaacgctcgcagcatccttactcctggctggcctgtgtattctggcaaacaccctggttccccatgagatgggagcattgcgaagcgctctggctgtactggggttaggcggagtaggggctgcttttacctgtatcacgatttatagcagtgagcttttcccgacggtcctcaggatgaccgccgtggggcttggtcagatggcagcgcgcggaggtgccattctgggaccactcgtgcgtctactaggagtgcatggcccctggctgcccctcctcgtctatgggaccgttcccgttctgtcaggcttggccgcattactgttacctgagacccaatcactgcctctccctgatacaattcaggatgtgcagaaccaggccgtgaagaaggccacccatggcaccctcggcaatagcgtcctcaagagtacgcagttctag

SEQ ID NO: 205776 - DNA, 1665 bp, Artificial Sequence
  Description of Artificial Sequence: Synthetic coding sequence
atgcccaccgtggacgacatcctggagcaggtgggcgagagcggctggttccagaagcaggcttttctgattctgtgtctactttctgcagcatttgcccctatctgcgtgggaatagttttcctcgggtttacccccgatcaccattgtcagtcacccggggtagcggagctgtctcaacgctgtgggtggagccccgctgaggagctgaactatacagtccccggcttgggacctgccggtgaagcctttcttggccaatgccgaaggtatgaggtggactggaaccagtctgccctgagctgtgttgatcccctagcatccctggctactaaccgtagtcacctgccactcggtccatgccaggatggttgggtctacgacacccctggcagctctattgttaccgagtttaatctggtgtgtgccgattcttggaagctggatcttttccagagctgcctgaacgcaggattcctattcggttccctgggcgtgggatatttcgccgaccggtttggccgcaaactgtgtctgcttggcactgttctggtgaatgccgtcagtggcgttctgatggcttttagtccaaattacatgtccatgttactatttagactccttcagggactggtatcaaaaggtaactggatggcaggatacactctgattaccgaatttgtcggatctgggtcaaggcggacggtcgccatcatgtatcagatggccttcactgtgggattggtcgcactgaccggactcgcttatgcactaccccattggcgctggctgcagttagcagtgagccttcctacctttctgttcttgctgtattactggtgtgttccagagagcccgaggtggcttctgagccagaagagaaatacagaggctatcaaaataatggaccatatcgcacagaagaacgggaagctgcctcccgcggatcttaagatgcttagtctcgaggaagatgttacggaaaaattgtcacctagctttgccgacctattccgaacgccccgcttacggaaacggacctttattctgatgtatctatggtttaccgacagtgtgctgtatcaaggtctcattctgcacatgggcgcaaccagtggaaatctctacctcgatttcctgtattcagccctggtcgaaatacctggggcattcattgctttgatcaccatcgaccgcgttggacgcatctaccctatggcaatgagcaatctgctggcaggcgctgcatgcctggtgatgatatttatctccccagatcttcattggctgaacatcatcatcatgtgcgtgggaagaatgggaatcacaattgctattcagatgatttgcctggtgaatgccgagctgtatcccacgtttgtgagaaaccttggggtgatggtttgttcctcactgtgcgacatcggcggcattatcactcccttcattgtcttcaggctacgggaggtgtggcaggcactccctttgattctctttgccgtcttaggattgctggccgccggcgtaacactgttgctacccgagacgaagggagtagccctgcccgagacaatgaaagatgccgaaaacctggggcgcaaagcaaagcctaaggagaacactatttacctcaaagtgcagactagcgaaccttcagggacatag

SEQ ID NO: 205777 - DNA, 1005 bp, Artificial Sequence
  Description of Artificial Sequence: Synthetic coding sequence
atgttcttcctgctggccctgctgagcgccaccttcgcccccatctacgtgggaattgttttcctggggtttacccccgaccaccgctgcagatcccctggagtggccgaattgagcttgcgctgcggctggtctccagcagaagagctgaactatacagtgccagggcccgggccagccggcgaagcctctccccgccagtgcaggcggtacgaggtcgactggaaccaatccaccttcgattgcgtggaccccctggcttctttggataccaatcggtcccgactccctttggggccatgtagggacggttgggtttacgaaacccctggcagctccatcgtgacggaattcaacttggtctgcgccaattcatggatgcttgacttatttcagagcagtgtcaatgtcggattctttattggttctatgtccatcggctatattgctgatagatttggtcggaagctctgtctcttaacgaccgtactgatcaacgcagctgcgggagtgttgatggccatatcccctacatacacctggatgctgattttcaggttgattcagggcctggtcagcaaggcaggttggctgatcggctatatactgataaccgagttcgtcggtcgtcgatacagaagaacagtgggcatcttctatcaggtggcctataccgtcggtcttttggtcctagctggcgtagcttacgccttacctcactggcgatggctgcagttcacagtgtcccttcctaacttttttttccttctctattattggtgtattcctgagtccccacggtggctcatctcgcagaacaagaacgccgaggccatgaggattatcaagcacatcgcaaagaagaatggtaaaagcctaccggcatcgctgcagagactgcgcctcgaggaggagacaggaaaaaagctgaatccatcttttctcgacctggtaagaacacctcagattcgaaagcacaccatgatactgatgtacaattggtag

SEQ ID NO: 205778 - DNA, 1668 bp, Artificial Sequence
  Description of Artificial Sequence: Synthetic coding sequence
atgcccaccaccgtggacgacgtgctggagcacggcggcgagttccatttttttcagaaacagatgttcttcttgctggcgctgctcagtgctacgttcgcaccaatctatgtggggattgtatttttggggtttacacccgaccatcggtgcagaagcccaggcgtcgcagagctgtccctccggtgtggctggtcacccgcggaggagctgaactatacggtacctggacctgggccggccggcgaggccagcccccgtcagtgtcggaggtacgaggtagactggaaccagtccacgttcgattgtgtggatcccctggcttctctggatacaaacagatcacgactcccactcggcccctgtcgagatggatgggtgtacgaaacgcccggcagcagcattgtgactgagttcaacctggtttgcgcaaactcatggatgcttgacctcttccaatcgtccgtgaacgtcggcttttttataggatcaatgtccatcgggtacatcgctgatcggttcgggaggaagctgtgcctgcttactactgtactgattaatgccgccgctggtgtgcttatggcaatatctcccacgtatacatggatgcttatctttaggttaattcagggactggtctccaaggcgggctggttgattggctacattctcattaccgagttcgttggacgccgatacaggagaactgtgggtatattctaccaggtggcatacacggttggactgctggtgctggccggagtagcatatgctctgcctcactggcggtggttacaatttacagttagcctccctaactttttctttttgctgtactattggtgcatccccgagtccccacggtggctgatctctcagaacaagaatgccgaagccatgcggataattaaacatatagccaagaaaaacggcaagtcgctcccagcctctctgcagcgcctgcgtttggaagaagagaccggaaagaagctgaacccttctttcttggatttggtccgcaccccgcaaattagaaagcatactatgattctgatgtataattggtttacctcaagcgtactctaccaaggcctgattatgcacatggggctcgccggcgataatatctacctcgatttcttttacagtgccctcgtcgaatttccagcagcttttatgataatcctgaccattgaccgaatcggacgtcggtacccttgggccgcctctaatatggtcgcaggggccgcctgtctcgctagcgtctttatccccggggatctgcagtggttgaaaataatcattagttgtctggggcgtatgggcatcaccatggcctatgagatcgtgtgtctcgtaaacgccgagctataccctacattcatcaggaacctgggtgtccacatttgtagctctatgtgcgatatcggaggcatcataactccctttctcgtgtacagactgactaatatatggctcgagctgcccctcatggtgtttggcgtgcttggcctggtggctggcggactggtcctgctgctccccgagaccaagggtaaagccctaccagaaaccatcgaggaggcggagaatatgcagagaccaaggaaaaacaaagaaaaaatgatatatctgcaagtccaaaaactcgacattccattaaattag

SEQ ID NO: 205779 - DNA, 1632 bp, Artificial Sequence
  Description of Artificial Sequence: Synthetic coding sequence
atgcggaccctgcacgccgtgagccacccctacagcaacagcatgaggtttcagagagtgctgtatttcatatgtgcatttcagaatatatcttgcggaatacattaccttgccagcgtgttcatgggcgtgacacctcatcacgtgtgcaggccccccggaaatctccagaatggagagatttgggaattatctaggtgtagtagaaacaaaagggagaacacatcatcccttggctacgaatataccggaagcaagaaagaattcccttgtgttgacgggtacatctacgaccaaaacacctggaagtctactgcagtcacccagtggaatcttgtgtgcgacaggaagtggctcgcaatgctaatccagccactgtttatgtttggcgtgctgcttggctcagtcactttcgggtacttctccgaccggctgggcagacgtgttgtgctctgggcaacctcaagcagtatgtttctttttggaattgcagctgcatttgcagtcgactattatacttttatggccgcccgcttcttcctggccatggttgcaagtggatatttggtggttggatttgtatatgttatggagtttatcggaatgaagagtcggacatgggcctccgttcacctgcattcgtttttcgctgtgggaacacttttggtagccctgacaggctatctggtcagaacttggtggttataccagatgatcctttcaactgtgaccgttccgtttattctttgctgctgggtactaccagagactccattttggctcctgtccgagggcagatacgaggaggctcagaagattgttgatataatggccaagtggaatcgtgcctccagctgtaagttaagtgagctgctgtcattagatctgcagggcccagttagcaactctcccacagaggtccaaaagcataacctgtcctacctgttctacaattggagcattaccaaacggaccctaaccgtgtggctgatctggtttacaggttccttaggattctatagtttctccctgaacagcgtgaacctcgggggaaacgaatacctcaatctttttctccttggcgtggtggagatcccagcttataccttcgtttgtattgctatggacaaagtggggcgccgcaccgtgttggcttactccctgttctgtagcgctcttgcttgcggagttgtgatggtcatcccacagaaacattacattctgggcgtcgtgactgccatggtggggaaattcgcaataggcgccgcattcggcttgatttacctatatacagcagagctgtacccaacaatagttaggtctctggcggtgggatcaggtagcatggtctgcaggctggctagcatcctggcgcccttcagtgtggatctgtcctccatatggatcttcatccctcagctgtttgttggcactatggccttgctgagcggagtgctgacgcttaagctgccagaaactctgggcaaacggctggctaccacttgggaggaggctgccaagttggagtccgagaacgagtctaagtcctccaaactacttctcactacaaataattctggactcgagaagaccgaagccattacaccacgagattccgggctgggagaatag

SEQ ID NO: 205780 - DNA, 1734 bp, Artificial Sequence
  Description of Artificial Sequence: Synthetic coding sequence
atgggcagccggcacttcgagggcatctacgaccacgtgggccacttcggccgctttcaacgagtactctattttatttgtgcgtttcagaacatatcctgcggcatccactatttagcaagtgtgtttatgggcgtcaccccccaccacgtctgtaggcctccgggaaacgtaagtcaagtggtttttcacaaccacagcaactggagtctggaagacacaggtgcgctgctgtcctctggacaaaaggactacgtgacagtccagttgcagaacggcgagatctgggagctgtcaaggtgtagccgcaataagagggaaaacaccagcagtctgggatacgagtatactggctcaaagaaggagttcccatgcgtggacggctacatatacgatcaaaatacctggaagtctactgctgttactcagtggaacttagtgtgcgatagaaaatggttggctatgctgatccagcccctgtttatgttcggagtattgctgggttcagttacatttgggtacttctcggatagacttggtaggcgcgtggttctttgggcaacatcatcctccatgtttctgttcggcatagcggctgcttttgcagtggattactacacgttcatggctgcgcgttttttcctggctatggtggcctcagggtatctcgttgttggttttgtttatgtgatggagttcatcggcatgaagtctcgcacttgggctagtgtgcaccttcactcattttttgctgtggggaccttgctggtggcgctgaccggctaccttgtgcgcacgtggtggctatatcagatgattctatcaacagtcacagtgcctttcattttgtgctgctgggtactgcctgagacccctttttggctcctcagtgaggggcgatatgaggaggcccaaaagatcgtcgacatcatggccaagtggaatcgcgcaagctcatgtaagctgagtgagttgctgagtttggacttacaaggtcctgtgagcaacagtcctacggaggtccaaaagcataacctatcgtatctcttttataattggagtataaccaagcggactctcaccgtgtggctgatctggttcactggatctctgggcttttattccttctccctcaacagcgtcaatttaggcggaaatgaatacttgaatttgtttctgctgggggttgtagagatccccgcttataccttcgtgtgcattgccatggacaaggtcggtcggagaactgtgctggcttactccctgttctgctcagccttagcatgcggagtggttatggtcatcccccaaaagcactatatactgggggtggtgaccgctatggttggaaaatttgcgattggtgctgcctttgggctcatttacctttataccgcagagctgtatcctaccatcgtgcgctctttagcggtcgggtcaggttctatggtctgccgcctggcgtctattctcgcccctttttccgttgacctctcttctatatggatcttcataccacagctgtttgtaggcaccatggccctgttgtcaggagtgttgaccctgaaactgcccgaaacccttgggaaaagattggcgacaacctgggaggaggcagctaagctggaaagcgagaacgagagcaagtcatcgaaactgctgctcactaccaacaattcaggactggagaaaaccgaagctataacgccgagagattccggtctgggggagtag

SEQ ID NO: 205781 - DNA, 525 bp, Artificial Sequence
  Description of Artificial Sequence: Synthetic coding sequence
atgggcgtgaccccccaccacgtgtgccggccccccggcaacgtgtcccaggtcgtgtttcataaccactccaactggagcctggaagacacaggcgccctactgtcctccggtcagaaagattatgttacagttcagcttcagaatggtgaaatctgggaattgtcaaggtgctccaggaacaaaagggagaacacatcctcgctggggtacgaatataccggtagtaaaaaggagtttccttgtgttgatgggtacatctacgatcagaacacttggaaaagtaccgccgtgacccagtggaatctggtctgtgatagaaagtggttagcaatgctcatacagcctttgttcatgttcggggtgctgctcggctctgtgacttttggatacttctccgataggcttggaaggcgggtggtcctgtgggccacctcgtccagcatgtttctgttcggaattgctgcggctttcgcagtggattactatactttcatggcagctagattctttctggctatgtag

SEQ ID NO: 205782 - DNA, 804 bp, Artificial Sequence
  Description of Artificial Sequence: Synthetic coding sequence
atgagcgccggcccccaggccatgctgggccggcgggtggtgctgtgggccacctcctccagcatgttcctgtttggtatcgccgccgctttcgcagttgattactatacgtttatggctgccaggttcttcctggctatggtcgcaagcgggtatctggtggtggggttcgtgtatgtgatggaatttattggcatgaaatcccggacttgggccagtgtgcacctgcattctttctttgccgtgggcactctgcttgtggcgctcacaggttacctcgtgcgcacctggtggttatatcaaatgatcctttctacagtgactgtgcccttcatcctctgctgttgggttttgcctgaaacccccttttggctgctttccgagggcagatacgaagaggcccagaagatcgtagatatcatggcaaagtggaatagagccagttcatgcaagctttccgaactgctcagcctggatctgcagggtcctgtgagtaatagtcctactgaagtacagaaacacaatcttagctacctcttttataactggagcattaccaaaagaactcttaccgtctggctgatttggtttacggggtcccttggcttttattctttctctttgaattccgttaacctaggtggcaatgaatacctgaacctgttcttgcttggcgtagtggagatcccagcctacactttcgtttgcattgcaatggacaaagtgggcagacggaccgttcttgcctacagcctcttctgttccgctctggcatgcggcgtggttatggtaattcctcagtag

SEQ ID NO: 205783 - DNA, 1056 bp, Artificial Sequence
  Description of Artificial Sequence: Synthetic coding sequence
atgggcgtgaccccccaccacgtgtgccggccccccggcaacgtgtctcaagttgttttccacaatcattcaaactggtcgctggaggataccggggcattactctctagcggtcagaaggattacgtaactgtgcagctccagaatggagagatttgggaacttagcagatgttctcggaataaaagagagaacacttcctccctgggttatgaatatactgggtccaagaaggaattcccttgcgttgatggctacatttacgatcaaaacacctggaaatcaacggccgtcactcagtggaacttggtttgtgataggaagtggttggctatgctaattcagcccttattcatgtttggagtgctgcttggctccgtcacatttgggtacttcagcgaccgactggggagaagagttgtcttatgggccacaagcagcagcatgttcttatttggaatcgccgccgccttcgcagtggactactataccttcatggcagcccggttcttcttggctatggtggccagtggctatctagtggtaggcttcgtatacgtgatggagttcatcggaatgaaatcaaggacttgggccagcgtccatttacattcgtttttcgcggtcggcaccctcctggtcgcactgactggctacttggtaagaacctggtggctttatcaaatgatcctctcaactgtgacagtgccgttcattctatgttgttgggttctccccgaaacacctttttggcttctgtcggagggccgatacgaggaggcgcaaaagatagtcgatattatggcaaagtggaatagagcctcaagctgcaagctttcggagctgttgagcctcgacctgcagggccccgtgtcaaattctcccactgaggttcagaagcacaatctttcctacctcttctataactggtctataacaaaacgcactttaaccgtctggcttatctggttcacaggttccctgggcttctactctttttctttaaacagtgtaaacctgggaggaaatgagtatctgaacttgttcctgctttag

SEQ ID NO: 205784 - DNA, 1548 bp, Artificial Sequence
  Description of Artificial Sequence: Synthetic coding sequence
atgggcagccggcacttcgagggcatctacgaccacgtgggccacttcgggagatttcaacgggtcctctactttatttgtgcatttcaaaatattagttgcggcatccactatttggcaagtgtgtttatgggggttactccacatcacgtatgcagaccccctggcaatgtctcccaggttgtgtttcacaatcacagcaactggtccctggaagacaccggtgctttactgtctagcggtcagaaagactacgtgaccgtgcagctccaaaacggagaaatatgggaactcagtcggtgttccaggaacaagcgggaaaacaccagctctctggggtatgagtatacgggatctaaaaaagaatttccctgcgtcgacggatacatttacgatcagaacacatggaagagtaccgctgtcacgcagtggaacctggtgtgtgacaggaagtggctggctatgctgattcagcccctgtttatgtttggggtgcttctgggaagcgtgacgttcggctatttcagtgaccgcctcggacgacgcgtcgttctctgggccacaagtagttcaatgttcttgtttggaatagcagctgcgtttgccgtcgattattataccttcatggctgcccgattctttttagctatggtcgcttccggatatttagtagtcggatttgtttacgttatggaattcattggtatgaaatcacgaacatgggctagtgtgcaccttcattcctttttcgccgtgggcactctgttggtggccctcacaggttatcttgttcgtacctggtggctgtaccaaatgatcctgtcaaccgtgacagtcccatttatcttatgttgctgggtcctgcctgagacaccattctggcttttgagcgagggaagatatgaagaggcccagaagatcgtcgacattatggctaaatggaatagagcgagttcatgtaagctctcagagttgctctccctcgacctccaggggccggtctcgaactccccaacggaggtgcaaaagcacaacctctcatatctattttacaactggagcattacgaagcggacacttaccgtgtggttgatttggtttaccggtagtttgggcttttatagcttcagtcttaactccgttaacctcggcggcaatgaataccttaacttgttcttgttgggcgtcgtggaaattcccgcttacacctttgtgtgtattgctatggacaaggtaggccggcgaacggtgctcgcctactctctattctgtagtgcactcgcctgcggcgtggtcatggtgattccacaaaagcattatattttgggcgttgtgactgccatggtgggaaagtttgccattggcgccgcttttgggttgatctacctctacaccgccgagttgtaccccaccatcgtgagatctctagcagtgggctcaggcagcatggtgtgtcggctagccagcatactcgcaccattttcagttgacctgtcaagcatttggattttcattcctcagttactaggacagcacctccaggaatag

SEQ ID NO: 205785 - DNA, 1299 bp, Artificial Sequence
  Description of Artificial Sequence: Synthetic coding sequence
gactacgtgaccgtgcagctgcagaacggcgagatctgggagctgtcgcgctgctcgcggaacaagagggagaatactagcagcctggggtatgaatacaccggtagtaaaaaggaattcccctgcgtcgacggctacatatacgatcagaatacgtggaagtctacagccgtcacacagtggaatttggtctgcgataggaagtggctcgcaatgctaatccagccattgtttatgtttggcgtactgctcggttctgtgaccttcggctatttctccgacagactaggccggagggttgtactctgggccactagctcttccatgtttctctttgggatcgccgccgcattcgctgtggattattacactttcatggctgctcggttcttcctggccatggtggcctcgggatatctggtggtcgggtttgtgtacgtgatggagttcatcggcatgaaaagccggacatgggcatccgtgcatttacatagcttctttgccgtgggaacgttgttggtggcactcaccggttatctcgtcagaacctggtggctataccagatgatcctgagcaccgtgacggtgccctttatcttgtgttgctgggtgctgcctgagacccccttctggctgttaagtgagggcagatatgaagaggctcagaagattgtggatataatggcgaagtggaaccgcgcgtcatcatgtaaactatccgagttattgagcctagatcttcagggtcccgtatctaattcaccaaccgaagtccagaagcataatctcagctacctgttctataattggtctataactaaacgaaccctcactgtatggctcatttggttcactggctccctcggtttttattctttcagtttgaattcggttaatctgggcgggaatgagtatctgaacctcttcctcttaggagtggtcgagatccctgcttacactttcgtatgcattgccatggataaggttggacgcaggactgtactcgcctattcactcttctgttccgccctggcgtgtggcgtggttatggtgattcctcagaagcattatatccttggcgtcgttaccgccatggttggcaaattcgccataggtgctgcatttgggctcatctatctctacactgctgagctgtaccccaccatcgtccgatccttggcggtaggcagcgggtccatggtttgccgcttggcatcaatcctggctccctttagcgtcgacttatcttcaatctggatcttcatcccacagctgctgggacagcacctgcaggagtag

SEQ ID NO: 205786 - DNA, 600 bp, Artificial Sequence
  Description of Artificial Sequence: Synthetic coding sequence
atgggcagccggcacttcgagggcatctacgaccacgtgggccacttcggtaggttccaacgagtgctctacttcatctgtgccttccagaacattagttgcggaattcattacttggcatccgtgttcatgggagtgacaccccatcacgtgtgtaggccccctggtaacgtgagtcaggtagtgttccataatcactccaactggtccctagaagacacaggtgccctgctgtcttctgggcagaaggattacgtgaccgttcagctgcagaatggagagatctgggaactatccagatgttctcggaacaagagggaaaatacctccagccttggttacgaatataccggatccaaaaaggagtttccatgcgtggacggatacatttatgaccagaatacatggaagagcaccgccgtgacccagtggaatctcgtgtgcgatagaaaatggttggccatgctgattcagcccctattcatgtttggagttcttctgggaagtgtaaccttcgggtactttagtgacagggtaggattcttgaccgcctggtacaagacctcaggctttcctacaagttcagcccccccgttgtag

SEQ ID NO: 205787 - DNA, 1674 bp, Artificial Sequence
  Description of Artificial Sequence: Synthetic coding sequence
atgcgggactacgacgaggtgaccgccttcctgggcgagtggggcccatttcagcgattaatcttcttccttctgtcagcatctatcatccccaacgggttcactggattgtcaagtgtgttcctgatcgcaacacccgagcatcgctgccgggtcccggatgccgctaacctttcaagtgcctggaggaaccatacagtaccactgcgcttgagggacgggcgggaggtgccccacagctgtcggcgctacaggcttgccacaatagccaatttttccgccttgggcttagagcctggccgggacgtagatctgggccagttagagcaggagagttgcctcgatggctgggagtttagtcaagatgtctacttatcaaccatagtcacagagtggaatttggtctgcgaggatgattggaaggcccctcttaccattagcctgttctttgttggggttctcctcgggtccttcatctctggccagctgtctgatcgttttggtcggaaaaacgtactgttcgtgacaatgggaatgcaaacagggttctcgtttctgcaaatcttttcaaagaatttcgagatgtttgtggtattatttgtgctagtgggtatgggtcagatatctaactacgttgccgcattcgttttggggactgaaatcctgggcaagagtgtccgtattattttttccactctaggagtatgcatcttctacgctttcggatatatggtactgccgctgttcgcatactttattcgggactggaggatgctcttggtcgctcttaccatgccgggagtcctttgtgtggcactctggtggtttatccctgaatcccccaggtggctgatctcacagggccgctttgaagaggccgaggtgattattaggaaggctgccaaggccaatgggattgtggttccaagcacaatttttgacccatctgagttacaggatttgtctagtaagaagcagcagagccacaacatcctggacttgctccgcacatggaacattagaatggtcactataatgtccatcatgctgtggatgactattagcgtggggtactttggactgagcttagacactcccaacctccacggagacatttttgtgaattgcttcctgagtgcaatggtggaggtccctgcttacgttctggcgtggttacttctgcagtatcttcccagaagatactccatggccactgccctgtttctggggggatccgtgctcctttttatgcagctagtccctcctgacctctactacctcgccactgtgctggtaatggtgggtaagttcggcgtgactgcagccttttccatggtctatgtgtacactgctgagttgtaccctacggtcgttaggaatatgggcgttggcgtcagttcaacggcctcaagacttggcagcatcttaagcccctactttgtgtatctcggggcctacgatcgatttcttccttacatcttgatgggtagtttgaccattctgacagctatattaaccctgttcctgccagagtcgttcgggaccccactgccggacaccatcgaccagatgttacgcgtcaaaggcatgaaacaccgaaagaccccgagtcacacgcgaatgttgaaagatgggcaggaacgacccacaattctcaagtcaaccgcattttag

SEQ ID NO: 205788 - DNA, 1746 bp, Artificial Sequence
  Description of Artificial Sequence: Synthetic coding sequence
atgcgggactacgacgaggtgaccgccttcctgggcgagtggggcccgtttcagcgcctgattttcttcctgctcagcgcctccatcatcccgaacggatttactggactttcctcagtgttcttgattgcaacccccgaacaccggtgcagagtacctgatgccgctaatctctcatccgcgtggcgaaaccataccgtgccactacgactccgggatggaagggaagtccctcattcttgtagacgttaccggctcgccaccattgctaacttcagcgcattggggttggagcccggccgtgatgtcgatcttgggcagctggaacaggagagttgccttgatggttgggagttttcccaggatgtataccttagcaccatcgtgacagagcaggacagcggcgcttacaacgcgatgaagaatcgcatgggtaaaaaacccgcactctgcctgccagcacagtggaacctggtatgcgaggacgattggaaggctcctctcacaatcagtctgttctttgtgggagtgctgctgggttctttcatttcaggacagttaagtgacagatttggtagaaagaatgtgcttttcgtgaccatgggcatgcagaccgggttcagctttctgcagatttttagtaagaactttgaaatgttcgtggtgttattcgtactggtgggaatgggccagatttcgaattacgtggctgccttcgtcttggggactgagatcctcggtaaaagtgttcgaattattttctccaccctgggcgtttgcatcttttacgcatttggatatatggtgctacctctgtttgcttacttcatacgcgattggcggatgctgctggtggcacttactatgcccggcgtcctgtgcgtagccctgtggtggttcatcccagagagtcctaggtggctgatttctcagggaaggttcgaagaggccgaggtcatcattcgtaaggctgccaaggcaaatgggatcgtcgtcccctcgacaatcttcgatccaagcgagctccaggacctctcctctaagaagcagcagagccacaacatcctcgacctcttgaggacctggaatattcgcatggtgactattatgtctataatgctctggatgactattagtgttgggtattttggcctatctcttgacacccccaatctacatggtgatatttttgtgaattgctttctgagtgccatggtggaggtgccagcgtatgtcctggcttggctgcttctgcaatacctgcctcgcaggtatagcatggctactgctctgttcctgggcggctctgtgttgctttttatgcagcttgtgccgcccgatctctactatctggctaccgtgctagtgatggtcggaaagttcggggtcactgctgcattttcaatggtgtacgtttacacagctgagctgtatcctaccgtcgttcggaatatgggagtaggcgtgtcaagtacagcttcacgactagggtcaatattgtccccatacttcgtttacctgggtgcatacgaccggttcctcccttacattctgatgggatctctaaccattctgacagctatcttaactcttttcctgcccgaatcctttggcacccctttgcccgacaccatcgaccagatgttaagggtcaagggaatgaagcatcggaagactccctcacatacccgaatgctgaaggatggccaggagagacctaccattttaaaaagcacagctttttag

SEQ ID NO: 205789 - DNA, 1656 bp, Artificial Sequence
  Description of Artificial Sequence: Synthetic coding sequence
atgcgggactacgacgaggtgatcgccttcctgggcgagtggggcccgtttcaacgcctgattttcttcttactatccgcctccatcatcccaaatggattcaacggcatgtctgtggtgttcctcgctggcacaccggaacatcggtgtagggtgcccgacgcagccaatttaagctccgcctggagaaacaacagcgttccgttgaggttacgcgacggcagagaggttccacactcttgtagccgctacaggctggccactattgctaatttcagcgcactcggactggagcctggccgagatgtcgacttggggcaacttgagcaagagtcctgtctggatggatgggaattttcccaagacgtgtatctgtctaccgttgtcactgagtggaatctggtttgcgaggacaactggaaggtgcctttgactacctctctgttctttgtgggggtactactgggatcttttgtcagcggtcagctctctgacaggtttggtcggaaaaacgttctctttgccacgatggcagtacagactggcttttcctttttacagatattttccattagctgggagatgtttaccgtactcttcgtcatagtgggtatgggccaaatttctaactatgtggtggctttcatcctgggcaccgagatattgggcaaatcagtccgcatcatttttagcaccctgggagtctgcacattcttcgctgtaggctacatgctgctgccattatttgcatatttcatacgcgactggaggatgctcctgctggcgctgactgtgccaggtgttttgtgcgtgcccctgtggtggtttattcccgagtctcctagatggctgatttcgcagaggcgcttccgcgaggctgaggatattattcagaaggccgccaaaatgaacaatatagctgtgccagctgtaatttttgactccgttgaggagctgaatcccctgaagcaacagaaggccttcatcttggacttatttcgcacccgaaatatcgctattatgacaatcatgtccctactgctgtggatgctcacctctgtaggctactttgccctgagtctggacgcccccaacctgcacggcgatgcatatttgaactgttttctctcagccttgattgaaataccagcatacattaccgcttggttattgctcaggactctgcccaggaggtacattatcgcagctgtcctcttctggggcggaggagtcctgttgtttattcagctcgtgcccgtcgactactactttctgtcgataggactggtcatgctcgggaaatttggaatcacctctgctttctctatgctgtatgtgtttacagccgaactatatcccactttggtgcgcaacatggccgtgggcgtaactagcaccgcttctcgcgtcgggtctataattgccccctattttgtgtacctgggcgcctacaatagaatgctaccctatatcgtcatgggctccttgactgtgctgattggaattctgaccttattttttcctgagagtcttggaatgactttacccgagacccttgaacagatgcagaaggtgaaatggttccgttccggtaagaaaaccagggattccatggagaccgaggagaatcccaaggtgctgatcactgccttctag

SEQ ID NO: 205790 - DNA, 1656 bp, Artificial Sequence
  Description of Artificial Sequence: Synthetic coding sequence
atgggcttcgacgtgctgctggaccaggtgggcggcatgggccggtttcagatctgcctcatcgcctttttctgcataactaacattctcctgtttcctaacattgtgctggagaactttaccgcatttacgccatcccaccggtgctgggttccactgctcgacaacgacactgtctctgataacgacaccggtacgctcagcaaagatgacctcctgcggatctcgatcccactggattcaaacttgcggccacagaagtgccagaggtttatccaccctcagtggcaactccttcaccttaacggtaccttccccaataccaacgaacccgacacggagccctgtgtggacggttgggtgtatgatcggtcatcctttttgtctacaatcgtgactgagtgggacctggtgtgtgagagccagtctctcaagtctatggttcagtctctgtttatggcgggcagcctcctaggcggtctcatttatggtcacttaagcgaccgggtgggacgcaagattatatgcaaactgtgtttcttacagctggctattagcaatacctgtgctgcttttgcccccacttttcttgtttactgtatactgcgtttcctggctggctttagcactatgacaatcttaggtaacacatttatcctctccctcgagtggacccttcctaggtctcgctcaatgacgataatggtgctcttgtgttcctattctgtgggtcagatgctgcttggaggcttggccttcgccatccaggattggcacatcctacagctgaccgtgtcaacaccaatcatcgtgctcttcctgagctcctggaaaatggtagagtctgccagatggttaattattaacaaccagttggacgaggggctgaaggaactccggagagtggcccacattaacggaaaaaagaacacagaagaaacgctcactaccgagctggtgcgctcaactatgaaaaaggagctggacgctgtcagaatcaaaacttcaattttctccctttttcgtgcgcccaaactgcgtatgcgagtctttggcctctgctttgtgcgatttgcgataaccgtgccattttacgggcttatcttgaatctgcaacacctgggctcaaatgtttcactattccagatactctgtggcgctgtgacattcactgctcggtgcgtctccttgctcaccctaaatcacatgggaagacggatctctcagatcctcttcacttttcccgtaggtttatttattctggtgaataccttcctgccacaggaaatgcagatcctgcgggtggtactggccaccttaggaattggcagcgtatcagccgcatcgaacagcgcatcggtccaccataacgaacttgtgccaaccatactgagaagcacggtggccggtatcaatgccgtatcaggtagaaccggcgccgccctggcgccgctgttaatgaccctgatggcctattcaccccacctgccgtggatcagctacggggtgtttcccattcttgccgttccagtgatccttctcctgcccgagacccgggatctccccttaccaaatactatccaggacgtggagaatgagaaggactccaggaacattaaacaggaagatacatgcatgaaagtgacacagttttag

SEQ ID NO: 205791 - DNA, 738 bp, Artificial Sequence
  Description of Artificial Sequence: Synthetic coding sequence
atggaggtggaggaggccttccaggccgtgggcgagatgggcatctaccagatgtacctctgcttccttctggctgtgttgctgcaactatatgtcgccacagaagccattttaatcgctctcgtcggagcaacaccgagttaccactgggatctggctgagctcctccccaatcagtctcatggaaaccagtctgccggcgaggatcaggcctttggcgattggctgctgacggcaaacggaagcgaaatacataaacacgtacactttagcagcagctttacctccatcgccagcgagtggtttctaatagccaaccgttcttacaaagtttcagccgccagtagcttttttttcagtggggtctttgtcggggtgattagctttggccagctttccgaccgttttggcaggaaaaaagtgtacctgactggctttgccctagacatcctgtttgcaatagctaacgggtttagtccgagctatgaattcttcgccgttacacggttcctggtgggtatgatgaacgggggcatgagcctcgtggcctttgtgctgttaaacgagtgcgtggggactgcgtattgggcactggccggcagcatagggggactgttcttcgccgtggggattgcccaatatgccctccttgggtattttatccggtcctggaggactctggccattctcgttaacttacagggaacagtcgttttcctgctgtcactagtggactag

SEQ ID NO: 205792 - DNA, 1644 bp, Artificial Sequence
  Description of Artificial Sequence: Synthetic coding sequence
atggaggtggaggaggccttccaggccgtgggcgagatgggcatctatcagatgtacctgtgtttcctgctggccgtgctgctgcagctgtatgtggccaccgaagcaatactgatcgcactggtaggggctacgccaagctaccattgggatcttgccgaactgctgcctaatcagagccacgggaaccagagcgctggcgaagatcaggccttcggcgactggcttttaacagctaatggtagcgagatccataaacacgtccatttcagctcatcatttaccagcatcgcttcagagtggtttttaatagcgaacagaagctacaaggtgtccgctgcaagctccttcttttttagcggcgtgttcgtgggcgtgatctcattcggtcaacttagcgaccggtttggtaggaagaaggtctatctgacaggttttgccctggatattctgttcgccatcgcaaacggtttctcaccgtcatacgagttttttgcagtcaccagatttcttgtcggaatgatgaatggggggatgtccctcgtagcttttgtcttgttgaatgaatgcgtgggcaccgcttactgggccctcgcaggaagcatcggcggactgtttttcgccgtgggcattgcccagtatgctctccttggctattttattcggtcttggcgtacattggccatcctcgtgaacctgcagggcactgtagtgttccttttaagcctatttatccccgagagcccgagatggctgtactcgcaagggcggctttcagaagctgaagaggcattatatctgatcgctaagcgtaatagaaagctgaagtgtactttttccctgacccatccagcgaaccggtcttgccgcgagacagggtctttcttagatctcttccgttatcgggtactgctagggcatacactcatcctgatgtttatctggttcgtgtgctctctggtttactacgggctgacactctcagcaggcgacctcggagggagcatctatgcaaatctggcattatctgggctgatcgaaataccatcatatccgctctgtatctacctcattaaccagaagtggtttggccggaaaaggactttgtccgctttcttgtgcttaggaggccttgcttgcctgatcgtgatgttcctgcccgagaaaaaagacactggagtattcgccgtggtgaactcacatagcctttccttattgggcaaactgaccatctccgcggcctttaacattgtctacatatatacaagcgagctgtacccaacagtcattcggaacgttgggctcgggacttgctctatgtttagtagagtcggaggcatcatcgcgccctttattccgagccttaagtatgttcagtggagcctgccgtttattgttttcggtgccacaggactcacatccgggctgctctccctgttattaccagaaacactgaattccccactcctagaaaccttttctgatctgcaagtgtatagctataggagactaggggaagaagctctgagtctccaggccctcgacccacaacaatgcgtggataaggagtcttcactagggagcgagtctgaggaggaagaagagttttacgatgccgatgaagagacacagatgatcaaatag

SEQ ID NO: 205793 - DNA, 1008 bp, Artificial Sequence
  Description of Artificial Sequence: Synthetic coding sequence
atgcccgccgtgctgggcttcgagggcagcgccaacaagatcggcgtgggggtcgttcgggacgggaaggtactggccaatccacgacggacatacgtgactccccccggaaccgggtttctgccgggcgatactgcccgccatcatagagccgtcatcctagatttactgcaggaggcgcttacggaaagcggactcacgagccaggacatagactgtattgcatacacgaagggtccaggcatgggcgccccccttgtgtctgtggcggtggtcgcacgaacggtggcacaactgtggaataaacctcttgttggagtgaatcactgcatagggcatatcgagatgggaaggctgatcactggcgcaacctcacctacagtgctatatgtgtcaggtggcaatacccaggttatcgcttactcagaacacaggtataggatcttcggcgagaccattgacatcgccgtgggcaattgcctggaccggttcgctcgggtcctgaagatctccaatgacccatctcctggctacaatatcgagcaaatggcaaagagaggcaaaaagttggtcgagcttccatacaccgtgaaaggcatggacgtgtcattttccggaatcctgtctttcatcgaggacgtcgcacatagaatgctggccaccggagaatgtacacctgaagacctgtgcttctcccttcaggaaacagtgttcgccatgctggttgagatcaccgaacgtgctatggctcattgcgggtcccaggaggcacttattgtgggaggagtggggtgtaacgtgcggctccaggagatgatggcaaccatgtgtcaggagcgaggggccagattgttcgccacagacgagcgcttctgtatcgacaacggcgccatgattgctcaggcaggatgggagatgttcagagccggtcacagaaccccactctcagactccggtgtcacacagcgttataggactgacgaggtggaggtgacatggagggactag

SEQ ID NO: 205794 - DNA, 1563 bp, Artificial Sequence
  Description of Artificial Sequence: Synthetic coding sequence
atggccagcgaccccatcttcaccctggccccccccctgcactgccattacggggcattcccgcctaacgctagtggctgggaacaaccgcccaacgccagtggtgtgagtgtagcaagtgcggctctcgccgcctcagctgcctctagagtggcaactagtacagacccctcctgcagcggcttcgcaccccctgattttaatcattgcttgaaggattgggactacaatgggctaccagtgctgaccaccaacgctattggacaatgggacctggtttgtgatctcggatggcaggtcatcctggagcagatcctttttatcttgggtttcgcgagcgggtacctgtttctcggataccccgccgaccgcttcggcaggagaggaattgtgctgttgactctcggcctcgtggggccatgcggggtgggaggtgctgccgcaggttcgtctaccggggtgatggccttgcgtttcctgctcggcttcctactggcaggtgttgacctgggtgtgtatttgatgaggctcgaactttgtgaccctacccaaaggttacgcgtcgcgctcgccggggaacttgttggggtaggcggccattttctgtttctgggtctggctctggtctctaaagattggaggtttctccagagaatgatcacagccccctgcatactgtttctgttttacggctggcctggactcttcctggaaagcgcccgttggctgattgtcaagaggcagatcgaagaggcccagagcgtcctcagaattctggcggaacggaatcggcctcatggccagatgctaggggaggaagcgcaagaggcactgcaggatctcgagaatacatgtccgctgccagcaacttctagttttagcttcgcctcactactgaattaccgaaacatctggaaaaatcttctcatccttggcttcacaaacttcatcgctcatgccattagacactgctatcagccagttgggggaggcggctccccttccgacttttatctatgttctctgctggcctccggaactgctgctttggcctgcgtgttcttaggagtgactgtggaccgttttggcaggagaggtattcttctgttatccatgaccttgaccggcattgcatcgctcgtgctgctcgggctgtgggattatctgaacgaggcagccatcacaacattctccgtgctgggcttgttctctagccaggctgcagccatcttatccacactattagctgccgaagtgatccccaccacggtgcgcggtaggggcctggggctgattatggcattaggcgctctagggggtctatccgggccggctcagcggctccatatgggccacggggccttccttcaacacgttgtgctggccgcctgcgctctcctatgtatcctgtctataatgctgttgcctgaaacaaaacgaaagcttttacctgaagtgttgcgagacggggagttgtgccggcggccatcactgctgaggcagcccccacctaccaggtgtgaccatgtcccccttctcgccacccctaatccagccctctag

SEQ ID NO: 205795 - DNA, 1617 bp, Artificial Sequence
  Description of Artificial Sequence: Synthetic coding sequence
atggccagcgaccccatcttcaccctggccccccccctgcactgccattacggagctttccctcccaacgcaagtggatgggaacagcctcctaatgcctctggcgtctctgtggcctcggccgctctggcagctagcgccgcttcacgagtggcaacaagtaccgacccttcgtgcagcggattcgctccacctgattttaatcattgcctgaaggattgggactacaacggcctacctgtgttgacaaccaatgcaatcggacagtgggatttagtctgcgatcttgggtggcaagtgatactggagcagattttgtttatcctgggcttcgcaagcggctatttgtttctgggctatcccgccgataggttcggaagacgggggatagtgctgcttactctcgggcttgtcggtccttgcggcgtgggaggcgccgctgccgggtctagtactggagtcatggcgctccgcttcctgctggggttcctcctggcgggggtggatttgggcgtctacctgatgcgtcttgaactctgtgacccaacccagagacttcgcgtcgccttagcaggggaactggtgggagtgggtggccatttcctgtttcttggcctcgccctcgtcagtaaggattggaggttcctccaacgtatgatcacggccccctgtatcctctttctattctacggatggcccggactgttcctcgagagcgcccggtggcttattgtgaaaaggcaaattgaggaggctcagtctgtactgcgcattctggcagagcgaaatagaccccatggacagatgctgggggaagaggcacaggaggccctgcaggatcttgagaacacatgcccactcccagccacatcctcattttcgtttgcttcgctgctgaactacaggaatatatggaagaacttgctgatcctcggctttactaatttcatcgcccatgccattcggcattgctaccagccagttggtggtggtggatccccctcagacttttatttgtgttcgctcctagccagcggtacagcagcactggcctgcgtgttcctgggggttacagttgataggtttgggagacgcgggattctgctactgtccatgaccttgacggggatcgcctctctagtgctcctgggcctttgggattgtgagcatcccatttttccaaccgtttgggcacaacaaggcaaccctaatagggacctcaacgaagcagctattaccaccttctcagttttaggtttgttttcaagccaagctgctgccatcttaagtaccctgctggcagctgaggtgattcctaccacggtgcgcgggcgaggactgggcctaattatggcgctcggagccctgggaggcctgtcgggtccagcgcagcggttgcatatgggccatggggcctttcttcagcatgtggtcttggcagcgtgcgcactgctttgcatcctttcgattatgctattgccggagacaaagaggaagctcctccccgaggtactccgggacggagagctctgccgtaggccgagtctgctgagacagccaccacccacgcgatgtgaccacgtccctctcctggcaacacccaatcctgctctgtag

SEQ ID NO: 205796 - DNA, 1086 bp, Artificial Sequence
  Description of Artificial Sequence: Synthetic coding sequence
atggccatcgaccggcggcgggaggccgccggcggcggccccggccgacaaccggcccccgcggaggagaacggatccctgccgccaggggacgctgcagcatctgctccattaggtgggcgagccggtccggggggaggtgcagagatccagccacttcctcctctgcacccaggaggaggaccacatccaagctgttgtagcgccgccgccgccccctcactgctgctcctggattacgacgggagtgtactgcccttcctgggtggtttggggggcgggtaccagaagactttagttcttcttacgtggatccctgcactgtttatcggtttctcccagtttagtgactcgttcttacttgatcagccgaacttctggtgtcggggggcagggaaaggaactgagctggccggcgtgactacaaccgggaggggaggggatatgggcaattggacttcactcccaacgacgcccttcgcaacggcaccatgggaagctgcgggaaatcgttctaattcgagcggagccgacggcggtgacaccccccccctaccttctcccccagacaaaggcgacaatgcttccaactgtgattgcagggcttgggactacggtataagagccggactcgttcaaaatgtagtctccaagtgggacctggtgtgtgacaatgcatggaaggttcacatcgcaaagttctctttgttagtgggcctgattttcgggtaccttatcactggctgcattgctgactgggtcggcaggagacctgtcttgctgttttctattatctttattttgatctttggactgaccgtggctctgagcgtgaatgtcaccatgttctcgacattgcgcttcttcgagggtttctgccttgctggcatcatcttgaccctttacgccttacggatagagctgtgccctccaggaaaacggttcatgattaccatggtcgctagttttgtcgccatggcaggccaatttctgatgcctggcctcgccgccctgtgtagggattggcaggtcctacaggctctgataatctgtcccttcctgttgatgctgctttactggagctag

SEQ ID NO: 205797 - DNA, 1218 bp, Artificial Sequence
  Description of Artificial Sequence: Synthetic coding sequence
atgttcagcaccctgcggttcttcgagggcttctgcctggccggcattatactcaccttgtacgctttgcgcatcgaactgtgcccacctggtaagcgctttatgattactatggttgcttctttcgtggcgatggcaggccagttcctcatgccgggcctggcagcactgtgccgggactggcaggtgctgcaagccctgattatttgcccatttctgttgatgcttttgtactggagcatcttcccagaaagcctgaggtggttaatggcaacccaacagttcgaatcggctaaaaggctcatcctccacttcacccagaaaaatcggatgaaccccgagggagatataaagggagtgattcctgaacttgaaaaagaacttagcaggcgaccaaagaaagtttgtattgttaaagttgtgggaacacgcaatctctggaagaacatagtggttctgtgtgttaattccctgacggggtacggaatccatcactgcttcgctcggtctatgatgggccatgaggtgaaggtgcctctattggagaacttctatgcagactattacacaaccgctagcatcgccctcgtttcgtgtttagctatgtgtgttgtcgtgcgatttctgggcaggcgaggaggcttgctcctgtttatgattctgaccgctctagcgagtctgctgcagttaggtctcctcaaccttattgggaaatattctcaacaccccgactccggaatgagcgacagtgtgaaagataaattcagtatagcattctcgatcgtagggatgttcgcctcccatgcggttggctcactgtcagtgtttttttgtgccgaaatcacccccactgtgatacgatgcggcggactcggcttagtcctcgccagtgccggattcgggatgctgacagcacccatcattgaactgcataaccagaagggatatttcctgcaccacataattttcgcttgctgtaccctgatttgtataatttgcatactgctcctccctgagtctagagaccagaaccttcccgagaatatttctaatggagagcactatacacgacagcctcttcttccacacaagaaaggtgagcaacccctcctcctgaccaatgcagagctcaaggactactctggccttcacgatgccgccgccgcaggggatacactgcctgagggggctaccgcaaacggcatgaaagcaatgtag

SEQ ID NO: 205798 - DNA, 2061 bp, Artificial Sequence
  Description of Artificial Sequence: Synthetic coding sequence
atggccatcgaccggcggcgggaggccgccggcggcggccccggccgccagccagcccctgccgaggaaaacgggtctctcccgccaggcgacgctgcagcttcagcaccactgggcgggcgggccggcccaggcggaggtgctgagattcagcctctcccccccctgcacccaggtgggggccctcatcctagctgttgtagcgctgcagccgctccatctcttctgctcctggattacgacggcagtgtgctcccgtttctgggcgggcttgggggaggctaccagaagacattggtacttcttacttggatccccgccctctttatcggcttctctcagttctcagatagtttcttgctggaccagcctaatttttggtgcaggggcgcggggaaggggacagagttagccggggttactaccacaggtcggggtggcgacatgggtaactggacctcacttccaaccaccccctttgccactgccccgtgggaggccgctgggaaccgatcaaacagcagcggcgctgatggcggagatacgccacccctccctagtccccccgacaaaggcgacaacgcctcaaactgcgactgccgagcatgggattacgggattcgcgccggtctcgtgcagaatgtggtatcaaaatgggatctggtgtgtgataatgcctggaaagtccacattgctaagtttagcttgttagtggggttgattttcgggtacctcatcaccggctgtatcgcagattgggttgggcgccgccccgttttgctcttcagcatcattttcatcctgattttcggcctgacagtggccttgtcagtcaacgtgactatgtttagcaccttaagattctttgaaggtttttgtctagcgggcatcattctgactctgtacgctttgcggattgaattgtgtccaccaggtaagcggttcatgataacgatggttgcttctttcgtggctatggccggtcagttccttatgccaggactagccgcattatgccgcgactggcaagtcctccaagccttgatcatttgtcctttcttactgatgcttctgtattggagcatctttccggagagtcttagatggctgatggccacccagcagtttgagtccgccaaacggttaatcctccactttacacaaaaaaatcgcatgaacccggagggcgacattaagggtgtgattcccgagctggaaaaagagctgtcccggaggccaaagaaagtatgcattgtcaaggtagtgggcacaagaaatctgtggaagaatatcgttgtgctgtgcgttaacagcctgactggctatggaattcaccactgtttcgctcggtctatgatgggccacgaggttaaagtgcccctcctcgaaaacttctatgcagactattacacgacggcctccattgcattagtgtcatgccttgctatgtgtgtcgttgttaggttcctggggaggcggggcggactgctgctttttatgatcctgaccgctctcgcgtcactgctgcagctgggactgctcaacctgatcggcaagtactcccagcatcctgattctggcatgtccgattctgtgaaggataaatttagcattgcatttagtatagtcgggatgttcgctagtcacgcggtgggaagcctgtcagtcttcttctgcgccgagattacaccaaccgtgattagatgcggaggtctgggtctagtgctggctagcgccgggttcgggatgttgaccgcccccatcatcgagctccataatcagaagggctacttcctgcaccacatcatctttgcatgctgcacactgatttgtattatttgcatcctcctgctgcccgagagtagggatcagaatttgcccgagaatatctctaacggagagcactacaccaggcaaccattgctgccgcacaagaaaggagagcaacccttgctgctgactaatgcagaactgaaggactacagcggcctccatgatgctgccgccgctggggatacgctgcccgagggtgccaccgcaaatggaatgaaggcgatgtag

SEQ ID NO: 205799 - DNA, 1218 bp, Artificial Sequence
  Description of Artificial Sequence: Synthetic coding sequence
atgttcagcaccctgcggttcttcgagggcttctgcctggccggcatcatattgaccttgtacgccctacgcattgagctgtgcccacccggcaagaggttcatgattacaatggttgcatcgttcgtggcaatggccggacagttcctaatgcctggccttgccgcactgtgtcgggattggcaggtcctacaagcactcattatttgcccttttctcctaatgttgctgtattggagcattttccccgagagccttcggtggctgatggccacccagcagttcgagtctgcgaaacggctgatcctgcacttcacccagaaaaaccgcatgaatcccgagggtgacatcaaaggggtgattccagaactggagaaggaactgagtcgtcgaccaaaaaaggtatgtatcgtaaaggtagtcggtaccagaaacctttggaagaatatcgtcgtcttatgcgtaaactccctcactggatacggcattcaccattgtttcgcccggagcatgatggggcacgaggtgaaagtgccactgttagagaatttctatgcagactactacaccaccgcttccattgcgctggtgtcttgcctggccatgtgcgtagtggtgcgctttctcggtcgacgtggaggcctgctgttattcatgattctgacagcccttgccagccttttacagctgggacttctgaacctgatcggaaaatatagccagcatcctgactccggaatgtctgactcagtgaaggacaaattcagtatcgctttttccatcgtgggcatgttcgctagtcatgcagtcggaagtctctcagtgtttttttgcgcagagatcacacctacagttataagatgcgggggcttgggactggtactcgccagcgctgggttcggcatgcttacggcacctataatcgagctacacaaccagaagggttactttctgcaccacattattttcgcatgctgtactctgatttgtattatatgtatccttctactgcccgagtctagagaccagaatttgcctgagaacataagcaacggagaacattacacgcgccagcctctgctaccgcacaagaagggtgaacagcctctgctactcaccaacgcggagcttaaggactactccggcctgcatgacgctgcagcagctggtgacaccctgccagagggagctacagccaacggaatgaaggccatgtag

SEQ ID NO: 205800 - DNA, 969 bp, Artificial Sequence
  Description of Artificial Sequence: Synthetic coding sequence
atgggcttcgacgtgctgctggaccaggtgggcggcatgggccggtttcaaatttgcctgatcgccttcttttgtattacgaacatcctcctgtttccaaacattgtgctggagaactttacagcgtttaccccctcacaccgctgttgggttcctttactggataacgataccgtgagcgataatgataccgggactctgagtaaggacgacctactgcggatctcaatccccctggactcaaacctccgaccccagaaatgtcaacggttcatccacccacagtggcagttgttgcacctgaacggcactttccccaatacgaatgagcctgatacggagccatgcgtggatgggtgggtctatgacagaagctcctttttgagcactattgtcaccgagtgggatctcgtgtgtgagtctcagtctctcaagtcaatggtacagtcactgtttatggcgggcagtctcttgggtggtttgatatacggccatctgtctgatcgcgtcgggcgcaagataatctgcaaactatgtttccttcagttggcaatcagtaacacatgtgccgcgttcgcgcctactttcttggtatattgcatcctgcggttcttggcaggttttagcaccatgaccattctcggcaacacttttatcctcagcctcgagtggaccttgcccagatctaggagtatgacgattatggtgctcctgtgttcttatagcgtgggccagatgctcctcggcggattagcctttgcgattcaggattggcacatcctgcaacttaccgtttcgacaccaatcatcgtcctcttcctgtcatcctggtacgagcagtccccccattcgcttcctgtcagtgaagctatggtagacattgagcgtaagatcctgacgcctggaatctgttccgtgagcggactggttctgagccatgatgtccattcgacttactgcgtgacctag

SEQ ID NO: 205801 - DNA, 780 bp, Artificial Sequence
  Description of Artificial Sequence: Synthetic coding sequence
atgcgggcccaggaggacctggagggccggacccagcacgagaccacacgggacccaagcacgccccttcctaccgaacctaagtttgacatgctgtacaagatcgaggacgtgcccccttggtacctctgcatattattgggattccaacattatctgacctgtttctccgggactatcgcagtcccgttcttgcttgcagaagctctgtgcgtgggtcacgaccaacatatggtgtctcaactgattgggacgatcttcacctgcgttggaatgttctgcactctcttcgggatgatcaccgccgtgggtctgagcaacctccagttcgtagacatgaactcttcacgcaatttgttcgtactcgggttttccatgttttttggattgaccttgccgaattacttagagtctaacccaggtgcaataaatactgggatcctggaggtcgaccagattctgatagtgctcctgactaccgaaatgttcgtgggtggatgccttgcattcatcttagacaatactgtcccagggtcacctgaggaaagaggacttatacagtggaaagcgggggcccacgcgaatagtgacatgtctagctctctcaagtcatacgactttcccatcgggatggggattgttaagagaatcacttttttaaaatatattcctatctgcccagtattcaaagggttctcaagctctagtaaggatcagattgcgatacccgaggatacacctgagaacacggaaaccgcatccgtgtgtacaaaggtgtag

SEQ ID NO: 205802 - DNA, 1797 bp, Artificial Sequence
  Description of Artificial Sequence: Synthetic coding sequence
atgcgggcccaggaggacctggagggccggacccagcacgagaccacacgcgaccctagcacacctcttcccaccgagccaaagtttgacatgttgtacaaaatcgaagatgtcccaccatggtacctttgcattctcctgggattccaacactatttgacctgcttttcaggaaccattgctgtcccatttctcttagccgaggctttgtgtgtggggcacgatcaacacatggtatcgcagctgataggaacaattttcacatgcgtgggcattacaacacttatccagacaacggtaggtatccggctcccccttttccaggcttccgcattcgccttcctcgtgcccgccaaggcaatactggccctggagaggtggaaatgtccacccgaggaagagatttatggaaattggtctcttcctctaaacaccagtcatatatggcaccctcggattcgggaggttcaaggcgctatcatggtctcctcagttgttgaggtggtgattggacttctcgggctgcccggagcactcttaaactatattgggccactcacagtgacccctactgtttccctgattgggctgagtgtgttccaggccgctggtgacagggcggggtcccactggggcatcagtgcatgtagtatccttctcatcatcctgttttcgcagtatctgcgcaacctcacctttttgcttcctgtatatcgatgggggaagggattgaccctgttaaggattcagatcttcaaaatgtttccgataatgttggcgattatgacggtctggctcctgtgctacgtgttgactctcacggacgtactgcccacagatcccaaggcctacggttttcaggccagaacggatgcgcgtggagatattatggcaattgccccctggatacggattccatacccctgccagtgggggttgcccacagtaaccgcagctgccgtcctaggaatgttctccgccaccctggcagggattattgagagtataggagactattacgcctgcgctagactcgccggagcacctccccctccagtgcatgcaattaatcgggggattttcaccgaaggaatttgctgtatcatcgcaggccttctggggaccggcaacggctctacttcatcaagccccaacatcggcgtcctggggataacaaaagtcgggagccgtagggtggtgcaatacggcgctgctattatgctcgtgctaggcactattggaaagttcaccgccttgttctcatccctaccagacccaattcttggcggcatgttttgcactttgttcggcatgatcactgccgttggcctctcaaacctccagtttgtggacatgaatagctcacgcaacctgttcgtgttaggcttttcaatgttttttggattgacacttccaaactacctggagtcaaatcctggcgcaatcaacaccgggattcttgaggtggatcagatactgattgtgttgctgactactgagatgtttgtcggagggtgcctggcatttattctggataataccgtcccagggtctcccgaggagcggggacttattcagtggaaagcaggtgcccacgctaactcagacatgtcctccagccttaagagctatgattttccaataggaatgggcatcgtcaagcgaatcacgttcctaaagtacatcccgatctgccccgtttttaagggctttagtagttcttcgaaagaccagatcgctatccctgaggacacgcctgagaatacagaaacggcttcggtgtgtactaaagtatag

SEQ ID NO: 205803 - DNA, 1809 bp, Artificial Sequence
  Description of Artificial Sequence: Synthetic coding sequence
atgcgggcccaggaggacctggagggccggacccagcacgagaccacacgggatccctcaacaccactaccaaccgagcctaagttcgacatgttgtacaagattgaggacgtaccgccctggtacctctgtattttgctggggtttcagcactacctgacttgcttttccggtactattgccgttccttttctgctcgcagaagcactgtgcgtcggacacgatcagcatatggtgagccagttaatcggaacgatattcacgtgcgtgggtattacaactctgatccaaacgaccgtggggataagacttccattatttcaggcctccgcattcgccttcttggttcccgcaaaagctatcctcgcgttggagagatggaaatgccccccagaggaggagatttatggtaattggagcttgccgctgaacacatcacatatatggcatcccaggatccgcgaggtgggtctgcacgtacagggcgctatcatggtgagctcagtggttgaggtcgtaatagggctgttggggcttcctggggcactgttgaactacatcgggccacttaccgtgacccccacagtgtctctcattgggctttccgtattccaagctgcaggcgatagagcgggctcacattggggaatctctgcgtgctcaattctcctaataatccttttttcccagtaccttaggaatttgacctttcttcttccagtataccgctgggggaagggactcaccctgctcaggattcagatattcaagatgttccctatcatgctggccatcatgaccgtctggctattatgctatgtcctgacactaacagacgtgctccctactgacccaaaagcatacggcttccaagcgaggacagacgcccgaggagacatcatggccatcgcaccctggattagaattccttacccttgccaatggggcctgcccaccgtgaccgccgctgcagtactcggcatgttctctgctaccctcgcagggatcattgaatcaatcggagattattacgcctgcgctaggctagcaggcgctccccccccacccgtgcacgctatcaaccgcggtattttcaccgaaggtatttgctgtattatcgccgggttgctcggaactggcaatggaagtactagttccagtccaaatataggggtccttggcattacgaaggttggttcacgcagggttgtacagtatggagccgcaatcatgctggtcctgggcacgattgggaagtttacggcactcttctcctcccttccagatccaatcctgggggggatgttttgtactttattcggcatgatcaccgctgtcggcctctctaatctgcagttcgtggacatgaactcatcacggaacttgtttgtgctcgggttcagcatgttttttggtctcacactccctaattacttagagtccaacccaggggcgatcaacacgggcatccttgaagtggaccagatattaatagtgttgctgaccacagaaatgtttgtcggggggtgtctggcattcatcctcgacaacacagtgcctggcagcccagaggagagggggttgatccagtggaaggctggagcacatgcgaactccgatatgtcctcgtccctgaaatcctacgatttcccaatcggtatgggtatagtgaagcgcatcaccttcctgaagtatatccccatttgccccgtgttcaagggcttttcgtccagtagcaaggatcaaatcgccatccccgaggatacgccagaaaatacagagacagcaagtgtgtgtaccaaagtgtag

SEQ ID NO: 205804 - DNA, 1179 bp, Artificial Sequence
  Description of Artificial Sequence: Synthetic coding sequence
atgcgggcccaggaggacctggagggccggacccagcacgagaccacacgcgatccctcgacccccctccctacagaacctaagtttgacatgctgtataagatagaggacgtgcccccttggtatctgtgtattcttttgggttttcagcattacctgacatgtttctccggcaccattgctgtgccattcttactcgcagaggcactgtgcgtggggcacgatcagcatatggtctctcaactgattgggacaatctttacttgtgtgggcattacgactcttattcagaccaccgtaggtatacgattacctctcttccaagcgtctgccttcgcgtttctcgttccggccaaagcgatcctcgccctggaaaggtggaagtgcccaccagaggaggagatctatggcaactggagtctgccccttaatacctcacatatttggcacccaaggatccgggaggtgggtctgcacgtgtccattgaggaggccggaggctatatgggtgtcagggtagccgccgagttcggcgacctgaggcggtggtcccgttcttttgtcccagccagcagcagccaagtccagggggccatcatggtgagcagcgtggtggaggtggttattggcctgttggggctgccaggagcactcctaaattatatcgggccattgactgtgacaccaaccgtgtctctaattggcctgagcgtgttccaagctgccggcgatagggccggcagtcattggggtatctcagcatgcagcatcttgctaatcatcctgttcagccagtatttgcgtaatctgaccttcctattaccctgcgcccaacagtccgcacctctctggcaggcatccctctccccatcagagatcaccacaccggttcctgcctggttggttcaccacccactccagtatatgctgtctacgggagcctcctctcctaaagcatttgctgccagttcccgaggatactgggcacgtgctactggtcctcctcgccccgtgccaacgctcgcctcctgggagctacctcggtgggcagcgggcgcttggtgtagtatggtcaggctcagttgttggagctgggccccaagcgcatcatcccggccttcatccccacggtcattgaccccaagttggggagcgtgttcagccctctcactggcatag

SEQ ID NO: 205805 - DNA, 1953 bp, Artificial Sequence
  Description of Artificial Sequence: Synthetic coding sequence
atgatgggcatcggcaagaacaccaccagcaagagcatggaggccggatcctcaaccgagggcaaatatgaggacgaggcgaagcaccccgcattcttcacacttcccgtcgtaatcaacggtggggctacgtcttcaggtgagcaggataacgaggacacagagctgatggccatatacactacagaaaatggtatcgccgagaaatcaagtctcgctgaaacactggatagcacagggtctctggatccacaaaggagtgacatgatttataccattgaggatgttcccccctggtatctttgcatctttctcggcttacagcactatctgacctgtttctccggaacgatcgctgtcccgttcttacttgccgacgccatgtgtgtcgggtacgaccagtgggcaacttcccaactcataggcactatctttttttgcgtcggcattacaaccctgctgcagacgacgttcgggtgcagacttccattattccaggctagtgcgttcgcatttctcgcaccggcccgagctatattgtctctcgataagtggaagtgtaatacaacggatgtcagtgtggctaatggcactgcggaattgctgcacactgaacacatctggtatcccaggatcagggaaatacaaggtgcaataattatgtccagcctgatagaagtggtgatcggcctgcttggccttcctggggctctgcttaagtacatcgggcctctaactatcactccaacggtcgccctgatcggtctttccggcttccaggctgctggtgaacgagccgggaaacattggggaatcgctatgttgactatctttctggtgctcctctttagccagtacgccaggaatgtgaagttcccacttcccatttacaagtcgaagaaaggatggacagcgtacaagctgcaactttttaagatgtttcctatcatcctcgccattctggtctcttggctgttgtgtttcatctttacagttaccgacgtcttccctccggactccactaagtatggcttttatgcaagaactgacgcgcgtcagggagtcttattggtggccccatggtttaaggtaccatacccttttcagtggggcctgccaaccgtgagcgccgccggggtcattggcatgctgtcagcagttgtggcctccattatcgagagtatcggtgattattatgcatgcgcccgcctcagttgtgcaccaccacctccaatccatgcaataaaccggggaatcttcgtcgaaggactgagctgcgtactggatggaattttcggcacaggaaatggctctaccagctctagccccaacataggcgtgcttgggattacaaaggtggggagtaggcgagtgatccaatgcggagccgcactgatgcttgccttggggatgattgggaaattttccgcactctttgcttccctaccagatcctgtgctgggggccctcttttgcactctgtttggcatgattaccgccgttggtttgtctaacctacagtttattgacctgaactcatcacggaatctgttcgtgcttggcttctcaatattttttgggctggtcttacctagttacctgcggcagaatccactggtgacagggataactgggattgatcaggtgctcaacgtcctactgacgacagccatgttcgttggggggtgcgtagcattcattctggataacaccattcccggcacccctgaagagcgaggaattcgcaaatggaagaaaggggttggtaagggaaataagagcctcgacgggatggagtcttataacctccccttcgggatgaatattattaaaaaatatcgctgtttcagctatctgccaatttcaccgacgtttgtaggctatacatggaaaggtctgagaaagtcagataacagtcggtcctcggatgaggactcccaggctactggttag

SEQ ID NO: 205806 - DNA, 1953 bp, Artificial Sequence
  Description of Artificial Sequence: Synthetic coding sequence
atgatgggcatcggcaagaacaccaccagcaagagcatggaggccggttcctcaaccgaaggcaaatacgaagatgaagccaagcatcccgcattctttaccctgccagtggtgatcaatgggggcgcgacctccagtggcgaacaggacaacgaggacaccgagcttatggcaatctacaccacagagaatgggattgccgagaaaagtagtctggccgagactcttgattcaaccggcagtctcgacccgcagcgctcagatatgatatatacgatcgaggacgtgccaccctggtacctgtgtatttttctcgggctccagcactatctgacttgtttctcgggaacaatcgccgtgccctttttattagccgacgctatgtgcgttggctatgaccagtgggccacaagtcagctaatcggtaccatttttttctgcgtgggtattactacccttctacaaaccacctttggctgccgactgcctctgttccaggcgtctgccttcgcatttctcgcccctgcccgggccatcttgtcactggacaaatggaagtgcaacacaactgatgtctccgttgcgaatggtacagctgagttgctgcacacagagcacatctggtatccccgcattagggaaatccagggtgctatcataatgagttcactgattgaagtggtgattggtcttttgggactccctggcgctctgctaaaatacatcgggccactcaccataactcctactgtcgccttgattgggctgtctgggtttcaggctgctggtgagagggccggaaagcattgggggatagctatgctcaccatcttccttgtcctgctgtttagccagtacgctcggaacgtcaagtttcccctgccgatttacaagagtaagaaaggctggacagcctacaaactgcagttgtttaagatgtttcccataatcctggccattctcgtctcctggttactgtgtttcatttttactgtcaccgacgtgttcccacccgacagcacgaaatacggtttttacgcacgtacagatgctagacagggggtgttgctcgtggcaccctggttcaaggtgccatatccgtttcagtggggcctgccgaccgtgagtgccgcaggcgtcataggcatgcttagcgctgtggttgcttccatcatagagtccatcggggactactatgcctgcgcacggctgagctgcgcccctccccctcctatccatgccatcaaccggggcattttcgtggaaggcctctcttgcgtgttagacggcatcttcggaacaggcaatggctccacaagttcctcccccaatattggtgtgctgggtatcaccaaggtgggctctcgtcgggtaattcagtgtggcgccgccctgatgcttgcactggggatgatcggcaaatttagcgccctgtttgcaagcctgccagaccctgtgctgggcgccttgttctgcacattgttcgggatgattacagctgtggggctctcaaacctgcagtttatcgacctgaactcctcccgcaatctgtttgtgttaggattctccatcttcttcgggctagttctaccaagttatctgcgtcagaatcctttggtgacaggtattacaggcatagaccaggtgctgaatgtcctgctgaccactgccatgtttgttggtggttgtgtggcttttattctagataatactatcccaggaactcccgaagagaggggaattcgcaaatggaagaaaggagtggggaaaggcaataaaagcctggatgggatggaaagctacaatttaccatttgggatgaatatcataaagaaataccggtgcttcagctacttgcctatctcgcctacgttcgtaggttatacctggaaaggtcttagaaaatctgataattcaaggagcagcgatgaggacagtcaagcgacagggtag

SEQ ID NO: 205807 - DNA, 915 bp, Artificial Sequence
  Description of Artificial Sequence: Synthetic coding sequence
tgaggctacgaccagtgggccaccagccagctgatcggcaccatcttcttctgtgtgggcatcacaaccctcctgcagaccacgtttggatgccgcaccatcttccttgtccttctgttctcccagtacgccagaaacgtgaagtttcccttacctatttataaatcgaaaaagggctggacagcttacaaactgcagctctttaagatgttccctattattcttgcgatcctcgtgagctggctcttgtgttttattttcactgttactgatgttttccctccagatagtacaaagtatggcttctatgcccggaccgacgcgagacagggggtgctcctcgtagcaccttggtttaaagtgccataccccttccagtgggggcttccgacagtctctgccgcaggtgtgattggaatgttatctgcagtggtggcaagtattatagaatctatcggcgactactatgcctgcgccagactgtcttgcgccccaccacctcccatccacgctattaatcggggaatattcgtcgaaggtctgtcctgcgtgcttgacgggatttttgggactggaaacggctcgactagcagctctccaaacatcggcgtgctgggtatcactaaggtgggatcacggcgcgtgattcagtgcggggctgctctgatgttggcgctcggcatgataggcaagtttagcgccctgtttgcaagcctcccagacccagtcctcggggcactgttctgcaccttgtttgggatgatcacggcggtgggactgtcaaacctgcagtttattgatctgaactctagtagaaacctgttcgttcttggcttcagcatttttttcggcttagttctgccttcgtacttacgacagaacccactggtgaccggcataacgggcatagactag

SEQ ID NO: 205808 - DNA, 1611 bp, Artificial Sequence
  Description of Artificial Sequence: Synthetic coding sequence
atgatgggcatcggcaagaacaccaccagcaagagcatggaggccggcagcagtacggagggaaaatacgaagacgaagcgaaacatcccgctttttttacgctgcctgtcgtcatcaatggcggtgccaccagcagtggcgagcaggataatgaagatactgagttgatggcaatctatacaaccgagaatggcattgctgagaaaagtagcttggccgagactctggattctaccgggagcctcgatccccaaaggagtgatatgatctacacaatcgaggatgttccaccctggtacctgtgtatttttctgggtctgcagcactaccttacctgtttttccggcaccattgctgtccccttcctgttggcggacgccatgtgcgtagggtacgaccagtgggccacctcacaactcataggcacgatctttttctgtgtgggtataactacccttctacagactaccttcggttgtcggacgatctttctagtcctcctcttctcacagtacgctcggaacgtcaaattccctttacccatttataaatccaaaaaagggtggacagcctataagttacagctatttaaaatgtttcccatcattctcgctatcctggtgtcctggcttctgtgcttcatctttacagtgacggacgtgttccccccagactccacaaagtacggtttttacgctagaaccgatgcacgtcaaggtgtgctgctggtggcaccatggttcaaagtcccatacccctttcagtggggattgcccacagtttctgctgccggtgttattgggatgctgtccgcagtcgtggcttctataatagaaagtatcggggactattatgcttgtgccagactctcgtgtgcacctccaccacccattcacgcgatcaaccgggggatttttgtcgaaggcctctcctgcgtgctcgacgggatctttggcaccgggaatgggagtaccagctcgtctccaaacattggcgtgctgggcataactaaggtgggatctagacgcgtcattcagtgcggcgctgctcttatgcttgctctcggcatgatcgggaaattcagcgccctctttgcttcccttcccgacccagtcttgggcgctttgttttgtactctgttcggcatgattaccgcagtgggcttgagcaacttacagttcatcgatctgaacagctcccgcaatctcttcgtgctgggctttagcatatttttcggacttgtactgccttcatacttgaggcagaaccccttggtgaccggaataaccggtattgatcaagtgctcaacgtattgcttactaccgccatgtttgtgggcggctgtgtagctttcattctagacaataccatcccaggcaccccagaggaaagggggattcgcaaatggaaaaagggggtggggaaggggaataagtctctagatgggatggagtcctacaacctgccatttggtatgaatatcataaaaaaatataggtgctttagctacctaccaattagccccacctttgtgggatatacctggaagggtctgcgaaagagtgataactcaaggagcagcgacgaggattctcaggctactggatag

SEQ ID NO: 205809 - DNA, 3300 bp, Artificial Sequence
  Description of Artificial Sequence: Synthetic coding sequence
atgggcaagctgatccggatgggcccccaggagcggtggctgctgagaaccaaaaggctgcactggtcccgcctgttattcctcctaggcatgcttataatcggctctacataccagcatttaaggagaccgcgggggctgagcagcctgtgggccgcagttagcagccaccagcccattaagttagcgtctagggatctttccagcgaggagatgatgatgatgtcctcatcccctagcaagcccagctccgagatgggaggcaaaatgctggtgcctcaggcatctgtaggttccgacgaggccactctctctatgacagttgagaacataccatctatgccaaaaagaaccgcaaagatgattccaactacgacaaagaacaattatagtccaacagctgcaggcactgagagacgcaaagaagacactccaaccagcagtaggacattgacttactacacctctacctcaagtcgccagatcgtaaaaaaatatacccctactcctaggggcgaaatgaaaagctactctccaacacaggtgcgcgaaaaggtcaagtacacgccaagtccccgaggccgaagggtaggcacgtacgtcccgagtaccttcatgactatggaaacctcacacgctatcacaccccgtactacggtgaaagattccgacattaccgcaacctataagatcctcgaaactaactccctaaagcggattatggaggagacgacacctactacgctgaaaggtatgttcgactccacacctacattcttgacccacgaggtggaggccaacgtactgacgtctcctcggagcgtgatggaaaagaataacctcttccctcctaggagggttgaaagcaacagcagtgcccacccctggggcctcgtgggcaagagcaatccgaagacccctcaaggaaccgttctgctgcatacaccagctaccagtgagggccaagtgaccatctcaacgatgacaggctcttctccagccgagactaaagcttttaccgcggcgtggtcattaagaaatccctctcccagaactagcgtgagtgcgataaaaaccgctcctgcaattgtgtggcgtctggccaaaaaaccatccacggctccctccacctccacaacacctacagtgcgagctaaattgactatgcaagtccaccattgcgtcgtagtaaagcccacaccagcgatgttgacgactccttcccccagtcttactacagcgctactcccagaagagttgtccccatctcccagtgtcttacctccttcgctgcccgacctgcatccaaaaggggagtaccctccagacttgtttagcgtagaggagcggagacaaggttgggtagtgctgcacgtgtttggaatgatgtacgtttttgtggccctggctattgtatgtgatgaatatttcgttccggcattaggcgttatcacagacaagctccagatatctgaagatgtggcaggcgcaacttttatggccgctggtggcagcgctccagaactgttcacctccctcatcggagtctttatcagccactccaacgtaggtataggcaccattgtgggcagcgccgtctttaatatactcttcgttatcgggacctgtagcctattctctcgcgaaattcttaatctgacgtggtggcctctatttcgcgacgtttctttttatatcctcgatctcatcatgctgatactgttcttcctagattctctaattgcctggtgggagtcccttctgttactcttagcttacgcgttctacgtttttaccatgaaatggaacaaacacatcgaggtgtgggtcaaggagcaactttccaggcgccctgtagcaaaagtcatggcattagaagatctgagtaaacctggagatggtgctattgccgtggacgagcttcaggacaacaagaagttaaagctgccatctctgttgacccgtgggtccagtagcacgagcctgcataacagcacgatccggtctaccatttatcaacttatgctgcattccctcgatcctctgagagaagttcggctagcaaaagagaaagaggaggagtcacttaaccagggggctagggcccagccccaggctaaagctgagagcaagcccgaggaggaagagcctgccaagctgcccgcagtgactgtcacacctgcaccagtccctgatattaagggagaccaaaaggaaaaccccgggggtcaggaggatgtagcagaagctgaaagtaccggcgaaatgcctggtgaagaaggcgagaccgcaggggaaggcgaaaccgaagagaagtctggcggcgagacacagcccgaaggcgaaggcgagacggaaacacaggggaagggagaggagtgcgaggatgagaatgaagccgagggtaaaggggacaatgagggagaggatgagggagaaatccacgcggaagacggcgagatgaaggggaatgagggtgaaacagagtcgcaagaattgagcgctgaaaatcacggcgaggcaaaaaatgatgagaaaggagtggaagatggcgggggttccgatgggggagattctgaggaagaggaagaagaggaagaggaacaggaagaggaggaagaggaagaggagcaggaggaggaagaggaagaagaagaggaagaggaggaaaagggcaatgaggagccactgtccctggattggcctgagacgcgccagaaacaagcaatctacttgttccttctgccaatcgtctttccattatggttaacagtcccagatgtgcgcaggcaggaaagccggaagttcttcgtgtttactttcctgggatctataatgtggattgcgatgttttcatatcttatggtttggtgggcgcaccaggtcggtgaaactattgggatatccgaggaaatcatgggactgaccatactcgccgctggtacatctattcctgatttgatcaccagtgtgatcgttgcaagaaagggtcttggcgacatggctgtgagctctagcgtgggatcaaatatattcgatattacagtggggctgcctgtcccttggcttctgttctctttaataaacgggcttcaaccggttccggtgagcagtaacggtctattctgcgctatcgtgctgttgtttttgatgcttctgtttgttatatcctccatcgcttcctgtaaatggagaatgaataagattcttgggttcactatgtttcttctttacttcgtctttttgataatttccgtcatgttggaagaccgtatcatctcttgccccgtctctgtttag

SEQ ID NO: 205810 - DNA, 3246 bp, Artificial Sequence
  Description of Artificial Sequence: Synthetic coding sequence
atgggcaagctgatccggatgggcccccaggagcggtggctgctgcggaccaagcgcctgcattggagcagactcctattcctgctcggaatgctaatcatcggctccacttaccagcacctgcgtaggccaagaggcctctcctccttgtgggcggccgtctcttcacaccagcctattaagctggccagccgcgacctatcatcagaagagatgatgatgatgtcgtcaagcccttccaagcccagttctgaaatgggaggaaagatgcttgtgcctcaggcttcggtggggtcggacgaagccactcttagtatgacagtagagaatattccgtcgatgccgaagcggaccgcaaaaatgatacccacgacaacaaagaacaattatagtcctacggcagcgggtacagaaaggcgcaaggaggacacaccaacgagttcccggactctaacgtactacacgtcaacgtcttcccgacagattgttaagaagtatacccctacacctagaggagaaatgaaatcatattcaccgacccaggtgcgcgaaaaagtaaagtacacaccatctcctcgcggcagacgagtgggaacctatgtcccctccaccttcatgacaatggagacgtctcatgcaattactccacggacgacagtaaaggacagtgatatcacagccacgtataaaatactcgaaacaaattctctcaaaaggatcatggaagaaactactcccacaacgttaaagggaatgttcgactcgactccgacattcttgacccacgaggtcgaagccaacgtgctaacaagcccccggtccgttatggagaagaacaatctttttccgcccagaagggtcgaatccaactcatcagcccacccttgggggctagtgggcaagtcgaacccaaagacccctcaaggaaccgtcctgcttcacacacctgcaacctccgagggacaggtgactatcagtacaatgactgggagctcacccgccgagacaaaggccttcacggctgcctggagtctgcgaaaccctagcccccgaacctccgtgtccgcaataaagaccgcccccgccatagtttggcgtttggcaaagaagccgtcaaccgctccaagcacatccacgacgccaaccgtgagggccaaactcacaatgcaggttcatcattgtgttgtggtcaaacctacacccgccatgctgactaccccatccccctcactgaccacagcgttgctcccagaggagctttccccatctccttctgtcctgccgccttcgttacctgatctgcacccaaagggcgagtatccccctgacttgttttccgttgaagagagaaggcaggggtgggttgttctacacgtttttggtatgatgtatgtgttcgtcgccctagcgattgtctgcgatgaatattttgtgcccgcacttggcgttatcaccgataagctccaaatttccgaggatgtcgcgggggccacgtttatggccgccgggggctctgcacccgagctgtttacctcactgatcggagtcttcataagtcacagcaacgtgggaatagggacgatcgtaggttctgctgtgttcaacatcctgttcgttataggaacttgctctttgttctctcgggagatcctgaacctgacctggtggcccctgttcagggatgtttctttctatatcctcgatctgataatgctgatactattctttcttgacagtctaattgcttggtgggaatctctgcttttgctcctggcttatgcattctatgtgtttacgatgaagtggaacaagcacatcgaagtatgggtgaaagaacaactgagcaggcggcccgttgcgaaagttatggcgctcgaggacctgagtaaactgccaagcttgctaacgaggggctccagctctacctctcttcacaattcaacaatccgatccactatctaccagctgatgttacactcactggatcccctgcgtgaggtgcggcttgcaaaagaaaaggaagaggaaagtctcaaccaaggagcccgagcccaaccccaggccaaggccgagagcaagcccgaagaggaggagcccgccaagctacccgccgtcaccgttactcctgcacctgtaccagatattaaaggagaccagaaagagaaccccggtgggcaagaggatgtcgctgaagccgagagcacgggggaaatgccgggtgaagaaggcgaaacagcaggcgagggggagacagaagaaaagtctgggggagagacacaacctgagggcgagggtgagaccgaaacccaaggcaagggggaagagtgtgaggatgaaaatgaggccgaaggaaagggcgacaatgaaggagaggacgagggcgaaatccacgcggaagacggtgagatgaaggggaatgagggggaaactgaaagccaggagttatctgctgagaatcatggcgaagcaaagaacgacgaaaaaggagtagaagacggagggggcagcgatggaggagattctgaggaagaagaggaggaggaggaggaacaagaggaagaggaggaggaagaggaacaggaagaagaagaagaggaagaggaggaggaggaggagaaaggcaacgaggagcccctcagcttggattggcccgagacccggcagaagcaggctatctacttgttcctgctgcccatagttttccccctgtggttaacagtgcccgatgtgcggcggcaggagtctagaaaatttttcgtcttcaccttcttgggtagtattatgtggatcgctatgttttcatacctgatggtgtggtgggcccaccaggtgggcgagactattgggatttccgaagagatcatgggactcactatcctcgcagccgggacctcgattcctgatttgataactagtgtcattgtagcccggaaaggactgggcgatatggcagtgtcaagttccgtgggaagtaacattttcgatatcacagtaggcctgcctgtaccatggctgctgttcagcctgattaatggcctgcaaccagtcccagtgagctccaacggactgttttgtgcaattgttctactgttcctgatgctcttgtttgtaatctcttctattgcttcgtgtaagtggcggatgaataagatactgggctttaccatgttcctgctgtatttcgtgtttctgataatcagtgtcatgctcgaagaccgcatcattagctgtcccgtgagcgtatag

SEQ ID NO: 205811 - DNA, 3210 bp, Artificial Sequence
  Description of Artificial Sequence: Synthetic coding sequence
atgggcaagctgatccggatgggcccccaggagcggtggctgctgagaacaaagcggcttcactggagcaggctgctgtttctgcttggcatgttgataattggctcaacctatcagcatctgagacgaccgagagggttgagtagcctttgggcagctgtctccagtcatcagccgatcaagctggcttcccgcgatctgagtagcgaggagatgatgatgatgtccagctcacctagcaaaccctccagtgagatgggaggaaaaatgctcgtgccacaagcaagcgtgggctccgacgaagcaaccctgtctatgactgtcgagaacatcccgagcatgcctaagcgaaccgccaagatgatccctaccaccactaaaaataattattctcccaccgccgcaggcacggaacgtcgcaaggaagatacacctacctcctcacgcaccctgacttactacacgtccacctcctcacggcaaattgtcaagaagtacaccccaactccccggggggagatgaagtcatactcccctactcaagttagagagaaggtaaaatacaccccaagccctcgcggacgcagagtggggacgtacgttccatccaccttcatgactatggaaaccagccatgcaatcactcccagaaccaccgtgaaggactctgatattactgcgacctacaagatcctggagaccaatagtctgaaaaggatcatggaggaaacgacacccacgacactaaagggtatgttcgacagtaccccaactttcctgacgcacgaggttgaggctaatgtgctgacttccccacgttcggtgatggagaaaaataacctgttccctccaagaagggtagaaagtaactcctccgcacacccgtggggactggtcgggaagagcaatccgaagactccccagggaaccgtgctgctgcatactcccgccacctccgaggggcaggttacgataagcactatgactgggtcatctcctgccgaaacaaaagccttcactgccgcttggagtctgaggaatccctctcctagaacttcagtgagcgccatcaaaacggcaccggccatcgtgtggagattagcaaagaagcccagcactgcaccttcaaccagcaccacgccaacagtaagggccaaactgactatgcaggttcaccactgcgtcgtcgtgaaacccacccctgccatgctgactaccccaagcccctccctaactacggctttgcttccagaggagctctcccctagtccctctgtcctgccccctagcttgcctgacctccatccaaaaggcgagtacccacccgatctgttttcggtggaggaacgcagacaggggtgggttgttcttcacgtattcggcatgatgtatgtgtttgtagccctagcgattgtctgtgacgaatattttgtgcccgctctgggcgttataacagacaaactgcagatctccgaggatgtggctggcgcaactttcatggccgctggcggaagcgcccctgaactcttcaccagcctgataggggtgttcatctctcatagcaacgttggaattgggacaatcgtcggttccgccgtctttaacattctatttgtcatcggaacctgttccctgttttcaagggagattttgaatcttacctggtggcctctgtttcgcgacgtaagcttttatattctcgatcttatcatgcttattctgttcttcctggacagtctgatagcctggtgggaatccttgctgcttctgctggcttacgccttctacgtttttaccatgaaatggaataaacacatcgaagtgtgggttaaggaacagctcagtcgcagacccgtggccaaagttatggcactcgaagatttaagcaaacccggcgacggcgccatcgcggtggatgaactgcaggacaataaaaagctcaaattgccaagcttgcttacacggggaagctctagcacctcccttcacaatagcaccattagatccacaatataccagctcatgctacattcactggacccattgagagaagtcagactggccaaagagaaggaggaggaaagtctgaatcagggggcaagggcccagcctcaggcgaaagctgaaagtaagccagaggaggaggagcctgctaaactcccagccgtgaccgtgacaccggcccctgtcccagatattaagggcgatcagaaggaaaatcccgggggccaagaagacgtcgcagaagcagaatctacaggggaaatgcctggggaagaaggggagacagcaggggaaggagagacggaggagaagtccgggggcgaaactcaaccagagggagaaggagagacagagacgcagggcaagggcgaggagtgtgaagacgagaacgaggccgaaggcaagggagataatgagggcgaggatgagggggagattcacgccgaagacggcgagatgaaaggtaacgagggtgaaacagaatcgcaggagttgagcgcagagaaccacggtgaggccaagaacgatgagaagggagtcgaggacggcggagggtcagatgggggcgacagcgaagaggaggaggaagaggaagaagaacaggaggaggaggaagaagaggaagaacaggaggaagaagaagaagaagaggaggaggaggaggagaagggtaacgaagagccactctcattggattggcccgagacccggcagaaacaagcaatctacttattcctgctccccattgtgttccccctctggttaactgtgcccgacgtgcggcgccaggtgggcgaaaccatcggtatctctgaggaaataatggggctgactatactagccgcggggaccagcataccggacttgatcacgtccgtaatcgtcgctcggaaaggcctgggagatatggcagtgtcctcaagcgtagggtcaaacatatttgatataactgtgggccttccagttccctggctgctcttcagtttgataaatgggcttcagcctgtgcccgtctcgagtaatggtctattctgcgcgattgtgcttctcttcctaatgttgctgtttgtaataagttctattgcctcctgcaagtggcggatgaataagattctagggttcacaatgttccttctctattttgtctttctcattatatcagtgatgctcgaagatcggatcatctcttgcccagtttccgtgtag

SEQ ID NO: 205812 - DNA, 3246 bp, Artificial Sequence
  Description of Artificial Sequence: Synthetic coding sequence
atgggcaagctgatccggatgggcccccaggagcggtggctgctgcgaacgaagaggctgcactggagcaggcttctctttctcttaggcatgctcataatcgggagcacataccaacacctgcgccgcccccgcgggctgtcatccctctgggcggcagtgagcagccaccagccaatcaagttggcgtcaagggacctaagctctgaagagatgatgatgatgtcctcctccccttccaaaccctctagtgaaatgggaggaaaaatgttggtccctcaggcatccgtgggtagcgatgaggccacgctgtctatgaccgtggagaacatcccatccatgcctaagcgtaccgctaagatgatccctacaacaacaaagaacaattacagtccaaccgccgccggtactgagaggcgcaaggaagacacaccgaccagcagtcggaccctgacatattataccagtaccagttcaaggcagattgtgaagaaatatacacccacacctcgcggagagatgaagtcctacagccccactcaagtccgtgagaaggttaagtatactcccagtcctcgcggcagaagagttggaacctacgtacccagtactttcatgactatggagacctcccacgccataacaccacgcaccacagtcaaggacagcgacattacagcgacctacaagatcctagaaactaacagtctgaagcgaatcatggaagagacgacacccaccaccttgaagggtatgtttgactccaccccaaccttcttgacacacgaggtcgaggctaacgtgctcacgtcaccacgatctgtgatggagaagaacaacctgtttcctccacggcgcgtggaatccaatagttccgcccatccatggggtctggtgggcaagtcaaatcccaagaccccccaggggactgtgctgttgcatacaccggccacatctgagggtcaggtcaccatcagcaccatgacaggaagttctcccgcagagacaaaggcttttacagcggcctggtccttacggaatccgagtccgcgcacatccgtaagcgctatcaagacagcccccgccatcgtgtggaggttggcaaaaaagcctagtacagccccctctacaagtacaactcccaccgtcagggcgaaattaactatgcaagtgcatcattgtgttgtcgtgaagcccaccccagctatgttaacaactccatcaccttctctgacaaccgctttacttcctgaagagctcagtcctagcccatccgtcttacctccttcactgcccgatctgcaccctaagggcgagtacccccctgacttgttcagtgttgaggagcgacggcaaggctgggtggtcctgcatgtcttcggaatgatgtatgtgtttgttgcactcgctatagtgtgcgacgaatacttcgtaccagccctgggtgtgattacggacaaactacagattagcgaggatgttgctggggccacgttcatggcggccgggggctcagccccagaacttttcacgtcgctgattggggtgtttatatctcactccaatgtagggatagggacaatcgttgggagcgccgttttcaacattcttttcgttataggtacttgttccttgttctccagggagatattgaacctcacctggtggccattattcagggatgtcagtttttatatccttgacctcattatgttgatccttttttttctggactcactaatcgcatggtgggagagtttactgcttcttctggcatacgctttctatgtgttcacaatgaagtggaacaagcacatcgaagtttgggtcaaagagcagctgagccgtcggcctgtcgcgaaggtgatggccctggaagatttgtctaaactgccctccttgttaacgagagggagttcatcaacttcactgcacaattctaccatcagaagcaccatctatcaacttatgctacattccctcgaccctttgcgggaagttagacttgctaaagagaaggaggaggagagtctgaaccaaggtgctagagcccagccacaagctaaggcggagagcaagccagaagaggaggaacccgctaagctcccggctgtgacagtcactccagcacccgtgcccgatatcaaaggcgaccaaaaggagaatcctgggggacaagaggacgtcgcagaggccgaatctacaggcgagatgcctggagaggagggggaaacggcgggagagggcgaaaccgaggaaaagtcagggggtgagacgcaacccgaaggtgaaggcgaaaccgaaacacagggtaagggcgaagagtgtgaggacgaaaacgaggcagagggaaaaggtgataacgaaggcgaggacgaaggtgagatccatgccgaagatggagagatgaagggtaacgagggcgaaactgaatctcaggagctatctgcagagaatcacggtgaggctaagaacgatgagaaaggtgtggaggatggtggaggtagtgatgggggagacagcgaagaggaagaggaggaggaggaagaacaggaagaggaggaggaagaagaagaacaggaggaggaagaagaagaggaagaggaggaagaggaaaagggtaacgaggagccactgagcctggactggcccgagactagacagaaacaagccatttacttgtttctgctccccattgtgtttcctttgtggctgaccgtacctgatgttcgacgtcaggagtcgaggaagttcttcgtgttcacgtttctcggctcaattatgtggatcgccatgtttagctatctcatggtgtggtgggctcaccaagtgggggagaccatcggcatcagcgaggagattatgggcctgaccatccttgctgcaggaacctccatcccagacctcattacgagtgtgatcgtggctcggaagggacttggcgacatggccgtgtcctctagcgtggggagcaatatctttgacatcactgttggccttcctgtgccgtggctgctgttcagtttaatcaatggactccagccagtgcctgtgagctccaatggactgttctgcgcaattgttctgctcttcctgatgctgctttttgtgatatcatccatcgccagttgtaaatggcgcatgaataagatcctcggctttacgatgttcctgctatacttcgtgtttcttatcatctctgtgatgctcgaagatcggatcattagctgcccagtgagtgtgtag

SEQ ID NO: 205813 - DNA, 1935 bp, Artificial Sequence
  Description of Artificial Sequence: Synthetic coding sequence
atggacctgcagcagagcaccaccatcaccagcctggagaagtggtgcttagacgaaagcctgtcaggatgtagacggcactactccgtgaagaagaagctcaagctcatccgtgtccttggtctgttcatgggattagttgccatttctacagtaagcttctctatctctgcattctctgagacagacacgcagtctactggcgaggcgtccgtggtcagtggaccgagggtggcacaggggtatcaccaacggaccctgctcgacctgaacgataagatactcgactacaccccacagccacctctttccaaggagggcgagagcgaaaacagcacggaccatgcccagggagattatcccaaagacatcttttccctggaggagcgacgtaagggagcaattatcctgcacgtgattggtatgatatatatgttcatcgcgctggccattgtgtgcgacgagttttttgtgccgagtctcacagtgatcactgagaaactcggaatcagcgatgatgtggcgggcgcaactttcatggccgctggcggatcagcccccgagcttttcacctcactaatcggggtgtttattgctcattccaacgtagggatcggcacgatagttggcagcgcagtgtttaatatcttgttcgtgataggcatgtgcgcactctttagccgggagatcttaaacctcacttggtggcccttgtttagggacgtatctttctacatcgtagacctgattatgctgattatattcttcttagataacgtcatcatgtggtgggaatccctactactcttgaccgcatacttctgctacgttgtctttatgaagtttaatgtccaggtcgaaaagtgggtgaagcagatgatcaaccgcaacaaggtggtaaaggtgacagcccctgaagcgcaggccaaaccttccgccgcacgggataaagatgaacctacgctccccgccaaacccaggcttcaaagaggcggctcctccgcttctcttcacaattctctgatgcggaatagtatttttcaactgatgattcacaccctagatcccctggctgaaggcagatttagggaaaaggctagcattctgcataagatcgcgaagaagaaatgtcacgtagatgaaaatgagcggcagaatggggcggccaaccacgtggaaaaaatcgagcttcccaactctacctccactgacgtggaaatgacgccatctagtgatgccagcgagcctgtgcagaatggcaacctttcacacaacattgagggagcagaagcccagaccgctgacgaagaagaggatcagcctctaagtctggcctggcccagtgagacccggaaacaagtcacattcctcatagtgtttcccattgtttttccactttggatcactctccctgatgtgagaaagccttctagccggaagttttttcctatcactttttttggttcgatcacctggatcgccgtctttagttatctcatggtctggtgggctcaccaggtcggagaaactatcgggatctcggaggaaataatgggactgaccatacttgcggctgggacttccatccccgacctgatcaccagcgttatcgtcgcccggaaaggactgggggacatggctgtttcctcctctgttggttcaaacatcttcgatattacagtcgggctccccctcccctggctgctatacaccgtcattcatagattccagcccgtggcagtgtcatccaacgggttgttttgcgctattgtgctcttgttcattatgctgctcttcgtaattctctcgatcgccttgtgtaaatggaggatgaacaagatccttggttttattatgttcgggctgtatttcgtctttcttgtggttagtgtgctcttggaagatagaattcttacgtgccctgtgagcatctag

SEQ ID NO: 205814 - DNA, 1986 bp, Artificial Sequence
  Description of Artificial Sequence: Synthetic coding sequence
atggacctgcagcagagcaccaccatcaccagcctggagaagtggtgcctagatgagagtttgagcggatgccggaggcactatagtgtcaagaaaaagctgaagctgatcagggtcctgggcctattcatgggcctagtggctatcagcactgtttcctttagcatctctgccttcagtgagaccgatactcagtcaaccggggaggccagcgttgtatctggaccccgagtggcccagggctaccatcaaagaacgttgttggatttaaatgataagatcctagactacaccccccagcctccactgtctaaggagggggaatccgaaaattctaccgaccatgcccagggcgattatccaaaggacatttttagcctagaagagagacgcaaaggagccattatcctccatgtgattggcatgatttatatgtttatcgccctggccattgtgtgcgacgagttctttgttcctagtctgacagtgatcaccgagaagctaggcatctctgatgatgtcgccggagcaaccttcatggctgcaggcgggagtgctccagaacttttcactagcctgattggtgtgtttattgcacatagcaatgtcggcatcggcaccatcgtaggatccgctgtctttaacatcctattcgtgataggtatgtgcgctttgttttcaagggagatcctgaatctgacctggtggcccctcttccgagacgtgagtttttatatcgttgacctcatcatgttaattatcttctttcttgacaacgtcatcatgtggtgggagagcctcttactgttgacagcatacttctgctatgtggtgttcatgaagttcaacgtgcaagtcgagaagtgggtgaagcaaatgattaacaggaataaggtagttaaggttaccgcaccagaagcacaggccaagcctagcgcggcaagagataaagacgagcccactcttcctgcaaagcctaggctgcagcgaggcgggtctagtgctagcctgcataactcgctcatgaggaacagtatttttcagctgatgatccatacacttgacccgctggctgaagaattaggttcctacggcaagctgaaatattatgataccatgacagaagaaggcaggtttagggaaaaggccagcattctgcacaagattgcaaaaaagaagtgtcacgtcgacgaaaacgaaagacagaatggcgccgcaaatcatgtcgagaaaatagaacttcctaattcgacaagcaccgacgtcgaaatgaccccatcctcagacgcctctgagccagttcagaatggaaatctgagtcataatatcgagggtgcagaagcccagaccgcagacgaagaagaggaccagcctctcagcctggcttggccatctgagacaaggaagcaggtgacatttctgattgtttttcccatagtctttcccttgtggattacattacctgatgtcaggaaacccagctcccggaagttttttcccatcacttttttcggatccataacttggattgctgtcttttcatacctgatggtgtggtgggcccaccaagtaggggagacaatagggatctccgaggaaatcatgggcctgacaatcctggctgctggaacgagcatcccagatctgattacatcagtgattgtggcaagaaagggcctgggggacatggcagtgtcgagctctgtgggttctaatatttttgatatcaccgttgggctccccctgccttggctactgtatacggttatacaccggtttcagccagtggctgtgtctagcaatggcctcttttgtgccatagtcctgctctttatcatgctgttgtttgtcatactgagcattgccctgtgcaagtggaggatgaataagatcctgggttttatcatgtttgggctctattttgtgtttctcgtcgtgtccgtgctgttagaggatcgaattcttacttgtcctgtgagtatctag

SEQ ID NO: 205815 - DNA, 1935 bp, Artificial Sequence
  Description of Artificial Sequence: Synthetic coding sequence
atgcggcccagcggcgacgaggaccgggcccggcggcggcggcggaggagacgccgtcgcgacctgctgttgtcccagctgtgttttctagcctcagtggctctgttactgtggagtttgtcgagtctgcgtgagcaaaaggagctcgacctaatggatctggtgggcgaagataggaaatggatgatggctcgtaagctcatgcaggttaatgacacattgacaagtgaagacgctgggctgaggaatagcaaaaactgcaccgaacccgcgctccacgaatttccaaatgatattttcacaaatgaagacagaaggcagggggccgtcgttctgcacgtgctctgcgcaatctacatgttctacgccctggcgattgtgtgcgacgacttcttcgtgcctagcctcgaaaagatttgcgagagactgcacctttccgaggacgtcgcaggggccacgtttatggccgccggctcttctgctcctgaactttttacatcagtaattggcgttttcattaccaagggcgacgtaggcgtggggaccattgttggatcagccgtcttcaatatactctgtatcataggcgtgtgtggcctcttcgcaggtcaggtcgtggctctatccagctggtgccttctgcgggattctatctattacacattatcagtgattgctttaattgtgttcatctacgacgaaaaggtctcatggtgggagagccttgttttggtactgatgtatctgatttatatcgttattatgaaatacaatgcttgcattcaccaatgcttcgagagacgcaccaagggcgctggcaatatggttaatggtcttgccaacaacgcagagattgacgactcttccaactgcgacgccacagtggtcctattgaagaaggccaactttcacaggaaggcctcagtcatcatggtggacgagcttctgagtgcataccctcaccaacttagtttttccgaagctgggctgaggatcatgattacctctcactttccaccaaaaacccggttgagcatggcttctcggatgttaattaatgagcgccagcgcctgataaatagccgagcttatacaaacggcgagtctgaagtggctataaagattcctataaaacataccgtagagaacggaactgggcccagcagtgcacctgatagaggggtgaacggtacccggagggacgatgtcgttgccgaagcaggaaacgagactgagaatgaaaatgaagataacgaaaatgacgaggaagaggaagaggatgaagacgacgacgagggtccatacacaccatttgacacccctagcggtaaactggagactgttaaatgggctttcacatggcctctgtccttcgtactgtacttcaccgtgcctaattgtaacaagcctaggtgggagaagtggttcatggtgactttcgccagtagtacactttggatagcagcattttcctatatgatggtgtggatggtaaccataataggctacacactcggaataccggacgttatcatgggcattacattcctggccgccggcacgagtgttcctgattgtatggctagtcttattgttgccaggcaggggatgggcgacatggcggtgagtaacagcattgggtctaatgtgttcgacatactcattggattaggccttccatgggcattacagactctcgccgtggattacgggtcatacattcgcctaaattctagagggttgatctactcagtggggcttctgcttgcctctgtcttcgtcaccgtgttcggtgtccatttaaacaaatggcagttggataaaaagctgggttgtggctgcctcctgctctacggcgtgtttctctgcttcagcatcatgactgagtttaacgtctttacctttgtcaacttgcccatgtgcggcgaccattag

SEQ ID NO: 205816 - DNA, 1755 bp, Artificial Sequence
  Description of Artificial Sequence: Synthetic coding sequence
atggccggccggcggctgaacctgcggtgggccctgagcgtgctgtgcgtgttgctgatggccgagacagtgtctggcacccgcggatcatcaacgggagcccacatttcaccacagttccctgcatcaggggtcaatcagacgcccgtggtggactgtcggaaggtctgtggactgaacgtgtctgatcgctgtgactttatcagaacaaatcccgactgtcactccgatggtggttatctggattatctggaaggcattttttgtcatttcccaccatccctgctgcctctagcggtcaccctgtacgtaagctggctcttgtatctgttcctcatactgggggtcactgctgcaaagttcttctgccctaatctttcggctatatctactacacttaaactgtcacacaacgtcgcaggagtgacattcctggcattcggaaatggcgcacctgacatttttagcgccctggtggctttcagcgacccccacactgcaggactcgcactgggggccctattcggagccggcgtgcttgttacaaccgtggtggccggtggcatcaccatcctccatcccttcatggcagcttcgcgtcctttcttcagagacatcgtgttctacatggtggccgtgttcctgaccttccttatgctcttcaggggcagagtgactctggcctgggccctcggatacttaggcctgtatgttttttacgtggtgacagttattctctgtacttggatttaccagcgccagaggcggggttccctcttctgcccgatgcctgtcacacccgaaattctgagtgacagtgaagaggaccgggtcagttccaacaccaattcatatgattatggggatgagtaccgacctctctttttctaccaggagacaacggcacagatcctggtgcgagccctaaatccccttgactacatgaagtggcgcaggaaaagtgcctattggaaggccctgaaggtctttaagctacccgtggagttcttactgttactcaccgttcccgtcgtggaccctgacaaggacgatcagaactggaagcgccccctgaactgcctccatctggtaattagcccactagtggtcgtcctaacactgcagagcggtacttatggcgtttacgagatcggagggcttgtgccagtctgggtcgtggttgtgattgctggcaccgccctggccagtgtgacattcttcgctaccagcgactcccaacctccacggcttcactggcttttcgcgttcctgggcttcctcacgtcggcactgtggatcaatgccgcggccactgaggttgtgaatatactgcggtcacttggcgtggttttccgtctctctaacacagtcctcggactcacacttctcgcgtggggtaattcaattggagacgcctttagtgacttcactctggctaggcagggatatccacgtatggcgttcagtgcttgctttggcggcataattttcaatatcctggtgggcgtgggcttggggtgtctgctgcagatcagcagatcccacacggaagtaaagctggagcctgacggactactggtctgggttctggccggcgctctggggctgagtctggtcttctccctggtaagtgtgccactccagtgttttcaactgagtcgagtttacgggttttgccttcttttgttctacctcaactttctggtagtggctctgttaaccgagttcggggtgattcacctcaaatccatgtag

SEQ ID NO: 205817 - DNA, 1587 bp, Artificial Sequence
  Description of Artificial Sequence: Synthetic coding sequence
atggccggccggcggctgaacctgcggtgggccctgagcgtgctgtgcgtactgctgatggccgagacggtaagtggaacacgtggcagttcgacaggtgcgcacattagcccccagttccccgcctcaggagtcaaccagacccctgtggtcgattgtagaaaggtctgtggcctgaacgtttctgacagatgtgacttcatccggacaaaccctgactgtcactcagacggaggctacctcgactatctagaggggattttttgccacttccccccttctctcctccctctagcagtcacactctatgtgagttggctcctgtacctgtttctaatcctgggagtaacggccgccaaatttttctgtcccaatttgagcgctataagcacaaccctcaaattgtcacacaatgttgcgggagtcacgttcctggcattcgggaatggggccccggacattttttctgcgcttgtcgctttttcggacccacacaccgctggcttggcactgggagcgctgttcgggtatctgggactatacgtcttttacgttgtgactgtcattttatgtacttggatctatcagaggcaaagaagggggtccctattctgccctatgcctgtcacccctgagatactgagcgacagtgaagaagatagggtgtcttctaatacaaactcctacgactatggggacgagtatagaccattattcttctaccaagagaccacagctcagatcctggtgagagctctgaatccccttgactacatgaaatggcgcagaaagtctgcttattggaaggccctcaaagtatttaagctcccggtggaatttcttctcctcctgacggttcctgtagtggatcccgataaagacgaccagaattggaagcggccactaaattgtttgcatctggttatctctccgctggttgttgtgttaacactgcagagtggcacatatggcgtttacgaaattggggggctggttccagtgtgggttgtggtcgtgatcgctggaaccgcgctggcttcggtgaccttttttgccacatccgactctcagccccccagactgcattggctgttcgccttcctggggttcctcacttctgcactgtggattaatgccgccgcaaccgaggtggtcaacatcctccggagccttggcgtagtcttcagattatccaacacagtcctgggactgacccttttggcctgggggaattcaatcggagacgccttcagcgactttaccctagcccggcaaggatacccgcggatggccttcagcgcctgtttcggggggattattttcaacatcctcgtcggagtgggcctcggatgtctgttgcaaattagcaggtctcataccgaagtgaagttagagcctgatggacttttggtgtgggtgctggccggagccttgggactttcacttgtgtttagcctagtgagcgtgccgctgcagtgcttccagctgagccgggtctatggcttttgtctgctgctgttttacctgaactttctggtcgtggcactattgaccgaatttggagttatccaccttaagtccatgtag

SEQ ID NO: 205818 - DNA, 1587 bp, Artificial Sequence
  Description of Artificial Sequence: Synthetic coding sequence
atggccggccggcggctgaacctgcggtgggccctgagcgtgctgtgcgtgttgttaatggccgagacagtgagcggcacgaggggctcaagcactggcgcacacatctctccgcagtttccggctagtggcgtaaaccagactcctgtagtggactgtcgcaaggtgtgcggactgaacgtatcagataggtgtgattttattcggaccaacccagattgccactccgatggaggttaccttgattatctcgagggcatcttttgccacttcccacctagtctgctgccactcgctgtaacactgtatgtgagttggttgctgtatttgttcctcatcttgggcgtgacggctgctaagtttttctgtccaaatctctccgccatcagtacgacactgaagctttcacacaacgtggcaggggtcacattccttgcgtttgggaacggggctccggatatcttttctgcccttgtcgcatttagtgatcctcatacagcaggactggcactcggcgccttgtttggatacctgggcctctatgtgttctatgttgtcactgtgatcctgtgtacctggatttatcaacgtcaaagaagaggcagtctgttttgtccaatgccagttactccagagatactgtcggatagcgaagaagaccgggtctcatccaatacaaattcctacgattacggagacgagtatcgacccctgtttttctatcaggagacaaccgctcagattcttgtccgcgccctgaatcccctagattacatgaagtggaggcgcaaaagcgcgtactggaaagccttaaaggtgtttaagcttcccgtggagttcctgctgcttctcaccgtgcctgtggtggaccccgacaaagatgatcaaaattggaaacggccactgaattgcctccatctcgtgatcagccccttggtcgtggtactcactctgcaatccggcacttatggagtgtatgaaatcggaggattggttccagtgtgggtggtggtggtcatcgctgggactgcccttgccagtgtcacttttttcgcaacgtccgactcacaacctccacgtctgcattggctgttcgcttttctaggatttttgacttctgcgctgtggatcaacgccgccgcaactgaagttgtcaatattcttaggtcattaggtgtagtgttcaggttaagcaataccgtgctagggctgacactcctggcatggggcaactccattggagatgcattctccgacttcacccttgccagacagggatatcctaggatggccttcagcgcttgtttcggtggcataattttcaacattcttgtaggcgtgggtctgggctgtctgttacaaatctcacggagccataccgaagttaagctcgagcctgacggtctacttgtatgggtgctcgctggggctctgggactcagtctagtgttttctttagtatcggtgccactgcaatgttttcagctgtcacgggtgtatggattctgtttactgttgttctatctaaacttcctcgtcgtggcactcctcacagaattcggggtgatccacctgaagagtatgtag

SEQ ID NO: 205819 - DNA, 396 bp, Artificial Sequence
  Description of Artificial Sequence: Synthetic coding sequence
atggccggccggcggctgaacctgcggtgggccctgagcgtgctgtgcgtcctgctgatggccgaaacggtctcgggcacacgagggtcatccactggcgcccacataagcccccagttccctgcctccggcgtgaatcagacaccagttgtggattgcagaaaagtctgtgggctgaatgtttcagaccgctgtgacttcatccgaaccaaccccgattgccacagcgatggaggctatctggactatctggaaggtattttctgccactttccaccaagtcttctgcctcttgcagttaccctgtatgtgtcctggcttctgtacttgttcttgatcctgggcgtgactgcggcaaagttcttctgccctaatctttccgctatctccacttag

SEQ ID NO: 205820 - DNA, 696 bp, Artificial Sequence
  Description of Artificial Sequence: Synthetic coding sequence
atggccggccggcggctgaacctgcggtgggccctgagcgtgctgtgtgttctgcttatggcggagacggtgtccggcaccaggggctcgtctactggagcccacataagtcctcagtttcccgctagcggcgtgaatcagacacccgtcgtggattgccgcaaggtgtgtggactcaatgtctccgataggtgcgactttatccgtaccaatcctgattgtcactcggatggcggttacctggactaccttgagggtatcttttgccattttcccccatctctcctcccactggccgtcacattgtatgtcagctggctgctttatctctttctgatcctcggggttacagctgccaaatttttttgtcctaacctcagtgcaatttctactaccctgaagctgagtcataacgtcgctggggtgacattcctggcatttgggaacggtgccccggacattttcagtgccctggttgcttttagcgaccctcacaccgcgggcctagctctcggcgctttattcggcgccggtgtcctagtcacaacagtggtggccggtggcattacgattctccacccctttatggcagcctccagacctttctttagggacattgtgttctacatggtagccgtgtttctgaccttcctcatgctgttcaggggcagagtcaccctagcttgggccttgtag

SEQ ID NO: 205821 - DNA, 312 bp, Artificial Sequence
  Description of Artificial Sequence: Synthetic coding sequence
atggccggccggcggctgaacctgcggtgggccctgagcgtgctgtgcgttcttcttatggctgagacagtgtccgggacaaggggatcaagtacaggggcccatatctcaccgcagtttcctgccagcggcgtgaaccaaaccccagtggtggactgccgcaaggtctgcggtctgaatgtgagcgataggtgcgatttcataagaacgaaccccgattgccactccgacggtggatacctagactacttagaggggattttttgccacttccctccatccctcctgcctctggccgttacactatactag

SEQ ID NO: 205822 - DNA, 1755 bp, Artificial Sequence
  Description of Artificial Sequence: Synthetic coding sequence
atggccggccggcggctgaacctgcggtgggccctgagcgtgctgtgtgtactcctgatggccgagacagtgtctggcacccgaggctcctctacgggagcacacatctcacctcagttccctgcaagcggggtcaatcagaccccagtggttgactgtcgaaaggtctgcggcctcaatgtgtctgatagatgtgacttcattcgcacaaacccagactgtcactcagatgggggttatcttgactacttggaggggatcttttgtcactttccgccctctctgttaccactcgccgtgaccctgtacgtgagttggctgctctacctgttcttgatcttaggcgttactgctgcaaaatttttttgtcccaatttgtctgccattagcaccaccctgaaactgtctcacaatgtggctggcgtgacctttctggcattcggcaatggcgcccccgacatttttagtgccctagtcgcattctctgacccacatacggctggccttgccctgggcgccctgtttggcgctggcgtgctggttacaacagtcgtggctggaggaatcactatcttgcatccatttatggccgcttcacgacctttcttccgtgacatcgtcttctacatggtggctgtcttccttacctttctgatgcttttccgagggagggtgactctggcatgggccctgggatatctgggcttgtatgtgttttacgtggtgacagtgatactatgcacatggatttatcagaggcagcggcgtggctccctgttctgtccaatgccagtgacgcctgagatactatccgattctgaggaagatcgggtgtccagcaacacaaactcctatgattatggggacgagtatcgacctctgtttttctatcaggagactacagcccagattttggtgcgtgctctaaatcccctggactacatgaagtggcgaaggaagagcgcatactggaaggcgctgaaggtattcaaactgcccgttgagttcctgttactgctgaccgtccctgtggtggacccagataaggatgatcagaattggaagcggcccctcaactgtttgcacttggtgatctcgcctttggtggtggtgctcaccctccaatcaggcacctacggtgtatatgagatcggcgggctcgtccctgtgtgggtcgtagtcgtcatcgccggaaccgcactggcatccgtaaccttttttgctacttcggattcgcagccacccaggttgcattggttgtttgcattcctcggtttcctgacctccgccctctggattaacgccgccgccacggaggttgtaaatatccttcggagtctcggggttgtgtttcgccttagtaacacggtgctgggcctgacacttcttgcctgggggaactcgatcggagacgccttctctgattttacgctcgctagacagggatatccccgtatggcgttctctgcgtgtttcggaggtattatcttcaatatccttgttggggttggtcttgggtgcctcttacagatctctcgttcccacactgaagtgaagctggagcccgatggtctgttagtctgggtgttagcaggcgccctcggcttaagcctcgtcttcagcttagtgagcgtacctctccagtgcttccaactatctcgggtctatggtttttgcctgctgctgttttatctgaatttcctggttgtggcccttttgacagaattcggggtcattcacttaaaatccatgtag

SEQ ID NO: 205823 - DNA, 906 bp, Artificial Sequence
  Description of Artificial Sequence: Synthetic coding sequence
atggccgaccagcccaagcccatcagccccctgaagaacctgctggcgggaggctttgggggtgtgtgccttgtgttcgttggccaccccctggacacagtcaaagtccggctacagacccagccaccctccttacctggacagccgcccatgtacagcggcaccttcgactgtttccgaaagacacttttcagggagggcattaccgggctctaccgaggtatggctgccccaatcatcggtgtgaccccaatgtttgccgtctgcttcttcggctttggactaggcaaaaagctgcagcaaaagcaccccgaggatgtgctttcttatccacaattgttcgcagctgggatgttgagtggagtgtttaccaccggaatcatgacgccgggcgagcggattaagtgtttactccagatccaggcaagttctggtgagtccaagtataccgggacactcgattgcgccaagaaactgtaccaggaatttggaatccgcgggatctacaaaggcactgtgctcaccctaatgcgggacgtaccggcctctggcatgtattttatgacgtacgagtggctcaagaatattttcacccccgaaggcaagcgcgtttcagagctgagtgccccaagaatccttgtggcagggggtatagccggcatatttaactgggcagtggctatacccccagatgttttaaagtctagattccagacagctccaccaggcaagtatccaaacggttttcgggatgtgctgcgggagctgattcgtgatgaaggagtgacatctctctataaaggcttcaatgcagtgatgatacgcgccttccctgcgaacgcggcatgttttcttggattcgaggtggctatgaagttcctgaattgggccacacccaatctgtag

SEQ ID NO: 205824 - DNA, 756 bp, Artificial Sequence
  Description of Artificial Sequence: Synthetic coding sequence
atgtacagcggcaccttcgactgcttccggaagaccctgttccgggagggaataaccggactgtacagagggatggccgcccctatcatcggcgtgactcctatgttcgccgtgtgctttttcggctttggactaggaaaaaagttgcaacagaaacaccccgaggacgtactgtcttaccctcagctctttgcagccggcatgttgtcgggagtgttcacaacagggataatgactcccggggaacgcattaaatgtctgctgcagattcaggcttcctccggcgagagtaaatacacaggcactttggattgcgccaagaagctgtatcaggaattcggcatcagaggcatctacaagggaacagtgttaacactcatgagagatgttccagcgtccggcatgtactttatgacctatgagtggttgaagaacatctttacccctgagggtaaacgggtaagcgagctgtccgctccgcggatacttgtggcaggcggaattgcaggtatctttaactgggcagtagccatccctcctgacgtcctgaagtctcgctttcagaccgctcctcctggcaaataccccaatggatttcgcgacgttcttcgggagctgattagggacgagggagtgacctccctctataagggctttaacgctgtcatgattagagcctttcctgccaatgctgcatgcttcctggggtttgaggtcgccatgaaatttcttaattgggcgacacccaatttgtag

SEQ ID NO: 205825 - DNA, 948 bp, Artificial Sequence
  Description of Artificial Sequence: Synthetic coding sequence
atgacccaccaggacctgagcatcaccgccaagctgatcaacggcggagtggctggcctcgtcggtgtcacttgtgtctttcctattgatctagccaaaacgcgcctgcagaatcaacatggcaaagcaatgtacaagggcatgatcgactgtctaatgaagactgcccgagctgagggattttttggcatgtaccgcggcgctgccgtgaacctaacacttgtcacccccgaaaaggcgattaaactcgccgccaacgatttctttagacggctgctgatggaagacggcatgcagcgcaatctgaagatggaaatgctcgctgggtgcggcgctggcatgtgccaagttgtggtgacttgcccgatggaaatgctgaagattcaacttcaggacgctgggcgcctggccgttcatcatcaagggtctgcctcagcaccgtcgacctcacggtcgtacaccacgggatcagcctccacacaccgcagaccctccgccaccttaattgcatgggagctccttaggacccagggcctggctggactgtatcgtggactgggggccaccttgctcagagatatccctttcagcatcatctactttcccctcttcgctaatctgaacaacctgggctttaacgagctggcgggcaaggcgagcttcgcccactcttttgtgtccggctgtgttgccgggtcaatagccgccgtggcagttacgccccttgacgtgctgaagactcgcattcaaaccctcaaaaaggggctgggcgaggacatgtacagcgggattactgactgcgccaggaagctgtggatccaggaggggccctctgcattcatgaagggggctggctgccgggccttggtgatagctcccttgttcggaattgcgcaaggagtctatttcattgggataggggaaagaattctgaagtgctttgactag

SEQ ID NO: 205826 - DNA, 948 bp, Artificial Sequence
  Description of Artificial Sequence: Synthetic coding sequence
atgacccaccaggacctgagcatcaccgccaagctgatcaacggcggcgtggcaggcctcgtgggcgtaacctgcgtctttccaatagacctggccaagaccaggctccagaaccagcacggtaaagctatgtacaaaggcatgatcgactgcctcatgaagacggcccgggcagaaggcttctttggtatgtacaggggagctgccgttaatctgaccctggttactcccgagaaggccattaaattagctgcaaatgatttctttcgtaggctcttgatggaggacggcatgcaaaggaacctgaaaatggaaatgctagccgggtgtggtgcgggcatgtgccaggtggtagtgacttgtcctatggagatgctcaaaatccagttacaagacgctggacgcctggctgtccaccatcaaggctccgcctcagccccgagcacatcaaggtcgtacacaaccggtagcgccagcacacaccgaaggccttctgccacccttattgcatgggagctgctgcggacacaaggactcgcaggcctgtatcgcggccttggcgcaaccctactgcgggacattcctttcagcattatatacttcccactcttcgctaatctcaataacctgggcttcaatgagctagccggcaaggccagctttgcgcattcctttgtgagcgggtgtgtagcgggcagcatcgccgcagttgcagtcactcccctggatgttctcaaaacacgcatccaaacgctcaagaagggcctgggagaagacatgtactctggaatcacagattgcgcaagaaagttatggatccaggagggaccaagcgccttcatgaaaggtgcaggatgcagggctttagtcattgcccccctatttggcatcgcccagggtgtgtactttatcggcatcggtgaaagaattcttaaatgcttcgactag

SEQ ID NO: 205827 - DNA, 1716 bp, Artificial Sequence
  Description of Artificial Sequence: Synthetic coding sequence
atggagaacgtgaaggagatcttcggccagaccatcatccaccaccatatccctttcaactgggattgcgaatttatccgattgcactttggacacaacagaaagaagcatttgaattataccgagtttacacaatttctgcaggaattgcagctggagcatgcccgccaagcctttgcacttaaagacaagtctaagtccggtatgatctcaggcttggacttcagtgatattatggtcacaataagaagtcacatgctgactcccttcgtcgaggagaatttggtgtcagccgccggggggtctatcagtcatcaagtttccttctcgtatttcaacgcttttaactctctgctcaacaatatggaactggtgagaaagatctatagtaccttggcagggacaagaaaggacgtcgaagtcacaaaagaggaatttgctcaaagcgcgatccggtatgggcaggtgactcctctggagatagacattctctaccagctagcagacctctacaatgcatctggacgactgaccttggctgatatcgagcgaatcgccccactggcggaaggcgccctgccatacaacctcgccgagctccaacgccaacaatctcccggcctaggccggcctatctggctgcagatcgctgaaagtgcctaccgtttcactcttggcagcgttgcgggcgccgtaggggccacagccgtgtacccaatagatttggtgaaaacaaggatgcagaatcaaaggggcagcggaagtgtcgtgggtgaactcatgtacaagaattcttttgactgcttcaaaaaagtgctgcgctatgaagggtttttcggattgtatcgcgggttgatcccacagctgattggcgtggcccctgagaaagcaattaaactgaccgtgaacgactttgtacgagataaatttacccgaagagacggctccgtgccattacccgcagaagttctggccggtggatgcgcggggggcagtcaggttattttcactaatcctctcgaaatcgtcaagatacggctgcaggtagctggggagatcacgacagggcctcgcgtctcggctctgaatgtacttcgagacctgggtatcttcggtctctataagggggctaaagcctgctttctacgcgatatccctttttctgccatctactttcccgtctacgcccactgtaagcttctcctagcagacgagaacggccatgttggcggattaaacctcctagctgcgggggctatggcaggcgtcccggctgcctcgctggtgaccccggcggatgttataaagacaaggctccaggttgcagctagggctgggcagactacgtacagcggcgttatagattgcttcagaaaaattttgagggaggagggtccctcggctttctggaagggtactgccgcgagggtgttcaggagctccccccagttcggtgtcactttagtgacgtatgaactgctgcagcgctggttctatatagattttggtggactgaaacccgcaggctccgagcccacccctaaaagccggatcgcagacctgccgcccgcgaacccggatcatatcggtgggtacagattagcaacagccacctttgctggaatcgaaaacaaattcgggctttacttacccaagttcaagtcacccagcgttgccgttgtgcagccaaaggcagctgttgcagccactcagtag

SEQ ID NO: 205828 - DNA, 2037 bp, Artificial Sequence
  Description of Artificial Sequence: Synthetic coding sequence
atggccgtgaaggtgcagaccaccaagcggggcgacccccacgagctgaggaatatcttcctgcagtacgcctccaccgaggtcgacggcgaaagatatatgacccccgaggactttgtgcagcgttacctgggtttgtacaatgaccctaactctaacccaaagatagtacaacttttggccggggtcgcagatcagacgaaagacgggctgatatcctaccaggagtttctcgcatttgagtcagtgctatgcgctcccgactccatgttcatcgtggcattccagttgttcgataaatccggcaacggagaagtgacctttgaaaatgtgaaagagatcttcggacagacgatcatacatcaccacattccgttcaattgggattgcgaattcatccgtctgcactttggccataatcgcaagaagcacctgaattatactgagtttacccagttcctccaggagctgcagttggagcatgcccggcaggcctttgccctgaaggacaagtctaagtctggtatgattagtggcttagacttctctgacataatggttaccattcgaagccacatgttaactcccttcgtagaagagaacttggtgtccgcagccggcggcagtatatcgcatcaggttagtttctcctactttaatgccttcaatagtctgcttaataacatggagctggtgcgcaaaatctacagtacactagcagggacccgcaaggacgtggaggtgactaaagaagaatttgcccaatcagccatcagatacggccaagtgactcccttggaaatcgacatactttaccagctggccgatttgtataacgcatcagggagacttaccctggctgatattgagcgaattgccccactagcagagggggccctgccctacaatctggctgaactacagagacaacagtctccgggcctcggacgtcctatctggctgcaaatcgctgagagcgcttatcgttttaccttagggtctgtggctggagccgtgggtgctacagccgtctatccaatagacctggtcaaaactcgaatgcagaaccagcgaggatcggggagtgtcgtgggcgagcttatgtacaagaatagttttgactgcttcaagaaggtcttgcggtatgagggcttctttgggctgtacagagggttaattccgcagctcataggcgtggcccctgagaaggcaattaaactaactgtcaacgactttgttcgtgacaagttcacaagaagagatggctccgttcccctgcctgccgaagtgctcgctggaggttgcgccggtgggtcgcaagttatttttacgaacccattagagatagtgaaaattaggctacaggtcgctggcgagatcaccactggccccagggtgagtgcgttgaacgtgcttcgcgatctgggtatctttggactttacaagggggctaaggcctgtttcctgcgagatattcccttttccgcaatctactttcccgtctacgctcattgcaagctcttgttggcagatgaaaacggtcacgtgggcgggctcaatttattagccgctggcgctatggccggagtcccagcggcgtccctcgtgacacctgctgacgtgattaagaccagactgcaggtcgccgcccgtgctggccagaccacatacagcggcgtcatcgactgcttcagaaagattctcagagaggaagggccttccgccttctggaaggggactgctgcaagggtgttcagatccagccctcaatttggagtcactctggtgacctacgagctactgcagcgctggttttacatagattttggcggcttgaaacctgctggcagcgaacccactcccaagtctcgaatcgctgatctacctcccgcaaaccctgaccacataggaggttacaggcttgcaacggcaactttcgctggaatcgagaataaattcggtctctacttgccaaaatttaagtcccccagcgtcgcggtcgtccagccaaaagccgccgtggctgctacccagtag

SEQ ID NO: 205829 - DNA, 1944 bp, Artificial Sequence
  Description of Artificial Sequence: Synthetic coding sequence
atggccgccggcctggccacctggctgcccttcgcccgggccgccgctgtggggtggcttcctctcgctcagcagccgcttccgcccgccccaggtgtgaaggctagccgaggcgatgaggtcctggtcgtaaatgtgagcggacggaggttcgaaacgtggaagaatactctggaccgatatcccgacaccctgctggggagctccgagaaagaattcttctacgacgctgactccggagaatactttttcgatcgcgaccctgacatgtttagacacgtgttgaacttttaccgaacaggacgcctgcactgtccacggcaggaatgcatccaagcgttcgatgaggagttagcattttacggcctggtgcccgagctcgttggggattgttgcctcgaggaatatcgtgatcgcaagaaagagaatgcggaaaggctggctgaggacgaagaagctgagcaagcgggcgatgggcctgctctgcccgcggggtcaagcttacgacagagactgtggagggcttttgagaaccctcacaccagcaccgcagccctggtcttttattacgtcaccgggttcttcatagccgtctccgtgatagctaatgtcgtggaaacaatcccatgccgggggtccgcgcggcggagcagccgcgagcagccatgtggtgagcggttcccccaagctttcttctgcatggacacagcctgcgtcctcatatttactggtgaatacctcctgcgcctttttgctgccccgtccaggtgtagatttctgcgtagcgttatgtctctgatcgacgttgttgccattctgccatattatatcgggttgctggtgcccaaaaacgacgatgtctccggcgcctttgtgacgttgagagtgtttagagtgtttcggatcttcaagtttagtcgtcattcccagggtcttaggatcttgggttataccttgaagagttgcgcctctgagctggggtttctccttttttccttaacgatggctattataatcttcgcaaccgtcatgttctacgccgaaaagggaaccaataagacaaacttcaccagtataccagccgccttttggtatacaatcgttacaatgaccaccctagggtacggcgacatggtgcccagcactatagctggaaaaatttttggcagcatatgtagtctgagcggcgtgctggtcatcgctttgccggttcctgtgatagtgagcaacttctcgcgaatttatcatcagaatcagcgggctgacaaacggcgtgctcagcagaaagttaggctcgctagaatcaggttggccaaatccggaactacgaatgcctttttacagtataagcagaatggagggctggaggacagtggctctggggaggagcaggccttatgcgtgagaaacaggtctgcttttgagcagcagcatcaccacctactgcattgtctggaaaaaacaacatgccacgagttcaccgacgagttaacatttagcgaagctcttggcgccgtgtctcccggcgggagaacttcgaggtcgaccagcgtcagctctcaaccagttggccctggctctttactcagttcttgctgccccaggagggccaaacgccgggccatcagactggccaattccaccgcctccgtctccagagggtcaatgcaggagcttgatatgcttgcaggcctacggcgatcacatgccccccagagccggtcgtccctgaacgcaaagccccacgattcccttgacctgaattgcgactctagggactttgtggctgccataatcagtatacccacgcctcctgccaacacaccagatgagtcccaaccctctagtccgggcggaggtggtcgggctgggtccactttgcggaactcctccctaggcaccccctgtctgtttcctgaaaccgtcaaaatcagttcactttag

SEQ ID NO: 205830 - DNA, 1062 bp, Artificial Sequence
  Description of Artificial Sequence: Synthetic coding sequence
atgggcatcttccccggcatcatcctgatcttcctgcgggtgaagtttgccaccgcggccgtaatccatcagaagtctaccacggtttcacacgagatgagtggtctgaattggaaaccgtttgtgtatggtggccttgcctcaattgtcgccgagtttggcacttttcccgtggatttgaccaaaaccaggctccaggtccagggccagagcatagacgccagattcaaagaaatcaaataccgcggcatgttccatgccctgttccggatatgcaaagaagaaggggtcctggcattgtacagtgggattgcaccagctctgctgcgccaggccagctacggcacaattaagattggcatttaccaatcgctgaagcgactgtttgtggagagactggaggacgagacgctgctgataaatatgatctgtggcgtggtatccggtgtgattagctccacgattgcaaacccgaccgacgttctgaagatccgcatgcaggcacaaggcagcctgttccagggcagcatgatcggaagtttcatcgacatttatcagcaggaaggtacccgcggcctctggcgttgcctgtgttctaaagctgtcaccgggtgtgttctatggctcatgccagtcatccccgccctgtgggaggccaacgcgggcggtagtcttgagggcgtggtgcctaccgcccagagggccgccatcgtggtcggagtcgaactgcctgtctatgatatcacgaaaaaacatttgatcctttcaggaatgatgggagatactattttgacacacttcgtaagttcatttacttgcggcttggccggggcattagcctcaaaccctgtggatgtggtacgtacccgaatgatgaaccaacgggccattgtggggcatgtggacctatataagggcactgttgatggtatcctaaaaatgtggaagcatgagggcttctttgccctgtacaaggggttttggcctaactggttgcggctgggtccttggaatatcatcttttttatcacatacgaacagctaaagaggctgcagatctag

SEQ ID NO: 205831 - DNA, 969 bp, Artificial Sequence
  Description of Artificial Sequence: Synthetic coding sequence
atgggcatcttccccggcatcatcctgatcttcctgcgggtgaagtttgccacagccgctgtgatccaccaaaagagcacaaccgtgtcacacgagatgtcgggcctcaattggaagccattcgtgtacggtggattggccagcattgtggcagaattcggcacattcccagtcgatctgactaagacaagactgcaggtccagggtcagtctatagatgcaaggttcaaggagataaaatatcgtggcatgttccacgccctgttcaggatctgtaaagaggagggcgtgcttgccctgtattcgggtatagctccggccctcctgcgccaggcaagctacggcaccatcaagatcgggatatatcagtctctaaagcggcttttcgttgagagactggaggatgagaccttgttgataaatatgatctgtggagtcgtatctggagtcatatcgagtacgatagccaatccaacggatgttcttaagattcggatgcaggcacaggggtccttgttccagggttccatgattggcagctttattgacatttaccaacaggaggggacccggggcttgtggcggggggtagtgcctactgctcaacgcgccgctatagtggtgggagtggagctgcctgtgtacgatatcaccaagaagcacctcatcctgtctgggatgatgggggacaccattctaacccacttcgtgagctccttcacttgtggcctggccggcgctcttgcctctaatcccgttgacgttgttagaacccgaatgatgaaccagagagccattgtgggtcacgtggacctatacaaagggacggtggacggcattctgaagatgtggaagcatgaggggttctttgctctttataaggggttttggccgaactggctgcggttgggcccctggaacattattttttttataacgtatgagcagctcaagaggttgcagatctag

SEQ ID NO: 205832 - DNA, 597 bp, Artificial Sequence
  Description of Artificial Sequence: Synthetic coding sequence
atgggcatcttccccggcatcatcctgatcttcctgcgggtgaagtttgctacggctgccgttattgtttcaggccaccagaagtctactacagtgagccacgagatgagcggcctaaattggaaaccatttgtgtacggaggccttgctagtatagtggcagaattcggcactttccccgtggatctcacaaaaacgaggctacaggtgcagggtcaaagtatagacgccagattcaaggagattaagtacagaggcatgttccatgcactgttccgcatctgtaaggaggaaggagttctggctctgtatagcggaattgctccagctttgttgcggcaggcttcatatggcaccatcaaaatagggatctatcagtcacttaaacgccttttcgtggagagattagaggatgagaccttgctgatcaacatgatctgcggggtagttagcggcgtgataagtagtacaatcgccaaccccacggacgtgctgaagatcaggatgcaggctcagggaagtttgttccaagggtcaatgatcggctctttcatcgacatataccaacaggaagggacccgaggcctgtggcgctag

SEQ ID NO: 205833 - DNA, 618 bp, Artificial Sequence
  Description of Artificial Sequence: Synthetic coding sequence
atgagcggcctgaactggaagcccttcgtgtacggcggcctggccagtattgtcgcggaatttggcacttttccagtagacctgactaagactcgcctccaggttcagggacagagcattgatgctaggttcaaagagattaagtacagagggatgtttcacgcactattccgaatttgcaaagaggagggcgtcctcgccttgtattccggtattgctccggcactcctgaggcaagcctcgtatgggaccattaagatcggaatataccaatcacttaaaaggctgttcgttgaaaggctagaagatgagacactcctgatcaacatgatatgcggagtggtaagtggagtgatctcatctactattgctaatcctacagatgttttgaaaatccgtatgcaggctcagggatccctgtttcaggggagtatgattgggtcttttatagacatataccagcaggaaggtacccgcgggctttggagaggcgtggtccccactgcccaaagggcggccatcgtcgtgggagtcgagctgccagtgtatgacataacaaagaaacacctcatactgagcgggatgatgggcgatacaatcctaactcatttcgtgtag

SEQ ID NO: 205834 - DNA, 723 bp, Artificial Sequence
  Description of Artificial Sequence: Synthetic coding sequence
atgggcatcttccccggcatcatcctgatcttcctgcgggtgaagttcgcgacggccgctgtcatcgtctctggtcatcagaagtctaccacagtctcccacgagatgtctggactgaactggaaacccttcgtgtacgggggtctcgcgagtattgtggccgagtttggaacttttcccgttgatctgaccaaaacaaggttgcaagttcaagggcagagtatcgatgctaggttcaaggagatcaagtacagaggaatgttccacgccctattcaggatctgcaaagaagaaggagttctggctctgtactcaggcattgcccccgctcttttgaggcaggcctcctacggtaccataaaaataggaatttaccagtcactcaagaggttgttcgtggagcgccttgaggacgagacccttctgatcaacatgatatgcggggtggtgagcggggtgatctcctcaaccattgcgaaccctaccgacgttttaaagatccgcatgcaggctcagggatctcttttccagggctccatgattggctccttcattgacatctatcagcaggagggcacccggggattgtggcgcggggtggttccaaccgcccaaagggccgctattgtggtgggtgttgagctgcccgtgtatgacattacaaaaaagcacctgatcctgtcaggtatgatgggggataccatcttgacccattttgtgtag

SEQ ID NO: 205835 - DNA, 972 bp, Artificial Sequence
  Description of Artificial Sequence: Synthetic coding sequence
atggccgacaagcagatcagcctgcccgccaagctgatcaacggcggcatcgccggactgataggtgtgacttgcgtttttcctattgatctggccaagacccgcctgcagaatcaacaaaatggtcaacgcgtctatacatcaatgagtgactgtctaatcaagaccgttcggagtgaaggctacttcggtatgtatcgtggagcagctgtgaacctaacccttgtaacccctgaaaaagccataaaactggctgctaacgacttcttccgacatcagttatctaaagatggccagaaacttacactcctgaaggaaatgctggctggctgcggggccggaacatgtcaggtaatcgtcactacacctatggagatgctgaagatacagcttcaggacgcgggcaggattgcagctcagcgaaagattttggcagcacaaggacagctctcagcgcagggcggcgcacagccaagcgttgaggctcccgcagctccacgcccaactgcaacacagctcacacgtgacttgctacgctcccgaggaatcgccggattgtacaaaggcctgggcgccacgcttctgagagatgtgcccttttctgtggtatactttccattgttcgcaaaccttaatcagcttgggaggcctgctagcgaggagaagagccctttctacgtctcattcttggcagggtgcgtcgcggggtccgctgccgccgtggccgttaacccatgcgacgtggtcaagacacgacttcagagcctgcaacggggcgtgaacgaggacacatacagcgggattctcgactgtgcccggaagattctgaggcacgagggaccatcagccttcctcaagggagcctattgcagagccctcgtgatagcacccctgtttggaatcgctcaggtggtctatttcctcggaattgctgagtctctgctggggctgctccaggacccacaggcatag

SEQ ID NO: 205836 - DNA, 333 bp, Artificial Sequence
  Description of Artificial Sequence: Synthetic coding sequence
atggccgacaagcagatcagcctgcccgccaagctgatcaacggcggtatcgctgggttgataggcgttacctgcgtattcccaattgacctggccaagacccgtctgcagaatcagcagaatggtcagagggtgtatacctccatgagcgactgtctcattaagactgtgcgctcagaggggtatttcggaatgtaccgaggagcagccgtgaatctgacacttgtgacccccgagaaggccattaagctggcagccaatgatttcttcagacaccagctgagtaaagacgggcaaaaactcactctgctcaaggagatgctcgctggctag

SEQ ID NO: 205837 - DNA, 384 bp, Artificial Sequence
  Description of Artificial Sequence: Synthetic coding sequence
atggccgacaagcagatcagcctgcccgccaagctgatcaacggcggcatcgccggcctgatcggcgtcacatgtgtcttcccaatcgacctagccaaaactcggctccagaaccagcagaacggacagcgcgtgtatacgtctatgtcagactgtttaatcaagacagttagatctgaaggctacttcggaatgtacaggggagccgctgtgaatctgactctggtcacgcccgaaaaggctatcaaattagctgcaaacgacttcttcagacatcagctatccaaggacggacagaaactcaccctcttaaaagagatgctggctggatgtggtgccggcacctgccaggtgattgtaaccactcctatggaaatgctatag

SEQ ID NO: 205838 - DNA, 360 bp, Artificial Sequence
  Description of Artificial Sequence: Synthetic coding sequence
atggccgacaagcagatcagcctgcccgccaagctgatcaacggcggaattgctggcttgataggtgtcacatgcgtatttccaattgacctggctaaaacccggctccagaaccagcagaacggacagcgtgtgtacacttccatgagtgactgcctgattaagacagtccgatcggaaggctatttcgggatgtaccggggtgccgccgttaacctgactctggtcacccctgagaaagctatcaaactagcagcgaatgattttttccgtcatcaattgtcaaaagacggacaaaaattaactctgcttaaggaaatgcttgctggatgtggcgctggaacctgtcaggtcatttag

SEQ ID NO: 205839 - DNA, 372 bp, Artificial Sequence
  Description of Artificial Sequence: Synthetic coding sequence
atggccgacaagcagatcagcctgcccgccaagctgatcaacggcgggattgccggcctgatcggagtgacatgcgtgttcccaattgacctggcaaagacacggttgcagaatcaacagaatggccagcgggtctacactagcatgagcgactgcctgatcaagaccgtgaggtctgagggctactttggaatgtaccgaggcgccgccgtaaatcttacactggtaacccctgagaaggccatcaaacttgctgcgaatgattttttccgccaccagttgtctaaagacggtcaaaagctgacactccttaaggaaatgttggccgggtgcggggccggaacctgtcaagtgattgttacaacaccctag

SEQ ID NO: 205840 - DNA, 342 bp, Artificial Sequence
  Description of Artificial Sequence: Synthetic coding sequence
atggccgacaagcagatcagcctgcccgccaagctgatcaacggcggaattgcgggcctgataggtgttacatgtgttttcccgatagacctggcaaaaactcgtttgcagaatcagcaaaacgggcagcgtgtgtatacttccatgtcagattgtctgatcaaaacagtgcggtccgaagggtattttgggatgtatcgaggtgcagcagtaaacttgaccttggtcactcctgagaaggccattaaactagcagcaaatgattttttcagacatcagttgagtaaggacggccaaaagctgacacttctgaaggagatgctcgcaggatgtggtgcttag

SEQ ID NO: 205841 - DNA, 237 bp, Artificial Sequence
  Description of Artificial Sequence: Synthetic coding sequence
atggccgacaagcagatcagcctgcccgccaagctgatcaacggcggcatcgctggcctgattggcgtaacctgtgtgtttccaatagaccttgccaaaacccggctccaaaaccagcagaatggccaaagagtgtatacctccatgagcgattgtctcattaagactgtgcgatcggaggggtattttggcatgtatagaggggccgcggtgaacttaacccttgtaactccttag

SEQ ID NO: 205842 - DNA, 180 bp, Artificial Sequence
  Description of Artificial Sequence: Synthetic coding sequence
atggccgacaagcagatcagcctgcccgccaagctgatcaacggcgggatcgccggactgattggtgtaacttgcgtgttcccaatcgatctcgcgaaaacaagactacagaatcagcagaacggtcagcgggtctatacctctatgagcgactgcttgatcaagaccgtcaggtcttag

SEQ ID NO: 205843 - DNA, 972 bp, Artificial Sequence
  Description of Artificial Sequence: Synthetic coding sequence
atggccgacaagcagatcagcctgcccgccaagctgatcaacggcggtatagcagggctcatcggtgtcacatgcgtgttcccgattgatctcgcaaaaactcggctccaaaatcagcaaaatggccagcgtgtttatacaagcatgtccgactgcctgattaagactgttaggagtgagggctacttcggtatgtataggggggccgccgtgaatctcaccctcgttacccccgagaaggccatcaagcttgcagcaaatgatttctttaggcaccagcttagcaaggacgggcagaaactcactctgctgaaagagatgctagccgggtgtggggcaggcacctgccaggtgatcgttacaacgccaatggagatgttgaagattcagctgcaggacgcgggccgcatagctgcccagcggaaaatacttgccgctcaaggccagctgtccgcgcaggggggagcacagccatcggtggaggccccagccgcacctaggccgacagctactcagctcacccgcgaccttttgcgcagccgcggtatcgccgggctgtataagggcttaggagcaaccctcctgagagacgtcccattctcggttgtgtacttcccattgtttgctaatcttaatcaactgggacgcccagcaagcgaggagaagagccccttttacgtgagttttttggccggatgtgttgccgggagtgcagctgctgttgcagtgaatccatgcgatgtagttaagacacgacttcagtcactccagaggggagttaatgaagacacctatagcggtatccttgactgcgctagaaaaattctcaggcatgagggcccatctgcctttttgaaaggcgcttattgtcgtgccctcgtaatagcgcctcttttcgggattgctcaggtggtgtacttcctagggatcgccgaatctctgctgggccttctgcaggacccccaagcctag

SEQ ID NO: 205844 - DNA, 345 bp, Artificial Sequence
  Description of Artificial Sequence: Synthetic coding sequence
atggccgacaagcagatcagcctgcccgccaagctgatcaacggcggcattgcaggtttgatcggagtgacctgtgtatttcctattgatctggctaagactagactgcaaaatcaacaaaacggtcagcgggtgtacacgtccatgtccgactgtctcatcaagaccgtacggagtgaagggtacttcggcatgtatcggggcgctgcagtcaatctaactctagtgacacctgaaaaggccattaaactagctgcgaatgatttcttccggcatcagctttccaaagacggacagaagctcaccttactcaaagaaatgttggccggatgcggagccggctag

SEQ ID NO: 205845 - DNA, 237 bp, Artificial Sequence
  Description of Artificial Sequence: Synthetic coding sequence
atggccgacaagcagatcagcctgcccgccaagctgatcaacggcggcatagctgggctcataggggtgacgtgtgtgtttcccatcgacctggccaaaacacgactgcagaaccagcagaatggacagagggtctacacctcaatgtctgattgccttattaaaacagtccgctcagaaggatactttggcatgtatcgaggcgccgctgttaatctgactttagtcaccccctag

SEQ ID NO: 205846 - DNA, 321 bp, Artificial Sequence
  Description of Artificial Sequence: Synthetic coding sequence
atggccgacaagcagatcagcctgcccgccaagctgatcaacggcgggatcgctggcctaataggtgtgacctgtgtgttccccatcgatctggccaaaactcgcctgcaaaaccaacagaacggccagagggtgtacaccagcatgagcgactgcttgattaaaacagtgaggtctgaggggtactttgggatgtacaggggggccgccgttaatctgacgctggttacaccggagaaagccattaagttggcggcgaacgatttctttaggcatcagctgtcaaaagatggacagaaactgaccttgcttaaggagtag

SEQ ID NO: 205847 - DNA, 408 bp, Artificial Sequence
  Description of Artificial Sequence: Synthetic coding sequence
atggccgacaagcagatcagcctgcccgccaagctgatcaacggcgggatagcggggctaataggcgttacttgtgtttttcccattgatctcgccaagacacggctccagaaccagcagaatgggcagcgcgtatacacatcaatgagcgactgccttataaagacggtgagatctgaaggatacttcgggatgtaccgcggcgcggctgtgaacctcaccctggtgaccccagaaaaggctattaaactggcagcaaatgactttttcagacaccaactaagtaaggatggccagaaactgaccttgctaaaggagatgttggctggctgcggggcaggcacatgtcaggtcatcgttactaccccaatggaaatgttgaagatacaactgcaggatgccggttag

SEQ ID NO: 205848 - DNA, 948 bp, Artificial Sequence
  Description of Artificial Sequence: Synthetic coding sequence
atgcaccgggagcccgccaagaagaaggccgagaagcggctgttcgatgcatctagtttcgggaaggacttgctcgccggaggggtggctgcagccgtttcgaaaaccgctgtcgcaccgatcgagcgtgtaaaacttctgcttcaggtccaggctagctctaagcagatttctcctgaagccaggtacaagggaatggtagattgcttggtaagaattccccgcgagcagggttttttttctttttggagagggaatctcgcaaacgtgattcggtacttcccaactcaagcgctgaatttcgccttcaaagacaaatataagcagctgttcatgagtggggttaataaagaaaaacagttttggagatggttccttgctaacctggcctccgggggtgctgctggtgcgacttcactgtgcgtggtctatccactggatttcgcacggacgagactcggagtggatatcgggaaaggtccggaggagcggcaatttaaaggactgggagactgcataatgaaaatagcgaagtctgacggtatcgctgggctttaccagggctttggagtctctgtccaaggcatcatcgtatacagagcctcttactttggcgcatacgacaccgttaaaggtctcctaccgaaacctaagaaaacacccttccttgtcagcttcttcatagctcaggtcgttactacgtgttctggcatactgagctacccgttcgatacagtcaggaggcgcatgatgatgcagagcggagaagctaaacggcagtataaggggaccctggactgcttcgttaagatataccaacacgagggcatctcctcgttctttcggggagcgttttcaaacgtgttacgtgggactggcggcgctctggttctcgtgctctacgataagatcaaagaattctttcacattgatattgggggtaggtag

SEQ ID NO: 205849 - DNA, 897 bp, Artificial Sequence
  Description of Artificial Sequence: Synthetic coding sequence
atgggcgaccacgcctggagcttcctgaaggacttcctggccggcggcgtagctgcagctgtttcgaaaaccgcagtcgcccccatcgaaagagtgaaacttctcctgcaggtgcagcacgccagcaagcagattagcgcggaaaagcaatataagggcatcatcgattgcgtggtaaggatccctaaagaacagggctttctctccttttggcgaggcaatctggctaacgtgattcggtacttcccaacccaggccctgaattttgcattcaaggataaatacaagcagctatttctggggggggttgacaggcacaaacagttttggaggtacttcgccggaaacctggcaagtgggggggctgctggggccacttctctttgctttgtgtatcctctcgatttcgcccggacacgtctggcagccgacgttggaaagggggccgcgcagcgggaatttcacggcctgggcgattgcatcattaagatctttaaatccgatggcctgcgaggtctctaccaggggttcaacgtatcagtgcaaggaatcatcatttatagagcggcttacttcggggtctacgatactgctaagggcatgctccccgacccgaaaaatgttcacatcttcgtgtcttggatgatcgcacagtctgtgaccgccgtggcggggttagtatcttacccattcgacaccgttagaaggcgcatgatgatgcagagcggcaggaaaggcgcagacattatgtacaccggcacagtagattgctggagaaagatcgccaaggacgagggtgctaaagcctttttcaagggcgcttggagcaacgttctgcggggtatgggaggggccttcgtgttagtgctatatgatgagatcaagaagtacgtgtag

SEQ ID NO: 205850 - DNA, 897 bp, Artificial Sequence
  Description of Artificial Sequence: Synthetic coding sequence
atgaccgacgccgccgtgagcttcgccaaggacttcctggccggcggcgtcgccgcagccatcagtaagaccgcagttgcacctattgagagagtgaagcttctcctccaggtacagcacgcttcaaaacagatcactgcagacaaacagtataaaggcatcattgattgtgtggtgcggatccccaaagagcagggggtcttatctttttggaggggaaatttagcaaatgtgattcgctacttccccactcaagcactcaactttgcatttaaggacaagtataagcagatttttctggggggtgtagataagaggacccagttctggctctacttcgccggaaacctcgcctccggaggtgcagccggcgcaacatccctttgcttcgtataccccctagacttcgccagaacccggttggccgctgatgtgggcaaggcgggagccgagagggagttccgagggttgggtgattgtctggtgaaaatttacaagtctgacggaatcaaaggtctgtaccagggcttcaacgtgtcggtgcaggggattatcatctaccgggcggcatactttgggatttacgacacagcgaagggaatgctgccagatccaaaaaacactcatatcgtaatcagctggatgatagctcagaccgtgacggctgtagcaggtctcaccagctaccccttcgataccgtgcggcgcaggatgatgatgcagtccggacgaaaagggacagatattatgtacacaggaacccttgattgttggcggaaaatcgcgcgggacgagggagggaaagctttcttcaagggagcatggtcaaatgtgctgagaggaatggggggtgcctttgtcttggttctctacgatgaaataaaaaaatacacctag

SEQ ID NO: 205851 - DNA, 897 bp, Artificial Sequence
  Description of Artificial Sequence: Synthetic coding sequence
atgaccgagcaggccatcagcttcgccaaggacttcctggccggcggcatagcggcggccatttctaagacagcagtggccccaattgagagggtgaaactgttattgcaagtccaacacgcctcaaaacagatcgcggccgacaaacagtacaaaggaattgttgactgtatagtgcggattcccaaagaacagggggtgctgagcttctggcggggcaatttggctaacgtaatccggtatttcccaacacaggcactgaattttgctttcaaggataaatataagcaaatttttttagggggggtggataagcatacccagttctggcggtatttcgccgggaatttagctagtggaggcgccgctggcgccaccagcctctgcttcgtttatcctctggacttcgcaaggacccgattggctgccgacgtcgggaagagtggcaccgaacgggagttccgtggtttaggtgattgcctggtgaaaatcaccaagtcagatgggattcgtggactctaccagggctttagtgtttccgttcagggaatcataatatatagggctgcatattttggcgtgtacgacactgctaagggtatgctgccagatccaaagaacacgcacatcgtcgtcagttggatgatcgcacagactgtgacggcggtggcaggcgtcgtgtcataccccttcgacaccgtgaggcgacgcatgatgatgcaatccggccgcaaaggcgcggatatcatgtacaccggcaccgtggattgctggcggaagatttttagagatgagggcggtaaggcattttttaaaggcgcctggagtaacgtgctgagagggatgggtggtgccttcgtcctggtactctatgacgaactaaaaaaggtgatttag

SEQ ID NO: 205852 - DNA, 477 bp, Artificial Sequence
  Description of Artificial Sequence: Synthetic coding sequence
atgaccgagcaggccatcagcttcgccaaggacttcctggccggcggaattgctgctgccatctccaagactgccgtggcacctattgagcgggtaaaacttctgctgcaggtgcagcatgcctctaagcagattgccgctgacaaacagtataaggggatagtcgactgtatagtgaggattccaaaggaacagggggtgctgtccttttggaggggcaacttagccaatgtcatcagatatttccctacccaggctcttaatttcgcatttaaggacaagtataagcagatatttctaggcggagtagacaagcatacccagttctggcgctatttcgctggaaatctggctagcggaggagccgcaggtgcgactagcctatgctttgtgtacccactggattttgccaggactcggctggccgctgatgtggggaagtctggaaccgagagggaattcagggggctaggttag

SEQ ID NO: 205853 - DNA, 2913 bp, Artificial Sequence
  Description of Artificial Sequence: Synthetic coding sequence
atgctgtgcttcctggacgacggcgccggcatggaccccagcgacgccgctagtgtaattcagttcggaaagtccgcaaaacggacacccgagtcaacacaaataggccagtatgggaacggtctgaaatctgggagtatgaggatcggcaaggatttcatcctgtttacgaagaaagaggataccatgacgtgcctcttcctgtcccggacattccacgaggaggaagggatcgatgaagtgatcgtcccgctaccgacatggaacgccaggacacgagagccagttacagacaatgtagaaaaatttgcaatcgagacagagctcatctataagtactctccgtttcgaacggaggaggaggtgatgacccagttcatgaagattccgggcgattcgggaaccctggttataatcttcaatcttaagctcatggacaacggtgagcctgagttggacatcatctctaatcctcgagatattcagatggccgagacctcacctgaagggaccaaaccagagagacgctcttttcgagcctacgctgcagttttatacatagaccccaggatgagaatattcatccatgggcacaaagttcaaactaagaggcttagctgttgtctctacaagccccggatgtacaaatatacctcctcacgctttaaaaccagagctgagcaagaagtgaagaaagccgagcatgtcgctaggatcgcagaagagaaggcgagggaggccgagtctaaggcacgcactctcgaagtgcgacttgggggcgatctcacacgagacagcagggttatgcttaggcaggtgcagaacagagctatcactctgcgacgtgaggctgacgttaagaagagaataaaagaagcaaagcagcgtgcattgaaagagcccaaagagctaaactttgtcttcggagtaaacatcgagcacagggaccttgacggaatgtttatatataactgttcccggctcattaaaatgtacgaaaaagtgggaccccagcttgaggggggcatggcctgtgggggcgtcgtgggggtcgtggatgtgccgtaccttgtgttggaaccgacacacaataaacaggatttcgccgatgcaaaggagtataggcatctgctgcgagccatgggggagcatctcgcgcaatattggaaagatatagccatcgcgcagcgaggcattataaagttttgggatgagtttggatatctgtctgcgaattggaatcagccgccttccagcgagttacgttacaagcgccgccgggccatggaaatcccgaccaccatacaatgcgacttgtgtttaaaatggcggacattacccttccagctctcctctgttgagaaggactacccagacacttgggtttgttccatgaatccagatcctgaacaggaccgatgcgaggctagtgaacagaagcagaaggttccacttggcacgtttaggaaagacatgaagactcaggaggagaagcaaaagcagttaaccgagaagatcagacagcagcaggaaaaacttgaagctctgcagaagacaacaccgattcgatcacaagctgatctgaagaagctgcctctggaagtgactacacggccgagtactgaggagcccgtacgtcgcccccaaaggcctcggagtcctcccctgcccgcggtgatacgaaacgcaccctctaggccgcccagcctccctactccgcggccggctagccagccccgcaaggcaccagtcatttcctctacccctaaactccccgcactcgctgcgcgagaagaggcgagtacaagtcgtctactgcagccaccagaggctccgcgaaagcctgcgaacacacttgtaaagactgcctcccgacccgcccctctcgtgcagcagttgtcgcctagtctgctgcccaacagtaaaagcccacgcgaggtaccttctccaaaggttattaagactccagttgtgaagaagacggagtctccaataaaattgtcccctgctacaccatcgaggaagagatccgtggcagttagtgacgaggaagaagtggaggaagaggctgagcgtcgcaaggaaagatgtaaacgaggtagatttgtcgtaaaggaggagaaaaaggactctaacgagttgtccgactctgcaggagaggaagacagtgcggatctaaaacgggcgcaaaaggataaggggctgcatgtcgaggtgagggtcaaccgagagtggtacaccgggcgcgtgaccgctgtggaggtgggaaaacacgtggtcagatggaaggttaaattcgactacgtaccaaccgacaccacccctcgcgatcgctgggtggagaagggctctgaagatgtacgcctgatgaaaccaccatcaccagagcatcagtcactggacacacaacaggagggaggagaagaagaggtgggtcctgtagcacaacaggcgattgcagtggcggaaccatcgacctccgaatgtttacggattgaacccgatactaccgccctatccaccaatcatgaaacaatcgaccttctggtgcagatcctgcggaattgtctgaggtactttctacccccttcctttcctattagcaagaaacaattaagtgccatgaattcggacgaattaatctcttttcccttaaaggaatacttcaaacaatatgaggtgggcctgcagaacctgtgcaacagctaccaatctcgagccgactcccgggctaaagcttccgaggaaagtctccgaacatctgaaaggaaactgagggaaacagaggagaaacttcaaaagctgaggaccaatattgtggccctgctgcagaaagtccaggaagacatcgatattaacaccgacgatgagctcgatgcttacatcgaagatctcattacaaagggggactag

SEQ ID NO: 205854 - DNA, 627 bp, Artificial Sequence
  Description of Artificial Sequence: Synthetic coding sequence
atgttcgagttcctgagcaaccacatgcgggacgcccagggccggctcgatagtacccgaggcctgctttgtggcttaggggcgggcgtggccgaggctgtggtggttgtgtgcccaatggagacaattaaagtcaagttcatccatgaccagacgagtccaaatcccaagtaccggggcttctttcacggcgtccgcgagatcgtaagagagcagggtctgaaaggcacctatcagggcttgacagcaaccgtgctcaaacagggctccaaccaggctataaggttcttcgtcatgacatcattaaggaattggtatcgcggcgacaatccaaacaaaccaatgaacccactgattaccggagtgttcggggctatcgcaggcgctgcatctgtgtttgggaatacaccattagacgtaatcaagacacggatgcaggggctcgaggctcataaatacaggaatacctgggactgcggtctgcagatcttgaagaaagagggcctcaaggcattttacaaggggaccgtgcctcgcctgggccgagtgtgcctcgacgtggcaatagtatttgtgatatacgacgaggtggttaagttgctgaacaaagtttggaaaacagactag

SEQ ID NO: 205855 - DNA, 999 bp, Artificial Sequence
  Description of Artificial Sequence: Synthetic coding sequence
atggccgccgccaccgccgccgccgccctggccgccgccgaccccccccccgcaatgccccaggctgcaggagccggcggtcccaccactaggagggatttctactggctcagaagctttttggctggtggcattgcaggatgctgcgccaagaccaccgtggccccacttgaccgtgttaaggtgctgttgcaggcccacaatcaccactataaacacttgggggtcttttcagcattgcgtgccgttccacagaaggagggtttcttaggtctgtataagggaaatggcgcgatgatgatcagaatcttcccttatggggccatacagttcatggcctttgaacactacaagaccctgatcactactaagctgggaataagcggacatgttcaccgcctgatggccggatctatggccggtatgaccgcagtgatttgcacatatcctctcgatatggtgcgggtccggcttgctttccaggtaaaaggggaacactcctatacaggcatcatccacgcctttaaaaccatctacgccaaagaggggggtttctttggattttatcggggcctcatgcctactattcttggaatggcaccatatgccggtgtctcctttttcactttcggtaccttaaagtcagtaggattgagccacgcaccaacactcctggggcgaccatcaagtgataaccccaatgtcctggtgttaaagacacatgtaaatctgctgtgtgggggagtcgctggcgccatagcgcagactatatcctacccttttgacgtcacacggcgacgaatgcagctgggcacagtgctgcccgaattcgagaagtgccttaccatgagggacacgatgaaatatgtgtacggacaccacggtataaggaagggactttatcgggggcttagcctgaactacatcagatgtattccgtctcaggctgtggctttcactacatatgaactaatgaagcagtttttccaccttaattag

SEQ ID NO: 205856 - DNA, 705 bp, Artificial Sequence
  Description of Artificial Sequence: Synthetic coding sequence
atgatgatccggatcttcccctacggcgccatccagttcatggcctttgagcactacaagaccctaatcacgacgaaattaggaatttcagggcacgttcacaggctgatggcgggatcgatggctggcatgacagcagtcatttgcacgtatccactggacatggttcgggtccgtctggcgttccaggtcaaaggagagcactcgtacaccgggattattcacgccttcaaaacaatttacgcaaaagaggggggattttttggattttatcggggtctcatgcctaccatcctcggaatggctccctatgcaggggtgagctttttcacttttggaactctcaaaagtgtaggcttgtctcatgctcctactcttttggggcgtcccagttctgacaatccgaatgtacttgtgctgaagacccatgtaaatctgttgtgcggaggtgtagctggcgccatcgcacagaccatatcctacccctttgatgtgacgagacgacggatgcaacttggcacagtcctgccagagttcgagaagtgtctgacaatgagggacaccatgaagtacgtgtacggacatcacggaattcggaaggggctgtaccgaggcctctccctaaattacataagatgcataccaagtcaggcagtagctttcactacctatgaacttatgaagcagttctttcacctaaactag

SEQ ID NO: 205857 - DNA, 906 bp, Artificial Sequence
  Description of Artificial Sequence: Synthetic coding sequence
atgaagagcaaccccgccatccaggccgccatcgacctgaccgccggggccgctggcggcaccgcctgcgtgttaactgggcagccttttgacacgatgaaggtaaagatgcagacttttccggatctgtaccgcggtttgacagactgttgcttgaaaacatactcccaagttggctttagaggtttctacaagggcaccagtcccgccctgattgctaacatcgccgagaattccgtgctgtttatgtgctacggcttctgccagcaggttgttaggaaagtggccgggttggataagcaagctaagttgagcgatcttcagaatgcagccgccggatcattcgcttccgcctttgccgcactggtgctctgccccacagaactggttaaatgtaggcttcagaccatgtatgagatggagacaagcggaaagatcgctaaatcccagaatacagtctggagcgtgatcaaatctatactacggaaggacggtccattgggcttctatcatggcctctcttcgaccctactccgggaggtgcccggatacttttttttttttggaggctatgagttgtcaaggagtttcttcgccagtggacgctcaaaagatgagctgggtccggttcctctgatgctttctggtggggtcggagggatatgtctgtggttagctgtatacccagtggattgcatcaagtcccggatacaggtacttagcatgtctgggaagcaagcgggattcatccgtacctttatcaatgtagtgaagaacgagggcatcacagcactgtacagcggtctgaagccaaccatgattcgagcgttccccgccaacggtgccctgttcctggcttatgaatatagtcgaaaacttatgatgaaccagctggaagcctactag

SEQ ID NO: 205858 - DNA, 402 bp, Artificial Sequence
  Description of Artificial Sequence: Synthetic coding sequence
atgaagagcaaccccgccatccaggccgccatcgacctgaccgccggcgcagccggagggaccgcctgtgtgttaacgggtcaaccattcgatactatgaaagtaaagatgcagacctttcctgacctctatcgcggactgaccgattgctgtctcaaaacgtacagccaagtgggcttcagaggattttataaggggacatctccagccttgatcgcaaatatagctgagaattctgtgcttttcatgtgttacggattttgccagcaagttgttaggaaggtggcggggctggataagcaggcaaagctctcaacagtttggagcgttatcaagagcatactccgcaaagacggccctcttggcttttaccacggattgtcctccacccttctgcggtag

SEQ ID NO: 205859 - DNA, 402 bp, Artificial Sequence
  Description of Artificial Sequence: Synthetic coding sequence
atgaagagcaaccccgccatccaggccgccatcgacctgaccgccggggcggcaggcggcactgcgtgtgtcttaactgggcagccatttgacaccatgaaagtcaagatgcagacttttcctgatttgtatagaggcttgactgactgctgccttaagacttactcccaggtggggtttcggggcttctataaggggacatctcccgctttaattgcgaatattgcagagaactctgtgctgtttatgtgttacggattctgtcaacaggtagtacggaaggttgctggcctggataaacaggcaaaactgtcaaccgtctggagtgtaattaaatcgattctgcgaaaagacggccctcttggattttaccacggcttatcgagtaccctcctccgatag

SEQ ID NO: 205860 - DNA, 906 bp, Artificial Sequence
  Description of Artificial Sequence: Synthetic coding sequence
atgaagagcaaccccgccatccaggccgccatcgacctgaccgccggtgcggcgggcggtaccgcctgtgtgctgacaggccaaccattcgacacaatgaaggtgaagatgcaaacattccccgacctctaccgcgggcttactgattgctgtcttaagacctacagtcaagtaggctttcgcggcttttacaagggcacatctccagccctgattgctaatatcgccgaaaacagtgtgctgttcatgtgttatggcttctgccagcaggtagtacgcaaagtcgcaggactggacaaacaggccaaactcagcgacctccagaacgccgcagcgggctcctttgcgtccgcattcgccgcgctggtgctttgccctactgagctggtgaagtgtcgtctacaaacgatgtacgaaatggagaccagcgggaagattgccaagtcccagaacaccgtctggtctgtgatcaagtctatcctgcgcaaagatggccccctagggttctaccatgggctttccagtactctgctacgtgaagtgccagggtactttttcttctttggtggctatgaactgagcagaagcttcttcgcctccggaagatccaaagatgaattagggccagtgcccctcatgctgtccggcggcgttggtggaatctgtctgtggctggctgtgtacccagtagattgcattaaaagcaggattcaggtactgtccatgtctgggaagcaggcaggcttcattagaactttcattaacgtcgttaaaaatgagggaattactgctttgtactctggtctaaaacctacaatgattcgcgccttccccgcaaatggagctctcttcctggcatacgagtatagtaggaaattgatgatgaaccagctggaggcttactag

SEQ ID NO: 205861 - DNA, 726 bp, Artificial Sequence
  Description of Artificial Sequence: Synthetic coding sequence
atgaagagcaaccccgccatccaggccgccatcgacctgaccgccggagccgctggcggaaccgcttgcgtactcactggacagcctttcgacacaatgaaagtggccggcctggataagcaagccaagttatccgatttacagaacgccgccgccggctcttttgcgagcgcttttgccgccctggtcttatgtcctaccgaactggttaagtgcaggctgcagaccatgtacgaaatggagaccagtggcaagatcgcaaagagtcagaacaccgtgtggagcgtgataaaaagcattctgcgtaaggacggaccactcgggttctaccatggtttatcttctacactactcagagaggttccaggctactttttttttttcggtggttacgagctttccagaagcttttttgccagcggaagaagcaaggatgaacttggccccgttcctcttatgttgagcggcggcgtgggcggtatatgcttatggctggcagtatacccagtagactgcattaagagccgcattcaagtcctgtcaatgagcggcaaacaggctgggtttattaggactttcattaatgttgttaagaacgagggcatcacggccctgtatagcggcttgaagccaacgatgatccgcgcctttcctgccaatggagccctgttcctggcctacgagtatagtcgaaagttgatgatgaatcaactcgaagcttattag

SEQ ID NO: 205862 - DNA, 906 bp, Artificial Sequence
  Description of Artificial Sequence: Synthetic coding sequence
atgaagagcggccccggcatccaggccgccatcgacctgaccgccggagcggcgggtggtaccgcctgtgtcttaacaggccaaccatttgacactatcaaagtgaagatgcaaaccttcccggatctgtacaagggactgacagattgttttctgaagacctacgcgcaggtggggctaagaggcttttataaaggcaccgggccagctctgatggcctacgtggctgaaaactctgtgctattcatgtgttacggtttctgtcagcagtttgtacgcaaggttgccgggatggacaagcaagccaagttatctgatttgcagaccgccgcagccggcagttttgcttccgcttttgccgcgctggcgctgtgccccacagagctcgtaaaatgtcgtctacagacaatgtacgagatggagatgtcaggaaagattgctaagtcccacaacaccatttggtctgtggtgaaaggaattctgaaaaaggatggccctttgggattttaccacggactgtcatccaccctcttacaggaagtacccgggtacttcttctttttcggaggatacgaactctcccggagctttttcgcttcaggaagatctaaagacgagctgggccctgtgcatctcatgttatccggcggcgtggctgggatctgtctgtggctggtcgttttcccggtggactgcattaagtccaggattcaagtgttgagcatgtatggaaagcaggcaggcttcattgggactcttttgtccgtcgtaagaaacgaggggatcgtagctctgtactctggtctaaaagccaccatgattagggcgatccccgctaacggtgcacttttcgtggcatatgaatacagccggaagatgatgatgaaacagctggaagcttattag

SEQ ID NO: 205863 - DNA, 423 bp, Artificial Sequence
  Description of Artificial Sequence: Synthetic coding sequence
atggccggctggaacgcctacatcgacaacctgatggccgacggcacgtgtcaggatgctgctattgtggggtataaggactcaccatcagtttgggctgctgtcccagggaaaacattcgttaatattacccctgctgaagtgggggtgctggtaggtaaggatcggtcttcattttacgtgaatggcctaacactgggcgggcagaaatgctcagtgatccgcgactcgctcctgcaggacggggagtttagtatggacctgcgtacaaaatccacagggggcgccccaacctttaatgtaactgtcaccaaaacagacaagactctggtactgctgatgggaaaggagggtgttcatggcggcctaatcaataaaaagtgctacgaaatggcaagtcatctgcgcaggagccaatattag

SEQ ID NO: 205864 - DNA, 792 bp, Artificial Sequence
  Description of Artificial Sequence: Synthetic coding sequence
atggccgccaccgccagcgccggcgccggcggcatcgacggcaagccaaggacttctcctaagagcgtgaagtttctattcggcgggctggccggactgtcagctgggctgctgagacaagccacatacacgacgactaggttagggatctacaccgttctgttcgagaggttaactggagcagatggaacaccccccggttttctgctcaaggcagtgatagggatgacagccggcgctacaggggcctttgtaggaactcctgcagaggtcgccctgataagaatgaccgccgatggccggctacccgctgatcagaggaggggctacaaaaatgtgttcaacgctctgataaggataactcgcgaagagggggtcctgactctatggagggggtgcatccccacaatggctcgcgccgtggttgtaaacgctgcccaactggcaagctatagccaatccaagcagtttttgcttgattcgggttactttagcgataacattctctgtcacttctgcgcttctatgatctcgggtctggtgactaccgcggcatctatgcccgtggatattgctaagactcggattcagaacatgcggatgattgatggaaagcctgaatacaaaaacggcctggatgttctatttaaggtggtccggtatgaaggttttttttccctctggaaagggttcacgccttactacgcccggttagggccccatacggtgttaactttcatttttttagagcaaatgaataaggcctataaacggctgtttctgtcaggctag

SEQ ID NO: 205865 - DNA, 678 bp, Artificial Sequence
  Description of Artificial Sequence: Synthetic coding sequence
atggagtactggtacgtggccctgaagcagcagagcctgaaggccgacatcctgccttccttgtttctgtccatattcctcgttaagggggtggtcaacgtacttttaaccacacctctttgggtcgtgaatacacgtctcaagctgcagggagccaaattcaggaacgaggacatcgttcccaccaactacaaggggatcatcgacgctttccaccagatcatacgcgacgagggcatttcagctctgtggaatggcacttttccttcactgctgctggtttttaaccctgctattcagttcatgttctacgaaggccttaagagacagctccttaaaaaacgcatgaaactgagctcattagacgtgttcatcatcggcgctgtcgccaaagctatagctacaacagtgacataccctttgcagacagtccagtccattctgcggtttggcaggcacagactgaatccagagaatcgaacacttggatctctgcggaatatattgtacttactacaccagcgcgtccgtagattcggcattatggggttgtataaaggcctggaggctaagctcctccagaccgtcctgactgctgccttaatgtttctggtctacgagaaactgactgcagctaccttcaccgttatgggtctgaagcgagcccaccagcactag

SEQ ID NO: 205866 - DNA, 279 bp, Artificial Sequence
  Description of Artificial Sequence: Synthetic coding sequence
atgggcagcgtgaccgccatgaccgtgttcttccccctggacaccgccagactcaggctccaggtggacgagaaacgcaaaagcaagacaacccatatggtgctgctcgagattatcaaagaggaaggcctgctggccccctatcgggggtggttcccggtaatttcctcactgtgctgctccaacttcgtttatttttatactttcaacagtttaaaggcactgtgggtgaagggccagcacagcaccaccgggaaagacctcgtcgtgggcttctag

SEQ ID NO: 205867 - DNA, 924 bp, Artificial Sequence
  Description of Artificial Sequence: Synthetic coding sequence
atggccagcgtgctgagctacgagagcctggtgcacgccgtggccggcgcggtggggtctgtgaccgcaatgaccgtgttttttcctctggataccgcccgactccgactgcaggtcgatgagaaacgcaagtccaaaacaacacatatggtcctgctcgaaatcatcaaagaagagggccttcttgccccatacagaggttggttccctgtcattagtagtctttgctgcagtaacttcgtgtatttctatacattcaatagcctaaaggcattatgggttaagggtcagcacagcactacaggcaaagacctggttgtcggctttgtggccggcgtcgtaaacgtactgctcacaactccgctgtgggtggtgaacacaaggctcaagctccagggagccaagttcaggaacgaggacatcgttccgaccaactataagggtattatcgatgcctttcaccagatcatccgtgatgaaggtatctctgccttgtggaacgggacattcccatcactattgcttgtcttcaaccccgccatacagttcatgttttatgaaggcctgaagcgccagctgttgaagaagcgcatgaaactttcctccttggacgtgttcattatcggtgcagtggccaaggcaatagccacgacagttacatacccactgcagaccgtccagtcaatccttcgattcggaagacaccgtttgaatcctgagaatcgcacacttggaagcctgcggaatatactgtacctgctgcaccaacgggtcagaaggttcggaatcatgggcctatacaagggtcttgaggctaaactgttgcagacagtgctgactgcagcactgatgttcctagtgtatgaaaagctgactgccgcgacttttaccgtgatggggctgaaaagagcccaccaacattag

SEQ ID NO: 205868 - DNA, 705 bp, Artificial Sequence
  Description of Artificial Sequence: Synthetic coding sequence
atggccagcgtgctgagctacgagagcctggtgcacgccgtggccggtgctgtgggttctgttactgctatgacagtcttttttcctctcgatacagctagacttcgattgcagggagtggtcaatgtgctgctgactacacccctgtgggtggttaatactcgcctcaaactccagggagccaagtttaggaatgaagatatagttcctactaattataagggaattatcgatgcgttccaccagataataagggatgaaggcattagcgcactgtggaacggaacgttcccgtcactcttactcgttttcaaccccgcaatccaatttatgttctacgagggactgaagaggcaactcttaaagaagcggatgaaattaagtagcttggatgtgtttattataggagctgttgcaaaggcgattgcaacaacagttacttatccactgcagactgtgcagtcgattctccgcttcggtcgccacaggttgaaccctgaaaataggactcttgggtctctgcgtaatatcttatacctcttgcaccaacgcgttcgacggttcggaattatgggcctttacaaggggttagaagcgaagctacttcagaccgtgctgacagctgcgctgatgttcctagtctacgagaaactaaccgccgctaccttcactgtaatgggcttgaagcgcgcacaccagcactag

SEQ ID NO: 205869 - DNA, 813 bp, Artificial Sequence
  Description of Artificial Sequence: Synthetic coding sequence
atgatcgacgagaagcggaagagcaagaccacccacatggtgctgttagaaataattaaggaagaaggactgctcgctccctaccggggctggttccctgtcattagttccttgtgctgctccaattttgtgtacttttataccttcaactccttgaaagccttgtgggtgaaagggcagcacagcacaaccggaaaggacttagtggtcggctttgtggctggcgttgtcaacgtgctgctgacaactccactctgggtcgtcaacacccggctgaagctgcagggagcaaagtttcgcaatgaggacattgtgcctactaactacaaagggataatcgacgccttccatcaaatcatccgggacgagggtatctctgctctgtggaacgggaccttccccagtctactcctagtttttaacccggcaatccagtttatgttttatgagggcctaaaacgtcagctccttaagaaacgaatgaagctgtccagtcttgacgtgtttataattggagccgtggcaaaagcgatcgcaacaacagtgacctaccctcttcagacagtccaaagcatcctgcgatttggaaggcataggttaaatcctgagaatcgcactctgggtagtcttcggaatatcctctacctccttcaccaaagggtccgacgattcggcataatgggcctctataaaggactggaagcaaaacttctacagaccgtcctgacagccgcgctgatgttcctcgtgtatgagaagttaacggccgccacttttacggtcatgggactgaagagagctcaccagcactag

SEQ ID NO: 205870 - DNA, 1086 bp, Artificial Sequence
  Description of Artificial Sequence: Synthetic coding sequence
atgttcagcagcgtggcccacctggcccgggccaaccccttcaacacgccgcacttgcaattagtccacgacggcctgggggacctccgatctagctcacccggacctacaggccagccgagacgaccacgcaatctggccgctgctgccgtggaggagtatagctgcgagtttgggagcgccaaatactatgccttatgcggcttcggcggcgtattgtcatgcggcttaacacacaccgcagtggtcccattggaccttgtaaagtgccggatgcaggtcgacccacagaaatacaaaggcatttttaacggcttttccgttaccctgaaggaagacggagtgagaggattggccaagggatgggccccaacttttctgggatattcgatgcaggggctctgcaaatttggcttttatgaggtcttcaaggtgctgtacagcaatatgcttggggaggagaatacatacctatggcggacaagtctttacctcgctgcaagcgcctctgctgaattctttgccgacatagcactcgctccgatggaggcagcaaaggttagaatccaaacccagcccgggtacgctaatactttgcgggatgccgccccgaagatgtataaagaagagggactgaaggcattttataagggggttgctcccctgtggatgcggcaaatcccttataccatgatgaaattcgcttgctttgaacggaccgtggaggcgttgtacaagtttgtggtaccaaagccaagaagcgaatgcagtaagccggagcagctggtggtgaccttcgttgctggctatattgccggcgtgttctgcgccatcgtgtcccatccagctgactccgttgtctctgtgctcaataaggagaaagggtccagtgcctccctcgtcttaaagcgcctgggattcaagggggtgtggaagggactgtttgcccggatcatcatgattggcacactgacagctttacaatggttcatttacgatagcgtgaaggtgtactttagactgccaagaccccctcccccagaaatgcctgaatctctgaagaaaaagctggggcttacccagtag

SEQ ID NO: 205871 - DNA, 1776 bp, Artificial Sequence
  Description of Artificial Sequence: Synthetic coding sequence
atggacgacctggacgccctgctggccgacctggagagcaccaccagccatatctctaagcggcccgtatttcttagcgaggagaccccatactcttaccccactggcaatcatacctaccaggaaatcgcagtgcctcctccagtccctccacctccttccagcgaagccctcaatggcactatcctcgatcctcttgatcaatggcagccatcatcatcccgctttatccaccagcaacctcaatcctctagcccagtctatggtagctccgctaagacatcaagcgtatccaacccacaggattctgtgggctccccctgctccagagtaggggaggaggaacacgtatatagtttcccaaacaaacagaagtcagcggaaccctcacctacagttatgagtacttccctaggttctaaccttagcgaattagaccgactgttactcgaactgaatgccgttcagcataaccctcctggctttcctgcagacgaggctaatagcagccccccactgccaggagctctgagccccctgtatggcgtaccggagacgaacagccccctcggagggaaggccggaccactcaccaaagaaaagcctaagcgcaacgggggtagaggcttggaggacgtgcggcccagtgtcgagagccttctggacgaactggaaagcagtgtgcctagccctgtgcctgctattaccgtgaaccagggtgagatgtcaagtccccagcgggtcacgagcactcagcaacagactagaatatccgcttcctccgcgactagagagttggatgagctcatggccagtctttccgactttaagattcagggactggagcagagagccgatggggagcgctgctgggccgctggttggccgcgggatggagggagaagctcccctggaggccaggatgaagggggcttcatggcccagggaaagaccgggtcctcctcacctcccgggggaccaccgaagccaggctctcagctggacagcatgctcggctctttacaatctgatctcaataaactgggcgtcgctacagtcgccaagggtgtatgcggcgcgtgcaagaagcctatcgcgggtcaggtagtaactgctatgggcaaaacctggcatccagagcacttcgtctgtactcactgccaggaagaaattgggtcacgaaattttttcgagagggatggtcagccatactgcgaaaaggactatcacaatctgtttagtcccagatgctactattgtaatggcccaatcttggataaggtggtgacggctttagacaggacctggcatcctgagcactttttctgcgcacaatgcggcgcttttttcgggcctgagggcttccatgagaaagatggcaaggcttactgtaggaaagattactttgatatgttcgctcccaagtgtggaggctgcgcacgcgctatcctggaaaactatatttcagctctcaatacactttggcatccagagtgctttgtttgtcgcgaatgctttacaccgttcgtcaacggatccttttttgagcacgacggtcagccctactgtgaagtgcactaccatgaaagacgtggctccttgtgtagtggatgccagaagccaatcaccggccgttgtataacagccatggccaagaagtttcatccagagcactttgtatgcgccttttgtttgaaacagcttaataagggaacttttaaagagcagaacgataagccttactgccaaaactgcttcctgaagctgttctgctag

SEQ ID NO: 205872 - DNA, 1086 bp, Artificial Sequence
  Description of Artificial Sequence: Synthetic coding sequence
atgttcagcagcgtggcccacctggcccgggccaaccccttcaacaccccacatttacagctggtgcatgacggtctcggagacctacgcagttccagtcccggtcctactgggcagccccggcgacctaggaacctcgctgccgcagccgtggaagagtacagttgcgaatttggcagcgctaagtactacgccttgtgtggatttggaggtgtactatcttgcgggctgacacataccgccgtagtcccactggatcttgttaaatgcaggatgcaggtcgaccctcagaagtataagggtatcttcaacggcttctcggtaacactgaaggaagatggagtgcgtgggttggccaaggggtgggccccgacctttctggggtactccatgcaggggctatgcaagttcggcttttatgaagtcttcaaggtgctgtatagtaatatgcttggcgaagagaacacctatttgtggcggactagtctgtatttagcagcttcagcctctgccgagttttttgcagacatcgctctggcaccaatggaagctgccaaagtgagaattcagacccagcctggctatgctaatacactgagagacgccgctcccaagatgtacaaagaggaaggattaaaggctttttataagggagtcgcacccctgtggatgaggcagattccttacacaatgatgaagttcgcctgcttcgagagaactgtggaggctctttacaagttcgtggtgcccaagcccaggagcgagtgttccaaaccagaacaactggtcgtgacattcgtcgctggatacatcgcgggcgtattctgtgccatcgtgtcccaccctgccgattccgtcgtctccgtactcaataaggagaagggcagcagcgcttcactggttctgaaaaggctggggtttaaaggggtttggaaaggcctcttcgcaagaatcatcatgatcgggactttgactgcgctacagtggttcatttatgactcagtgaaagtttattttcggttgcccagaccgccacctcccgagatgcccgagagtttaaagaagaagctgggcttaacccaatag

SEQ ID NO: 205873 - DNA, 1086 bp, Artificial Sequence
  Description of Artificial Sequence: Synthetic coding sequence
atgttcagcagcgtggcccacctggcccgggccaaccccttcaacactcctcacttacagttagtgcacgatgggctgggagacctcagaagcagcagtccaggccctaccgggcagcccagaaggcctcgcaacctcgcagcagctgcagtcgaagagtactcttgtgagttcgggtccgcgaaatattacgctctttgcgggttcggcggagtactgtcttgcgggctcacacatacagcagtggtccctctggatctggtgaaatgtaggatgcaggtggaccctcagaaatataaggggatcttcaatggattctcagtcacactgaaggaggatggggtgagaggattggccaaggggtgggcaccaaccttcttgggttatagcatgcaggggctttgcaaatttggcttctacgaagtgttcaaggtcctctactccaacatgctgggagaagagaacacttacctgtggcgcacctcattgtatctggccgcaagcgctagcgcagaatttttcgctgatatcgcattggcccccatggaggcggccaaagttcgaatccagacccaacccgggtacgcaaacactctacgggatgcagcacccaagatgtataaggaggaaggactaaaggccttttacaagggagtcgcccccctgtggatgaggcaaattccctacacaatgatgaagtttgcatgttttgagaggaccgtggaggcgctatacaagttcgtggttccaaaacctcgatctgaatgtagtaagccggagcagctggttgtgacgttcgtagctggatacatagcgggggtgttctgtgcgatagttagccacccggccgactctgtcgtatctgtgttgaacaaagagaaggggagctcagcgtccctggtgctgaagcgactaggatttaagggagtgtggaaaggcctttttgccagaatcattatgataggcaccctcactgctttgcagtggttcatttacgactctgtcaaggtgtacttccggttgcctaggccccctcctcccgagatgccagagtccctgaagaagaagctaggcctcacacagtag

SEQ ID NO: 205874 - DNA, 1089 bp, Artificial Sequence
  Description of Artificial Sequence: Synthetic coding sequence
atgttcagcagcgtggcccacctggcccgggccaaccccttcaacaccccccacctccagctggtacacgacggattaggcgacctgagaagctcctcgcccgggcctaccggacagcccaggaggcctagaaacctggccgccgctgcagtggaagaacagtactcctgcgattacggctctgggcggttctttatcctctgtggactgggcggaatcatctcatgcggaacaacacatacagcactggtgcccctggacttggtcaagtgccgcatgcaggtggatccacagaaatacaaaggtatctttaatggtttttctgtgaccctgaaggaagacggggtacgaggactggccaagggctgggccccgaccttcctgggctactcaatgcaaggcctttgcaaatttggattctacgaagtgtttaaggtgctttatagtaatatgctcggggaggaaaatacttacctatggcgcactagcctgtatctggccgcgtcagcttctgccgaattttttgccgatattgctctggccccgatggaggccgctaaggtcaggatccagacacagcccggttacgcgaatacacttcgagatgcggccccaaagatgtataaagaggagggactgaaggccttctataaaggggtggctcccctgtggatgcgacaaataccctatactatgatgaagttcgcgtgcttcgagagaactgtcgaggcattgtacaagttcgtggtgccaaagcctagaagcgagtgtagcaagcccgagcagctcgtggtaacgtttgttgctggctacatcgcaggcgttttctgcgcaatagtgagtcacccggccgacagcgtggtttccgtccttaataaggagaagggttcatctgctagcctggttttaaagaggctggggttcaagggggtgtggaagggcctattcgccagaatcatcatgattggcaccctcacggcactgcagtggttcatctacgattcagttaaggtgtactttcgtctcccgagaccacctccacctgaaatgccggaatccctaaaaaaaaaactgggcctcacgcagtag

SEQ ID NO: 205875 - DNA, 1086 bp, Artificial Sequence
  Description of Artificial Sequence: Synthetic coding sequence
atgttcagcagcgtggcccacctggcccgggccaaccccttcaacacaccccatttgcaactcgtgcacgatggcctcggcgacttgcggtcaagttcccctggcccaactggccagccacgccggcctaggaacctggccgccgcagcagtggaagaatactcatgcgaattcgggtccgccaaatattatgccctgtgcggtttcggtggagtgctttcatgcgggctgacacacacggccgtcgtgccgttggacctcgtgaaatgtcgcatgcaggttgacccccagaagtataaaggtattttcaatggtttctctgttacactgaaggaggacggcgtccgtgggctcgcgaagggttgggctcctacttttctagggtattccatgcagggtttatgcaaattcggattctatgaggtgtttaaagtgctgtattccaatatgttgggagaggaaaacacctatctgtggcgtacctccctctacctggccgccagtgctagtgcagaattcttcgcggacatcgctctcgccccaatggaagccgccaaagtgagaatccaaactcagccaggctacgcaaacacacttcgcgacgcggccccaaagatgtacaaggaggagggcctgaaagctttttataagggcgtggctccgctgtggatgcgacaaattccgtacaccatgatgaaatttgcttgcttcgaacggacggtggaggcattgtacaaattcgttgtgcctaaaccacggtctgagtgctccaaaccagagcagctggtggtcacattcgttgccggctatattgcgggagttttctgtgctatcgtgagccatccagcggactctgtggtctctgtgctgaataaagaaaagggcagctcggcctccctggttctgaaacggctcgggttcaaaggcgtttggaagggtctgttcgctcggatcataatgattggaacactaacagccctgcagtggtttatttacgactcagtcaaggtgtacttccgattgccccgaccacccccacccgagatgccagaaagcctgaaaaagaagctagggctgacccagtag

SEQ ID NO: 205876 - DNA, 897 bp, Artificial Sequence
  Description of Artificial Sequence: Synthetic coding sequence
atgagcgccaagcccgaggtgagcctggtgcgggaggccagccggcagattgttgctggcgggagcgcagggctagtggaaatttgccttatgcaccccttagacgtcgtgaagaccagattccaaatccagcggtgtgctacagaccccaattcttacaagagcctggtagactccttccgaatgatcttccagatggagggtctgttcgggttctacaagggcatcctgcctcctattctcgccgagactccgaaacgagcagtgaagtttttcacttttgagcagtacaagaaattattggggtacgtgtctctatcccccgccctgacttttgctattgccggcctggggtctgggctgacagaggcaatagttgtgaatccgtttgaggtggttaaagtcgggttgcaggcgaatcggaacacctttgctgagcagccttcaacagtgggctacgctcggcagataatcaaaaaggagggctgggggctccaggggctgaataaggggcttaccgctactctgggcaggcacggcgtgtttaatatggtgtatttcgggttctattataacgtaaagaatatgattcctgtcaacaaagacccaatcctggagttttggcggaaattcggaatcggtctgctgtcaggaaccatcgctagtgtcattaacatcccgtttgacgtggcgaaatcaagaatccaggggcctcaacccgtgccaggcgagattaaatatcggacctgttttaaaaccatggccaccgtctaccaggaagaagggattctggcactgtacaaaggtctcctccccaaaattatgcgcctcggccccggtggcgcagtgatgttactagtttatgagtacacatacagttggctgcaggaaaattag

SEQ ID NO: 205877 - DNA, 900 bp, Artificial Sequence
  Description of Artificial Sequence: Synthetic coding sequence
atgagcgccaagcccgaggtgagcctggtgcgggaggccagccggcaaattgtggctggtgggtctgccggtctcgttgagatctgtctgatgcatccgctcgacgtcgtgaagactagattccagatccagcggtgcgcaaccgacccaaactcctataagtccctggtggactcatttcgtatgatttttcagatggaaggcctcttcggcttctacaaggggatactgccgccaattctcgccgaaactcctaaacgtgctgttaagttttttactttcgagcagtacaagaaactgctgggatacgtgtccctgagtcctgctctcaccttcgccatcgctgggctcggtagtggtctgacagaagccatcgtggttaatccattcgaggtggttaaagtcggactgcaggccaatcgcaacacattcgctgaacagccatccacagtaggctatgctcgacagattattaagaaggaggggtgggggctgcagggcttgaacaaaggacttacagccacactcggcaggcatggagtgtttaacatggtatattttgggttctattacaacgtaaaaaacatgataccagtgaacaaagatcccatcctcgaattctggcggaagtttggaattggtctcctttctggaaccattgcctcggtgattaacattccttttgacgtggctaaatctcggattcaggggccccagccagtgcctggagaaattaagtaccgaacgtgcttcaaaactatggcaactgtgtatcaggaagaggggattttggcgctatataagggtttgctacctaagatcatgcgcttgggacctggaggtgcagtcatgttgctggtgtacgagtatacatatagctggcttcaggaaaattggtag

SEQ ID NO: 205878 - DNA, 963 bp, Artificial Sequence
  Description of Artificial Sequence: Synthetic coding sequence
atggtgggctacgaccccaagcccgacggccggaacaacaccaagttccaggttgcagtggcagggagcgtctccggccttgtgacgcgggccctgatttctccttttgacgtgattaaaatccgctttcagctccaacacgagagactatcaagatccgacccatccgcgaaataccatgggattttgcaggccagcaggcaaatcctgcaggaagagggacccactgctttctggaagggccacgtgcctgcgcagatcctctccattggatacggcgcagtgcaattcctctccttcgaaatgctgacggagctggtgcatcggggcagcgtctatgatgctagagagttttctgtgcatttcgtttgtggaggattggcagcctgtatggctactctgactgtccaccccgtggatgtgttacggacgagattcgctgcccagggtgaaccaaaagtttacaatactctccgacatgccgttgggacaatgtaccgctctgagggcccccaggtcttttataagggcttagctcccaccttaatcgctatcttcccttatgccgggcttcagttctcctgctattcctcacttaaacacctttataagtgggccatcccagctgaggggaagaaaaacgaaaatttacagaacttgctgtgtggtagcggggccggcgtcatctctaagaccttgacctatcctctcgatctcttcaaaaaacgccttcaggtggggggtttcgagcacgcgagagccgctttcggtcaggttagaaggtacaaagggctgatggattgtgccaagcaggtgctgcaaaaggaaggggctctcggtttcttcaaaggactgagcccttcactgctcaaagctgctctgtccacaggatttatgttcttttcttacgagttcttttgcaacgtgtttcactgcatgaatagaacagcatcgcagcgatag

SEQ ID NO: 205879 - DNA, 963 bp, Artificial Sequence
  Description of Artificial Sequence: Synthetic coding sequence
atggtgggctacgaccccaagcccgacggccggaacaacaccaagtttcaagtggccgtggccggctctgtctcaggtctggtgacaagagccctgatcagtcccttcgacgttatcaagattcgctttcagctccagcatgaacggctttcaaggagcgacccgagcgccaaatatcatggaatcctccaggcctctaggcagattctccaggaagaaggcccaacagccttctggaagggccacgtgcctgcacagattctgtccatcggttatggggctgtgcagttcctgagcttcgagatgttgaccgagctggttcatagaggatcagtgtacgacgcacgagagtttagcgtacatttcgtgtgtgggggactggccgcatgtatggctaccctcaccgtgcatcctgtcgatgtgctgcgcactaggttcgcagcccagggggagcccaaggtgtacaatacactaaggcacgccgtagggaccatgtaccgctccgagggaccccaagtgttttataaagggctggcgcccacccttattgccatctttccctatgccgggctgcagttctcatgctattctagtctgaagcatctttataaatgggctattccggccgagggtaagaaaaatgaaaatctgcagaacctgctgtgtggtagcggcgccggtgtgatcagcaagaccctgacatatccactggacctgtttaagaagcgcctgcaggtcggcggctttgagcacgccagggcggcttttggacaagtgcggcgctacaagggtctgatggactgcgcaaagcaggtgctgcagaaagagggagcgttagggttctttaaaggcctttcaccaagccttttgaaagccgctctatcaacaggcttcatgttcttttcttacgagttcttctgtaatgtgttccattgcatgaaccgcactgccagccagcgttag

SEQ ID NO: 205880 - DNA, 792 bp, Artificial Sequence
  Description of Artificial Sequence: Synthetic coding sequence
atggtgggctacgaccccaagcccgacggccggaacaacaccaagttccaggtggcagtggccggttccgtgtctgggctggtgacaagggctctgatctcgcccttcgacgtgattaagattcgcttccaactgcagcacgagaggttgagccgcagcgaccctagcgccaaataccatggcatactgcaggcttcacggcagatcctgcaggaggaaggacctacagctttctggaaaggccatgtacccgcacagatcctgtcgatcgggtatggggccgtgcaagtctacaacaccctgcggcatgcagtgggcacaatgtatcggagcgaaggacctcaggttttttataaaggtctggcccccacactcattgccatcttcccttacgccggacttcagttttcttgttatagctctctgaagcatctttataaatgggccatccccgccgaagggaagaagaatgagaatctgcagaacctgctgtgcggtagcggggctggagtcatctcgaaaaccttaacgtatcctttagatctcttcaaaaagcgcctgcaggtgggagggtttgagcatgcgcgtgcagcattcggtcaagtacggagatacaaggggttgatggattgcgccaaacaggtcctgcagaaagagggagccctcggcttctttaaaggactgtccccttctttactcaaggcagctctgtccacggggttcatgttttttagttacgagttcttttgtaacgtgtttcattgtatgaatcgcaccgcctctcagagatag

SEQ ID NO: 205881 - DNA, 963 bp, Artificial Sequence
  Description of Artificial Sequence: Synthetic coding sequence
atggtgggctacgaccccaagcccgacggccggaacaacaccaagttccaagtggccgtggctgggtctgtcagcggcctagtcacaagagctctcattagcccctttgatgtgatcaaaatccgctttcagctgcagcatgaacgattaagccgctctgaccccagcgctaagtatcacggaattttgcaggcgtcgcgccagatactccaggaggagggcccaacagccttttggaagggccacgtccccgcacagattctcagcattgggtacggagcagtgcagttcctgagttttgaaatgttgacggagctcgttcatagaggctctgtctacgacgcccgagagttctctgtgcatttcgtgtgtgggggcttggctgcatgtatggcaacactgacagtgcatccagtagatgtcttgcgcacccgctttgccgctcagggggagcccaaggtgtacaacactctccgtcatgctgttggaactatgtatcgctctgagggccctcaggtgttctataaggggctcgcgcccacactcatagctatcttcccctatgcaggactgcaattcagttgttacagcagccttaaacatctgtataagtgggccatccctgctgagggcaaaaaaaatgaaaatctccagaaccttctctgtggatctggagccggggtgataagtaagaccctgacctatcctctggacttatttaaaaaacggctccaggtgggaggcttcgaacacgcacgagctgcgtttggtcaggtcagacggtataagggcttaatggactgtgccaaacaagtgctacagaaggaaggagctcttggcttctttaagggcctctctccttctcttctaaaggccgccctctcaaccggatttatgttcttctcctacgagttcttctgcaacgtgttccattgcatgaataggactgcctcacagaggtag

SEQ ID NO: 205882 - DNA, 963 bp, Artificial Sequence
  Description of Artificial Sequence: Synthetic coding sequence
atggtgggctacgaccccaagcccgacggccggaacaacaccaagtttcaggtggccgttgctggatccgtgtctggccttgttacaagggctctgatatccccctttgacgtgattaaaatcaggttccagcttcagcacgagcgtctttctaggtcggatccgagcgctaaatatcatgggatcctccaggcaagcagacagatcttgcaagaagaaggccctacagcattttggaagggtcatgtgccggcccaaatcctgtccatcgggtacggcgccgtgcagtttctcagctttgaaatgttgaccgagctcgtccatcgtggaagcgtttacgatgcccgcgagttttccgtacatttcgtttgtggagggctcgcggcctgcatggccaccctcactgttcacccagtggacgttctgaggacgagatttgccgctcagggcgagcctaaggtgtacaacacgttacgtcacgccgttggtacaatgtacaggtccgaagggccccaggtgttctacaagggactcgccccaacgttaatcgccatattcccctacgcaggattacagttttcatgttattcctccctcaaacatctctacaagtgggctatccccgcagaaggaaagaagaacgagaatctgcagaatctgctctgcggcagcggggcgggcgtgatttccaagacgctgacttatccactggacctcttcaaaaaacggctgcaggttggcggttttgaacatgcccgtgccgcatttgggcaggtcagacgatataaaggcctcatggattgtgccaaacaggtgctccagaaagaaggcgcactgggtttcttcaaggggctgtcaccaagtctcctgaaagcagcactgtccacaggattcatgttcttcagttatgagtttttttgtaatgtgtttcactgcatgaataggacagcatctcaaagatag

SEQ ID NO: 205883 - DNA, 963 bp, Artificial Sequence
  Description of Artificial Sequence: Synthetic coding sequence
atggtgggctacgaccccaagcccgacggccggaacaacaccaagtttcaggtagcagtggcaggttctgtgtccggcctggtgacgcgcgctttaatcagtccatttgatgtgataaaaattcgctttcaactacagcacgagagactcagcagaagcgacccttccgctaagtaccacggcatcctccaggcgtctagacaaatccttcaagaggagggacctacggctttctggaaggggcacgtgcctgcacagatccttagtatcggatatggagccgttcagttcctgtccttcgagatgttgactgagctggtgcatcggggctccgtctatgatgcccgggaattcagcgtgcattttgtctgtgggggtctggccgcgtgcatggccactttaacagtgcaccccgtggatgtgttgagaacaaggtttgccgcccaaggggagcccaaggtctacaacacgctgagacatgctgtcggaaccatgtaccggtctgagggtccacaagtgttctacaaaggcctggcgcctaccttaatcgcaatcttcccttacgcaggactgcagttctcctgttactcttccctgaagcacctatacaaatgggccatccccgccgaaggaaaaaagaatgaaaacctgcagaacctgctgtgcgggtcaggcgccggggttatctccaaaactctcacttaccctcttgacctgtttaagaagcgtctgcaggtgggaggctttgagcacgctagagctgcttttggacaagtgagacggtacaaggggctgatggattgcgctaaacaggtgcttcagaaagaaggcgctctgggcttctttaaaggcctcagtcccagcctgcttaaagccgccctgagcacgggattcatgttcttttcctacgagtttttctgtaatgtgttccactgtatgaaccgcaccgcatcccagaggtag

SEQ ID NO: 205884 - DNA, 2028 bp, Artificial Sequence
  Description of Artificial Sequence: Synthetic coding sequence
atggccgccgccaaggtggccctgaccaagcgggccgaccccgccgaactgcgaaccattttccttaaatatgcaagtatagaaaagaatggggaattcttcatgagcccaaacgattttgttacccgctacctgaacattttcggtgagagccagcccaacccaaagacagtggagctactgagcggtgtcgtcgaccagactaaggatggtctcatcagctttcaggagtttgtggcctttgagagcgtactgtgcgcacctgatgcactgttcatggtggctttccagttgtttgataaagcggggaagggggaggtcacctttgaagacgtcaaacaggtgtttggccagacgacaattcatcaacatattcctttcaactgggattctgaattcgtccagttacactttggcaaggagcgcaagcggcaccttacgtatgcagagttcacacagtttctgctggaaattcaactggagcacgcaaaacaagcatttgttcaaagggataatgcccgcacaggccgcgtaactgcgatcgacttccgcgacattatggtcaccatcagacctcacgtcctgaccccctttgtcgaggagtgtttggtagccgccgccggcggaacaacgagccaccaggttagcttcagctattttaatgggttcaacagtctgttgaataatatggaacttatcagaaaaatctacagcacattagcaggaacccggaaggacgtagaggttacaaaagaggagtttgtattagctgcccaaaaatttggacaggtgacccctatggaggttgacatcctgtttcagttggccgacctatacgagcccagagggcgcatgacgctagctgacatcgagagaatcgctccactcgaagagggcactctgcccttcaacctggcggaagcccagagacaaaaggcatccggcgattctgccagacctgtgctgctgcaagtcgctgagagcgcgtaccggtttggtctcgggagtgtggccggagccgtcggtgccacggcggtgtacccgatcgacttagtcaagactagaatgcaaaatcagagaagcaccggctcttttgtcggcgagttgatgtacaaaaacagctttgattgctttaagaaggtgcttcgctacgaagggttctttgggctgtatcggggactgctgccccagctgttgggagtggcccccgagaaggctattaagctgacggtcaatgattttgtcagggataagtttatgcataaggatggtagtgtcccactggccgccgagattttggccggtggttgcgccggcggaagccaggtgatcttcactaatccactagaaattgttaaaattagactccaggtggcaggcgagattactacagggccaagggtgagcgccctctctgtggtccgggatcttggctttttcggtatttataaaggggctaaggcgtgcttccttcgggacattccattctctgccatctattttccctgttatgcccatgtcaaagctagttttgctaacgaggatgggcaggtcagtcccgggagcctcttactggctggcgccatagcagggatgccagcggccagcctcgtcactcccgccgatgttatcaagactcgtttgcaggtcgcagctagggcgggtcaaaccacttattcaggcgtaatcgattgcttcaggaaaattcttcgggaggagggtcccaaggcactgtggaaaggagctggagcaagagtgttcagatcctcgccccaatttggggtgaccctgctgacatatgagcttttgcagcggtggttctacatagactttggaggtgttaagcccatgggctctgagcccgtgcccaaatcaaggatcaatttgcccgctcctaacccagaccacgtcggcggctataagctcgctgtggctacattcgctggtatcgagaacaaatttggcctgtaccttcctctgtttaagccctcagtgtctactagcaaggctattgggggagggccctag

SEQ ID NO: 205885 - DNA, 2031 bp, Artificial Sequence
  Description of Artificial Sequence: Synthetic coding sequence
atggccgccgccaaggtggccctgaccaagcgggccgaccccgccgaattaagaaccatctttctgaaatatgcatctattgaaaagaatggcgagttcttcatgtccccaaatgactttgtgacgaggtatcttaacatttttggtgagtctcagcctaacccaaagactgttgagctgctgagcggggttgttgaccaaacaaaagacggcctgatttcgttccaagagtttgtggccttcgaatccgttctgtgcgcccctgatgcactgtttatggtggcgttccagctattcgacaaagctgggaagggggaagttacgttcgaagacgttaagcaggtctttggacaaactacaatccaccagcacattccctttaattgggacagtgaattcgtgcaactccactttggaaaggagagaaagagacacctgacctacgctgaattcactcaatttctcctggaaattcagttggagcatgcaaagcaggcttttgttcagagagacaacgccaggacagggagagtgaccgcaatcgacttccgtgatatcatggtgactattcgccctcatgtattgacgccttttgtcgaagaatgtctggtggcagctgcaggcgggacgaccagtcatcaggtgtccttcagctatttcaacggtttcaacagtcttctgaacaatatggaactcatccgcaagatctatagcacattggctggtacccgaaaggatgtcgaggtcacgaaggaagagttcgtgctggccgctcagaagtttggccaggttaccccaatggaggtggacattctcttccagcttgctgatctgtacgaaccacgtgggaggatgactctcgccgatatcgaacgaattgcccccctcgaagaaggcactttgcctttcaacctcgccgaggctcaaagacagcagaaggcatcgggagacagtgctagaccggttttgctccaggtcgctgagtcggcatataggttcggcctcggtagcgttgcaggcgcagttggagctactgccgtatatcccatcgaccttgtgaaaacaagaatgcagaaccagcgttccaccggatcctttgtgggcgagctgatgtataagaactcttttgattgttttaaaaaggtattgaggtatgaaggattcttcggtctttacaggggtctgctgccccaactcctgggggtggctcccgaaaaagccatcaaacttaccgtaaacgactttgtccgcgacaagtttatgcacaaagacgggtctgtgccactggcggctgagattctcgccggcggatgtgctggggggtctcaggtcattttcacaaaccctttggagatcgtgaaaatacggctccaggttgcgggcgaaatcacgactggcccacgcgtatccgccctgtcggttgtgcgcgatctcgggtttttcgggatatataagggcgccaaggcatgctttttgagggacatcccgtttagcgccatttactttccttgttatgcccacgtgaaggccagtttcgccaacgaggacggacaggtttccccaggctccctgctgctggctggggcaattgccggcatgcccgcagcctcgttggtgacaccagcagatgtgataaaaacccgcctgcaggtggccgctagggctggtcaaacgacatattcaggagtgattgattgctttcgaaaaattttacgtgaagaaggacccaaggcgttgtggaaaggagccggggctagagtctttcggtcctctcctcagttcggagtaactctgctgacctatgaactcctccagaggtggttctatatagacttcggcggggtgaagcccatgggcagcgagcccgttcctaagtctcggattaacctccccgcccccaacccagatcacgtgggcggatataagctcgcagtcgcaacctttgccggaatagagaacaagtttggactttatttgccgcttttcaagcccagtgtcagcaccagtaaagccatcggcggaggtccttag

SEQ ID NO: 205886 - DNA, 1704 bp, Artificial Sequence
  Description of Artificial Sequence: Synthetic coding sequence
atggaggacgtgaagcaggtgttcggccagaccaccatccaccagcatattccattcaactgggattccgagttcgtccagttgcattttgggaaggagcggaagcgccacctgacttacgccgagtttacccagtttctattggaaatccaactcgagcacgcaaagcaggcattcgttcagcgtgacaatgcaaggacagggagggtgacagctattgattttagggatatcatggtcaccataaggcctcatgtgctaactccgtttgttgaggagtgcctggttgctgcagctggcggcacaacatctcaccaggtttctttttcctacttcaatggattcaattcactactcaacaacatggagttgatccggaagatttactctactctggcaggaaccaggaaagacgtggaggtgacaaaggaagaatttgtgctcgccgcgcagaaatttggacaggttacccctatggaagtcgacatcctatttcagttggcagacctgtacgaacctcggggacggatgaccctggccgatattgaaaggattgccccgctggaggaaggtactctaccattcaatctggcggaggcccagcgccagaaggccagtggagacagcgccagacccgtactcctgcaggtcgcggaaagtgcctatcgtttcggcctcgggtccgtcgccggcgcggttggtgctacagctgtctaccctatcgacctggtaaaaactcgtatgcagaatcagcgcagtacgggcagttttgtcggagagctgatgtacaagaactcttttgactgcttcaaaaaagtgctaagatacgaagggttctttggactctaccgcggtctcctaccacagttgctgggtgttgctcccgagaaagcaataaagttgaccgtcaacgattttgtcagggacaaattcatgcataaggatggttctgtccccctggccgcagaaattctagcaggtggctgcgcaggggggagccaggtgatcttcactaatcctctcgagatcgtcaagatacggctgcaggtggccggggaaatcactacgggccctcgtgtctccgccttgagcgtggtgcgagacctggggtttttcgggatctataagggggctaaggcttgttttttacgggatatccccttttcagccatctatttcccgtgttacgcgcacgttaaggcttcctttgctaatgaggacggtcaggtttcccctggcagcctgctcctggccggagccattgccggaatgcccgccgcatcccttgtgactcccgccgatgtgatcaagacaaggctgcaagttgcagcacgagcggggcaaacgacttactctggggtgattgattgttttagaaagatattaagagaggagggtccaaaagcattgtggaagggcgctggggcacgcgtgtttcgaagtagccctcagtttggggtgacgcttctaacatatgaactccttcagaggtggttttatattgattttggcggcgtgaagccaatggggtctgagccggtgcccaagagccgtatcaacttgcctgcacccaatcccgatcacgtaggaggctataagttggctgtggctacgttcgctggcattgaaaacaagttcggtttatacctacctcttttcaagccaagcgtctctaccagcaaagccatcggaggtggcccatag

SEQ ID NO: 205887 - DNA, 561 bp, Artificial Sequence
  Description of Artificial Sequence: Synthetic coding sequence
atgaagcacatgctggccgccagcgccggcgaggtggtggcctgcctgattagggtgccctccgaagttgttaagcagagggcacaggtgtccgcctcaacccgtacgtttcagattttcagcaacatcctttacgaggaagggattcagggcctgtaccggggctacaagagtactgttctcagagaaatcccattctctctcgtgcagttccccctatgggagtctttgaaggctctctggagttggcgacaggaccacgtcgtcgactcctggcagagtgctgtctgcggcgcgtttgcaggcggatttgcagccgcggtcaccacacccctggatgtggctaaaaccagaataacacttgcgaaggccggctcctcgacggccgatggcaatgtgctaagtgtactgcacggggtgtggcgatcccaggggctggccggcttgttcgcaggggtgtttccgaggatggcagccatctctctgggtggcttcattttcctcggagcgtatgatcgcactcactctctcctgctcgaggtaggaaggaaaagcccctag

SEQ ID NO: 205888 - DNA, 825 bp, Artificial Sequence
  Description of Artificial Sequence: Synthetic coding sequence
atggaccggcccggcttcgtggccgccctggtggccggcggcgtggcaggagtctctgtggacctgatcctctttcctctagataccataaaaactagactgcaatccccgcaaggcttctctaaggctggcgggtttcatggaatttatgcaggtgtacctagcgccgcaatagggtcgttccccaatgccgcagcttttttcattacttacgaatacgtgaagtggttcctccacgccgatagcagtagttatctgaccccaatgaagcatatgctcgccgcctccgccggggaagtggtcgcatgcctaataagagtaccctccgaagtggtaaaacagagagcacaggtctccgccagcaccaggaccttccaaatcttctcgaatattctttacgaagaaggaatccaggggttatatcgcggttataaatccacagttctaagagaaatcccgttttctctagtgcagtttccactgtgggaatcccttaaggcgctgtggagctggcggcaagaccacgttgtagattcatggcagtccgcagtctgcggagctttcgcaggcggtttcgccgccgctgtgaccaccccgcttgatgtcgcaaaaactcgtattaccttggcaaaggccgggtcttcgacagcagacggcaatgtcctaagtgtcctgcacggagtgtggaggagccagggcctggctggtctgttcgccggtgtgtttccgcgcatggccgccatctcccttggcgggttcatcttccttggcgcttacgacaggacccattctctgctcctggaggtggggcggaagtcaccatag

SEQ ID NO: 205889 - DNA, 66 bp, Artificial Sequence
  Description of Artificial Sequence: Synthetic coding sequence
atggaccggcccggcttcgtggccgccctggtgctgctgcacttcttgagtcccatgaacatgtag

SEQ ID NO: 205890 - DNA, 477 bp, Artificial Sequence
  Description of Artificial Sequence: Synthetic coding sequence
atggagggcaagcggaagctggagggcaagcccctgcggttccggggagtgcaccacgcattcgcgaaaatcctcgccgaaggcggtatacgggggctctgggccggctgggtacctaatattcaacgggcggctctggtgaacatgggtgatctgacaacctacgatacagtgaagcactatctcgtcctgaacacccccctggaggacaatataatgacacacggcctgtcctccttgtgctccggtctcgtggcttctatcttgggtacccccgccgacgtgatcaagtcacggataatgaatcagcccagggacaaacagggtaggggtttactgtataaaagcagcaccgactgtttgattcaggcggtccaaggcgagggatttatgagcctgtacaagggattcctccctagttggcttagaatggccgcagtgattgtgaattcaagccggtctcagttgaaagtgtag

SEQ ID NO: 205891 - DNA, 972 bp, Artificial Sequence
  Description of Artificial Sequence: Synthetic coding sequence
atgagcgtgcccgaggaggaggagcggctgctgcccctgacccagcggtggccaagggcgagtaagttcctgctcagcggctgtgccgctaccgtagccgagctggctacttttcctctggatctgacaaagacccgcctccagatgcagggcgaggcagctctcgcccgcctcggagacggggcccgggagagcgccccttacagaggcatggtgcgaactgccctgggcattatagaggaagaggggtttcttaagctttggcaaggtgtgacaccagccatctaccgccacgttgtgtactcaggaggacggatggtaacatacgaacatcttcgcgaggtagtgttcggaaaatctgaggacgagcattaccccctctggaaatctgtgattggcggaatgatggccggagtgattgggcagtttttggctaatcccacagatctagtaaaggtacaaatgcagatggaagggaagagaaaactggaggggaagcctctcaggttccgcggagtgcaccatgctttcgccaagatcctggccgagggagggatccggggactgtgggcaggttgggttcccaatattcagagagccgctcttgtgaatatgggagacctgacgacttacgacaccgtgaagcactacttagtgctcaacactccattagaagacaacatcatgacgcatggcctgtctagtctgtgttccgggcttgtcgcttctattttaggcacacctgccgacgtcattaaatcaagaatcatgaaccaaccacgcgacaaacagggtcgaggcctcctgtacaaatcaagtaccgactgtctgattcaggcagttcagggagaggggttcatgagcctctataaaggttttctaccctcttggcttaggatgaccccgtggagtatggtcttttggttgacatacgagaaaatccgcgaaatgtccggcgtaagccccttctag

SEQ ID NO: 205892 - DNA, 738 bp, Artificial Sequence
  Description of Artificial Sequence: Synthetic coding sequence
atgagcgtgcccgaggaggaggagcggctgctgcccctgacccagaggtggccaagggcatcgaaatttctacttagcggatgtgcggccaccgtggcagagcttgccaccttcccactagatctcactaagacccgcctgcaaatgcagggagaggcagccctggcccgtttgggtgatggggctcgggaatctgctccctacagggggatggtccggacagccctgggaatcattgaggaagagggattccttaagttgtggcagggcgtgacccccgctatctacaggcatgtcgtgtactcaggaggccgtatggtcacgtacgaacatctccgagaggtagtatttggaaaatctgaggacgagcactacccgttgtggaagagtgttattggcggaatgatggcaggagtaattggccaatttctcgccaacccaaccgacttggtcaaggttcagatgcagatggagggaaagaggaaactggaaggcaagccgctccgctttagaggagttcatcatgctttcgcgaagattttggccgagggcggcatcaggggactctgggccggctgggtgccaaatatccagcgtgctgccttggtaaacatgggtgacttgaccacatacgatacagtgaagcactatttagtgctgaacacaccgctggaggataatattatgacgcatggcctatcctccgatctagtggggagccataaagcaatacagtag

SEQ ID NO: 205893 - DNA, 297 bp, Artificial Sequence
  Description of Artificial Sequence: Synthetic coding sequence
tgaaacatgggcgacctgaccacctacgacaccgtgaagcactacctggttttaaacacgccactcgaggacaatatcatgactcacggactgagttccctgtgttcaggcctagtggcctcaatacttggcacacctgctgacgtgatcaagagcagaatcatgaaccagcccagggacaagcagggacggggcctgctatataagtcctctacggactgccttattcaggcagtacaaggcgaaggcttcatgtctctctataaggggttcttaccctcctggctgcgaatgtag

SEQ ID NO: 205894 - DNA, 450 bp, Artificial Sequence
  Description of Artificial Sequence: Synthetic coding sequence
atgagcgagtgccccctgatcctgtacatccacaagcacatcgacacctactcacaaagttacctgttcaacgatttgttttatcctgtctactcaggaggacgcatggtcacatatgaacacttacgggaggtggtgttcgggaaatcagaagacgagcactacccgctgtggaagtccgtaattggtgggatgatggctggagtcatagggcagtttctggccaaccccaccgatctagttaaagttcagatgcagatggaaggaaagcgaaagctggagggtaaaccactcaggttcagaggcgtacatcacgctttcgccaagattttagccgagggaggtattcggggcctctgggctggctgggtgcccaacattcaaagggccgccctcgtcaacatgggagatctcactacgtatgacacggtcaagcactatctagtgtag

SEQ ID NO: 205895 - DNA, 480 bp, Artificial Sequence
  Description of Artificial Sequence: Synthetic coding sequence
tgaatggagggcaagcggaagctggagggcaagcccctgcggttccggggagttcatcacgcttttgctaaaatactcgcggagggcggaattagaggcctgtgggcaggctgggtgcctaacatccagcgcgcagcactggtcaatatgggcgatttgaccacatatgatacagtgaagcattacttagtgctcaataccccgctggaggataatattatgactcacggcctgtcctctctgtgttccggcctcgtcgcatctatcctcggcactcctgccgatgtgatcaagtctcgcatcatgaaccagcccagagacaagcagggaagaggtttgctgtacaaatcttctaccgattgtctaatccaggctgtccagggcgaaggtttcatgagtctctacaaaggtttcctccccagttggctgagaatggcagctgtcattgtgaacagttcacggtcacagttgaaagtgtag

SEQ ID NO: 205896 - DNA, 714 bp, Artificial Sequence
  Description of Artificial Sequence: Synthetic coding sequence
atgtacctgtacctgatgaagatgcccgccgcctaccaggtgtacagcggtggccgcatggtgacttacgaacacctacgcgaggtcgtctttggcaagtcagaggatgaacactatcccctttggaaaagtgtcattggagggatgatggccggagtaatcggacagtttttggcgaaccctaccgatcttgtgaaggtgcaaatgcaaatggagggaaagcgcaaactagagggcaagcctctgagatttagaggcgttcatcatgcgtttgccaaaatcctggccgaggggggaattaggggtttgtgggccggttgggtcccaaacatccaaagagcagctctggtcaatatgggggatctgaccacatatgatactgtgaaacattacctcgtgttgaatacccccctagaggacaatatcatgacccatggactcagcagcctgtgttccggactggtggccagtatcctgggcactccagctgatgtgatcaaatctcggatcatgaaccagccaagggataagcaagggagggggttgctgtacaagtcatcaactgactgtttaattcaggccgtccagggggagggatttatgtcattgtacaaaggcttccttccttcatggcttaggatgaccccctggagcatggtgttctggctgacttacgaaaaaattcgggagatgtccggtgtgagtccattctag

SEQ ID NO: 205897 - DNA, 1095 bp, Artificial Sequence
  Description of Artificial Sequence: Synthetic coding sequence
atggagctggagggccggggcgccggcggcgtggccggcggccccgcagctggaccaggtcgaagccctggcgagagcgccctgctagatggctggctacagcggggagtaggacgcggggctggagggggtgaggccggggcttgccgccctcctgtccgccaggatcccgatagcgggccagattacgaagccctgcctgctggagccacagtgactacacacatggttgctggagccgtcgctggcatcttagaacattgcgtaatgtatcccatagattgcgttaagaccagaatgcagtcactgcagcctgaccctgccgctaggtatcgtaatgtgctggaggccctgtggcgcatcataaggacggaaggtctgtggcgccccatgcgaggtctcaatgttactgctactggggcgggaccagcccacgctctgtatttcgcgtgttacgagaagttgaaaaaaaccctttcggatgttatacatccagggggcaattcccacatcgccaatggtgccgctggctgtgtggcaacactcttacacgatgccgcaatgaacccagctgaggttgttaagcaaaggatgcaaatgtacaattcaccctatcacagagtgacagactgcgttcgcgccgtgtggcagaacgagggcgccggtgcattctataggagctacaccactcagttgacaatgaatgtgccattccaggccattcacttcatgacgtatgagttcctacaagaacacttcaacccccaaaggaggtataacccctcttcacacgttctgtcaggagcctgcgcaggggcagttgccgccgccgctacgaccccgttggacgtctgtaaaacactcctgaacacacaggagagcttggccctcaactctcatattactggtcacattacaggaatggcttccgcctttcgcacagtctatcaagttggcggagtaaccgcctactttagaggggtacaagccagggtgatataccaaattccaagcaccgctatcgcctggtctgtatacgaattcttcaaatacctgatcactaagcgacaagaagagtggagagcaggcaagtag

SEQ ID NO: 205898 - DNA, 678 bp, Artificial Sequence
  Description of Artificial Sequence: Synthetic coding sequence
cggggcgccgccggctggagccactgccaccacgcccacggcggcagacgacgcggccgcgaccccggggccttgcgggatgttcctcataggctgagacagggggccgcgggttgcgtggcaacccttctgcacgatgcagctatgaatcccgccgaagtcgttaaacagaggatgcaaatgtacaattctccctaccatcgtgtgacagactgcgtgagagctgtttggcagaacgagggcgccggtgccttctacaggagctatacgacacagctgacgatgaatgtaccatttcaggccatccactttatgacctacgaattcctgcaagaacatttcaatccacagcgccgttacaatccttccagccatgtgctgtccggtgcctgcgccggtgccgtagccgcggcagccacaacacccttggacgtgtgcaagactttactcaatacccaggagagccttgctctgaactcacatatcacaggccatatcacaggaatggcctctgcttttcggactgtttatcaggttgggggagtcacagcatacttcagaggtgtacaagcgcgcgtcatttaccagatcccctctaccgctattgcatggtccgtgtatgagttcttcaaatacctgataactaaacgacaggaggaatggagggccggcaagtag

SEQ ID NO: 205899 - DNA, 876 bp, Artificial Sequence
  Description of Artificial Sequence: Synthetic coding sequence
atgagcgccctgaactggaagcccttcgtgtacggcggcctggccagcatcaccgcagagtgtggaactttccctattgacctcacgaaaacaaggctgcaaatccaggggcagactaacgacgctaaatttaaagagatcagataccgcgggatgctccacgctctcgtgcgtatcggacgtgaagagggactgaaagccttatattcagggatcgcaccagcaatgctccggcaggcctcctatggcacgatcaagataggaacatatcagagcctgaagcgattgttcatcgaacggcctgaggacgagacgctgcccatcaacgtcatctgtggcatcctttctggggtgatcagctctacaattgctaacccgaccgacgtcttgaaaatacggatgcaggctcagagcaacactatccaaggcggtatgataggaaactttatgaacatctaccagcaagagggcaccagaggactgtggaagggcgtatcgctaacggcccagcgcgccgccattgtggtcggtgtggaactcccggtctacgatattactaagaagcaccttattctgtctggactgatgggcgatacagtctacacacactttttgagttcattcacatgcggcctggccggcgcattagcgtcgaatccagtggatgttgttaggacacgcatgatgaaccagcgggtcctgcgagacggccgatgttctggctatactggcacgctggactgcctactgcagacctggaagaatgagggcttctttgcattatataagggattctggcctaattggctcagacttgggccatggaacattattttcttcgtcacttacgagcagttgaaaaaacttgatctttag

SEQ ID NO: 205900 - DNA, 651 bp, Artificial Sequence
  Description of Artificial Sequence: Synthetic coding sequence
atgctgcggcaggccagctacggcaccatcaagatcggcacctaccagtcactgaagagactgttcattgaaagacccgaggatgaaacactccctattaatgtgatctgcgggattttatcaggcgtgatctcaagcaccatagctaaccccacggatgtcctgaagatcagaatgcaagcccagtcaaatacaatccaggggggtatgatcggcaactttatgaatatctatcagcaggagggaactagaggcctctggaagggggtgtctctcacggcccagagagcagcgatcgtagtcggggtggaactgcccgtgtacgacatcactaaaaaacacttgatcttgagcggactgatgggcgatactgtgtatacccacttcctttctagcttcacgtgcggcctggctggtgccttggccagcaacccggttgacgtcgtacgcaccaggatgatgaaccagcgcgtgctacgggatggcagatgctctggttatacgggtactttggactgcttgctgcagacatggaaaaatgaaggtttcttcgccctgtacaaaggcttttggcctaactggctccgcctcgggccatggaacatcatcttctttgtgacctacgagcagctgaagaaactagatttatag

SEQ ID NO: 205901 - DNA, 723 bp, Artificial Sequence
  Description of Artificial Sequence: Synthetic coding sequence
atgctgcacgccctggtgcggatcggccgggaggagggcctgaaggccctttattctggcattgcccctgccatgcttcggcaagcctcctacggcaccatcaagattggcacataccaatctttgaagcggcttttcatcgagcgcccagaggacgaaactctacccattaatgtgatctgcgggatcctgtccggtgtcatctcaagcactatcgccaatccaacagatgtgctcaagattaggatgcaagctcaatctaacaccattcaaggcggcatgattggtaactttatgaacatatatcagcaagagggcacccgcgggctgtggaaaggggtgtctctgacggcccaacgcgcggccatagtggtcggcgtggaactgcccgtgtatgacattacgaagaagcatctgatcttgagcggactgatgggggacacagtctacacgcatttcctctcttccttcacctgtggtctcgctggtgctctggcctctaatcctgtggacgttgtgcggacacggatgatgaatcagcgagtgcttagagatggcaggtgttccggctatacaggcacactggattgcctgctgcaaacttggaagaacgaaggctttttcgccctttacaagggattttggccaaattggcttcgcctgggaccttggaatattattttcttcgtgacatacgaacagctcaaaaaactggacttgtag

SEQ ID NO: 205902 - DNA, 948 bp, Artificial Sequence
  Description of Artificial Sequence: Synthetic coding sequence
atgaccggccagggccagagcgccagcggcagcagcgcctggagcacagtgtttcggcatgtcaggtacgaaaatctgattgctggcgttagcggcggcgtgctaagcaaccttgccctccaccctctagacctggttaaaatacggtttgcggtctcggatgggctggagttgcggcctaagtataacggaattctgcactgcctcactactatatggaaattagatggtctgcggggcctgtaccagggcgtgactccgaatatctggggtgcggggctctcctggggcttgtatttctttttttacaacgctattaagtcgtacaaaaccgagggtagagccgaaaggctggaggccactgagtacttggttagcgcggctgaagcaggcgctatgaccttatgcataacaaacccactgtgggtgacaaagactaggttgatgttacagtatgacgctgttgtaaacagccctcatcgtcagtacaaagggatgtttgacaccctcgtgaaaatctacaaatacgaaggcgtgcgtgggctttacaaggggttcgtgcccgggttattcggaacatcgcatggggcccttcagttcatggcctacgagctcctgaaactgaaatacaatcaacatattaatagactgccagaggcacagttgagtacagtggagtacattagcgtggcagcactgtccaagatcttcgcagtggccgcaacctatccttatcaggttgtaagggctagattacaagatcaacacatgttctactcaggagttattgacgtcataactaaaacctggagaaaggagggagtaggcgggttttataaagggattgcaccaaacctgatccgcgtgacacctgcatgttgtataacgtttgtggtctatgagaacgtgtctcatttcctgttggatttaagagagaaacgcaagtag

SEQ ID NO: 205903 - DNA, 900 bp, Artificial Sequence
  Description of Artificial Sequence: Synthetic coding sequence
atgaccggccagggccagagcgccagcggcagcagcgcctggagcggtggtgtcttgagtaatttggctctccaccctctggatctggttaagattaggtttgcagtctctgatggtctggagctgcgccccaagtacaatgggattctccactgcttgaccacaatctggaaactggatggactgcgcgggctgtatcagggtgtcactcctaacatctggggtgctggcctgagctggggtttgtacttttttttctacaatgcgataaagagctataaaactgaggggagggctgagcgcctggaggcaaccgagtatctcgtctcagccgccgaagctggcgctatgacactctgtatcactaaccccctttgggttaccaagaccagactgatgctgcagtacgatgcagtggtcaactcgccccatcgacagtacaaggggatgttcgacaccctggtcaaaatctacaagtatgagggggtcagaggcttgtacaaggggttcgtacctggactgtttggcactagccatggggcattacaatttatggcctacgaacttctgaagttgaagtataaccagcacattaacagattgcctgaggcccagctgagtactgttgagtatatctccgtggcggcactgtcaaagattttcgccgtggccgccacctatccctaccaggtggtccgagctaggcttcaggatcagcacatgttctattctggtgtcatcgatgttatcaccaaaacatggcgcaaggagggagtcggggggttttataaggggattgcccccaatcttatccgcgtcacgcctgcctgttgtataacattcgtcgtgtatgagaacgtgagtcacttcctcctagacctgagggaaaagaggaagtag

SEQ ID NO: 205904 - DNA, 552 bp, Artificial Sequence
  Description of Artificial Sequence: Synthetic coding sequence
atgaccctgtgcatcaccaaccccctgtgggtgaccaagacccggttaatgcttcagtatgatgctgtggtgaacagtccacacagacagtacaaggggatgttcgacaccttggtgaaaatttataagtatgaaggtgtaagaggactgtacaagggctttgtccctggcctgttcggcacatcccatggtgctctgcagttcatggcttatgaactgctgaagttgaaatacaatcagcacataaatagattgcccgaggcccaactgtctaccgtcgagtatatctctgtcgctgctctcagtaagatctttgccgtggctgcgacctacccctatcaggtcgtcagggcccgcttgcaagatcagcacatgttttacagtggagtaattgatgtcattacgaagacctggcgcaaggaaggagtgggggggttctacaagggaattgcgccaaatcttatccgcgtgacaccggcctgctgcattactttcgtagtttatgagaacgtaagccactttctgttggacctgcgagaaaaacgcaaatag

SEQ ID NO: 205905 - DNA, 966 bp, Artificial Sequence
  Description of Artificial Sequence: Synthetic coding sequence
atggccaccggcggccagcagaaggagaacaccctgctgcacctgtttgcgggcggttgcggcgggaccgtcggggcaattttcacatgtcccttggaggtgatcaaaacacgtttgcagtctagccgactcgccctgaggacagtctactaccctcaggtccatctcgggaccataagcggagccggaatggttcggccgacttccgtaacgcctggactgttccaggtgttgaaatccatcttggagaaagaggggccaaagagcctgttcagagggctggggcccaatctagtgggagttgccccatcacgggcggtgtatttcgcatgctactcaaaagccaaagaacagttcaatggcatcttcgtgccgaatagcaacatagtccatatcttcagcgccggctccgctgccttcatcaccaatagcctaatgaaccctatctggatggtcaagacacggatgcagctcgagcagaaagtccgcggatcaaaacagatgaataccctgcagtgcgctcgctatgtctatcagactgagggcatccgcggtttttacaggggcttaaccgcaagctatgccggtatctcggaaactatcatttgttttgccatttatgaatcattgaagaagtatctcaaagaagctcctctggcctcatcggcaaatggcactgaaaagaattccactagcttctttgggctgatggctgctgccgccctgagtaaagggtgcgcaagttgtattgcctacccacacgaggtgatccggaccagattgagggaggagggtacaaaatataagagtttcgtgcagacagcccgccttgtcttcagagaggaggggtacttagcgttctaccggggcctgttcgcccagctgatacggcagatccctaacactgcaattgtgctctctacgtatgagctgatcgtctacttacttgaggatcgaacccagtag

SEQ ID NO: 205906 - DNA, 915 bp, Artificial Sequence
  Description of Artificial Sequence: Synthetic coding sequence
atggagaccgtgccccccgccgtggacctggtgctgggcgccagcgcatgctgcctggcctgcgtgttcaccaatccattagaggtagtcaaaacaagattgcagctccagggtgaacttcaagccaggggaacttaccctcgcccctaccacggctttatagcaagcgttgctgcagtagctcgagctgatggtttgtggggactgcaaaaaggcctggcggctggcctgctctaccaaggccttatgaacggtgtgcgattttactgctactcactggcatgtcaggctggtttgacccagcagcctgggggtactgtggtcgccggggccgtagcaggggctctgggcgccttcgtaggaagccccgcctatctgattaaaactcagctccaagcacagacagttgcggctgttgcagttgggcaccaacataatcaccagaccgtgctcggcgcactggaaacgatttggcggcagcaaggcctccttgggctctggcagggggttggaggagcagttccaagggtgatggtgggctcggcagcacagctggccacttttgcttctgctaaagcatgggtgcagaaacagcaatggttacccgaagactcctggctggtggccttggcaggaggtatgatcagtagcatcgctgtggtcgtggtgatgacccctttcgacgtagtgagcacacgactgtacaatcagcctgtggataccgccggacggggccagttgtacggagggctgacggactgtatggtgaaaatttggagacaggagggaccgctggctctctacaaggggctgggccctgcctatctgcggctcgggcctcatacaatcctcagcatgctgttctgggatgagcttagaaagctcgcaggacgggcccagcataaagggacatag

SEQ ID NO: 205907 - DNA, 888 bp, Artificial Sequence
  Description of Artificial Sequence: Synthetic coding sequence
atggacttcctgatgagcggcctggccgcctgcggcgcctgcgtgttcacaaatccattggaggtggttaagacccgcatgcagctgcagggtgagctccaggcccccggtacctatcagcgtcactatcgcaacgtttttcatgccttcattactattgggaaagtagacggactggccgccttgcaaaagggcctagcacctgcacttctctaccaattcctcatgaacggcatccgactggggacatacgggctggcagaagccggggggtatcttcatactgctgagggtacacactcccctgcccgctctgccgctgcaggggccatggccggagttatgggtgcctaccttggaagtcctatctatatggtcaagactcacttgcaggctcaggctgcctctgagatcgccgtgggccaccagtataaacaccaaggtatgttccaagccctgacagagatcggacagaagcacgggctggtgggcctctggaggggcgccctggggggtctgcccagggtgatcgtcggatcttccacccagctttgcaccttcagctcgacaaaggatcttctgtctcagtgggaaatctttccccctcagtcttggaagcttgcactagtcgccgccatgatgtccgggatcgccgtggtgctggccatggcaccatttgacgtggcctgcactaggttgtacaaccagccgacagacgcccagggcaaaaatcgagtgcccaagttcagtgccaccagctgctccgctagtgcacctttgttgggaactaaagacgtcagaattgttaaagggcagacggggcaccagctgttcaaggtgacccaagcccctggatgctccccgattctgctgggtacccaatcttag

SEQ ID NO: 205908 - DNA, 876 bp, Artificial Sequence
  Description of Artificial Sequence: Synthetic coding sequence
atggacttcctgatgagcggcctggccgcctgcggcgcctgcgtgttcacaaacccactggaagtggtcaagacaagaatgcagcttcagggcgaactacaagcccctgggacttaccagaggcactatagaaatgtgttccatgctttcatcaccattgggaaagtggatggcttggcggctctgcagaaagggctcgcccctgctcttctgtatcagttcctcatgaacgggattaggctcggtacttatggcctcgccgaggcagggggataccttcacactgcggagggcacacactcacctgctcgcagcgccgcggctggggccatggctggcgtgatgggggcttacctgggctcgcccatttacatggtgaaaacacatctacaggcccaggccgcctccgagatagccgttggccatcaatacaaacatcaggggatgtttcaggctctgaccgagatcggccagaagcacggccttgtaggcctgtggagaggtgctctgggcggcttgcctagggtcatcgtgggttccagcactcagctctgtacattcagcagcacaaaggacctgctgtctcaatgggaaatctttccaccccagtcctggaagctggctctcgttgccgctatgatgtccgggatagctgtggtgctggccatggccccatttgacgttgcttgcacaagactttataatcagcctactgacgcacaggggaaaggcctgatgtaccggggcatcttagatgcccttctccagaccgctcgtaccgaaggaatatttgggatgtacaaggagccaagcccacaagtgttgagcaacatcatgcagtgcttctcagccttcaccggagatcagcggtgctag

SEQ ID NO: 205909 - DNA, 915 bp, Artificial Sequence
  Description of Artificial Sequence: Synthetic coding sequence
atgatccagaacagccggcccagcctgctgcagccccaggacgtgggggatacagtggagaccctcatgctgcacccagtcataaaagccttcctttgcggttcgatctctggtacctgcagcaccctgctgttccaacccttggatttgctgaaaacccggctgcagacactgcagccatctgatcacggatcgcggcgggtgggcatgctggcggtcctcctgaaagtggttcgtacagaatccctgctgggcctttggaaaggtatgagtccgtctatcgtaagatgcgtgcccggcgttggcatctactttggcactctctactccctcaaacaatacttcctgcgcggacaccctcccacagccctcgagagcgtgatgctcggcgtaggcagtagaagcgtcgcgggtgtgtgcatgagcccaattacagtaatcaaaactagatacgagtcgggcaagtacggttacgagagtatctatgccgcattgaggagcatctaccactcagaaggtcatagggggttattcagtgggttgaccgctacactactcagggacgcccctttctcaggcatctacctgatgttctataatcagacaaaaaatatcgtgccccacgatcaggtagacgcgactttgatccctatcaccaatttctcctgtggaatcttcgccggaattcttgcctcattggtcacccagcccgccgatgtaattaagactcacatgcagctgtatcctctgaagttccaatggatcggtcaggcagtaaccctgatctttaaggactacggattgagagggtttttccaggggggtataccccgggctctgcggcgcacgctgatggccgcgatggcctggaccgtctatgaggagatgatggccaagatggggctgaaatcttag

SEQ ID NO: 205910 - DNA, 1671 bp, Artificial Sequence
  Description of Artificial Sequence: Synthetic coding sequence
atgccccccgagcggcggcggcggatgaagctggaccggcggaccggcgctaaacctaagcgcaaacccggcatgcgccccgattggaaggctggtgcagggccgggcggcccacctcagaagcccgccccaagttctcaaagaaagccaccagcacgaccctccgccgcagcggcagccattgcagttgccgctgctgaagaggaacgcagactgcgccagcgtaacaggctgaggctcgaggaggataaacctgcagtggagagatgtctggaggagctggtattcggagacgtggagaatgacgaggatgcgctgttacggcggctgagaggcccacgagttcaggagcacgaggattcgggtgactctgaggtcgaaaatgaagctaaaggaaatttccccccccagaagaagcctgtgtgggtggatgaagaagacgaagacgaggagatggtggacatgatgaacaacagatttagaaaggacatgatgaagaatgcttccgaatctaagctgtccaaggataacctgaagaaaagactcaaagaagagttccaacacgcgatggggggcgtcccagcctgggcggaaacaacaaaacgtaaaacgtcgagtgacgacgaaagtgaagaggacgaggacgacttgttacagcgtaccggtaattttatctctactagcacttcactgccaagaggaattctcaagatgaaaaattgtcagcacgccaacgccgagcgtcctactgtggcccgaatcagcagcgtgcagttccatcctggcgcgcagatcgtgatggtggcaggtctcgataatgccgtctccctcttccaggttgatggcaagacgaatcccaagatccaatcaatctacctggagcgatttcctatattcaaagcctgtttctccgcaaatggcgaggaagtgcttgccacctcaacacacagcaaggtgctgtatgtgtatgacatgcttgcaggaaagcttatccccgttcaccaggtaaggggacttaaggaaaagatcgtgagatccttcgaggtgagtcccgacggatcatttctgcttattaacggaatcgccggctatttacacctgctggccatgaagacgaaggaactgatcggatcgatgaagatcaacgggcgtgtggcggcctccactttctcttccgatagtaagaaggtgtacgcttcaagcggagatggcgaggtctacgtttgggatgtgaactcgcgcaagtgcctgaaccgcttcgttgatgaggggtcactatatggccttagtatcgctacctcccggaatggacaatacgtggcatgtgggtccaattgtggagttgtcaacatctacaaccaggattcttgcctgcaggagaccaaccctaagcccattaaggctatcatgaatctcgtgacaggtgtaacctcccttacattcaaccctacaactgagatcctggctatcgccagcgaaaaaatgaaggaggcagtgcggctggtccacctgcccagctgtaccgtctttagcaactttcccgttatcaagaacaagaacatttcccacgtgcataccatggatttttctccgcggtcaggatattttgcactcgggaatgagaaggggaaagctctgatgtataggctgcatcactattctgatttctag

SEQ ID NO: 205911 - DNA, 1080 bp, Artificial Sequence
  Description of Artificial Sequence: Synthetic coding sequence
atggccgaccaggaccccgccggcatcagccccctgcagcagatggtcgcctctggaaccggagccgtagtgacaagcctttttatgacgccactggatgtggttaaagttaggcttcaatcccagagaccctccatggcatcagagttaatgccttctagcaggttgtggtctctaagctacaccaagctgccatcttccttgcagagcactggcaaatgcctcctgtactgcaatggcgtgctcgaaccactgtacctgtgtcctaacggggcacgctgcgctacttggttccaagacccgacgcggtttactgggacgatggacgccttcgtgaagattgtcaggcacgaaggcacacgcaccctttggagcggcctgcccgccacactggtgatgaccgtccccgctaccgccatttactttacagcatatgaccagctcaaggcatttctgtgtggccgggctctgacttccgacttgtatgctcctatggtggccggggctctcgccaggctgggcactgttaccgtgatcagccctttggagctgatgcgaaccaagctgcaggcccagcacgtatcctatagagaactgggggcctgtgttcgtacagcggtggctcagggtggttggcgaagcctctggctgggatggggccccaccgctctccgcgacgtgccattcagtgcgttatattggttcaactacgagctggttaagtcttggctgaatgggtttcgaccaaaggatcagacatcagtgggaatgtcattcgtggcaggtggaatttccggtacagtcgctgctgtactgaccttgccctttgatgttgtaaagacacagcgccaagtagccctcggagccatggaagctgttagagtgaacccattgcatgttgactctacctggctgttacttcggcgtatccgagcggagtcgggtaccaaggggttgtttgcaggttttctcccacggattattaaggccgctccctcctgcgccatcatgatctcaacttatgaattcggcaaatcatttttccagcgtcttaaccaagacaggctgctgggcgggtag

SEQ ID NO: 205912 - DNA, 1011 bp, Artificial Sequence
  Description of Artificial Sequence: Synthetic coding sequence
atggccgaccaggaccccgccggcatcagccccctgcagcagatggtcgccagtgggaccggtgctgttgttacaagcctctttatgacacctctggacgtagtgaaagtgaggctccagtcacagcgacctagtatggcaagcgggaaatgtctcttatattgcaacggggtcctggagcccctgtacctgtgtccgaacggggctcgctgcgctacttggttccaggaccctacccggttcactgggaccatggacgctttcgtgaagattgtacgccatgaaggcactcggacactctggtccgggctacccgctaccttagtgatgaccgtgccagccacagcgatctacttcactgcatatgaccagctcaaagcatttctgtgtggcagggccctcacctctgatctgtatgcccctatggtcgcgggcgccctcgccaggttgggtacggtcaccgtgatcagtcctctggaactgatgaggaccaaactccaggcacagcatgtgtcctatagagaactgggggcttgcgtcagaaccgctgtcgcccagggaggctggcgcagcctctggcttgggtgggggccgaccgctctgagggacgtgccttttagtgctctgtactggtttaactacgaacttgtcaagtcctggctaaatgggtttaggcctaaagaccagacttccgtcggtatgtccttcgtcgccggtggaatatcgggaacggtcgccgccgtactcacattgccttttgatgtagtgaagacacagcggcaagtcgcattaggagccatggaggctgtccgggtgaaccctttgcatgtggacagcacctggctgctgctgcggaggatcagagcagaatcagggacaaaaggcctgtttgcagggttcctgccccggatcatcaaagcggcgccaagttgcgccattatgattagtacgtacgagtttggcaagtcctttttccagcggcttaaccaggatagattgctaggtggatag

SEQ ID NO: 205913 - DNA, 1017 bp, Artificial Sequence
  Description of Artificial Sequence: Synthetic coding sequence
atggaccccgagacccggggccaggagatcatcaaggtgacccccctgcagcaaatgctggctagttgcaccggagccatcctgacaagcgtaatcgtcacaccgctcgatgtggtgaaaatccggctgcaggcccagaacaacccactacctaagggtaagtgttttgtgtacagtaacgggctgatggaccatctgtgtgtttgcgaagaaggcgggaataaactgtggtataagaagcctggaaatttccaggggaccctggacgcatttttcaagataatccggaacgaaggaatcaaaagcctgtggagcgggcttcccccgacactagtgatggccgtgcctgccacagtcatttactttacttgctatgatcagctctccgcactccttaggagcaaattgggcgaaaatgagacatgcattcctatcgtcgccggaatcgtcgccagattcggcgccgtgaccgtgatcagtccactggaactgatcagaaccaaaatgcagtcaaaaaaattttcctacgttgaattacatcgctttgtgagtaagaaggtgagcgaagacggttggatctcactttggagggggtgggcaccaaccgtgctgcgcgacgtcccattcagcgcgatgtattggtacaactatgagattctgaagaagtggctatgcgagaaaagcggtctgtacgaaccaacatttatgattaattttacgagcggggccctctctgggagcttcgccgccgtggccacattgccctttgacgtcgtgaagacccaaaagcagacccaactgtggacatacgaatcacacaaaatctcaatgccgctgcatatgagcacctggattattatgaaaaatatcgtggccaaaaatggcttttcaggcctcttttctggtttaatacctagacttattaaaatcgcccctgcctgcgcaattatgatcagtacatatgaatttggaaaggccttttttcagaaacagaatgtaaggagacaacagtactag

SEQ ID NO: 205914 - DNA, 1113 bp, Artificial Sequence
  Description of Artificial Sequence: Synthetic coding sequence
atgggcgcccagcccggcgagccccagaacacctgcagccggatccaaaccctgtttcgacgggtcaagactctactcatcaaagctccccctcctccgcagcccccccccccgcccccaagctggaatcctggttgcacccatgtttacggctatgccttcggacacatgcacgataataatctcgagcatctgccttctcagcaggtgttggacaccggtgagcagctaatggtgcctgtagaggtactggaggtggataataaggaagccctttggaaattccttctgtcaggtgcgatggccggcgcagtctccaggaccggcactgcccctctggatcgggccaaagtgtacatgcaggtctatagctccaagaccaacttcacaaatctgctgggcgggcttcagtcgatggtgcaggaaggcgggttccgaagcctctggcgggggaacggtattaacgtgctcaaaatagcacccgagtatgccatcaagttttcggtgtttgagcagtgcaagaactacttctgcggcattcagggatcaccaccatttcaggaaagactcctggccggttctctcgccgtggccatcagtcagactttgataaaccctatggaagtactgaagacaaggctgacgttgcggcgtaccggacagtacaagggtctcctggattgcgcccgtcagatcctgcagcgggagggaactagagcactgtaccgaggttatctgccaaatatgttgggcataatcccatacgcctgtacagatctggcggtctacgaaatgctgcagtgtttttgggtaaagtcgggccgggacatgggagatccaagtgggctagtgtccttgtctagcgtgaccctgtccacaacctgtggccaaatggcttcttaccctctgactcttgtaagaacgcgcatgcaggcccaggacacagttgaaggctctaatcccaccatgcgtggcgtgctacagcggatactggcccagcagggctggctgggtctataccgcggcatgacccccacactccttaaggttctacctgctggcggcataagttatgtggtttatgaggccatgaaaaagaccttgggcatctag

SEQ ID NO: 205915 - DNA, 729 bp, Artificial Sequence
  Description of Artificial Sequence: Synthetic coding sequence
atgggcgcccagcccggcgagccccagaacacctgcagccggatccagactctctttcgcagagttaagacccttttaatcaaggctccgcccccccctcaacccccacctccgccccctagttggaatcctggatgtacccatgtgtacggctacgcgttcggacacatgcacgataacaacctagaacacttaccatctcagcaggtactcgacacaggagagcagctcatggtgcccgtcgaagtgctggaagtcgataacaaggaagccctgtggaagtttttgctgtctggggctatggctggggctgtcagtcggaccggcactgccccgctggatagagccaaggtctacatgcagttgctggggagattgagacaggagaatagactgaacctaggaggtgggggctgttccgagccgagaagccctgaccgaactcctgcttgggcaaccgaaagcactccccccagacgtacttccccgacgtgttggggcggctacagagcgtggagcagaagggctgcatctgccccatgtggaggcgcaactgcttccacttgcagccgactgctgctgtcgatgccgagttcatctccctactcctcatccgcgagaatcacgagcgtggagtataaaggaccgagacctagtcggtccgtgtcactgctcgccccgtggctgtggccttccccgcgaccctcatcaacgccttggcggtgttag

SEQ ID NO: 205916 - DNA, 957 bp, Artificial Sequence
  Description of Artificial Sequence: Synthetic coding sequence
atgggcaacggcgtgaaggagggccccgtgcggctgcacgaggacgccgaagccgtgttatcctcaagtgtatcatcaaagagggaccacaggcaagtcctttctagtttactctctggcgcactcgctggggcccttgccaaaaccgctgtggcacccctagaccgtaccaagataattttccaggttagttcaaaaagattcagcgcaaaggaggcgtttcgcgtgttatattatacttatctcaacgagggatttcttagcctctggcggggcaactcagccaccatggttcgcgtggttccctatgccgcaatccaatttagcgctcacgaggagtacaagaggattctcggatcctattatgggttcagaggcgaggctcttcccccatggccacgtctgtttgctggagccttagctgggacaacagccgcctctctgacctacccattggacctcgtgagagccaggatggcagtgaccccgaaggagatgtattcgaacatcttccatgtttttatcagaatctccagagaggagggtttgaagactctctatcacggctttatgccaactgtgctcggtgtgattccctatgccggactctcctttttcacatacgagacattgaagtccttacacagggagtatagtggacggaggcagccctatccttttgaaaggatgatttttggcgcatgcgccggtctgatcggacaaagcgcctcgtacccacttgacgtggtgagaagacggatgcagaccgcaggagtgaccgggtatcctcgggcaagcatcgcgaggaccctcagaactattgtgcgggaggagggggctgtaagaggtttgtataaggggcttagtatgaattgggtgaaggggccaattgcagtggggatatcctttacgacctttgacttaatgcagattctgcttagacatctgcagagctag

SEQ ID NO: 205917 - DNA, 1011 bp, Artificial Sequence
  Description of Artificial Sequence: Synthetic coding sequence
atgagcgtgctgttcttctacatcatgcggtacaagcagagcgaccccgagaaccccgataatgatagatttgtgctggccaagattgccacacgcaaagcatgcgggttagctctggcaaagctgggttatgctaataaccgggtggtagttctggacggcgacacacggtacagcaccttctcagaaatattcaacaaagaatacccggagcggtttatcgagtgcttcatggccgaacaaaacatggttagcgttgctctaggctgtgcttctagaggacgaacaattgctttcgcttcaactttcgctgccttcctaacgagagcatttgaccatattcgcataggcggtttggccgagtcaaatatcaacatcattgggtcgcactgcggagttagtgttggagacgatggggccagtcaaatggctctcgaggacatcgcgatgtttagaaccattccaaaatgcacaatcttctatccaaccgatgccgtaagcaccgaacacgctgtcgccctcgcagcaaacgcgaaagggatgtgcttcattagaacaacaaggcccgagacgatggtgatatatacaccacaggagcgctttgagattgggcaggctaaggttctccgccattgtgtctccgacaaggtgacagtgattggggccggaatcaccgtgtacgaagctcttgcagccgcagacgagctttctaagcaggatatttttatacgagttattgatttgttcactattaagccattggacgttgcgacgatcgtgtcttccgcgaaagcgacagaaggccggattattacggtggaagaccactatccccagggagggattggagaagccgtgtgtgccgccgtatccatggatcctgacattcaggtgcacagtctagccgtttcaggtgttccacagagtggcaaatcagaggagctgctggacatgtatgggatctccgcccgtcatatcatagtcgcagtgaagtgtatgctacttaactag

SEQ ID NO: 205918 - DNA, 870 bp, Artificial Sequence
  Description of Artificial Sequence: Synthetic coding sequence
atggccacctggcggcgggacggccggctgaccggcggccagcggttgctgtgtgctggcttagcaggcactctgtcactaagcttgaccgcccccttggaacttgctgcgtatcgaaaatttgttgtcctattcactgacgatttaggacacatatcccagtggagttctattatggcaggaagcctggctggaatggtcagcactatcgttacttatccaactgatctgatcaaaacccggctgatcatgcagaacattctggagccgtcttaccgcgggctgcttcatgcattctcaaccatctaccagcaggagggcttcctcgcattgtacaggggtgtgtctctaacagtcgtaggcgccctgccattttccgctgggtcccttctagtgtatatgaacctagaaaaaatttggaacggcccaagggatcagttctctctccctcagaatttcgccaacgtatgtctggccgcggcagttacccaaacattatctttcccctttgagacagttaagcgcaagatgcaggcccaaagcccatatcttccgcactctgggggcgtcgacgtgcacttttccggagccgtggactgcttcaggcaaatcgtgaaagctcagggcgtgcttgggctttggaacggactcaccgcaaacttactgaagatcgtcccatatttcgggatcatgtttagtacatttgagttctgcaaacggatttgcctgtatcaaaacggctatatcttgagcccgctgtcttataaactcacacccggcgtggatcagagcctgcagccccaggagctgcgtgaactgaaaaaatttttcaagacacgcaagccgaaaccgaagaaaccgacgttatag

SEQ ID NO: 205919 - DNA, 681 bp, Artificial Sequence
  Description of Artificial Sequence: Synthetic coding sequence
atggccacctggcggcgggacggccggctgaccggcggccagcggctgctgtgtgctggcctggccggcacactgtctctatccctgaccgccccgttagagctcgctactgtgctggctcaggtcggagtcgtgaggggacatgctcggggaccctgggcaaccggacaccgagtttggcgagcagaggggcttagagctctgtggaaaggtaacgccgtcgcatgcttgagactgttcccttgttcggcagtgcagcttgccgcctacagaaaatttgtcgtgctcttcacagacgatttgggacatataagtcaatggagctccatcatggcagggtctctggctgggatggtgagtacaatagttacttacccaaccgacttgattaagaccagactaatcatgcagaacatcctggaaccctcgtaccggggcctgctgcatgccttctctaccatctatcagcaggagggtttcttagcactgtataggggagtgtcactgaccgtggttggttccgaaccactccctcccacacaatggagatccagatgcccttttttgcgcagttcggggctgctacccgccgacagcgaaggccctggcggacccggggcgctggagtggatcgactcccaatttacagaggatagctcaattttctggaactatgtgtag

SEQ ID NO: 205920 - DNA, 945 bp, Artificial Sequence
  Description of Artificial Sequence: Synthetic coding sequence
atggaggacaagcggaacatccagatcatcgagtgggagcacctggacaagaagaagttctacgtttttggagttgccatgaccatgatgataagagtgagcgtgtaccctttcacacttataaggacacgtttacaggtgcagaagggcaagagtttgtaccacggaacctttgacgcttttattaagatattgcgtgcagacggaatcactggcctgtaccgaggattcctggtcaatacctttaccttaatctcgggccagtgttatgtgacaacctacgaactgactaggaaattcgtggccgactattcacaaagcaacacagtgaaaagcctggttgctggagggtccgcatcactggtcgcacagtccatcacggtgcctattgatgtggtctcacagcacttgatgatgcaacggaagggggaaaagatgggccgatttcaggttcgcggaaacccagagggacagggggttgtcgcatttggccagacgaaggatatcattaggcagattttgcaggccgacggactccgtggcttctatagagggtatgttgccagcctgcttacatatattccgaattcagcagtctggtggcccttttaccatttctatgcggaacagctgtcatacctgtgccccaaagaatgcccccatattgtatttcaggctgtttctggccccctagcagctgcaacagctagtattttgaccaacccgatggatgtcattagaacacgggttcaggttgagggtaagaattctatcattctgacattccgccagctgatggccgaggaggggccctggggcctgatgaaaggcctttctgctaggatcattagcgcaaccccctcaactattgttatcgttgttggttacgagagtcttaaaaagctgtcccttcgcccggagttagtggactccaggcactggtag

SEQ ID NO: 205921 - DNA, 489 bp, Artificial Sequence
  Description of Artificial Sequence: Synthetic coding sequence
atggaggacaagcggaacatccagatcatcgagtgggagcacctggacaagaagaagttctacgtctttggggttgcaatgaccatgatgatcagggttagcgtgtaccccttcacgctgattcgcactcggttacaagtacagaaggggaaaagtctgtatcatgggacttttgatgcctttattaaaatccttcgggcagacggtatcaccggactatatcggggctttttagtgaacacatttaccctgatcagtggccagtgctatgtcaccacgtatgaacttaccagaaagttcgttgcggactatagccaaagcaatactgttaagtctctgatggccgaagaggggccttgggggctgatgaaaggacttagcgctcggattatcagcgccacaccatccacaatcgttatcgtggtcgggtacgagagccttaagaaactgagcttgcgacccgagctggtggattcaaggcactggtag

SEQ ID NO: 205922 - DNA, 876 bp, Artificial Sequence
  Description of Artificial Sequence: Synthetic coding sequence
atggaggacaagcggaacatccagatcatcgagtgggagcacctggacaagaaaaaattctacgtgttcggggtagcaatgactatgatgattcgagttagcgtatacccatttacactgatcagaacccgtctgcaggtgcaaaaagggaagtccttgtaccatggcaccttcgatgctttcatcaaaatcctgcgtgccgacggcattaccggtctctatcgcggcttccttgtgaatacattcaccctgatttctgggcaatgttatgtcaccacctacgagctaacgcgcaagttcgtggccgactactctcagtccaatactgtgaaatccctcgttgcaggcggatctgcaagcctggtggcacagtccatcaccgtgagagggaaccctgaagggcagggggtggtcgccttcggccagacaaaagacatcatccgacagattttacaggcagacggcctcagggggttctaccggggatatgtcgcctcacttctgacttacattcccaattccgccgtctggtggcccttttaccatttttatgctgaacaattgtcttacctgtgtcccaaggagtgcccgcacattgtgttccaagcagtgtcgggacccttagcagccgccacggccagcattttaaccaatcctatggacgtcatccggacacgggtgcaggtcgagggtaaaaattcgataatacttaccttccgccagttaatggctgaggaaggcccgtgggggctgatgaagggactctctgctaggatcatcagcgcaaccccctccactatcgtgattgtggttggatacgaaagcctgaagaaactttccctacgtccagaactggtcgactcaaggcactggtag

SEQ ID NO: 205923 - DNA, 741 bp, Artificial Sequence
  Description of Artificial Sequence: Synthetic coding sequence
atggtgaagatctaccggcacgagagcctgctgggcttcttcaagggaatgagtttcccaattgcttctatcgcggtggtaaattcagtcttattcggcgtgtatagtaatactctgctcgttctgaccgccacctctcatcaggaaaggcgagcacagccaccatcctatatgcatatcttcttagctggatgcaccggcggctttctgcaggcctactgcctcgcacccttcgatctgattaaagttcgcctccagaatcagaccgagccccgggcacagcctggctcccctccaccgagataccagggcccagtgcattgtgcagcatccatttttagagaggaggggccccgcgggctcttccgcggtgcatgggccctgaccctgagggatactcctacagtgggcatctattttatcacctacgaaggactgtgccggcaatataccccagaaggacagaacccatctagtgccaccgttttggtggccggggggttcgctggtatcgcatcctgggttgccgccactcccctcgatatgattaagtcccggatgcagatggatggcctgaggcggagagtgtatcagggaatgctggactgcatggtgagcagtatcaggcaggaagggctcggggtgtttttccgtggcgtgactattaattcagctcgggccttccccgtaaatgctgtgacgttcctgagttacgagtatttgcttagatggtgggggtag

SEQ ID NO: 205924 - DNA, 795 bp, Artificial Sequence
  Description of Artificial Sequence: Synthetic coding sequence
atgcccgtggaggagttcgtggccggctggatcagcggcgccctggggctcgtcctgggacatccctttgatactgtgaagctgttaggtttcttcaaaggaatgtcctttcccatagcaagtattgccgttgtaaacagtgtgctgttcggagtctattcaaatacccttttggtacttacagcaacaagccatcaggaacgtagggctcaaccacctagctatatgcacatctttctcgccggctgtaccggagggttcctgcaggcctactgcttggctccatttgacctgatcaaggtgagactgcagaaccagactgagccgcgcgcccagcctggtagtccccccccgagatatcagggtccggtgcattgtgcagcatccatattccgggaagagggcccgagagggttgtttcgtggcgcatgggcactcaccctgcgtgacacccctaccgtcgggatctattttattacctacgaggggttatgcagacaatacacccccgagggccagaatccgtcatctgctacagtgctcgttgcaggcggcttcgctggcatcgctagctgggtggcagccactccactcgacatgatcaaatcccgcatgcagatggacggtctgaggcggagggtgtaccagggaatgctggattgtatggtatctagcatccgacaggagggattgggtgtcttcttcaggggagttacaataaacagtgcgagggcgttccccgttaatgccgttacctttctgtcttacgagtacttgctgcgctggtgggggtag

SEQ ID NO: 205925 - DNA, 555 bp, Artificial Sequence
  Description of Artificial Sequence: Synthetic coding sequence
atggtgaagatctaccggcacgagagcgcctactgcctggcccccttcgaccttatcaaggtcagactgcagaatcaaacggagccccgggcacagcccggatccccacctccccggtatcaggggccagtccactgcgcggcgtctatttttcgagaagagggacctcgggggctctttagaggggcctgggctctgaccctcagggacactccgacggtgggcatctattttatcacatatgaagggttatgtcgccagtacacccccgagggccagaatcctagttccgctaccgtccttgtggcaggggggtttgccggcattgcctcttgggtggctgctacccccctcgatatgatcaagagcagaatgcagatggatggcctacgcaggagggtttaccagggcatgctagactgcatggttagcagcattagacaggaagggctaggtgtgttttttcgtggggtgacgatcaatagtgcccgcgcattccccgtgaacgcagtgacattcttgagctacgagtacttactccggtggtggggttag

SEQ ID NO: 205926 - DNA, 867 bp, Artificial Sequence
  Description of Artificial Sequence: Synthetic coding sequence
atgcccgtggaggagttcgtggccggctggatcagcggcgccctggggctggtgttgggacatccctttgacaccgtgaaagtgcggctgcagacgcagacgacctatagaggcattgtagactgcatggttaagatctatcggcatgaaagtctcctgggttttttcaaaggcatgagctttcctattgcctcaattgccgtcgtaaattctgtgctctttggcgtatatagtaataccctgctcgtgctcaccgccaccagccaccaggaacgcagggcccaacccccatcatacatgcacatcttccttgctggatgcaccggtggattccttcaggcctactgtcttgctcctttcgacctgattaaagtgaggttgcagaaccagaccgagcctagagcccagcctggcagccccccacccaggtatcaaggccctgtccattgtgcggcgagcatcttccgagaagaaggcccgcgcggtttgttccggggagcctgggcccttacgctgcgagataccccaaccgtcggcatatattttataacttatgagggcctgtgtcgacagtacacaccggaagggcagaaccctagctctgctacagtgctagtcgctggtgggtttgctggcatcgcttcatgggtggccgccaccccccttgacatgattaaatccagaatgcagatggatgggcttaggcgccgcgtgtatcaaggcatgttggactgcatggtgtcatctatcaggcaggaggggttgggagtgttctttaggggcgtgactattaatagcgcccgcgcttttccagtcaatgccgtgactttcctgagctacgaatacctccttcgttggtggggatag

SEQ ID NO: 205927 - DNA, 741 bp, Artificial Sequence
  Description of Artificial Sequence: Synthetic coding sequence
atggtgaagatctaccggcacgagagcctgctgggcttcttcaagggaatgtcctttccaatcgcgtcgatcgctgtggtcaacagcgtgctctttggcgtgtacagtaatacactgctggttttgaccgcaaccagccaccaggaaagaagagcccagccgccttcctacatgcacattttcctggcaggctgcaccggggggttcctgcaggcctactgcttggccccatttgacctcatcaaggtccgattgcagaaccagacggagccgcgggcgcagccaggcagccccccgccccgttaccaaggaccagttcactgcgcggcatccatctttcgcgaggaggggcccaggggcctctttcggggggcatgggctctgacccttagggacacccctactgtgggtatttatttcattacgtacgaggggttgtgccggcaatacactccggaagggcagaaccctagtagcgcgactgtgcttgtagctggcggatttgctggtatcgccagttgggtcgcggccactcctctcgacatgataaagtcacgaatgcagatggacggcttgagacggcgggtataccagggcatgttggactgcatggtatcctctattagacaggagggcctcggcgttttctttaggggagtgacaattaactctgccagagcatttccagtgaatgccgtaacattcttgagttacgagtacttactgcggtggtgggggtag

SEQ ID NO: 205928 - DNA, 867 bp, Artificial Sequence
  Description of Artificial Sequence: Synthetic coding sequence
atgcccgtggaggagttcgtggccggctggatcagcggcgccctgggtttggtgttaggccatccgtttgatacagtcaaagtcagactgcagacccaaaccacctatagggggattgtggattgtatggtgaagatatatcgacatgagtccttgctggggttctttaaagggatgagctttccaatcgcatctatcgctgtggtcaactccgtcctgttcggagtgtactcaaacaccttgctggtcctgacagccacgagtcaccaggaacggcgagcgcaacctccttcctacatgcacattttcctagccggctgcacgggaggctttttgcaggcttattgtctggctccctttgaccttatcaaggtgaggctgcaaaatcaaacggaaccaagggcccagcccggttctcctcctcccagatatcagggtccagtccactgcgctgcttcaattttccgggaagaagggcccagggggctgtttagaggcgcatgggctctgaccctgcgggatactcctaccgtgggcatctacttcatcacttatgaaggactgtgcagacagtataccccggaaggccagaatcccagtagtgccactgtcttggtggctgggggctttgctggcatcgcatcttgggtcgctgccacccccctggacatgattaagtcacgaatgcaaatggacggtctgcgccggagagtgtatcagggaatgcttgactgtatggtctcctcaattcggcaagagggcctgggtgtgtttttccgaggggtcactatcaactctgcaagagcttttcctgtgaatgctgttaccttcttgtcctatgagtacctgttacggtggtgggggtag

SEQ ID NO: 205929 - DNA, 357 bp, Artificial Sequence
  Description of Artificial Sequence: Synthetic coding sequence
atgcccgtggaggagttcgtggccggctggatcagcggcgccctgggcttggtgctcggacacccgtttgataccgtgaaagttcgcctgcagacacagacaacctataggggaatagtggattgtatggtcaagatataccggcacgaaagtctgcttggattcttcaagggtatgtcattccctatagctagcatcgccgtcgttaattccgtcctatttggagtatattcaaacaccctgctagtccttaccgctacttcccatcaagaacgcagggcccagccaccttcttatatgcatattttcctggccggctgcactggggggtttcttcaggcctactgcctggcctag

SEQ ID NO: 205930 - DNA, 1257 bp, Artificial Sequence
  Description of Artificial Sequence: Synthetic coding sequence
atgcacccccggcggcccgacggcttcgacggcctgggctaccgggggggtgcgcgggatgagcagggtttcggtggagcatttcctgctcggtctttttctaccggatcagacttaggtcactgggttactacaccccctgacatcccgggatcacggaatcttcactggggagagaaatcccctccctatggcgtccccaccacaagcaccccatatgagggcccaactgaggagccattctcaagtggcggcggaggctccgtgcagggtcagtcctctgagcagctgaaccgcttcgccggtttcggtatcggtctggctagtctgttcacagagaacgtgcttgcccatccatgtattgtgcttcgtcgacaatgccaggtgaactatcatgcccaacattatcacctgactcctttcacagtcattaacattatgtactcttttaacaaaactcagggcccccgggcgctctggaaaggcatggggtccaccttcatagtccagggcgtgacgctgggcgctgaaggaattatcagtgaattcacacctctccctcgagaggtcctacacaaatggtcacccaaacagataggcgaacatttactacttaaatcattaacatacgtagtggccatgcctttttatagcgccagtcttatagagactgttcagtcggagatcattcgagacaatactgggatcctggagtgcgttaaggagggaatcggcagggtgatcggaatgggagtccctcattccaaaaggctgttgccccttctcagtctcatcttccctacagtcctgcacggggttctccactacattatctcctcagtgatccagaaatttgttttgctaatcctgaaacggaagacttacaattcccacctcgcggagagcacaagccccgtgcagagcatgcttgatgcctattttcctgagctgattgcaaactttgccgcgtcgttgtgctcagacgtgattctgtatccgttggagactgtactgcaccggctccacatccagggcacccgcactataatcgacaatactgacctcggatatgaagttcttccgattaatacacagtacgagggcatgagggactgtatcaacacaattcgtcaagaggagggggtatttggcttctataaaggatttggcgccgtgattattcagtatacgttacatgcggcagtactccaaattaccaaaataatttactcgacgctgttgcagaataacatctag

SEQ ID NO: 205931 - DNA, 1014 bp, Artificial Sequence
  Description of Artificial Sequence: Synthetic coding sequence
atgcacccccggcggcccgacggcttcgacggcctgggctaccggggtggtgcaagggatgaacaggggtttggtggtgcatttccagccagatcgttcagcactgggagcgatctggggcattgggttactacccccccggatataccaggctcccgcaatttgcactggggtgaaaaaagccctccatatggcgtgcctactacctcaactccatatgaaggccctacagaggaaccattctctagtggtggaggtgggtcagttcaggggcagtcttccgagcagctgaatagatttgctgggtttggaatcggattagcttcactatttactgagaatgtgttggctcacccatgtattgtgctccggaggcagtgtcaagtcaattaccacgcacagcactaccatctgactccattcacggtcattaatataatgtattcatttaacaaaacacaaggaccccgcgctctctggaaaggtatggggagcacatttatagtccagggtgtgaccttgggtgcagagggtataatctctgaattcacccccctgccacgggaggtcctccataagtggagtcccaaacagattggagagcacctcttattaaagtctctcacatatgtggtggccatgccattctattccgcttcacttatcgaaacagtccagagtatgctggatgcctactttcctgaactgatcgcgaattttgctgcctcactgtgcagtgatgtaattctctaccccctagaaactgtcctgcaccgtctgcatatccaaggtacaaggacaatcatcgacaacaccgacttgggttatgaagtcctacccatcaacacacaatatgagggaatgcgcgattgcattaacacgattcgccaggaagaaggcgtgttcggcttctacaagggctttggagcggtgatcattcagtacactttacacgctgctgtgctccagattaccaaaattatctactcgacactgttacagaacaatatctag

SEQ ID NO: 205932 - DNA, 819 bp, Artificial Sequence
  Description of Artificial Sequence: Synthetic coding sequence
atgtacagcttcaacaagacccagggcccccgggccctgtggaaggggatgggaagcaccttcatcgtacagggagtcactctgggagccgaaggcataatttcagagtttacaccccttcctagagaagttctccataagtggagtcctaagcaaatcggggagcatctgttactgaaatcactcacctacgtggtggcaatgcccttctattctgcatccctcatcgaaactgtgcagtccgaaattatcagggataacaccgggattctggagtgcgtgaaggagggcattggccgcgtgatcggcatgggcgtgccccactcaaaacgcttattacccttgctgtccttaatctttccgacagtactccatggtgttctacactacatcatctcatccgttatccagaaatttgtgctccttatcttgaaaagaaagacatataacagtcacctcgccgagagcacctcgccagtccagagcatgttggatgcctattttcctgagttgattgccaacttcgctgcctctttgtgcagcgacgtgattctatatcccctggaaaccgtcctgcataggctgcacatccagggaacccgcaccatcatcgataacaccgatctgggatatgaggtcctgccgatcaatactcagtacgaaggcatgcgtgactgcattaatacgattcggcaggaagaaggtgtgtttggcttctataagggatttggagccgtgattatacagtatacacttcacgctgcggtcctccagatcactaaaatcatctattccacgctgttgcaaaacaacatctag

SEQ ID NO: 205933 - DNA, 618 bp, Artificial Sequence
  Description of Artificial Sequence: Synthetic coding sequence
atgcccttctacagcgccagcctgatcgagaccgtgcagagcgagatcattcgggacaatacgggcatattggagtgtgtgaaggagggaatcggaagggtaatcgggatgggcgtgccccactccaagagactactccctttactgtctttgatctttcctaccgtactacacggggtgctacattacataatcagcagcgtgatccagaagttcgtgttactcatactgaagagaaaaacctacaattctcacctggccgagtccaccagccccgttcaatctatgctggacgcctactttcccgaactgatagccaacttcgccgccagcctctgctcagacgttatcctctaccctctggagacagtcctgcatcgccttcacatccaggggacacggacgattatcgataacactgacctcggctacgaagtcctgcccataaacactcaatatgagggtatgagggattgtatcaacacaatacggcaggaggagggagtgttcggattttacaagggttttggcgccgttatcatccagtatacactgcatgccgctgttctgcagataaccaagattatttatagcacacttctgcaaaacaatatctag

SEQ ID NO: 205934 - DNA, 984 bp, Artificial Sequence
  Description of Artificial Sequence: Synthetic coding sequence
atgaagaccgagcagctgaaccggttcgccggcttcggcatcggccttgcctctctgtttaccgagaacgtgctggcccatccatgtattgtacttcggagacagtgtcaagtcaattatcacgcccagcattatcacctgactccttttaccgtcattaatattatgtattccttcaacaaaacccaggggcctcgggctttgtggaagggcatgggaagtacatttatagttcagggtgtcactctgggtgccgagggtattataagcgaattcaccccacttccgagagaggtgctgcacaaatggtcacctaagcagattggcgagcacttactgctgaagagcctgacttacgttgttgctatgccgttttactcagcatccctaatagagaccgtgcaatctgagattatcagggacaatacgggaattcttgagtgtgtcaaggaagggattggacgagtcatcgggatgggggtacctcacagcaagcgtttgctgccactcttatcccttatcttcccaacagtgctgcacggcgtgctccattatataatctctagtgtcatccagaaattcgtgctactaatcctgaagcgtaagacatataactctcacctggctgaatccacctcacctgtgcagtcaatgctggacgcttactttccagagttaatcgcaaactttgcagcctcgctgtgctcagacgtgattctgtatcctctcgagactgtgttacacagactgcacattcaaggaacccgaaccatcattgataacactgatctaggttatgaggtcctgccgattaacactcagtatgaagggatgagagactgtattaacacaattcggcaggaggaaggcgtgttcggattttataagggctttggagcggtgattattcagtacacactccacgcggctgtcctgcagattaccaagattatatactcaacgcttttgcagaataacatatag

SEQ ID NO: 205935 - DNA, 771 bp, Artificial Sequence
  Description of Artificial Sequence: Synthetic coding sequence
atgggcagcaccttcatcgtgcagggcgtgaccctgggcgccgagggaattatcagtgaattcactccactgcccagggaggtgttacataaatggagtcccaagcaaatcggcgaacacctgctcttgaaaagcctgacctatgtggttgcaatgccgttttattccgccagtcttattgaaaccgtccagtccgaaatcatccgagataatactggaattttggagtgcgtgaaagaaggcatcggccgtgttatcggtatgggcgtgccacatagtaagcgcctgctgccactgctatccttgattttccccacggtacttcatggagtccttcattacatcatcagcagcgttattcaaaaatttgtgctcctgatactcaaacgcaaaacttacaattctcatcttgccgagagtacctcccccgtccagtcaatgttggacgcttattttcccgaactgattgccaacttcgcagccagcctgtgctcagatgttatactttatccattggaaactgtgctgcacagactgcatatccaaggaacccggaccatcattgacaacaccgatctcggatatgaagtgctccccatcaatacgcagtatgaagggatgcgggactgtattaacactatcagacaggaggagggcgtgtttgggttctataaaggattcggtgctgtgataatacagtacacactccacgcggccgtccttcagattacaaagattatatattcaaccttgctccagaataatatatag

SEQ ID NO: 205936 - DNA, 819 bp, Artificial Sequence
  Description of Artificial Sequence: Synthetic coding sequence
atgtacagcttcaacaagacccagggcccccgggccctgtggaaggggatgggaagcacgttcattgttcagggagtcacactcggtgctgagggaattattagcgagtttaccccactccccagagaggtgttgcataagtggagtcccaagcagattggagaacatctcctccttaagtctctgacatacgtcgtggctatgcctttctactcggccagccttattgaaacagtacagagcgagataatccgagataacactgggatccttgagtgcgtgaaggaaggcatcggacgggtgatcggcatgggagtacctcattccaagcggctcctgcccttactatccctgatcttccccacagtgcttcacggtgtgctgcactacatcatatcttctgtgatacagaaattcgtgctgctgatcctgaaacggaagacgtacaacagccatctggcagaatccacctctcccgttcagtctatgttggatgcctacttcccagagctgattgccaatttcgccgcctccctttgcagtgacgtcattctttaccctcttgagacagtgttgcatcggctgcacattcagggcacacgcactataattgataacactgacttggggtacgaagtactgcccataaacactcagtatgagggaatgagggactgcatcaatacaataagacaggaggagggcgttttcggcttctataagggctttggggctgtgataatacaatatacccttcatgcggcagtcctgcagattacaaagattatatactccactctgttacagaacaacatatag

SEQ ID NO: 205937 - DNA, 2220 bp, Artificial Sequence
  Description of Artificial Sequence: Synthetic coding sequence
atgagcagcgagagcaaggagcagcacaacgtgagcccccgggacagtgcggagggcaatgacagctacccttccggaattcacctggagttacagcgtgaatcttcgacagacttcaagcagttcgagactaatgaccagtgccggccctatcacagaattctgattgaacggcaagagaagtccgatactaatttcaaagagtttgtgattaagaaactgcagaagaattgccagtgttcaccagctaaagctaaaaacatgatactgggtttcctcccagtgcttcagtggctacccaagtacgatctcaagaaaaacatactgggagatgtgatgtccggcctcatcgtgggcatactcctggttcctcagagcatagcctattccctgctagctgggcaagaacccgtctacggactgtacaccagttttttcgcctcgataatctatttcctgctgggcacatctaggcatatctctgtcggaatctttggcgtcctttgccttatgatcggtgaaacagttgatcgggagctccagaaagctgggtatgacaacgcgcactctgctcctagccttggaatggtgtccaacgggtccacactgcttaaccacacctccgaccgcatttgcgataagtcctgttacgcgatcatggtcggaagcaccgtgacatttatcgccggcgtctatcaggtcgccatgggcttctttcaggtcgggttcgtgagcgtctatctcagcgacgctctacttagcggattcgtcaccggagcctcgttcaccatcctgacctcccaggccaaatatctgctcggactgaatttgcctcggactaacggcgtgggtagcctgattactacttggattcacgtctttcgcaacattcacaagacgaacttgtgtgaccttattacctccctgctgtgcctattagtattattgcccacaaaggagcttaatgaacacttcaagagcaagttgaaagccccgatccccatcgagctggttgtggttgtcgccgctaccttggcaagtcattttggtaagctacacgagaattacaactcctccattgccggacacatacccacaggctttatgccccccaaggtgcctgagtggaatttgatcccgagcgtcgcagttgatgctatagcaatttccattattggatttgctatcaccgtgagcctgagcgagatgttcgccaaaaagcacggatacaccgtgaaggcaaatcaggagatgtacgctataggattctgcaacattataccaagctttttccattgtttcacaacttcggccgcccttgcaaaaacccttgttaaggaatcaaccggttgtcacacccagttgagcggtgtggttacagcattagtactgctgttggtgctgctcgtcatcgcacccctcttttattctctgcagaaaagcgtgctgggagtcatcaccatcgtcaatctgaggggagccctacgcaaattccgcgacctccctaaaatgtggagcatcagccggatggacaccgttatctggtttgtcacaatgttgtctagcgcactcctcagtacagagatcggcctgctggtaggagtctgtttcagcattttctgcgtgatcctgcgcacgcagaagcctaagtcatctctgctgggtctggtggaagaatcggaagtgtttgaatcagtgtctgcttacaagaatctacaaattaagccaggaattaaaatttttcggttcgtagctcctctgtactacatcaataaggagtgcttcaaatctgcgctgtacaaacagacagttaatccgatcctgataaaagtggcttggaagaaggcagctaagcgtaaaatcaaagaaaaagtcgttacattaggcggtattcaggatgaaatgtcggtgcagctgtcacatgatcctctggagttgcacaccatagtgatagattgctctgctattcagttcctggatacagctggaatacataccctcaaagaagtccgccgggattatgaggctattggcatacaagtgcttctggcacaatgcaacccaaccgtgcgcgacagccttaccaacggcgagtactgtaaaaaggaggaagagaatttgctgttctactcagtatacgaagccatggccttcgccgaggtatcaaagaatcaaaagggggtgtgtgtgcctaacggcctgtcactctcctccgattag

SEQ ID NO: 205938 - DNA, 72 bp, Artificial Sequence
  Description of Artificial Sequence: Synthetic coding sequence
atgagcagcgagagcaaggagcagcacaacgtgagcccccgggactctgccgaaggaaacgattcctattag

SEQ ID NO: 205939 - DNA, 2295 bp, Artificial Sequence
  Description of Artificial Sequence: Synthetic coding sequence
atgatcgagcccttcggcaaccagtacatcgtggcccggcccgtgtacagtactaatgcgttcgaagagaaccataaaaagactggcaggcatcacaagaccttcctggatcacctgaaagtgtgttgcagttgctctcctcaaaaagcaaagcgcattgttctgtccttattccccattgccagctggttgcctgcttacagattaaaagagtggctcctgagcgatatcgtctctggtatttccactggaatcgtggctgtcctgcaggggctggctttcgccttactcgtcgacatacccccagtttatggcctttatgcatctttctttcccgcaattatctacctcttcttcgggacatctaggcacatctccgtgggtccgtttccaatcctgtctatgatggttggattggctgtgagcggcgccgtgtcaaaagcagttcctgaccgcaacgctaccacacttggtctccctaataactccaacaactcctctttgcttgatgacgagcgcgtgcgggtggcagctgccgccagtgtgacagtcctgtccggaatcatccagttagcattcggcattcttaggattgggttcgtggtaatctacctgagcgaatcactaattagcgggttcacaacggccgccgcagtgcacgtgctggtgtcacagctgaagttcatctttcaactgacagtgccatcccacactgacccagtgagtatcttcaaggtcctttattccgtgttttcacagattgagaagactaacatagctgacctggtcacagctctaatagtgttgttagtggtgagcatagtgaaagagatcaaccagcgctttaaggacaaactcccagtgcccatcccaatagagtttatcatgactgtgattgctgctggcgtctcctatggctgcgattttaagaacagattcaaggtggccgttgtgggggacatgaacccagggtttcaaccaccgatcacacctgatgtggaaactttccaaaacaccgttggcgactgtttcggaatcgccatggtggctttcgcagttgcctttagcgttgccagtgtgtactcactcaaatatgattatcccctggatgggaatcaggagctgatcgcccttggcttggggaatattgtttgcggtgtttttcgaggattcgctgggagtactgccctttctcggtctgccgttcaggagagcacaggtggaaagactcagatcgctgggttgataggcgccataatagtcctgatcgttgtgctggctatcggctttctgctagcacccttgcagaagtccgtcctggctgccttagcactggggaacctgaagggcatgctaatgcaattcgccgagatcggccgtctctggcggaaggacaaatatgactgtcttatttggattatgactttcatctttaccatcgtgctggggttgggtttaggcctcgccgcgtccgttgctttccaattgctcactatcgtgttcagaacccagttcccaaagtgctctacattggccaacatcggaaggacaaacatatataagaacaagaaggactactacgacatgtacgagcccgagggagtgaagattttccgctgtccttcaccaatttattttgctaatattggcttcttcaggaggaaactaatcgacgctgtgggcttcagcccactgagaattcttcgcaagcgcaacaaggcactgcggaagattcggaaactgcagaagcaggggctgctgcaggtgactcccaaaggatttatctgcactgtggatacaattaaagactcagatgaagagctggacaataaccaaatcgaggtgctggaccagccgatcaatacaaccgatctgccattccacattgattggaacgacgatctcccgttgaacatcgaggtccccaagatctctttacatagtctaatcctggacttttctgcagtgtccttcctcgacgtgtccagtgtgagagggttgaagagcattttacaggaatttattcggattaaagtggatgtgtatattgtcgggaccgacgacgatttcatcgaaaagctgaaccgatacgagttctttgatggagaggtcaagagtagcatattttttctgacaatacatgacgctgtattgcatattctgatgaagaaggactattctactagcaaatttaacccttctcaggagaaagatgggaagatcgactttacgatcaacacaaacggcggccttcgaaatagggtgtacgaggtacctgtggaaaccaagttctag

SEQ ID NO: 205940 - DNA, 1956 bp, Artificial Sequence
  Description of Artificial Sequence: Synthetic coding sequence
atgctgctgcggaagatcatcaagcggcaggaggacatcatccggcacttctggatcatttcaaagtgcgtggtagcctcttggcttccggcctatagactcaaggagtggctactttctgacatcgtcagtggaatttccacaggcatcgtcgcagtcctgcaaggtctggctttcgcccttttggtcgacatccctccagtctacgggctctacgcttcatttttccccgctataatttacctcttcttcggaaccagcagacatattagtgtgggtccgtttcccattctcagcatgatggttggattagcagtttccggtgctgtctcgaaagccgtgccagataggaatgctacaacgctcggcctgcctaataatagcaataactccagcctgctggacgatgaacgggtgcgggttgcagccgctgccagtgttacagtgctcagcggtatcatccagctcgccttcggaatcctgaggatcgggttcgtggtgatttacctgtccgaatctctgatttccgggtttaccaccgctgcggctgtgcacgtactcgtatcccagttaaagtttatcttccagctgaccgtgccgagccacaccgatccagtgtccatcttcaaggtcttgtattctgtgttttcacagattgagaagacaaacatagcggatctggtgacagccctcatcgtcctcctcgtcgtgagcattgtgaaggaaatcaatcagagattcaaggataaactgcctgtcccaattccgatcgagttcattatgaccgtcatagccgctggtgtatcgtacggctgtgatttcaagaataggtttaaggtggcagtcgtcggggatatgaatcctgggttccagcctcccattactcctgacgtggaaacttttcagaatactgtaggggattgttttggcatcgcaatggttgcttttgccgtggccttcagcgttgcctccgtgtactcgttgaagtacgactatcctctggatgggaaccaggagttaatagctctaggcctggggaacatagtctgcggagtgtttcgtgggtttgctggctctaccgctctgtccagaagcgccgtgcaggagagcactggagggaaaacgcagattgccggcctgatcggcgccatcatcgtcctgatcgtggtccttgctattggattcctattagctcctctgcagaagtccgtgctggctgcactggctctgggaaatctcaaaggcatgcttatgcaattcgcagagatagggcgtctctggcgcaaagacaaatacgactgtctgatttggattatgactttcatattcaccatcgtgcttggtcttggtcttggcctggccgcaagcgttgcttttcagcttcttaccatcgtgtttagaacacagtttccaaaatgctctacgctcgcgaacatcgggaggaccaacatctacaaaaacaaaaaagactactacgatatgtatgaaccagagggggttaagatatttcggtgtccctctccaatctacttcgcgaacattggttttttccgccgcaagctgattgatgccgtgggcttcagcccgcttcgcatccttaggaaacgcaataaggctctgcggaagattcggaagctgcagaagcagggcctgcttcaagtgacacctattttgcaggagtttatcagaatcaaagtggacgtatatatcgttggaactgacgacgactttattgaaaagttgaataggtacgagttttttgacggagaggtaaagagttctatcttctttctgaccattcacgatgccgtgctgcatatcctcatgaagaaggactatagcaccagcaaatttaaccctagccaggaaaaggacggcaaaatcgacttcacgattaacacaaacggtggtctaaggaaccgcgtgtacgaagttcccgtagaaactaagttttag

SEQ ID NO: 205941 - DNA, 363 bp, Artificial Sequence
  Description of Artificial Sequence: Synthetic coding sequence
atgatcgagcccttcggcaaccagtacatcgtggcccggcccgtgtattcaaccaatgcctttgaggaaaaccataagaagacgggcaggcaccacaagactttcctggaccatctcaaagtgtgctgcagttgctcaccccagaaggcgaaaagaatcgtcctgtcgctatttccaatcgcgagctggctcccagcttaccgtctgaaagagtggcttctgtccgatatcgtctcgggaatatccaccgggatagtggcagttctgcagggactggcctttgcactgcttgtggacatcccaccggtgtacggtctgtacgcttcattcttccccgcgatcatatacttattctttggttag

SEQ ID NO: 205942 - DNA, 2343 bp, Artificial Sequence
  Description of Artificial Sequence: Synthetic coding sequence
atggccgcccccggcggccggagcgagcccccccagctgcccgagtattcttgctcctacatggtatcgcgccctgtgtatagcgagctggcctttcagcagcagcacgagcgaagattgcaggagcgtaagacactcagggaatcactcgccaagtgctgttcatgctctcgaaagcgcgcctttggtgtcctaaagacattggtacctatcctggagtggctgccaaagtatagggtgaaagagtggctgctgagtgatgtgatttccggggtgtccaccggactggtggctacccttcagggtatggcttatgccctccttgctgctgtgcccgttgggtacggcctgtactctgctttctttcctattctcacatactttatttttggcaccagcagacacatctctgtcggtccatttccagtagtgtcgctgatggtgggtagtgtggtcctcagcatggctcccgacgaacactttttggtgagctcaagtaacggaaccgtactgaacacaacgatgattgataccgctgcccgagacaccgcccgggttctcattgccagtgcactgacactcctggtgggtatcatacagctgatctttggtggcctgcaaattggattcattgtccggtacctggctgatccccttgttgggggattcacgacagctgctgccttccaagtcctggtgagccagctgaagatcgttttgaatgtgtctactaaaaactataatggtgtcctctcgatcatctacactcttgtcgaaatttttcagaatatcggcgacaccaatctggccgacttcaccgccggattgctgaccatagttgtgtgtatggctgtgaaggagctgaatgatcgcttcagacacaaaatccctgtcccaatccccatcgaggtgatcgtgaccatcattgcaacagccatatcatatggtgccaacctcgaaaagaattacaacgctgggattgtgaagtccatcccgagaggcttcctgcctccggaactgcctcctgtgagtcttttttccgagatgttggcggcctcattcagcatcgcggtggtggcttatgccatcgctgtctctgtcggaaaggtgtatgctaccaaatacgattacaccatagacggaaaccaggagtttattgcattcggcatcagcaatattttttcaggttttttcagctgttttgtggccactaccgccctttctagaacggctgtgcaggaaagcacggggggtaaaacgcaggtggcgggaattatttctgcggccatcgttatgatcgcaatactcgctcttgggaaactgctcgaaccactgcagaaaagtgtgttagcagctgtggttattgcaaatctcaaaggaatgttcatgcagctgtgcgacattcctcgtttatggcgccaaaataagatcgatgctgtcatatgggtctttacatgcattgtatctatcatcctgggcttggatttaggactcctagccggccttatttttgggttactgaccgtggtgttaagggtccagttcccttcctggaatggactcggttccattcctagcacagacatctataaatcaacaaaaaattataagaatattgaagagcctcaaggagtcaagattttgagattctcgtcgccgatcttctatggtaacgtggatggatttaaaaaatgtattaagtctaccgtaggttttgacgctatccgcgtctacaacaagagacttaaggctctgcgcaagattcagaagctcatcaagtctgggcagttgcgagctaccaaaaacggcatcatctctgacgctgtgtctacaaataacgcctttgaacctgacgaggacatcgaggacctcgaagagctcgatatccctaccaaagagatcgagatccaggtggactggaacagcgagttgccagtgaaggttaatgtcccaaaggtacccatccatagcctcgtgctggactgcggagctattagttttctggacgtggtcggcgtccgttcactgcgtgtgatagtaaaggagtttcagagaattgatgtgaatgtctatttcgcgagtctacaggactatgtcattgaaaaacttgagcagtgtggattttttgatgataacataagaaaagatactttttttcttacagtccacgacgccatcctttacctgcaaaatcaagtaaaaagtcaggagggacagggctcgatattagagacgattacattgattcaagactgtaaggacacacttgagctaatcgagacagagctgaccgaggaggagctggatgtacaagatgaagccatgcgcacacttgcatcatag

SEQ ID NO: 205943 - DNA, 396 bp, Artificial Sequence
  Description of Artificial Sequence: Synthetic coding sequence
atggccgcccccggcggccggagcgagcccccccagctgcccgagtacagttgctcctacatggtcagccgcccagtgtactccgagttagcctttcaacagcagcatgagcggagactgcaggagcggaaaacactgcgggaaagcctagccaaatgctgctcatgctccaggaagcgggcattcggcgtgttgaaaactctggtgcctattcttgaatggctgcccaaatacagagtcaaggaatggctcctttcggatgtgatctctggggtgtcaacgggcttggtggcaaccctgcaaggaatggcatatgccctgctagcagcagtaccagtcggctacggactgtattcggccttttttccaatccttacatatttcatttttgggtag

SEQ ID NO: 205944 - DNA, 1026 bp, Artificial Sequence
  Description of Artificial Sequence: Synthetic coding sequence
atgcggcacggcctggccgtgcccagcgtgctggccgccgtggtgattgcaaacctcaagggcatgttcatgcagctttgcgacatcccaaggctgtggcggcagaacaaaatagacgccgtgatctgggttttcacctgtatcgttagtatcatactgggtctcgacctgggattgttggcaggactcatatttggcctgctgactgttgtactgagagttcagttcccatcctggaatggactgggtagcattcctagtaccgatatatacaagagcaccaagaattataaaaacatcgaagagccccagggtgttaagatcctcagattctcgtcgccaattttttacgggaatgtggatgggttcaaaaagtgtatcaaaagcacagtgggctttgacgcaattcgagtgtacaacaagcgattgaaggccctgaggaagatccaaaagttgatcaaatccggccagctgcgtgctacaaagaatggaattatctccgacgctgtgtcaacgaataatgcttttgagccagacgaagatatcgaagacttagaagaattggacataccgacaaaggaaatcgagattcaagtggattggaactctgagttaccagtgaaggtgaacgtgcctaaggttcctatccattcactcgttttggactgcggggcaatcagctttcttgatgtggtgggcgtgaggtccctgagagtgattgtcaaggagttccagcgaattgacgttaacgtctacttcgcctccttgcaggattacgtcattgaaaagttggaacagtgcggttttttcgatgacaacatcaggaaagacacctttttcctgacggtgcacgacgcaatactgtatctgcaaaatcaagtcaaaagccaggaggggcagggaagcatccttgagactatcacattgatacaggattgcaaagatacccttgaacttatcgagaccgagctgacggaagaggagttggatgtacaggacgaggccatgcggactctcgcatcgtag

SEQ ID NO: 205945 - DNA, 1050 bp, Artificial Sequence
  Description of Artificial Sequence: Synthetic coding sequence
atgatcgccatcctggccctgggcaagctgctggagcccctgcagaagtcagtgctagcggccgtggtgatcgcgaatctcaaaggcatgtttatgcagctttgtgatattcctcgtctttggaggcagaacaaaattgacgcggtcatttgggtttttacctgtattgttagcattatcttggggttagacctgggtctgctagcagggctgatttttggactactaactgtggtgctgcgcgttcagttccctagctggaatggcctcgggtctatcccatcgactgacatctacaagtcgacaaaaaactacaaaaatattgaagaaccacagggggtgaagatactgcgattttcttcaccgattttttacgggaatgtcgacggatttaagaagtgtattaagtccacggtcggcttcgacgccatccgcgtgtacaataagagactcaaggcgctgcgtaaaatccaaaaactgatcaagagcggtcagttgcgcgccactaagaatggcattatcagcgacgcagtgtctacaaacaatgctttcgagcctgacgaagatattgaggacctcgaggagttagacatcccgaccaaggagatcgaaatccaggtggactggaatagtgagctgcctgtgaaggtaaatgttcccaaagtccccatccacagcctggttctcgactgcggtgcaatttcattcctagatgtggtgggcgtgcgctccttgcgcgtgatcgtgaaagaattccaaaggatagatgtgaatgtgtactttgcgtcactgcaggactacgtgattgaaaaacttgaacagtgtggcttttttgacgataatatcagaaaggacaccttttttttgacagtgcacgatgccattctttacctccaaaaccaagtgaagagccaggaggggcaaggatcgatcctcgagacgataacacttatccaagactgtaaagataccctggaactcatcgaaaccgagcttacagaggaggaacttgacgtgcaagatgaggccatgcggacgttggcctcttag

SEQ ID NO: 205946 - DNA, 1104 bp, Artificial Sequence
  Description of Artificial Sequence: Synthetic coding sequence
atgcggcacggcctggccgtgcccgtggccggcatcatcagcgccgccattgttatgatcgccattttagccctgggaaagcttctggagcccctccagaaaagtgtcctcgccgctgtggtgattgcaaatttgaaaggcatgttcatgcagctatgtgatatccctaggctgtggcgacaaaacaagatcgacgccgtgatatgggtcttcacctgtattgtgtctattattctgggactcgatctgggactcttggcgggcttaatctttggattgttaacagtggtcttgcgagtgcaatttccttcatggaatggtctcggctcaatcccctctacggatatctataagtctacaaaaaattataagaacatagaagaaccccagggtgtgaagattctgaggtttagctcccctattttttatggaaacgttgacggatttaaaaagtgcattaaatccacagtaggctttgatgccatcagagtttataataaacgccttaaggctctgagaaagatccaaaagttgattaagtctggtcagttacgcgccaccaaaaatgggataatctctgatgccgttagtacgaacaacgcctttgaacccgatgaagacattgaggacctggaagaactggacatccccacaaaggagatcgagatccaggttgattggaattccgagctgcccgtgaaggtgaacgtgccgaaagtccccatccactctctggtcctggattgtggcgccatcagctttctcgatgtcgtaggggtgagaagtctccgcgtgattgtcaaggagtttcaacgaattgatgtcaatgtttattttgccagcctgcaggactatgttatcgagaagctagaacagtgcggattcttcgacgataatatccgcaaggacacattttttcttacagtgcatgatgctattttgtacctgcagaatcaagttaaatcccaggaaggccaaggttctattctggagactatcacgctgatccaagattgtaaagacacccttgagctgatcgaaaccgaactgacggaagaggaattggacgtccaggacgaggccatgcgtacactggctagctag

SEQ ID NO: 205947 - DNA, 2235 bp, Artificial Sequence
  Description of Artificial Sequence: Synthetic coding sequence
atggaccacgccgaggagaacgagatcctggccgccacccagcggtactatgtggagagacccatattctctcatcctgtgcttcaagagagactgcatactaaagacaaggtccccgactccattgctgacaaattaaagcaggcattcacgtgcacccctaagaaaatcagaaatatcatctatatgtttcttcccatcacaaagtggctgccagcctataaatttaaagaatacgtgctgggggatttagtctcagggattagtacaggggtgctccagttgccccaggggctggctttcgcaatgttagctgctgtacctccaatattcgggttgtattccagtttttaccccgtgataatgtactgcttcctggggactagtcggcacatcagcataggtccattcgctgtaataagtctgatgatcggaggcgtggcggttcgtctggtgccggacgatattgtgattcccgggggggtcaatgccacaaatggaactgaggctcgggatgcactgcgcgtgaaagttgctatgagcgtgacgcttctttctggaatcatccagttctgtctaggagtgtgccgcttcggattcgtagcaatctatctgacagaaccgcttgtccgtggctttacaacagccgccgcagtgcatgtgttcacatctatgcttaagtacctttttggagtcaagaccaaacgctacagcgggatcttttccgtggtgtactctactgtagccgtgctgcagaatgttaaaaaccttaacgtttgttctttgggggtgggtctgatggtgtttggtttgctcctcggaggcaaagaatttaatgaacgtttcaaggagaaattgcccgcaccaattccattggaattcttcgccgtggtgatggggaccggaatatccgcgggatttaatctgaaggagtcctataatgtggacgtggtgggcactctgcctcttggcctgctacctcccgcgaatccggacacatcactcttccatctggtttatgtagacgctattgctatcgcaatagttggctttagcgtaacgatcagcatggcaaaaaccctcgctaacaagcacgggtaccaggtggacggcaatcaggaacttattgcacttggactctgcaacagtatcgggagcttgttccaaaccttctccatatcctgctcgctgagccgctccctagttcaggaaggtacaggtggcaagacccagctcgctggctgcctcgctagtctgatgatactgctcgtcattctggctaccgggtttttgttcgagagcctgccgcaggccgtactgtccgctatagtcattgtaaatctgaagggtatgtttatgcagtttagtgatcttccctttttctggcgcacttctaagatcgagttaacgatttggttaacaacatttgtgtccagtttgtttttaggattagattacgggctaataaccgctgtgattattgccctgctcaccgtaatctataggacccagtccccatcctataaggtgctcggtaaacttccggagaccgacgtgtatatagatatcgatgcctacgaagaggttaaagagatccccggaattaagatttttcaaatcaacgctcctatatattacgccaactcagacctgtatagcaatgccctcaaacgcaagaccggggtgaaccccgcagtcatcatgggcgcccggagaaaggccatgcgtaaatatgccaaagaggttggcaacgccaatatggccaatgccacggtggtgaaggcggacgcagaagtggacggggaagacgccaccaagcccgaggaagaagatggcgaggtgaaatatcctcctatcgtaataaagtccaccttcccagaggaaatgcaaagattcatgccacctggcgataacgtgcacaccgtcatcctggactttacacaggtaaatttcatcgactccgtgggagtgaagacgctcgccggtatcgttaaggagtacggggacgtgggcatctacgtgtacctggccggatgcagtgctcaggtggtcaacgaccttacacggaaccggttttttgagaacccagccctgtgggagctgcttttccacagcatccacgatgctgtgcttgggtcccaactgcgagaggcactagccgagcaggaggcttcggccccccctagccaggaggatttggaacctaatgccacacccgcaacaccagaggcctag

SEQ ID NO: 205948 - DNA, 2058 bp, Artificial Sequence
  Description of Artificial Sequence: Synthetic coding sequence
atggaccacgccgaggagaacgagatcctggccgccacccagcggtattatgttgagcgcccgattttcagccatcctgtgctgcaggaacggctacatacgaaggacaaagttccagattcgatcgccgataagttgaaacaggcgtttacttgtacccccaagaaaatccggaatattatctatatgtttctgccaatcaccaagtggctgcctgcctacaaatttaaggaatatgtgctgggagacttggtgagcgggattagtacgggggtgctccagcttccacagggacttgcttttgccatgcttgccgccgtgcccccaatcttcgggctgtatagtagtttttatcccgtgatcatgtactgcttcctgggcacaagtaggcatatttcgattggtcccttcgcagtgatctcactgatgatcggcggcgttgctgtccggctggtccctgatgacattgtcatcccaggtggagttaatgccaccaatggaaccgaagcccgggatgccctgcgcgtgaaagtggccatgagcgtcaccctcctgagcggtatcatccaattctgcctgggagtgtgtcgatttggcttcgtggcgatctatctaacggaaccactcgttagggggtttacaacagcagcggcggtccatgtcttcacatccatgctgaagtacctcttcggcgtgaagaccaagcgatattctgggatattcagcgtcgtgtatagtaccgtggcagtgctacaaaacgtgaagaatctcaacgtttgctctttaggcgtggggctgatggtgttcggccttttgttaggcggtaaagagttcaatgagcgatttaaagagaagttgccagcgcccattcctctggagttcttcgcagtcgttatgggaaccggcatctctgctggatttaacctcaaagaaagctataatgtggatgttgtgggcaccctgccactcggactgctgccccctgccaatcccgacacttctttgtttcacctggtatacgtcgatgcgatcgccattgctatcgtaggcttttcagtgacgataagcatggctaaaactctcgccaacaagcacggctatcaggtcgatgggaaccaggagttaattgccttgggcttatgcaattccatcggctcactgttccagacgttctctatctcgtgcagcctgagccggtctctggtgcaggaaggcactggtggaaaaacccagctcgcggggtgccttgcgtcactgatgatcctcctggtaatcttggctacaggctttctgttcgagtcactgccacaggctgtgctctccgccatcgtcatcgttaacctgaagggcatgttcatgcagttctctgacttgccatttttttggagaacctcaaaaattgagctgacaatatggctgactactttcgtaagctctctgtttctgggcctggactatggcctgataaccgccgttatcattgctctgctgaccgtgatataccggacacaatccccatcttataaggtcctgggtaaactgcctgagacagatgtctacatagacatcgacgcctatgaagaagtgaaggaaatccctgggattaagatattccagattaatgcccctatctactatgcgaacagcgatctttacagcaacgctttaaagagaaagacaggggtgaatcctgctgtgattatgggcgcccgacgcaaggccatgcgcaagtatgccaaagaagtgggcaacgccaatatggcaaacgctactgtcgttaaagcagatgctgaggttgacggggaggacgccactaaaccggaagaagaggacggggaggtaaagtatccacccatcgtgattaaatcaactttccccgaggaaatgcagaggttcatgccccctggggacaatgtgcataccgtgattctcgacttcacacaggtgaactttattgatagcgttggggtaaaaaccttggctggcatagttaaagagtacggggacgtgggtatatacgtctatctggctgggtgctcggcgttcattcaaaggtag

SEQ ID NO: 205949 - DNA, 534 bp, Artificial Sequence
  Description of Artificial Sequence: Synthetic coding sequence
atgggcgcccggcggaaggccatgcggaagtacgccaaggaggtggggaacgccaatatggcaaacgctaccgtcgttaaagctgacgcagaggttgacggcgaagatgcaactaagcctgaggaagaagacggagaggtgaagtatccgccgattgttattaaaagcacgttccccgaggagatgcaaagattcatgcctcctggagacaacgttcacacagtcatccttgacttcacccaggtcaacttcatcgactccgttggtgttaaaaccttggccggcattgtgaaagaatacggtgacgtcggcatttacgtgtacctcgccgggtgtagcgcacaggttgtcaatgacttaactcgcaaccgttttttcgaaaacccagccctttgggaactgctgttccactctatccacgatgccgtgctcggctctcaactcagggaagcactggctgaacaggaggctagcgctccacccagccaggaggacctggagcccaatgcgactcccgctacgcccgaagcatag

SEQ ID NO: 205950 - DNA, 1008 bp, Artificial Sequence
  Description of Artificial Sequence: Synthetic coding sequence
atggaccacgccgaggagaacgagatcctggccgccacccagcggtattacgtggaacgacccatctttagtcacccagtgctgcaagagagactgcataccaaagataaagtgcccgattctatagccgacaaacttaagcaggccttcacatgcacccccaagaagatccgaaatatcatctatatgtttctgccaatcaccaagtggctccccgcatacaaatttaaagagtacgtgctgggcgatctggtctctgggatatcaaccggcgttcttcagttaccacaggggctggcattcgccatgctcgctgctgttccacctattttcgggctctattcatctttctacccggtgataatgtattgctttctcggcacctctaggcatataagcataggacctttcgccgtgataagcctcatgattggcggagtcgctgtgagactggtgccagatgacattgtgatcccagggggagtaaacgcaaccaacggcacagaagcgcgcgatgccctgcgagtcaaggttgccatgagcgtgactctgctaagtggaatcattcagttttgcctgggcgtgtgtcgttttggcttcgtggccatttacctcactgagcctctcgtcagaggcttcactaccgctgcagcggtgcatgtatttacatctatgctgaagtacctatttggagtcaagaccaagagatattcgggaatcttcagcgtcgtgtacagtactgtagccgtcctgcagaatgtgaagaacctgaatgtttgctcccttggggtgggcttgatggtctttggactgcttctggggggcaaggaatttaacgagaggtttaaagaaaagctgccagcccccattccacttgagttcttcgcagtggtgatgggcacgggcatctccgcagggtttaacctcaaagaatcttataacgtggacgtagtgggtactctacctctgggtttccacactgagatgacaaggagatggcgcccttag

SEQ ID NO: 205951 - DNA, 2145 bp, Artificial Sequence
  Description of Artificial Sequence: Synthetic coding sequence
atggaccacgccgaggagaacgagatcctggccgccacccagcggtactatgttgagaggcccatcttctcgcatcctgtgctccaagagcgcctgcacacaaaagacaaggtcccagatagcatcgctgataagctgaaacaggctttcacttgcacccccaagaaaattagaaatatcatttatatgttcttacctatcacgaagtggctacccgcttataagtttaaggagtatgttttgggagacctggtgtcaggcatttcaaccggcgtcctccagctgccccagggccttgcttttgcgatgctagcagcggtgccgcccatctttggcctctactccagcttttaccccgtgatcatgtactgttttctgggaaccagcaggcatatctctattggccccttcgcagtgatcagcctaatgatcggaggggtggccgtgaggcttgtgccagatgacatcgtgatccctgggggcgtgaacgccactaatgggaccgaggctcgcgacgcactgcgcgtgaaggtggctatgtctgttactctgctgtcaggaattatccagttctgcctcggagtgtgtcgtttcgggtttgtggccatttatctcacagagccccttgtgcgcggtttcaccaccgcagcagcagtacacgtgtttaccagcatgctgaaatacctgtttggggtcaagacaaagcgttattctgggatcttttctgtcgtgtactctaccgtggctgtactgcagaacgtgaaaaacctcaatgtctgctcactgggagtgggattgatggtttttgggctactgttgggtggcaaagaatttaacgaacgctttaaggagaaactgcccgctcccattccattggaatttttcgccgtggttatgggaacgggaataagcgccggttttaatctcaaagaaagctacaacgtcgatgtggtgggcacattgcccctgggcctcttgccccccgctaatccggacacctctcttttccatctggtgtatgtggacgccatagccatcgctatcgtgggattttcggtgacaatttctatggccaaaacactcgccaacaagcacgggtaccaggttgacggtaatcaagaactgatcgcactgggcctctgcaattcaatcggctccctgttccagacatttagtattagctgcagtttaagcagatcactggtccaggaaggtacaggcggaaagacccaattagctggttgtttggcctctttaatgattttgctagtgattctggctacaggcttccttttcgagagtctacctcagaccatatggctcacaaccttcgtgtccagtctgttcttgggcttagactacggcctgatcaccgctgtgatcatagcactgctcaccgttatctatcggacccagagtccaagctacaaggtgctgggcaagctgcccgaaaccgacgtgtacatagacattgatgcatatgaggaggtgaaagaaatccctgggattaagatattccaaataaacgcccctatttactacgcaaactctgatctctactctaacgcattgaagagaaaaaccggcgtgaacccggccgtgattatgggggctcggagaaaggccatgcgcaagtatgctaaggaggtgggaaacgccaacatggctaacgccaccgtggtcaaggccactcaggatgcagaagtggatggcgaagacgctaccaaacctgaggaggaagatggcgaggtgaagtacccccccatcgtcatcaaaagcaccttccctgaggaaatgcagagatttatgcctcccggagataatgtgcacacggtcattttggactttacacaggtgaacttcatagactctgttggcgttaaaaccttggcaggtatcgtaaaagagtatggcgacgtgggtatttacgtgtacctggccggttgctccgcccaagtggtgaatgacctgactagaaaccggttcttcgagaatcctgcattatgggagctgttgtttcattctattcacgatgctgtactaggttctcagcttcgcgaggctctggctgagcaggaagcaagcgcgccccctagtcaggaagacctcgaacctaatgctactcccgcaactccagaagcgtag

SEQ ID NO: 205952 - DNA, 2241 bp, Artificial Sequence
  Description of Artificial Sequence: Synthetic coding sequence
atggaccacgccgaggagaacgagatcctggccgccacccagcggtactatgtggaacggccaatcttcagccaccccgtactgcaggaacgcctccataccaaagataaggtgcctgactctatcgcagataaactcaaacaggcctttacttgcacgccgaaaaaaatccggaatattatctacatgttcctgccgataaccaaatggctgcccgcctacaagtttaaggagtatgttcttggcgatcttgtttctggcatctccactggagtgctccagctgcctcagggcctagcctttgccatgctggctgcagtgcctcctattttcggtctgtattccagcttctaccctgtgataatgtactgtttccttggcacctcacgacacatttccatcggcccgtttgccgtgatatctctaatgattggcggggtcgctgtccgactggttcctgatgatatcgtgatccctggcggtgtcaacgccactaacggcaccgaggctagggatgccctgcgtgtcaaagtcgctatgtccgtcacgctgttgtcgggtattatccagttttgtctaggcgtgtgcagatttggcttcgtggcaatttatctgacagagcctttggtgagagggttcacaacagctgcagccgtccatgtgttcacaagcatgctgaagtacctctttggagtgaagaccaaacgctacagcggaatcttcagtgttgtgtactcaacagtggcagtgttgcaaaacgtgaagaatttgaacgtgtgtagcctgggagttggactgatggtttttggcctgttgctgggtggcaaggagtttaacgaaaggttcaaggaaaaactcccagcgcctataccactcgagttcttcgctgtggttatgggaactggaatttctgcaggctttaatttaaaagaatcgtataatgtggacgtggttgggaccctgcctttagggctgctgcctccagccaaccctgatacatcactcttccacctggtatacgtcgatgccatcgccatagcaatcgtcggattttccgttactatctctatggccaaaacgcttgccaacaagcatggctaccaagttgacggtaatcaggagctcattgcattggggctgtgcaacagtatcggttccctgttccagacctttagcatctcatgtagcctgtctagaagccttgttcaggagggcacggggggcaagacacagttagccgggtgtctggcctcactcatgattctgttggtcattcttgcaacaggcttcctttttgagtctttgccacaggctgtgctgtcagccattgtgatcgtgaatctgaaagggatgtttatgcagttctccgaccttccttttttctggcggacctcaaaaatcgagcttaccatctggttaacgacttttgtgtcaagcctatttttagggttagattacgggctcattactgcggtgatcattgctcttctaactgtgatttaccgcacccagtctccttcttataaggtgctgggcaagttacctgaaactgatgtatacatcgacatcgacgcttacgaggaggtcaaagaaattcctggtatcaaaattttccagataaatgcccctatctactatgcaaatagcgatctgtactctaatgccctgaagcggaagacaggggtgaatccggctgtgattatgggcgccagaaggaaagccatgagaaagtatgctaaagaggtcggcaatgcaaatatggccaatgccaccgttgtgaaagctacccaggacgctgaggtggacggcgaagacgccacaaaacctgaagaggaagatggagaagtgaaataccctcctattgtgattaaatcaacgttccccgaagagatgcagagattcatgccccccggcgataacgtgcatacggtaatcctggatttcacccaagtcaactttattgactctgtcggcgtcaaaactctggccgggatcgttaaagagtatggggacgtgggcatctacgtctatcttgccgggtgttccgcccaggtcgtcaacgacttgactagaaaccggttcttcgagaaccccgctctgtgggagctgttgtttcatagtattcacgacgccgtcctcggcagccaattaagagaagccctcgctgaacaagaggcatccgccccaccatcccaggaggacttggaacccaatgccacacccgccacaccagaagcgtag

SEQ ID NO: 205953 - DNA, 2124 bp, Artificial Sequence
  Description of Artificial Sequence: Synthetic coding sequence
atggaccacgccgaggagaacgagatcctggccgccacccagcggtattatgtcgagcgtcctatttttagccatcccgtccttcaggaaaggttacacaccaaggacaaggtcccggactcaatcgctgataagctgaagcaggccttcacttgtacaccaaagaaaatccggaatataatttatatgttcctcccgataactaaatggctgccggcatataaattcaaggagtatgtgcttggcgacttagtgtctgggatcagcacgggagtgctgcagttgcctcagggaccgttcgccgtgatctcgctgatgatcggaggggtcgccgttaggcttgtgccggacgatatcgtgatcccggggggtgtgaacgcgaccaacggcacagaggcccgagatgctctcagggtgaaggtagccatgagcgtgaccttgctgtccggaatcattcaattctgtctcggggtttgcagatttggcttcgtggcaatttacctcacagagcccctcgtacgcggtttcaccactgctgcagcagtacacgtgtttacttccatgctgaaatacctgtttggggtgaaaacgaagcgttattcgggaatcttcagcgtggtttactctaccgtagctgtcctgcaaaacgtcaagaaccttaacgtgtgctccctgggggtcgggctgatggtgttcggtcttctgctgggagggaaggaatttaatgaacgattcaaggaaaagctcccagccccaattccgctggagtttttcgcagtcgtgatgggaaccggtatcagtgccggttttaacctgaaagaatcttataacgtcgatgtggtgggaaccctgccgctcggtcttctgcctcctgctaatccagacaccagcctgtttcacctagtttatgtggacgcaattgcaatcgcgatagtgggctttagcgtgaccatcagcatggcaaagacactcgctaataaacatggctaccaagttgacggcaatcaggagcttatcgctctgggtctttgtaatagtattgggagcctatttcagacattcagcataagctgctccctgtccagatctctggtccaggaggggacgggtggaaagacacaactggccggatgcctcgcctcactcatgattctcttggtaattctggcaacaggatttctgttcgaatctttgccacaggctgtcctctcagctattgtgatcgtaaacctaaaaggaatgtttatgcagttcagtgaccttccctttttctggcgtacgagcaagatcgagctgaccatttggctcacaactttcgtttcctcgctttttttagggctggattacggcctcatcacggccgtcatcattgcattgctgactgtgatatatagaacacaatcgccaagttataaagtgctgggaaaactgcccgaaaccgatgtgtacatagatatcgatgcttatgaagaggtcaaggaaattccagggatcaagatctttcaaattaacgctcctatctactacgccaatagtgatctttattccaatgcactgaaaaggaaaactggggtgaatcccgccgttatcatgggcgctaggagaaaagcaatgcgcaaatacgcgaaggaagtggggaacgcgaatatggccaatgcgaccgtggtaaaggcagacgctgaggtggatggggaggatgccactaagcctgaggaggaggatggtgaagtaaagtacccccctatcgtaatcaagtcgaccttcccagaggagatgcagcggttcatgccacccggggacaacgtgcatactgtcattctggactttacacaagttaacttcatcgacagtgtgggggtcaagacactcgccggaattgtcaaggaatatggagatgtgggtatctacgtgtatctcgccggctgttccgctcaagtagtaaacgatttaactaggaatagattttttgaaaacccagcactgtgggagttgctcttccactcaatccacgatgccgttctggggtctcagctccgtgaggccctggctgaacaggaagcctctgccccgccatcccaggaggaccttgagccaaatgcaaccccggccacccccgaagcttag

SEQ ID NO: 205954 - DNA, 2139 bp, Artificial Sequence
  Description of Artificial Sequence: Synthetic coding sequence
atggaccacgccgaggagaacgagatcctggccgccacccagcggtactatgtagagaggcctatttttagccaccctgtcctccaagagcggttgcacaccaaagataaagtgcctgattcgattgccgataagctaaagcaggcctttacatgcacccccaagaagatcagaaatataatctacatgttcctgccaattacaaagtggctacccgcttataagttcaaggagtacgtgctgggcgacctagtgagcggtatttctactggcgtccttcagctgccacagggcctggccttcgccatgttggccgctgtgccgcccatatttggcctgtactcttctttctacccagtgatcatgtactgttttctgggaactagccggcacataagtatcggaccttttgcagttattagcttaatgattggtggggtggccgtccgcctcgtgcccgatgatattgtcattcctggcggcgtgaatgctaccaatggaacagaagcccgggacgcacttcgcgtcaaggtagccatgagcgtgacgctgctgtctggcataatccagttctgtctcggagtttgtcggttcggctttgtcgcgatatacttaaccgagccattggtacggggtttcaccacagctgcagccgtgcatgtcttcacgtctatgctcaaatacttatttggggttaagactaaacgctacagcgggatcttctccgtggtgtattcgaccgtcgccgtgctgcagaacgttaagaacctcaacgtatgttccctgggggtcggtttgatggtgtttggactattattgggggggaaagaattcaatgaaagatttaaggagaaactgccagctcccattcccttggagtttttcgctgtcgtcatggggacaggtattagtgccggctttaatctgaaagaaagctataacgtggacgtggtgggcaccctgcctctggggttgttaccacccgcaaatcccgatacaagtttgttccatctggtgtacgtcgacgccatcgcaatcgctatcgttggattctctgtcacaatcagtatggctaagacactggccaacaagcacggctaccaggtggacggcaatcaggaactgattgcattgggtttgtgcaattctatcgggagcctgttccaaactttcagtatcagctgctcgctgtcacgctcacttgtccaggaaggcacagggggcaaaacacagctggcagggtgtctcgcttctctgatgatcctgctagtgattctggcgacaggcttcctcttcgagtccttgccgcagacaatctggcttaccaccttcgtttcatcactttttctgggtctagattatgggctgattaccgcggtgatcattgctctgcttacagtaatttatcgaactcaatctccttcatacaaagtgctcggcaagctcccagagaccgatgtgtacatagacatcgacgcctatgaggaggtgaaagagatccctggcattaaaatatttcagattaacgcgccaatttattacgccaatagtgatctctattccaacgccctgaagcggaagacaggagtgaatcctgcagtcattatgggcgcaagaagaaaggcaatgcgcaagtatgccaaggaggtaggcaatgctaacatggccaatgccacagtggtaaaggcagatgctgaggtggatggcgaagacgctacgaagccagaagaggaggatggcgaggttaaatacccaccaatcgtgattaagagtacatttccagaggaaatgcagaggtttatgccccctggggataacgtgcacactgtaatactggatttcactcaagtgaattttattgactcagtgggtgtcaagacactggcgggcatagtgaaagagtacggggacgtcggtatctacgtgtatctggctggatgctctgcccaggtcgtcaacgacctgactcggaaccggttttttgagaatccagcgctctgggagctgcttttccatagtatccatgacgccgtacttgggtctcagctgcgcgaggccctcgcagaacaggaggcctccgccccaccatcacaggaggacctggaaccaaacgctaccccagccactcccgaggcgtag

SEQ ID NO: 205955 - DNA, 1551 bp, Artificial Sequence
  Description of Artificial Sequence: Synthetic coding sequence
atggaccacgccgaggagaacgagatcctggccgccacccagcggtattatgtggagcgccccattttctcccaccctgtgctacaagagcgactgcacacaaaggacaaggtcccagattccattgcagataaattaaaacaggcgttcacgtgtacacctaaaaaaattcgtaatattatttacatgtttttgccaatcactaaatggctgcccgcctataaatttaaagaatatgtactcggagatttggtgtcgggcatctcaactggcgtcctgcagttacctcagggtcttgcatttgcaatgttggctgcggttcctccgatttttggtctgtacagttccttttaccccgtgatcatgtactgcttcctcggcacttctagacacatctctatcggcccattcgctgttatttccctaatgataggtggagtggcagtgcggctggtccccgacgacatagtcataccaggcggcgtcaacgccacaaacggtaccgaggcaagagacgctctgagagtgaaggtggcaatgtccgtgacattgctgagtggcatcatccaattctgtcttggagtctgcagatttggctttgtagccatttatcttaccgagccgctggtgcgcggttttacaaccgcagccgcagtgcacgtgttcacttctatgctaaaatatctattcggagtcaagactaaacgatactccgggatcttctccgttgtttacagtactgttgcggtgctgcagaacgtgaagaatttgaatgtgtgcagtctcggcgtcggtctgatggtgttcggactgctgctgggtggcaaggagttcaacgagagatttaaagagaagctgccagcccccatacctttagaattcttcgctgtggttatggggaccggcatcagcgcgggttttaaccttaaggagtcttacaatgtagacgtggttggtaccctcccactgggattgctccctcccgccaatcctgacacttctttgtttcacctcgtgtacgtggacgcgattgcgatagccatcgtgggtttttccgtaactatcagcatggccaaaaccttggccaacaaacacggctatcaggtggacggaaaccaggaactaatcgcccttggtctgtgcaattctatcgggtcactgtttcagacattctccatctcatgttccctctctaggtccttggtgcaggagggtacgggcggaaaaacccaactggcggggtgcctggcatccctcatgattttacttgtgatcttggccacagggtttctcttcgagtcccttcctcaggcggtgctgtcagcaattgtgattgtgaatctgaagggcatgtttatgcagttttcagatctccccttcttttggaggacgagcaaaattgaattaacaatctggctgaccacattcgtttcttcactgttcttaggtctagactacggcctgataactgccgtgattatcgccctgctaactgtgatctaccgcactcagtcttttcacaccgaaatgactaggcgctggagaccctag

SEQ ID NO: 205956 - DNA, 1422 bp, Artificial Sequence
  Description of Artificial Sequence: Synthetic coding sequence
atggaccacgccgaggagaacgagatcctggccgccacccagcggtactatgtcgaacgccccatcttctcccaccctgtgctgcaggagaggttacacaccaaggacaaggtacctgatagtatcgctgacaagcttaaacaggctttcacatgcactcccaagaagatcaggaacatcatatacatgtttctcccgatcacaaaatggctgccagcttacaaatttaaagaatacgttttaggagatttagtcagtggtatttccaccggggttttgcaactcccacagggcctggcatttgccatgctggccgccgtgccccccatcttcggcctgtacagctccttctaccccgtgattatgtattgcttcctcggaacctcccgccacatcagcataggacccttcgcagtgattagcttgatgataggcggagtggccgtgagactcgtccccgatgatatagtaatccccggaggcgtaaacgctaccaatggcactgaggccagagacgccctgagggttaaggtcgctatgtccgtaactcttttatccggtatcattcaattttgcttgggagtgtgtcgattcggtttcgtggccatttacctgaccgaaccactggtgagaggctttaccacagccgcagccgtgcacgtgttcacatccatgctgaagtacctgtttggggtgaagacaaaaagatacagcggaatattttcagttgtgtatagtactgtcgccgtactgcaaaatgtgaagaatcttaatgtgtgcagcctgggcgtgggactaatggtgtttggcctgttactgggcggcaaggagttcaacgagaggtttaaggagaaactccctgctcccatcccacttgagttctttgcggttgtaatgggcaccggcattagcgctggcttcaatctgaaagagtcttacaatgtcgatgtcgtggggaccctcccactcggtctgttgcctccggccaatccagacacgagtctgttccacctggtgtatgtagatgccatcgctatcgcgatcgtcggcttttccgttacaattagcatggccaaaacactcgccaacaaacatggctatcaagttgatgggaatcaggagctcatcgcactagggctgtgtaatagtattggtagtctcttccagactttcagtatttcttgctccctctctcgctccctggtccaagaagggactggcggaaagacccagcttgcggggtgtttagctagcctgatgattctgctggtgattcttgcaactggatttttgttcgagtccctgccgcagaccatttggctcacaacattcgtctcaagtctgtttttggggctggattacggccttatcacagctgtcatcatagccctcctgactgtgatctaccggacccaaaggtag

SEQ ID NO: 205957 - DNA, 2139 bp, Artificial Sequence
  Description of Artificial Sequence: Synthetic coding sequence
atggaccacgccgaggagaacgagatcctggccgccacccagcggtactacgtcgaacgcccaattttttctcatcccgtgctacaggaaaggctacacacgaaggacaaggtaccagattccattgcggataagcttaaacaggccttcacttgcacacctaaaaagatcagaaacatcatttatatgttcctgcccatcactaagtggctgccagcctacaagttcaaagagtatgtgttaggggaccttgtctcaggcatttccacaggcgttctgcagttgccacaaggactggctttcgccatgctggccgccgtgccgccaatctttggcctatattcctccttttatcctgtgattatgtattgttttctgggtaccagccggcatatctctatcggaccttttgccgtgatttctctgatgataggcggagtcgccgtgaggctggtacccgacgatatcgtgatcccaggtggagtgaatgcgacaaatgggaccgaagcccgcgacgccctgagggtgaaagtagccatgtcagtcacattgctcagcgggattatccagttttgtctgggtgtctgcagatttggcttcgtagccatctacttgacagaacctctggtcagaggtttcactaccgccgccgcagtacacgtctttacgtcaatgctgaaatacctgttcggagtaaagaccaaaaggtacagtgggattttctctgtggtgtactctactgtggccgttctgcagaacgtcaagaacctgaatgtatgcagcctgggggtcggcctgatggtgttcggactgcttttagggggaaaggagtttaatgagcggtttaaggagaaactgcccgcccctatccctctcgagttcttcgccgtcgtcatggggacaggaattagtgcaggcttcaatctcaaggaatcttacaatgttgacgtggttgggacattgcctctgggccttctgccgccagccaatcctgatacctctttgttccacctggtttacgtggacgcaatagcaatcgcgattgtcggtttcagcgtcaccatctccatggcgaagacgctcgcgaataagcacggctatcaagtggacgggaaccaggagctgatcgcactgggcctctgtaatagtatcgggagtcttttccagacattcagcatctcttgctcgctaagccggagcctggttcaagaggggaccggcggtaaaactcagctagcgggctgcttagcttccctcatgatcctgctcgtgattctggctacaggttttctgtttgaatcgcttcctcagaccatctggctgacaactttcgtgagttctttgtttttgggtttggattacgggctgattacagcagtcatcatcgccttattgaccgtgatctatcgaacacagagtccatcctacaaagtgctgggaaaactgcctgagaccgacgtgtatatcgacatcgatgcttatgaggaggttaaagagatccctggcattaaaatttttcagatcaatgcacccatttattatgctaattctgacctttacagcaacgctcttaagaggaagacaggagttaacccggcagtcattatgggagctcgaagaaaggctatgcgcaagtacgccaaagaggtgggcaatgcaaatatggctaacgcaactgttgtgaaggccgacgcagaggtggacggagaagatgcaaccaaaccagaagaagaggatggcgaagtgaaatacccaccgatcgtgataaaaagtactttcccagaagaaatgcagaggttcatgcctcccggtgataacgtacacaccgtgatcctggacttcacccaggtcaatttcattgatagcgtgggagttaagacattggcgggaattgtaaaggagtacggcgacgtgggcatttacgtgtatctggctggttgttctgcccaggtcgtcaacgacttaactcgcaacaggtttttcgaaaacccagccctgtgggagttacttttccactccattcacgatgctgtcctgggctcccagctgagggaagcccttgccgaacaggaagctagtgctcccccttctcaggaagatctcgagcctaatgccacacctgctactcctgaagcatag

SEQ ID NO: 205958 - DNA, 1344 bp, Artificial Sequence
  Description of Artificial Sequence: Synthetic coding sequence
atggaccacgccgaggagaacgagatcctggccgccacccagcggtattacgtggagcggccaatcttttcgcaccccgttcttcaggagcggctgcacacaaaggataaagtgcctgactccatcgcagataaactcaagcaggccttcacatgcacacctaagaagatccgcaacattatttatatgtttttgcccatcacaaagtggctgcccgcctataagttcaaggaatatgtgctgggagatcttgtatcaggaatctccacaggcgtcctgcagctgccacagggtttagcatttgctatgcttgcagctgtgccacctatcttcggcctgtatagctctttctaccccgtcattatgtattgtttcttaggaacaagccggcatatcagcatcggtccatttgctgtaatctcactgatgatcggcggagtggctgtgcggctagtcccagacgacatcgtcattcctggtggcgttaacgctaccaatggcaccgaggcgagagacgctctgcgggtgaaagtggcgatgtcagttacccttttgtccggtataatccagttttgcctgggagtctgccgctttggattcgtggctatatatttgacggaacccttggtcagaggtttcaccacggcagctgccgtgcacgtgttcacgtccatgcttaagtacctattcggcgtgaagaccaagcgatattctggcattttctccgtcgtctacagcacagtggccgtactgcagaatgttaagaatctgaacgtttgctccttaggtgtcgggctaatggtttttggcctcttgctcggtggcaaagaatttaatgagaggtttaaagagaaactcccggcccccatcccactggagttttttgccgttgtaatgggtaccggaatttctgctgggttcaacctgaaggagagctacaacgtggatgtggttggtactctacccctggggttgctgccgcccgccaacccagacacttcacttttccatttggtatacgtcgacgccattgcgatcgcgatcgttggattttcggtgaccatctcaatggccaagactctggccaacaagcatggatatcaagtggatggaaatcaggagcttatcgcactgggcctctgtaatagtattggatccctgttccagacattctccatcagttgttccttatcccggtcactggtgcaagagggaactggcggcaagacacagacaatctggctcacaacattcgtgagcagtctgttcctagggcttgactacggacttattaccgcggtgatcatcgcgttattgacagtcatttatcgcacccagaggtag

SEQ ID NO: 205959 - DNA, 1956 bp, Artificial Sequence
  Description of Artificial Sequence: Synthetic coding sequence
atgggcctggccgacgccagcggcccccgggacacccaggccctgctctcggccactcaagcaatggatctgaggcggcgcgattaccacatggaacgacccctgctgaatcaagagcaccttgaggagctaggccggtgggggtccgcacccagaacacatcaatggaggacatggctacaatgttcaagagctcgggcttacgcactgctactgcaacacctccccgtgctcgtatggctgccaaggtatcccgtgagagactggctacttggggacctcctgtctggcctgtcggtggccattatgcagctcccccaaggtctggcctacgctctgctggccggcctgcccccagtcttcgggttatatagctccttttatcctgtctttatctactttctgtttgggacaagccgccatatctctgtggttctggaggtgtgctggaagctgcctcagtccaaagtcggaactgtggtcactgccgcggtggcgggtgttgtcttagtggtggttaaattgctcaacgacaagctccagcagcagctccctatgcctatccctggggaactcctgaccttaattggggctacagggatctcatacgggatggggttaaagcataggtttgaagtagacgtggtgggaaatatacctgcaggcctcgtccctcccgttgcgccgaacactcagctttttagtaagttagtcggaagcgccttcactatcgcagttgtgggctttgccatcgcgatcagccttgggaagatctttgcactcagacatggctatagggtggattctaaccaggagttagtggccctcggcctctcaaacctcattggtggtatttttcagtgcttccccgtttcctgctccatgtcccggagcctggttcaagagagcacaggcggcaactcacaggtggccggagctatatcatcactgttcatcttattgattatcgtcaagttaggagaactgtttcatgacctgcctaaggcggtgctcgcggccatcataatcgtgaatttaaagggaatgttgcggcagttgtctgatatgaggtctctttggaaagcaaacagagccgacctccttatttggctagttaccttcacagccacaatcctactgaaccttgacctgggattggttgtggcggtgattttttcactgcttcttgtggtcgtccgcacccagatgccacactactccgtgctgggccaggtgcccgataccgatatctatcgcgatgtcgcggaatatagcgaggctaaagaggtcaggggagtaaaagtgttccgatcatcagctaccgtgtatttcgccaatgccgagttctactctgatgccctgaaacagagatgtggcgtggacgtggatttcctgataagccagaagaagaaattactcaagaagcaggagcagctgaagcttaaacagcttcaaaaggaggagaagctgaggaaacaagccgcctcccccaagggggctagcgtttccatcaatgtaaataccagtctggaggatatgaggtctaataacgttgaagactgcaaaatgatggtcagctccggagataaaatggaagacgctaccgccaacggtcaagaggatagtaaagctcccgatgggagtactctgaaagccctggggcttccccaacctgactttcactccctgatcctggatctgggcgccctgagttttgttgatactgtgtgcctaaaatcattgaagaacatctttcacgattttcgcgagatcgaggtggaagtgtacatggccgcatgccatagccctgttgtgagccaactggaggctggccattttttcgacgcctccataactaaaaaacatctatttgcatccgtgcacgacgctgtgacattcgcactgcagcatcccagaccagtgcccgattctcccgtatccgtgacccgcctctag

SEQ ID NO: 205960 - DNA, 2217 bp, Artificial Sequence
  Description of Artificial Sequence: Synthetic coding sequence
atggacctgcggcggcgggactaccacatggagcggcccctgctgaaccaggagcacctcgaagaactaggccggtgggggtctgccccccgcacacatcagtggcgtacctggctccaatgtagtcgagctcgggcctatgcgttactgctgcagcatctgcccgtgctcgtctggctcccccgatacccagtccgggattggcttctcggcgatctgttgagcggcctaagtgtcgccatcatgcaactcccacagggattagcgtatgccctgttggcgggcctgccacctgtctttgggttgtacagcagcttctaccctgtttttatttatttcctgtttggcacctcccggcatatctctgtgggcaccttcgccgtcatgtcagtcatggtcgggtctgttactgaatccctggccccgcaggctttgaatgactcaatgatcaatgaaacggctagggatgctgcccgcgtccaggtggcctctacattaagcgttttggtgggactcttccaggtaggactaggccttattcatttcgggttcgtggtcacctacctcagcgaacccctggttcggggttacactaccgcagccgctgtccaggtcttcgtgtctcaattaaagtacgtgtttggcttacatttatcttcacattcaggcccgctctcgctgatctacaccgtgcttgaagtctgctggaaactgcctcagagtaaggttggaacagtagttaccgcggccgtggccggtgtggtgctcgtggtcgtaaagctgctgaatgacaagctccaacagcaattaccaatgccaatccccggcgaactgctcacgctaattggagcaaccggcattagctacggaatgggccttaaacatcgctttgaagtggacgtggtgggcaacatccccgcaggtttggtacctcctgtcgccccgaatacacagctcttttctaagctggtggggagtgccttcaccattgctgttgttggcttcgccatagcaattagcttgggtaaaatcttcgctctgcgccacggatatagagttgactccaatcaagaactcgtggcactcggcctcagcaatcttataggcggcatctttcagtgctttcccgtctcctgctctatgagccggtctctggttcaggagtccactggcggtaactcccaagtggctggggccatctccagtctgttcatactcctaattattgttaaactgggggagctgtttcatgacctgcccaaggcagttctggcagcgatcattattgtgaatctgaaaggaatgttacgtcagctttctgacatgcgcagcctgtggaaggctaaccgggcagatctattgatttggcttgtgaccttcacggctaccatcctgctaaatttggatttagggctggtggtcgccgttattttttctctcctacttgtggtggtcagaacccagatgccccattacagtgtgctcggacaggtcccggacactgacatttacagggacgtcgccgaatactctgaggccaaggaggttcggggggtcaaagtgttccgctccagcgctacggtgtactttgcaaacgctgaattctatagcgacgccctgaagcagcgctgcggagttgatgttgacttccttatctcacagaagaaaaagttattgaaaaagcaggagcagctgaagttaaaacagctccagaaagaagaaaagttgcgtaaacaggcggcctcccctaagggcgcctcggtgtcaataaatgtgaatacctcgctggaggatatgcgaagtaataacgtggaggattgcaagatgatgcaagtatcaagtggggacaaaatggaggatgctacagcaaatggccaggaagactccaaagctcccgatggttccaccttaaaggcactcgggctccctcagccggattttcatagtctaatcctcgacttaggggctctgtccttcgtcgataccgtctgtctgaaaagtttaaaaaacatcttccacgacttcagggaaatcgaagtagaggtgtacatggccgcgtgccatagtccagtggtctctcagctggaggccggccatttttttgatgcctccataacaaagaagcatctttttgctagcgtacatgatgctgtgacctttgcccttcagcacccccgccctgttccggactccccagtgtccgtcacacgattatag

SEQ ID NO: 205961 - DNA, 2223 bp, Artificial Sequence
  Description of Artificial Sequence: Synthetic coding sequence
atgggcctggccgacgccagcggcccccgggacacccaggccctgctcagcgcaacccaggccatggatctgaggcgccgcgactaccacatggagaggcctctgttgaaccaggagcatcttgaggagctaggacgctggggctcagccccgaggactcatcagtggcgtacctggcttcagtgttctcgggcaagggcttacgccctactgctccagcatctgcccgtgttagtctggcttccaaggtatccggtccgtgactggctcctgggagatctgctttcagggctttcagtggctataatgcagctccctcagggcctggcttacgctttgcttgctggtctgcctcccgtgttcggactctactctagtttctacccggtgttcatatattttctgtttggtacttcccgccatatctctgtggggaccttcgccgtgatgtctgtaatggtaggaagcgtgacagagtccctcgcaccacaggctctaaacgactctatgatcaatgaaaccgccagagacgctgcacgcgtgcaggtagccagcaccctctctgttctggttggactgttccaagtgggcctgggtcttatccatttcgggtttgtggtgacatatttgagcgagccccttgtaagaggatatactacggccgctgcggtgcaggtatttgtgagtcaactcaaatatgtgttcggcctccatctgagcagtcacagcggaccactcagtcttatctacacagttcttgaggtgtgctggaagctgccccagtctaaagtcggaacggtggttacagctgccgttgctggggttgtccttgtagtggtaaaactgcttaacgataagcttcaacaacagttacccatgccgatcccaggcgaactgcttaccctgattggcgcaaccggcatatcctatgggatgggcctgaagcatcgtttcgaggtggacgttgtcgggaatatccccgctggacttgtccccccagtggccccgaatacccagttattctccaagctggtaggctctgcattcacaatagcggtggtgggctttgccattgctatctccttaggcaagatattcgcactgagacacgggtacagggtggacagcaaccaagaactagtggcactgggactcagcaatctaattggcggtattttccaatgcttcccggtgtcctgctctatgagccggtccctggtgcaggagtctaccggtgggaactcccaggtggccggtgctatttcatccttattcatactcctgattatcgtaaagctcggtgaactattccacgacctacccaaggccgttctcgcagcaataatcattgtcaacttgaagggaatgctgcgacaactctcggacatgcgttcactctggaaggcgaacagggccgacttgctcatctggctggtgaccttcacagccaccattctgctgaacctcgatttaggtctagtggtggccgttatttttagcctgttattggtcgtggttagaacacagatgccacactattctgtactgggccaggtgccagacactgacatatatcgagacgtggccgaatacagcgaggccaaagaagtccggggcgtaaaagtgttcaggtcatcagcaactgtgtactttgctaatgccgaattttatagtgatgctctaaagcagaggtgtggcgttgatgtggatttcctaatctcacaaaaaaaaaaattgctaaagaagcaggagcagctgaagctcaaacagctgcaaaaggaagaaaagctgcgaaaacaagctgggccattgctctcagcctgcctcgccccccaacaggtttcctccggtgataaaatggaggacgccacagctaacggtcaggaagatagcaaagccccagacggctcaactttgaaagccttgggcctgccgcaacctgactttcacagcctcattctcgaccttggagccctctcatttgtggacaccgtctgtttgaagagcctcaagaatatcttccacgattttcgcgagattgaagtagaggtctacatggcggcctgccacagcccggttgtgagccagttagaagcaggacacttcttcgatgctagcattaccaagaaacatctgttcgccagcgtgcatgatgcagttacatttgcactgcagcatccccgaccagtcccagacagtcccgtgtccgtgactcgcctgtag

SEQ ID NO: 205962 - DNA, 2280 bp, Artificial Sequence
  Description of Artificial Sequence: Synthetic coding sequence
atgggcctggccgacgccagcggcccccgggacacccaggccctgttgagcgcaacccaagcgatggatcttcgccgtcgcgactaccatatggaaaggccgctccttaaccaggagcatcttgaggaactcggccggtggggcagcgcccccagaacacatcaatggaggacatggctccagtgcagcagggctagagcctacgctctactgctccagcacctgccagtgctggtgtggctcccacggtatccggtccgcgattggcttctcggcgacctgttgtccggactgagcgtggcaataatgcaactgccacagggactcgcctatgcgctcttggccggactgccaccagtgtttggcctgtacagcagcttctatcccgtgttcatctactttctcttcgggacctcacgacatatctctgtgggcacctttgctgtcatgtccgtgatggtaggatctgtaaccgaaagccttgcaccgcaggctctcaatgacagcatgatcaacgagacagcccgggatgccgccagagttcaggtcgcttccacactgtctgtgctggtcgggctgttccaggtgggcttgggcttgatacacttcggctttgtggtgacttacctctccgaacctctggtaagaggctataccactgcagccgcggtccaggtgtttgtcagtcaattgaaatatgtatttggcctgcatcttagctctcactctgggcctttgagcctgatttacacagtgcttgaagtgtgctggaagctgccccagagtaaagtcggaactgtcgtcacggctgcagtcgcaggggtggtgcttgtcgtcgttaagctacttaacgacaagctgcaacagcaactcccaatgcccattcctggagagctgctcacattaataggagctactggaatcagctatgggatgggactgaagcatagatttgaagtggacgtggtcggaaacatccctgccggcctggtgcctcctgtagcccctaacacacaactgttcagcaagctggtggggtccgcctttactattgccgtcgtgggcttcgctatcgctatttccttaggcaagatctttgctctgcgccatggttaccgggttgatagtaatcaagaactggtcgcgctgggccttagtaatctgatcggaggaattttccagtgtttcccggtgtcttgcagcatgtcaaggagcctggtgcaggagtcaacgggcgggaatagccaggttgctggcgccattagcagcctgtttattctgctgatcattgttaaactgggagaattatttcatgatcttccaaaagcagtgctcgcagccattattattgtgaatctgaaggggatgctgcgacagttgagcgacatgaggtctctgtggaaagccaatagggcagacttgttgatctggttggtaaccttcaccgccaccattcttctcaatctagatcttggtctggtagtggctgtgattttcagcctgctccttgtggtagtgcgcactcagatgcctcactacagcgtacttggacaggtaccagacaccgatatttacagggacgtggcagagtactctgaggcaaaggaggtcaggggtgtgaaagtgtttaggtcaagcgcaaccgtgtactttgcgaatgccgaattttattctgacgctctgaagcaacggtgcggagtcgacgtggactttctgattagccagaagaagaaacttcttaaaaagcaggagcagctgaagctgaaacagctgcaaaaggaggagaagcttcgaaagcaggctgcatcacccaagggcgccagtgtctcaatcaatgttaacacatccctggaggacatgaggtcaaataacgtggaggattgtaagatgatgcaggttagttccggggataaaatggaagatgctactgcaaacggccaggaggattccaaggcccctgacggtagtacgctaaaggccctggggcttccccagcccgattttcactctctcattcttgatctcggagccttatcatttgtcgatacagtctgtctcaagagcctgaagaacattttccatgacttccgggagatcgaagtcgaggtatatatggcagcctgtcactcccctgtggtttcccagctggaggccggtcattttttcgacgcttccatcaccaaaaagcatctgtttgcaagcgtgcatgacgccgttaccttcgctctgcagcacccgaggccagtgcctgacagccccgtgtcagttactcggctgtag

SEQ ID NO: 205963 - DNA, 2277 bp, Artificial Sequence
  Description of Artificial Sequence: Synthetic coding sequence
atgggcctggccgacgccagcggcccccgggacacccaggccctgctttcagccactcaggccatggacctcaggcgcagagattatcatatggaaagacccctgctgaatcaagagcacctggaggagctaggtcgctggggctctgcgccacgcacccatcaatggcggacctggctgcagtgttcaagggctagagcatacgcactgttgctacaacacctgcccgttttggtctggttgcccaggtatccagtacgggactggctgctgggggaccttttgtccggactgagtgtagctatcatgcagctgccccaggggctagcttacgctctcctggcggggctgccccctgtgtttgggctgtactcatctttttaccctgtctttatctattttctatttgggacctcccgccacattagcgtcggtacttttgcagtaatgtcggttatggtgggctctgtgaccgagtccctggccccgcaggcccttaacgactccatgataaatgaaacagcacgggatgccgcccgagtgcaggttgcatcgacactcagtgtgctggtgggactgttccaggtcggccttgggttaattcatttcggcttcgtcgttacatatctatccgagccattagtcagagggtacaccacagccgcggcggtgcaggtgtttgtatcgcagctgaagtatgtcttcgggctccatcttagtagtcatagcggtccgctgagtcttatttacacagtgctggaagtgtgttggaagctgccacagagcaaggtgggcacagtggtaacagcagccgttgccggcgtagttttggtagtcgtaaagctgcttaacgacaaactccagcagcaacttcccatgcctatcccaggagagctcctgactctcataggcgccacgggcatctcctatgggatgggtctcaagcacagattcgaggtcgatgttgtgggaaatatcccagccggtctggtcccgccagtcgcccctaatacccagctgtttagcaagctggttggctctgccttcactattgccgtggtaggctttgccatcgccattagtctgggcaagattttcgctcttagacatggctacagggtggatagcaatcaagaactggttgcactcggcctctcaaatctaattggaggcattttccagtgcttccctgtaagctgttcgatgagtcgtagcctggtacaagagagcacaggcggtaattcacaagtggcaggagcaatctcatcactctttatcctgctcattattgtaaaactcggggaactttttcatgatctccctaaggctgtgttggccgccattatcattgtgaaccttaaagggatgctgagacaactgagcgatatgaggagtctgtggaaagctaacagagcagaccttctgatctggttagtgacctttactgcgaccattctcctgaatctggatctcgggctagttgtggctgtgattttctctctgcttctggtggttgtccggactcaaatgccacactacagcgtgctggggcaggttcctgatacagatatttaccgcgacgtcgcagaatatagtgaggctaaggaggtacggggcgtaaaagtgtttagaagctccgccacggtgtatttcgccaatgcagagttttattccgatgcactgaaacaacggtgtggagtggacgtcgacttcctgatctcccagaagaagaagttgctgaagaagcaagagcagctgaaacttaagcagctgcagaaggaggagaaactgcggaagcaggccgcttcacctaaaggagcctccgtgagcatcaatgtgaatacctcactcgaagatatgcgcagcaacaacgtcgaagactgcaagatgatggtctcaagcggcgacaaaatggaggatgccactgcaaatggacaggaagatagcaaagcccctgacggttcaaccctgaaagcactggggctaccgcagcctgattttcactccctgattctggatttgggcgccctgagtttcgtcgacacagtgtgcctgaaatctctcaagaacatattccacgacttcagagagatcgaggttgaggtttatatggcagcttgccatagccccgtggtgtcacagttggaggccgggcatttttttgacgccagtataactaagaaacacttattcgcctctgtgcacgacgctgtaacattcgcactccagcacccacggcccgtcccagattcacccgttagcgtcaccagactatag

SEQ ID NO: 205964 - DNA, 2262 bp, Artificial Sequence
  Description of Artificial Sequence: Synthetic coding sequence
atgggcctggccgacgccagcggcccccgggacacccaggccctgctcagcgcgacccaagcaatggatttgagaaggagggactaccatatggagagacctctgctgaaccaggagcacctagaagagctggggaggtggggatcagctccacgcacgcaccagtggcgaacctggctgcaatgctcgagagcaagagcgtacgcattactgctgcagcacctgcctgtgcttgtgtggctgcctagatatccagtaagggactggctgctaggggatctgctctctgggctgagtgttgccatcatgcagcttcctcaagatcttttgtcccgactgcactgctatcacagcaccctgggcctcgcatatgccctcctggctggactgccacccgtcttcggactctattcctctttctacccagtatttatttacttcctgttcgggacgtcccgtcacatctctgttggcactttcgcggtgatgtccgttatggtaggtagcgtcactgagtccctcgcccctcaggccctgaacgactctatgatcaatgagacagcgagagacgccgcacgcgtccaagtggcctcaacgctcagtgttttggtagggctgttccaggtggggttgggtttgattcattttggctttgtggttacctacctgtccgagccgctggtaaggggatacacgaccgccgcagcagttcaagtgttcgtttctcagctgaagtatgtatttggacttcatctgagttcccattctgggcctctttctctgatttacacagtactcgaggtctgttggaaacttccccagagcaaggtagggactgttgtgactgccgctgtcgcaggcgtggttctggtagtggtgaagctgttgaacgacaaattgcagcagcagctccctatgcccattcccggtgaactgttgaccttgattggggccacaggtatttcatacggaatgggccttaaacaccggttcgaagttgatgttgtggggaacatacctgcaggactggtcccgcctgtggccccaaatacccaacttttcagcaagctcgtgggatctgcctttactattgctgtagtggggttcgccatcgctatcagcctgggcaagattttcgccttgcggcacgggtaccgggtggatagcaaccaggagctggtggccctgggcttatctaatttaattggggggatctttcagtgttttccggtctcttgtagcatgagtcgctctctcgtgcaggaatcgactggcggcaactcgcaagtggcaggtgccatctcctcactcttcattctcctcattatcgtgaagctcggggagttgttccacgacttgcccaaggcagtgctggcggcaatcatcatcgttaacctgaaagggatgctgcgacagttgtcagacatgcgctctctgtggaaagccaaccgcgcagacctgctgatctggttggtgacttttaccgcaaccatcctgctaaacctggatctcggactggtcgtagcagtgatcttctctttgcttctcgttgtcgtgaggacacagatgcctcactacagcgtgttggggcaggtgcccgacacggatatctaccgtgatgtagctgaatattcagaagctaaagaggtccgcggcgttaaggtgttccggagttccgctacagtgtacttcgccaacgcggagttctacagtgacgccctgaaacaaaggtgcggggttgacgtggatttcctgatctcgcaaaaaaaaaagctgctcaagaagcaggagcaactgaagcttaagcagctgcagaaagaagagaaattacgcaaacaagccggtcctctgttgtcagcatgcttagccccacagcaagtgtcctctggagataagatggaggatgcaacggcaaacggccaagaggattctaaagcacctgacgggagcaccttgaaagcgttgggtttacctcaacccgactttcattcactgatactggatctgggcgccctgtccttcgtggacacggtctgtcttaaatccctcaagaacattttccacgactttcgggaaatcgaagttgaagtctatatggccgcttgccactcacctgtcgtctcacagctggaggccgggcacttctttgacgcttcaatcactaaaaagcatctgtttgcatccgtgcatgacgccgtgacattcgctctgcagcatcctaggccggtgcccgatagccccgtttcggtaacgcgtctgtag

SEQ ID NO: 205965 - DNA, 2172 bp, Artificial Sequence
  Description of Artificial Sequence: Synthetic coding sequence
atgggcctggccgacgccagcggcccccgggacacccaggccctgcttagcgctacccaagctatggaccttcggcgcagagactaccacatggaaaggccactgttaaatcaggaacacctggaggagctcggccgctgggggagcgcccctaggacacatcaatggagaacttggctgcagtgtagccgggctcgggcttatgctttgctattacagcacctccctgtgctagtctggctacctaggtacccagtccgggattggctcttgggcgatttgctatccgggctgtcggtcgctatcatgcaactgcctcagggcttagcctacgcactgctggccggcctacccccagtgtttggcctgtactctagcttctacccggtctttatctatttcctcttcggcacctccagacacatctccgtggcgacccccgggcctttaccactactgacggcccccggcaggccgacaggcggggcaggtcccgatccattgcgcctccggggccacctgcccgttcggacctcatgccccaggttataccactcctgtagttgcgctggtctgcggctgacagcccaggtgtgcgtgtggcctccctcagagcagccgctttgggccactgtgccacacctcctccttgaggtttgttggaaacttccacagagtaaggtgggaaccgtggtaacagccgccgtcgcaggggtcgtgctggtggtggtgaagctccttaatgacaaactgcagcaacagttaccaatgccaattcctggggagctccttacactcatcggggcaaccggaatcagttacggaatgggattgaaacaccggttcgaggtggacgttgtggggaacatcccggcagggctggtacccccggtagctcctaatacccagctcttttcaaaactcgtggggtccgccttcactattgcagtagtcggtttcgctatcgccatatcattggggaaaatttttgctctaaggcacggataccgcgtcgattccaatcaagagctggtcgccctcggtctctccaacctgattggcgggatttttcaatgctttcccgtgagctgttctatgtccaggtccctggtgcaagaatctactggcggaaacagtcaggttgccggggcaatatctagtcttttcatccttctcataattgtgaaactgggcgaattgtttcacgacttgccgaaggcagtgttggccgccatcattattgtaaatctcaagggtatgctgagacagctttctgacatgcgcagcctgtggaaggctaacagagctgacctgcttatttggctggtcacattcacggcgacaatcctattaaatctggacttaggactggtcgttgccgtaatcttctccctgctattggtcgtggtacgcactcagatgccccattatagcgtcctggggcaggtccctgacaccgacatataccgtgatgtcgcagaatactccgaggccaaagaggtgagaggagttaaagtcttccgtagctcagccaccgtgtatttcgcgaatgcagaattctatagtgacgccctcaaacagaggtgcggggtggacgtcgatttcctcatctcacaaaagaaaaaactacttaagaagcaagaacagctgaagctcaaacagctccagaaggaagagaagttgcgcaaacaagccgcctctccaaaaggcgccagcgtgtccattaacgtgaatacctcccttgaagacatgaggtccaataacgtcgaagactgcaagatgatgcaagtgtctagtggggacaaaatggaagatgccacagcgaacggccaggaggacagtaaggccccggatggctccacgctaaaagccctcgggctaccccagcccgacttccatagtctgattttggatctgggggctctctctttcgtcgatacagtatgccttaagtccctcaagaatatcttccacgacttcagagagatagaagtggaggtttatatggccgcctgtcacagtcctgtcgtgagccaactggaagccggccacttcttcgatgcgagcattaccaagaaacacctgtttgcttctgtgcatgatgctgtgacatttgcactgcagcatccacgcccggtgccagactctcccgtgagtgtgacacgtctgtag

SEQ ID NO: 205966 - DNA, 1941 bp, Artificial Sequence
  Description of Artificial Sequence: Synthetic coding sequence
atgcgggcccccggcgccggcgccgccagcgtggtgagcctggccctcctgtggctgctgggacttccatggacatggtccgcagcggctgccttaggtgtctacgtaggctcaggcggatggcgcttcttgagaattgtctgcaaaactgctcgtcgggaccttttcggcctgtccgtccttatacgcgtgaggcttgagctcaggcgccatcagagagctggccacacaattccgcgcatttttcaggccgttgtgcagaggcagcccgagaggctggcactcgttgacgccggcaccggcgaatgctggacatttgcccagctggatgcatactcaaacgctgtggctaatctgttccggcagctgggtttcgctccaggagatgttgtggccatttttctcgaggggcgccctgaattcgtcggactatggctcggcctggccaaagcaggcatggaggccgccctcctgaatgtgaatctgcggagagaacctttggcattttgtttagggacatcgggagcaaaagccctgatttttgggggtgaaatggtggccgccgtggcagaagtttccggtcacttaggcaagtcccttatcaagttctgcagcggggatcttgggcctgagggtattctgcctgatacccacctgctggacccgctgctcaaagaagcttccaccgccccactggctcagatcccatctaaaggaatggacgaccgcttgttttacatttacacctccggcaccacaggactacctaaggccgcaattgtggtgcatagtcgctactatcggatggccgcttttggccaccatgcttatcggatgcaggcagctgatgtgctgtatgactgtcttcctttataccattccgctgggaacatcataggtgtggggcagtgcctcatctatggcctcacagtggtcctaagaaaaaagttcagcgcctcaagattctgggacgactgcattaagtacaattgtacagtggtgcagtatatcggcgaaatctgtcgatacttgctcaaacagccagtgagggaagccgagcggagacacagagtgcgattggccgtggggaacgggctgcgccctgctatatgggaagaatttacggaacgcttcggggtgcggcagatcggggaattttatggagctacagagtgcaattgcagtatcgcgaatatggacggtaaggtaggatcctgcggatttaactcacgcatcctcccgcatgtgtacccaattcggttggttaaagtcaatgaggatacaatggaactactcagggatgcccaggggctgtgtatcccctgccaggctggcgagcccggcctccttgttgggcagattaatcagcaggaccccctgaggcgttttgacgggtacgttagcgaatctgcaacttccaagaagatcgcacattcagtgttttctaagggcgatagcgcctacctcagtggcgatgtcctggtgatggacgaattagggtacatgtatttccgcgatcggtcaggggacactttccgctggcgcggcgagaacgtcagcaccaccgaagtggaaggtgtgctgagtaggttgctgggacagactgacgttgcggtttatggcgtggcagtaccgggggtcgagggtaaggctgggatggcagctgtggctgaccctcactctctcctggatcctaacgcaatctatcaggagctgcagaaggttcttgctccttacgcacgcccgatctttctgcggttgctaccacaggtcgatacaaccgggacatttaagatccagaaaacccggctgcagcgagagggtttcgaccccagacagacatctgatcggctattttttctggatctgaagcagggtcactatctacccctgaacgaggctgtgtataccagaatctgctcaggagcctttgccctctag

SEQ ID NO: 205967 - DNA, 723 bp, Artificial Sequence
  Description of Artificial Sequence: Synthetic coding sequence
cccgagttcgtgggcctgtggctgggcctggccaaggccggcatggaagctgctctgctcaatgttaatctccgtagggagccgttagccttctgtcttggaacctccggtgctaaggctctaatcttcggtggagagatggttgccgccgtggcagaagtctcaggacatctggggaaaagtctaatcaagttttgcagcggcgatctgggacccgaaggaattctgccagatacccacctcttggacccccttcttaaggaggcaagcactgcgccgctcgctcaaattccctctaaggggatggacgatcgcctgttttacatatatacgtcaggaacgaccgggcttccaaaagccgcaatcgtcgtgcactccagatactaccgtatggctgcattcggccaccacgcctataggatgcaagccgctgacgttctctacgattgcctgccgctgtatcattccgccgggaatatcatcggcgtgggccaatgcttgatatatggactgaccgtggtcctccgaaagaaattctctgctagtagattttgggacgattgcatcaaatataactgcacttggcatgggcctagctggactgagaagttagaaccccagaggaacccatgtctgtccgccgcgctggtaccattgtgcttgcctccgcttccagcctttcaaccactctcacctagtatacctgtccccgtatggccatag

SEQ ID NO: 205968 - DNA, 1941 bp, Artificial Sequence
  Description of Artificial Sequence: Synthetic coding sequence
atgcgggcccccggcgccggcgccgccagcgtggtgagcctggcccttctctggttattgggactcccctggacttggtctgcagccgctgctttgggcgtttatgtggggtctggaggctggcgctttctgcgtattgtgtgtaagaccgctcggcgggatctgtttgggctctctgttctgatacgcgtgcgccttgagcttaggcgtcatcaaagagctggccatactatccctaggatttttcaagctgtcgttcagaggcagcccgagcgcttggcactggtcgatgcaggtacgggcgagtgctggacctttgctcagctggatgcgtactcaaatgctgttgctaacctctttcgtcagcttgggttcgccccaggagatgtggtcgccatatttttggaggggaggcctgagtttgtggggctatggctggggttagcgaaggcgggcatggaggccgccctcctgaacgtaaacttgcgaagggagccgctggccttctgcttagggaccagcggcgcaaaagcactgatttttgggggggagatggtggccgccgttgcggaggttagcgggcacctggggaaatccctgatcaagttttgctctggggatttggggcccgagggtattttgcccgatactcacctcttggatcctttgcttaaggaggccagcactgcacccttggctcaaattccctctaagggcatggacgaccgtctcttctatatctatacttctggcacaacaggtttgcctaaggctgctattgtggttcactccagatattaccggatggctgcctttgggcaccacgcgtatcgaatgcaggcagcagacgtgctgtatgactgtctgcctctgtaccacagcgcaggaaatatcataggcgttggccagtgcctgatatacggattaacagtggtgttgcgaaagaagttctctgccagtaggttttgggacgattgcataaagtataactgcacagtggtgcagtatatcggggaaatctgccgctatctccttaagcagccagtccgtgaggccgaaagacggcatagagtccggcttgctgtgggtaacggcctccgccccgccatctgggaagaattcactgaaagatttggtgttcgccagattggcgagttttacggggccacagaatgcaattgctcgattgcaaatatggacggcaaggtagggagctgtggatttaattctcgcatcctgcctcatgtgtatcctattaggctcgtgaaagtgaatgaggataccatggaactactaagggatgcccagggactctgtatcccttgccaagctggtgagcctggcttgctggtaggtcagattaatcaacaggacccactcaggcggttcgacggttacgtatctgagtcggccactagtaaaaagattgcgcacagcgttttctcaaaaggcgactccgcctatctgagcggcgacgtgctcgtgatggacgagctgggatacatgtacttccgagaccggtcaggagatacctttaggtggcggggggaaaatgtgtcgaccacagaggtggagggggtgctctcgaggcttctaggacagacagatgttgcagtctatggtgtggcagtgcccggcgtagagggaaaggctggaatggccgccgtggctgaccctcattcattattagacccaaatgccatctatcaggagcttcaaaaggtgctggcaccctacgctcgccctatcttcctgcgccttctgccgcaagtggacacgactggtactttcaaaattcagaagacgcggctgcagcgggaaggcttcgacccacgccagacgtcagatagactatttttcctcgatttaaaacaaggccattacctgccacttaacgaggctgtctacactcgaatttgttccggagcctttgccctttag

SEQ ID NO: 205969 - DNA, 1863 bp, Artificial Sequence
  Description of Artificial Sequence: Synthetic coding sequence
atgctgagcgccatctacaccgtgctggccggcctgctgttcctgccactgcttgttaacctgtgttgcccatacttctttcaggacatcgggtacttccttaaagtagcagctgtgggtcgtcgggtgcgatcctatggcaaaagacgaccggcaagaactatcttacgagcatttctcgagaaagcaagacaaacacctcataagcccttcctgctcttccgggatgagactttgacctacgcgcaagtggaccggcgctctaaccaggtggctcgcgcactccacgatcaccttggtttacgacagggggattgtgtcgccctactgatgggaaatgagcccgcatacgtgtggctctggctcggattggtgaaactgggctgtgctatggcctgtctgaattataatattcgggccaaaagcctgttacattgcttccagtgctgcggtgcgaaggttctgctagtctcccccgagctccaggctgcagtcgaggagattctgcccagcctaaagaaagacgacgtttctatttattacgtcagtcgcacctccaatacagatggcattgatagtttcctggacaaggttgacgaggtgagcacagaacctattcctgagagttggcgctctgaagttacattttcaactcctgcactgtacatatatacatcagggaccacaggactgcccaaggcagccatgatcactcatcagagaatttggtacggaaccgggctgaccttcgtgagcgggctaaaggccgacgacgtcatctatatcactctgcccttttaccacagcgcagctctgttgatcggcatccacgggtgtatcgtggctggcgctaccctagctttaaggaccaaattttccgcttctcagttctgggatgactgccggaaatacaatgtcactgtgattcagtatattggtgagcttcttcgatacttatgcaactcccctcagaagccgaatgatcgagatcataaggtgcgcctggccttgggcaacggcttgaggggggacgtctggcggcagttcgtcaaaagattcggggatatctgcatctacgagttttacgccgcgactgaaggaaatataggttttatgaactatgcccgtaaggtcggggccgtcgggcgcgtcaattacctccagaaaaagatcatcacatatgatctgattaagtacgatgtcgaaaaggatgagcccgtgagggacgagaacgggtactgcgtgagagtccctaagggagaggttggacttctcgtttgtaaaatcacacaactgactcccttcaatggttacgcaggggcaaaagctcagaccgaaaagaagaaacttcgggacgtcttcaaaaaaggggacctctattttaatagcggtgatctgctgatggtggaccacgagaacttcatatacttccacgacagagtcggcgacacatttcgatggaaaggggaaaacgttgcaacaaccgaggtagctgacacagttggtctggttgacttcgtgcaagaagtcaatgtctatggcgttcacgtccccgatcatgaaggacgcatcggcatggcttccatcaagatgaaggagaaccatgagtttgacggaaaaaaattattccagcacatcgccgactatcttcccagttatgctagacctcggttcttgcgaattcaggacactatcgaaattacaggtacatttaagcatcgaaagatgacactggttgaggaaggcttcaatccagccgtaatcaaggacgccctctactttttggacgatacagctaaaatgtacgtccccatgactgaagacatctacaacgctatttcggccaagacactcaagctttag

SEQ ID NO: 205970 - DNA, 1704 bp, Artificial Sequence
  Description of Artificial Sequence: Synthetic coding sequence
atgctgagcgccatctacaccgtgctggccggcctgctgttcctgccactgctggttaacctctgctgtccttacttctttcaggatatcggctacttccttaaagttgctgccgtgggtcggcgggtgagatcatatgggaaacgacggccagctcgtaccattttacgggccttcctggagaaagcccgacaaacaccgcacaagcccttcctgctgtttcgggatgagacactgacctatgcacaggtcgatcggaggtctaatcaggtcgcacgtgcgctgcacgatcatctaggactgcgacagggcgattgcgtagcactccttatgggcaatgagcccgcctacgtgtggctgtggttgggtctggtaaagttaggttgtgccatggcgtgcctcaactataatatccgggccaaaagcctcctgcattgcttccaatgttgtggcgccaaggtcctcttggtctcaccggaactccaagctgcagtggaggagatcctaccctcgttgaaaaaggatgacgtgtctatctattacgtgtcaaggacgtcaaacaccgacggaattgactcattcttggacaaagtggatgaagtgagcaccgagcctatccctgaaagctggcggagcgaggtgactttcagcaccccggccctttatatttacacttccggaaccactggagcgacactcgcactgcggaccaagttctctgccagtcaattctgggacgattgtagaaagtataatgtcaccgtaatccagtacatcggcgagctccttcgatacctctgcaactctccccagaaaccaaacgatcgggaccataaggttcggctcgcgcttggcaacggcctacgcggcgatgtgtggcggcagttcgttaaaagattcggtgacatttgtatttatgaattttacgccgcgaccgaggggaacataggattcatgaactatgctcgcaaagttggcgctgtcggcagggtcaattacctccaaaaaaaaattatcacctacgacctgatcaaatatgacgtggagaaagatgagccagtgagagacgaaaatggctactgcgtacgcgtcccaaagggggaggtgggcctcctggtatgcaagattacgcagttaacccccttcaacggctacgccggtgccaaggctcaaaccgagaaaaagaagctgagagatgtcttcaagaagggtgatctttatttcaacagcggtgatctattgatggtcgaccatgaaaacttcatatatttccacgaccgcgtcggagacaccttccgctggaagggcgaaaacgtcgcaaccaccgaagtcgccgatactgtgggcctcgtcgattttgtgcaggaagtcaatgtgtacggcgtccacgtgcctgaccacgaaggcaggatcggaatggcgtctatcaagatgaaagaaaaccacgagtttgatggcaaaaagctgttccagcacattgccgactatcttccctcttatgcacggcctcggtttctgcgtatacaggacaccattgagatcacggggacattcaagcaccgcaagatgacgttggtggaagaaggctttaaccctgctgtaatcaaagatgccttgtattttctggacgacaccgccaaaatgtatgtgccaatgacggaggacatttataacgctatatccgcaaagacgctgaaattgtag

SEQ ID NO: 205971 - DNA, 2436 bp, Artificial Sequence
  Description of Artificial Sequence: Synthetic coding sequence
atgcccaagccccccaagccccggaacaacctggaggaccggcacaaccctggcatccagggccgccgcgagcatcggcccggtccgggaagagttagggccgcttctagccctgggggctctgctcctagggcagagaggcgcctctggggggaagggtgggaatccggcgccgccccccatccacactccagtagagtgtcagccctcaggccatgcggagtggtaggggcttgggtggggatgggcgtgtgccagaggacccgcgccccgtggaaggagaaatcccagctcgaacgggcggcgctcggctttaggaagggggggtcgggtatgtttgcttccggctggaaccaaacagtgccgatagaggaggctggaagcatggccgccttactccttttacctctactccttctccttccgctactgctgcttaagctgcacctgtggccacaactgcggtggttacctgccgacctcgcttttgcagtgcgggccctgtgttgcaaaagggccttaagagcccgcgccctggctgctgcggccgccgacccagagggaccagaaggcggctgttcgctcgcctggcgactggcagagctggcccagcagcgcgccgcccacacctttctcatacatgggagccgccgcttctcttacagcgaagcagagagggaatccaaccgcgcagcaagggcctttctgcgcgctctcggctgggactgggggcctgatggaggtgattccggcgaagggtcggcgggagaaggcgagcgtgccgctcctggtgccggagatgcagccgccggctcaggtgccgaatttgccggaggggatggcgctgcccgcggtggtggggccgcagcacccttatcacccggtgccactgtggccctgcttctacccgccggtcctgagttcctgtggctttggttcggactcgcaaaagccgggcttaggaccgcatttgtgcccacggcactacgcagaggccccttactccattgcttgcgttcatgcggggcccgcgccttagttcttgctccagagttcctggagtcacttgaacctgatctccctgctctacgcgccatgggtctgcatctttgggcagccggaccagggacacacccggccggtatctcagatctgcttgctgaagtctcggccgaagtggacggcccggtgccaggttacctgagcagccctcagagcatcaccgatacatgtctctacattttcacaagtggaactacaggattgcctaaggccgctcggatcagccatctgaaaatcctgcagtgccaggggttttatcagctgtgcggagtgcatcaggaagatgtgatttacttggcactccctttatatcatatgtcggggagtctgttggggatcgtggggtgcatgggcatcggagctacggtagtgttaaaatcaaagtttagcgctgggcagttttgggaggactgtcagcaacatagggtcactgtgttccagtacataggcgaactgtgtcgctatctggttaatcagccaccaagcaaggctgagcggggccacaaagtaagactggctgtgggcagcggtctgcgcccagacacatgggagagattcgttagaaggtttgggcccctccaggttctcgagacctatggccttacagagggcaatgtcgccaccattaattacacaggccaacggggcgcagtaggacgggcttcctggctgtacaaacacatatttccattctctctcatccgctatgatgtgaccacaggtgaaccaattagggacccacaaggacattgtatggcgacttcacctggagagcccggactactggtagccccagtctctcagcagtcaccgttcctgggatacgctggaggcccagagctggcacagggaaagttattgaaggacgtgtttagacctggtgacgtgttttttaatactggagacctgcttgtgtgtgacgatcagggatttcttcgcttccacgatagaacgggggatactttccgttggaaaggggagaatgttgccacaacagaagtcgcagaggttttcgaggccctggatttcctccaggaagttaatgtttacggagtgaccgtgcccgggcatgagggtcgtgccgggatggcagcactcgtacttcgcccccctcatgcgcttgatctcatgcagttgtatacccatgtgagcgagaacctgcccccatatgcccgcccccgcttcctgcgcctgcaggaaagtctagctacaaccgagacattcaaacagcagaaggtacgtatggccaatgagggctttgacccatctaccttgtctgaccccctgtacgtgctggaccaggccgtgggagcatacttacctttaactacagctcggtactcagcccttctggccggaaatctccgtatttag

SEQ ID NO: 205972 - DNA, 2193 bp, Artificial Sequence
  Description of Artificial Sequence: Synthetic coding sequence
atgggcgtgtgccagcggacccgggccccctggaaggagaagagccagttggagagagccgcactggggttccggaaggggggaagcggcatgttcgcttccgggtggaaccaaacagtgcccatcgaggaggccggaagcatggccgcactgctcctgctgccattgctgctgctcctgcctttacttctgttgaaactgcacctgtggccacagctgcgttggctgccggccgaccttgcatttgcagtgcgagccttatgctgcaagcgggctctgcgcgctcgggccctcgccgctgccgctgccgatccagagggccccgaaggaggctgtagcctggcctggagactggctgaacttgctcaacaaagagctgcccacactttcctgattcacgggagcaggcgcttttcctattccgaagccgaacgggaaagtaatagggcagcacgcgctttccttagagcactggggtgggactggggccccgatggtggagattcaggagaaggctcggcgggcgagggggaaagagcagcccccggtgccggcgacgctgccgctggaagtggggccgaattcgcagggggcgatggggccgcccggggtgggggtgctgctgcccccttgtcgccaggtgcaaccgtggccttactgttgccggctggccccgagttcctgtggctgtggtttggcctggccaaggccggtctaaggaccgcctttgtacctactgctctacggcgcggtccgctgttgcactgtctgcggtcatgcggcgctcgggctctggttcttgccccagaatttctggaaagccttgagcctgacttgcctgcactgagagcaatgggcctgcatttgtgggccgccggtccaggtactcaccccgcgggcataagcgacttgctggcagaggtaagcgcagaggttgacggaccagtgcctggctatctgagttcaccacagagtatcaccgacacttgtctgtacatcttcacatcagggacaaccggcctacccaaagccgcaaggatttcccacttgaaaatactccagtgtcagggtttctaccagctctgtggcgtgcaccaggaagatgtgatttatctcgccctgccactatatcacatgagcggcagcctgctcggtattgtgggatgtatgggaatcggtgcgacagtggtccttaaatccaagttttccgccggacagttctgggaggattgtcagcaacatagggtgaccgtgtttcagtacattggcgaactgtgtcgttacctcgtgaaccagcccccgtccaaagcggagcggggccacaaggtgcggcttgcggtcggcagcggccttcgtccggacacctgggaacgctttgtaagaaggttcggaccactgcaagtgctcgaaacctacggcttaacagagggaaacgtggcaacgatcaattacaccggccagagaggcgctgtgggtcgcgcaagctggctttataaacatatttttccattcagtctcattcgctacgatgtgactaccggggagcccattcgcgatccacaggggcattgcatggccacatcccccggagagcctggactccttgtcgccccagtgtctcagcagtcgccgttcctgggatatgccggtgggcccgagctcgcgcagggaaagctgctgaaagatgtttttaggcccggagatgtgttcttcaataccggggatcttctggtgtgcgatgaccagggctttcttagattccatgatagaaccggggatactttcaggtggaagggtgagaacgttgcgacgaccgaggtcgcggaagtgtttgaggccctggatttcctccaggaggtgaatgtctacggcgtcacagtgccagggcacgagggccgagcaggcatggccgccctcgttcttcgcccacctcacgcactcgacctgatgcaattgtacacacatgtaagtgagaacctgccgccttacgcgcgtccaaggtttttgagactgcaggagtccctggctaccaccgaaacatttaagcaacagaaggttagaatggctaacgagggattcgatccctccacactgtccgaccccctctacgttctagatcaagccgtgggagcctatttacctttgacgaccgcacgttacagcgcgctgctggctggcaacctgcgcatatag

SEQ ID NO: 205973 - DNA, 1932 bp, Artificial Sequence
  Description of Artificial Sequence: Synthetic coding sequence
atgctgctgggcgccagcctggtgggcgtgctgctgttcagcaagctggtgctgaagctgccctggacacaagtgggcttcagcttgctgtttctttacctgggttccggaggatggaggtttatccgggtttttattaagactattaggagggacattttcggggggttggtcctgctcaaagtgaaggccaaagtaagacagtgtctccaggagcgaaggacggtgccgatcctctttgccagtaccgtccgcaggcaccctgacaaaacagcactgatttttgaaggaaccgacactcactggaccttccgccagctggacgaatacagttcctcagttgccaactttttgcaggctagaggcctggctagcggtgatgtagccgctatattcatggagaacaggaacgagttcgtcggcttgtggctgggaatggcaaagttgggggtcgaggcagccctgatcaacacaaatctgcggagagatgccctgctgcattgcctgactacctctagagcaagagccctggtttttggaagcgagatggcatcagctatctgcgaggtccacgcctctcttgatccaagtctgtcactcttttgctctggatcatgggaacctggcgcggtgccgccatctaccgagcacctggatccactgcttaaagacgcccccaaacacctcccctcatgccctgacaaggggttcactgacaagctcttctatatctacaccagcgggaccaccggcctcccaaaagctgcaatcgtggtgcattcccgctattacaggatggcggccttggtttattatggatttaggatgaggccaaacgatatcgtttacgactgcctgccgctgtaccatagtgccggaaacatagtggggatcggccagtgcttgctccacggaatgacggtcgttatccggaagaaattctccgccagcaggttctgggacgactgcattaagtataactgcactatagtgcagtatattggggaactgtgtcggtacctgctcaatcaaccgccacgggaggcagagaaccaacatcaggtgagaatggctctggggaacggactgcgacagagcatctggactaattttagtagtcgtttccacatcccacaagtcgctgagttttatggtgcgacagaatgtaattgttctctgggaaactttgatagccaggttggggcctgcggatttaacagtaggatactgtcatttgtttatcctattagacttgtgcgggtgaacgaggatacaatggagctgattcgcggcccagacggagtatgtatcccatgccagcccggtgaaccaggccaactggtgggacggatcatacagaaggatccactcaggcgcttcgatggatacctgaaccagggtgccaataacaagaaaatcgccaaagacgtgttcaagaagggagaccaggcctacctgaccggagacgtgctggtgatggacgagctaggatacctgtacttccgggacagaactggagatacatttagatggaaaggggagaatgtctctaccacagaagtggaggggaccttgtcccgactgctagacatggcagatgtcgcagtctacggagtggaagttccgggcacggaaggacgcgccgggatggccgcagttgcttcccctacagggaactgcgatctcgaaagatttgcccaggtgcttgaaaaggagctccctttatatgcgaggcctatttttttgagactgctgcccgagctgcataaaacgggcacttataaattccagaaaaccgaactcagaaaagagggcttcgaccccgcaatcgtgaaagatcccttattttacctcgacgcacagaaaggacgttacgtgcccctggatcaggaggcctactctcggatacaggcaggagaggagaagctctag

SEQ ID NO: 205974 - DNA, 714 bp, Artificial Sequence
  Description of Artificial Sequence: Synthetic coding sequence
atgcccctgaccctgagcaccctgctgcagcccggccggatctggacagggcgacgggcagccgagcccaccccagggcataatgccgcatggtccctctctggtgggggggcagctgtactgcaggctggagccgaaaccgctctggaccccggtggaattctgccggtggtgcctcttctcggcatatggaggctggccttacacccaggcctacatcaggatcaccaggcatatctcacaggggacgttctggtgatggatgaattggggtacctgtacttccgggatcgaacaggcgataccttcaggtggaaaggcgagaacgtgtcaaccactgaggtcgagggaaccctaagccgtctcttggatatggcggatgtggccgtttacggggtcgaggtgcctggtacagagggccgtgctggaatggccgcagtggcgtcccctaccggtaattgcgatctggagcggttcgcccaggtcttggagaaagaattacctttgtacgctagacctatttttctccgcctgctacccgagctacacaagactgggacctataaattccaaaaaaccgaactccgaaaagagggatttgatcctgccatcgtgaaagacccacttttctatctggatgcacagaagggacgatatgtgccactggaccaggaggcctatagcagaatccaagccggggaagaaaagttgtag

SEQ ID NO: 205975 - DNA, 2073 bp, Artificial Sequence
  Description of Artificial Sequence: Synthetic coding sequence
atgggcgtgcggcagcagctggccctgctgctgctgctgctgctgcttctgtgggggctcggtcagccagtctggcccgtcgctgtcgctctcactctgaggtggctgctgggggaccccacctgttgcgtcctgctggggctcgcaatgctcgcaaggccctggctagggccttgggtaccccacggcctgtccctagccgccgctgccctggctctcaccctgctgcccgcccggctacctccgggcctgcggtggcttcccgcagacgtgattttccttgccaagatcctacatttgggactcaaaattagaggatgtttgtcaagacagccgccggacacgtttgttgatgccttcgagaggcgcgcccgcgcacagcccggaagagccctgctggtatggaccggtccaggggccggcagtgttacattcggagaactcgacgctagggcatgtcaggcggcatgggctctgaaggctgagctgggcgatccagcgtccctgtgtgccggagagcccaccgccttactggttctggcatctcaggctgtccccgctttatgtatgtggctcggcttggccaaattgggatgtcctaccgcttggatcaatccacacggtcggggcatgccccttgcgcactctgtcctgtctagcggcgcacgagtcttagttgtcgatcccgacctgcgggaaagcctggaggagattcttcctaaactgcaagccgaaaatattaggtgtttctacctgagccacactagccccacaccaggcgtgggcgcgctcggtgccgccctggatgctgcaccatcccatcccgttcctgccgatctaagggcaggtattacatggcggtcaccagcactcttcatctatacctccgggacaactggcctgccgaagcccgctatcctcactcatgagcgtgtactgcagatgtccaagatgttaagtctgagcggcgcaacggcagacgatgtggtctatacggtcttgcccctttaccatgtgatggggctcgtggtgggcatcctcgggtgcctggatctcggcgctacctgcgtgctcgctcctaagtttagtacctcttgcttctgggatgactgcaggcaacacggtgtgactgtgatcctttatgtcggggaactgctgaggtacctctgcaatatacctcaacagccggaagatcgcacccataccgtgcggttagcaatgggtaatgggcttcgggccgatgtttgggagacatttcaacagagatttgggccaattaggatctgggaggtgtacgggagtaccgagggaaatatgggactcgtgaactatgttgggagatgcggggcccttggcaaaatgagctgcctgcttcggatgctcagcccattcgagctggttcagttcgacatggaggccgctgagcctgttagggacaatcagggcttttgtattcctgtagggctgggtgaacctggcctcctgctcactaaagtagtctcccaacagcccttcgtgggctacagagggccccgagaactcagcgaaagaaagctggtcagaaacgtgagacagagcggcgatgtgtattacaacaccggcgacgtcctcgctatggatagagaaggctttctctatttcagagacaggctgggcgataccttccgctggaaaggcgagaacgtgtccacacatgaggtggaaggcgtgttatctcaggtggacttcctgcagcaggtgaatgtctatggcgtttgcgtccccggatgcgaaggaaaagtgggcatggcagccgtacagctcgcccccgggcagacattcgacggtgaaaagctctatcagcacgtgagagcttggctacccgcttatgcgaccccacatttcatccggatacaggacgccatggaagtcacatcgacattcaagctgatgaagactaggctcgtgagagaggggtttaatgtgggaattgttgtcgaccctttgttcgttctggataatcgagcccagagctttcgtcctctcactgcagagatgtaccaggctgtgtgcgagggcacctggcgactgtag

SEQ ID NO: 205976 - DNA, 1950 bp, Artificial Sequence
  Description of Artificial Sequence: Synthetic coding sequence
atggagaacgaccccagccggcggcgggagagcatcagcctgacccccgttgccaaagggctggagaatatgggggccgactttctcgagagtttagaagagggacagttacctaggtccgacttatccccagcagaaataaggtcttcctggtcagaggccgcccccaagccctttagcagatggcggaacctccagccggcactccgagcccggagcttttgtagagagcatatgcagttgttccgctggatagggacgggcctgctgtgcaccggtctgtctgcctttctcctggtcgcctgcctccttgatttccagagggccctggcactgtttgttctgacttgcgtggtgctcacgtttctgggccatagactgctgaagcggctgctcggcccaaaattaaggcgttttctgaaacctcagggccaccctagactgctgctgtggtttaagaggggattggccctcgctgcatttctgggcctggttttatggctgtctcttgatacttcacagagaccagaacagttggtcagtttcgccgggatctgtgtgtttgtcgcgctgctgtttgcctgttctaagcatcactgcgccgtctcttggcgtgccgtgtcttggggtctgggtctgcaatttgttttggggctgttggtcatccgaacagaaccaggctttatagcttttgaatggttaggcgagcagataagaatctttctctcttacacaaaggccggtagctcttttgtatttggagaggccttggtgaaagacgtgttcgccttccaggtgcttcctataattgtattcttttcatgcgtgataagcgtgttatatcatgtgggccttatgcagtgggtgatcctgaagatagcttggcttatgcaggtgacgatgggcacaactgcaaccgagactctgtcagtggcggggaatatatttgtgtcacagactgaagcccctttacttatcagaccttacctggctgacatgaccttatcggaggtgcatgtggtcatgacaggggggtacgccacaatcgcggggtctttgctgggggcttatatctctttcggcatcgacgccacctcgctgatagctgctagtgtgatggccgcaccatgcgccctggccctgtccaaactggtgtatcccgaggtggaagagagcaaatttagacgtgaagaaggggtgaagctgacatacggggacgcccaaaatctcatagaagccgcctcaacaggtgccgcgatatctgtgaaagtcgtggcaaacatagctgccaacttaatcgccttcctggccgtgctggacttcatcaacgcggctcttagttggctaggagacatggtcgacatacagggcttatcctttcaattaatctgttcttacatcctgcgcccagttgctttcctcatgggagttgcctgggaggattgcccagtcgtggctgagctgctcggaatcaagctctttctgaatgaatttgtcgcctatcaggacctgagtaagtacaaacagaggcgcctggctggcgctgaagaatgggtgggtgaccggaaacagtggatctctgtcagagcggaagttctgaccacgttcgccttgtgcggcttcgccaattttagtagcattggcattatgttggggggtttgacctcaatggtgccccaacgaaagtcagattttagtcagatcgtgctgcgcgctctttttactggagcatgtgtgtcactcgtaaacgcgtgtatggctggaatcctctatatgccgaggggggcagaagtggactgtatgtctcttttgaacactacgctgtccagttcctcgttcgaaatctaccagtgctgtagagaggcttttcagagtgtcaacccggaattctcacctgaagctctggacaattgttgcaggttttacaatcatacaatttgtgctcagtag

SEQ ID NO: 205977 - DNA, 528 bp, Artificial Sequence
  Description of Artificial Sequence: Synthetic coding sequence
atggagaacgaccccagccggcggcgggagagcatcagcctgacccccgtggcgaaaggtttggaaaatatgggcgcagacttcctggagtccctagaggagggccagctgcctcgtagcgacctgagcccagctgaaattagatcctcttggtcagaggctgcacccaagccattttcccgctggagaaacctacagcccgccctgagagcacgcagcttctgccgtgagcatatgcagctgttccgatggattggcactggccttctatgcacgggactgtcggcattcttgcttgtggcctgtttgctggacttccagcgcgcgctcgccctgtttgtactgacctgtgtggtgctgactttcctcggccatcgactgttaaagcggctgctaggtcctaagctgagacgattcctcaagccacaagggcacccccggctgttgctgtggttcaagagagacccacggccatggagcaaggaaggacctaatcagtacttgccccagatcacctggaccgtttag

SEQ ID NO: 205978 - DNA, 1950 bp, Artificial Sequence
  Description of Artificial Sequence: Synthetic coding sequence
atggagaacgaccccagccggcggcgggagagcatcagcctgacccctgtagctaagggacttgagaatatgggcgccgattttctggaatctcttgaggaaggacaactcccccgctcggacctgtccccagcagagattcgtagctcttggtccgaggccgctccgaaacctttcagtaggtggcggaatttgcagccggccttaagagccagatcattttgccgtgaacacatgcagctgtttcgatggatcggcacgggcttgctttgcacaggcttatccgctttccttctagtcgcttgtcttctggacttccagcgcgcacttgcgctgttcgtgctcacatgcgtcgtcctgacattcctcgggcatcgcctgttgaaaagacttctcggccccaagttgcgacgctttctgaaaccacaaggccatccccggttgctgctgtggttcaagcgcgggctggcactggccgccttcctgggtttagtgttgtggcttagcctggacacttcccagcgacccgagcaactcgtgagctttgccgggatctgtgtcttcgttgctcttttatttgcttgctccaagcaccactgcgctgtgagctggcgtgccgtgagctggggcttgggtctccagttcgttttggggctgctggtgattcggaccgaaccggggtttatcgcttttgagtggcttggagaacagatacgaatatttctcagttataccaaggccggttcaagctttgttttcggcgaagcccttgtgaaagacgtgtttgcattccaggtgctccccattatagtatttttctcatgtgtgatctccgtcctttaccacgttgggctgatgcagtgggtgattcttaaaattgcctggctgatgcaggtgaccatgggaaccaccgcaaccgaaacgcttagtgtggccggcaacatcttcgtgagccaaacggaggccccacttttgattagaccttacctcgcggacatgacccttagtgaagtgcatgtggtgatgacaggcggctacgcaaccattgcaggaagtttacttggcgcatatataagtttcgggatcgacgccacatcgctaatagccgctagcgtgatggcggccccatgtgccctggccctctctaagctagtctatcctgaggtggaggagtcaaaatttcgccgcgaagagggcgtcaagctgacttacggcgatgcacagaatctgattgaagctgcatccacaggagctgcaatcagcgtcaaggtggtggcaaacatcgccgcgaatctgatcgcgtttcttgctgtgctggacttcatcaatgcagccctttcctggctgggtgatatggtagatatccagggactttcattccagttgatatgtagctatatcctcagaccggtcgctttcctaatgggagttgcctgggaggactgtccagtcgtagccgagcttctaggaattaaactgtttctgaacgaatttgttgcttaccaggacttaagcaaatacaaacaacggcggctcgctggcgccgaagaatgggtgggagatcggaaacaatggatatccgtcagggcagaagtccttacaaccttcgctctctgtggattcgcaaatttttctagcataggcatcatgcttgggggacttaccagcatggttccccagcgtaagagtgatttctctcaaatcgtgcttcgggcgctgtttacaggggcctgtgtcagcctggtaaatgcatgtatggccggaatcttgtatatgcccaggggggccgaagtggattgtatgtcattactcaacactactttgtcttcgtcctcctttgagatataccagtgctgtcgcgaggcatttcagtcagtgaatcctgagtttagtcctgaggcccttgataactgctgtagattttacaaccacacgatctgtgctcagtag

SEQ ID NO: 205979 - DNA, 1632 bp, Artificial Sequence
  Description of Artificial Sequence: Synthetic coding sequence
atggagaacgaccccagccggcggcgggagagcatcagcctgaccccagtggctaagggactggaaaacatgggggcagactttctggagtcacttgaagaggggcagctgcccagatcagatctgtctcccgctgagatccgttcctcatggtcagaagcggccccaaagcccttctcccgctggcggaacctgcagccggctctgcgcgccagatcattctgccgggagcacatgcagttgttccgttggatcgggacaggactgttgtgcacagggctatcggcgtttctgcttgtggcctgtttgctggattttcagagggccctcgccttgtttgttcttacatgcgttgtgttaactttcctgggccaccgcttgcttaagcggctgttgggcccaaaactgcggcggttcttaaagccccagggacaccctagactacttttatggtttaaaagaggactggcacttgctgccttcctgggactggtgttgtggctatcgctcgacacctcacaaagacccgagcagctggtgtcatttgcaggaatatgcgtgtttgttgctctgctgttcgcttgttcaaaacaccactgtgctgtgagctggagggctgtctcgtggggcctaggattacagtttgtgctcgggttgttggttattagaactgagccaggcttcatcgccttcgaatggcttggggagcagatccgcatcttcctgtcctacaccaaagcaggatcctcatttgtgtttggggaggccttggtgaaagacgtgttcgcttttcaggtcctgccaataattgtgttcttcagctgtgtaatttctgtgctttatcacgtggggctgatgcagtgggtgattctgaagatcgcttggctgatgcaggtgacaatggggactaccgcaaccgagaccctgtctgttgccgggaacatctttgtctcacagaccgaggctcccctgttaattcgcccttatttggccgacatgacactgtctgaggtgcatgtcgttatgacaggcggatatgccactatcgccggatcactgctcggagcatatataagttttggcattgacgccaccagcctcatcgcagccagcgttatggcagctccctgtgcactggcgctcagcaagcttgtttaccctgaagtggaggagagtaaatttagacgagaagagggggtaaaattgacctacggcgatgcacagaacctcatcgaagctgctagcactggcgccgcaatttcagtcaaagtggtcgcaaatatcgccgccaatttgatcgcattcctggctgtgctggacttcattaatgctgccctaagctggttgggtgatatggtggacattcagggcctgtccttccagctgatctgctcatatatcctgcgccccgttgccttcctaatgggtgtagcctgggaagactgccctgtggtggcagagctactgggaattaaattgttcctcaatgagtttgttgcctaccaagatctttctaagtacaagcagcgaaggttagctggcgccgaagaatgggttggggatagaaagcagtggatctcgcgccgagggctagccatgctgactaggctggttcttaatagttggccgtag

SEQ ID NO: 205980 - DNA, 1911 bp, Artificial Sequence
  Description of Artificial Sequence: Synthetic coding sequence
atggagaacgaccccagccggcggcgggagagcatcagcctgacccccgttgctaaagggctagagaacatgggcgccgatttcctcgagtctctcgaagaggggcaacttcccaggagcgaccttagtcccgccgagattcggtccagctggagcgaggctgcacccaagccgtttagccgatggagaaatctgcagcccgccttgcgggctcggagcttctgtcgtgagcacatgcagctttttcgttggatcggcactggactcctgtgcacgggactgtccgcctttctcttggtggcctgtctgctagatttccagcgagcactcgccctgtttgtactgacctgtgtggtgctcaccttcttgggacaccgcctgctcaaacggcttctcggacccaaactccggcgattcctcaagccccagggccatccccgattgcttctgtggtttaagcggggcctggccttggcggcctttttggggctggtcctgtggctcagtctggacacatctcagcggccagagcaactcgtgtcgtttgccggaatttgcgtatttgttgcccttctctttgcctgctccaagcatcactgtgccgtctcttggcgcgccgtctcatggggcttgggcctgcagttcgtgttgggacttctcgttattagaacagagcccggcttcatagcctttgaatggttaggtgaacagatccgaatctttctgtcttatactaaggctggatctagctttgtatttggggaggccctggttaaggacgtcttcgccttccaggtgctccccattatcgtattctttagttgtgtgataagtgtgctctatcacgtgggactgatgcaatgggtgattctgaaaattgcctggcttatgcaggttaccatgggaaccaccgctactgagaccctgagcgttgctggcaatattttcgtgagtcagaccgaggcacccctacttatccgtccgtacctggctgacatgaccctgtctgaagttcatgtggtgatgacggggggctacgcaacgattgccggaagcttactgggagcttatatctccttcggcatcgatgcaacttcgctaatcgctgcaagcgtgatggccgctccatgcgccctcgcactgagtaaactggtgtatccggaagtggaggaaagcaaattccgcagagaagaaggggttaaactgacatacggagacgcgcagaatttgatcgaagctgccagtaccggtgcagctattagtgttaaagtcgtggctaacatagctgcaaatcttattgccttcttagcggtgttggatttcatcaatgcggccctgtcatggctgggggatatggtggacatccagggactcagtttccagctaatttgttcctacatcctgagacccgtggctttcttgatgggcgtggcctgggaggattgccctgtcgtggccgagcttctgggaatcaagttgttccttaatgagttcgttgcgtaccaggatctgagtaagtacaagcagcggcgtctggccggcgcggaggaatgggtcggggatcggaaacagtggatttcggttagggctgaggtgttgaccacattcgctctgtgcggctttgcaaacttcagttccataggaattatgttggggggactgactagcatggtgcctcagaggaagtcagactttagccaaatcgtgctacgagccctctttaccggagcttgcgtgtccctcgtcaacgcgtgtatggcagggatcctgtatatgccccgcggagctgaggtggattgcatgtccttactgaatacgaccctgagctcgagttccttcgagatctaccagtgctgtcgtgaagccttccagcgcatcttcaagagtacacctgccgagagtcaaccgtag

SEQ ID NO: 205981 - DNA, 864 bp, Artificial Sequence
  Description of Artificial Sequence: Synthetic coding sequence
atgcagctgttccggtggatcggcaccggcctgctgtgcaccggcctatcggccttcctgttagtggcctgcctattagacttccaaagggctttggctctcttcgtgttaacttgtgtcgtcctgacatttctgggccacagactccttaagagattacttggccccaagttgagacggttcctcaaacctcaggggcatcctaggttactcctctggttcaagagaggcctcgccctggccgcatttttgggcctcgtgctttggctctccctggacacaagccaaagaccagaacagctcgtgtcctttgccgggatttgtgtgttcgttgcactgttgtttgcttgctcgaaacaccattgtgccgtgtcttggcgtgccgtgagctgggggttggggctgcagtttgtgttgggcctgctggtgatcagaactgagccgggtttcatagcatttgagtggttgggtgaacagattcgtatattcctaagctataccaaagctggatccagcttcgtgttcggcgaggctctcgtgaaagacgtctttgcattccaggtgctccccattatcgtctttttttcctgtgttatctccgtgctgtaccatgttggcctcatgcagtgggtcatactgaagattgcctggctgatgcaagtaacaatggggaccactgccacggaaacactgtccgtagctggcaacatattcgtgtcccagacagaggcccccctgttaattagaccctacctcgccgacatgaccctgagcgaagtccatgtggtaatgaccggtggttatgcaaccattgctgggagtttactaggtgcctacatctcttttggactggaaaaactatag

SEQ ID NO: 205982 - DNA, 1452 bp, Artificial Sequence
  Description of Artificial Sequence: Synthetic coding sequence
atggagaacgaccccagccggcggcgggagagcatcagcctgacccccgtcgcgaaaggtctcgagaacatgggggctgacttcctggaaagcttagaggaggggcagcttccacgaagcgatttatcaccagcagagataaggtcctcctggagcgaagcagcccccaagcctttctccaggtggcgcaatctacaacccgccctcagagccagatcattctgcagggagcacatgcagctttttcgttggattggcaccggattactgtgtactggactatccgcgtttcttctagtggcatgtctcctcgacttccagagagctctggcactcttcgtgctgacgtgcgtcgtgcttaccttcttaggtcatcggttactgaagagactgctcggtccaaagcttagacgcttcctgaaaccccaaggacacccgaggcttcttttgtggtttaagagagggcttgccctggcagcgttcctaggactcgtgctctggctatctctggatacttctcagcggcccgagcagctcgtgtcgttcgctggtatctgcgtttttgtcgctctcctttttgcgtgtagcaaacaccactgtgccgtgagctggcgggcggtttcctgggggctggggcttcagttcgtcctcggcttgcttgtaattaggacagagccgggatttattgccttcgagtggctgggggaacagataagaatttttctgtcatacacaaaagcgggcagttcatttgtgtttggagaagccctagtcaaagacgtgttcgcatttcaagtgcttccaatcattgttttttttagctgcgtgatcagcgttctgtaccatgttggtctgatgcaatgggtaatactgaagatagcctggctcatgcaggtgactatgggaaccacggctactgagactctctccgtcgccgggaatatctttgtctcccagaccgaggccccactactcattaggccctacctggccgatatgaccctttccgaagtgcacgtcgttatgactggcggatacgcaactattgccggcagcctccttggagcctacatcagtttcggggtacgggctgaggtcctcacaacctttgctctgtgcggcttcgcgaatttttcatccataggaattatgctaggaggattgacatccatggttccccagcgcaaatccgatttttctcagattgtcttaagagccctttttaccggtgcctgtgtaagcctggtgaatgcctgtatggcaggtatcctgtacatgccgcgcggcgcggaggtcgattgcatgagtctcttgaatactacacttagctctagttcttttgaaatttaccaatgctgtcgagaggctttccaaagtgtgaaccctgagtttagccctgaagctcttgataactgttgcagattttataaccatacgatctgcgctcagtag

SEQ ID NO: 205983 - DNA, 1977 bp, Artificial Sequence
  Description of Artificial Sequence: Synthetic coding sequence
atggagaaggccagcggccggcagagcatcgccctgagcaccgtggagacagggacagtcaaccctggcctggaactgatggagaaagaagtagagcccgaggggtccaaacggactgatgcacaagggcatagccttggcgacggactcggtcctagcacatatcagcggaggtcccgatggcctttttccaaagcgcgaagcttctgcaagacccacgccagcctttttaaaaagatcctgctcggcctgctgtgcctggcatacgccgcctatctgctcgctgcatgcatactgaatttccagcgggccctggcattgtttgttataacttgcttggttatattcgtgctggttcacagcttcctgaaaaagcttctcggaaagaagctcactagatgtttgaaaccctttgagaattcaagattacgcctatggactaagtgggtcttcgccggggtgtctttggtgggcctcatcttatggttggccctggatactgcccaaaggcctgagcagcttatacctttcgccgggatctgtatgttcattctgatcctgttcgcctgcagcaagcaccactcggcagtcagctggagaaccgttttttcaggactgggtctccaatttgtcttcggcattctagtcatccgaactgatctcggctacacagtgttccaatggctcggagagcaggtccagatttttctgaactacaccgtggccggctctagtttcgtgttcggtgataccctggtcaaggacgttttcgcgttccaggcactgcctatcatcatcttttttggctgcgttgtgtccattctctactacttaggattagtgcagtgggtggttcagaaagttgcatggttcctacaaatcacgatgggcacgactgctacagagactctcgccgttgccggcaatattttcgtcgggatgactgaggctccactgctcatcagaccatatttgggggacatgacactatcagagatccacgccgtcatgacggggggttttgcaaccatcagcggaacggtgctcggtgcctttatagcattcggcgtcgacgcaagttccctaattagcgcaagtgtcatggctgctccatgcgcactcgcaagtagcaaactggcctatcccgaagtggaggagtctaaatttaagtcagaggaaggagtgaaactccctcgaggaaaagaaagaaatgtgctggaagccgccagcaacggagcagtggacgcgatcggtctggcaaccaatgtggctgccaatctcatcgcattcctcgctgtgctggcctttataaacgctgccctatcctggctcggggaactcgtcgacattcagggtctcacgtttcaggtgatctgcagttacctcttgaggcccatggtcttcatgatgggtgtcgagtggaccgactgtccgatggttgccgagatggtggggatcaagttttttattaacgagtttgtggcatatcagcaactatctcagtacaagaataaaagactctccggtatggaggagtggatcgaaggagaaaagcagtggattagcgtgagggccgaaattataacgacctttagcttatgtggattcgccaatttgagtagcataggaatcacattgggcggtctcacctccatcgtaccacacagaaagtcggacctctcgaaggtagtggtgagggcactgtttacaggagcttgcgtgtccctgatttccgcctgtatggccggtatcctgtatgtccccagaggcgcagaagcggattgcgtatcattcccaaatacctctttcacgaaccggacgtatgagacatacatgtgttgccgaggtctttttcagagtacgtctctcaatgggaccaatccccccagcttctctgggccatgggaggacaaggagttttccgctatggctttaaccaattgttgtggcttctacaataatacagtctgtgcttag

SEQ ID NO: 205984 - DNA, 2076 bp, Artificial Sequence
  Description of Artificial Sequence: Synthetic coding sequence
atggagctgcggagcaccgccgccccccgggccgagggctacagcaatgtggggtttcagaacgaggaaaactttctggagaacgaaaatacttctgggaataattccatccgctccagagcagtccagagtagggagcataccaacactaaacaggacgaggagcaggtgactgtagagcaggactcaccacggaaccgggagcacatggaagatgatgacgaggaaatgcaacagaagggctgtctggaaagacggtacgacacagtctgtggattctgtcggaaacataagaccacactgcgtcacataatttggggtatactcctcgccgggtacctggtgatggtgattagtgcttgcgtacttaattttcaccgcgccttgcccctctttgtcataacagtggcggcaattttcttcgttgtgtgggatcatctaatggccaagtatgaacatagaatcgacgagatgctgtctccgggtcgccgactgctcaatagccactggttttggctaaagtgggtgatttggtcctctctcgttctggctgttatcttctggctggcgttcgataccgccaagttgggacagcagcagctggtcagctttgggggcttgatcatgtatattgtcctactgttcttgtttagtaaatatccgacgcgtgtttactggaggccagtcctctgggggataggcctgcagttcctcctggggctcttgattttgcgcacagaccctgggttcatcgcctttgactggctgggaaggcaggtgcaaaccttccttgagtatactgacgctggggcgagtttcgtgttcggtgaaaagtataaggatcattttttcgccttcaaagttctgccaattgtagtgttcttcagcacagtgatgtctatgctctactacttgggacttatgcaatggatcattaggaaggtggggtggattatgttggttactactggaagtagtcctattgagtccgtggtggcctctggaaatatatttgtcggccagacagaaagcccccttctggtccggccatacctgccctacatcaccaagtccgaactgcatgcaatcatgacagccgggttttccactatcgccggctcagttttgggggcttacatctctttcggggtaccttcgtcccatctgcttactgcgagcgtgatgagcgctcctgccagccttgctgctgctaaattgttctggcctgagactgaaaaacccaagatcaccttaaagaacgctatgaagatggaaagcggggatagcggtaacttacttgaggccgcgacacagggtgccagcagcagcatttcactcgtcgcgaatattgccgtgaacctgatcgctttcctggctctcctgtctttcatgaacagcgccttgagttggttcgggaacatgtttgactatccacagctcagctttgagttgatttgcagctacattttcatgcctttctcttttatgatgggcgtggagtggcaagatagttttatggtggcccgactcattggatataagacattcttcaacgagttcgtggcatatgagcaccttagcaagtggatccacctgagaaaggaaggtgggcccaaatttgtgaatggggtccagcagtacatttcgatcaggtccgaaatcattgccacttacgcattgtgcgggttcgctaatattgggtccctcgggatcgtgatcggcggcctcacctctatggctccttctcggaagcgagatattgcttctggcgcggtccgcgctctgatcgccggcactgtcgcctgtttcatgaccgcatgcatagcagggatcctcagcagtaccccggtcgacatcaattgtcaccacgtcttggaaaatgctttcaactcaaccttcccaggcaataccacaaaagttatcgcctgctgccagtccttgctttcttccacagtggccaaaggtcctggggaagttatccctgggggcaaccacagcctttactctctgaagggttgttgtactctgctaaatccgtcaacctttaactgcaatggcataagcaataccttttag

SEQ ID NO: 205985 - DNA, 1869 bp, Artificial Sequence
  Description of Artificial Sequence: Synthetic coding sequence
atggaggacgacgacgaggagatgcagcagaagggctgcctggagagaagatatgacacagtctgtggcttttgcaggaaacacaaaactactctgaggcacatcatatgggggatactactagccggatacctcgtgatggtgattagcgcttgtgtgctgaatttccaccgggctctgccgctcttcgtgattacggtcgctgccattttcttcgtcgtgtgggaccatctgatggccaagtatgagcaccgcatcgatgaaatgctcagccctgggagacgcctgttaaacagccactggttctggctaaagtgggtgatttggagcagcttagtgctagcagtcatcttttggctagcctttgatactgcgaaactaggacagcaacagcttgtgtcattcggcggtttgattatgtatatcgtgctgttatttctgttctcaaaatatcccacccgagtgtactggcggcctgttctctggggaatcggccttcagtttctgttggggcttctgatcttgcgtacagatcccgggttcatcgcctttgactggcttggacgccaggtgcagaccttcctcgaatataccgacgcaggcgcgagctttgtctttggcgaaaaatacaaggaccacttttttgcttttaaggttctgcccatcgtggtattcttctctactgttatgtccatgctctactaccttggcctcatgcagtggataatacgtaaggtggggtggatcatgctcgttaccacgggctcgagccccatagaaagcgtggtcgccagcggtaacatcttcgtaggacagactgagtcccctctgttagtcagaccatatctcccctacatcacgaaatccgagctgcatgccataatgaccgctggattctcaaccattgcaggttccgttctgggcgcatacattagctttggggtcccatcttctcacctcctgactgcctctgtcatgtcggcccccgcctccctggctgccgccaagctgttttggccagaaactgaaaagccaaagatcaccttaaagaatgcaatgaaaatggagagcggagatagcggcaatctccttgaggccgctactcagggcgcctcttccagcatttctttggtggctaatatcgccgtgaatctgatagcgtttctggccctgctcagcttcatgaacagcgcactctcgtggttcggtaacatgtttgattatccccagctgtcgtttgagctgatctgcagctacatatttatgcccttctcttttatgatgggcgttgagtggcaggatagttttatggtcgctagactgattggctataaaacgttcttcaatgaattcgtggcctacgaacacctgtctaaatggattcatctgaggaaagagggggggccaaaattcgtcaatggcgtccaacagtacatttcaattagatccgagattattgccacatacgccctgtgcgggttcgccaacatcgggtctctcggaattgtaattggaggtctgacatccatggctccgagccgcaagcgtgacattgcttctggcgccgtgcgggccctcatagcggggactgtggcatgtttcatgacagcttgcatcgcaggaatcctgagctccaccccggttgatatcaactgccaccatgtattagagaatgcatttaattctactttccctggaaataccactaaggtgattgcatgttgtcaaagcctgctgagcagcaccgttgccaagggtcctggggaagtaatccctggcgggaaccatagtctgtatagcttgaagggttgttgtaccctcctgaatccatctacatttaactgtaatggtattagcaacaccttttag

SEQ ID NO: 205986 - DNA, 1608 bp, Artificial Sequence
  Description of Artificial Sequence: Synthetic coding sequence
atgcggcgggagcggacccggggcccccaggcctgggagttccccagccccaccaagagcggttgctcactgcagtccttatcgagggatctgagagagctgcgggagggagagaaaccagaagatcaggcagagacggaggagagctggcaaggactcgctagaaagacgccgggaaaggcctgcgctccggagggcggctcctgccagcccgggaaaaccgaaaacaccataactatgacaaccagccaccagcctcaggatcgctacaaggctgtatggctaatcttttttatgctggggttggggactttacttccctggaattttttcatgaccgccacccagtatttcacgaatagattagatatgagccagaacgtgtcccttgtgactgcggagctaagtaaagacgcccaggcgtccgctgcccctgctgcccccctgcctgaacgaaattctctctctgcaatcttcaataacgttatgacattgtgcgctatgcttcctctcctgttattcacctacctgaattctttcctgcatcagagaatcccacagagtgtgaggatactgggaagcctcgtggcgatcctgctggtgtttctgattactgccatcttagttaaggtgcagctggatgccctacccttttttgtgattactatgattaaaatagtgctcattaacagtttcggtgcaatattgcagggttcactgttcggcttggcaggcctcctcccggcttcctacacagcacctatcatgagcggacagggtttggcaggtttctttgccagcgtggctatgatctgcgcaattgcttcgggctcagagctgtccgaaagtgctttcggctacttcattaccgcctgtgcggtgatcatccttactatcatttgttacctgggactgccccggctggaattttaccgctactaccagcagcttaagctggaagggccaggagaacaggagaccaaactggatttaatatcaaagggcgaggagcctcgtgctggaaaagaggaaagtggggtgagtgtgtcaaattctcaacctaccaacgaatcacactccatcaaggccatacttaagaatatctctgtcctggccttcagcgtgtgcttcatcttcacaatcacaattgggatgttccctgccgtgacggtggaagtgaagtcctctatcgcgggtagttccacatgggagaggtacttcatccccgtgtcatgctttcttacatttaacatctttgactggcttggccggagccttaccgccgtattcatgtggcccggtaaagatagtcggtggttacccagcttggttcttgcgaggctcgtattcgttcccctgctgctactgtgtaatatcaaacctcgtagatacctaacagtcgtgttcgagcatgacgcttggtttatatttttcatggctgctttcgcgttcagcaacggctatttggcctccctttgtatgtgtttcggtccgaaaaaggtcaaacctgccgaggctgaaactgctggcgccataatggccttcttcctttgcctgggactggcactcggtgcagtgttctcgttcctgtttagggccattgtatag

SEQ ID NO: 205987 - DNA, 1371 bp, Artificial Sequence
  Description of Artificial Sequence: Synthetic coding sequence
atgaccaccagccaccagccccaggaccggtacaaggccgtgtggctcatcttcttcatgctcggtctagggacactcttaccctggaacttctttatgaccgccacacaatactttacaaataggcttgacatgagtcagaacgtgtccctagtgactgctgaactctcgaaagatgcacaggccagcgctgctcccgctgcccctctaccagaacgtaactcattgagcgccattttcaataacgttatgaccctgtgcgctatgcttccgctgctgctgtttacatatcttaatagcttcctccaccaacggattccccaatctgttagaatcctgggctccctagtggccatattacttgtgtttctcattacggctattttagtgaaggtccagctcgacgctttgcctttcttcgttatcactatgattaaaatagtgctgattaattcctttggggccattctgcaagggagtctgttcgggttagcagggttgctccccgcgagctataccgctcccattatgagcggacaagggttggctggttttttcgccagcgtcgccatgatatgcgcaatcgcatcaggctcggaactcagcgagagcgcatttggatattttattaccgcatgtgccgtaataattctcactatcatttgctatttagggctcccccgcctcgaattttaccgttattaccagcagctaaagttggaagggcctggggagcaagagactaagctcgacttgatcagcaagggagaggagcccagggcagggaaagaagagagcggcgtatccgtctcaaacagccagccaacgaacgagtcacattctattaaggccattctgaagaacatctctgtcctggctttctcagtctgtttcatctttacaattacgataggcatgttcccagctgtaaccgtggaggtaaagagttctatcgccgggagctctacctgggagaggtatttcatacctgtgtcttgcttcttaacatttaatatcttcgactggcttgggaggtctttaactgctgtgttcatgtggccaggcaaagacagcagatggctgccatcactcgttctggctcggctggtgttcgtcccccttttactcttgtgtaacatcaagccaagaaggtatctgactgtggtctttgaacacgacgcctggtttatttttttcatggccgcatttgccttctccaacggctatctcgcttcgctatgcatgtgtttcggccccaagaaagtcaagccagcagaagcagagacagctggtgcaattatggcattcttcctctgtttgggactagcactgggtgctgtctttagtttcttgttcagagcaattgtctag

SEQ ID NO: 205988 - DNA, 1371 bp, Artificial Sequence
  Description of Artificial Sequence: Synthetic coding sequence
atgaccaccagccaccagccccaggaccggtacaaggccgtgtggctgatttttttcatgctcggactggggacgctgttgccttggaactttttcatgaccgccacacagtacttcacaaatagattggacatgagccagaacgtgtccctggtgaccgctgaactgtcaaaggatgcacaagccagcgccgctcctgcggccccgttacctgagcggaattccctcagtgccatttttaataatgttatgaccctttgcgctatgttgcctctgcttttatttacctacctgaacagctttctgcatcagcgcattcctcagtctgtgaggatccttggatcgctggtcgccattctcctcgtatttcttatcaccgcgatcctggttaaggtccagctggacgcattgcctttctttgtgattacaatgattaaaatagtactgattaacagcttcggagccattttgcagggatctcttttcgggctggccggcctgctgcctgcgagctatactgctccaataatgagcgggcaaggcttggccggattctttgccagcgtcgctatgatctgcgccattgcctccggatctgaactgagcgagtctgcttttggctacttcatcactgcatgtgccgtaatcattctgactataatttgttacctcgggctgcctcggttggagttctaccgttactatcagcagttgaagctggaaggacccggcgagcaggagactaagctggatctcatttcaaagggggaagagccacgcgctggcaaagaggagtccggggtgtccgtgtcgaactcccaaccaaccaacgaatcccacagcatcaaggccatcttgaagaacatcagtgttctcgcattttccgtctgctttatttttacaataacaattggaatgttccccgccgtaacagtcgaggtgaagtcatctatcgctgggtcttccacatgggagcggtattttatccccgtctcttgttttctgacttttaatatttttgactggctgggcaggtcgctgaccgcggttttcatgtggcccggcaaggacagtcgatggttgcccagtctagtcctggcacgactggttttcgtgccacttctcctgttgtgcaacataaagccccgccgctacctgacggtagtgttcgagcacgatgcgtggttcatcttcttcatggccgcctttgcattctccaacggctaccttgcctccctttgcatgtgcttcggtcccaagaaggtcaagccagccgaggcggagacagcaggagccattatggcattttttctgtgccttggccttgctttgggcgcggtcttttcgtttctgtttcgggccattgtctag

SEQ ID NO: 205989 - DNA, 1371 bp, Artificial Sequence
  Description of Artificial Sequence: Synthetic coding sequence
atgaccaccagccaccagccccaggaccggtacaaggccgtgtggctgatcttttttatgctgggtttgggtacactgctgccttggaatttttttatgacagctacacagtacttcaccaacaggcttgacatgagccagaacgtgtccctggtaacagccgagctttccaaggatgcacaggcgagtgccgctccagcggccccattacctgagaggaactccctgagcgcgatcttcaacaacgtcatgactctttgcgccatgcttccattgttgctctttacatatttgaactcattcttacatcaaaggattcctcagtccgtccgcatcctgggtagccttgtggcaattctgttggtgtttctgattaccgctatattggtgaaagtgcagctagatgcccttcctttcttcgtgattaccatgatcaagatcgtgctgatcaactcttttggcgcaattcttcagggcagcctgttcggccttgccggcctgctgcctgcaagctatactgcccccataatgtcaggccaaggcctggccgggtttttcgccagtgtcgccatgatttgtgctatcgcttctggtagtgagctttcggagagtgcatttggttatttcattaccgcttgtgcagtgatcatcctaacaatcatatgctacctcggcctgccaaggctcgagttctatagatactaccaacagctcaaactggagggccctggagaacaggagactaaactcgacctgattagtaagggggaagaacctcgggcgggaaaggaagagtccggagtcagcgtgtccaattcccagcccaccaacgaaagtcactcaatcaaggcaatccttaaaaacatcagcgtcctggcgttctctgtgtgctttatcttcaccattactattggtatgtttccagccgtgacggtggaggtaaagtcctcaatcgccggctctagtacctgggagcgctattttatcccagtgtcatgcttccttacattcaatatcttcgactggctaggccggtcacttaccgctgttttcatgtggcctggcaaagactctcgctggctccccagtctggttttggccagattggtatttgtgcccttgctactcctgtgtaatataaaaccccgccggtacctcacggtcgtgtttgagcacgacgcctggttcatattcttcatggctgctttcgcctttagcaacgggtacctcgcaagtctgtgtatgtgtttcgggcccaagaaggtcaagcccgcagaagccgagacagccggtgccatcatggctttcttcctatgcctcggactagccctgggggccgtcttctcgtttctgtttcgtgctatagtgtag

SEQ ID NO: 205990 - DNA, 1371 bp, Artificial Sequence
  Description of Artificial Sequence: Synthetic coding sequence
atgaccaccagccaccagccccaggaccggtacaaggccgtgtggcttatctttttcatgctagggcttggtaccctccttccctggaatttttttatgaccgcaacgcagtatttcaccaatagacttgacatgtcacaaaatgtttcattggtgactgcggagctgagcaaggacgctcaagcatccgcagctccagcagcaccgctacccgaacggaattcactgtctgcgatcttcaataacgtgatgaccctgtgcgccatgcttccgctgctcctgtttacctacttaaactcctttcttcatcaaagaatcccccagagcgtgaggattttgggcagtctagtcgctattctcttggtgttcctcatcacagccatcctcgtcaaggtgcagctggacgccctaccttttttcgtcatcactatgataaagatcgtgttaataaactctttcggcgctattctgcagggaagtctcttcggcttggccggcctgctaccagcgtcatacactgcgcctataatgtctggacaggggctggcgggtttttttgctagtgtagccatgatttgtgcaatagctagtgggtcggagttatctgaatcagctttcggttactttatcactgcttgtgctgtcatcattcttacaattatctgctatctcggtttgcctcggctagaattctaccggtattatcagcagttgaaactggaggggcctggagagcaggaaacaaaactggacctgatttccaagggagaagaaccccgtgctggaaaggaggagtctggagttagcgtgtccaatagtcaacctaccaacgagtctcacagcatcaaggccatcttgaagaacatttcggtgctggcattctccgtctgtttcatcttcactatcacaatcggaatgttccccgcagtcaccgttgaagtgaaaagctcaattgccgggagtagcacatgggagcgctattttatccccgtgtcctgtttcctgacatttaatatattcgactggctagggaggtcactgaccgctgtgtttatgtggcccggaaaggattccaggtggctgcctagtctggtgctggctcgcttggtttttgtgccacttttattgctgtgtaatattaaacctcgccggtatctgactgtggtttttgaacacgacgcatggttcattttttttatggccgcatttgccttcagtaatggatatctggcttccctgtgcatgtgcttcggacctaagaaggtcaagccagccgaggctgagactgcgggagccattatggccttttttctctgtttgggtctggctttgggggcggtcttctcatttttgttccgtgccattgtctag

SEQ ID NO: 205991 - DNA, 1371 bp, Artificial Sequence
  Description of Artificial Sequence: Synthetic coding sequence
atgaccaccagccaccagccccaggaccggtacaaggccgtgtggctcatattcttcatgcttggtctggggacactccttccttggaacttctttatgacggcaacccaatacttcaccaatagattagatatgagccaaaatgtcagtctcgttacggccgaattgagcaaggatgcacaagcgtccgcggcaccagccgcccctctcccagagaggaacagcttaagcgcaatctttaataacgttatgaccctctgcgccatgcttccacttctattatttacttacctcaatagctttctgcatcagaggatcccacaatccgtgcgtatccttggctcactagtggcaatcctcctggtgtttctgattaccgcaattctggttaaggtccagctggacgcactacccttctttgtgatcacgatgattaaaatcgttctgattaacagtttcggtgctattctgcaaggttccctgtttgggcttgccggactgctgcccgcctcctataccgcccctattatgtcaggacaggggttggccgggttctttgcttccgtagccatgatctgtgcaatcgccagcgggtccgagttatcagagagcgcttttgggtatttcatcactgcatgtgccgtgattattctcaccattatttgctatctgggacttcccagactagaattctatcggtactatcagcagttgaaactcgagggacccggcgagcaggagactaaactggatttgatcagtaagggagaggagccacgagccggaaaggaagaaagtggagtaagcgttagtaactcgcagcctacaaatgagagtcactctattaaggcgatcttgaagaatatcagcgtgctggcattctccgtttgcttcatcttcacaatcaccattgggatgttcccagcagtcacagtggaggtcaaaagctcaatcgcgggctccagcacatgggagcggtatttcatccctgtgagttgcttcctgacgttcaatattttcgactggctgggacgctctctgactgccgttttcatgtggcctgggaaggactctcgatggctgcctagcctggtactagcacggttggtgtttgtgcccctgttgttgctctgcaacatcaaacctcgtaggtacttaactgtcgtgttcgaacatgatgcctggtttatcttttttatggccgcctttgccttctcaaatggttacctggctagcctgtgtatgtgttttggccctaagaaagtgaaaccggcagaggcggagactgctggggcaatcatggcatttttcctatgcttgggactggctctgggtgctgtcttctcttttctgtttcgagccattgtctag

SEQ ID NO: 205992 - DNA, 1371 bp, Artificial Sequence
  Description of Artificial Sequence: Synthetic coding sequence
atgaccaccagccaccagccccaggaccggtacaaggccgtgtggctgatcttttttatgcttggcttgggcactttgcttccttggaacttctttatgacggccacacagtacttcactaatcgacttgatatgtcacagaatgtctcgctggtaaccgcagaactcagcaaagatgcacaagcgtccgcagccccagccgcaccactccctgagcgcaactctctgtccgcaatattcaacaatgtgatgacactgtgcgctatgctgcccctgctgctgtttacatatctgaactctttcctccaccaacgcataccccagagcgtgagaattctggggagcctcgttgctattctgcttgtatttctgatcacagccatcctggtaaaagtgcagctggacgctttaccattcttcgtgattacaatgatcaagattgtcttgataaatagtttcggcgctattcttcaaggatccctgttcggcctggccgggctgcttccagcctcatacactgcgccaatcatgtccggtcaggggttggcaggcttcttcgcatccgtggccatgatttgcgccatcgcatccggaagcgaactttccgaatccgccttcggatattttatcacggcctgtgccgtgataatactcacaattatctgttacctgggtcttcctaggcttgagttttaccgctactatcagcagctgaagttggagggaccaggtgagcaggagaccaagctggatctgatcagcaaaggggaggagcctagagccgggaaggaagagtctggggtgagtgtaagtaacagccagccaacgaatgagtcgcattcaattaaagccatcttgaaaaacatttccgttctggctttttcggtgtgcttcatttttactatcacaattgggatgttccccgccgtgacagtggaagtcaaatcctccatagccggcagttccacctgggaaagatactttatacccgtgtcatgctttctgacatttaacatattcgattggcttgggaggtcgctgacagctgtgtttatgtggcccgggaaagattctagatggctgccttcccttgtcctggcccggctcgtgttcgttccactcctgctgttgtgtaacattaagccccgacggtatctcacagtggtcttcgaacatgatgcatggtttatcttctttatggcggcttttgccttttctaatggatacctcgcctccctttgcatgtgctttggcccgaaaaaggtcaagcccgccgaggctgagacagccggggccataatggccttttttctttgtctgggacttgccctgggcgccgtgttttcctttctgttccgtgccatcgtttag

SEQ ID NO: 205993 - DNA, 1371 bp, Artificial Sequence
  Description of Artificial Sequence: Synthetic coding sequence
atgaccaccagccaccagccccaggaccggtacaaggccgtgtggctcatcttcttcatgcttgggcttggaactctgctcccatggaatttcttcatgacagccacgcagtatttcacaaacagactcgatatgtcccagaatgtgtccctggttaccgccgaactgtctaaggacgcgcaggcttcagcggctccagccgctccgctacctgagaggaatagcctgagcgctatatttaacaacgtgatgacactgtgtgctatgctgccgttgctgctgttcacatatctcaactcattcctgcaccaacgcatcccacagtcagtgcggatcctgggttcactggtcgcaattttgctcgtttttctgatcacagccatccttgtgaaggtgcagcttgatgctctgcccttctttgtcattacaatgatcaaaatagtactgatcaactcctttggcgccatccttcaaggatccctattcggactggcgggcctgctgcctgcctcctatacagctccaattatgtcaggccagggtctggctggtttttttgcctccgtggccatgatatgtgcaatcgcatcaggatcggagctcagtgaatctgcattcggctacttcatcaccgcatgcgctgttataatcctgactatcatttgttacctcggcctgcctagactggagttttatagatattaccaacagctcaaacttgaaggtcctggggagcaggagacaaagttggatctgatctcgaaaggcgaggagccccgcgccgggaaagaagagtccggcgtgagcgtatctaacagtcaacccacgaacgagtcccatagtatcaaggcgatactaaaaaatatttccgtgctagcattcagcgtatgctttatctttaccatcaccatcggcatgttcccggccgtaacagtggaggtcaagagctccattgccggatcctctacctgggaaagatactttattccagttagctgttttctaacttttaacatattcgactggcttggccggagcctaaccgcagtgtttatgtggcctggaaaagattcccgctggttaccttccctcgtgctcgctcggttagtgtttgtgcctctcctgctgctttgcaacattaagccacgccggtatcttactgttgttttcgaacatgacgcttggttcatcttctttatggcagcgtttgccttcagcaacggctatttggcctccctgtgcatgtgctttggccctaaaaaagtgaaacccgctgaggctgagaccgctggcgcaattatggctttctttctctgtctgggcttggcactgggtgctgtcttcagcttcctttttagagccatcgtctag

SEQ ID NO: 205994 - DNA, 1371 bp, Artificial Sequence
  Description of Artificial Sequence: Synthetic coding sequence
atgaccaccagccaccagccccaggaccggtacaaggccgtgtggttgatctttttcatgctgggactgggaaccctgctgccttggaatttctttatgactgctacccagtattttacgaaccgccttgacatgtcacagaacgttagtctggtcaccgcggagctgagcaaggacgcccaggcttccgccgctccagccgccccactaccagagaggaattcactaagtgcaatctttaataatgtgatgacactttgcgcgatgctcccactgctcttatttacctatctcaactcgtttttgcaccaacggatcccccaatcagtccgcattctcggcagcctcgtcgccattctgctagtcttccttatcactgcaatcctggtcaaggtacaattggatgccttgccattctttgttatcacaatgataaaaatcgtgctcatcaatagttttggtgctattcttcagggaagcctatttggcttggcaggcctcctccctgcctcctacactgcccccataatgtccggccagggccttgccggcttttttgcctcggtggccatgatctgcgccattgcaagcggctctgagctgtccgaaagtgcatttggttatttcatcactgcctgtgctgtaattatattaactatcatctgctacctgggactgccgaggctagagttttataggtactatcagcagctgaagctcgaggggcctggggagcaggagaccaagctggacttgataagcaagggcgaagaaccgcgcgcgggcaaggaggagtccggcgtgtctgtttccaacagccagcccacaaatgagagtcattccatcaaggcaattcttaagaacatctcagttctggcattctcagtctgttttatatttacgatcactattggaatgttccctgcagtcacggtggaagtaaagagctctatcgcagggagctctacatgggaacgctatttcattcccgtctcctgctttctgactttcaatatcttcgattggcttggaagatcgctgacagccgtttttatgtggcccggcaaggatagtcggtggctaccttcgctcgtgctggcccgtttagtattcgtgcccttgttgcttctctgtaacattaagcccaggaggtatctgaccgtcgtgtttgaacatgacgcttggttcatctttttcatggcagcattcgccttttctaatggatatttagctagcctttgtatgtgttttggtcctaaaaaggtgaaaccggcagaggccgagacagccggggcaataatggctttctttttgtgcttgggcctggcactgggagcagtattctctttcctcttccgggctattgtttag

SEQ ID NO: 205995 - DNA, 1371 bp, Artificial Sequence
  Description of Artificial Sequence: Synthetic coding sequence
atgaccaccagccaccagccccaggaccggtacaaggccgtgtggcttatttttttcatgttaggtcttggcaccttgctcccgtggaacttcttcatgactgcaacccaatacttcaccaaccgtctagacatgtctcagaacgtcagccttgtgaccgcagagttaagcaaggatgctcaagccagtgccgctcccgccgcccctctgcccgagcggaattccttatcagccattttcaataatgtcatgaccctatgcgcgatgctcccactgctgctgtttacatacctgaactcctttcttcaccagaggattccacaatcagtgcggatcctgggctctctcgtggcaatcctgttggtgtttcttatcacagccatcctggtaaaggtccagctggacgcattgccatttttcgtgatcactatgatcaagatcgtccttattaattctttcggtgccatccttcagggtagtctgttcgggttagctggcctgctccccgcgtcgtacactgcccctataatgtccgggcaaggactggcaggtttcttcgcctccgtagctatgatctgcgctattgcaagcggcagcgaactgtccgagtccgcctttggctacttcattaccgcatgtgctgtgatcatcctcacgatcatctgctatctggggttaccacgactggagttctacaggtattaccaacagctgaaactcgaaggccccggcgagcaggaaacaaaactggacttgatctctaagggcgaggaaccacgagcaggcaaagaagaaagcggagtatccgttagcaacagccagccaactaatgaatctcacagcatcaaggcgatcctcaaaaatatctcggtgttagccttctctgtctgttttatcttcacaatcactataggtatgtttccagctgtcactgtggaggtcaaatcctctatcgccggaagtagcacatgggagcggtacttcatccctgtgagctgttttctgacatttaatatcttcgactggctcggccgttcactgacggccgtgttcatgtggcctgggaaggattcgagatggcttccctccttagtgttggcgagacttgttttcgtgcccctcctcctgctatgtaatattaaacctagacgttatcttaccgttgtcttcgaacatgatgcctggttcatcttctttatggctgcctttgccttcagcaatgggtacttggcgtcattatgtatgtgttttggtccaaagaaagtcaaacccgctgaggccgagaccgccggcgcgatcatggccttcttcttgtgcttagggctggccctgggggcagtattcagctttctgttccgggcgattgtgtag

SEQ ID NO: 205996 - DNA, 510 bp, Artificial Sequence
  Description of Artificial Sequence: Synthetic coding sequence
atgcggcgggagcggacccggggcccccaggcctgggagttcccctcaccgaccaaatccggctgctcgcttcagtcactatccaggtacaaagctgtgtggttgatcttctttatgctgggactcggcacgctccttccttggaatttctttatgactgccacacagtattttactaaccgcctcgatatgtctcagaacgtgtcactcgtcacagccgagctgtccaaggacgctcaggcttctgcagctccggccgcacccctgccggagagaaactccctatctgctatttttaacaacgtgatgaccctgtgcgctatgttgcctctactgcttttcacttatttaaactcttttcttcaccagcgtatcccccagtctgtgcggatcctagggtcgcttgtggcaattttgctagtgtttttgattacagcaattctcgtcaaggtgcagctggatgctctgcctttctttgttatcacaatgataaagatcgtgctgatctag

SEQ ID NO: 205997 - DNA, 1371 bp, Artificial Sequence
  Description of Artificial Sequence: Synthetic coding sequence
atggcccggggcgacgccccccgggacagctaccacctggtgggcatctcctttttcattctgggtctgggtacgctgctgccctggaacttctttattacggctatcccttattttcaggcgcgcctggccggggccgggaatagcacagcaaggattctgagcacaaaccataccgggccagaggatgcgttcaattttaacaactgggtcactctcctctctcagctcccccttttactatttacactcctgaattcatttctatatcagtgtgtgcccgagactgtcagaatcctaggctccctacttgccatcctattgctgttcgcactaacagccgcgctggttaaggtcgacatgtcccctgggcccttctttagcattaccatggcttccgtttgtttcataaatagcttttccgcagtgttgcaaggcagtctgtttggccagcttggcaccatgccctctacatatagcactttgttcctgtcaggacaggggctggcgggaatctttgctgcactcgctatgttactgtccatggctagcggggtggatgctgaaacttccgcgctcggctactttatcacaccgtgcgtggggatcctgatgtccattgtgtgttacctcagtctgccccacttgaagtttgctagatactatttagccaacaaatccagtcaggcccaggcacaggagctggagacaaaggcagaactgctgcagagcgatgaaaatggaataccttctagtccacagaaggtggcgcttacgttggatctggatcttgaaaaagagcctgagtctgaacctgatgaaccacagaagccggggaagccttcagtttttaccgtgtttcaaaaaatttggctaacggcactctgcctcgtgcttgtgttcacagtcacgctgtcagtgttccccgcaatcactgctatggtaacgagctctacgtcgcctggaaagtggagccaattttttaatccaatctgttgttttcttttgtttaatattatggactggttgggacggtctttgacaagctatttcctttggccggacgaggacagtagactgctgcctctcctcgtctgtctgcgattcctgtttgtcccactcttcatgctgtgccacgtgccccagagaagtaggctcccaatcctattcccacaagacgcatattttatcaccttcatgctcctcttcgcagtgagcaacggttacctcgtgagtctgacaatgtgtctggcccctcgccaggtgttgccccatgaaagggaagtagctggcgctctgatgaccttctttctggcgcttggtttaagttgcggggcttccctgtcatttcttttcaaagcccttctctag

SEQ ID NO: 205998 - DNA, 1371 bp, Artificial Sequence
  Description of Artificial Sequence: Synthetic coding sequence
atggcccggggcgacgccccccgggacagctaccacctggtgggcattagctttttcattcttggtctgggcaccttgctaccatggaacttctttattactgcaatcccatacttccaagcccgactagcaggtgcgggaaactctacagccagaatactgagcactaaccacaccggacctgaggacgcattcaattttaacaattgggtgacactcttgagtcagctgccacttctgctcttcaccttattaaatagcttcttgtaccagtgtgtacccgagacggtccggattcttgggtccctactggccatactgcttctgtttgctctgaccgcagctctcgttaaagtcgacatgtccccaggaccatttttctctatcaccatggcctctgtgtgctttattaactcattcagcgcagttttgcagggaagcctctttggacagctcggaaccatgccctctacttacagcacattgtttttgtccggccagggcctcgccgggatattcgccgccttggccatgcttcttagtatggcctcaggcgtggacgccgagacaagcgccttgggatactttataactccctgcgtaggcattctgatgtcaatcgtgtgttatctctctcttccccacctcaaatttgcacggtattatcttgccaacaaaagctctcaggcgcaggcccaggaacttgagaccaaagcagagcttctgcagagtgatgaaaacggtattcctagttcaccccagaaagtggctctgacacttgatctagacctggagaaggaacccgagtccgagcctgacgagccacagaaacccgggaaacccagcgtgttcaccgttttccagaaaatatggcttacggcgctgtgccttgttctggtgtttacagttacacttagcgtattcccggcgataaccgctatggttacctcttccaccagccccggcaaatggagtcagttctttaacccaatctgttgctttcttctcttcaacattatggattggttagggaggtccctgacaagctacttcctctggcctgacgaagattctcggctcctgccactcctcgtctgcctgcgttttctgttcgtgcctctcttcatgctttgccatgttcctcaacgtagccggctgcccatcctgttcccccaagacgcctactttatcacgtttatgctgttattcgcggtctccaacggttatctcgtcagcctcactatgtgtctcgcccctcggcaggtcctgcctcacgagcgcgaggttgcaggcgctctcatgacctttttcttggctttaggcctatcctgtggagctagcctcagctttctgttcaaagccctcctctag

SEQ ID NO: 205999 - DNA, 1371 bp, Artificial Sequence
  Description of Artificial Sequence: Synthetic coding sequence
atggcccggggcgacgccccccgggacagctaccacctggtgggcattagtttcttcatactgggactcggcacccttttaccttggaacttctttatcacggctataccctactttcaagcgcgccttgccggggccggcaattccacagccagaatcctaagtaccaatcatacgggccccgaagatgcgttcaactttaacaattgggtgactttactcagtcagctcccattattattgttcactctacttaactcttttctttaccagtgcgtgccagagactgtgagaattctgggctctctgctggccatcctgctgcttttcgcccttacagcagcccttgttaaggtggacatgtctccagggccttttttctccatcactatggcatccgtatgctttattaattctttttccgcggtgctccagggctcgctgttcggacagctaggtactatgccctcaacatactccactctctttttgagtggacaggggcttgctggcatttttgcagcgttggcgatgttgctgagcatggcctcaggtgtggatgccgagaccagtgccctgggctacttcattacaccgtgcgtgggaatcctgatgagcatagtgtgctatctgagcctcccccatctgaagttcgcccgctactacctggctaacaagtcatcacaagcccaagctcaggaacttgagaccaaggctgagttgctgcagtccgacgagaatggaatcccatcatcaccacagaaggtggcactcaccctagacctggacctagagaaagaacccgaaagtgagccggatgagcctcaaaaaccaggaaagccttccgtgtttactgttttccagaagatatggctcaccgcattatgcctggtgctggtattcaccgtcaccctgtcagtcttcccagcaattaccgccatggtgacaagcagcacgtccccgggcaaatggtctcagttctttaatcctatttgctgtttcctgctgtttaacatcatggactggctgggcagaagtttaacgtcctacttcttatggcccgatgaggattcccggctgttgccactgctcgtctgtctgagatttctgtttgtccctctgtttatgctgtgtcatgtccctcaacgctcccgacttcccattctctttccccaggatgcttactttattacgttcatgctcctgtttgctgtgtctaacggatacttagtgtctctaacaatgtgcctggctccaagacaggttttgccccacgaaagagaagtagcaggcgccctcatgacattttttctggccttgggtctgtcctgcggcgcgagtctgtcattcctttttaaggcactcttatag

SEQ ID NO: 206000 - DNA, 1428 bp, Artificial Sequence
  Description of Artificial Sequence: Synthetic coding sequence
atggccgtggtgagcgaggacgacttccagcacagcagcaacagcacatatcgcaccacctcctctagccttcgggccgatcaggaggccctgctcgagaaactcctggatcggccacctcccggtctgcagagaccggaggacaggttctgtggcacatatatcattttcttctctctgggtatcggtagtttgctgccatggaatttctttattactgctaaggaatattggatgttcaaactcaggaattccagcagccctgcgacaggcgaagaccctgagggtagtgacatactcaattacttcgagagctacctagccgtcgcctccaccgttccatccatgctttgcttggttgcaaactttctgctggtgaatcgggtcgcagtgcatattagggtgctggcgtccctgaccgtaatccttgccatattcatggtcatcacagcgctggttaaagtagacacttctagctggaccaggggatttttcgcagtcactatcgtctgtatggttattctgtcaggagctagtacagtgttcagctcatccatatatgggatgactggaagtttccccatgcggaacagtcaggctcttatttcgggtggtgcaatgggaggcacagtctctgccgtggcctcactggtagatctggccgctagtagcgatgtgcggaactcggctttggcattcttcttaacggctacagtcttcctggtgctctgtatggggctgtacctactgcttagccgactggaatacgcccggtactacatgagacctgttttagccgcacacgttttctccggggaagaggagctgccacaggacagcttgagtgcgcccagcgtggccagcagattcatcgattcccacacacctcctcttaggcccatactcaagaaaaccgcctcattggggttttgtgtgacatacgtattctttattacttcactcatttatccagccatttgcacgaatatagagtctctcaataaaggatcagggtccctgtggactacgaagttcttcattcctctcaccacattcctcctgtataatttcgccgatctctgcgggagacagttgactgcttggattcaggtgcccgggccaaatagtaaggccctgccgggcttcgtcctcttgcgcacctgtctcataccgctgtttgtgctttgtaactatcagcctcgcgttcacttgaagaccgtcgtcttccaaagcgacgtgtatcctgccctgctctcaagtcttctggggctcagcaacgggtacctctctactctggcactcctgtatggccccaaaatagtccctagggaactggccgaagccacgggagtcgtgatgtccttttacgtgtgcctcggtctaactctggggtcagcctgttctaccctgctggtgcatttgatctag

SEQ ID NO: 206001 - DNA, 1590 bp, Artificial Sequence
  Description of Artificial Sequence: Synthetic coding sequence
atgagccaggacaccgaggtggacatgaaggaggtggagctgaacgagttggaacctgaaaagcagccaatgaacgccgcttctggtgctgccatgtctttggctggggctgagaagaatggactggtgaaaattaaggtggctgaggacgaggccgaggccgcggccgctgcaaaatttacaggattgtccaaggaagagctgctgaaagtggcagggagccccgggtgggtacgcacccgctgggcattactcctgctgttctggcttggttggctgggtatgttggcaggtgccgtggttattatcgttagggccccgcggtgcagagaactccctgcgcagaagtggtggcacactggcgcactctatcgtatcggagacttacaggcatttcagggtcatggagccggaaatctggccggccttaagggccggctggactatttgtcgtcgctgaaggtcaaagggttagttctcggccccatacataaaaaccaaaaggatgacgttgcacagaccgatctactgcaaatcgaccctaactttgggagtaaagaggacttcgactccttgcttcagtcggccaagaagaagagtattcgggtgattcttgacctgacacctaattatagaggtgaaaatagctggttctcaacccaggtggataccgtagcaaccaaggtcaaggacgcactggagttctggctacaagcaggggtcgacggcttccaagtacgcgacattgaaaacttaaaggacgcctcaagcttcctggccgagtggcagaatattaccaaaggattctcagaggacagactgctgatagcagggacgaattcaagcgatctgcagcagattctgagcctactggaatcaaacaaagatctgctgctgaccagcagctaccttagcgattctggctccacgggagagcacaccaagtccctcgtgacacaatacttaaatgcaaccggcaaccgctggtgttcctggtccctttctcaagcccggttgctgacaagctttctccccgcacagctgcttagattgtatcaattgatgttattcactcttcccgggacacccgtgttcagttacggcgacgaaatcggtctggacgcggccgctttgcccggtcagcctatggaggcccccgtgatgctctgggatgagagcagctttccagatattcccggagcggtgtcagcaaatatgacagtgaaaggtcagtccgaggaccctggctctctcctcagtctttttcgacggctctccgatcagcgatcgaaggagcgcagcctgttgcatggcgacttccacgccttcagcgctggccctggtttattcagttacatccggcactgggaccagaatgaacgatttctggtggttctcaatttcggggacgtgggcttatccgcgggacttcaggccagtgacctgcccgcatcggcctccctacctgccaaagcagacctgctgctgtcaacgcagccgggacgtgaagaaggctcccccttagaactcgagcggcttaagctggagcctcacgaaggactgctgctgcgcttcccttacgcagcctag

SEQ ID NO: 206002 - DNA, 1707 bp, Artificial Sequence
  Description of Artificial Sequence: Synthetic coding sequence
atggagctgcagccccccgaggccagcatcgccgtggtgagcatcccccgccagctgccaggatcccactcagaggcaggagtgcaaggactgagcgccggcgatgactctgggacaatgagccaggatacggaagtcgacatgaaggaagtcgagctgaacgagctggaacccgagaaacagccaatgaatgctgcaagcggtgcagccatgtcactggcaggtgcagagaagaatggattggtcaagattaaggtcgctgaagacgaggctgaagctgcggcagccgctaagtttaccggtctgtccaaggaggagctgttgaaagtcgccggctcccccggctgggtacggacacgctgggcattacttctgctgttctggcttgggtggctaggaatgctggcaggcgctgtggtgataattgtccgcgcacctaggtgcagagaactgcctgcccagaagtggtggcacacaggcgccttataccgcattggagatcttcaggctttccagggccacggcgccgggaacctggctggtttgaaaggacggttagattacttgagctctctaaaggtgaaagggctggtgctaggtccgattcacaagaaccagaaggacgatgtcgcgcagacagatctgctccagatcgaccccaactttggctctaaagaagatttcgacagtctgcttcagagcgccaagaagaagtcaatcagggtgatacttgacctaactcccaattaccggggtgaaaattcctggttctcgactcaagttgacactgtcgcgactaaggttaaggatgcccttgagttttggctacaagcaggtgtcgacggtttccaagtgcgagacattgagaatctaaaagacgctagtagtttcttggccgagtggcagaatattaccaaagggttctccgaagaccggctgctcatagccggtaccaactcatccgacctgcaacaaatactcagtctcttagaatcgaacaaagatttgctattgacctcaagttatctttcggactcaggatcaaccggggaacatacaaaaagcttggtgacacagtacttgaacgctactgggaaccggtggtgctcctggtccctgagccaagcgcgattgttaaccagcttcctcccagctcagctgttgagactgtaccaattaatgctcttcacgctgcctgggacgcctgtgttcagctacggtgatgagatagggctagatgccgcagcgttaccgggacagcccatggaagcccctgtaatgttgtgggacgagtcttctttcccagacatcccaggcgccgtatccgcaaacatgacagtaaaaggccagtcagaggatcccgggtcgcttctttctctcttccgtcggctttctgatcagcgcagcaaggaaaggagcttgttgcacggcgacttccacgctttcagtgccggtcctggcctgttctcctacattcgccactgggatcagaacgaaaggtttcttgtggtgctgaacttcggcgacgtagggctgtccgctggcctgcaagcatctgacctcccagcgtctgcatctctgcccgcgaaggctgacctgcttctgtcaacccagcctggccgcgaggagggaagcccgttggaactggagcgcctgaaactggagccacacgaagggctccttctgcggttcccctatgctgcttag

SEQ ID NO: 206003 - DNA, 1893 bp, Artificial Sequence
  Description of Artificial Sequence: Synthetic coding sequence
atggagctgcagccccccgaggccagcatcgccgtggtgagcatcccccgacagctcccggggtcacactccgaagctggcgtgcagggcctcagcgctggagatgatagtgaacttggcagccactgtgtcgcacagacagggctggaactgcttgcaagcggtgacccgctaccatccgcgtcccagaatgctgaaatgattgagacaggttcagattgtgtcacccaggctggtctgcagctactggcctcctctgatccacctgcactcgccagtaaaaatgccgaggtgaccggcactatgtcacaggatacggaagtcgacatgaaagaagttgaactgaacgagttagagcctgagaaacaaccaatgaatgcagcatctggagccgcaatgagtctggctggagccgagaagaatggacttgtgaaaatcaaggtcgcagaagacgaggctgaggccgcagctgccgcaaagtttaccgggttgagtaaagaggagctgctgaaagtggcgggcagccccggctgggtccggaccaggtgggcccttctcctcctcttttggctgggatggctcggcatgctggccggggctgtggtgatcatcgtcagggctcctcggtgccgagaactgcctgctcagaagtggtggcacaccggggcactgtacagaattggcgatctccaggcctttcagggtcacggagccggaaatctcgctggcttgaagggccgattggattacttgtcaagtctgaaggtgaaagggcttgttctgggtcctatacacaagaatcaaaaggatgatgtcgcccagacagacctactgcagatcgatcccaacttcggaagcaaagaggactttgacagcctgctgcaatctgctaagaaaaagtctatacgagtcattctggacttaactcccaactaccgaggcgagaattcatggttttccacacaggtggacactgtcgccacgaaggtgaaagacgcgctcgaattctggctgcaggcaggcgtggacggatttcaggtgcgtgacatcgagaatctgaaggatgcttcaagcttcctggcagagtggcaaaacattactaaggggttctccgaggacaggctccttatcgctggcacgaacagctcagacttgcagcagatactgtcactcctagaatcaaataaggacctccttctcacctctagttatttgtccgacagcggatcaaccggggagcacacaaaatcgctggtgacgcagtacttgaacgccacggggaacaggtggtgtagctggtcactgtcacaggctcggttactgaccagcttcctgccagcccagctgctgcgcttataccaactcatgctgttcacgctgccaggcactcccgtatttagctatggagatgaaattggcctggatgctgctgctttaccaggccagccgatggaggcacccgtcatgctatgggacgagagctcctttccggatatcccgggcgcagtaagtgctaacatgaccgtgaagggacagagcgaggatccagggagcctgttaagcctgtttagacggctgagcgaccaacgatctaaggagcgtagcctgcttcacggggattttcacgccttttcagccgggcccggcctgttcagctacattaggcactgggaccaaaatgaaagattcttggtcgtgctgaatttcggtgacgttgggttgtcggctggactccaggcatccgatctacctgccagtgcctccctgcctgctaaggccgatctactgctctcaactcagcccggccgggaggagggaagtccgcttgaattggagaggttaaagttggagccccatgaggggctgcttctgcgctttccatatgcagcatag

SEQ ID NO: 206004 - DNA, 1896 bp, Artificial Sequence
  Description of Artificial Sequence: Synthetic coding sequence
atggagctgcagccccccgaggccagcatcgccgtggtgagcatcccacgtcagctgcccggaagtcactctgaggccggagtgcaggggctctcggccggcgatgactctgagacaggaagcgactgcgtaacacaagccgggctgcagctgctcgccagttccgacccccctgctttagcttccaaaaacgctgaggtgaccgtggaaacgggctttcatcacgtcagccaagctgacatagaattcctcaccagcattgatcctaccgcctctgcttccggttcagccggcatcaccggaacaatgtctcaagacaccgaggtggatatgaaagaggtggaactgaatgagttagaacccgaaaagcagccgatgaacgcagcaagcggtgctgctatgagcctggccggcgcagaaaaaaacggcttggtgaagattaaggtcgccgaggatgaggctgaggccgctgccgcggcaaaatttactgggctaagcaaggaggagttgctgaaggtagccgggagcccaggatgggtccggacaagatgggccctcctgctcctattttggttgggatggctgggcatgctggcaggtgcagttgtcattattgtaagagctcctagatgccgggaattacccgctcagaagtggtggcacactggggcactctaccgaattggcgatttgcaggcatttcaggggcatggggccggtaacctcgctggcctcaagggacgcttggattatctctcatcgttgaaggtgaaaggactggtgctcggccccatccataaaaatcagaaggacgatgtggcacagacggatcttctgcagatagacccaaatttcggatcaaaggaagatttcgatagcctcctgcagtccgcaaagaagaagagcattcgggtcatcctggacttgactccaaattatcgcggcgagaactcgtggttttctacccaagttgatacagttgccacaaaagtgaaggacgctctcgagttctggctgcaggccggggtggacggttttcaggtccgtgatatcgaaaacctaaaggatgcctcttcgttcctggcagaatggcaaaacataacaaaaggattcagcgaggacaggctgctaatcgccgggactaatagtagcgatctgcagcagattttgtcgcttctcgagagcaacaaggacctccttcttacctcttcctacctgtccgattccggcagtacaggtgagcacacaaaaagtctggtcactcagtacttgaatgccaccggaaatagatggtgcagttggagtctgagtcaggccaggctactaacgtctttcttgccagcacagctgctgaggctgtaccagcttatgctgttcaccttgccaggcaccccagttttctcctatggggatgaaatcgggctggatgcagccgccctacccggacagccgatggaagccccggttatgctctgggatgagagttcctttccagacatcccaggagcggtgagcgctaatatgacagtgaaaggccagtccgaagaccccggcagcctactatcactatttcggcgattgagcgaccagagaagcaaagagagaagtttgttgcacggagacttccacgcatttagtgcaggtcctgggctattctcttacatccgacactgggaccagaacgaaaggttcttggtggtgctgaacttcggcgacgttgggctgagtgctgggctccaggcatccgatctccctgcctctgcctctttgcctgcgaaagctgacctgctcctctcaacacagcctggccgagaggaagggtctccgttagagctggagcgtctgaaactcgagccgcacgagggcctcttgctgcgatttccgtacgccgcatag

SEQ ID NO: 206005 - DNA, 1986 bp, Artificial Sequence
  Description of Artificial Sequence: Synthetic coding sequence
atggagctgcagccccccgaggccagcatcgccgtggtgagcatcccacggcagctccctggttcccactccgaggcaggagtacagggcctaagcgccggagatgatagcgaactgggctctcattgtgtcgcccaaacaggcttagaactgctcgcttctggagacccgctcccgagtgcttcgcaaaatgccgagatgattgagaccggctccgactgcgtcacgcaagccggtctgcaactgttggcttcctctgatccccctgcgctggcctccaagaatgcagaagtgacagagaccggtttccaccatgtctctcaggcagacatcgagtttctgaccagtatagatcccactgcgagcgcatccggcagcgctgggatcaccggcaccatgtctcaggatacggaggttgacatgaaagaagttgaactgaatgaacttgagccggagaaacaaccaatgaacgcagcctcaggggctgccatgtctctagctggtgctgagaaaaatggcttggtgaagatcaaggtggccgaggatgaggcagaggcagccgcagctgccaagttcactgggctatccaaggaagagctgctgaaagtagcggggagtccaggctgggtgcgcactagatgggcactcctgttactattttggcttgggtggctcgggatgctggctggcgcagtggtgattatcgttagagctccaagatgcagagaacttcccgctcagaagtggtggcacacaggagccctgtatcgcatcggcgatctgcaggcttttcaagggcacggagccgggaatcttgctggactgaagggcagactggactatctgtcctccctcaaggtgaagggtctagtgctggggcccatacataaaaatcagaaagacgacgtggcccagaccgaccttctgcagattgatccgaacttcggaagcaaggaggatttcgactcgctgttgcagtcagccaaaaaaaaaagcattcgcgttatcctggacctcaccccgaactaccggggagaaaactcatggttcagcactcaggtcgatacagtggctactaaagtaaaagatgctctcgagttctggctacaggctggcgtggacggattccaggtgagagacattgagaacctgaaggacgcctctagcttcctggccgagtggcagaatatcactaaaggtttcagtgaggatagacttctgatagcaggaacaaactcttctgatctacagcagatcctgagcctgctggagtctaacaaagacctgcttttaaccagttcgtatctgtctgacagtggcagcacgggcgagcacacaaagagtctggtaacccagtacctcaatgccacgggtaataggtggtgttcctggtctttatcccaagctcgactcctcactagttttctccccgcccagctgttgcgtttatatcagctgatgctgttcacgcttcccggtactcccgtgttttcctacggagatgaaatcggcctggatgctgccgcactgcccggacagccaatggaggcccccgtaatgttgtgggacgaatcctccttccccgatatcccaggagccgtgagcgctaatatgactgtgaaggggcagtcagaggatccaggctccttgcttagcctttttagaaggctgtctgatcaacggtcgaaagaaaggtcactgctgcatggtgatttccatgctttcagcgcaggccctgggttgttctcctacatacgccattgggatcaaaacgagcgatttctggtggtgcttaacttcggagacgtgggattgtcagcagggcttcaggcttcagacctgccagccagtgccagcctgccagccaaagctgacctcctattgtcaactcagcccggcagagaagagggttctccactggaacttgagagacttaaactggagccccatgagggattactgctgaggttcccttacgccgcctag

SEQ ID NO: 206006 - DNA, 1536 bp, Artificial Sequence
  Description of Artificial Sequence: Synthetic coding sequence
atgagccaggacaccgaggtggacatgaaggaggtggagctgaacgaactggaacctgaaaaacagcccatgaatgcggcctccggcgccgctatgagcttggcgggggctgaaaagaacggactggttaaaattaaagtagctgaggacgaggccgaggcagccgccgccgctaagttcaccggtctatccaaagaggagctccttttttggttagggtggctgggtatgctggcaggagcagtggtcatcatagttcgagccccacggtgccgtgagttgcctgctcagaaatggtggcatacgggcgccttatacaggatcggtgatctgcaggcgttccaggggcacggtgccggcaatctggcgggcctgaaaggccgactagactatctaagctctctaaaagtgaagggtcttgtgttgggtcccatacacaaaaaccaaaaggatgacgtggctcagacagatttgttacaaatagacccgaacttcggtagtaaagaagacttcgactcactgctacagtctgccaagaagaagagtatcagggtgattttggatcttactcctaattacaggggcgagaacagctggttcagcactcaggtggacacagttgcaactaaggtgaaagacgcattggagttctggctgcaggccggcgttgatggttttcaagttagagatatcgagaatttgaaggatgcatctagttttctggccgaatggcaaaacattacaaaaggattcagcgaggaccgactactgatagccggaactaattcaagcgacctccaacaaatactgagcctactggagagcaacaaggacctcctgcttacaagcagttatctgtctgattccgggagtactggagaacacactaagtctctggtgacccagtacctgaacgccaccggcaatcgctggtgctcctggagcctatcccaggcccggttgctgactagtttcctacctgcacaacttctacgactgtatcaactcatgctgttcacattacctggaacacccgtctttagctatggggatgagatcggactggatgctgcagcactgcctgggcagcctatggaggcccccgtcatgctctgggacgaatcctccttccccgatattcctggagctgtctccgcgaatatgacagtgaaaggccaaagtgaagatccgggaagcttgctcagcctcttcagacgcctgagcgatcagaggagcaaagaacgcagtttgctccacggagacttccatgctttctcagctggtccaggcctcttcagttacatccgccattgggaccagaatgagcgattcttagttgtgctgaactttggcgatgtgggcctcagcgcaggtttacaggccagtgatttgcccgcttccgcgtcattgccggctaaggccgatctactgctaagtacacagccaggaagggaagaaggttcccctctagaactcgaaagactgaaactggagcctcacgagggtctgctcctccggtttccctacgcagcctag

SEQ ID NO: 206007 - DNA, 408 bp, Artificial Sequence
  Description of Artificial Sequence: Synthetic coding sequence
atgagccaggacaccgaggtggacatgaaggaggtggagctgaacgagctcgagcccgagaaacagcctatgaatgctgcatctggtgccgccatgagcctggccggcgccgagaagaacggtctagtgaagatcaaagtggccgaagatgaagcagaggccgccgctgccgccaaatttacgggcctgagtaaagaagagttgctgaaggtggcaggatcacctggctgggtgcgcactaggtgggctctattattattgttttggttgggatggcttggcatgctcgctggggcagtggtaatcatcgtgagagccccccgatgccgcgaactcccggcccaaaaatggtggcacacaggcgcattataccgcatcggagatctacaggccttccaggggcattag

SEQ ID NO: 206008 - DNA, 2058 bp, Artificial Sequence
  Description of Artificial Sequence: Synthetic coding sequence
atggccgaggacaagagcaagcgggacagcatcgagatgagcatgaaggggtgccagacgaacaacggattcgtgcacaatgaagatatcttagaacagacccccgacccaggaagcagcacagataatctgaaacattcaactcgcggcatcctggggtcacaggagccggattttaagggtgtgcagccatatgcaggaatgcctaaggaggttttgtttcaattctctggtcaggcaagataccgcatcccgcgggaaatcctattttggcttaccgtcgcaagcgtcctcgtactgatcgcagccaccatcgcgattatcgcccttagtcctaagtgcctggattggtggcaggagggacctatgtaccaaatctatccccggagctttaaggattccaacaaagacggcaatggtgacctcaaaggaattcaggacaagctcgactacataaccgctctgaacataaagactgtttggatcacaagcttctacaagagctcactgaaggacttcaggtacggcgtggaagatttccgcgaagtagatccaatctttggcacaatggaggattttgaaaatctggtcgccgctatccatgacaagggactgaaactgatcatcgattttatccccaaccacaccagcgacaagcacatatggtttcagctgtctcggacacgaactgggaaatacacagactactacatatggcacgactgtacgcacgagaacgggaaaactattccgcccaacaattggttatcagtttacggaaattccagttggcacttcgacgaagtcagaaatcaatgctactttcaccagtttatgaaagagcagccagatctgaacttcaggaatccagatgtacaggaggagatcaaagaaattctgcgtttctggctcaccaagggcgtggatggcttctccttagatgccgtcaagtttttgttggaagcgaaacacctgcgggacgagattcaggtgaataaaacacagattccggatacagtgactcagtattccgaactgtatcacgactttacaacaacgcaggttggtatgcacgatattgtcaggtcttttagacagaccatggatcagtacagcactgaaccgggccggtaccggtttatggggaccgaggcctacgcagaatccattgatcgcacagtcatgtattacggactgcctttcattcaggaagctgattttccctttaataattatctgagcatgctcgatacagttagtggcaattcggtgtacgaagtcattaccagctggatggagaatatgccggagggcaagtggccaaactggatgatcggaggccccgacagcagcaggcttacaagccgcctgggaaatcagtatgtgaacgtgatgaatatgctgctctttacattaccaggaacccccattacatattacggagaggaaattgggatgggcaatatagtggctgctaatttaaacgagtcatatgacattaacacgctgagatccaagtctcctatgcagtgggacaacagcagcaatgccggtttcagcgaggccagtaacacctggttgccaaccaattccgactaccatacagtgaacgtggatgtacagaaaacccagccaaggtcggctctgaaactgtaccaggacctgtcgttactgcatgctaatgaacttctgctgaatagaggatggttctgccatcttaggaatgactcccattacgtcgtttatacccgcgagttggacggcatcgatagaatttttatagtcgtgctgaattttggcgagtctaccttgttaaatctgcataatatgatttccgggctcccggcaaagatgagaatcaggctctcaactaactccgcagacaaaggcagtaaagtcgatacctcaggaattttcctcgacaagggcgaaggactcatctttgagcacaatacaaaaaacttattacataggcagacagctttccgggacagatgctttgtttccaatcgtgcttgctacagctccgtgcttaacatactctatacgtcatgttag

SEQ ID NO: 206009 - DNA, 1866 bp, Artificial Sequence
  Description of Artificial Sequence: Synthetic coding sequence
atgaagaccttctggagccggccccggatccagttcagcggccaggcgcggtaccggatccctagggagatacttttttggctgaccgtggcgtctgtccttgtcttgattgctgcgaccattgctatcatagccttgtctccgaaatgcctcgactggtggcaggaaggtccaatgtatcagatttacccacgtagctttaaggactccaataaggacggcaatggggacctcaaggggattcaagataagctggattatatcactgcccttaacattaaaaccgtgtggatcacatctttttataaatctagccttaaggacttccgctacggcgtggaggattttcgcgaggtggacccaatcttcggaactatggaagactttgagaatctggtcgccgcaatccatgacaaggggctcaagctgattattgattttatccccaaccacaccagcgacaaacatatatggttccagctctctcgcaccagaacaggcaagtatactgactactatatttggcacgattgcacccacgaaaatgggaagactatcccgccaaataattggctatccgtctacgggaatagtagctggcacttcgatgaagtgcggaatcagtgttattttcatcagtttatgaaagaacaacccgacctgaatttccgcaatccagacgtgcaggaagaaatcaaagagatcctccggttctggctgacaaaaggagtcgacggtttttctttagacgccgtgaagtttctgttggaagcaaagcacctccgtgatgaaatccaagtcaataagactcagatccccgataccgtcacccagtactcagagttgtaccacgattttaccactacacaagtggggatgcacgacatcgtgcgcagttttcggcagactatggaccagtactccaccgagcctggcagataccgctttatgggcactgaggcgtatgcagagtctatcgatcgaacagtaatgtattacggtctccctttcatccaggaggcagatttccccttcaacaattacctcagtatgctcgacacagtttcgggcaacagcgtgtacgaggtgattacatcctggatggaaaacatgcctgagggcaagtggcccaactggatgatcggcggtcccgatagcagcagactgacctcgaggctgggcaaccagtatgtgaacgttatgaacatgctcctcttcactctgcccgggactccaatcacctactatggagaagaaatcggaatggggaacatcgttgctgctaatctgaatgaatcttatgatatcaataccctgcgctctaaatcccccatgcagtgggacaacagctccaacgcagggttttcagaagcctcaaatacatggcttccgacaaactctgactaccacaccgtcaacgtagacgtgcaaaaaacgcagccacgtagcgctctgaaactgtaccaggacctgagtctgctgcacgcgaatgaactcctgctgaatcgaggctggttctgtcatcttaggaacgattcccactacgtggtttacaccagagagctggatgggattgaccggatatttatagtcgtgctgaatttcggggagtccacactgttgaatctacacaacatgatttccgggctccctgccaagatgaggatacgcttgagcaccaattcagcagacaaagggagtaaggtagacacctcaggaatattcctggataagggcgaaggtctaattttcgagcataatactaaaaatctgctccaccgacagaccgcatttcgcgacagatgcttcgtgtccaacagagcatgctacagctccgtcctaaatatcttgtacacaagctgttag

SEQ ID NO: 206010 - DNA, 1656 bp, Artificial Sequence
  Description of Artificial Sequence: Synthetic coding sequence
atggccgaggacaagagcaagcgggacagcatcgagatgagcatgaagggatgccagaccaataatggatttgtgcacaacgaggacattctggaacaaacaccagaccccggttccagcacggataacctgaagcactctactcgggggatccttggatcccaggagccggattttaaaggtgtccagccatatgcaggcatgcctaaagaagtgctctttcagttcagcggccaagcgagatacagaatacctcgcgagatcctgttctggctgacagtcgcgagcgtgctcgtgctgatcgccgcgactatcgccatcattgccctaagtcctaagtgcttagactggtggcaggaaggccctatgtatcagatatatccacgatcatttaaggactccaacaaagatggcaacggggacctgaaggggattcaggacaagctggactatatcactgcactcaacatcaaaacagtgtggataacaagcttttacaagtcgtccttaaaggacttccggtacggcgtcgaggatttcagagaggtagatcctatatttgggactatggaggatttcgagaacctggtggctgccatccacgataagggtctcaaacttatcatcgatttcattcccaatcatacaagtgataaacacatctggtttcaactctcccgcactcgcacagggaaatacacagattattacatttggcatgactgtacccatgagaacgggaaaacgatccccccaaataattggctcagcgtgtacgggaactcctcctggcattttgacgaggtgagaaatcaatgttacttccatcaattcatgaaggagcaaccagacctgaactttagaaaccccgacgtccaggaagagataaaggagatcttgaggttttggctgactaagggagtggacgggttcagtctggatgccgtgaaatttctgttagaggcgaagcacttaagagacgagatccaggtcaacaaaacacaaataccagatacagtcacccagtacagcgagttgtaccacgatttcactaccacacaggtcggaatgcatgatatagtgcggtcctttcggcaaaccatggaccagtattctacagagcctgggcggtatcgtttcatgggaactgaagcctacgccgaatcaatcgaccggactgtgatgtattacggcctgcccttcatccaggaggccgactttccctttaacaattacctgtctatgctggatacagtgtcaggcaactctgtttacgaggtgatcacctcatggatggaaaacatgcccgaggggaaatggcccaactggatgatcgggggaccagattcttcacggctcacctctagattgggcaatcagtatgtgaacgtgatgaacatgctattgttcaccctcccaggcacaccgattacttactatggtgaagaaatcgggatgggaaacatcgttgccgcgaatctcaacgagtcgtacgatataaacactcttaggagcaagtcccccatgcagtgggacaatagctccaatgccggcttcagcgaagctagcaatacctggctgcctaccaacagcgattaccatacagtcaacgtggacgtgctgctcagacacccgtgctccagcgccgtagcctag

SEQ ID NO: 206011 - DNA, 1524 bp, Artificial Sequence
  Description of Artificial Sequence: Synthetic coding sequence
atgggctgctggggccggaaccggggccggctgctgtgcatgctggccctgacctttatgttcatggtgttggaagtcgtcgtgtctcgggtaactagcagtctagctatgttgtctgactccttccatatgctttctgacgtccttgctctggttgtagcactggtggctgagaggttcgcaagacgcacacatgccacacaaaagaacacatttgggtggatacgggccgaagtaatgggtgcgctcgtgaatgctatctttttgacaggcctgtgcttcgcaattttactggaagcaatcgaaaggtttatcgagccacacgaaatgcagcaacctctggttgtccttggggtgggcgtcgcggggctgttagtgaacgtgttgggattatgtctttttcaccaccattccggcttcagccaggacagtgggcacggtcatagccatggcggccatgggcatggacacggtctgcctaaggggccccgtgtgaaatcgacgcggccgggctcctcggatattaatgtggctcccggtgagcaaggcccggatcaagaagaaacaaacactctggttgctaatacatcaaatagcaatggactgaaattagacccggcggaccctgaaaaccctcgttctggagacacggtggaagtgcaagtaaacggcaacttggtgagagaacctgaccacatggaactggaagaggatcgcgctgggcagctgaacatgagaggagttttcctccacgtgctcggggacgccctcggcagcgttatcgtggtggttaatgctctggtgttttactttagctggaaaggctgctctgaaggggacttttgcgtgaacccttgctttcccgacccctgcaaagcattcgttgaaatcatcaacagcacacatgcaagcgtgtacgaggcaggcccatgctgggtcctctacctcgaccctaccttatgcgttgtgatggtgtgcattttgttgtatacaacctacccactattgaaagagagtgccttgatcttgttgcaaacagtgcccaagcagatcgacataaggaacttaattaaggaacttcggaacgttgaaggagtagaagaagttcatgaactgcacgtgtggcagcttgcgggtagcaggatcatcgccacagctcatataaagtgcgaagatccaacaagttatatggaggtcgctaagaccatcaaagatgtttttcacaaccatgggattcacgctacaaccattcagccagagttcgcctcagttggctcaaaaagctccgtggtcccgtgcgaacttgcctgtcgaacccaatgtgccctgaagcagtgctgcggcacactgccgcaggcgccaagcggcaaggacgcagaaaaaacgccggcagtgtccatcagctgccttgagctgtctaacaacctggaaaaaaaacccaggcggactaaggccgaaaacattcctgccgttgttatcgaaattaaaaatatgcctaataagcaacctgagtcctctctctag

SEQ ID NO: 206012 - DNA, 1119 bp, Artificial Sequence
  Description of Artificial Sequence: Synthetic coding sequence
atggaggccaaggagaagcagcacctgctggacgcccggcccgccattaggtcatacaccgggtctctgtggcaggagggggctgggtggatccccttgccgcgaccaggactggacctgcaggctatagaactcgccgcgcaatcaaatcatcattgtcatgcccagaagggccctgactctcattgtgatcccaagaaaggcaaggctcaaaggcagctgtacgttgcttcagcaatttgcctccttttcatgataggcgaggttgtcggcggctaccttgcacactctcttgccgtcatgactgatgcagcccacctacttacagatttcgcgtcaatgctgattagtctgtttagcctgtggatgtcttccagaccggctacgaagaccatgaacttcggatggcagagagctgagattctgggagcattagtcagcgtgctaagcatttgggttgtgacaggtgttctggtctatttagctgtcgaacgcttgatctccggagactatgaaatcgatggtggtactatgcttattacgtcaggttgtgccgtggccgtgaacatcataatggggctcacgttgcatcaatcaggccatggacattcccatggcactacaaatcagcaggaagaaaacccatcagttagagctgcctttatccacgtaatcggggacttcatgcagtctatgggggtactggtggccgcctacatactatatttcaagcctgagtataaatacgtggatcccatctgcactttcgtgttcagtatccttgtactggggaccactttgaccatcctaagggatgtgattttggttttgatggaaggcacccccaagggggtggacttcaccgctgtccgtgaccttttgctttctgtcgagggcgtcgaggctctgcactccttgcacatatgggcgctgaccgttgcccaacccgtactgtctgttcatatcgccattgcccaaaataccgacgctcaagccgtgttgaaaaccgcgagttcacgcttgcagggaaaatttcactttcatacagttactattcagatcgaggactacagcgaggacatgaaagactgccaggcatgccaggggcccagtgactag

SEQ ID NO: 206013 - DNA, 972 bp, Artificial Sequence
  Description of Artificial Sequence: Synthetic coding sequence
atggaggccaaggagaagcagcacctgctggacgcccggcccgccatacgctcatacaccggcagtctttggcaggagggcgctggatggatcccactacccaggcctggtcttgacctgcaggctattgaattggccgctcagagcaatcatcactgtcacgcccagaaggggcctgactctcattgcgatcctaaaaagggaaaggcccagagacaattatatgtggccagcgcaatttgtctgctgtttatgataggcgaggttgtggaaattttaggggcccttgtctctgtcctgagcatctgggttgtcaccggagtgctggtgtatttagccgtggagaggctgattagcggcgactatgagatcgacggcggcactatgcttattacaagcgggtgcgctgtggccgtgaatatcattatgggtctgaccctccaccagtcaggtcatggtcattcacacggaactactaaccaacaggaggaaaatccatctgttcgagcggcatttatccatgtaattggagacttcatgcaaagcatgggggtgttggtcgccgcttatatcctatacttcaaacctgaatacaaatatgtggatccgatctgtacatttgtgttcagcatcctggtgctcggaaccacactaacaatccttcgggatgtcatcctcgtgctgatggaaggtacccccaagggagtcgactttaccgcagtgagggatctgctgctctcggtagaaggtgtggaagcactgcatagtctgcatatctgggccctcacagttgcacaacccgttctgtccgtgcacatagcaatcgctcaaaatactgatgcacaggccgtcttaaagacagccagttccaggctgcaggggaaattccacttccatactgtaaccattcagattgaagattacagcgaagacatgaaggattgccaggcttgtcagggtccatccgactag

SEQ ID NO: 206014 - DNA, 345 bp, Artificial Sequence
  Description of Artificial Sequence: Synthetic coding sequence
atgggcccccggcggcggagccggaagcccgaggccccccggcggagaagcccaagtcccaccccaacacctggtccgtccaggcgtggtccctccctcggagctagttcccatcagcattcaagacgcaggcagggctggctgaaggagatcaggaagctacaaaagtccacccacctcctgataagaaagctccccttttctcgcctggccgcggaggcctttcttgtgcacttgttcgaagacgcctacctcctgaccctgcacgcagggcgcgtgactctttttcctaaggatgtgcagctggcgcggcggatcagaggtttagaagaaggtctcggctag

SEQ ID NO: 206015 - DNA, 300 bp, Artificial Sequence
  Description of Artificial Sequence: Synthetic coding sequence
atgcccttccaccactgccaccgggaccccctgcccccccccggcttgacccccgagcggctacatgctagaagacagctgtatgcggcctgtgccgtatgtttcgtgtttatggccggagaggtcgtgggagggtatttggcccactctctggcgatcatgactgacgcagcacacttgctcgccgacgtggggagcatgatgggatccctattctctctttggctctctacacgtcccgctactagaaccatgacttttggctggcacagatccgagacactcggggctctagcgtag

SEQ ID NO: 206016 - DNA, 723 bp, Artificial Sequence
  Description of Artificial Sequence: Synthetic coding sequence
atgcccttccaccactgccaccgggaccccctgcccccccccggcctaacaccggagcgactccacgccagaagacagctgtatgccgcatgtgccgtgtgctttgtattcatggcaggcgaggtggtcggtgggtacctcgctcacagcctagcaattatgactgatgcagcacacctcttggcagacgtaggtagcatgatgggatctctgtttagtctgtggctgtctacacgcccagccacacggacaatgacgttcggttggcacaggagtgaaaccttgggagcgctggccagcgtcgttagcctttggatggtcaccggcattctcttgtacctggcctttgtgagactgctgcacagcgactaccacattgagggaggggcaatgctgctcaccgcctcgatcgccgtgtgtgctaatctgctcatggcattcgtgctgcatcaagcaggaccgccgcattcccacgggagtaggggggccgagtatgccccccttgaggagggacccgaagagccattgcctctgggtaacacgagcgtgagggccgcttttgtacacgtgttgggcgacctcctgcagtctttcggggtactcgccgccagtattctcatttatttcaagccccagtacaaggctgcggacccaatcagcaccttccttttttcgatttgcgccctgggctcgacggcgcccacacttagagacgtactctag

SEQ ID NO: 206017 - DNA, 1152 bp, Artificial Sequence
  Description of Artificial Sequence: Synthetic coding sequence
atgcgggtggccgccggcgcccggggcgagaacatcgagcacctgaaactgcgcctggaagcacgtccaccgaccttgctgctattcactgaaccaagcgagcccctccccgaggaatccaagcccgtcgagatgccattccaccactgccaccgagatcccctgcctccacctgggctgactccagagaggcttcacgctcggcggcagctgtatgccgcttgcgctgtctgttttgtgttcatggctggggaggtagttggcgggtacttagctcactctctggccataatgactgatgccgcacatctacttgccgacgtgggcagtatgatgggctctctgttctccctgtggctgagcacccgcccagcaacccggactatgacctttggctggcatcgctccgagactttaggcgcactggccagcgtagtgtctctgtggatggtcacagggatcctgctgtacctagccttcgtgcgcctgctgcacagtgactaccatatagaagggggcgccatgctgttgaccgcgagcattgcagtttgcgctaatctgctcatggcctttgtgctgcaccaagctggacctccacactcacatggcagccgaggggccgaatacgcccccctggaggagggacccgaggaacccctgccactggggaacacatctgtaagggcagcgtttgtgcatgttctgggcgatttacttcaatcattcggagtgctcgcggcatccatcctgatctactttaagccacagtataaagctgctgatccaatatctaccttcctgttttccatctgcgccctcggctcgacggcccccacactgcgcgacgtattgaggatcctaatggagggcacaccccggaatgttgggtttgaaccggtccgggatacccttttatccgtgcctggagtgagagcaacacatgaactgcatctatgggccttgacccttacctaccacgtggctagtgcgcatcttgccatcgactccactgcagaccccgaagccgtgttggccgaggcttcttctcggctgtacagccgttttggcttcagctcttgcacactccaggtggagcagtaccaacctgagatggcccagtgtctcagatgtcaggaacccccacaggcgtag

SEQ ID NO: 206018 - DNA, 336 bp, Artificial Sequence
  Description of Artificial Sequence: Synthetic coding sequence
atgcccttccaccactgccaccgggaccccctgcccccccccggcctgacaccagagcgtttgcacgctaggagacaattgtacgccgcctgtgcagtttgttttgtttttatggctggtgaggtggtaggcggttatctcgcacattctctcgccatcatgaccgatgccgcccacttgttggcagacgtgggtagcatgatgggctctttgttttctctgtggctgtccactcgcccagctacgcggaccatgacttttggatggcaccggagtgaaacactcggagccctggcctctgtggtgagtctgtggatggtcactggcatcctgtag

SEQ ID NO: 206019 - DNA, 1290 bp, Artificial Sequence
  Description of Artificial Sequence: Synthetic coding sequence
atggccggcagcggcgcctggaagcggctgaagagcatgctgcggaaagacgacgctccattgttcctcaacgatactagcgccttcgactttagcgacgaagcaggggacgaggggctcagtcgtttcaataaattaagagtggtggtcgctgatgatggttcagaggctccagagcgccccgtcaatggtgcacatcctactctgcaagccgatgacgattcgctgctggatcaggacctccctttgacaaacagccagctaagcctgaaggtggattcatgcgacaattgtagtaagcagcgagagatcttgaagcagaggaaagtaaaagcgcgcctaaccatcgctgctgttctgtacctgctgtttatgataggcgagttggtgggagggtatattgcaaactctcttgcgatcatgaccgatgcactccacatgctgacagatctctccgcaataatattgactctgctggcactttggctgtcatctaagtctccaacaaagaggtttacgtttggcttccaccgcctggaggtgctcagcgcgatgatttcagtcctactcgtttatattttaatgggcttcttattatatgaggctgttcaacggacaatccacatgaactacgagattaacggtgacatcatgctcatcacagcggccgtaggcgttgcagtcaacgtgatcatggggttcctcctgaatcagagcggccataggcacagccattctcatagcctcccttccaatagtcccactaggggctctggctgcgaaagaaaccatgggcaggatagcttggctgtcagggccgcctttgttcatgcccttggcgacctcgtgcaatcagtcggagtcctaatcgcggcctatatcatcaggttcaagcctgagtacaaaattgcagaccctatctgcacatacgttttcagtcttctagtcgcatttacaacattccggattatttgggacaccgtggttatcatcctggagggcgttcctagtcatctgaatgttgactatatcaaggaagcattgatgaagatcgaggacgtgtattctgtcgaagatcttaatatctggagtctcacttccggcaaatccacagccatagtccacattcaactgataccaggtagctcttcaaaatgggaagaagtacagtcaaaggctaaccacctgctgcttaatactttcggaatgtatcggtgcacaatccagctgcagagctaccgtcaagaggtagacagaacctgtgctaactgtcagtcctcaagtccctag

SEQ ID NO: 206020 - DNA, 357 bp, Artificial Sequence
  Description of Artificial Sequence: Synthetic coding sequence
atggaggagaagtacggcggcgacgtgctggccggccccggcggcggcgggggcctgggccccgtcgacgtgccatctgcccggctgactaaatatatcgttttgttgtgttttacaaaatttctcaaggcggttggcctctttgaatcttacgacctgctgaaagccgtgcatatcgtgcagttcatttttattctgaagcttggaaccgcattctttatggtacttttccagaagccatttagtagtggaaaaactattacgaagcaccagataattggaagtctgaagatccctggcagaaaggaattcaaggataaaaagctgaatgacccacgcaagttagtggggaactag

SEQ ID NO: 206021 - DNA, 2298 bp, Artificial Sequence
  Description of Artificial Sequence: Synthetic coding sequence
atggaggagaagtacggcggcgacgtgctggccggccccggcggcggagggggtctgggccccgtggacgtgccttctgcgcgcctgaccaagtacatcgtgttactgtgttttaccaagtttctgaaagcagtcggcttgttcgagtcctacgatctgctcaaagctgtgcacatcgtacagtttatattcatcctaaagctgggcaccgcatttttcatggttctgttccagaaacctttctcctccggcaagactataactaaacaccagtggattaaaatctttaagcacgctgtggcgggttgtataatctcacttctctggtttttcgggctcaccttgtgtggccctctgaggaccttgctgttattcgagcatagcgacatcgtggtgatcagcctgctgtcagtgctgttcaccagttccgggggcggacctgccaaaacccggggggccgctttcttcatcattgccgtgatttgtttgctcctgttcgataacgacgatctcatggccaagatggccgaacatcccgaaggacaccacgactctgccttgacccatatgctgtatactgccatagcttttcttggggtcgcagatcataaaggtggggtgctgctcttagtgctagccctgtgctgtaaagtaggcttccatacggcatcccgcaagcttagcgtagacgtcggcggggccaagaggctccaggccttgtctcacttggtaagcgttttgcttctgtgtccatgggtcattgtcctcagcgttacaacggagtctaaagtggaaagttggtttagcctaatcatgccctttgccacagtgatattctttgtgatgattctcgatttttacgttgattccatctgcagcgttaagatggaggtgtcgaaatgtgcacgatacggtagtttccctatttttatctccgctctgcttttcggcaacttttggactcatccaataactgaccagctgcgggcgatgaacaaagctgcacaccaggagtctactgagcacgtcctcagcggaggggtggtagtgtcggctatcttcttcattctgtcagccaacattctctctagtcccagcaaaagaggccagaagggtaccttgattggctactcgccagaaggcactcctttgtacaactttatgggcgatgccttccagcattcgagccagtccatacccaggttcatcaaggagtctcttaaacagatattagaggaatcagactctcggcagattttctatttcctgtgtctaaacctcctttttactttcgtagagctgttctatggcgtgctcaccaatagcctgggactgatcagtgatgggttccatatgctctttgattgctccgcgttggtgatgggactttttgcagccctcatgagccggtggaaggccactagaattttctcttatgggtacggcagaattgagattcttagcgggtttatcaacggactgtttctgatagtcattgccttcttcgtctttatggagtctgttgcgagactgattgaccctccagagttggacacccacatgctgacccccgtgtcagtcggcggtctaatcgtcaatctcatcggcatatgtgcattctcccatgcacactcccatgcccatggcgcctcacagggttcatgtcattctagcgaccatagccactcccatcacatgcacggccatagtgaccacggacacgggcattctcacgggtccgccggaggtggcatgaacgctaacatgaggggcgtgttcctgcatgtgctggccgacactctcgggagcatcggggtcattgtgagtactgtgttgatcgagcaatttgggtggttcatcgctgatccactatgcagcctgttcatagccatcctgatctttctgtctgtagtgccactgatcaaggacgcctgccaggttttgttgctgcgtctgccccccgaatacgaaaaagagctgcatattgctttagaaaagatccagaagatcgaaggattaatttcatacagggatccacatttttggagacactctgcctcaatagtggccggcaccatacacatccaagtgactagcgatgtactagagcagagaattgtgcagcaggtcacaggaatccttaaagatgccggggtgaacaatctcaccatccaagtggagaaagaagcctactttcagcacatgagtggactgtccaccgggtttcacgatgtcctggccatgaccaaacagatggaaagcatgaagtattgcaaagacggcacttacattatgtag

SEQ ID NO: 206022 - DNA, 1083 bp, Artificial Sequence
  Description of Artificial Sequence: Synthetic coding sequence
atgggcgacgccttccagcacagcagccagagcatcccccggttcattaaggagagcctaaaacagatcctcgaggaatccgattctagacagattttttattttctgtgcttaaatctgctgtttacattcgttgagctgttctatggcgtgctgaccaactctctggggctgattagtgatggctttcatatgttattcgattgcagcgctctcgtcatgggcctcttcgctgctctaatgagtagatggaaggccacgcgaattttttcttacggttacggccggatagagattttgtccggtttcattaacggtttgtttctgatcgtcattgcctttttcgtgttcatggagagcgtcgcaaggctgattgacccacctgagctggatacacacatgctcaccccttgtcattcgcatgcccacggagcatctcagggaagctgccactcgtctgatcatagccactcacaccatatgcacggtcatagcgatcacggacacggtcacagccatggttctgccggaggggggatgaatgccaatatgcgaggcgtgttccttcacgtgctcgccgatactttgggatcaatcggggtcattgtgtctactgtgctgatcgaacagtttggctggttcattgccgaccccctgtgctctctctttattgccattctcatatttctgagcgttgttccactgattaaagatgcctgtcaggtgctactgttacgtctcccccccgagtatgagaaagagctgcacatcgccctggagaagatccagaaaattgaagggcttatttcgtaccgagatccccatttctggcggcacagcgcctctatcgtcgcaggcacaattcatatccaagtgacgtccgatgtcctagaacagcgcatagtccagcaagtgaccggcatcctcaaagacgcgggcgtgaataacctaaccattcaggtagaaaaagaggcctattttcaacacatgagtggtctttctacgggatttcacgatgtgctcgctatgaccaagcagatggaaagtatgaagtattgcaaggatgggacatacataatgtag

SEQ ID NO: 206023 - DNA, 1386 bp, Artificial Sequence
  Description of Artificial Sequence: Synthetic coding sequence
atgggcaccatccacctgttccggaagccccagcggagcttcttcggaaaattgctgcgggagttccgcctggtggctgccgacagacgctcttggaagattctgctgtttggggtaattaaccttatttgcacgggttttttgttgatgtggtgctcctctacgaatagcatcgctctgactgcgtatacctacctgaccattttcgacctcttttctctgatgacttgcttgatctcatactgggtgactcttcgaaagcccagccccgtgtattcctttgggtttgagaggctcgaggtcctcgcagtattcgcctccactgttttagcacagctcggggccctgtttattctgaaggagtctgccgagcggtttttggagcagcccgagatccacacaggacgcctgttagtcgggacgtttgtcgcactgtgcttcaacctcttcaccatgctaagcataagaaacaaaccatttgcctacgtgtctgaagccgcgtcaactagctggctccaggagcacgtggcagatctgtcccgatccctctgcggaattatccctggattatcttccatttttctcccccgaatgaatcccttcgtgcttatcgatctggccggtgcattcgctctctgcatcacctacatgcttatcgagataaacaattacttcgcggtggatacagcaagcgccattgctatcgccctgatgacatttgggaccatgtatcccatgagtgtatatagtggcaaagtgctgttacagaccacaccccctcatgttatcggccagctggacaaactgatacgtgaggtcagcaccctcgacggagttctcgaggtaagaaatgaacacttttggactttgggattcgggagcttagcgggctcggtgcacgtccgcatcagaagagacgctaatgagcaaatggttcttgcacacgtgacaaaccgcctttacaccttagtgtcaacactcactgtccaaattttcaaagatgactggatccgccctgccctgttaagcgggccagtggctgctaatgtgcttaacttcagtgaccatcacgtgattccgatgcctctgctcaaaggcacagacgacttgaaccccgttacttctacgcctgcaaaaccgtccagtcctccaccagagttctcctttaatacgccaggcaaaaacgtaaatcccgttatcttgttgaatactcagacacgcccctacggattcgggctgaatcatgggcacaccccttattccagcatgcttaaccaggggctgggggtgcccggtattggagccacgcagggactcagaactggcttcactaatattccttctcgctatggaacaaataatcggattggacagcctagaccctag

SEQ ID NO: 206024 - DNA, 795 bp, Artificial Sequence
  Description of Artificial Sequence: Synthetic coding sequence
atgaaccccttcgtgctgatcgacctggccggcgccttcgccctgtgcatcacatacatgcttatagagatcaataactatttcgccgtcgacacagctagcgctatagccatcgctctaatgacatttgggactatgtatcctatgtcagtgtactctgggaaggttcttcttcagaccactcccccccatgtgatcggacagttggacaagctaattcgcgaggtgagtaccctggacggggtcctggaagtgcgaaacgaacacttctggaccctgggattcggcagtcttgccggaagcgtgcatgtcaggatacgccgagatgccaacgaacagatggtgctggcgcatgtgaccaataggctttacaccctcgtttcgacactaacagttcagatctttaaggacgactggatacggcctgctctgctctccgggcctgtcgcggcaaatgtgctaaatttttcagaccatcatgttattccgatgcccttactgaaaggaactgacgacctcaaccctgtcacctctacacccgccaaaccatcaagcccgcctccagagttctcgttcaacacccccgggaagaacgttaatcctgttatcttgctgaatacccaaaccagaccttatggctttggcctcaaccatgggcacaccccttactccagcatgcttaaccagggcctgggcgtgcccggcatcggtgctactcagggacttcggactggattcacgaatattccttccaggtacggtactaataacagaatcggccagccccgaccttag

SEQ ID NO: 206025 - DNA, 1506 bp, Artificial Sequence
  Description of Artificial Sequence: Synthetic coding sequence
atgggcaccatccacctgttccggaagccccagcggagcttcttcggcaaactgctgcgtgagttcaggctcgtggcggccgatcggcgcagctggaagatcctgctgttcggagtgattaatctaatttgcaccggctttctgctaatgtggtgcagctctaccaattccattgctctgactgcatacacctacctcactatattcgacctgttccgcgacggcgtgtccccattctggctgggatggagtcagactccagacttaaagtggagcacccacctgggactgcccaagtgctgggacaataggcgggaactcccctgtctgagcaactccttgatgacctgcttgatctcctactgggtgaccttaaggaaaccatctcctgtttactcatttggatttgagcggctcgaggtgctagctgtgtttgctagcacagtgctggcccagctgggggctctgtttatattaaaggagagcgcggaacggttcctggagcagcctgaaattcataccgggcggttactggtgggtacttttgtcgccctctgcttcaacctgtttacaatgctgtctatcaggaacaaaccatttgcgtatgtgagcgaagccgcaagtacgtcttggcttcaggaacacgtcgcagacctttctagaagcctgtgtggtatcatccctgggctgtcatcgatatttctgccgagaatgaacccatttgtgctgatcgaccttgccggagcctttgccttatgtataacatacatgctgatagagattaataactacttcgccgttgacactgccagcgccatagccatcgctctgatgacctttggcactatgtaccccatgtcagtgtattctgggaaggttctcttgcaaacaacccctccacatgtcattggccagctggacaaattaatccgagaggtgtccacattggacggcgtactggaggtcagaaatgaacacttctggactctggggttcggctccctcgctgggtctgtgcatgtgcgaatccgacgcgacgctaacgagcagatggtcctggcccacgttacgaaccgcctgtatacactcgttagcaccctgactgtccagatctttaaagacgactggatccgccctgctttgctgagcggcccagtggccgccaatgttttgaacttctccgaccatcacgtaatcccaatgcctttattaaagggcaccgacgatctgaatcccgtgaccagcacccctgcaaaaccatcctcccctcctcctgaattcagtttcaacacccctggcaagaacgtgaatcctgtcatacttctgaacactcagacgaggccttacgggttcgggctcaatcacggccacacaccgtacagtagcatgctcaaccaagggttgggcgtgcccggcatcggggcgacacagggcttgagaacggggtttactaacatcccgagccgatatggaactaacaaccgaataggacagccgcggccctag

SEQ ID NO: 206026 - DNA, 1164 bp, Artificial Sequence
  Description of Artificial Sequence: Synthetic coding sequence
atgacctgcctgatcagctactgggtgaccctgcggaagcccagccccgtgtactcattcggattcgagaggctggaagttctggctgtgtttgcaagcactgtgctcgcccagctgggcgcactgttcatcctgaaggagtctgcggaacgcttcttagagcaaccagaaatccataccggacgcctactggtgggtactttcgtggctttatgcttcaacctgtttacaatgctttccattcgcaataagccgtttgcatacgtcagtgaggctgcttctacgagttggctgcaggagcatgtcgctgatctgagtcgcagtctgtgtgggattatacctggactttctagcattttcctgccccgtatgaatcctttcgtactgatcgacctggcaggtgcattcgccctatgcatcacctacatgttgattgagatcaacaactactttgcagttgacaccgctagcgccatcgccattgccctcatgacattcgggactatgtacccaatgtcggtttacagcgggaaagtcttgctgcagacgacaccaccccacgtgattggccagttggacaagcttatccgggaggttagcacactggacggcgttctcgaagttcgaaatgaacacttttggacactgggctttgggtcgctggcaggctcagtacacgttaggattcgccgcgacgccaacgaacagatggtactggctcacgtgacgaatcgcctgtacacactggtcagtaccttgacagtacagatattcaaggacgactggattagacctgccttgctcagtggacctgtggcagccaacgtgttgaatttcagcgaccaccatgtgatccccatgcctctgctgaagggcacagatgatctgaatcccgtaaccagcaccccagcgaaaccatcatctcccccccctgaattttcattcaatacccccgggaagaatgtgaatccagtgattttgctcaacacgcagacacgaccgtacggcttcggactaaaccacggccatactccatacagttctatgctcaatcagggtcttggagtgcccggcatcggcgctacgcagggtctgaggacgggttttaccaatatcccaagtaggtatggcaccaacaacagaatcggtcagccaaggccctag

SEQ ID NO: 206027 - DNA, 1317 bp, Artificial Sequence
  Description of Artificial Sequence: Synthetic coding sequence
atgggcaccatccacctgttccggaagccccagcggagcttcttcggtaaattactccgagaattcaggctagttgctgccgacaggagatcttggaaaatcttgttgtttggcgtcattaacctgatttgtaccgggttcctgctgatgtggtgctctagcaccaattcaatcgccttgaccgcctacacctacctgacgatcttcgatctgttctctctgatgacatgtctcatctcctactgggtgactctccgcaaaccttctccggtgtatagttttggcttcgagaggttggaagtcctggctgtgtttgctagtactgtgcttgcccagctgggtgcccttttcatcctaaaagagtcagcagagcgtttcctcgagcagcctgagatccacacaggaagactcctagtaggaacttttgtggctttgtgtttcaacctgttcacaatgctgtcaatccgaaacaaacccttcgcctatgtatccgaggctgctagcacaagctggttacaggagcacgtcgcggacttgtccagaagtctttgtgggatcatcccagggctgtctagcatttttctccctaggatgaatcctttcgtcttgattgacttggctggggcattcgcactatgcattacttacatgctgatagagatcaacaattattttgccgtggatacggccagcgcaatcgcgatcgctcttatgacatttggaactatgtaccccatgtctgtgtattccggaaaagttcttcttcaaaccacccccccccacgtgattgggcagttggacaagctcatcagagaggcggggtcagtgcatgtgaggattcgcagagacgctaatgagcaaatggtcctggcccacgtcacaaaccggctgtacacactggtcagtaccctaaccgttcagattttcaaggacgactggatcaggcccgcactgttgtctgggcctgtggctgctaatgtgttaaatttctccgaccaccatgtgattccgatgccactactgaagggcaccgatgatcttaaccccgtgactagcacacctgctaagcctagctccccacctcccgagttttccttcaacacaccgggcaaaaacgtgaacccggtgatcctgctgaatacccagacccggccttatggctttggcttaaaccatggacatactccttattcatccatgctgaaccagggactcggcgttccaggtattggggccacccagggactgcgcacaggctttacaaatataccgagccggtatggcaccaacaaccggattggtcagcctaggccctag

SEQ ID NO: 206028 - DNA, 1299 bp, Artificial Sequence
  Description of Artificial Sequence: Synthetic coding sequence
atgagctggaagatcctgctgttcggcgtgatcaacctgatctgcacaggattcctccttatgtggtgctcttccaccaattcaatcgcccttaccgcctacacctacctcactatctttgacctgttcagccttatgacgtgcctgataagctactgggtgactctcaggaaaccaagcccagtatattctttcggttttgaaaggctcgaggtacttgcagtgtttgcaagtacagtgctggctcagctgggggctctgttcatattgaaagagagcgcagagagattcctggaacaaccagaaatccataccggacgtctcctggtcgggaccttcgtggctctctgttttaatctcttcacgatgctgtcaatccgcaataaaccctttgcctatgtgtccgaagctgccagcacctcctggcttcaggagcacgttgccgatctctccagatctctttgcggcatcatccctgggctatcctcgattttcttgccacggatgaatccattcgtgcttatagatttggccggcgccttcgccctttgtataacatatatgctgatcgaaataaataactatttcgccgttgacaccgcctctgcgatagctatcgccctgatgacattcggcactatgtatcctatgtcagtctattccggaaaagtcctcttgcaaaccaccccacctcacgttataggccagctagataaactcataagagaagtttctacacttgacggcgtgttggaagtcaggaacgaacacttttggacactggggtttggtagtctcgctggttctgtacacgttcggatcagacgtgacgcgaacgagcaaatggtgctagcacatgttacaaaccgtctgtacaccctggtctccacacttactgtacaaatctttaaggacgactggattagacctgccttgctatccggaccagtggccgccaacgtactgaacttttcagatcaccatgtgatccctatgccattactcaagggaaccgatgatcttaatccggtaacctccacccccgctaagccatcatcccctccccctgagttttctttcaacacgccaggcaagaacgtcaaccccgtgattctcttgaatacccaaacaagaccttacggctttggtctgaaccatggccacactccatactcctccatgctgaaccaggggctgggagtccctggaattggggctacccagggattgcgcactggcttcactaacatacctagccggtatggcaccaataacagaattggccaaccacggccttag

SEQ ID NO: 206029 - DNA, 1131 bp, Artificial Sequence
  Description of Artificial Sequence: Synthetic coding sequence
atgctgcccctgagcatcaaggacgacgagtacaagccccccaagttcaatctcttcggaaaaatctcagggtggtttaggagcattttgtctgacaagacatctagaaatctgtttttctttctgtgcctcaacctctcctttgcatttgtagaactcctgtacggtatatggtctaactgtctcggactaatatccgatagtttccatatgtttttcgattccactgccattttggctggtcttgctgccagcgtgatctccaagtggagagataacgacgctttctcctacgggtacgtaagggcggaggtcctcgccggattcgtcaacgggctgttcctgatctttaccgcattcttcatcttctccgaaggtgttgaaagagctctggcaccacccgacgtgcatcacgaacgcctcctgctggttagtattctaggatttgtcgttaatcttatcgggatttttgtgttcaaacacggaggtcatggccactcccacggctccggacatggacattctcacagcctttttaatggcgctttggatcaggctcacgggcatgtggatcattgtcactcacacgaggtgaagcacggtgccgctcatagtcacgatcacgctcatggacatggccacttccacagccatgacggacccagcttgaaggagaccacgggcccttccagacaaattttgcaaggcgtttttttgcacattctggccgacaccttggggagcatcggagtgatcgcatcagctataatgatgcagaactttggactcatgatagctgaccccatttgctcaattcttatcgcgattcttattgtggtttccgttattcccttactgcgcgaatctgttggtatcctcatgcagaggactcctcctctgctcgagaattccctgccccaatgctatcagcgcgtgcagcagttgcagggagtgtatagcctccaagaacaacacttctggaccttgtgcagcgatgtatatgtgggcaccctgaagttaattgtcgcccccgatgcagacgcacgctggattctgagccagacccataatattttcacacaagccggcgtcagacaactgtacgtgcagatagatttcgccgcgatgtag

SEQ ID NO: 206030 - DNA, 273 bp, Artificial Sequence
  Description of Artificial Sequence: Synthetic coding sequence
tgagtgatccccctgctgcgggagagcgtgggcatcctgatgcagagaacccctccactactggagaattcactgcctcagtgctaccaacgggttcagcaactccagggtgtgtatagcttgcaggagcagcacttctggaccttgtgctccgatgtgtacgttggtacactgaagcttatagtagccccagatgctgacgcccggtggattctgagccagactcataatattttcacccagaaattggaagaagagaacgagaatctgtag

SEQ ID NO: 206031 - DNA, 1131 bp, Artificial Sequence
  Description of Artificial Sequence: Synthetic coding sequence
atgctgcccctgagcatcaaggacgacgagtacaagccccccaagttcaacctatttggcaaaatcagcgggtggttcagaagcattctgtccgataaaacatctagaaacctattcttttttttgtgcctcaacctctcttttgcttttgtggagcttctgtacggaatctggagcaactgtctggggctgatttccgattctttccacatgtttttcgactcaacagccattttggccggcctagccgcctcggtgatctccaaatggcgggacaacgacgctttttcctatggttatgtgcgggccgaggttcttgcagggtttgtcaacggcctgttcttgatttttaccgcgttttttatttttagcgagggcgttgagcgcgccctggcccccccagatgtgcaccacgagcgcctgttgctcgtcagtatcctcggattcgtggtgaatctcatcggaattttcgtcttcaagcatggcgggcatggacacagtcacggcagtgggcacggacattctcacagtctcttcaacggagccctagaccaggctcatggtcatgtcgatcattgccatagccacgaagtgaaacacggagccgcgcacagccatgatcatgcacatggacacggacattttcatagccacgacgggcccagccttaaggagaccaccgggccaagtaggcagatattacaaggagtgttcctacatatccttgccgataccctgggtagtatcggcgtgatcgcctcagctatcatgatgcagaactttggcctgatgattgccgatcccatctgttccattttaatcgccatactgatcgtcgtcagcgtgatcccattgctgcgagagtccgttgggatcctgatgcagagaacaccacctctgcttgagaacagtctgccacaatgctatcagcgagtccagcagttacagggggtgtacagcctgcaggagcaacacttttggactttgtgttcagatgtgtatgtgggcaccctcaaactcatcgtggctcccgatgctgacgctcgatggatcctctcccagacacacaatattttcacacaggccggggtcagacagttatacgtccagatagactttgcagccatgtag

SEQ ID NO: 206032 - DNA, 963 bp, Artificial Sequence
  Description of Artificial Sequence: Synthetic coding sequence
atgtaccactgccacagcggcagcaagcccaccgagaagggcgccaatgaatatgcctacgcaaagtggaagctgtgcagcgctagtgccatctgtttcatctttatgatcgcagaagttgttgggggccacatagcaggcagcctagcagttgttacagacgccgctcaccttctgattgatcttacgagctttctcctatcattgttctcactctggttgagttctaagcctccttccaaaaggctcaccttcgggtggcacagagctgagatactgggagctctgctctcaatcctatgcatctgggtggtgacaggcgttttagtctaccttgcctgtgaacggctgctgtaccccgactaccagattcaggccacagttatgatcatcgtgtcctcgtgtgccgtggccgcaaacatagtcttaactgtggtgttgcaccagcggtgcctgggccataaccacaaagaggttcaggctaatgctagcgtcagggctgctttcgttcacgctctgggggacctctttcagagcatctccgtgttgattagtgcacttatcatatattttaaacccgaatataaaattgcggaccctatttgcacgttcatcttttctattctagttcttgcttccacaattactatcctgaaagactttagtatactgctcatggagggcgttcccaagagtttgaactactccggcgtgaaagaactgatcttagctgttgatggcgtcctgtccgtgcatagcctgcacatttggtcactaacaatgaatcaggtgattctgagtgcacacgtagctactgctgcatcaagggatagccaggttgtccggcgcgaaattgccaaagccctgtcgaaatcttttacaatgcattctctgaccatccagatggagtcccctgtagaccaggaccccgactgtctcttttgcgaagatccgtgcgattag

SEQ ID NO: 206033 - DNA, 1110 bp, Artificial Sequence
  Description of Artificial Sequence: Synthetic coding sequence
atggagttcctggagcggacctacctggtgaacgacaaggccgccaaaatgtacgcatttacgctggaaagtgtggagctgcagcagaagcctgtcaataaagaccagtgcccccgagaacgacccgaggaactggagtccgggggtatgtaccattgtcacagtggctctaaacccactgagaaaggtgccaatgaatatgcgtatgctaagtggaaactctgttcagcatctgccatctgctttatcttcatgatagctgaggttgttggtggtcatattgcaggtagcctggccgtcgttacagacgctgcccatcttctgattgacctgacctctttcctgctgtctctgttctcgttgtggctctcatccaagcctccttcgaaacggctgacctttggttggcacagagccgaaatactcggcgctttgctctccatcctctgcatatgggtggtaaccggagtccttgtctacctggcctgcgagcgattactgtacccagactatcaaattcaggccaccgtcatgatcatcgtgagcagctgcgccgtggcagcaaatatcgtgcttactgttgttctacatcagcgctgtttaggacacaaccacaaggaggttcaagccaatgcctctgtgcgggctgcatttgtgcatgccctaggtgatctattccagagcatttccgtgctaatatcggcacttatcatttactttaagcctgaatacaagattgcggaccccatatgtacttttatcttctcgatccttgtgctcgctagcacaataacaatactgaaagatttttctatcctgctgatggagggggtgcctaaaagcttgaactattctggggttaaagaactgattttagccgtcgatggcgtgctgtcagtgcactccctgcatatctggtctctcaccatgaaccaggtgatactctcagcccacgtggccactgccgcgagtcgagactctcaggtcgtgagaagggagattgctaaggccctttcaaagtcctttacaatgcattcactaaccatacagatggagtctccagtcgatcaagaccccgattgtctgttttgcgaggacccatgtgattag

SEQ ID NO: 206034 - DNA, 1458 bp, Artificial Sequence
  Description of Artificial Sequence: Synthetic coding sequence
atgggccggtacagcggcaagacctgccggctgctgttcatgctggttctaacggtggccttctttgtagccgagttggtgagtggatatcttgggaactccatcgcccttctgtccgactcttttaacatgctctccgacctgataagcctgtgcgttggactatctgctggatatatcgcgcggcggccaacacgcggcttctctgctacttacggttatgctcgagccgaggttgtgggcgcactctctaatgccgtgttccttaccgctctgtgttttaccatcttcgtggaggccgtgctccgcttagcacgcccagagcgtatcgacgatccggagctggtccttatagtgggcgtgcttggcctgctcgtgaacgtcgtgggactgctgattttccaggactgcgctgcctggtttgcttgttgcctgagaggaaggagccgccgcctgcagcaacggcagcagctcgccgaggggtgtgtccctggggcctttggaggccctcagggtgcagaagatccccggcgagcggctgatcccactgccccggggtctgacagcgctgtgactcttagggggacaagtgtggagcggaagcgggagaagggagctacagtcttcgctaacgttgccggggattctttcaatactcagaacgagccagaagacatgatgaagaaagaaaagaagtccgaggccctcaatatacgcggcgtgcttctgcacgtgatgggagacgctctgggctccgttgtggtagtaatcacggctattattttctacgttctgcctttaaagtcagaggacccatgtaactggcagtgttatatagatccctccctgactgtgctgatggttatcattatactcagctctgcctttcccttgatcaaggagaccgcagctattctactacagatggtgccaaaaggggttaatatggaagagctcatgagcaagctctccgcagtgccaggcatctcttcagtccatgaagttcacatctgggagttagttagcggcaaaatcatcgccaccctccacattaagtatcccaaggatcgagggtaccaagatgcttctacaaagatcagggagatcttccatcacgcgggcatacacaacgtcacaattcagtttgagaatgtcgacctgaaagagccactagagcaaaaggacctcctcctgttgtgcaattcaccctgtattagcaagggatgtgccaagcagttgtgctgtccaccaggggccttacccctcgctcatgtaaatgggtgcgcagaacacaatggtggaccctcgctggacacatacgggagcgacggtttaagccgccgggacgcacgcgaggtcgctatcgaggtttcacttgatagctgtctgagtgatcacggccagagcctcaataagacgcaggaagatcagtgttacgtgaacagaactcacttctag

SEQ ID NO: 206035 - DNA, 723 bp, Artificial Sequence
  Description of Artificial Sequence: Synthetic coding sequence
atgggcgacgccctgggcagcgtggtggtggtgatcaccgccatcattttttacgtcctgccactgaaatccgaggacccctgcaactggcaatgctacattgatccgtctctcaccgttctgatggttatcatcatcttgtcctcagccttcccactgataaaagagacggcggccattctgctccaaatggtgcctaagggcgtaaacatggaagagctcatgtcaaaactcagtgcagtgcccggcatcagtagcgtccatgaggttcacatctgggagctggtgagcgggaagattatcgcaactttgcacataaaatatccgaaggatcgtggataccaagacgcgtcaacgaaaataagggaaatttttcatcatgctggaattcacaacgttacgatccagtttgagaacgtcgatcttaaggagccattggaacagaaagatctcctgctgctgtgcaattccccatgtatctctaagggctgcgcgaagcagctttgctgccctcccggtgcccttccactggcccatgtgaatggctgtgctgagcacaacggagggccttccctggatacatacggctccgatggcttgtctcggagagatgctagagaggtggctatcgaagtgtccctggactcgtgcctgtccgaccacgggcaatcactcaacaagacacaggaagatcagtgttacgtcaacagaacacatttttag

SEQ ID NO: 206036 - DNA, 672 bp, Artificial Sequence
  Description of Artificial Sequence: Synthetic coding sequence
atgggccggtacagcggcaagacctgccggctgctgttcatgctggtgctgaccgtggcatttttcgtggccgagttggtgtctggctatctcggaaattcaatcgccttactgtcggattcctttaacatgctctcagacctcatatcactgtgtgttggcctgagcgccggctatatcgccaggagaccaactcgcggattctccgcgacatatggctatgctcgcgctgaggtcgtaggcgccctcagcaatgccgtgtttctgacagccctctgctttaccatattcgttgaggcagtactgcgccttgcccggcccgaaaggattgacgacccagaactcgtgctcatcgttggcgtcctcggcttgctcgttaatgtggttggattgctgattttccaggactgcgcagcatggtttgcatgttgtctccgcggccggagtaggagacttcagcaacggcaacaactagccgagggctgcgtgcccggtgctttcggtggcccacagggagcggaggacccaaggagggccgccgaccccacggcacccggatctgattcagcagtgacgctccgcggaacttccgtagaacgcaagagggagaagggcgccacagtttttgccaatgttgctgagctgatccacaacactagattccttctttag

SEQ ID NO: 206037 - DNA, 567 bp, Artificial Sequence
  Description of Artificial Sequence: Synthetic coding sequence
atggaccacagccaccacatgggcatgagctacatggacagcaacagtacgatgcaaccatctcaccaccacccaaccacctctgcatcccattctcatggggggggagattcctctatgatgatgatgccaatgacattttactttgggttcaaaaacgtggagctgctattttctggattggtaattaatactgctggcgagatggccggcgctttcgtcgccgtattccttctcgctatgttttatgagggcttgaagatagcgagagagtctctgcttagaaaaagccaggtgagtattcgatataatagtatgcccgttcccggccccaacgggaccattctgatggagacacacaaaacggttgggcagcagatgctgtcattcccacatcttctccagacctgctgggactaccggcacgaaccgcctcatttatcgttgtcacctagttattactctgacttaaactaccctaagaaagcaaaggtcctcctgcgtgtatccgtcgagctgatgattcaggaggccctcatgatcactgccggagactcactttgttag

SEQ ID NO: 206038 - DNA, 573 bp, Artificial Sequence
  Description of Artificial Sequence: Synthetic coding sequence
atggaccacagccaccacatgggcatgagctacatggacagcaactcaactatgcagccatcccaccatcaccccacaacatctgcatcccactcccatggaggaggtgattcttccatgatgatgatgcccatgactttttattttggatttaagaatgttgaactgctgttctcaggcctcgtcatcaatactgccggcgagatggctggggcgtttgtggccgtgttcctgctggcaatgttttacgagggattgaaaatcgcccgcgagtccttactccgtaagagccaagtaagtattaggtataattccatgcccgtaccagggcccaatggtaccatactcatggagactcataaaacagtaggacaacagatgctaagctttccccaccttcttcagaccgtgctccacataatccaggtggtcataagctactttctgatgctgatattcatgacctacaacggctacctctgcattgccgtcgcagctggagccggaactgggtactttctgttctcctggaaaaaggcggtcgtagttgacataacagaacattgccattag

SEQ ID NO: 206039 - DNA, 432 bp, Artificial Sequence
  Description of Artificial Sequence: Synthetic coding sequence
atggccatgcacttcatcttcagcgacaccgccgtgctgctgttcgatttctggtccgttcacagccccgcaggcatggcactcagcgtactggttctcctgttgctagcagtactgtatgagggcataaaggtgggtaaggctaagctgttaaatcaggtactggtcaacctccccactagcatctcccagcagacgatcgccgagactgatggcgacagtgcaggtagcgactctttccctgtcggacgaacacaccacaggtggtatctttgtcatttcgggcagagcctgattcatgtgatacaggtcgtcattggatattttattatgttagccgtcatgtcctacaacacatggatctttttaggtgtggtgcttggaagcgcagttggctactaccttgcgtaccctctcctgtccaccgcttag

SEQ ID NO: 206040 - DNA, 1650 bp, Artificial Sequence
  Description of Artificial Sequence: Synthetic coding sequence
atgagccccaccatcagccacaaggacagcagccggcagcggcggcctggaaacttctcccattcactggacatgaagagtggccccctgccacccggaggctgggatgactcccatctggactcggcaggtcgtgagggagatcgggaggctcttcttggcgatacaggtactggcgacttcctgaaggccccgcagtccttccgggctgagctgtcttcaatcctcctattactgttcctttacgtccttcagggaatccctctagggctggccggtagcatccctctgattcttcagagtaaaaacgtgagctataccgatcaggccttcttcagctttgtgttctggccatttagcctcaagctgctgtgggcacctctggtcgatgccgtttacgtgaaaaactttggccgtaggaagagttggctggtccctacacagtacatcttaggcctctttatgatttatctctctactcaagttgatcggctgttgggcaacacagatgatcgaaccccggatgtgatcgccttaaccgtcgctttttttttattcgagtttttggcagccacccaagacattgccgttgacggttgggcactcaccatgctgtcgcgcgaaaatgtggggtatgcttccacttgcaactcagtggggcaaactgccgggtatttcctgggaaacgtcctctttctggccctggaatctgcagatttttgcaacaaatacctgcggttccagccacaacctagggggatcgttactctgagcgatttcctcttcttttggggtaccgtgtttctgattaccacaacgctggtcgctttactaaagaaggaaaacgaggtgagtgtggtaaaagaggagactcagggcataaccgatacttacaagctgctgttcgccataattaaaatgccggcagtgctcaccttctgcttgctcatcctcaccgcaaaaattggcttcagcgccgcagatgcggttaccgggctaaagttggtggaagagggggtccctaaagagcatttggcgctccttgccgtgccaatggttccactgcagatcatactgcctctcattatcagcaagtatacagctgggcctcagccacttaatactttttacaaagccatgccttatagattgctgctggggctcgaatatgctctgctcgtttggtggactccaaaggtggaacatcaaggcggatttccgatttattactacatcgtggtcctgctcagttatgcactgcatcaggtcactgtatatagtatgtatgtctccataatggcattcaacgccaaagtcagcgacccattgatcgggggaacatatatgacactgctgaacaccgtgtctaacctcggcggcaactggccctctaccgttgctttgtggctggttgatccgctgacggtgaaggaatgcgtgggggcctcaaatcagaactgtaggaccccagacgctgtggaactttgcaaaaaattaggcggttcctgcgtcacagctttggacgggtactacgtggaatctataatctgtgtcttcatcggcttcgggtggtggttttttctaggcccaaaattcaagaaactccaggacgagggcagctctagttggaagtgtaaaaggaacaattag

SEQ ID NO: 206041 - DNA, 1650 bp, Artificial Sequence
  Description of Artificial Sequence: Synthetic coding sequence
atgagccccaccatcagccacaaggacagcagccggcagcggcggcctggaaattttagccattccctggacatgaagtccggtcccttaccacctgggggctgggacgactcacatctggacagtgctggtagggaaggagacagggaggcactgctgggcgacaccggtacaggcgactttctgaaggcgccccagtcattcagagctgaattgtcctctatcctactgctgctctttctgtacgtgctgcagggcatcccactaggactggctggctccattcccctgatcctgcagagtaagaatgtatcttacactgatcaggcgttttttagttttgtgttttggcctttcagcttgaaactactctgggctccgctagttgacgccgtgtacgttaagaacttcggccgcaggaaatcatggctggtgcctacacagtacatcctgggtttgtttatgatttacttgagtactcaagtcgaccggcttctgggcaatacagacgatagaacaccggacgttattgccctgaccgtggcctttttcctgtttgagttcctggcagccacccaggacatcgccgtcgatggctgggcactgacaatgctctccagggagaacgtagggtatgcaagcacatgtaatagtgtagggcagaccgctggctacttcctgggcaatgttctgtttctggcacttgagagtgccgatttctgcaacaagtacttgaggtttcagcctcaacccagggggatcgttaccctctcggacttcttgtttttttggggcactgtctttctcatcaccacaaccctggttgccctgcttaaaaaggagaacgaggtctctgttgttaaggaagagacacagggcatcactgatacatacaagctgctcttcgccattataaagatgcctgccgttcttacattctgtctgctgatcctgactgctaaaatcggcttcagtgccgctgacgccgtcacgggcctgaagctcgtggaagaaggagtgccaaaggagcaccttgccctgttggctgttcccatggtgccactccaaattatcctgccactgatcatttctaaatataccgccggtcctcagccgctgaatactttttacaaggcaatgccctacagactgcttctcggcctagaatacgccctgctcgtatggtggacccccaaagttgagcaccaaggcggatttcccatatattattacatcgttgtgctgctcagctatgcacttcaccaggtgacggtgtattctatgtacgtgtcaatcatggccttcaatgccaaagtgagcgatcctttaattggcggtacctatatgacgttactgaatacagtgtcaaatctggggggaaactggccaagcacagtggccttgtggctagtagaccccctgacggtgaaggaatgtgtgggtgcgagcaatcagaactgccgcacgccggatgccgtcgaactttgtaaaaaactcggaggctcttgcgttacagcactggacggttactatgtggagagcatcatctgtgtgtttatcggttttggttggtggttctttctgggcccaaagttcaaaaagttgcaggatgagggtagctcttcttggaagtgtaaaagaaacaattag

SEQ ID NO: 206042 - DNA, 1920 bp, Artificial Sequence
  Description of Artificial Sequence: Synthetic coding sequence
atgctgagctacggcgagcggctgggcagccccgccgtgagccccctgcctgttagaggggggcacgtcatgaggggtactgcttttgcctacgtaccgtcaccacaggtgctccaccggatcccagggacaagtgcctatgcatttcccagtttggggccagtggccttggcagaacacacttgcccatgcggagaagtgctggagcgtcacgaaccgctgcctgccaaactggcgcttgaagaggagcagaaacctgaatctcgtttggttcccaaactcaggcaagctggggccatgctgcttaaggtgccgttaatgttaaccttcctgtacttgttcgtgtgtagcctagatatgttgagtagcgccttccagttggctggagggaaagttgcaggggacatattcaaagataacgctatactgtctaatcccgtggccggcctggttgtcgggatacttgtcactgtgcttgtgcaaagtagttcaacaagcacaagcattatagttagtatggtcagcagtggcttgcttgaagtctcgtcggccattcctattatcatgggatcaaatattggaactagtgtcaccaataccatcgtggcccttatgcaggcaggcgacaggaccgactttaggcgagcgttcgctggagcaactgtccacgattgctttaactggctctctgtgctggtcctgctgcccttggaggctgcaacgggctatctgcatcacataaccaggctggttgtggcgagctttaacatacatgggggccgcgatgctcctgacctgctcaaaataataaccgagcccttcaccaagctgattatacagctggatgaatctgtcatcacatccattgcgactggggacgaatccttgcggaatcattccctgatccagatttggtgccaccccgacagcctgcaagcacctacttcgatgtcaagggccgaggccaattcctctcaaacactcgggaacgccactatggagaagtgcaaccacattttcgtagatactggactgcctgatcttgctgtgggcctcattctcttagctggtagcctcgtcctattatgtacttgcctcatactgttagtgaaaatgctcaactccctgctgaagggacaggtggccaaagtaatccagaaggttattaacactgattttccagcccctttcacgtgggtaaccggttacttcgcaatggtggttggtgcaagtatgacgtttgtcgtccagtcatcatctgtgttcaccagcgcaatcacaccgctcatcgggttgggagtaattagcatagaaagagcatacccacttaccctcggctccaacattggaactacaacaacagcaatcctggcagccttggccagcccccgcgaaaaactgtccagtgccttccagatagccctgtgccatttcttcttcaatattagtgggatcctactctggtaccctgtgccttgtactaggttaccaatccgcatggcgaaggcactcggcaaaagaaccgcgaaatacagatggtttgctgtcttgtacctgctcgtctgtttcctgctgttacccagcctagtctttggcattagcatggccggctggcaggtcatggttggtgtcggcactccctttggggccctccttgccttcgtcgtcctcatcaacgtcctccaaagtcggtcccctggtcacctccccaagtggctgcaaacctgggattttctcccaaggtggatgcattccctgaagcccttggaccacctgattactcgggccaccctctgctgcgcccgcccggagccacgctcaccacctttgcccccacgggtgttcctagaagagctgccacctgcgactccttccccaaggctggcactgcctgcccatcacaatgcaacccggttatag

SEQ ID NO: 206043 - DNA, 330 bp, Artificial Sequence
  Description of Artificial Sequence: Synthetic coding sequence
atgctgagctacggcgagcggctgggcagccccgccgtgagccccctgccagtgagagggggacatgtcatgcgcggtacggcatttgcgtacgtaccctccccccaggtgttgcaccggattccagggacaagcgcatacgcattccccagcctgggaccggtggccctggccgagcacacatgcccgtgcggggaggtccttgagcgccacgagcccctcccggcaaagctggctttggaagaagagcaaaagcctgagtcgagactagtgcccaagctgcgacaagccggcgccatgctgctcaaagtgccactgatgttgacatag

SEQ ID NO: 206044 - DNA, 1023 bp, Artificial Sequence
  Description of Artificial Sequence: Synthetic coding sequence
atgctgagctacggcgagcggctgggcagccccgccgtgagccccctgcccgttcgcggcggtcacgtaatgcggggcactgccttcgcttatgttccttcccctcaagtgctgcacagaattcccggaacctcggcgtatgctttcccatcactgggccctgtggccctcgccgagcatacgtgcccttgcggagaagttctggagagacatgaacccctgcccgctaagcttgccttggaagaggagcagaaaccggagtcacgcttggtccctaaattgaggcaggccggagcaatgttgttgaaagtcccgttgatgctgacctttctgtatctgtttgtttgtagtttggacatgctctcttccgcctttcagctggcgggagggaaggttgcaggcgacatttttaaggacaatgccattttgtccaaccctgttgcaggtctggtggtgggtattctggtaactgttctcgtacagtcctctagcaccagtaccagcatcatcgtcagcatggtgagttctggcctactcgaggtgtcatccgccatacccatcatcatgggctccaatatcgggacaagtgttacaaacactattgtagctctgatgcaggccggcgatcgcacagatttccgtagagctttcgcaggcgcaactgtgcatgattgctttaactggctttcagtcctggtgcttctgcccctggaagctgcgactggttatctgcaccacattacccgacttgtcgtggcaagttttaacattcacgggggacgggacgctcctgacctgcttaagatcattactgagccatttacgaagctcataatccagctagacgaatcagttattaccagcatcgcgacaggggatgagtctctgcgtaaccatagcctgattcaaatttggtgccatcccgacagcttgcagcagaaccttgaagggcgcgagattactcatttcgatctccgcaaaaaacaggcaatggaagattccagtgtgcctcattgcccttag

SEQ ID NO: 206045 - DNA, 2073 bp, Artificial Sequence
  Description of Artificial Sequence: Synthetic coding sequence
atggccccctggcccgagctgggcgacgcccagcccaaccccgacaagtaccttgagggcgccgccggtcagcaaccgacagccccagataagtccaaagagaccaataagactgataataccgaagctcccgtgacaaaaatcgaactcctgcccagctacagcaccgccactctgattgatgaaccgaccgaggtcgatgatccttggaacctccccactctgcaggattctggcataaagtggtccgagcgagacacaaaaggaaaaatactgtgctttttccaaggcataggcagattgatactgttgctgggttttctttatttcttcgtatgctcactcgatatactgagcagtgcgttccagctggtgggtggcaaaatggctggccagttcttctctaattcaagcatcatgagcaatccacttctgggccttgtaatcggcgtcctggtaaccgttctagtgcaatccagttctacctctacctccattgtggtttctatggtaagttcttccctactgacagtccgggccgcaattcctattatcatgggcgccaatattgggactagcatcactaacaccatagtggccctgatgcaggtcggtgacagatccgagtttcggcgcgcctttgcaggagccacagtacatgattttttcaattggttgtcggtgctggtcctgctgccagttgaggtggctacccactatctggagatcatcactcagctgattgtcgaatctttccatttcaagaacggtgaggacgcgccagacctgctcaaggttataactaaacctttcactaagctgatcgtccaactggataaaaaggtcatttctcagatcgcaatgaacgacgaaaaggcaaagaataagagtcttgtaaaaatttggtgtaagacctttacaaataagacacagatcaatgtcactgtgccgtcaacagccaactgtacatcaccgagtctgtgctggacagatggcattcagaattggacaatgaagaatgtgacctataaagaaaatatagccaagtgtcagcatattttcgtgaactttcacctccccgacctggcggtggggacaatcctattgatcctgagcctactggtgctttgtggatgcttaatcatgatcgttaagatcctcggttcggtgctgaaaggtcaggtggccactgtcattaagaaaaccataaacactgatttcccttttcccttcgcctggcttaccggctacttggcaattctcgtgggagccggaatgactttcattgtccagagcagcagtgtgttcacctctgccctgactcctctgatcggcattggagtgattaccattgaaagggcatacccactgaccctgggcagcaacatcggcacaaccactaccgccattcttgctgccctggctagtcctggtaatgcacttcgttcttctctgcagatcgccctttgccattttttcttcaacattagcggcatactgctgtggtacccaatcccgttcactcgcctgcctattcggatggcaaaaggactgggaaacatttcagcaaagtatagatggtttgccgtcttctatctgattatattcttttttttgattccactgacagtattcggcctttctctggccgggtggcgggttctggtaggagtgggagtccccgttgttttcattatcattctcgtgttatgcttaagattactgcagtcacgctgtccgcgcgtgctgcccaagaaactccagaattggaatttcctccctctctggatgagaagtctgaagccttgggatgcagtcgtttctaagttcaccgggtgtttccagatgcgatgctgctgctgctgtcgggtgtgttgcagggcttgttgcctgctgtgcgactgccccaagtgctgccggtgtagtaagtgttgcgaagatctggaggaggcacaggaaggtcaggatgtccctgtgaaagctcccgagacctttgataacattaccattagtagggaggcgcaaggagaggttcccgctagtgattcaaagactgagtgtacagcactctag

SEQ ID NO: 206046 - DNA, 2070 bp, Artificial Sequence
  Description of Artificial Sequence: Synthetic coding sequence
atggccccctggcccgagctgggcgacgcccagcccaaccccgacaaatatttagagggcgcagctgggcagcagcctactgccccagacaagagcaaggaaacaaataagaacaatactgaggcacctgtaacgaagatcgaacttctcccatcctactctaccgctactcttatcgatgaacctaccgaggtggacgacccatggaacttaccaacactgcaggactcaggtatcaaatggagtgagagggacacaaaaggaaaaatactttgtttcttccaaggcattggacgacttatcctgctattagggtttctctacttcttcgtgtgctctctggacattttgtcaagcgctttccaactggtgggcggtaagatggctggccagttcttttcaaatagctccattatgtccaatcccctcctcgggctggtaattggcgtgctcgtgactgtcctggtccaaagcagttctacctccaccagcattgtggtgtcaatggtgagttcatcactgctgacagttcgagccgcaatcccaattatcatgggggcaaacattggaaccagcatcactaataccattgtggccctgatgcaggtgggagacagaagcgagttccgcagggccttcgctggtgcgactgtgcacgacttttttaattggttatctgtgctggtcctgcttcccgttgaagtagccacccactacctcgagatcattactcaactgatcgtggaatcatttcactttaaaaatggggaggacgctccggacttgctgaaggtgatcactaagccattcaccaagctgatcgtccaattggacaaaaaggtcataagtcagatcgccatgaacgacgaaaaggccaaaaataagtctctagttaaaatctggtgcaagacctttactaataaaacccagatcaatgtgacggtgccaagcaccgcaaactgtacatcaccctccctgtgctggaccgatggtattcagaattggaccatgaagaacgtcacttataaggagaatatcgccaagtgtcagcatatcttcgtgaactttcacttgccggatctggctgtgggcaccattctactgatcctgtcgttattggttctctgcggatgcttgattatgatcgttaagattctcggtagcgtgcttaagggccaggtcgcaacagtgattaagaagactattaacacagacttcccctttccttttgcatggttaaccgggtacttggccatcctggttggggctgggatgacattcatcgtccagtctagcagcgtgttcacttcagccctgacgcctttgatcggaatcggggtcattactatcgagagggcctacccactcaccctaggcagtaacatcgggactacaacaaccgccatcttagccgctctggcgtcaccagggaacgccctccgaagtagcctgcagatcgctctgtgtcacttcttttttaatataagtggaatccttctctggtaccccatcccatttactaggctccccattaggatggctaagggcttgggtaacatctccgcaaaatacagatggtttgctgtgttttatctgataattttcttcttcctgatccctctgacggtattcggactgtctttggcaggctggagagtgctggttggcgtcggcgtgcccgttgtgtttattatcattctggtgctctgcctcagactgctacagagtagatgccctagggttctaccaaaaaagctgcagaactggaacttcttgccactctggatgcggagtctcaaaccttgggacgcagtggtttccaagtttaccgggtgttttcagatgcggtgctgctgctgttgcagagtgtgttgccgcgcctgctgtcttttgtgcgattgcccaaagtgctgtcgttgctcaaagtgctgtgaggatctcgaggaagcccaggagggacaggatgtgcctgtgaaagctcccgaaactttcgacaatatcactatctctagggaggcccagggggaagtaccagcctctgacagcaaaaccgagtgcacagccttgtag

SEQ ID NO: 206047 - DNA, 2070 bp, Artificial Sequence
  Description of Artificial Sequence: Synthetic coding sequence
atggccccctggcccgagctgggcgacgcccagcccaaccccgacaaatacctggaaggggctgccggtcaacaaccgaccgcgcccgacaagtctaaggaaacaaataagaacaatacggaggcacctgtcactaaaattgagttgctaccttcctattctactgccacgcttatcgacgagccaacagaagtcgatgatccctggaatcttcccacgcttcaagactcgggtatcaagtggagcgagcgcgacacaaagggtaaaatcctctgttttttccagggcatcgggaggctgatactgcttcttggatttttgtatttctttgtgtgctcactcgatattctgtcctcagccttccaactggtgggaggtaaaatggctggtcaattctttagtaattctagcatcatgtctaaccctcttctgggcttggtaatcggagtgttggtgactgtgctcgttcaatctagtagtacttcaacatcaatcgtcgtgtcaatggtgtcctcttcgctgctgaccgtgcgcgctgcaatcccaatcattatgggcgccaacatcggcacatcaatcacaaacacgatcgtcgcactgatgcaggtgggtgataggagcgagtttcggcgcgcttttgccggagccaccgtgcatgatttcttcaactggcttagtgtactcgtgctgttgccagtggaggtggcgactcactatttggagatcatcactcagctgatcgtagagagttttcatttcaagaatggagaggatgccccggacctgctcaaagttatcactaagccattcacaaagttgatcgtgcagctggacaagaaggtgatctcacagattgccatgaacgacgagaaagccaaaaacaagtccttagtgaaaatttggtgtaaaactttcaccaacaagacacagatcaatgtgaccgtccccagcacggccaattgtacttccccgagcctctgttggactgacggcatccagaattggacaatgaagaatgtgacctacaaggaaaacatcgccaagtgtcagcacatttttgtaaacttccacctgccggacctggccgtcggaaccatacttttgatactgtcccttctggtcctgtgcggctgtctgatcatgatcgttaagattctcggctcagtgctcaaggggcaggtcgcgactgtcatcaaaaagacaattaacactgatttccctttccccttcgcatggcttactggctacctagctatcctggtcggggcaggcatgactttcatcgtccagtcaagcagcgtgttcacttcagctctgacacccctgattgggattggcgtgattaccatcgaacgggcctatccactcacgttgggctccaatataggcacgaccacaaccgctatcctggccgctctggcctctccgggaaacgcacttcggagctccctccagatcgcactctgtcactttttcttcaatatctctggcatcttgctgtggtatcctatcccattcacccgtttgcccattcgcatggcgaaggggcttgggaacatcagtgccaaataccgctggtttgccgtgttctacttgatcatcttcttctttctaatcccattgaccgtgttcggcctgtcattggcagggtggagagtgcttgtgggggtgggggtaccagtagtgttcatcatcatcctggtgctctgtctgagactcctccaatcccgctgtcccagggtgctgcctaagaaacttcagaactggaacttcctgcctctgtggatgaggtccttaaaaccttgggatgctgtagtgtcaaaattcaccggctgtttccagatgaggtgttgttgctgctgcagagtgtgttgtcgagcctgttgcctcctctgcgactgccctaagtgctgtcgctgcagtaaatgctgcgaggacttagaggaagcgcaggagggacaggacgtccctgtcaaggccccggagacattcgacaacataacaattagtcgcgaagcacaaggcgaggtccctgcaagtgatagcaagaccgaatgcactgcgctgtag

SEQ ID NO: 206048 - DNA, 486 bp, Artificial Sequence
  Description of Artificial Sequence: Synthetic coding sequence
atggccccctggcccgagctgggcgacgcccagcccaaccccgacaagtacttggaaggtgcagccggccagcaacccactgcccccgacaaaagtaaagaaactaacaagaccgataataccgaggcccctgtgaccaagatcgaactgcttccatcttattccaccgcaacgctcatcgatgagcctacagaggttgatgacccttggaatctgcccaccctgcaggatagcgggattaaatggtccgagagagacacaaaagggaaaattctctgtttcttccaaggcatcgggcgactgattctgttgctgggctttttgtacttcttcgtgtgttcacttgatatcctatcttctgcctttcagctagtgggcggaaagatggccggccagttcttttctaactcttcaattatgtcaaaccccctgctggggctggtgatcggggtcctggttactgtactggtacagtcgagttcctag

SEQ ID NO: 206049 - DNA, 492 bp, Artificial Sequence
  Description of Artificial Sequence: Synthetic coding sequence
atggccccctggcccgagctgggcgacgcccagcccaaccccgacaagtacctggaaggggccgcgggacagcaaccgacagcgccggacaagtcgaaggaaacaaataaaaacaataccgaggctccagtcaccaaaattgagctgcttccatcctatagcacagcaacattgatcgatgaacctaccgaagtggacgacccatggaatctcccaactctgcaggactccgggattaagtggagcgaacgagacactaaggggaagatactctgcttcttccaggggatcgggcgcctgatcctgctactcggcttcctttattttttcgtctgttcactagacatcctctcttcggcttttcaactggtagggggaaaaatggcagggcagttttttagtaattccagcataatgtcaaaccctttgcttggcctggtcataggagtcctggttactgttctcgtacaatcctcatcaactagcacttag

SEQ ID NO: 206050 - DNA, 1800 bp, Artificial Sequence
  Description of Artificial Sequence: Synthetic coding sequence
atgcccagcagcctgcccggcagccaggtgccccaccccaccctggatgctgtcgacctggttgaaaaaacgctacgcaatgaggggacatcttcgtctgcccctgtgctcgaagaaggtgataccgatccatggaccttgccacaactgaaggacacttctcagccttggaaagagctccgggtagctgggcggctgagaagagtggcggggtctgtgctaaaagcgtgtgggctgctggggtctctgtactttttcatttgttctctggatgtcttgagcagcgcctttcagctcctgggcagtaaggtagctggggacatttttaaagacaatgtggtactcagcaaccccgtggccggattggtgatcggagttctggtgactgctctggtgcagtcttcatcaactagcagcagcatcgtggttagcatggtggcggccaagttacttactgtgcgcgtctccgtgcctattatcatgggtgtcaatgtcggcacaagcatcactagtacgttagtgagcatggctcaatcgggcgaccgtgacgagttccagcgagctttttcagggtcagcagtgcatggaatctttaattggttgacagtactggtcttgctgccccttgagagcgctaccgctttgcttgaaaggttatcagagctggctctcggtgccgcaagtttaactccaagagcccaggctccagatatcttaaaggtgctgaccaaacccctgacccatctcatagtacagttggacagtgatatgatcatgtcttcagcaacgggaaatgccacaaacagctctctgatcaagcattggtgtggcaccacaggacaacctactcaggagaattcatcatgcggcgccttcggtccctgtaccgagaagaattctaccgcccctgctgatcgcctcccctgccgtcatctgtttgccggcaccgaattaacagatctggccgttggctgcatcttgttggcaggctctctgctcgtcttgtgtggttgtctggtgctgattgtcaagctgttaaactctgtcctgcggggacgtgtggcacaagttgtgcggacagtaataaatgccgatttcccatttcccctgggctggttgggggggtatctggcagtgttggctggtgctggactgacattcgctttacagagctcctccgtattcacagctgccgtggtgcctctgatgggcgtcggtgtcatttccttagaccgcgcttaccccttactattagggtccaatatcggcactacaacaacagcactgcttgccgcactggcctccccagctgaccggatgctaagtgcactccaggtcgctctgatccatttttttttcaacctggctggaatcctgctctggtatcttgtgcctgccttgcggctgcccattcccctagcgcggcattttggggtagttactgccagatataggtgggtggctggagtttatcttctcttgggctttcttctgctgcctctagccgccttcggcctgtccctggccgggggcatggagctcgctgccgtaggcggcccactggtcggactagtcctgctcgtcatactggtcactgtgctccaaaggaggcggcctgcctggctgccagttcggctgaggtcctgggcctggctgccggtgtggctacactccctagaaccttgggacagacttgtgacaagatgttgcccgtgtaatgtttgtagcccccccaaggctacaacaaaggaagcctattgctacgaaaacccagagatcctcgctagccagcagctttag

SEQ ID NO: 206051 - DNA, 1800 bp, Artificial Sequence
  Description of Artificial Sequence: Synthetic coding sequence
atgcccagcagcctgcccggcagccaggtgccccaccccaccctggatgccgtcgacctcgtggagaagactctgaggaatgaagggaccagcagtagtgccccagtgttggaagagggagatacggatccttggacactgccccagctgaaagacacgtcgcaaccctggaaggagttgcgcgtagccggcagactacgcagagtggctggctcagttctaaaagcatgtggattattgggcagcttgtacttcttcatctgctccttggacgtgctgagttctgctttccagctactaggaagcaaagtggccggagatatctttaaagataacgttgtgctctcgaaccccgtcgcaggcctggtgataggcgtcttggttacagcgctggtgcagagttcttcaacaagttcgagcatcgtggtctcaatggttgcggcaaaattgctaaccgtgcgggtttcggttcctatcataatgggggtaaacgtcggcacaagcataaccagcacgctcgtctcaatggcacaaagtggagaccgggacgaatttcagagggctttctcggggtccgcagtgcacggcatttttaactggcttacagtattagtgctgctccctcttgagagtgcaaccgctctgttggaacggctgagcgagcttgctctgggagcagcttcactgactccccgagcccaagctccagatattctcaaggtcctgaccaaacccctcacccaccttatcgtgcagcttgatagcgacatgattatgtccagtgctactggcaatgcgacaaattcatcccttattaaacattggtgtggaactacaggtcagccaacccaggagaactccagttgcggggcctttgggccctgcactgagaaaaattccactgcacccgccgaccgcctcccatgccgtcacctgttcgcaggcactgagcttaccgatctggctgtgggatgtatcctgctggcggggagtctgcttgttctgtgcggatgtttagtgctgatagtcaagttgctgaacagcgtgttgaggggacgggtggctcaggtggttaggaccgttattaacgctgacttccccttcccgctcgggtggctgggaggctacctcgctgtccttgcaggcgccggcctgactttcgctctgcagtcctcatcggtttttacggctgctgtcgtccccctaatgggagtcggggttatctccctggaccgggcataccctttgctgttaggatcaaacattggtacaactacaacagcacttcttgcggccctagcgtcccctgccgaccggatgttgtccgccctccaggtggcgctaattcactttttttttaatctggctggcattctgctctggtacctggtccccgctctgcggctgcccatcccccttgcacgccattttggagtggtcactgccagatatcggtgggttgctggggtctatctgttactcggttttctgctgctccccttagctgctttcgggctctcgctggctggcggaatggaactggcagccgtggggggtccactggtcggcctggtgctgttggttatccttgttaccgtgctccaacgcagaaggccagcttggctccctgttcgccttcgtagttgggcctggcttccagtatggctgcactccctggaaccctgggacaggttagtcacccggtgttgcccctgtaacgtatgcagcccacccaaggcaacgactaaggaagcctactgttatgagaacccggaaattttggctagccagcagctgtag

SEQ ID NO: 206052 - DNA, 570 bp, Artificial Sequence
  Description of Artificial Sequence: Synthetic coding sequence
atgaccctgatggccgccgtgtacaccatcgccctgcggtacacccgaactagcgacaaagaactgtacttcagcaccaccgctgtttgcatcaccgaggtaattaagttgctattgagtgtgggcatcctcgctaaggaaacaggcagtctcggtcgcttcaaggctagtctgcgagagaatgtgctggggtcgcccaaggagcttttgaaactctctgtgcctagtctcgtttatgccgtgcagaataatatggcatttcttgctttgagcaacttggacgccgcggtctatcaagtaacctatcagctgaagatcccctgtactgctctttgcaccgtgctgatgctgaataggacgctctctaaattgcagtgggtgtccgtgtttatgttgtgcgctggcgttactctggtacagtggaagcccgctcaggctacaaaagttgttgaatacatactgaaaaagttcaaggaatttcgctatttttccctgggagaaaagcatagcaatgtctcaataagagattattgcgatatatcatggcggcttctggtcagatggagttag

SEQ ID NO: 206053 - DNA, 1014 bp, Artificial Sequence
  Description of Artificial Sequence: Synthetic coding sequence
atggccgccccccgggacaacgtgaccctgctgttcaagctgtactgtttggccgtgatgaccctgatggctgcagtttatacaatcgctttgcgctatacgcggacctcagataaggagttatatttcagtacaaccgctgtttgtattacagaagtcatcaagcttctcctctccgttgggattctcgctaaggagaccggctcattaggcagattcaaggcaagtctgcgtgagaatgtgctcggaagtcctaaggaactgcttaaattaagcgtacccagcttggtgtacgctgtccagaataacatggcttttctcgcgttgagtaatctagatgcagccgtataccaagtgacttaccagcttaagatcccctgtacagccttgtgcactgtcctcatgcttaatagaacactgagtaaattacaatgggtctcggtatttatgctttgtgcaggagtgaccctagtgcagtggaaaccagcccaggcgacaaaagtcgttgtggaacaaaaccccctgctgggatttggcgccatcgcaatcgcagtgctgtgctccggtttcgccggcgtctatttcgagaaggtgctcaagtccagcgatacctccctgtgggttcggaatattcaaatgtacttgtccggaatcatcgtgaccttagcaggtgtgtacttaagcgatggtgcagaaatcaaggagaagggctttttttatggttacacatactacgtctggttcgtgatttttctcgcgtccgtcggtggactgtacaccagtgtggtcgttaagtacacggacaacattatgaaaggctttagcgcagcagccgccatcgtgctctcgaccatagccagcgtgatgcttttcggcctgcaaatcactctcacctttgcactgggaactttgctggtgtgtgtttccatctacctttacgggctccctcgacaagacaccacttcgatccagcaaggggagacggcaagcaaagaacgcgtaattggagtttag

SEQ ID NO: 206054 - DNA, 837 bp, Artificial Sequence
  Description of Artificial Sequence: Synthetic coding sequence
atggccgccccccgggacaacgtgaccctgctgttcaagctgtactgcctggctgtgatgaccttaatggccgctgtgtatacaattgcccttcgttatacccgcaccagcgacaaggagctctatttctccacaacagcagtgtgcataaccgaagttatcaagctcctgttgtccgtcgggatattggccaaggagaccggcagtctcggaagattcaaagcttctctccgagaaaacgtgctcgggtcacctaaggagcttctcaaactaagcgtgccctccttagtttatgccgtgcagaacaatatggcgttcctggctctaagtaatctggatgccgctgtataccaggttacctatcagctgaaaatcccttgcacagccttatgtacagtgctcatgctcaatcggacattgagcaagctgcaatgggtcagtgtcttcatgctgtgcgccggggtcaccctcgttcagtggaaaccagcccaggcgactaaagtagtggtggagcagaatcccctactgggcttcggggccattgccatcgccgtactgtgttctggctttgccgtactcgcctcagtcggggggctgtatacatccgtcgttgttaaatacaccgataacattatgaagggtttcagcgcagcagccgccattgtcctttccactatcgcttcagtcatgttattcggattgcagatcaccttaacatttgctctaggaacgctcctggtgtgcgtgtctatttacctgtatggcttgcctaggcaggacaccacctcaatacagcaaggtgagacggcttccaaggaacgagtcataggggtttag

SEQ ID NO: 206055 - DNA, 570 bp, Artificial Sequence
  Description of Artificial Sequence: Synthetic coding sequence
atggccgccccccgggacaacgtgaccctgctgttcaagctgtactgcttagctgttatgactctgatggctgcggtgtacacgatcgcactccgctacacaagaaccagcgataaggagttatactttagtaccaccgcggtgtgcataacggaggtgattaaattgctcttaagcgtagggatactagcgaaggagacggggtctcttggaaggttcaaggcttccctgcgcgagaatgtgctgggtagtccaaaggagctcctgaaactcagcgtgccctctctggtctatgccgtccagaacaacatggcttttctggccctgagcaatctagatgcagccgtctatcaggtcacatatcaacttaaaattccatgcacagcactttgtacagtactgatgctgaatagaactctctccaagcttcagtgggtttctgtgtttatgctgtgcgctggcgtgacgttagtgcagtggaaacctgcacaagcgactaaagtggtgtttttgcaagtattggtggcgtcgacccttctcctgtggctgagtacgcagaccacctcttag

SEQ ID NO: 206056 - DNA, 537 bp, Artificial Sequence
  Description of Artificial Sequence: Synthetic coding sequence
atggccgccccccgggacaacgtgaccctgctgttcaagctgtactgcctggccgtaatgacactcatggctgctgtttatactattgcactgaggtacacacggacatcagataaagagctatacttctccacaacagccgtgtgcatcacggaagttatcaagctgctcttgagcgtcggcatattagctaaagaaacagggtctctggggcggttcaaagcatcccttcgagagaatgtcttaggatcccccaaggaactgctgaaactgagtgtccccagcttggtatacgccgtgcagaacaacatggcttttctggcgcttagcaatctcgatgccgcagtctaccaggtgacctaccagctcaagatcccatgtacagctttgtgtacagtcttaatgttaaacaggaccctgtcaaagctccagaagaaggattttagcatggtaacacatattatgagcggcctgagttccgtgtcgatccaggaactgaaggtgctgtcccgttcattcatcttttttctgtcttag

SEQ ID NO: 206057 - DNA, 612 bp, Artificial Sequence
  Description of Artificial Sequence: Synthetic coding sequence
atgctgaaccggaccctgagcaagctgcagtgggtgagcgtgttcatgctgtgcgctggtgtcactcttgttcagtggaagccagcccaagcgacaaaagttgtggtggaacaaaatcccctactcggtttcggcgctattgccattgcagtcttgtgttctggctttgctggcgtgtatttcgagaaggtactgaagagcagtgacaccagtctgtgggtgcgtaatatccaaatgtacttgtctggcatcattgtcactcttgccggagtgtatctgtccgacggcgccgaaatcaaggagaaggggttcttttacggatacacatactatgtgtggttcgtcattttccttgctagtgtgggcggactatacacgagcgttgtggtcaaatacaccgacaatattatgaaaggattcagtgctgcagctgctatcgtgctgtcaaccatcgctagcgttatgctgttcgggctgcagatcaccctgactttcgcccttggtactcttctagtgtgcgtttcgatctacctgtatggactcccgaggcaggataccacatctatccagcaaggagagactgcctctaaagagagagtaatcggggtctag

SEQ ID NO: 206058 - DNA, 1191 bp, Artificial Sequence
  Description of Artificial Sequence: Synthetic coding sequence
atggccgccgtgggcgccggcggcagcaccgccgcccccggccccggagccgtctctgccggtgcgttggagcccggcactgcttcagcagctcataggagacttaagtacatctcgctagcggtgttggtcgtgcagaacgcctctctgattctgagcatccgatacgcgcgcaccctccctggcgaccgcttctttgctactacggcagtggtaatggcagaagtcctgaagggcctgacttgcctgctcctactattcgcccaaaaacgaggcaatgtgaagcatttggtgctgtttctgcacgaagcagttctcgtccagtatgtggacaccctcaagctggcagtgccgagcttgatttacacacttcaaaataacctgcagtacgtcgcaatctctaacctgcccgcagcaacttttcaagtgacctatcagctcaaaatccttacgactgcattgttctctgtgctgatgttaaatagatccctgtctcgactgcagtgggcttccctcctgctgctgtttactggggtggccattgtgcaggcccagcaggctggcgggggggggccgaggccattagaccagaatcctggcgccggacttgctgctgtagtggcctcatgtctgtcaagcggctttgctggggtgtatttcgagaagattctgaagggatcatccggatcagtctggctgaggaatctccaactggggcttttcggcaccgccctcggacttgtggggctgtggtgggccgaggggaccgccgtggccacaagaggtttctttttcggctatacgccggcggtctggggagttgttctaaatcaggcttttggtgggctgttggtcgcggtggtggtcaagtacgccgacaatatcctcaaaggctttgccacctcactctcaatcgtgctcagtacagtagctagtattagactcttcggatttcatgtggatcctctgttcgccctgggggcaggcctcgtgatcggcgctgtctatctctactcccttccacgaggtgccgccaaggccatcgcctctgcgtcagcttccgctagcggcccttgtgtgcaccagcagcctcccggacagcccccacctccacagctgagctctcatcggggagacttaataacggaacctttccttccaaagttgctgacaaaggtgaagggctcttag

SEQ ID NO: 206059 - DNA, 492 bp, Artificial Sequence
  Description of Artificial Sequence: Synthetic coding sequence
atggccgccgtgggcgccggcggcagcaccgccgcccccggccccggtgccgtgagcgccggcgcgctcgagcctggaactgcctcagcagcccatagaaggcttaaatacatctctttagcggttttggtggtgcagaacgcgagcctgatactttccatccggtatgctcgcacacttccaggagaccgcttctttgccacaaccgctgtggttatggccgaggtgcttaaaggcctcacctgtcttctgctgctgttcgcccagaagcgcggcaacgtgaaacacctggtactctttctccacgaggccgtgcttgtccaatatgtcgacactttgaaactggcggtgcctagcctgatctatactctgcagaacaatctgcagtatgtggccatttctaatcttccagccgcaactttccaggtgagtcccaagccttctatggccccagaagagctcaccggcttgggaacaggtgtctgggagtag

SEQ ID NO: 206060 - DNA, 657 bp, Artificial Sequence
  Description of Artificial Sequence: Synthetic coding sequence
atgaagctgtgccgggacgcccaccggcggctgaagtacatcagcttggcagtactggtggttcagaacgccagcttaatcctctctatccgatacgctagaaccctacccggagaccgttttttcgccaccactgccgtcgtcatggccgaggtgcttaaggggcttacatgcctgttactgttgttcgcccaaaagcgaggtaacgttaagcaccttgtgttatttcttcatgaagccgtgttggtgcagtacgtcgacactctgaagttagcagtccccagcctcatatacactctccagaacaacttgcagtacgtcgctatatctaacctgccagccgcaaccttccagcctagtccacgctgctctcagtcacattcattgtgcctttgtcttcgcctgcgtgctctgaggtctcccgccgcatctagagctgcaacaactactgctgccgtgtttcctccctggaggccccatcatggggcgctgagtgccaaggtctccgcaggcgaggtccgcgcgggaagcaacggtgggacccagggtcgaggtacaggcgtggagggggtgggacacctacaggacccctcccgtcatccacccggacccggcagctcaggtttcggtaggtggtccttcctccctgggcattag

SEQ ID NO: 206061 - DNA, 1182 bp, Artificial Sequence
  Description of Artificial Sequence: Synthetic coding sequence
atggccgccgtgggcgccggcggcagcaccgccgcccccggccccggggccgtgagcgcaggggcacttgagcccggcacagcatccgccgctcatagacgactgaagtacatctcactggccgttctggtggttcagaacgcctctctcatactatccattcgctatgctaggacgctgcccggagatcggttctttgccacaaccgctgttgttatggcagaagtccttaagggccttacgtgtctgctactgctattcgcccagaaaaggggcaacgtcaagcacctggtgctctttctgcatgaggccgttttggttcaatacgtggacacgctaaagctggctgtgccctctctaatttacactctccagaacaacctgcagtatgtcgcgatctccaatctccctgcagccaccttccaggtgacataccagctaaagatactgactacagcactattcagcgtactcatgttgaatcggtctctctctcgactgcaatgggcttcactgctgctcctgtttacgggcgtcgcaatagtccaggcacaacaggctggaggggggggtcctaggcctctagaccagaatcctggggctggcctcgccgcagtggtggcctcttgcctgtccagtggcttcgccggagtctactttgaaaagattttgaagggaagctccggaagcgtctggctgcggaatctgcagctcggattattcgggactgcccttggtctggtgggcttgtggtgggctgaaggaaccgctgtggcaacgaggggtttcttcttcggatacaccccggctgtttggggtgtagtgcttaatcaggcttttggcggcttgctggttgcagtagtggttaaatatgcagacaacattctgaagggcttcgcaacatccttgtccatagtgttatccactgtcgcctccatccgcctctttggattccacgtcgaccccttgtttgcactcggtgctggcctggttatcggagctgtctacctttatagtctaccgcggggggctgcaaaagctatcgccagcgcaagcgcaagtgctagtggaccttgcgtgcaccagcagccacccggtcagcctccaccaccgcagctaagtagccacagaggggacctgataactgaaccatttttgccaaaatcggtactggtgaagtag

SEQ ID NO: 206062 - DNA, 675 bp, Artificial Sequence
  Description of Artificial Sequence: Synthetic coding sequence
atggccgccgtgggcgccggcggcagcaccgccgcccccggccccggggccgtctccgccggcgcattggaacccgggactgccagcgccgcacatcgccgcctgaagtatatatctctcgccgtgctcgttgtgcagaatgcctccctcattttgtccatccgttatgctagaaccctgcccggggatagatttttcgctactacagccgtcgtcatggcagaggtgctgaagggactgacatgcctgttacttctgtttgcccagaagagaggcaatgtgaaacacctcgtcctgtttcttcacgaggccgtcctcgtgcaatacgtagacacgctcaaattagcggtccctagtttgatatatacgctccagaataaccttcagtatgtcgctatttcgaacttgcccgccgcaactttccaaccctctccacggtgtagccagtcccattccttgtgcctgtgcttgagactgcgtgcgctgcggtcgccagccgcgagccgcgcagccaccactactgccgcggtgtttccaccatggcgtcctcatcacggggccctctctgccaaagtagctcatcagggagaagggtttctggccgctggaatcgaggacataggattagcgtcctttagcctactcgcgctcggaccagcggggactaagctgtag

SEQ ID NO: 206063 - DNA, 999 bp, Artificial Sequence
  Description of Artificial Sequence: Synthetic coding sequence
atggccgccgtgggcgccggcggcagcaccgccgcccccggccccggggccgtttcagccggggccttggaacctggcacagcaagcgccggtaacgtgaaacatctcgtgctatttcttcatgaagcagttcttgttcaatacgttgacaccctgaagctggccgtgccttcccttatctacaccttgcagaacaatctccagtatgtcgccataagtaatctgccagctgcaacattccaggtcacatatcaactgaagatcttgacaaccgctctgtttagtgtactgatgcttaatcgatccttgtcccgactacagtgggcttcactgctgctgttgttcactggcgtggccatagtacaggcccagcaagctggtggtggcgggcccagacccctggaccagaatcccggcgccggactggctgcagtagtggcctcctgcctgagctcgggcttcgccggcgtctattttgagaaaatactgaaaggctcttccggatcggtctggctgaggaacctgcagttggggcttttcgggaccgcactggggctagttgggttgtggtgggccgagggtacagctgtggcgacacgcggcttctttttcggatatactcccgccgtgtggggtgtggtgctgaatcaagccttcggcgggctcttggttgctgttgtggtaaagtatgcggataatattctcaaaggatttgcgacctctttgtcaattgtgctctctaccgtggcctccatcagactgttcgggtttcacgtagaccccctgttcgccctcggcgcgggacttgtaataggtgcagtgtacctgtacagcttaccccgcggggccgcaaaagcgatagccagcgctagtgcctcagcatctggaccttgtgttcatcagcagcctcctggccaaccacccccacctcagctgagctctcacagaggcgacttaattaccgaaccttttcttcctaagtcagtgctggtgaaatag

SEQ ID NO: 206064 - DNA, 729 bp, Artificial Sequence
  Description of Artificial Sequence: Synthetic coding sequence
atggccgccgtgggcgccggcggcagcaccgccgcccccggccccggggctgtgtcagccggcgctttagagcccggaacggctagcgcagcgcatagacggctgaagtatatcagcctagccgtgctcgttgtccagaacgcatccctcattctgagcatccgctacgccaggaccctccctggagatcgattttttgcgactaccgccgtggtgatggcagaggttttaaaggggctgacttgcctactcttactattcgcccaaaaaagggggaatgtgaaacacctcgtgctgttccttcacgaggccgttctcgtccagtatgtggatacactaaagctggccgtgccatctctgatttacacgctccagaacaaccttcagtatgttgcaatctccaacctccccgccgctacctttcaacctagcccccgatgctcacaaagtcactcactgtgcctctgccttcgactcagagcactccgctcccccgccgcgtcccgagcagccacaacgaccgcggccgtatttcccccttggaggccacatcatggggctctgtctgctaaggtgtctgcaggagaagtacgggcagggtccaatggcgggacacagggtagaggcactggagtcgagggggtaggtcatctgcaggatccaagccgtcatccaccgggtcctgggtctagcggctttggaaggtggagctttcttccgggccactag

SEQ ID NO: 206065 - DNA, 531 bp, Artificial Sequence
  Description of Artificial Sequence: Synthetic coding sequence
atggccgaggtgctgaagggcctgacctgcctgctgctgctgttcgctcagaagcggggaaatgtgaagcacctcgtcctctttctgcatgaggcagtcctagtacagtacgtggacacgttgaagctggccgtgccatcgttgatctatacattgcagaacaacttgcagtatgtggctatttcaaatctgccagcagccacgtttcaggttacatatcagctcaaaatcttgacaactgccttgttctccgtcctgatgctaaaccgctctctgtctagactgcagtgggccagcctattactccttttcacaggagtggccattgtacaagcccagcaggccgggggcggcggtcccagacccctagaccaaaatccaggcgcaggactggctgccgtcgttgcaagctgtctgtcaagcggcttcgccggcgtatactttgagaagatattgaagggctcctctggaagcgtgtggctccgcaacttgcagctcggtctttttggaactgccctaggtttagtctag

SEQ ID NO: 206066 - DNA, 1266 bp, Artificial Sequence
  Description of Artificial Sequence: Synthetic coding sequence
atggccgccgtgggcgccggcggcagcaccgccgcccccggccccggcgccgtttcagctggggcgctagaacccggtaccgctagcgccgagttgctcctgacctgggaggaggccgaggcgcgagggcagggattgccgcagcctctgcctgacacttccgttagaatcccggcccacaggcggctgaaatacataagtctcgcggtgctcgtggtacaaaatgcctcactgattttgagcattcggtacgccagaaccctccccggcgatcgcttcttcgctacaactgccgtggtcatggccgaggtcctcaagggactgacttgcctgctactgctgttcgcccagaagcgcgggaatgtgaaacacctggtgctgttcttgcacgaggcagtactggtccagtatgtcgatacgcttaagctagcagtccccagtctgatttatacactccagaacaatctccagtatgtggctataagcaatttgcctgctgcaacctttcaggtgacctaccagctgaaaattctgaccactgcacttttttccgtgctcatgctgaatcgatccctcagccggttgcagtgggccagtctgctgttattatttacaggggttgctatcgtccaggcccagcaggccggtgggggtggaccccggcctctggatcagaaccccggggctgggctggcggcggttgttgcaagttgtcttagcagcggctttgccggggtgtatttcgagaagatcctcaagggatcttcaggcagtgtatggttgagaaacctgcaacttggacttttcggaaccgccttggggcttgtcggtctctggtgggccgagggcacagctgtggccacacgtgggtttttctttgggtatacccccgctgtttggggtgtggtcctgaaccaagcgttcgggggcctgctggtagctgtggtggtgaagtacgccgataacatattgaaagggtttgccacgagcctgagcatcgtgttgtctaccgttgcgagtataaggcttttcggctttcacgtcgacccgctgtttgccctaggcgccgggcttgtgatcggcgcggtctatttgtattccctgccacggggcgcagccaaagctatcgcttccgccagtgcctcagcatctgggccttgcgtgcaccagcagcctcccgggcagcccccccctcctcagctctctagccacaggggagacctgatcacagagcccttcctgcctaaatcggtgttagttaagtag

SEQ ID NO: 206067 - DNA, 1068 bp, Artificial Sequence
  Description of Artificial Sequence: Synthetic coding sequence
atggccgaggtgcaccggcggcagcacgcccgggtgaagggcgaggcacctgccaagtctagcaccttgcgcgatgaagaagagctcggcatggcttcagcagaaaccctcacagtgttccttaagctgctcgcagccggtttttacggagtaagttctttcttgatagtagtggtgaacaaaagtgtgctcaccaactatcggttcccatcttccctatgcgttggcctcggtcaaatggtagctaccgtggccgtgctgtgggtcgggaaagcacttagagtagtgaaatttcccgatctcgaccggaacgtacctcggaaaacgtttccgctgcctttgctgtattttggcaaccaaatcacagggctgttcagcactaagaagctcaatctccccatgttcactgttcttcggaggttttctatcctgtttaccatgttcgctgagggtgtcctgcttaagaaaaccttttcctggggaattaagatgacggtgtttgcaatgatcattggcgccttcgttgcagcctcgtctgatctcgcattcgacctcgagggatatgctttcatcctgattaatgatgtgcttaccgcagcgaatggggcttacgtcaagcagaaattagattccaaggaactgggcaaatacggactcttgtactataatgccctgttcatgatcctgccaaccctagccatcgcttattttacaggcgatgctcagaaagccgtcgagtttgagggctgggccgatactctgttccttttgcagttcacactgagctgtgtgatgggattcatcctgatgtatgctactgtgctgtgtacccaatataactccgcgttgacgaccactattgttggctgcattaagaacatactcattacctacatcgggatggtgttcggaggagactatattttcacctggaccaacttcatcggactgaacatatcaatcgccggctctctggtctactcttacatcactttcacggaagaacagctttccaagcaaagtgaggccaacaacaaattggacatcaaaggcaagggagctgtctag

SEQ ID NO: 206068 - DNA, 783 bp, Artificial Sequence
  Description of Artificial Sequence: Synthetic coding sequence
atggtggccaccgtggccgtgctgtgggtgggcaaggccctgcgggtagttaagtttcccgatctcgataggaacgtcccgcgcaaaacattcccgctgcctctgttgtatttcgggaaccagatcactgggcttttctcaacaaagaagctgaatctgcctatgtttaccgtgctccggaggttcagtatcttattcaccatgtttgccgaaggagtcctgcttaagaaaacattttcctggggcatcaagatgacagttttcgcgatgatcatcggcgctttcgtggccgccagctccgacctggcctttgacttggagggatacgcttttatcctaattaacgatgtcctcactgcggcgaacggtgcttatgtaaagcagaagctggacagtaaggagttaggaaaatacggactgctatactacaatgctctattcatgattctgcctactctggcaattgcgtattttactggggacgcacaaaaagcggtggagttcgagggatgggctgatactctgtttctcctgcagttcaccttgtcgtgtgtaatggggtttattctgatgtatgccacagttctctgtacccaatacaactcagctcttacaacgactatcgtcgggtgtataaagaatattctgatcacatacatcgggatggtgtttggcggcgactacattttcacatggactaacttcatcggcctcaatatttcatgcatctgccaccgcgggctgtgtgagctgagagtcgggagtgcaaccctgggaggatag

SEQ ID NO: 206069 - DNA, 1104 bp, Artificial Sequence
  Description of Artificial Sequence: Synthetic coding sequence
atgagcagccggagcgtgctgagccccgtggtgggcaccgacgcccccgaccagcacctcgagctcaaaaaaccccaggaattgaaggaaatggaacggctgcctcttgcaaacgaagacaaaacaatgttcgccaacctcaagtacgtgtcgctgggcatcctcgttttccagaccacgtctttagtccttactatgcgttactctagaacactgaaagaagagggacctcgatacttatctagtacagccgtggtggtggccgagctgctgaagatcatggcctgtatcctgttagtgtataaggactcaaaatgttctctgagggccttgaaccgagtgctacacgacgagatcttaaataaaccgatggaaactctgaagcttgccattcccagtggaatttacacgctgcaaaataatctgctgtacgtggctttgagtaaccttgacgcagccacataccaggtaacctaccaactcaagatacttactaccgctcttttttcagtgagtatgctgagcaaaaagctgggtgtttatcagtggctgtctctggttattctcatgacgggtgtggccttcgtacagtggcccagcgattcgcagctggattctaaagaactatccgccggcagccaattcgtcggtttgatggcagtcctgacagcatgcttcagcagtggctttgcaggggtgtatttcgagaaaatcctgaaggagactaagcagagcgtttggattcgaaacatccagctaggttttttcggatcaattttcggacttatgggcgtctatatctacgacggtgaacttgtgtccaaaaatggtttcttccagggatacaataggttgacatggatagttgtggtgttgcaggcgttgggtggactggtgattgctgcagtcatcaaatatgcagataatatcctgaaaggatttgcaacgtcgctgtctatcattctgtccaccctgatttcctatttttggcttcaggactttgtgcctacaagcgtattctttctcggagctattttggtaatcactgcgacgtttctgtatggatacgatcccaagcccgctgggaatcctacaaaagcatag

SEQ ID NO: 206070 - DNA, 978 bp, Artificial Sequence
  Description of Artificial Sequence: Synthetic coding sequence
atgttcgccaacctgaagtacgtgagcctgggcatcctggtgttccagacgaccagtctcgtgcttaccatgagatactccaggactctgaaagaagaggggccccgctacctgtccagcaccgccgtcgtggtcgccgagctgcttaagattatggcttgtatccttttggtctataaggattctaagtgttccctccgggcattaaaccgggttctacatgacgagattctgaacaagccaatggaaacacttaagctcgcgatcccgtcaggaatttacactttacagaataatctcttgtacgtggccctgagcaatctcgacgcagcgacgtatcaggttacataccagctaaaaattctcaccaccgcgctcttctctgtgtcgatgctgtctaagaaactgggagtgtaccagtggctctccctcgtaattctcatgactggtgtggctttcgttcaatggccttcagactcgcaattggattccaaagagctgagcgcagggagtcaatttgtggggctgatggctgtcttgaccgcctgtttcagcagtgggttcgcgggggtatactttgaaaaaatcctcaaagagaccaagcaatccgtgtggatcagaaacattcagttgggctttttcggaagcatcttcggcctcatgggagtctatatttacgacggcgagcttgtttccaaaaacggttttttccagggttacaatcgcttgacctggattgtggtggtgcttcaggctctggggggactggtaatcgcagcggtgatcaagtatgccgacaacattctcaaggggttcgcgacttcacttagtatcattttgagcacattaatcagttatttttggctccaggactttgtgccgacttcagtattttttcttggcgcgattctcgtaataacggccacattcttgtacggctatgacccaaagcccgcagggaacccaaccaaggcttag

SEQ ID NO: 206071 - DNA, 675 bp, Artificial Sequence
  Description of Artificial Sequence: Synthetic coding sequence
atgttcgccaacctgaagtacgtgagcctgggcatcctggtgttccagacgaccagcctggttcttacaatgcgatactcccgcaccctcaaggaagagggccctaggtatctatccagcaccgctgttgtcgtggccgaactccttaaaatcatggcttgtatcctgctggtctacaaagactcaaagtgcagcttgcgcgcccttaaccgtgtgctgcacgatgagattctaaacaagccaatggagacgctcaagctagctatcccgagtgggatctacaccctacaaaacaaccttctttacgtggcactgagcaatttagacgccgctacttaccaggtcacatatcagttgaagatcctaaccactgccttattcagcgtaagcatgctgagcaagaaactgggcgtctatcagtggctaagtttggtcattctgatgacaggtgttgctttcgtgcagtggccttccgattcccagttggacagcaaagaactttcggccggcagccaatttgttggcctgatggcagtcctgacagcttgcttctctagtggtttcgcaggagtctactttgagaaaattctgaaggaaactaagcagagtgtgtggattcggaatattcaactcggattcttcggttccatcttcggtctgatgggggtctattag

SEQ ID NO: 206072 - DNA, 978 bp, Artificial Sequence
  Description of Artificial Sequence: Synthetic coding sequence
atgttcgccaacctgaagtacgtgagcctgggcatcctggtgttccagacgacatccttggtcttaactatgagatactccaggaccctgaaggaagagggtcctcgctatttgtcatcaactgcagtggtggtggcagagcttctaaaaatcatggcttgcattctgctggtctacaaggactctaaatgttcgctgagggcattaaaccgcgttcttcacgacgagatcctcaacaagcccatggaaaccctgaaactcgcaattccctctggtatctacactctccagaacaatctgctctacgttgccctctcaaatttggacgccgctacttaccaggttacttaccaacttaaaatcctcacaaccgccctcttctcagtgagcatgctgagtaaaaagttgggagtctaccagtggctgagcctcgttatcttgatgaccggcgttgcttttgtgcaatggcccagcgactctcaattagactcgaaggaactgtcagctggcagtcagtttgtggggctgatggccgtgcttactgcctgcttttcttcaggttttgcgggcgtttatttcgagaaaattcttaaagagacaaaacaatccgtatggatcaggaacattcaattgggtttctttgggtctattttcggcctgatgggagtttacatttacgacggcgagctcgtgagcaagaacggattctttcaggggtataatcgcctcacctggatcgtcgttgtattacaggctctgggtggacttgtgatagctgcagtaatcaagtatgctgacaatattctcaagggatttgccacatctctctctattatcctgagcaccctcatctcatatttctggctgcaagattttgtgccaacgagcgtatttttcctgggcgctatcctagttatcaccgcaacttttctgtacggatacgatccaaagcctgctggaaatccaaccaaggcatag

SEQ ID NO: 206073 - DNA, 663 bp, Artificial Sequence
  Description of Artificial Sequence: Synthetic coding sequence
atgttcgccaacctgaagtacgtgagcctgggcatcctggtgttccagaccacatctttggtgctgactatgaggtattccagaactctgaaggaggagggaccccggtatttgagcagtaccgccgtagtggttgccgagttacttaaaataatggcatgcattctgctcgtgtataaggattccaagtgtagcctgcgggctttaaacagggtgctgcatgatgagatcctcaataaacctatggaaactttgaaattggccattccaagcggaatatacacactgcaaaataatctgctgtatgtcgccctgtccaatctggatgcagcaacttaccaagtgacgtatcagttaaaaatcctgaccaccgcactgtttagcgtatccatgctctcaaaaaagctgggggtctatcagtggctttctctagttatattgatgacgggcgtggccttcgtgcaatggccctcagattcccagctggactctaaggaactttctgccgggagccaattcgtggggctcatggcagtattgaccgcctgtttcagctcaggcttcgctggagtatacttcgagaaaattctcaaggagacaaaacagtcagtttggattcggaacatccagctggtgagcttttctctggaaccctccctgtag

SEQ ID NO: 206074 - DNA, 258 bp, Artificial Sequence
  Description of Artificial Sequence: Synthetic coding sequence
atgttcgccaacctgaagtacgtgagcctgggcatcctggtgttccaaacaacgtctctggtgttgaccatgagatatagtagaacactgaaagaggaaggccctaggtacctatctagcaccgctgtcgtggtggccgaactgctgaagattatggcctgcatcttgctggtctacaaagattcaaagtgctcactgcgtgctctgaatcgtgtgctccacgacgagatcctgaataaacccatggagaccctatag

SEQ ID NO: 206075 - DNA, 1104 bp, Artificial Sequence
  Description of Artificial Sequence: Synthetic coding sequence
atgagcagccggagcgtgctgagccccgtggtgggcaccgacgcccccgaccagcatctggaactgaaaaaaccacaggagctaaaggagatggagcgactccccctggcgaatgaggacaagacaatgtttgccaatctgaaatacgtgagccttgggattcttgtctttcagacaaccagtctcgttctgactatgcggtattcccgcactctgaaggaggaaggtccacggtatctttcatccactgcagtcgtcgtagcagaactgctcaagataatggcgtgtatcctgttggtgtataaggactcaaaatgcagcctgcgagccctcaatcgcgtgctgcacgatgagatcctaaataaacctatggagacactgaaactcgccatcccatctgggatttataccctccagaacaaccttctttatgtcgccctgtccaaccttgatgctgctacctatcaggtgacctatcagctcaagatcctgactaccgcactgttctccgtgtcgatgctttctaagaagctgggagtctaccaatggcttagtttggtcatcctgatgactggagttgctttcgtgcaatggccaagtgacagtcagctggactccaaggaactgtcagccggctcccaattcgtaggattaatggccgttctgacagcctgcttctcctctggcttcgctggtgtttatttcgaaaagattctgaaagagaccaagcaatccgtatggattaggaacatccaattaggattttttggaagcattttcggactgatgggagtgtatatatacgatggggaattagtttctaagaacggcttctttcagggctataacagactgacctggatcgtggtggtgctgcaggccctaggcgggttggtcatcgcagccgtcattaaatatgccgacaacatcctgaaaggcttcgccacttccttgagcatcatcctgtcgactctgatatcatacttttggttacaggattttgtccccacttctgtattttttctcggcgcaatactggtgatcacagccacatttctctacggctacgatcccaaaccagctgggaaccccacgaaggcatag

SEQ ID NO: 206076 - DNA, 969 bp, Artificial Sequence
  Description of Artificial Sequence: Synthetic coding sequence
atggccagcagcagcagcctggtgcccgaccggctgcggctgcccctgtgtttcctgggggtgtttgtatgttatttctactacgggatactgcaggagaaaatcactaggggaaagtatggtgaaggggcaaagcaggaaaccttcacgttcgccctcaccctagtgttcatccagtgtgttattaatgcagtcttcgccaaaatcttgatccaattcttcgacacggcccgtgttgacaggacacggagctggctgtatgcggcctgctctatatcatatctgggcgcaatggtgagcagcaacagcgctctccaattcgtcaactatccaacccaggtgctcgggaaatcatgcaagcctatcccagtcatgctactaggagtgactttgctgaagaagaaatatccattggcaaaatatttgtgtgtgctgcttatagtggccggtgttgccctctttatgtacaagcccaagaaggttgtaggcattgaggaacatactgtaggctacggagaattgctcctgctactgagtttaaccctggatggcctgaccggagtgagtcaggaccacatgagagcgcattatcagaccggaagtaatcatatgatgctgaacataaatctttggtcgacactgttactggggatgggaatcctgttcaccggcgaactgtgggaatttcttagttttgccgagaggtatccagccattatctataatatactgctgtttgggcttacctccgcgctgggacaaagctttatcttcatgactgtggtttattttggccctctgacctgttcaataatcacaacaacccgtaagttctttaccatcctggctagtgtgatcctgttcgccaaccctatctctcccatgcagtgggtggggaccgtcctggtatttctgggactggggttggatgccaagttcggaaaaggcgctaaaaagacaagtcattag

SEQ ID NO: 206077 - DNA, 450 bp, Artificial Sequence
  Description of Artificial Sequence: Synthetic coding sequence
ccccagagctgcctgatcggcaagatcagccgggcccgggaccagtctcgtgggtgcaggtttccatggcctagcggcatggagcccaggaccagggtgggccctctcctcgtcctgccggacgcttgtaagcaacctatcagacctagaccttggtgccatagtagaaacaccgtgtcttcctgtctaggaaccagaggcaagtacggggaaggggcgaagcaagagacctttacattcgctctgactttggtgtttatccagtgtgtgatcaacgccgttttcgcaaaaatctggtggatcgtgcccggggcaggaagcatgctccccgttcttagccccatctgggtcccttggtccccagccatccaacattacagtctgagcactacccagcttaggagtttggtgaatcccgcttcacaaagtcaaagctgcagcttaggctag

SEQ ID NO: 206078 - DNA, 1080 bp, Artificial Sequence
  Description of Artificial Sequence: Synthetic coding sequence
atgcggcccctgccccccgtgggcgacgtgcggctggagctgagcccgcccccacctctgctgccagtgccagttgttagcggcagccccgtaggcagctctggaagactgatggcctctagctcatcactggtaccagatagactgcgccttcctctttgtttcctgggggtgtttgtatgctacttttattacggtattctccaggaaaagatcactcggggcaaatacggcgagggtgcgaagcaggagacctttaccttcgctctgactctggtctttatccaatgtgtgatcaacgcagtctttgccaaaattctcattcaattttttgacacggcccgcgtggatcgcacccggtcgtggctttacgctgcgtgctccatctcttacttaggcgccatggtcagctcgaactcagctctgcagtttgtcaactatccgactcaggtccttggcaaatcatgtaagcccattcctgttatgttgctcggcgttacactccttaagaagaaataccccctcgccaaatacctctgtgtactgctgatagtagccggagtggcacttttcatgtataagccaaagaaggtggtgggcatcgaggagcatactgtcggctatggcgaactcctgctcctgctaagcctcacactagacggtttaacgggtgtgtcacaagaccacatgagggcccactatcagactggatccaatcacatgatgcttaatatcaatctgtggtccacccttctcctcggcatgggcattcttttcactggggagttgtgggaattcttgtcattcgcggaaagatatcccgctatcatttacaatattctcctgtttggtctcacttctgcactcgggcagagtttcatctttatgacagtcgtctatttcggccccctcacctgctctatcattactacaacaagaaaattttttacgatcctggcaagtgtgattctctttgcaaatcccatttccccaatgcagtgggttgggactgtgctggtgttcttagggctcggactggacgcaaagtttggtaagggagcgaagaagaccagtcactag

SEQ ID NO: 206079 - DNA, 720 bp, Artificial Sequence
  Description of Artificial Sequence: Synthetic coding sequence
atggccagcagcagcagcctggtgcccgaccggctgcggctgcccttgtgttttctgggggtctttgtctgctacttctattacggcattctccaggaaaaaattacacggggaaagtatggagaaggcgctaaacaggagacttttacctttgccctgactctggtgttcatccagtgtgtcatcaatgccgtctttgctaagatactgatccagttttttgatactgcccgggtggaccgcacgcgatcatggctgtacgctgcctgttccatctcttacttaggcgcaatggtcagctctaatagcgccctccagtttgtcaactaccctacacaggttctgggcaagtcctgcaagcctatccccgtgatgctcctgggcgtgactttgctaaaaaagaaataccctctagctaagtatttatgcgttctactgatcgtcgccggtgtggccctgtttatgtacaaaccaaagaaagtggtgggtatcgaagaacataccgtagggtatggcgagttattactgctcctcagccttacactggatggcctaactggtgtctctcaggatcacatgcgagcccactatcagacggggtccaatcacatgatgctcaatataaacctttggtcaaccttgctactcggaatgggtgaatcacagttttgttgcagcagccatgtgtcaccagagggaagattacccagcagcttctag

SEQ ID NO: 206080 - DNA, 597 bp, Artificial Sequence
  Description of Artificial Sequence: Synthetic coding sequence
atgctgctgggcgtgaccctgctgaagaagaagtaccccctggccaagtatctctgtgttctattaatagtggcgggcgttgccctcttcatgtataagcctaaaaaggtggtcggaatcgaagagcacacagtcggctatggagagctgctcttgcttctgtctctgaccctcgatggcctcacaggcgtcagccaggatcatatgagggcccattaccagactggctctaatcatatgatgctgaatatcaacctctggtccaccctcctcctaggcatggggatactctttacaggggaactctgggaattcctgagcttcgcagaacgttatcctgctataatctacaacattctgttgttcggattgaccagtgccctgggtcagagcttcatctttatgacagtggtatattttggaccacttacatgctctataataaccactacgagaaagttcttcacaattctggcctcagtaattctgttcgctaacccgatctcccctatgcagtgggtagggaccgtgctggtatttttaggactgggactggacgccaagtttggcaagggtgccaagaagacctctcattag

SEQ ID NO: 206081 - DNA, 570 bp, Artificial Sequence
  Description of Artificial Sequence: Synthetic coding sequence
atgctgctgggcgtgaccctgctgaagaagaagtaccccctggccaagtatctctgtgtgcttctgatcgtagcaggcgtcgccttattcatgtacaagcctaagaaggtcgtcgggatcgaggagcacaccgttggctacggcgagctgctactgttgctctcactgactctagatggcctgactggggtatcgcaggatcacatgagggctcactatcaaactggcagtaatcatatgatgcttaatattaacctatggtcgactttgctgctcggcatgggaatactatttacaggcgagctgtgggagtttctgtcattcgcagagcgctaccctgccatcatttataacatcctcctgttcggactgacatctgcacttggccagagttttatattcatgactgtggtttactttggcccgttgacttgttcgataattacaaccacgcgaaagttctttacgattctagcctccgtgatactgtttgccaaccctatctcacctatgcagtgggttggcaccgttctggtgttcctcgctatgggaagctgttgcgtggcctag

SEQ ID NO: 206082 - DNA, 1179 bp, Artificial Sequence
  Description of Artificial Sequence: Synthetic coding sequence
atggacgcccggtggtgggccgtggtggtgctggccgccttcccctctctgggagcgggaggcgagaccccagaggcaccacccgagtcctggacacagttatggttcttcaggtttgttgtgaacgctgccggctatgcctcatttatggtgccaggctaccttctcgtacagtacttcaggagaaagaactacttagagaccgggcggggcctgtgctttccactggtcaaggcatgtgtgttcggaaatgagcccaaggcgtctgacgaggttccgctcgctccacggacagaggcagcagagaccacgccgatgtggcaggcgctcaaactgttgttctgcgcaaccggcctgcaggtgagctatcttacgtggggcgtccttcaggaacgtgtgatgaccagaagctacggtgctaccgcaacctctccgggcgagcggttcacagacagccagttccttgtgctgatgaaccgggtcctagccctgatcgtggcaggcttgagttgtgtgctttgcaagcagcccagacatggggctccaatgtaccgatacagcttcgcatccctgagtaatgtcctgtcttcgtggtgccagtacgaagccctcaagttcgttagttttcctacgcaggtgctggcgaaagcgtccaaggtcattcctgtcatgctgatggggaagttagtctcacggaggagctacgagcattgggaatacctcaccgctacccttatctccataggggtatctatgtttttgttgagctccgggcctgagccccggagctcacccgccaccacacttagtggcctgtttacagttggttcactcctcgagcagggcgctcttcttgagggcactaggttcatggggcggcactcagagttcgctgcccacgcacttctgctctctatttgttctgcctgcggccaactattcatcttctatactattggccaatttggagctgccgtatttaccatcatcatgaccctccgccaggccttcgcaatcctcctgtcatgtcttctatatggtcataccgtgaccgtcgtgggcgggttgggcgtcgcggtagtgttcgctgctttgctgctgcgggtgtacgctcgggggaggttaaagcagcggggcaagaaagcagttccagtagagtccccagtgcaaaaagtgtag

SEQ ID NO: 206083 - DNA, 1299 bp, Artificial Sequence
  Description of Artificial Sequence: Synthetic coding sequence
atggacgcccggtggtgggccgtggtggtgctggccgccttcccctccttaggagctggcggcgagacccctgaggcaccaccggagtcttggacccagctgtggttcttccgctttgtggtcaatgcggccggctatgcaagctttatggtgcccggatacctactggtccaatattttcggcgcaagaattacctcgagacagggagggggctatgcttcccactggtgaaggcctgtgtattcggtaacgaaccgaaggcatcggatgaggtaccccttgcaccgagaacagaggccgctgaaacgacaccaatgtggcaggccttaaagctcctgttttgcgcgacaggcctgcaggtcagttacctgacctggggagtgctgcaagaacgggtgatgacccggagctacggcgccacagctacaagccctggtgagcgatttactgactctcagttcttggtcttgatgaaccgagttttggcccttatcgtcgctggactttcctgcgttttgtgcaagcagccccgtcatggggcacccatgtaccgctacagcttcgcatctttgagtaatgtgctatcatcctggtgccagtacgaggcactcaaatttgtaagtttcccgacccaggtgctggccaaggcgtcaaaggtcattccggtaatgctgatgggtaagcttgtgagcagacgatcctatgagcactgggagtatctgacagccacactcatttccataggagtgtccatgtttctgctgagcagcggccctgagcccagaagctcacctgccacaacattgagcggactaattctcctggctggttacatcgccttcgacagctttacctccaattggcaggacgcactgttcgcgtacaagatgtcctctgtccagatgatgtttggcgtgaatttcttttcgtgcttgttcaccgtggggtcgctcctagagcaaggcgcactactcgagggcactcgtttcatgggccggcatagcgagttcgcagctcacgcgctcctgctaagcatatgttccgcgtgtggacaattatttatcttttatactattggacagtttggcgcggctgtattcacgataatcatgaccctgcgccaggcctttgccatactcttatcttgtctgctttatggacatacagttacagtcgtgggtggcttgggcgtggcagttgtgtttgcggccttgctgctacgagtgtacgccagaggccggctgaaacagaggggcaaaaaggctgtgcctgtggagtctccagtccagaaggtgtag

SEQ ID NO: 206084 - DNA, 900 bp, Artificial Sequence
  Description of Artificial Sequence: Synthetic coding sequence
atgacccggagctacggcgccaccgccaccagccccggcgagcggttcaccgactcccaatttctggtcctaatgaatcgggtcctggccttgatagttgcaggactctcctgtgtgctatgtaagcaaccacgccacggcgccccgatgtaccggtattcattcgctagcttatccaacgtgctttcttcctggtgtcaatacgaagccctgaagttcgtgtctttcccaacacaagttctggcgaaagccagcaaggtgattcctgttatgctcatggggaagctggtatcacggcggtcctacgagcactgggagtacttgacagctacactgatttctatcggagtgagcatgtttctgctgtcctctggacctgagccccgatcaagccctgctactacactctcaggtttaattttgctggccggttacattgcctttgatagttttacatctaactggcaggatgcattgtttgcatacaaaatgtcctcagttcagatgatgtttggcgtgaacttcttcagctgtctcttcactgtggggtcactcctggaacagggagctttgctcgaaggcactagatttatgggaaggcacagtgagttcgctgcccacgcccttctcctgagcatctgttccgcctgcggtcagctgtttatcttctatactataggccaatttggcgccgctgtgttcaccattataatgacactgcggcaggccttcgccattcttctcagctgcttattgtacgggcacaccgtcacagttgtggggggactcggcgtggctgttgtatttgccgccctactactgcgggtgtacgccagaggaaggttgaaacagagggggaagaaggctgtaccggttgagtcccccgtgcagaaagtatag

SEQ ID NO: 206085 - DNA, 1020 bp, Artificial Sequence
  Description of Artificial Sequence: Synthetic coding sequence
atgctgctggccatgcccgccctgtggtacctggccaccagctggtgcagcaccagcggcggacgcactacctggcggccagtctcctacctcacctggggagtactacaggaacgggtgatgaccaggtcctatggagctacagctacaagcccgggagagagattcacagactcccagttcctcgtcctgatgaatagagtgcttgcattgatcgtcgccggcctgagttgtgtcctgtgcaaacagccaagacatggcgcacctatgtaccgatactccttcgcttctctgtctaacgttctttccagctggtgtcagtatgaagcactgaaatttgtgtcttttcccacacaggtgctggctaaagcttctaaggtcatccctgtgatgctgatgggaaagctggtatcccggaggtcatatgaacactgggaatacctcactgctaccttgatctcaataggtgtcagtatgtttctcctctctagcggccccgaaccacgcagctcccctgccacaaccctgtccggactgattctcctggccggatacattgcatttgatagttttacctcaaactggcaagatgctctgtttgcatacaaaatgtccagcgtccagatgatgttcggagtgaacttcttcagctgtctgtttacagtggggtcccttctggaacagggggccttgctggagggaactcgctttatgggtagacacagcgagttcgcggcccacgcattattgctttctatttgcagcgcctgtggccagctttttattttctatacaataggccaatttggggctgcggtttttactatcatcatgaccctgcgccaggcatttgctattctgttatcttgcctgctttacgggcacactgtcaccgtcgtcgggggccttggggtagccgtggtgttcgcggctttgctcttacgagtctacgcccgcggacggctgaagcagcggggcaaaaaagccgtccccgttgaatctccagtgcagaaagtgtag

SEQ ID NO: 206086 - DNA, 852 bp, Artificial Sequence
  Description of Artificial Sequence: Synthetic coding sequence
atggacctgacccagcaggccaaggacatccagaacatcaccgtgcaggagacaaacaagaataactcagaaagcatagaatgttctaaaattacgatggacctcaagtttaacaattcccgcaagtatatttccatcactgtgcccagcaagacccagaccatgtcgccccatattaaatcggtggatgacgtggtagtcttagggatgaatctgagtaagttcaacaagctgactcagttcttcatctgcgtggcgggagtgttcgtattttacctgatctacggttaccttcaggagcttatcttcagcgttgaaggcttcaagagctgtggatggtacctgacgctggtgcagttcgccttctactccatctttgggctcatcgaactgcagctgatccaggacaagagaagaaggattccaggaaagacatatatgatcattgccttcctcacagtcgggaccatgggtcttagcaatacatctttgggctacttgaattacccaactcaagtgatattcaaatgttgtaagctcattcctgtgatgctaggcggagtgttcatccagggcaaacgatataatgtggccgacgtctctgccgcaatctgcatgtctttagggttgatctggttcacactcgctgactcaacaactgcaccaaacttcaatcttactggtgtggtgctgatatccctggccctctgcgcagatgcagtaattggcaatgttcaggagaaggctatgaagttgcacaatgcgtcgaacagtgagatgaatattactacatcttcctatagcggcgtctttatcttccctaacaagctaaaaatcccactggtactgtag

SEQ ID NO: 206087 - DNA, 1206 bp, Artificial Sequence
  Description of Artificial Sequence: Synthetic coding sequence
atggacctgacccagcaggccaaggacatccagaacatcaccgtgcaggaaaccaacaagaataactcagaaagcatcgagtgctcgaagattaccatggatctgaagttcaataattcacgaaagtacatatccattacagtaccatccaaaacacagaccatgagcccgcacataaaaagcgtggacgacgtggtggttctcgggatgaacctctccaaatttaacaagttgacacagttcttcatttgcgtggccggagtcttcgtcttctatctgatttacggctatcttcaggagctgatattctccgtggagggttttaagtcgtgtggctggtacctcactcttgtgcagttcgcattttattccattttcgggctcattgaactccagctgatccaagacaaacggcggcgcatcccaggaaagacttatatgatcattgccttcctgactgtggggactatggggcttagcaatactagtctgggctaccttaactatcccacccaggttatcttcaagtgctgtaagctcattccagtgatgctaggaggagtgtttattcagggtaaaaggtataatgtggctgacgtctctgccgctatctgcatgagtctgggcctgatttggttcactctggccgattcaacgactgcgccgaatttcaacctcacaggtgtggttctgatttctcttgccctgtgcgccgacgcagttattgggaacgtgcaggagaaggccatgaagctccacaacgcgtcaaactccgaaatggttttgtacagctatagcattggattcgtctacatattgcttggattaacttgcacatctggcctcggtcccgccgtgacgttctgcgctaaaaaccctgtgcggacctatggctacgcttttttgttcagccttaccggatacttcgggatctcttttgtacttgccctgatcaagatattcggggctctgatcgccgtgacagtcaccacaggccgtaaagccatgaccattgtcttatcgtttatcttctttgccaagcctttcacatttcagtatgtgtggtctggcctgttggtcgttctgggaatcttcttgaatgtctactcgaagaacatggataagattcgcctaccttccctatatgaccttatcaacaagagcgtggaagcccgtaaatcacgaacactcgcgcaaactgtttag

SEQ ID NO: 206088 - DNA, 657 bp, Artificial Sequence
  Description of Artificial Sequence: Synthetic coding sequence
atgctgcggctggcccagaccccccggcggctgcccagccccttcagagtcacatatcgcccttgggggaccagggcctttggggcgttcccagtgttcggtacccaaatctctagcccccccgaaaatctggacacggcccacctcccccaccctgagggcgcatttgaggagtggatgagaagcggctggaagaagagagaccttacacagcaagctaaagacatccagaacatcactgttcaggagaccaacaagaataactcagaaagcattgagtgctcgaaaataactatggacttaaagtttaacaactcccgtaagtacatctccattacagtgccctcaaaaacccagacgatgagtcctcatattaagagcgtagatgatgtagtggtgctgggaatgaatctgtcaaaattcaataaacttacacagttctttatttgcgtcgctggggtgttcgtgttttatcttatctacggatacttgcaagaactcatcttctctgtcgagggcttcaaaagttgcgggtggtatctcacattagttcagtttgctttttactctatctttggccttatcgaactgcagttgatccaggacaagcgccgacgatatgtcgtatgtttctactttctcatttttttatattag

SEQ ID NO: 206089 - DNA, 996 bp, Artificial Sequence
  Description of Artificial Sequence: Synthetic coding sequence
atgcggcccgccctggccgtgggcctggtgttcgccggctgctgctccaatgtgatcttcctggagctcctggcaagaaaacaccccgggtgtggaaatattgttacctttgcccagttcctctttatcgctgttgagggattcctgttcgaagctgacctgggtagaaaaccaccagccatccccattcggtactacgcgattatggtgacaatgttttttaccgtgtctgtcgtgaataattatgcacttaaccttaatattgcgatgcccttgcacatgatctttaggagtgggtcccttatcgctaatatgatattgggaatcatcattctcaaaaagcggtactctatcttcaagtacacttcaattgctttggtgtccgtagggatattcatatgcactttcatgagcgcgaagcaggttacatctcagagctccctgagcgaaaacgacgggtttcaggcattcgtgtggtggttgttaggcatcggtgccctcacttttgccctgctgatgagcgctcgcatgggtatttttcaggagacgctgtataaaagattcggcaaacactctaaagaagcccttttctataatcatgcgttgcctttgccagggtttgtgttcttagcttccgatatttacgaccatgctgtgttgttcaacaaaagcgagttgtacgagatccccgtgattggtgtgaccctgcctatcatgtggttctatctgctcatgaatattattactcaatacgtgtgtattcggggtgtgttcatcctgacaaccgagtgcgccagtcttaccgttactcttgtagtaaccctgagaaaatttgtgagcttgatttttagcatattatacttccagaatccctttaccctgtggcactggctgggtacactgtttgtgtttattgggacgctgatgtacacagaagtatggaataatctggggaccacaaaatccgagccgcagaaggactctaagaaaaactag

SEQ ID NO: 206090 - DNA, 1095 bp, Artificial Sequence
  Description of Artificial Sequence: Synthetic coding sequence
atgaaccgggcccccctgaagcggagccggatcctgcacatggccctgaccggagccagcgatccctcggccgaggccgaagccaatggagagaaaccctttctgcttcgcgcgctgcagatcgcactggtggtgtctctgtattgggtgacctctatatctatggtcttccttaacaagtacttgctcgacagtccttctctaaggctggatacgcccatctttgtcaccttttatcaatgcctcgtcacaaccctgttgtgcaagggcctgtccgctcttgccgcctgctgccccggagctgtggactttcctagtctccgtttagatctccgggttgctaggtccgtcctccccttgagcgttgttttcatcggaatgattacatttaacaatctgtgcttgaagtacgtgggggtggctttctataacgtgggccggtccttaacgacggtgtttaatgttcttctcagttatctcctgctgaagcagacaacatccttttacgctcttctgacttgtggaattattattgggggtttctggcttggggtcgaccaggaaggagcagagggcaccctgtcttggctgggcactgtcttcggcgtgttggcgtccctatgcgtgtccttaaacgccatatacaccacaaaagtgttgcccgctgtggacgggtccatctggcgactgactttctataataatgtgaatgcctgcatactttttttacccttactgcttctgctgggagagctgcaagcgttgcgagattttgctcaactggggtcagcacacttctgggggatgatgactctaggcggcctgtttggcttcgccatcggatatgtgactggactccagattaaatttactagtcccctcacacacaacgtctccggcactgcgaaggcatgtgctcagaccgtcctggctgtcttgtactacgaggaaacaaagtccttcttgtggtggactagtaacatgatggtgctgggtgggtccagcgcttatacctgggtgcgaggttgggagatgaaaaaaactcccgaggagccatccccaaaggattcagaaaaaagcgctatgggcgtgtag

SEQ ID NO: 206091 - DNA, 1056 bp, Artificial Sequence
  Description of Artificial Sequence: Synthetic coding sequence
atggccctgaccggcgccagcgaccccagcgccgaggccgaggccaacggcgaaaagcctttcctgctaagggcactccagatcgcgctggttgtctcactctactgggtcacgagcatctcaatggtttttctgaacaaatacctgctggactccccatccctacgcctggacaccccaatattcgtgactttctaccagtgcttagtcacgacgctcttatgcaagggactgagtgctttggccgcctgttgccctggcgcggtggacttcccatctctcaggctagacttgagagtggctcggtcagtactccctctcagcgtggtgttcatcgggatgatcacgttcaataatctatgcttaaaatacgttggggtggcgttctacaacgtgggccgctccttgaccactgtatttaatgtgctgttatcttacctgttgcttaagcagacaacaagcttttacgccctgctaacatgcggcattatcatcggcggattttggttaggcgtggatcaggagggcgctgaagggaccctgtcatggctgggtacggtgtttggagttttggcatcattgtgcgttagtcttaacgcgatctacactactaaagtgctaccagccgtcgacggcagcatttggagactgacattctataacaacgtcaacgcatgcatactctttttgccactgcttctgctgctgggagagcttcaggcgctgagagatttcgcccagctcggctctgcccatttttgggggatgatgacactgggcgggctgttcgggttcgctatcgggtacgttaccggcctgcaaattaaattcaccagtccgctcactcataacgtcagcggcacggcaaaggcctgtgcccaaactgtgctagctgtgttgtattacgaggagacaaaaagctttctctggtggactagtaatatgatggtgctgggcggcagctctgcttacacctgggttcgcggatgggaaatgaagaaaacgccagaagaacccagccccaaagactctgaaaaaagcgcaatgggagtgtag

SEQ ID NO: 206092 - DNA, 1056 bp, Artificial Sequence
  Description of Artificial Sequence: Synthetic coding sequence
atggccctgaccggcgccagcgaccccagcgccgaggccgaggccaatggcgaaaaaccgtttctgctccgcgccctgcaaatagctcttgtggtttcactctactgggtgacgtctatcagcatggtgttcttgaacaagtacctcctagacagcccatccttacggttagacacaccaatctttgtgaccttctaccaatgcctcgtgaccactctgctctgcaaaggcctcagtgctttggccgcttgttgccccggggccgtcgatttcccatcactgcgccttgacctaagagtcgcaaggtccgtcctgccactgtcagtggtgttcattggcatgattaccttcaataacctctgtttaaaatacgtgggggtcgcattctacaacgttggaagatctttgactaccgtatttaatgtgctactgagctacctgttgttgaagcagaccacctcgttttacgccttgctcacttgtggaatcattatcggaggcttttggctaggcgtggatcaggagggtgccgagggcacgctctcttggttgggcaccgtgttcggagtgctggcctcattgtgtgtcagcctgaacgccatctacacaaccaaggtcctcccagccgtggatgggtctatttggagactgacgttctacaataatgtcaatgcctgtatcctgtttctacccctgctgcttttattaggcgagctacaggctctgcgggactttgcacagctgggaagcgctcatttctggggcatgatgaccctggggggcctgtttggcttcgctataggctacgtcacaggacttcagattaaattcacatcccctctgactcacaatgtcagcggtaccgcaaaagcatgcgcccagaccgtgctcgccgtgctgtattacgaggagacaaaatctttcctgtggtggacgagcaatatgatggtgttagggggatcatccgcatacacttgggtgagaggctgggaaatgaagaagaccccagaagagccctctcccaaagacagcgagaaaagtgccatgggcgtgtag

SEQ ID NO: 206093 - DNA, 219 bp, Artificial Sequence
  Description of Artificial Sequence: Synthetic coding sequence
atggccctgaccggcgccagcgaccccagcgccgaggccgaggccaatggcgaaaaaccctttctcctccgggccctgcagattgcgctggtggttagcctgtattgggttacctccatttctatggtcttcctcaacaagtacctgttggattctccttcacttcgcttagacacacccattttcgtgaccttttatcagtgtctcgtgacgacatag

SEQ ID NO: 206094 - DNA, 498 bp, Artificial Sequence
  Description of Artificial Sequence: Synthetic coding sequence
atggccctgaccggcgccagcgaccccagcgccgaggccgaggccaatggagagaagcctttcttgctgcgagctctccaaatcgccctcgtcgtgtccctgtattgggtgacaagcatttcaatggtcttcctgaacaagtatctgttagactctccgtcattgaggttggatactcccatcttcgtcaccttctatcagtgcttggtcaccacactcttgtgtaaaggcctgagtgctctggccgcctgctgtcccggggcagttgattttcctagcctacgcctggacctccgtgtagctcgtagcgttctgcccctgagcgtggtattcataggcatgatcacatttaataatctgtgtctgaagtacgtcggtgtggccttctataatgttgggaggagtctgacaaccgtcttcaacgtgctactgtcataccttctgctgaaacaaaccacaagcttctacgccctcctgacatgtgggataatcatctag

SEQ ID NO: 206095 - DNA, 741 bp, Artificial Sequence
  Description of Artificial Sequence: Synthetic coding sequence
atgaaccgggcccccctgaagcggagccggatcctgcacatggcccttacaggcgccagtgatccttccgccgaagccgaagcaaatggcgagaagccttttctcctaagggcgctacaaattgctcttgtcgtgagcctctattgggtcacttccatctcaatggtgttcttgaataaatatttactggatagcccatctcttcgcctggacacacctattttcgtaacattctaccagtgcctcgttaccacccttctttgcaagggactgtctgcactggcggcgtgttgtccgggcgccgtggatttccccagcctgcgtttggacctacgggttgcacgctcagtgctgccactctctgtggtatttatcgggatgattacgtttaataacctatgcctgaagtatgtcggagtggcattctacaacgtgggtcggagccttacaaccgtatttaacgtcctcctgagctacttacttcttaaacagactacaagtttctacgcgttactcacctgcggaattattatagggggcttttggctgggcgttgaccaggaaggcgcagaagggacactatcttggttgggaaccgtttttggagtgttggcttccctgtgtgtctccctcaatgcaatatatacgacaaaagttttgccggcggttgatggaagcatctggagattgaccttttacaacaacgtgaacgcctgcatcctgtttcttccactgttatag

SEQ ID NO: 206096 - DNA, 1014 bp, Artificial Sequence
  Description of Artificial Sequence: Synthetic coding sequence
atgaccgccggcggccaggccgaggccgagggcgccggcggcgagccaggagctgctcgattgccatcaagagtggcacggttgcttagcgcattattctatggcacctgctccttccttattgtgctcgtgaacaaggcgttgctgacgacatacggctttccgtcccccattttccttggcatcggtcagatggctgccactattatgatcctctatgtgagcaaactcaacaagataatccacttcccagattttgacaagaagattcccgtgaagctgtttccacttcctttgttgtatgttggaaaccacataagtggtctgagcagtacttctaaactgtcgctgcctatgtttactgttctgcggaaattcactattccactcaccctcctactggagaccattattcttgggaagcagtattcccttaatatcattctcagcgtatttgccattatactgggagctttcatcgcggccggttctgacctggccttcaacctggaagggtatatcttcgtgttcctgaacgatatctttacagctgcaaacggagtctacactaaacagaagatggaccccaaggagttaggcaaatatggcgtacttttttacaacgcatgcttcatgattatcccaacacttataatttctgtgtctactggcgacctgcagcaggccacagagttcaatcagtggaaaaatgtagtattcattctccagttcctcctctcttgttttttaggctttttgttgatgtatagcacagtgctatgctcatattataattcggccttgaccacagccgtggtcggggccattaaaaacgtgtctgtcgcttatatcgggatcctgataggtggtgactatatcttcagtctactcaatttcgtgggcctgaacatctgcatggcgggaggcctgaggtatagcttcctgaccctctcctctcaacttaagccgaagcccgtcggtgaggagaatatctgtctggacttgaagagttag

SEQ ID NO: 206097 - DNA, 492 bp, Artificial Sequence
  Description of Artificial Sequence: Synthetic coding sequence
atgaccgccggcggccaggccgaggccgagggcgccggcggcgagcctggagctgcccgattacctagcagagtcgctagactcctctctgcccttttctacggcacgtgttcattcctcatcgtgctggtcaataaagccctgctgaccacttacggctttccctcaccgattttcctcgggataggtcagatggctgccacaattatgatactctacgtgtccaagctcaataagatcatccatttcccagactttgacaaaaagattcctgtgaagctctttccactgcctctcttgtatgtgggaaatcacatctcaggcttgtcatcgacctctaagctctcactccccatgttcacagtgcttcgaaagtttacaattcctctaaccctgctgctggaaactatcatactgggtaagcagtattcgctaaacattatcttatctgtttttgctattatactgggtgcgtttatcgcagctggctag

SEQ ID NO: 206098 - DNA, 750 bp, Artificial Sequence
  Description of Artificial Sequence: Synthetic coding sequence
atgaccgccggcggccaggccgaggccgagggcgccggcggcgagcccggggccgctcggctgcctagtcgggtggccaggttactcagcgccctcttttatgggacctgcagcttcctgatagtgctcgtaaacaaagctttactgacgacttatggctttccctctcctatcttcctcggaattgggcaaatggctgcaactattatgatcctgtacgttagcaagctcaacaagattatccacttcccagatttcgataagaagatcccagttaagttatttccactgccactgctctacgtgggaaaccacattagtgggttgagctccacctccaaactgagcctgccaatgtttactgttttgagaaaattcactattccactcaccctgctgttggagaccattattctgggcaagcagtatagtctgaacataattttgagcgttttcgccattattttaggagcatttatagccgctgggtttctccttatgtactcaaccgtgttgtgcagctattacaattcagcgctgaccaccgccgtcgtaggggccatcaagaatgtctctgtggcttacattggtattttaattggtggcgactacatcttctctctgctcaacttcgtaggattaaacatatgtatggctggtggcctgaggtactcgttcctgactctgtcatcccagttgaagccgaaacccgtgggggaagagaacatttgtctggatttgaaaagttag

SEQ ID NO: 206099 - DNA, 1251 bp, Artificial Sequence
  Description of Artificial Sequence: Synthetic coding sequence
atgcggcagctgtgccggggccgggtgctgggcatcagcgtggccatcgcacatggggtgtttagtggctcactgaacattttactcaaatttctcatatcaaggtaccaattctccttccttaccctggtgcagtgcctcaccagcagcactgccgccctcagcctggagttgctgaggagactcgggctgatcgctgtcccacccttcgggctttcactggctaggtcctttgccggagtcgcggttctgtcgacccttcagagcagcctgaccctgtggtcccttcggggtctctctcttcctatgtacgtcgtgttcaagcggtgcctgcctttagttacaatgttaatcggcgtcctggtattaaaaaacggagccccttctccaggggtgctcgccgccgtgctgatcaccacatgcggcgctgcactcgccggtgctggcgatctgacaggagacccaatcggatacgtgacgggtgttctggctgtactggtccacgcggcatacctcgtcttaattcaaaaggcaagcgctgacactgaacacggacccttaaccgctcaatatgtgatcgctgtcagcgccacccctctattggtgatctgcagcttcgcttccaccgactcaattcacgcctggacttttcctggctggaaggatccagcaatggtctgcatctttgttgcctgtattcttatcgggtgcgccatgaattttactacgctgcactgcacatatataaatagcgctgtgactacatcatttgtcggagtcgtgaagtccattgccacgatcacagtcggcatggtggcgttctccgacgtggaacctacatcactcttcattgcaggcgtcgttgtgaatacattgggctctattatctattgtgttgcgaagtttatggaaacacgcaagcaatcaaattacgaggatcttgaggcccaacctagaggtgaagaagcccagttgagcggggaccaattgcctttcgtgatggaagagctgcccggcgagggtggtaatggccggtccgagggcggggaggccgctggaggccccgcccaggaaagtaggcaagaagttaggggaagcccaagaggtgtgccactggtggccggtagttctgaggagggttctcggagatcgcttaaggatgcctaccttgaggtgtggcgcttagtgcgaggaacacgatacatgaaaaaagactatctgatcgagaacgaggaattgccctctccttag

SEQ ID NO: 206100 - DNA, 1431 bp, Artificial Sequence
  Description of Artificial Sequence: Synthetic coding sequence
atgagcacccagcggctgcggaacgaggactaccacgactacagctccactgacgtgtccccagaggagtctcctagtgaaggactgaacaatttgagttcccctggcagttatcaaaggtttggacagtcaaattcaaccacttggtttcagactctgattcatctcctcaaagggaatattggaacaggtctgctgggactcccactggcagtgaagaatgccggaattgttatgggccctattagcttgctcatcattggcatcgtggcagtgcactgcatgggcatcctggtaaagtgtgcccaccacttctgtcgtcgcctcaacaagtcttttgtggattacggcgacactgtgatgtatggtttagaatctagcccctgctcctggttacgtaaccacgctcactggggccggagagttgtggacttctttctcattgtgacccagttgggtttttgctgtgtgtactttgtttttctggctgataacttcaaacaagtgatcgaggcggcaaatggtacaactaacaactgccacaacaacgaaactgtgatcttgacgccaactatggattcacggctgtacatgctatctttcctgcctttcctggttttgctggtctttattaggaacctgcgagcattgtcgatctttagcttactggccaacattaccatgctggtttccttggtgatgatctatcagtttatagtgcagcgcatccccgatccgagccaccttccattagtggctccatggaagacctatcccttgttctttgggaccgccatcttcagctttgagggaattggtatggtcctgcctttagagaataaaatgaaagaccctcgtaaatttcccctgattttgtatcttggaatggtcatagttacaattctctatatttccctgggttgcctcgggtacctccagttcggggccaacatacaagggtctatcacactgaacttacctaactgttggctttaccagtctgtcaagttgctatattccatcggcattttttttacctacgcactgcagttttacgtaccagcagagattatcatcccatttttcgtgtcaagggctccagaacattgcgagctggtggtggacctgtttgtgagaaccgtactggtgtgtctgacatgcatcttggccattctgatccccagactcgacctggttatctcccttgttggcagtgtatcttcctctgccctcgcgctcattatcccgccactgctggaggtgacaacattctactccgaaggaatgtcccccctcacgatttttaaggacgccttgatttcaattttggggtttgttggtttcgtggtaggaacatacgaggctctatatgaacttatccagccatcaaatgctccaattttcatcaacagtacttgtgccttcatatag

SEQ ID NO: 206101 - DNA, 1161 bp, Artificial Sequence
  Description of Artificial Sequence: Synthetic coding sequence
atgagcacccagcggctgcggaacgaggactaccacgactacagctccactgacgtctctcctgaagagagtccttccgagggcttaaacaatctctctagccccggcagttatcaaagattcggtcagtctaattcgactacgtggtttcagaccctaatccacctgttaaaaggcaatattggcacaggtctgctggggctcccactagccgtgaagaatgccggcatcgtgatgggcccaatttctttactgattatcggtatcgtcgcggtgcattgtatggggatcctcgtgaagtgcgcccaccacttctgcaggcgcctcaacaagtccttcgtagactacggggacacggtcatgtacggcctagagagttctccctgttcttggttaagaaaccacgctcactggggacgccgcgtcgtggatttttttctcatcgtgacgcagttggggttctgctgtgtgtactttgtgtttctggccgacaacttcaagcaagtgattgaggctgctaatgggacaacaaacaattgtcataacaatgagactgttattctcactccgaccatggactccaggttgtacatgctctcgtttctcccctttctggtgctcctggttttcatcagaaatcttcgggccttgtcaatcttctctctgctagcaaatattaccatgttggtgtcactagttatgatctaccaatttattgttcagcgaataccagatccttcccatttgcccctggtagctccatggaagacctaccccctcttcttcggcaccgccatcttctcattcgagggcattggtatggtcctcccactcgaaaataagatgaaggacccacgcaagtttccacttatcctctatctaggcatggtgatagtgactatcctatacatctccctaggatgtctgggctacctccaattcggggccaacatccaggggtctatcaccctcaatcttcccaactgctggctgtaccagagcgtgaagctgctatattcaatcggtatctttttcacttacgctttgcagttttatgtgccagccgaaataatcattcctttttttgtaagcagggcaccagagcattgtgaactggtcgttgatcttttcgtgcggacggtcctggtgtgcttaacctag

SEQ ID NO: 206102 - DNA, 213 bp, Artificial Sequence
  Description of Artificial Sequence: Synthetic coding sequence
atgagcacccagcggctgcggaacgaggactaccacgactacagcagtaccgatgtaagtcccgaagagagcccttctgaggggctaaataatctgtccagccctggcagctaccagcgcttcggtcagtccaatagcactacatggttccagaccctgattcacctgctgaaaggaaatattggtaccggactgcttgggttgccactttag

SEQ ID NO: 206103 - DNA, 219 bp, Artificial Sequence
  Description of Artificial Sequence: Synthetic coding sequence
atgagcacccagcggctgcggaacgaggactaccacgactacagcagcacagacgtcagtcccgaggaaagcccaagcgagggattgaataacctgtcgagcccagggtcttaccagagatttggccagtcaaacagcacgacctggtttcagaccctgattcacttgctcaagggaaatatcgggaccggcctcttgggtcttcccctagcagtgtag

SEQ ID NO: 206104 - DNA, 1431 bp, Artificial Sequence
  Description of Artificial Sequence: Synthetic coding sequence
atgagcacccagcggctgcggaacgaggactaccacgactacagctccaccgacgtgagcccagaagaaagtccctcagagggcctgaataatctaagcagccccggcagctatcagcggttcgggcagagcaactcaactacatggtttcaaacacttatccacttgctgaaaggcaacatcggcaccgggcttctcggattacccttagctgtcaagaatgccgggattgtgatgggcccaatttcactgcttataattggaatcgttgccgtccactgcatgggtattctggttaagtgtgcccaccacttctgccgccgactgaacaaaagctttgttgattacggcgacacagtcatgtatgggctcgagtcttccccctgtagttggctccgaaaccatgcacactggggccgaagagtcgttgattttttcctgatcgtgacgcagctggggttttgctgcgtctactttgtttttctcgctgacaactttaagcaggtcattgaagctgcgaatggaacaaccaataactgccacaacaacgagactgtaattctgaccccaaccatggatagcagactgtatatgctgtcctttctcccgttccttgtgctgctcgtcttcattagaaacctccgagcattgtcgatattcagtttgctggccaatatcactatgttggtgtcactcgtgatgatctaccagtttatcgtgcagcgtatcccggacccttcccacttgcctctggtggctccatggaagacttatcctctattcttcggaaccgcaatcttttcattcgaaggcataggaatggtcctgcccctggagaataagatgaaggatccccgaaaattccccctcattctgtacctcgggatggtgatcgtgaccatcttatatatctctctcggatgtttgggctacctccagtttggcgcaaatattcaggggtccatcacgctgaatctgccaaactgctggctctatcagtcagtgaagctcctttacagcattggaattttcttcacttacgccttgcaattttacgtgccagcggagatcatcatcccgtttttcgtatccagggcccctgagcactgcgaacttgtagtagacctgtttgtaagaacagtgctggtgtgcctaacttgtatactcgccatcttgattccacggttggatttagtgatcagccttgttggctccgtgtcatccagcgccttagccttgatcattccacctctcctagaggtcactacattttatagtgagggcatgtctccattgactatcttcaaggacgccctgatctctatccttggatttgtagggttcgtcgtcgggacttacgaagctttatacgagctaattcagccctccaacgcccctattttcattaactccacgtgcgcctttatttag

SEQ ID NO: 206105 - DNA, 1167 bp, Artificial Sequence
  Description of Artificial Sequence: Synthetic coding sequence
atgagcacccagcggctgcggaacgaggactaccacgactacagcagtactgatgtgtccccggaggagtcaccatccgaaggactgaataacctgagctcaccaggcagttaccagcgatttggccaatcgaactccaccacatggttccaaacacttattcacctgctgaagggaaacatcgggactggcctgctgggcctccctcttgcagtgaagaacgccgggatcgtgatgggtcctataagcctactcataatcggcatagtggccgtgcactgcatgggcatactggtcaaatgtgcccaccatttttgcaggcggctgaacaaatctttcgttgattatggggacacagtaatgtacggattggagtcatcgccttgcagctggctgagaaaccatgcacactgggggaggcgcgtcgtcgactttttcttgatagtgacacagctgggattctgctgtgtatattttgtgttcctggccgataacttcaagcaggtgatagaagcggccaatggtacaactaacaactgccacaataatgaaaccgtgatcttaacaccaacgatggatagtcggctgtatatgttgtcgttcctgccctttctggttttgctcgtttttataagaaacctgcgggctctctccattttctcgctgcttgctaacatcaccatgttggtcagtctggtgatgatctaccagttcatcgtgcagaggattcccgatcctagccatttaccgctggttgccccgtggaaaacataccctctgttcttcggtactgccatcttttcatttgaggggatcgggatggtattacctctggaaaataagatgaaagatcctcgcaaattccctttaattctgtatcttggaatggtcattgttacaatcctttacatctctctggggtgccttggctacttgcagtttggcgcaaacatccagggaagcattaccctgaatctcccaaattgctggctctatcagtctgtgaagctcctttattcaatcggaatctttttcacatacgctctccagttctatgtgcccgctgaaattattatccctttctttgtttcacgggcccccgaacactgcgagctcgtcgtggatttatttgtacgcactgtgctagtgtgtttaacctgcgagtag

SEQ ID NO: 206106 - DNA, 1452 bp, Artificial Sequence
  Description of Artificial Sequence: Synthetic coding sequence
atgagcgtgaccaagagcaccgagggcccccagggcgccgtggccatcaagctggacttaatgtccccccccgagtcagccaagaaactggaaaacaaagattcgacttttctcgatgagagcccttcggaatccgcagggttgaagaagaccaaaggaataactgtgtttcaagcactcatccacctggttaaggggaatatgggcaccggcattctgggactgcccctggctgtgaagaatgcaggaatattgatgggacctctttcattgttggtcatggggttcatcgcatgtcactgcatgcacattttggtgaagtgcgctcagcggttctgtaagcgcctaaataagccattcatggactatggagacactgtgatgcatgggctcgaagcgaatcctaatgcctggttacagaaccacgctcactggggcaggcatattgtctccttctttttaattattacacagttgggtttctgctgtgtgtacattgtgttcttagccgacaacctgaagcaggtggtggaagcagtcaattctacaaccaacaactgctactcgaatgaaacagttattctcaccccgactatggatagtaggctgtacatgcttagcttcctgcccttcctagtgttattagtcctaatccggaatttgcggattctaaccatttttagtatgcttgcaaatatatcaatgctggtaagcctggtgataatcattcaatacattacccaggagatccccgatccatccaggctgcctctagtggcctcctggaaaacctaccctctattcttcggcaccgctattttctccttcgaaagcattggtgttgtgcttccattagagaacaagatgaagaacgcgaggcacttccctgctattcttagcctgggtatgagcatcgtgacctccctgtatatcggtatggctgctctggggtatctgagattcggggatgacatcaaagcctccattagtttaaacctgcctaattgttggttgtatcaatccgttaaactcctgtatatagccggaatcttgtgtacctacgcccttcagttttatgttcctgccgaaattataatcccctttgcaattagccgggtgagcactagatgggcactcccccttgatttgtctattagactggtgatggtgtgtctgacttgccttctggccattttgatcccccgtctggatctggttatcagcctggtgggatctgtttccggcacggccctggctctgataattccaccgcttctggaagttaccacattttatagcgaaggtatgagcccactgaccatttttaaggacgcgctcattagcatcctggggtttgttggcttcgttgtgggaacttatcaggctctcgatgagttgcttaagtctgaagattcacacccattttctaattcaacaacctttgttcggtag

SEQ ID NO: 206107 - DNA, 624 bp, Artificial Sequence
  Description of Artificial Sequence: Synthetic coding sequence
atgaacgacaccgccgtgctgcccctggagaacaagatgaagaacgctaggcacttcccagctatactgagcctcgggatgtcaatcgtgacctccttgtacattggcatggcagccctggggtacttgcgtttcggcgatgacatcaaggccagtataagcctgaacttgccgaactgttggctgtatcagtccgtaaagcttctgtatatagctggcatcttatgcacgtacgcccttcagttctacgtgcccgccgaaattatcattccgttcgctatcagccgggtgtccactagatgggctctcccccttgacctgagtattagactggttatggtctgcctgacttgcctcctggccatcctgattcccaggctggacctcgtcatctcactggtcggaagtgtgagcggtaccgccctggccctgataatacctccactgctggaggtgactaccttttactccgaagggatgagcccccttaccattttcaaggacgccctgattagcattcttggttttgtcgggtttgttgtcggaacataccaggctctagatgagctgcttaagtcagaggactcccatcctttcagcaacagcacaacgtttgtccgatag

SEQ ID NO: 206108 - DNA, 1413 bp, Artificial Sequence
  Description of Artificial Sequence: Synthetic coding sequence
atgagcctgctgggccgggactacaacagcgagctgaacagcctggataacggtccccaaagcccctccgaaagctccagctccataaccagcgaaaacgttcatcctgccggagaggctgggctatccatgatgcagacactgatccatctgctaaaatgtaatataggaacgggcctgctggggctccctctggcgataaagaatgcgggactcctggttggtccagtgtctctgcttgctataggcgtgctcaccgtgcactgcatggtgattcttctgaactgtgctcaacacttatcacagcgcctccagaagactttcgtgaattatggggaggccaccatgtacggactggagacttgccctaatacatggctgcgcgcgcatgcagtttggggccgatataccgtttcatttcttttagtgatcacacagctcggcttctgcagcgtgtacttcatgtttatggccgataatctgcagcagatggtggaaaaagcccacgtcacttctaatatctgtcagccccgcgagattctaacgctgacacccattcttgatatcagattttacatgttgattattctgccatttcttatcctcctggtattcattcagaatttaaaggtactgtcagtgttctctaccctcgccaatattaccaccctcggatccatggctctgatcttcgaatacatcatggagggcatcccctatccttcaaatctgccgttgatggccaattggaagacatttcttctgttctttggcaccgcaatctttacgtttgagggggtgggcatggtgctgccactaaagaaccaaatgaagcatccacagcagttctcattcgtactttatctcggcatgtccatagtcattatcttatatattctgctgggcactctcggctatatgaagttcggttctgacacacaagcgtctataactttgaacctgcccaactgttggctctatcagagtgtgaagcttatgtatagtataggcattttttttacctacgcccttcagttccacgtaccggctgagattatcatcccattcgccattagtcaggtgtccgaatcttgggcactatttgtcgatctgagtgtcaggtctgccctggtttgtcttacgtgcgtgtctgcaattctcatcccgcggttggacctcgtgatctcactggttggaagtgtgtcttcgtccgcattggccttaattatccccgccctacttgaaatcgtaatcttttacagcgaagacatgtcttgtgtcacaattgctaaggatatcatgataagcattgtgggcttactcggctgcatctttggtacctaccaggcactgtatgaattgccccagcccatctctcactcaatggctaatagcactggcgtccatgcttag

SEQ ID NO: 206109 - DNA, 1536 bp, Artificial Sequence
  Description of Artificial Sequence: Synthetic coding sequence
atgagcctgctgggccgggactacaacagcgagctgaacagcctggacaacggaccacaaagcccatcagagagctcaagttctataacttctgaaaatgtgcatccagccggagaggccgggctatcgatgatgcaaaccctgatacatttgcttaagtgtaacatcggtaccggcctgctgggcttgcctttagccatcaagaatgccggtttgctggtgggaccagtgagcttgctggcgatcggggttctcactgtccactgcatggttattctgctgaattgtgcccagcacttgtcccaacgcctgcagaaaaccttcgtgaactatggtgaggccactatgtatggacttgaaacctgcccgaatacctggctcagagcccatgctgtttggggtaggtggaatttagccctttcacccaggctggaatgttcgggcaagatctccgcccactgtaatcctcatctgcaaggctccagtaactctcccgcacaggctagtcgtgtggccggcatctataggtacactgtgtcttttctgttagtgattacccagttaggtttttgctccgtgtacttcatgttcatggcagacaatttacaacaaatggtggaaaaagcccacgtgacaagtaacatctgccagcctagggaaatattgacccttactccgattttggatatcaggttctatatgctgatcattctgccttttttgattttgctggtattcattcagaacctcaaggtgctgtccgtcttcagcacgctggctaacatcacaacactcggatccatggcgctcatattcgaatatattatggagggaattccctacccgagcaacctgcccctcatggccaactggaagacttttctcctgttcttcggtaccgccatctttaccttcgagggagtgggtatggtcctccccctcaagaatcagatgaaacacccgcagcagttctcctttgtgctgtatttgggtatgagtattgtgattatcctctatatcctgttagggactctcgggtatatgaagtttgggagcgacacgcaggcgtccataaccctgaatctcccaaactgttggttgtatcagtctgttaagctgatgtatagtatcgggatcttctttacttatgctctgcagtttcacgtgcctgcagaaatcattatcccatttgcaatctcccaggtttccgagagttgggccctgttcgttgacctttctgtcagatcagcactggtttgtctgacttgcgtatcagctatactaatcccccggttggatttggtaatctccctggtaggatctgtgtccagtagcgctttggccttgataatcccggccctgctggaaattgtgattttttacagtgaagacatgtcctgcgtgactatcgcaaaggatatcatgatatcaatcgttggcttactgggctgcatttttggaacctaccaggccctgtacgaactgccacaaccaatatcccacagtatggctaactcaaccggcgtgcacgcatag

SEQ ID NO: 206110 - DNA, 1515 bp, Artificial Sequence
  Description of Artificial Sequence: Synthetic coding sequence
atggaggccgccgccacccccgccgccgccggcgccgcccggcgggaggagctggatatggatgtgatgcgccccctgatcaatgagcagaacttcgacggcacctcggacgaggaacacgagcaagaattgctgcccgtccagaagcactatcagctcgacgaccaagagggcatctcttttgtacagacacttatgcacctcctcaagggaaatataggcactggcctgctggggcttcctctcgccataaagaatgctgggatcgtgctgggccctatcagcctcgtgtttataggaatcattagtgtgcactgtatgcacattctggtgcgctgctcccactttttgtgcctgcgtttcaagaagtcaactctggggtatagtgacaccgtgagttttgcgatggaagttagcccctggagctgtttgcagaaacaagcagcatggggtcggtctgtcgtggacttcttccttgtgataacccaacttggtttctgctccgtttatatagtgtttttagccgaaaacgtcaagcaggtgcacgaggggttcctggagagcaaagtatttatctcaaatagcacaaactctagcaacccctgcgaaaggcgaagcgtcgacttgcgcatctacatgctgtgtttcctgcctttcattatcctcctggtctttatccgggaactcaagaacctgttcgtattgagtttcctggctaatgttagtatggctgtgagcttggtaatcatctaccagtacgtagttcggaatatgcctgatcctcataacttgcccattgtcgcgggatggaagaagtacccactgtttttcgggacggcagtcttcgcctttgaggggatcggcgtcgtgctgccactcgagaaccaaatgaaggagtccaagcgtttcccccaggccctgaacatcggcatgggaatcgtgaccaccctctatgtcacactcgccaccctgggctacatgtgctttcacgatgagatcaagggatctatcactcttaatctgccccaggatgtgtggctttaccaatccgtcaagatcctgtactcctttggaatcttcgtgacatactccattcagttctatgtgccagcggagattattatacctggtataaccagtaagtttcataccaaatggaagcagatctgtgaatttggtattagatctttccttgtgtcgataacatgcgctggggcgattcttattcccaggctagatatcgttatctcatttgttggtgctgtgagcagtagtactctggcactgatcctgcctccgctcgtcgaaatcctgacgtttagcaaggaacattataacatctggatggtgctgaagaacatctctatcgcttttacaggggtggtcgggtttctgcttgggacttacataactgtggaggaaatcatataccccacacctaaggtagttgccggtacacctcaatccccttttctgaacctaaacagcacttgcctgacctcagggctgaaatag

SEQ ID NO: 206111 - DNA, 1602 bp, Artificial Sequence
  Description of Artificial Sequence: Synthetic coding sequence
atggcccggctgcccgccggcatccggttcatcatcagcttcagccgggatcagtggtaccgggcatttatctttatcctcacctttctcttgtatgcctcattccacctatccaggaagccaatatcaatcgtcaaaggggaactgcacaaatactgcacagcatgggatgaggccgatgtgcgtttctcttcccaaaacaggaagagtggctctgccgctccgcatcagctgcccgacaacgagacagactgtgggtgggcgccctttgacaagaataactatcagcagttattgggagccctggactactcgtttctgtgcgcctacgcggttgggatgtatttgtctggaattatcggtgagcgcctgccaatccggtattacctgacctttggtatgttagcctctggggccttcaccgcactgttcggactgggatacttctacaatatccattcctttgggttctacgtggtaactcaggtgatcaatgggctcgtgcaaacaacaggctggccttccgtggtgacttgccttggtaattggttcggaaaggggcgaagaggcctgatcatgggtgtgtggaatagtcacacatcagtgggcaacatcttaggatcacttatagccggatactgggtgtcaacctgctggggactcagctttgttgtccctggtgccatcgttgcagcaatgggcattgtatgtttcctgtttcttatagaacaccccaacgacgttcgatgctcttcgacgctggtcacccactctaagggctacgagaacgggacaaatcgactgcgcctgcagaaacagatccttaaatccgaaaagaacaaacctctggatccagagatgcagtgtttgctgcttagcgatggtaaggggagtatacacccaaaccacgtcgtcatcttgccaggggacggtggatccgggaccgctgcaatcagttttacaggcgccctcaagatccccggagttatcgaattcagtctgtgtctactctttgctaagcttgttagttacaccttcctgttttggttgcctttgtatatcaccaatgtggaccacctggacgctaagaaagcaggtgagctgtctacactcttcgatgtgggcggaatattcggcggtattctggccggcgtgataagcgatagactcgaaaaaagagcaagcacctgcggactgatgttacttctggctgccccaactttatatatattttctacagtgtccaagatggggctagaggcgacaatagcgatgttgttattgtccggggccctagtgtcgggcccctacactctgatcacgaccgccgtttccgctgatcttggcacacataagtctctcaaggggaatgctcacgctctgtccaccgtcaccgctatcatcgatggaacagggagcgtgggagctgccctggggcctctcctcgccgggttgctgtcaccatcaggatggtctaatgtcttctatatgctgatgttcgcggatgcttgtgcactgttgttcttgataaggttgatacataaggagctgtcctgtccagggagcgcaacaggagaccaggtgcccttcaaagaacagtag

SEQ ID NO: 206112 - DNA, 1602 bp, Artificial Sequence
  Description of Artificial Sequence: Synthetic coding sequence
atggcccggctgcccgccggcatccggttcatcatcagcttcagcagggaccagtggtatcgggctttcatctttatcctgaccttcctgctctatgctagctttcacctcagccgcaagcctatatcaatcgtgaaaggggaactccacaagtattgtactgcttgggacgaggccgatgtgagattttcatcccaaaatagaaagagcggatctgctgccccacaccagctgccagacaatgagacagactgtggctgggctcccttcgataagaacaactatcaacagctgctcggcgctctggactatagtttcttgtgcgcctatgcagtgggaatgtacctgagcggaatcattggtgagaggcttcctatacgatattatctgacttttggcatgctcgcttccggtgcgtttaccgccctgttcgggcttggttatttctacaacattcacagcttcggattctacgtggttacacaggtcattaatggtcttgtgcaaactaccggctggccatcggtcgtcacctgtctgggcaactggtttgggaagggtaggagaggtttaatcatgggtgtctggaatagtcatacaagcgttgggaatatactgggtagcttaattgctgggtactgggtcagtacctgctggggattaagctttgtagttccaggcgccatcgttgcggctatgggcatcgtgtgcttcctttttctgatcgaacaccccaatgacgtgagatgttcaagtactctggtgacccactctaagggctacgagaatggaaccaatcggctcagactccagaaacaaattttaaagtcagagaagaacaagcctctcgaccctgagatgcaatgtctactgttgtcagacggaaagggatccatacatccaaaccacgtggtcattcttcctggcgacggcggaagtggaacagccgctatctccttcaccggcgcactgaagatcccaggtgtgatagagttctctctgtgcctccttttcgcgaaacttgtttcctacaccttcctgttttggcttcccctctacatcacaaacgtggaccatctggacgccaaaaaggcaggcgagctttcaacactgttcgacgtgggcggtatcttcggaggcatcttagccggggtaatcagtgaccgcttagaaaagcgcgcttcgacttgcgggctgatgctgctgctggccgcacctacattatatattttttctaccgtgtccaagatgggtctggaggctactatagctatgcttctgctatctggagcgttagtctccggaccctacactctgattaccaccgctgtaagtgctgatttgggcactcataaatcccttaaggggaacgcgcacgccctgtctacagtgacagccattatcgacgggacaggctcagtcggagctgcgttgggccctctgctggccggtctgttgagcccgtcagggtggtctaatgtgttctacatgctgatgttcgcagatgcctgcgcgttactattcctgatccggctaatacacaaagaactgtcttgccctggctccgctaccggggaccaggtcccattcaaggaacaatag

SEQ ID NO: 206113 - DNA, 57 bp, Artificial Sequence
  Description of Artificial Sequence: Synthetic coding sequence
atggcccggctgcccgccggcatccggttcatcatcagcttcagccgggaccagtag

SEQ ID NO: 206114 - DNA, 57 bp, Artificial Sequence
  Description of Artificial Sequence: Synthetic coding sequence
atggcccggctgcccgccggcatccggttcatcatcagcttcagcagggatcagtag

SEQ ID NO: 206115 - DNA, 1464 bp, Artificial Sequence
  Description of Artificial Sequence: Synthetic coding sequence
atgatgcacttcaagagcggcctggagctgaccgagctgcagaacatgaccgtgccggaggatgataatatctcgaatgatagcaacgacttcaccgaagtagagaatggccaaattaacagtaaatttatttctgatagagaatcccggcgttccctgaccaactctcacctggaaaaaaagaaatgtgacgagtatatccctggtaccacgagcttaggaatgtcagtgttcaacctttccaacgcaattatggggtccgggatactgggtctggccttcgccctggctaacaccggaatcttgctgttcctcgtcctgctgacctcagtcacattacttagcatttattcaatcaacttattactgatttgctccaaagaaaccgggtgtatggtgtacgaaaagttgggggaacaggtttttgggacaacgggtaaattcgtgatatttggcgccaccagtctgcaaaacaccggggcgatgctgagctacctgtttatcgtgaaaaacgagctgccctccgcaatcaagttcctgatgggcaaggaggagacctttagcgcatggtacgtggatggacgagtgctcgtcgtgatcgtaacattcggcatcatcctgcccttgtgtctgctaaaaaatctcggctatttgggatatacctccggattctctctgagctgcatggtatttttcctgatagtcgtgatctacaagaagtttcagatcccatgtatagtaccagagctaaatagtacaatctctgccaattctacaaatgctgatacttgcacgcctaagtacgtgactttcaacagtaagacagtgtacgcactgccgacaattgcattcgccttcgtatgtcacccctcggtacttccaatttactcagaactgaaggaccggagtcagaagaagatgcagatggtgtcgaacatctcattttttgccatgttcgtgatgtattttctgacagcaatattcggatatcttaccttttatgataacgtacagtcagatctcttgcataaatatcagtcaaaggatgatattctgattcttactgtgcgcctggccgtaatcgtcgccgtaatcttaacagtgcccgttctgttctttactgtcaggtccagtctgtttgagctagccaaaaagaccaaatttaatctgtgcaggcataccgtggtgacgtgcattctcttggtggtgatcaatcttctggtaatcttcataccttctatgaaagacatcttcggagttgtgggggtgacgtccgcgaacatgctgatcttcatcttaccttcctcattatacttaaaaataacggaccaggacggagacaaaggcacacagcgaatctgggcagccctatttttggggctaggcgttctgttcagcctggtgtcaattccactggtgatatacgactgggcctgcagctcaagttctgacgaaggacactag

SEQ ID NO: 206116 - DNA, 1464 bp, Artificial Sequence
  Description of Artificial Sequence: Synthetic coding sequence
atgatgcacttcaagagcggcctggagctgaccgagctgcagaacatgactgtgcccgaggacgataatatatctaacgacagcaacgattttacagaagttgaaaatggacagataaacagtaaattcatctcggaccgggaatccaggcggtccctgactaatagccatcttgaaaaaaagaagtgcgacgagtatatccctggaactacctctctaggaatgagtgtgttcaatctatcgaacgcaattatgggcagtgggatccttggactggcctttgccctggctaacactggaattctcctctttttggtgctgctgactagcgtcaccttgctgtccatatactcaatcaatttacttctcatttgcagcaaagagaccggctgtatggtgtacgagaagttaggcgagcaggtctttgggaccacaggcaaattcgtgatatttggcgctaccagcttgcagaacaccggcgctatgctcagttacttattcatcgttaagaacgagctcccctctgccattaaatttttaatgggtaaggaggagacttttagtgcttggtacgtcgatggcagagtgctcgtcgttattgttacattcggcataatcctgccgctttgtctgctgaaaaacctcggctatctcggctacacctccggttttagcttgtcctgtatggtgtttttcctgatcgtggtaatatacaaaaaattccagatcccttgcattgtgcccgagctgaactcaactatcagcgctaattccacaaacgccgatacttgcacgcccaaatatgtaacgttcaattccaaaactgtttacgcgttgcctaccatcgcttttgctttcgtttgccatccgtctgtgttgccaatatatagcgagctgaaggaccgttcccaaaagaaaatgcagatggtgtctaatatttcattttttgctatgttcgtaatgtacttcttaaccgccatcttcggatatctaactttctatgacaacgtgcaaagtgacctgctgcataagtatcagtctaaagacgatatcctgattctgaccgtaagactggctgtgatagtggccgtcatactgacagtccctgtactattttttactgtgcgcagctccttatttgagctggcaaagaaaacaaagtttaatttgtgtcgtcacacagtggtgacatgcatcctcctggtcgtaataaatctgctcgtgatcttcattccctctatgaaggacattttcggggtcgtgggagttacgtccgctaatatgttgatcttcatcctccccagtagcttatacctcaaaataaccgaccaagacggggataagggcacacagcgcatatgggccgcgctgttcctggggctcggggtcctctttagccttgtgagcataccattagtgatctacgactgggcttgtagttcatctagcgatgaaggtcattag

SEQ ID NO: 206117 - DNA, 1464 bp, Artificial Sequence
  Description of Artificial Sequence: Synthetic coding sequence
atgatgcacttcaagagcggcctggagctgaccgagctgcagaacatgactgtgcctgaggacgataatatctccaacgattcgaacgactttactgaagtggagaatgggcaaattaattcaaaatttatctccgacagagagtccagaaggtctctcacaaactcacacttagaaaaaaaaaagtgcgatgaatacattcccgggacgacatccttaggaatgagtgtgttcaacctgtcgaatgccattatggggtctggaatcctggggttagcgttcgccctggccaacactggaattctcctcttcctcgtgctcctgactagtgtgacgttgctctctatctactccatcaatttactgctgatctgctcaaaagagacaggttgcatggtctatgaaaaactcggtgagcaagtgtttggaaccacaggcaagtttgtgatttttggtgcaacttccctgcaaaacacaggggcaatgctcagctatctgtttatagtgaagaacgagcttccaagcgcaatcaagttcctcatgggaaaagaagaaaccttttctgcctggtacgtcgatgggagagtgctcgtagttattgttacctttggcataatccttccactgtgtctgctcaagaatctggggtacctaggttacacctcaggcttcagtctctcatgcatggtgttttttttgattgttgtcatctataaaaagttccaaatcccctgtattgtgcccgaactcaacagcaccatttccgccaacagcactaacgcagacacttgtactcctaagtatgtcacatttaattccaagaccgtctacgccctccctaccatagccttcgccttcgtgtgtcatccgtctgttcttcctatatattccgaattaaaagaccgctcacagaagaaaatgcaaatggtgtctaacatcagctttttcgcgatgttcgttatgtattttcttactgctattttcgggtacctgactttctatgataacgtgcagagcgatttgctgcataagtaccagagcaaggacgacatcttgatcctgacggtgaggctggctgtaattgtggccgtgattctgactgtgccagtcctgttcttcactgtgagatcctcactcttcgagctggcaaaaaaaaccaagttcaatctgtgtcggcatacagtggtgacctgcatactgctcgtggtgataaacctgctggttattttcatcccctccatgaaggacatattcggagtggtgggagtgacaagcgccaatatgctcatatttatcctgccgtcatccctatatttgaaaattacagaccaagatggtgataagggcactcagaggatttgggccgctctcttcctcggactgggcgtgctcttctccctggtgagcattcccctcgtaatatacgactgggcctgttcctcttcatccgatgagggccattag

SEQ ID NO: 206118 - DNA, 1464 bp, Artificial Sequence
  Description of Artificial Sequence: Synthetic coding sequence
atgatgcacttcaagagcggcctggagctgaccgagctgcagaacatgaccgtgccagaagacgacaacatctcaaacgattcgaacgactttactgaggtggaaaatgggcagataaactcaaaattcatttcggaccgggagtctcgacggtcattgacgaactcacacctcgagaaaaagaagtgtgatgaatacattccaggcaccacatcactgggcatgagcgttttcaatttatccaacgcaatcatgggctctggtatactcggactggcattcgccctggctaatacaggaattctgctctttctcgtgttgctcaccagcgtgacactgctatccatctactctattaatctgctcctgatatgcagcaaagagacaggatgtatggtttacgagaagctgggtgagcaggtgtttgggaccactggaaaatttgtgatcttcggggcaacgtccttgcagaatactggagctatgctgtcctatctgtttatagtaaagaacgagcttcccagcgctataaagttccttatgggcaaggaggagaccttcagcgcgtggtacgtcgacggcagagtcctggtcgtaatagtcacctttggcattatcctgcccctgtgcctattgaagaacctcggctatctgggttatacgagcggcttttccctgagttgtatggtgtttttcctcatcgttgtcatctataagaagtttcagataccgtgcatcgttccagagctgaacagcacgatcagcgccaactccacgaacgcagatacctgcaccccgaagtacgtcactttcaattctaagactgtctacgctttaccaacaatagcttttgcattcgtctgtcacccatcagtgctgccaatatactctgagttgaaggatcggtcacaaaagaaaatgcagatggtgagtaatatcagcttcttcgcaatgttcgtaatgtacttcctgaccgccatttttgggtatctcaccttttacgataacgtgcagtcagacctgctgcacaagtatcagagtaaggacgatatcctaattctcaccgtgcgcctcgccgtcatcgtggccgtaattctgactgtaccagtgctattttttaccgtgcgaagctccttgtttgaacttgccaagaagacgaaattcaatctgtgccgccacaccgtcgtgacatgcattttattagtggtcatcaatctgcttgtcatttttatcccatccatgaaggatatctttggcgtggttggagtgacctctgctaatatgctgatttttatactgcccagcagtctgtacctgaaaatcaccgatcaggatggtgacaagggcacacagcgtatctgggctgcgctctttctcgggctgggagtcctgtttagccttgtctccattcccctggtaatttatgactgggcatgtagttcgtccagtgatgaaggtcactag

SEQ ID NO: 206119 - DNA, 1521 bp, Artificial Sequence
  Description of Artificial Sequence: Synthetic coding sequence
atgaagaaggccgagatgggccggttcagcatcagccccgacgaggactcctcaagctactcctcgaactcagactttaattatagctacccaaccaaacaggccgcgctcaagtctcactacgctgacgttgaccctgagaatcagaatttcttactggagtcaaatctcggaaagaagaaatacgaaaccgaattccaccctggtaccacctcttttggaatgtccgttttcaatctgtcaaacgccatcgtgggtagcggcatcctcgggttgtcctatgctatggccaacaccggcatcgctctgtttatcattcttctcaccttcgtctctatcttcagcctctactccgtgcacttgctgctcaagaccgctaatgagggtggcagtctcttgtacgagcaactcggctacaaagccttcggcctggtggggaagctggcggcatccggcagcatcactatgcagaatatcggcgcaatgtcttcttacctttttatagttaaatatgagttgccccttgtgatccaggcactcactaatatcgaagacaagacagggctctggtacctgaacggcaactatctggttttactagtgagcctggtggtaattctgccactgtcactgttcaggaatttgggatatctcggctacactagcgggttgagcctgctctgtatggtctttttcctgatcgtagtaatctgcaagaagtttcaagtgccctgccccgtcgaagctgccttgataatcaatgagaccattaatacgacactgacacagcctacagcgctcgtgcccgccttatctcacaacgtgacggaaaacgattcctgtcgcccccactacttcatcttcaacagtcagacagtgtatgcggtgcccatacttatcttttccttcgtctgtcaccctgccgtcctgcccatttacgaggagctcaaagacagatctcgtagacgtatgatgaacgtgagtaagataagctttttcgccatgtttctcatgtatttacttgccgccttgttcggttatcttacattctatgagcatgtggaaagcgaactgttgcacacgtactcaagcattctcgggactgacatcctgctgcttatagtgcggctggctgtgcttatggccgtaaccctgacagtgcccgttgtcatttttcccataagaagttctgtgacgcatctgttatgtgcctctaaggattttagctggtggagacactctttgattaccgtgagtattcttgcctttactaacctcttggtaatctttgtgccaacgattcgagatatatttggtttcatcggcgctagtgccgcctctatgctgatctttattcttcctagcgccttctatatcaaattagtaaaaaaggagcccatgaaaagcgtccaaaaaattggcgcccttttctttcttctctccggagttctcgtgatgaccgggagcatggcactgatcgtgctggactgggtacacaacgcccccggcggcggccattag

SEQ ID NO: 206120 - DNA, 1644 bp, Artificial Sequence
  Description of Artificial Sequence: Synthetic coding sequence
atggaccccatggagctgcggaacgtgaacatcgagcccgacgacgagagcagctcaggagaatccgctcccgattcttacattggcatcgggaattccgaaaaagcagcgatgagttctcaatttgcaaatgaagacaccgagtcccagaagtttttaaccaacggttttctggggaagaaaaagctggctgactatgctgacgaacaccatcccgggacgacatcctttggcatgtcatccttcaacctcagtaatgccatcatggggtcagggattctcggcctgtcctatgccatggctaacaccggtatcatcctcttcatcattatgctactggctgtcgccatactcagcctgtatagcgtgcacctgctgctgaaaacagcaaaggaaggcgggtcgctgatttatgagaagctgggggaaaaagccttcggatggccgggaaagattggcgccttcgtaagtattacaatgcagaacataggcgccatgagttcttaccttttcattataaagtacgagctccccgaggtcatcagggcttttatgggacttgaggagaatactggcgaatggtaccttaatggcaattacttaatcatcttcgtctctgtgggcatcatcttgcccctgtcactgctgaagaatctcggatacctggggtacactagcggctttagcctgacatgtatggtgtttttcgtgtcagtcgtgatatacaaaaagtttcagattccgtgcccactgcccgtcctcgatcattccgtaggcaacctgtcattcaataatacactacccatgcacgtggtaatgctccctaacaactcagagtcctctgacgtgaattttatgatggactacacacatcggaatcctgctggtctggacgaaaaccaggccaaagggagcttacatgactctggcgtagagtacgaggcccactccgatgacaaatgcgagcctaagtatttcgttttcaacagcagaacggcctatgcgattccgattctagtgtttgctttcgtctgtcaccccgaggtcttgcctatatacagcgaactaaaagaccggtcacgccggaagatgcagacggtgagcaacatctctattaccggcatgctcgtgatgtatctgttggccgccctttttggctacctgacattttatggtgaagtggaagatgaacttctacatgcttactccaaagtgtacacactggacatccccctactgatggtgcgtctggcggtcctagtagccgtgaccctgacagtgcctattgtgctgttcccaatccggacttccgtgatcacgctgctgttcccgaaacgccccttctcgtggatacgacattttctgattgcagccgttctgatcgcgctcaacaacgttctggtgattctggtgccaactattaaatatatatttggatttattggggcctcatcagccacaatgttgatctttattctccccgctgtgttttacttgaagctggtgaagaaagagaccttccgaagcccccagaaagttggggctttgattttcctggtcgtgggcatcttttttatgattggctctatggctctcatcattattgattggatatatgacccgcctaacagtaagcatcactag

SEQ ID NO: 206121 - DNA, 780 bp, Artificial Sequence
  Description of Artificial Sequence: Synthetic coding sequence
atggaccccatggagctgcggaacgtgaacatcgagcccgacgacgagtccagtagtggagagtccgcccctgattcatacattggaatcggaaatagtgagaaggctgcaatgtcttcccaatttgccaacgaagacaccgaaagtcagaagtttctgaccaacgggttcctcggcaagaaaaaactcgctgactacgccgacgagcatcatcctggaactactagcttcggcatgagcagttttaacctctccaacgccatcatggggtccgggattctgggcttgagctatgctatggcaaacacaggaatcatcctgttcattatcatgttgttagctgtagccatcctctccctctactcggttcatctcctgcttaagacagcgaaagagggaggctctttgatctatgagaagctcggcgagaaggcatttggctggcctgggaaaatcggcgcattcgtatccattactatgcagaacattggggcaatgtcctcttacctctttataatcaagtacgagctgcctgaggtgatccgggcctttatgggcttagaggagaataccggcgagtggtatctcaacggcaactacctgatcattttcgtgagtgtcggcatcatcttgccactgagcctcctgaaaaatctgggctatctgggctataccagcgggtttagcctgacttgcatggtcttttttgtttctgtcatgatttataagaagatcagcttctttctacaaatctttatcattctgaagctcttcttctag

SEQ ID NO: 206122 - DNA, 1644 bp, Artificial Sequence
  Description of Artificial Sequence: Synthetic coding sequence
atggaccccatggagctgcggaacgtgaacatcgagcccgacgacgaatcctcttcaggggagtccgcaccagattcctacattggcattggcaactccgagaaggccgcaatgagctcccaattcgctaacgaggataccgagtcacagaagtttctgactaatggctttttggggaagaaaaagttagctgactatgcagacgaacaccacccgggcactacctcttttggcatgtcctcgtttaatttgagcaatgcaatcatgggatccggcatcctgggtctctcttacgctatggccaatactggcatcatcctgttcatcattatgctccttgcagtcgctatcctcagcctctactccgtacatcttctcctcaaaactgcaaaggaaggaggaagtcttatatacgagaaattgggcgaaaaagcattcggttggcctggaaagataggtgcctttgtttcaatcacaatgcagaacatcggtgctatgtcatcttatctgtttataatcaaatacgagctgcctgaagtcatcagggctttcatgggattagaggagaataccggtgagtggtatcttaacggaaactatctcatcattttcgtgtctgtgggaattatcctgcctctatcactgctcaaaaacttaggctacctgggttatacttccggattttcacttacctgcatggttttctttgttagcgtagtcatatataagaagttccagataccttgccccttgccagtcctggaccattccgtaggtaatctctcattcaataacacactcccgatgcatgtcgtcatgctcccaaataacagcgaaagctcagacgtgaacttcatgatggattacactcacaggaaccccgccgggctcgatgagaaccaggcaaagggaagtcttcacgattccggcgttgaatatgaggctcacagcgacgacaagtgtgaacctaaatactttgtgtttaacagccggactgcctacgctatccccatcctggtattcgcctttgtgtgtcacccggaagtgctacctatctatagcgaactgaaggatagatcaagacggaaaatgcagacagtctccaatatttccataactgggatgttagtgatgtatcttctggcagccctgtttgggtacttaaccttctatggagaagtagaagatgagctgctgcacgcctattcgaaagtgtatactttggatataccgctgcttatggtaagactcgccgtgctggttgctgttacactcacagttcccatagtccttttccctatccgcacctcagtgataactctgctgttcccaaagcgaccgttcagctggatccgacatttcttgattgctgctgtcctgatcgcgctgaacaatgtgctcgtgatcttggttccaactatcaaatatatttttggctttattggtgcttcatcagctaccatgctcatcttcatcttacccgccgtgttttatttaaaactggttaaaaaagagacctttcggtcacctcagaaggtcggggctctcatcttccttgtcgttggaatattctttatgatcggatccatggccctcatcattatcgattggatttacgatccgcccaattccaaacatcactag

SEQ ID NO: 206123 - DNA, 579 bp, Artificial Sequence
  Description of Artificial Sequence: Synthetic coding sequence
atggaccccatggagctgcggaacgtgaacatcgagcccgacgacgagtcttcatcaggggaaagcgcacctgacagctatatcggtatcgggaacagcgagaaagccgctatgtcaagtcagttcgctaacgaagataccgagagtcaaaaatttctcaccaacggcttccttggaaagaagaaactagcggactatgccgacgagcatcatccaggaacaaccagcttcggaatgtcctcattcaatctgtcaaatgcgataatgggttctgggatactgggactgagctacgcgatggccaataccgggataatactgtttataatcatgctgctcgcggtcgccatcctaagcttatactccgttcatcttctgcttaaaacggcaaaagagggaggctcactcatctatgagaaactaggagaaaaggcctttggctggcctggaaagatcggggcctttgtctctattacaatgcaaaatattggggcaatgagttcttatctattcataatcaagtacgaactgcccgaagttatcagagcattcatgggcctcgaagagaacactggctag

SEQ ID NO: 206124 - DNA, 660 bp, Artificial Sequence
  Description of Artificial Sequence: Synthetic coding sequence
atggaccccatggagctgcggaacgtgaacatcgagcccgacgacgagtcctcatccggtgagtcagccccagattcttatataggcattggcaatagtgagaaagcagccatgtctagtcagttcgcaaacgaagacacagagagtcagaagttcctcactaacggcttcctaggcaagaagaagctggctgattacgctgacgaacatcaccccggaactactagtttcggcatgtcatccttcaatctgtcaaacgcaattatgggcagtgggatactgggcctttcctacgccatggcaaatacagggataattctcttcataattatgctactggctgtagccattctgagtctatatagcgtccacctcttgctgaaaactgctaaggagggcggctctttgatctacgaaaaactgggagagaaagcatttggctggcctggaaagattggcgcatttgtgagcattacgatgcagaacattggcgctatgtcctcatatctgtttatcataaagtacgaactgccagaagttattcgtgccttcatgggcttggaagagaacacgggtgaatggtatctaaatggcaattatctaatcattttcgtctcagtgggcatcatactgcctctgagtttgctgaagaatctgtag

SEQ ID NO: 206125 - DNA, 1419 bp, Artificial Sequence
  Description of Artificial Sequence: Synthetic coding sequence
atggagctgcaggaccccaagatgaacggcgccctgcccagcgacgctgtaggatacaggcaggagagggaggggttcctgccatctcgaggccctgcccctggttccaagccagtacagttcatggattttgaggggaaaacctcttttgggatgtcagtgttcaacttaagtaacgccatcatgggctccggcattctggggcttgcttacgctatggcccacacgggtgtgatcttctttcttgctctgctgctctgcattgccctcttgagtagctattccatccacctgctcctgacatgtgccggcatcgctggtatccgcgcatacgagcagctcgggcagagggcctttggacccgcgggaaaagtagtggtggcaacggtgatctgtctccacaacgtcggggcaatgtcctcctacctcttcattatcaagagcgagctgcccctggtgattgggacgtttctatacatggatccagaaggggactggttcctgaagggcaatttgctaatcattatcgtaagtgtcctgattatactcccactggctttaatgaaacacctgggatacctcggatatacaagcggtctgagccttacctgcatgctcttcttcctggtatccgtcatctacaagaagttccagctgggctgtgcaataggacacaacgagacagccatggagagcgaggcattggtgggcctgccctctcagggcctgaacagctcatgcgaagctcagatgttcactgtggattcccagatgagttatacagtgcccattatggcctttgccttcgtgtgtcaccctgaagtccttccaatatacacggagctctgtagacccagcaagagacgtatgcaggctgtggccaacgtctcaataggcgctatgttttgtatgtacggacttacggcaacctttggatacctgacgttctattcctcagtgaaagccgaaatgctgcacatgtacagccagaaggatcctcttatcctttgcgtccgactagcagtactccttgctgtgacattaaccgtcccagtggtacttttccccatcagaagagccctccagcagctactgttcccggggaaagccttttcttggcctcggcacgtggcgattgcactgattcttctggtactagtgaatgtcttagtgatctgcgtcccgacaatacgcgatatctttggggtgattggtagcacatccgcaccctctctcatcttcatcttacctagcatcttctatctcagaatagtgcctagcgaagtcgagccgttcctctcgtggcccaaaatccaggccctgtgtttcggcgttctgggagtactttttatggctgttagcctaggcttcatgttcgcaaattgggcgaccgggcagtcccgcatgagcggccactag

SEQ ID NO: 206126 - DNA, 1266 bp, Artificial Sequence
  Description of Artificial Sequence: Synthetic coding sequence
atgagcgtgttcaacctgagcaacgccatcatgggcagcggcatcctcggattggcctacgccatggcacatacaggcgtcatttttttccttgccctgttgctgtgcatcgccctactctcctcctatagtatccacctgctgttgacctgtgccggcattgccggtatccgggcctacgaacagctgggccagagggcctttggccccgccggcaaggtggtcgttgctacagtcatttgcctccataatgttggggcgatgagcagctatctctttatcattaagtccgagcttcccctcgtgattggcaccttcttgtatatggatcccgagggggattggtttctgaaagggaacctgctaatcatcatcgtctctgtgctgattattctgcccctagctttaatgaagcacctgggctatcttggctacacatcgggacttagcttgacgtgtatgttattcttccttgtgtctgtaatttataaaaagttccagctgggatgcgcaatcgggcataacgagaccgccatggaatctgaagccctggtggggctcccctcccaaggcctaaacagctcctgtgaggcacagatgtttacagtggattcacaaatgtcctacaccgtgccgatcatggcgtttgcgtttgtatgtcatcctgaagttcttcccatttatacggagttgtgcaggccttctaaacggcgtatgcaagctgtggccaatgtttccataggggcaatgttctgcatgtacggcctcacggctaccttcgggtacctgaccttttactcatccgtgaaagcagagatgcttcacatgtattcgcagaaagaccctttgattctgtgtgtacgtctggccgtactgctggcggttacacttacagtgcccgtagtattatttccgattagaagagcgcttcagcagttgctgtttccagggaaagcttttagttggcctagacatgtggctatcgccctcatcctgctggtgttggtcaatgtgctggtcatctgcgtgcccacaatcagggacatttttggcgtgatcgggagcacgagcgcgcctagcctcatctttattctgccaagcatattctatctccgaatagttccctccgaagtggagccgtttctctcatggccaaagatccaggctctctgctttggcgtgctcggtgttctgttcatggcagtaagcctggggttcatgttcgctaattgggccacaggtcagtccagaatgtcgggtcattag

SEQ ID NO: 206127 - DNA, 1419 bp, Artificial Sequence
  Description of Artificial Sequence: Synthetic coding sequence
atggagctgcaggaccccaagatgaacggcgccctgcccagcgacgccgtaggatatagacaagagcgagaaggcttcttgccaagtaggggcccagccccaggctccaaaccagtccagttcatggattttgaggggaagacatctttcgggatgagtgtgttcaacctgagtaacgcgatcatgggctcaggcattttaggcctggcctacgccatggcccacaccggcgttatcttcttccttgccctgcttctatgcattgctctacttagttcttatagcatccatctccttctgacatgtgcagggatcgcgggaatcagagcgtacgaacagctgggacagagggcattcggccctgcaggcaaagtggttgtggctaccgtaatttgcttgcataatgtgggcgcaatgtcctcctatttgtttattatcaaatcagaactccctctggtgattggaacatttctatatatggatccggagggtgactggtttctgaaagggaacctgctgattatcatagtttctgtacttattatcctgccactggcccttatgaagcacttaggctacctcggctacacgagtggcctcagcctaacctgcatgctgttcttccttgtgtcagtcatctacaaaaagttccagctgggctgcgctattggacataacgaaacagcaatggagagcgaggccctggtcggcctcccttctcaggggctgaactcctcatgcgaagctcagatgttcactgtggatagccaaatgagttacactgtccctataatggccttcgctttcgtgtgtcaccccgaggtgttaccaatttataccgaactgtgtcggccctccaaaagaaggatgcaggctgtggctaacgtcagtatcggagcgatgttctgtatgtacgggctgacggctacctttgggtatctgacattctatagttctgtgaaagccgagatgttacacatgtattctcagaaagatcctctgatcctgtgcgtccgcttagccgtcctgctagcagtgacacttactgtgcctgtggttctttttcccattcgcagagcactgcagcaactgttattccctggcaaggccttcagttggccccggcatgtggccatagccctcattctcctcgttctagtgaatgtcctggtgatttgtgtcccgaccattcgggacatcttcggggtaatcggctcaacgagtgcaccatctttaattttcattctcccctctattttttacttacgcattgtaccctcagaggttgaaccttttttaagctggccaaagatccaggctctgtgtttcggtgtactaggggtgctctttatggccgtgtctctaggatttatgttcgcaaattgggctacaggccagtcaaggatgtcaggccactag

SEQ ID NO: 206128 - DNA, 660 bp, Artificial Sequence
  Description of Artificial Sequence: Synthetic coding sequence
atggagctgcaggaccccaagatgaacggcgccctgcccagcgacgccgttggataccgccaggaaagagagggctttctgccatctagagggcccgctccaggctcaaagcctgttcagtttatggatttcgagggcaaaacgagcttcggcatgtccgtgtttaatctaagcaatgctatcatgggtagtgggatacttggactggcctacgcgatggctcataccggagtgatcttttttctggcccttctcctctgtattgccctgttaagctcctactcaatccatctcctgcttacctgtgcagggatcgccggaattcgggcatatgaacagctgggacaacgcgccttcggacccgccgggaaagtggtcgtcgccaccgtcatctgtctgcataacgtcggtgccatgtcttcctatctgtttatcataaagtctgagctacccctggttattggcactttcctatatatggatccagagggagactggtttctgaagggcaacctgttgatcatcattgtgagcgtgcttatcattctgcctctggctctgatgaaacacttaggctatctgggatatacctccggattatccctgacttgcatgctcttctttctggtgtcagtgatctacaagaagttccagctctag

SEQ ID NO: 206129 - DNA, 576 bp, Artificial Sequence
  Description of Artificial Sequence: Synthetic coding sequence
atggagctgcaggaccccaagatgaacggcgccctgcccagcgacgcagtcggctacaggcaggaaagggaaggcttcctgccgtcccgtggccctgctcctgggtcaaagcctgttcaatttatggacttcgaggggaaaactagcttcggcatgtctgttttcaacctgtcaaacgcaatcatgggctcagggatcctgggactcgcttacgccatggcacatactggggtaatcttttttctggccttactgctgtgcatagccctgctgagctcgtattccatacatttgctgctcacgtgcgctggcattgccggaatccgtgcttacgagcaacttggacagcgcgccttcggtcccgctggcaaggtggttgtggctacagtgatctgcctccataacgtgggagctatgagttcttatcttttcattatcaagtcggagcttccgctggtgatcggtacctttctatacatggaccccgaaggagactggttcctcaagggaaaccttctgattattattgtgagcgtgcttatcatactgcccttggccttaatgaaacacttgtag

SEQ ID NO: 206130 - DNA, 495 bp, Artificial Sequence
  Description of Artificial Sequence: Synthetic coding sequence
atggagctgcaggaccccaagatgaacggcgccctgcccagcgacgccgtgggctatcggcaggaacgcgaagggtttctgccctcccgcggaccagccccaggcagcaaacctgtgcagtttatggacttcgagggcaaaacctcatttggtatgtctgtattcaatctaagcaacgcaatcatgggctctggaatattaggactagcctatgccatggcacatacgggcgtgatattttttctggccctgctcctgtgtatcgccctactcagctcatactctattcatttgcttctcacctgcgctggtatcgcaggcattcgagcgtacgagcagcttgggcagagggcgttcggtccagcgggcaaggtggtggtcgctacagtcatttgcctgcacaatgtgggagctatgtcaagttatctgttcatcatcaagtccgaattgccactagtgattggaactttcttgtacatggaccctgaggggtag

SEQ ID NO: 206131 - DNA, 840 bp, Artificial Sequence
  Description of Artificial Sequence: Synthetic coding sequence
atggagctgcaggaccccaagatgaacggcgccctgcccagcgacgccgtcgggtatcgacaggaacgggaggggtttttaccaagccgaggaccagcccctggcagtaaaccagtgcagtttatggattttgagggcaaaacaagctttggcatgtccgtattcaatctatccaacgctatcatgggtagcgggatccttgggttggcttatgccatggcccacaccggagtgatcttctttcttgcattgctgctgtgtattgctctgctgtcgtcctatagcatccacctgctcctgacttgcgccggaattgccgggatacgcgcgtatgagcaactgggccagagagcgtttggtcccgccggtaaagtagtggtggccactgttatatgtcttcataatgttggagcgatgagctcttacctatttataatcaagtccgagctacccctggttatcggaacgttcctttatatggaccccgagggggactggtttttgaaaggaaacttgctgatcatcattgtgagcgtgttgatcattctgccgctcgccctgatgaaacacctggggtacctgggatacacctccggtctgtccttaacctgcatgttgttcttcctggtgtctgtgatctataaaaagttccaattaggctgtgccatcggccataacgaaacggctatggagtctgaggcactagttgggctgcccagccagggcctcaactcttcctgtgaagctcagatgtttacagtggattcccagatgagctacacagtcccgatcatggccttcgcatttgtctgccatccggaagtgctgcctatttactag

SEQ ID NO: 206132 - DNA, 819 bp, Artificial Sequence
  Description of Artificial Sequence: Synthetic coding sequence
atggagctgcaggaccccaagatgaacggcgccctgcccagcgacgctgtaggttacaggcaggaaagggaaggctttttgccctcccgaggcccagccccaggatccaaacccgtccaattcatggatttcgagggaaaaacctctttcggtatgtccgtgtttaacctgtcgaatgccattatgggctcgggaatcctgggattggcatacgctatggctcacaccggagtgatctttttcttagctctcctgctatgtattgcattgctgtcgtcttactcaattcacctgttactcacttgtgcaggtattgcgggaattcgggcctacgaacagctgggacagagggcttttgggcctgcaggaaaagttgtggtggcaacagtcatctgcttacacaacgtgggcgccatgtcttcttacttattcatcatcaagagcgagctgcctttggtgatcggaacgtttctctatatggatccagaaggtgattggttcctcaaaggcaatcttcttatcattattgtgtcagttcttataatcctgccattagctctcatgaagcatctcgggtatctgggttataccagtgggctgtcacttacctgcatgctgttctttctggtgagtgtgatctataagaagtttcagttaggctgcgccattggccacaacgaaacagccatggaatccgaggctttagtgggattgccatcacaaggacttaatagttcatgcgaagcacagatgttcacagttgattcacagatgagctatacagtgccaattatggcctttgcgtttgtgtgccactag

SEQ ID NO: 206133 - DNA, 1422 bp, Artificial Sequence
  Description of Artificial Sequence: Synthetic coding sequence
atggccacccaggccaagcggccccgggtggccggccccgtggacggaggggacttggatccggttgcctgctttctgtcatggtgtcgcagagtcggactggagctgtctcctaaagtgagcgaacgggccggtggccgcaggacacgcggcggtgctcgagcggcgctgaccagcccccccgcccaggtggccgtttccaggcagggtaccgtagcaggatatggcatggttgcacgagaatctgtgcaggctggagagttacttttcgttgttcctagggccgctctgctcagccagcacacctgttcaatcggtggtctgcttgagagagagcgggttgcactccagagccagtctggctgggtgcccctgctcctagctcttctgcatgaactacaggctccagcctcacggtggcggccatatttcgccttatggccagagcttggcaggttagaacacccaatgttttggcccgaggaggaaaggagatgtctgctccagggcaccggtgtgcctgaggctgtggagaaagatttagccaacattagatccgagtaccagtctatcgtgttacccttcatggaggcacacccagatctcttctccctgcgagtccggtccctcgaactgtaccaccagctcgtagctctcgtgatggcttattccttccaggagcctctggaagaagaagaggatgaaaaggaacctaactcccccgtgatggtgcccgctgctgacattcttaatcaccttgccaaccacaacgccaacctggagtatagtgccaattgtctgaggatggtggcaacccagcctattcccaaaggacatgagatattcaatacctatgggcaaatggccaattggcaactaatccatatgtatggatttgtggaaccctacccagacaacacagatgacaccgccgacatacaaatggtaacagttcgtgaagccgctctgcagggcacaaagacagaagctgaaaggcatctggtatatgaacgctgggactttctgtgcaaacttgaaatggtgggagaggagggtgcctttgttattgggcgggaggaggtgctgaccgaggaagaactgacaacaacactcaaagtgctgtgcatgcctgctgaagaatttagagaactgaaagaccaggatggtggcggcgatgacaagcgggaggagggcagcctcaccatcacaaatattccaaagctgaaagcttcatggaggcagctattacagaactcagttttgctgacattgcaaacctacgccaccgatcttaaaaccgaccaggggcttctgagcaacaaagaagtctacgccaagctcagctggcgcgagcagcaggccctgcaggttcgatacgggcagaagatgattctgcaccagcttcttgagctgacctcttag

SEQ ID NO: 206134 - DNA, 975 bp, Artificial Sequence
  Description of Artificial Sequence: Synthetic coding sequence
atgggcccctggggcgagcccgagctgctggtgtggcggcccgaggcagtcgcgtctgagcctcctgttcccgtgggactggaggtcaagctaggtgccctggttctcctgctggtccttaccttactgtgcagccttgtgccaatatgcgtacttcgcagaccaggagctaatcacgagggcagtgcctctcgccagaaggccttatccctggtctcctgttttgccggtggggtgtttctagctacttgtctcctggatcttctgccggactaccttgccgctattgatgaagctttggccgctcttcatgtgaccctacaatttcctctgcaggagttcattctcgccatggggttctttctggttctcgtgatggagcagattacacttgcatacaaggagcagagcgggccttcaccactggaggagaccagggcgttgcttgggacagtgaatggcgggccacaacattggcacgacggccccggggtcccccaggcatctggagccccagccaccccaagcgcacttagggcatgcgtcctcgttttttcactggctctgcactcagtcttcgagggtctcgccgtgggtctccagagggaccgcgccagggctatggagctctgtttggctcttctgctgcataaaggaattctcgctgtgtccttaagtctgcgtttactgcagagtcatctacgagcccaagttgttgctggttgtggtatactgttctcgtgtatgacacccttaggcatcggactgggtgcagcactcgccgagtcggccgggcccctgcaccagcttgctcagagtgtgctcgagggaatggctgcaggtacattcttatatattacctttctcgaaattctgccccaggagctggcttcatcagaacagcgcattcttaaggtgatccttctactcgccgggttcgccttgctgacagggctgctgttcattcaaatatag

SEQ ID NO: 206135 - DNA, 975 bp, Artificial Sequence
  Description of Artificial Sequence: Synthetic coding sequence
atgggcccctggggcgagcccgagctgctggtgtggcggcccgaggccgttgccagcgaacctcctgtccccgtcggcctggaagtgaagctgggagccctggtgctcttgctggtcctgacgttgctgtgctcactagtacccatttgcgtgctgcggcgcccaggagccaatcacgagggctccgcttctcgacagaaagctttgtctctggtgagttgcttcgcagggggagtttttctcgccacttgcctcctggacctgctgccagactacttggctgccatcgacgaggctctggccgcgctgcacgttaccctgcagtttcccctacaagaatttattctggccatgggtttttttctggtcttagtgatggagcaaatcaccttagcatacaaagaacaatccggaccttctccactcgaggagaccagggcactgctcggtaccgtcaatggcggacctcagcactggcatgatggccctggagtcccccaggccagtggggcccctgccacaccaagcgccctccgtgcttgtgttttagtcttttccctggcactacattccgtgtttgagggtttagccgtgggtttgcagcgagaccgggcacgcgccatggagttgtgtctggcactgctgctgcacaaaggaatactcgcggtaagtttatcacttagactcctgcaaagccacctgagggcacaggtggtggccgggtgcgggatcttattcagttgtatgaccccactgggcataggactgggggccgccctcgcagaatctgcaggccccctgcatcaactcgctcaaagtgtgctggaaggcatggccgccgggacattcctatacatcaccttcctggaaatcttgccgcaagagctggcctcttctgaacagcgaatcctcaaggtgatcctgctgctggccgggttcgcgctgctgacaggtttactctttattcagatctag

SEQ ID NO: 206136 - DNA, 975 bp, Artificial Sequence
  Description of Artificial Sequence: Synthetic coding sequence
atgggcccctggggcgagcccgagctgctggtgtggcggcccgaggcggtggcctccgaacctccagttcccgttggactggaagtgaagttgggggcactcgtcctgctcttggtgctcacgttactatgctctttagtcccaatctgtgtgttgcggcggcccggagctaaccatgaggggagtgcatcgcggcagaaggccctgagcctcgtgagctgttttgctggaggcgtcttcctggcaacatgtctcctcgatttactccctgattacctggctgcgatcgacgaggccttggcggctctccatgtgacattgcagttcccactccaggagtttattctggccatgggtttctttctggtgctggtcatggagcagatcaccctcgcatataaagagcagagtgggcctagcccgctggaggaaactcgggctttgctgggcacagtcaacggtggcccacagcactggcatgatggacctggagtgccgcaagcctccggtgcaccagctacaccaagcgccctccgggcctgtgttctcgtattcagcctagccttgcactcagtgtttgagggcctagctgtagggctgcagagggaccgcgctagggccatggagctttgtctcgccctgctgcttcacaagggcattcttgctgtgagtctttccttgcgacttctgcagagccacctgagggcccaggttgtggccgggtgcggcattcttttcagctgtatgacccctctgggtatcggactaggggccgccctggccgaaagtgctggtcctttacaccagctggctcagtcggtactggaaggcatggccgccggtacttttctatatatcacctttctggagatcctgcctcaggaactggcttcgagtgagcagaggatactcaaggtgattcttctgcttgccgggttcgccctgctaactgggctcctcttcatccagatatag

SEQ ID NO: 206137 - DNA, 975 bp, Artificial Sequence
  Description of Artificial Sequence: Synthetic coding sequence
atgggcccctggggcgagcccgagctgctggtgtggcggcccgaggcggttgccagtgaacccccagtacctgtggggctcgaggtcaaattgggcgcactcgtcctgctcctcgtgctgaccctcctgtgctccctggtgcccatctgtgtgttacgacgcccgggtgcaaaccatgaaggcagcgccagtcgccagaaagcattaagcctggtctcctgctttgccgggggcgtgtttctcgccacctgtctcttggacttacttcccgattatttggccgccattgacgaggcgctggctgctctccacgtcacactgcaatttcccctacaagagtttattctggccatgggctttttcctggttctggtgatggaacagatcaccctggcatacaaggagcagtcggggccatcacctttggaagagacacgggcgctgctcggcacagtcaatggaggaccgcagcattggcatgacggacctggcgtcccccaggcaagtggagcccccgccactccttctgccttgcgcgcctgcgtcctggtgtttagcctggccctgcacagtgtctttgagggacttgccgtggggttacagcgagacagagcccgtgcaatggagttgtgtctggcgctcctactgcacaaaggcattctggccgtaagcctgagtctgcgccttctgcagtcccatttgcgtgctcaggtggtcgctggttgtgggatccttttctcgtgcatgactccccttgggatcggcttgggcgctgccctggctgaaagcgccggtccgttacaccaattggctcagtccgtgttagagggaatggccgctggtacattcctttacattactttcctggaaatcctcccccaagagcttgcgtcttccgagcaaaggattttgaaggttattctgctgctggccggctttgctttactaacgggcctgttgtttatccaaatctag

SEQ ID NO: 206138 - DNA, 723 bp, Artificial Sequence
  Description of Artificial Sequence: Synthetic coding sequence
atgggcccctggggcgagcccgagctgctggtgtggcggcccgaggcggtggcctccgagcctccagtgccagttggcctcgaggttaaactgggcgcattagtgctcctcctggtcctgaccctcctttgtagcttggttccgatttgcgtgcttcggaggccaggggcaaaccatgaagggtccgcaagcagacagaaggccttatctctcgtgtcatgctttgcaggcggggttttcctggcaacatgtctgctggatttgctgcccgactatctggccgcgattgacgaggctctggccgccttgcacgtgaccctacaattcccgctgcaagaattcatcctggcaatggggttcttcttggtcctggtaatggagcaaattactttggcgtacaaggaacaaagtggcccttctcccctggaggagacgcgagcgctcctgggcaccgttaacggtggacctcaacattggcacgacggacctggtgtgccccaggcaagcggagctcccgccaccccttctgcgcttcgtgcctgcgtcctcgttttctctctggcactccatagcgtgtttgagggcttggccgtaggccttcagagagaccgcgcccgcgcgatggagctgtgtctggccctgctgctgcacaaagggatactcgctgtgtcgctgtctctgaggctgttgcagagtcacctgcgggctcaggtggtggcatag

SEQ ID NO: 206139 - DNA, 621 bp, Artificial Sequence
  Description of Artificial Sequence: Synthetic coding sequence
atgggcccctggggcgagcccgagctgctggtgtggcggcccgaggccgtagcttctgaaccaccggtcccggtaggcttggaggtgaaactcggagctctggtgcttttgcttgttcttacactactctgcagcctggtaccaatatgcgtactccgcagacctggcgctaaccacgagggaagcgcttcacgacagaaggcattaagcctcgtcagttgctttgcaggcggggtttttctagcaacctgcctgttagatcttctgcccgattatctcgcagcaatcgacgaggccctggccgctcttcacgtaaccttacagtttcccctgcaggagttcatactggctatggggtttttcctggttttagtgatggaacagatcacgcttgcttataaagagcaatccgggccctctccacttgaggagacacgggctttactcggtacggtcaacggtggtccccagcactggcatgatggccctggtgtcccccaggccagtggggctcctgcaacgcctagcgctcttcgggcttgcgtgctggtgtttagccttgccttgcactccgtcttcgagggactggctgtcggactgcagagggatcgggctaggtag

SEQ ID NO: 206140 - DNA, 966 bp, Artificial Sequence
  Description of Artificial Sequence: Synthetic coding sequence
atgggcccctggggcgagcccgagctgctggtgtggcggcccgaggcggtagccagcgagcctccggtgcccgtcgggctggaagtaaagctcggggcgctggtcctgctgctagtattgactctcttatgcagtctggttcctatttgcgtgttgcggaggcctggcgctaaccacgaaggatcagctagcaggcaaaaagcactgtcgctagtgagttgtttcgcagggggggtgtttcttgctacctgcttgctcgacctgctgcctgactatctggctgcgatagacgaggccctggccgccctgcacgtcaccttgcagtttcctttgcaagagtttatcttagccatgggcttttttttagtcctggtcatggaacaaataaccctcgcctataaagaacagtccggcccaagtcctctggaagagacccgggctctgctgggcacagtaaatggtggaccacaacactggcacgatggtccaggggtaccacaggcctctggggctccagcgacaccatctgcactgcgcgcttgcgtgcttgtattcagtttagctctgcactccgtctttgaggggctggcggtcgggctccaaagagacagggctagagcaatggagctttgcctcgccttactgctgcataaaggcatccttgcagtgagcttgtctctgcgactgttacagtcacaccttagagcccaggtggtcgcaggctgtgggatccttttttcatgcatgactcctcttgggatcggactgggcgctgcactggctgaatccgcaggccccctacaccagcttgcccaaagcgtgctggaaggaatggccgccggcactttcctttatattacgttcttagagatcctaccccaggaattggcaagcagtgaacagcgtatcttgaaggtcattctgttgctcgcagggtttgctctgcttactggcctgctgttctag

SEQ ID NO: 206141 - DNA, 669 bp, Artificial Sequence
  Description of Artificial Sequence: Synthetic coding sequence
atgaaggcccagctgcagttccccctgcaggagttcatcctggccatgggattctttctagtgctggtgatggagcagattacactagcgtataaggagcagtcaggtccatcaccattggaagagacccgtgctttgctaggcaccgtaaatggtggacctcagcattggcacgatggtccaggcgttcctcaggcctctggcgccccagctactcccagcgccttacgagcatgcgtgctggtgttctcacttgcactccactccgtgttcgaaggattagcagtgggactgcagagagatcgagcccgggccatggagctatgtcttgctctgctgttgcataaaggaatcctcgcagtcagtctgtctctgaggctcttacaaagccatttgagagcgcaggtggttgccgggtgcggaatactcttttcatgtatgacacccctcgggattggactgggtgccgcgctggcagagtccgctggtcctttacaccagctagcccagagcgtcctcgaaggaatggctgcagggaccttcctgtacattacctttctggagattctaccccaggagctcgcttctagtgagcagagaattttgaaagtgattctgctgcttgccggctttgcactcctgaccggtctgctatttatccaaatttag

SEQ ID NO: 206142 - DNA, 942 bp, Artificial Sequence
  Description of Artificial Sequence: Synthetic coding sequence
atgggcccctggggcgagcccgagctgctggtgtggcggcccgaggccgtggcctctgagccgccagtgcctgtgggactggttctaacacttctgtgcagcttagtgccaatctgtgtgctccggaggcccggcgctaatcatgaaggttcagcttctaggcagaaggcattatcgctcgtttcctgctttgcagggggcgtgttcctggccacttgtctgcttgatctgctgccagactatctcgcagccatcgacgaggccctcgctgccctgcacgtaacactccaatttccactacaagagttcatcctagccatgggattcttcctggtgctggtgatggagcagataaccctcgcttacaaggaacagagcggcccatcaccattggaggaaactcgggcactgttgggcacagtgaatggcggccctcagcattggcatgatgggccaggcgtaccacaggcttccggcgcacctgctaccccttccgctttgcgtgcctgtgttctcgtgtttagcctggcgctgcactccgtctttgagggcctggccgtcggtctgcagcgggatagagctcgagcgatggaattgtgccttgcactgttactgcacaagggaattctagccgtgtctttatccttgagacttttgcaaagccacctcagagcccaagttgtcgcaggttgcgggatactcttttcttgcatgacccctttggggattggtttgggcgccgcgcttgcagagtcagccgggcctttgcatcagcttgcacagagcgttctagagggcatggcagctggcacttttttgtatatcacattcttggaaatattaccacaggaactggccagctctgagcaaaggatactcaaggtgattttgctattggccggatttgccctgttaaccgggctcctttttattcagatatag

SEQ ID NO: 206143 - DNA, 1095 bp, Artificial Sequence
  Description of Artificial Sequence: Synthetic coding sequence
atgcccggctgcccctgccccggctgcggcatggccggcccccggttacttttcttaacagccctcgccttggaactgctggagcgggctggagggagccaacccgctctaaggtcacggggcaccgctactgcatgtcggctcgacaacaaagagtctgaatcatggggagcccttctgtcaggggaacgtctcgacacctggatctgcagccttttgggctccctgatggtgggcctaagcggtgtattccccttgcttgtgattccactcgaaatgggcaccatgctgcggtcagaggccggagcctggcgtcttaagcagctgttgtcctttgctctgggaggcttgctgggcaacgtttttttgcatttactgccagaagcctgggcttatacgtgtagtgcttcacccggaggcgaagggcaaagtctgcagcagcaacagcagcttggcttgtgggtgattgccgggattttaaccttcttggctctcgaaaaaatgtttctggactcaaaggaggagggcacaagtcaagcgcctaacaaggaccctaccgcagcggcggctgcactgaacggtggacattgtttggcacagccagctgcggagccaggcttaggcgccgtagtaagaagcatcaaggtgtctgggtacttgaaccttctggccaacactattgataactttactcacggcctagccgtcgcagcatccttcttggtcagcaaaaagattggcttgctgacaaccatggccatactactgcacgagattccacacgaggtgggcgatttcgcgattttgctgcgggctggatttgatcgatggagcgccgctaaacttcagttatctacagcactgggcgggcttctgggagccggctttgctatctgcacacaaagccctaagggcgtggaggagaccgcggcttgggtgttgccatttacttcaggcgggtttttatatattgccctcgtgaacgtgctccctgacttgctggaggaggaggatccatggaggagtctgcaacagctcctgctactgtgtgccggaatcgtggtgatggtgctctttagtctcttcgtcgattag

SEQ ID NO: 206144 - DNA, 1116 bp, Artificial Sequence
  Description of Artificial Sequence: Synthetic coding sequence
atgcccggctgcccctgccccggctgcggcatggccggcccccggctcctgttcctgactgcccttgctctcgagcttctcgaaagagccggcgggtcacagccagccctgagatctcgtggtactgctaccgcttgccggctcgacaacaaggagagtgagtcctggggtgcactccttagcggagaaaggctggatacctggatttgtagtctgctggggtcacttatggtcgggttaagcggagtgttccctctgcttgttattcccctagagatgggcaccatgttgcgcagtgaggccggcgcgtggagattgaagcagcttctgtccttcgccctgggaggtcttctgggcaacgtgttcctccacctgctccctgaggcttgggcatacacatgttctgcctctcccggcggcgaagggcagtcgcttcagcagcaacagcagctgggtttatgggtcattgcaggcattctcacctttctagctctggaaaagatgttcctcgacagcaaagaagaaggtacatcacaggccccaaataaagacccaacagcagccgccgctgccctaaacggcggtcactgcctggcacagccagcggcggagccaggactcggcgcagttgtgaggagtatcaaggtgtccgggtacctgaatctgcttgctaataccattgacaacttcacacatggactggcagtcgccgcaagtttcctggtgagcaaaaaaatcggcctcctcactactatggcaatactcctgcacgaaatcccacacgaggtcggggacttcgcaattctgcttcgggcagggttcgaccgctggtctgcggccaaactgcagcttagtaccgccttaggtggattgttgggagccggcttcgcaatctgcacacaatcccccaaaggagtggtgggctgctcacccgccgctgaggagaccgctgcctgggttttgcctttcacatccgggggattcctgtatattgcgctagtgaatgtcctgcctgacctgctggaagaagaagatccttggaggagcctgcagcagctgctcctcctctgcgctggaatcgtagtgatggtgctgttttccttatttgtggactag

SEQ ID NO: 206145 - DNA, 930 bp, Artificial Sequence
  Description of Artificial Sequence: Synthetic coding sequence
atggagcagctgctgggcatcaagctgggctgcctgttcgccctgctggccctaactttgggatgtggattaactccaatctgtttcaagtggttccagattgatgctgccagaggccatcaccgcctggtactcagactgttgggctgtatcagtgcaggcgtcttcctcggagcgggcttcatgcacatgacagctgaggcgttggaggaaatcgaatcccagatccagaaatttatggtacaaaataggagtgcaagtgaacgtaactcttcaggtgatgccgacagtgcacatatggaatacccctacggcgagttgatcatttctctgggatttttcttcgtctttttcctggagagcttggccctacagtgttgtcctggagccgctggcggaagcaccgtgcaagatgaggagtggggcggggcgcatatctttgaactgcacagtcatggacaccttccctcgccatctaaagggcctctcagagccttggtgctgctgctcagcctgagctttcactccgtctttgaggggttagctgtgggacttcagcctacagtggcagctaccgtccagctatgcctcgcagtgctcgctcataaggggcttgtggtctttggcgtgggcatgcgtcttgtacatttgggtacctcctcccgatgggccgttttctccattcttcttctggcccttatgagccccttggggttggccgtgggactggcagtgactggaggcgatagtgaaggtgggcgcggcttagctcaggcagttctggagggagttgccgccggtaccttcctgtatgtaactttcctggaaattctgccaagggaacttgcttcacccgaggcccctctagcaaagtggagctgcgtcgcagcggggttcgcctttatggcgttcattgcactgtgggcctag

SEQ ID NO: 206146 - DNA, 945 bp, Artificial Sequence
  Description of Artificial Sequence: Synthetic coding sequence
atggtgaagctgctggtggccaagatcctgtgcatggtgggcgtgtttttcttcatgttgttgggatccttgctacccgtcaaaattatagaaactgactttgaaaaggcccatcgatcaaagaagatcctcagcctgtgcaacacttttggcggaggcgtcttccttgcaacatgttttaatgcactcctgccagcggttcgcgaaaaactgcaaaaggtgctcagcctcggacatatctctacagattatcctctcgccgagactattttactattgggcttcttcatgactgtgtttctggaacaactgatcttgacttttcgcaaagagaaacccagcttcattgacctcgagacttttaacgccggctccgatgtcggaagtgacagcgagtatgaaagcccattcatgggtggtgcgcggggccatgctttatacgtggagccccacggacacggcccaagtttgtctgttcaggggttgtccagggcatcacccgtgcgcctgctcagtctggcttttgccctcagtgctcatagtgtgtttgagggacttgccctgggattacaagaagagggcgagaaagttgtctctctcttcgtgggagtcgcagtccacgaaactctggtggccgtggcattgggaatctcaatggctcgaagcgccatgccccttcgagacgccgccaagctggcggtgaccgtttcagccatgatccctctgggcataggcctcggcttgggtatcgagtcggctcagggggtgcccggcagcgtcgcttctgttctgctccaaggcctggcaggaggtactttcctgttcatcacttttctagaaatacttgccaaggaacttgaagaaaagtccgaccgtctgctgaaggtgttgtttctcgtactcggctacactgtcctggcagggatggtcttcttgaagtggtag

SEQ ID NO: 206147 - DNA, 318 bp, Artificial Sequence
  Description of Artificial Sequence: Synthetic coding sequence
atggtgaagctgctggtggccaagatcctgtgcatggtgggcgtgttcttcttcatgctgctgggaagtctgcttcccgtgaaaattatcgaaacagactttgaaaaggcgcatagatcaaagaagatcctgagtctttgtaatacctttggtgggggcgtgtttcttgccacatgttttaacgctcttctccccgcggttcgcgaaaaagtgagggctccttgggctctggcggccgcattgggtaccctgtggccacgggattccgatgccttttccacgctgatgcctagtagtgtgaaggctttaatgctttag

SEQ ID NO: 206148 - DNA, 972 bp, Artificial Sequence
  Description of Artificial Sequence: Synthetic coding sequence
atggtgaagctgctggtggccaagatcctgtgcatggtgggcgtgtttttctttatgctgctgggatcactcctgcctgtaaagattatcgaaaccgactttgaaaaggcccaccgatctaagaaaattctgagcctgtgtaatacctttggagggggggtgtttctggccacctgctttaacgcccttcttcctgccgtccgtgagaaactgcagaaagtcttgagtctaggacacatatcaacggactacccgctcgctgagactatcctgctgctgggcttcttcatgaccgtgttccttgagcagctgatactaacatttcgtaaagagaaaccgtcattcattgacctggaaacctttaacgcaggctcagacgtaggctctgactctgagtatgagtcccccttcatggggggtgcccgaggccacgctctttatgttgaaccccacggtcatggcccgagtttaagcgttcagggattgtctcgggcatcccccgttcggctgctgagcttggcctttgctctgagcgcacattctgtcttcgaagggttggcacttggcttgcaggaggagggtgaaaaggtcgtgtcactctttgtcggggtagctgtacatgaaacactggtcgctgtcgcacttggcatctccatggctaggagcgcaatgcccctgcgcgacgctgccaagttggcggtgactgtctccgccatgattccattaggcatcgggctgggtttgggaattgaaagcgcacagggcgtgcccggaagcgtggcatccgttctgctgcaggggcttgccggcggaacattcttattcatcacttttttagagatactggcaaaggaacttgaagagaagtctgacagactgctaaaagttctatttctcgtcctagggtacacagtcctggctggaatggtatttcttaagtggatatcaccgcccgaacctcgcgttagctag

SEQ ID NO: 206149 - DNA, 1869 bp, Artificial Sequence
  Description of Artificial Sequence: Synthetic coding sequence
atggtggacgtggtgggcctggagcgggagaccggcccccggggctcaccatggcccgggctgccattaccttccttggtgggccctgccccactgctgacttgtctgtgcccacagtgcctatctgtagaggacgcactagggctgggggaacccgaggggtccggcctgcccccaggacccgtgcttgaagcgaggtatgttgctcgcctctccgctgcagcagttttgtacctgtccaaccctgaaggaacctgtgaggacgctagggcaggtctgtgggcgtcccatgcagaccacttgttggccctgctcgaatccccaaaggctctcacaccaggactgtcgtggctcctgcagcggatgcaggcaagggccgctggacagacgcctaagaccgcatgtgtagacatccctcagctcctggaagaagcagtgggtgcaggcgcgccaggctctgccggcggcgtgctcgccgcgctgctcgaccacgtaaggagtggcagttgctttcacgccctaccttctcctcagtatttcgtggactttgtcttccagcaacactcctcagaggttccaatgacattagccgagctgagtgccttgatgcaaaggctcggcgtgggacgggaagctcactctgatcacagtcatagacaccgaggggctagctcttgggacccggtgccgctgataagcagtagcaacagcagctctgtgtgggatacagtgtgtttgtcggctcgagacgtgatggcagcatacggactgtctgagcaggctggagtgacgcctgaggcttgggcccagttgtccccagctctgctccagcagcagctaagcggtgcttgcacgtcgcaatctagaccgccagtccaggaccagttgagccagtccgagcgctatctgtatggaagcctggccaccctgctgatctgtctgtgtgccgttttcggacttctgcttctgacctgtactggatgccgcggagtgactcactacattctgcagacgttcctgtctctggccgtgggtgcattgactggtgacgctgtactccatctgacccccaaagtcctcggcctgcacacccattccgaggagggactgtccccccaacctacgtggcggctgctcgcgatgctggcagggctgtacgctttctttctcttcgaaaatttgttcaatttgctgctgcccagggacccagaagatctcgaggacgggccctgtggccactccagtcactctcatgggggccattcacacggggtgtccctgcagctcgcgccctccgagcttcggcagcccaagccgccccatgagggcagtagggccgatcttgtagctgaagaatccccggaattgttgaacccagaacctagaaggctgagcccagagcttcggcttctgccttatatgattacgctgggcgatgcggtccacaacttcgctgacggactggcggtgggggccgcatttgcgtctagttggaaaacaggcctcgccacttcactagctgtgttctgccatgagctaccccatgagcttggagattttgccgctctgctgcatgcaggactctcagtgcgccaggcgctgctgttgaatctggctagtgctcttactgcctttgccggactctacgtagccctggccgtcggcgtcagcgaggagagtgaagcttggatactggccgttgcaaccggattgttcttgtacgtggccctctgtgatatgctcccagcaatgcttaaagttcgcgatcctaggccgtggcttctgttcttgctgcacaatgtgggcttactaggcggttggactgtgttacttcttctgtctctctacgaagatgacatcaccttctag

SEQ ID NO: 206150 - DNA, 1944 bp, Artificial Sequence
  Description of Artificial Sequence: Synthetic coding sequence
atggccagcctggtgagcctggagctgggcctgctgctggccgtgctggtagtgaccgccaccgcctccccaccggccgggttactgagtctgttaacctctggacaaggtgcgttagaccaggaggcgctgggaggcctgctgaacaccctggccgatagggtgcactgtgctaatggcccatgtggtaagtgcctgagtgttgaggacgcccttgggttaggtgagccggagggtagtgggcttcctccaggacctgtcttggaagctcgatatgttgccaggctgtcagctgctgcagtgctttacttaagtaatccagaaggaacctgtgaggacgcgcgggcaggtctgtgggcctcacacgctgaccacttgctcgccctcctagagtcacctaaggcgcttacccccggcctgtcctggctgttgcaaagaatgcaggcgagggccgctggacagactcccaagactgcatgcgtggatattccgcaactcttagaggaggcagttggcgccggagctcctggctcagcaggaggggtgctggctgctctcctcgatcacgtgcgctccggctcatgtttccacgcattgccgtccccacagtactttgtggactttgtgtttcagcagcacagcagcgaagttcccatgacactagccgaactgtccgcgctgatgcaaaggctgggagtaggaagagaggcccactctgatcattctcaccggcataggggtgcaagctcctgggatcctgttcctctgatatctagttctaattcctcctctgtctgggacacagtgtgccttagcgccagagacgtgatggctgcttacgggctctccgagcaagcaggagtcacaccggaggcatgggcccagctgtcccccgcccttttgcagcagcagctgagtggcgcatgcacctcccaatcccggccgcccgtacaagaccaattaagccaatcagagcgctacttatacggatccctagcaaccctcctgatatgcctttgcgcagtcttcggcctgctcctgttaacttgcaccggctgtcgcggggttactcattacatcttgcagaccttcctgtccctggcagtcggggcactcacgggcgacgccgtactgcatctgacgcccaaagttctcgggctccatactcactccgaggagggcctgtctcctcagcccacctggaggctgctcgcaatgctggccggattgtacgctttttttctgttcgaaaacctgttcaacctgctgctgccaagagacccagaggacctcgaggacggtccatgcgggcactcctctcattcccatggcggtcactcacacggagtcagtttgcagctggctcctagcgaattacgccagccgaagcccccccacgaagggtcccgcgcagacctggtggccgaggagtcccccgagctgttaaaccccgagcccagaaggctgtcacccgaactgcgactactgccttatatgatcaccctcggcgatgccgtgcataactttgccgatggactcgccgtgggagccgctttcgcatcctcatggaagacaggcctggctacaagtttagcggtcttctgccatgagttgccccatgaactcggggacttcgctgccctactgcatgctgggctgtccgtcaggcaggcactgctgctgaacctcgcctctgcactgactgcatttgcaggcctctatgtggccctggccgttggcgtgagtgaagagtccgaggcctggattcttgctgtcgccaccgggcttttcttgtacgtggctctgtgtgacatgctgcctgcgatgttgaaagtgcgagatccacggccgtggctgttatttctgttgcacaacgttggccttttgggcggctggactgtgctcctgttactttccttgtacgaagacgatatcaccttctag

SEQ ID NO: 206151 - DNA, 1410 bp, Artificial Sequence
  Description of Artificial Sequence: Synthetic coding sequence
atggcccggggcctgggcgccccccactgggtggccgtgggcctgcttacgtgggctaccctcgggttactggtagctggactaggcggacatgacgacctacacgacgatctccaggaggatttccatgggcactctcaccgacatagccatgaggacttccaccatggccactcgcacgcccacggacatggacacacacatgagtcgatctggcatggacacacacatgaccacgatcacgggcactcccacgaagacctacaccacggccacagccacggatacagccacgaaagtctgtaccaccgtggccacggacacgatcacgaacacagccatggtggctatggagaatcaggcgccccgggcataaagcaggacttagatgcggtgacactgtgggcctatgcgcttggggctacagtgctgatttccgctgctccgttcttcgttttattcctgattcctgtcgaatccaattcccctcggcacaggtccctgcttcagatcctcctttcatttgcatcaggcggtctactcggagatgcttttctgcacctcataccccacgccttagagccccactcccaccacacactggagcagcctggccacggacattcacactccggccagggtccgattctgagcgtggggctatgggtcctgtccggtattgtcgcctttcttgtggtcgagaaatttgtgcggcatgtcaagggcggacacggccatagccatggtcatgggcacgcccattcacatactcgcggctctcacggacacggcagacaggagcgctctacaaaagaaaagcaaagcagtgaggaggaggaaaaagagacaagaggcgttcagaaacggcggggcggaagcaccgtacccaaggacggcccagtgaggcctcaaaacgcagaagaggagaaacgcggactggacttgcgggtgagcggatatcttaacctggctgccgatctggctcataatttcacggatggattggctatcggcgccagttttcggggtggacgcggactcgggatacttactactatgaccgtgctcctgcatgaggtcccacacgaggtaggggattttgccatcctggtacagtccggatgctccaagaagcaggccatgcggttgcagctactgacagccgtgggggccttagccggaaccgcatgcgctcttctcactgagggcggcgcagtggggagtgagatcgccggaggcgctggaccaggatgggtattaccttttactgccggaggcttcatctacgtagccacagtcagcgtgctcccagagctactgcgtgaggcctcaccactgcagtctctcctggaggtgctcggtctgctgggcggcgtcataatgatggttttgatcgctcatttggagtag

SEQ ID NO: 206152 - DNA, 1410 bp, Artificial Sequence
  Description of Artificial Sequence: Synthetic coding sequence
atggcccggggcctgggcgccccccactgggtggccgtgggcctgttaacctgggccaccctggggctcctggtcgccgggctcggcggacacgatgaccttcacgacgacctgcaagaagacttccatggccattcccaccggcacagtcacgaggactttcaccacggtcactcccatgcacacggccatggccacacccatgagagtatctggcatggccacacgcatgatcacgatcacgggcactctcacgaagatcttcatcacggtcactcccatggctacagccacgagtccctgtatcaccgtggccatggtcacgaccacgagcactctcatgggggctacggtgagagtggcgctcctggaatcaaacaggaccttgacgcagtaaccctgtgggcctacgcacttggagccaccgtgttaatctcggcagcccctttctttgttctgtttctcatccccgtggagtccaactcgccacgacatcgctctcttctgcaaatcctgctgagctttgccagcggaggcctccttggggacgcttttttgcacctgataccacatgctcttgagcctcattcgcaccacacccttgaacaacccggacatgggcacagccactccggccagggacccatcttgtccgtggggctgtgggttctctctggcatcgtggcgtttctcgtcgtggaaaaatttgtgaggcatgtgaagggcggccatggccattctcacggccacggtcatgcccacagtcatactaggggcagtcacgggcacgggaggcaggaaagatccacgaaagagaaacagagcagtgaggaggaggagaaagaaacaaggggagttcagaagcgcagagggggcagcacagtgcctaaggatggtcccgtgcggccccagaacgccgaggaagaaaaaagaggattggatctgcgagtgagtggctacctgaaccttgccgcagatctggctcacaattttacagatgggctagcaattggggcttcttttcgggggggacgaggtttggggatcctgactacaatgaccgtactgctgcatgaagtgccacacgaggttggggatttcgccatcctggtccagtcggggtgtagcaaaaaacaggctatgagactgcagttgctcactgctgtgggcgctctggccgggactgcgtgtgcattactgacagaggggggagccgtgggctccgagattgctgggggggccggacctggctgggtactcccctttaccgcaggcgggtttatctatgtcgcaaccgtcagtgtcctgccggaactgctccgggaagctagccccctgcagtccctgcttgaggtgcttggccttttagggggtgtcattatgatggtgctgatcgctcatctggaatag

SEQ ID NO: 206153 - DNA, 1410 bp, Artificial Sequence
  Description of Artificial Sequence: Synthetic coding sequence
atggcccggggcctgggcgccccccactgggtggccgtgggcctgctgacatgggctacccttggactgctggtcgcggggctcggaggccatgacgacctgcatgacgatcttcaagaggattttcacgggcactcgcaccggcactctcatgaggatttccaccatggtcatagtcacgctcatgggcacggacatacccatgaatccatatggcacgggcacacacacgatcacgaccacggacactctcacgaggatctgcatcacgggcacagtcacgggtatagccatgagagtttgtaccaccggggacacggacatgatcacgagcattctcacggagggtacggcgaatcgggggctcccggaatcaaacaggacctcgacgctgtcactctttgggcgtatgcattgggcgccacggttctcatttcggccgcaccgttcttcgtcctgtttctgattccagtagagtccaactcgcctagacatcgtagcctgctccagatcctcttgagtttcgcttccggggggctgctgggtgacgcctttctccacctcatcccacacgccctggagccgcacagccaccatacactcgagcaacccggtcacggacatagtcacagcgggcagggcccgattctatcagtcggactctgggtactcagcgggatcgtggcattcctggtggtggagaaattcgttcgacacgtgaaaggtggtcatggtcactcgcacgggcatggtcatgcccatagccacacccgcggctcacacgggcacgggcggcaggagcgatccacaaaagaaaagcagtcatcggaggaagaagaaaaggaaaccaggggagtccaaaaacgccgagggggaagcaccgtgccaaaagacggcccagtgagaccacagaatgccgaagaggaaaaaagaggattagatcttcgggtctccggctacctaaacctggcggctgatttagcacataatttcactgacggtctcgccataggggctagtttcaggggtggtcgcggcttaggtattctgacaaccatgacggtacttcttcatgaagtgccccacgaggtaggcgatttcgcgatcctggtgcagagcggatgttcaaaaaagcaggccatgaggttgcagctgctgaccgcggttggagccctcgccggcacggcctgcgccctcctgacagaaggtggggccgtaggctcagaaatcgccgggggcgccgggcctgggtgggttttgccattcactgctggtggcttcatctacgtcgcaaccgtttccgtcctgcccgaacttctgagagaagcttcccctctgcagagcctcttggaagtgctcggactcctgggcggggttatcatgatggtacttatagcacacttggagtag

SEQ ID NO: 206154 - DNA, 1410 bp, Artificial Sequence
  Description of Artificial Sequence: Synthetic coding sequence
atggcccggggcctgggcgccccccactgggtggccgtgggcctgctgacctgggctacactggggcttctggtggccggtttgggcggtcacgatgatctgcacgatgacctacaagaagacttccacggccacagtcaccgccattcacatgaagactttcaccacggccactcccatgcacacggacatggacatacccacgagtcgatctggcatggacacacacatgatcacgatcatgggcactcccacgaggatctacatcacggacactcacatggttacagccatgaatcactgtaccaccgcgggcacggacatgaccacgaacattcacacggcggctacggtgaaagcggagctccaggaatcaagcaggacctggacgctgttaccctttgggcctatgcattgggtgccacagtgttgatatccgcagccccattctttgtgctgttccttattccagtcgagtcgaattcgcctcggcatcgcagcctgctgcagattctcctgagcttcgcgagcggcggccttcttggagacgcatttcttcatctcatcccacacgctctagaaccccactcccaccatactctggagcagccgggccacggccacagccattccggccaggggcccatcctgagcgtggggttgtgggtgctgtctggaatagtcgccttcttggtggtcgagaaatttgtccgccatgtgaagggtgggcacggtcattcccatggccatggccatgcgcattcacacaccaggggctcccacggtcatggtaggcaggaacgcagcacaaaagagaaacagtccagcgaggaggaagagaaggagacgcgaggcgtgcagaaaaggcgcgggggaagtacggtccctaaagacggccccgtgcgcccccaaaacgcagaggaggagaagagaggcctggatttgagggtgagtgggtatctgaacttagctgcggatctggcccacaattttactgacggactagccatcggggcatctttcaggggcggacgcgggctaggcattctcacaacaatgaccgtccttctgcatgaggttccccatgaagtcggagacttcgcaatcttggtgcagagtggatgtagcaagaagcaggcaatgagactgcagctcttgaccgcggtaggcgctctggccggcacagcatgtgcgctgcttacagagggcggggctgtgggaagtgaaatcgctggaggagccgggcctgggtgggtgctaccattcactgcgggagggtttatctacgtggccactgtgtcagtgttgcctgaattactgcgcgaggccagtccgctacagtccctactggaggtgctgggcctcctaggtggcgttataatgatggtgcttatagcccacctagagtag

SEQ ID NO: 206155 - DNA, 663 bp, Artificial Sequence
  Description of Artificial Sequence: Synthetic coding sequence
atggacagcagcctgcccgagtgccggcacatcggcaagggcatcagggctaaggtggagcgaaacttcctgttttctcgcgacctgaaagccggcctgcctagaccgtccaagccaggaaaagagaggatccccgagccagcactgggagcaaccgttcttattagcgccgctccattctttgtcctatttctgatccctgtggagagcaacagccccagacatcgatcactcctccagatcttgctgagctttgcctccgggggcctgctgggagacgcatttctgcatctgatcccacacgcccttgagccccactcgcatcacacgctggagcaaccaggccatggccacagccattctggtcagggccctattctgagtgtaggactgtgggtgctgagcggcatagttgctttcctcgtagtagagaagtttgtgcggcacgtgaaaggaggccacgggcactcccacggccacgggcatgcccacagccacacccggggatcacacgggcacggtaggcaggaaagaagtacaaaagaaaaacagtcatctgaagaagaggagaaggaaacccggggcgttcagaagaggagggggggatctacagtgcctaaggacggccccgttcgtccccagaacgcagaagaggagaaatag

SEQ ID NO: 206156 - DNA, 663 bp, Artificial Sequence
  Description of Artificial Sequence: Synthetic coding sequence
atggacagcagcctgcccgagtgccggcacatcggcaagggcatccgggctaaggtagaacgcaactttctattcagtcgggacctgaaagccggcctcccgaggccttctaaaccaggaaaagaacggatccccgaacccgcactcggggctaccgttcttattagcgctgctcccttctttgtgctctttctcatacccgtcgaatcgaatagccccagacaccgctctctgctccagatcctcctcagctttgcctccggaggcctgctaggtgatgccttcctgcatttgattcctcacgccttggagcctcacagccaccacactctcgaacaaccaggccacggacatagccattccggccaggggcctatcctgtcagtcggtctctgggtcctgtcagggatagtggcttttctggtcgtcgagaaattcgtaagacatgtgaaaggaggtcatggccacagtcatggtcacgggcatgcccactctcatacacgtgggtcccacggacacgggagacaggagagatctacgaaggaaaagcagtcatcagaagaggaagaaaaggagacgcggggcgtacagaagagaagagggggctcaaccgtcccaaaggatgggcccgtgcgccctcagaatgctgaagaggagaagtag

SEQ ID NO: 206157 - DNA, 1410 bp, Artificial Sequence
  Description of Artificial Sequence: Synthetic coding sequence
atggcccggggcctgggcgccccccactgggtggccgtgggcctgcttacgtgggccactctggggctgttggttgctggccttggcgggcatgatgatctgcatgatgacttacaggaggattttcacgggcattctcacagacacagtcacgaggactttcaccacggtcattcacatgcccacggccatggacatacccatgaaagcatatggcatggtcacactcacgaccacgaccacggtcacagccacgaggacctacatcacgggcactctcatggatacagccacgaaagcttgtaccaccgcggtcacggccacgaccacgagcattcacacggcggctacggagagagtggtgcccccgggatcaaacaggacctggacgccgtgactctgtgggcctacgccttgggagctaccgtcctcattagtgcagcccccttctttgttctgttcttgattccagttgagtccaattctcctagacacagaagcctactgcagatccttctctcctttgcctctgggggcctactgggggacgcattccttcacttgattccccacgcgctggagccgcactcacaccacaccttggagcaacctggacacggacattcccattccggtcagggcccgattctcagcgtgggcctgtgggtgctgtctggcattgtggcgttcctggtcgtggagaagttcgtacgacacgttaagggggggcacggtcatagccacggacatgggcatgcacattcccatacgcgcggctcccatgggcatggacgtcaggagcggagcactaaggaaaaacagtctagtgaggaggaggagaaggagaccagaggggtgcaaaaaaggcgcggaggtagtaccgtgccgaaagacgggcctgtgcgcccccagaacgccgaggaagagaaacgcggactagatctgagggtgtcagggtaccttaatctcgctgccgacctagcccacaacttcacagatggactagccatcggggccagctttcgggggggaagagggttggggattcttactaccatgacagtgctactgcatgaagtgcctcacgaagtgggggacttcgccattctcgtgcagtcaggatgtagcaagaaacaagcgatgcgtctgcagctcttaaccgcagttggggcccttgccggcacagcctgtgcactacttaccgaaggtggagcggtgggctcagagatcgccggcggagctggcccaggttgggtcctcccctttacggccggggggttcatttatgtggctactgtgtccgtcctgcctgagcttttgcgcgaggcatcaccccttcagagtctcctagaagtgctgggcctgctaggtggtgtgattatgatggtgctgattgctcatctggaatag

SEQ ID NO: 206158 - DNA, 1410 bp, Artificial Sequence
  Description of Artificial Sequence: Synthetic coding sequence
atggcccggggcctgggcgccccccactgggtggccgtgggcctgctcacgtgggccacattaggcctcctggttgcaggcctgggtggccatgacgatctacacgacgatcttcaggaagatttccacggacactcccatcgccactcacatgaggattttcaccatggccacagccatgcacacggacatgggcatactcacgaatccatctggcacggacacacccacgaccatgaccacggacactcacatgaagatttgcaccatggtcacagccacggttactcacacgaatccctttaccacagaggtcacggccacgaccacgaacactctcatggcggatatggggaatctggggccccgggtattaagcaagacctggacgccgtcacactgtgggcatacgcgcttggcgcaacagtgctgatcagcgctgcacccttcttcgtcctgtttctgattcccgtggagtcgaatagtccacggcaccggtcacttctccaaatcctcctgagcttcgcttctggaggactcctcggcgacgcttttttacatctaataccacacgctctggaacctcattcgcatcataccttggagcagcccggccacgggcattctcacagtggccaaggtccaatcctgagcgttggcctgtgggttctcagtgggatcgtggcttttctcgttgtcgagaagttcgtgcgccacgttaaggggggacatgggcacagtcatggccacggacatgcacacagccacaccagagggtcccatgggcacggccggcaggagaggagtaccaaagagaaacagagttcggaagaggaggaaaaagagacccgaggagtgcagaaacggaggggaggttccactgtgcccaaagatgggccagtacgcccccagaatgccgaagaggaaaaacgtgggcttgatctgagggtgtcaggatacctgaacctggcggccgatctagcccataatttcaccgatgggctcgcaattggcgcctccttccggggcggccgcggcctgggcatactgaccaccatgacagtcctgctgcacgaagtgccgcacgaggtgggcgactttgccattctggtccagagcgggtgtagcaaaaagcaggctatgcggctccaactattgaccgccgtgggcgctttggcaggcaccgcttgcgctcttttgacggaaggtggcgctgtggggagcgagatcgccggcggcgctggacccggctgggtgctgccattcactgccggaggtttcatttatgtcgccacagtgagtgttctgccagagttacttagagaagcttcacctctccagtcactcctggaggtcctgggtttacttgggggagtcattatgatggttctgatcgcccaccttgaatag

SEQ ID NO: 206159 - DNA, 1410 bp, Artificial Sequence
  Description of Artificial Sequence: Synthetic coding sequence
atggcccggggcctgggcgccccccactgggtggccgtgggcctgctgacatgggctaccttaggtcttctcgtagctgggctgggcggacacgacgatttgcacgacgacctgcaggaagattttcacggacatagccatagacattcacacgaagactttcaccacgggcactctcatgcacacggccatggccacacccacgagagcatctggcatggtcatacacacgaccatgatcatggccacagccatgaggatctccaccacggtcactctcacgggtatagtcacgagtcattataccatcgcggccatggccatgatcacgaacatagtcatggaggatatggcgaatccggagctcctggcattaaacaggatcttgacgcagtgacactgtgggcatacgccctgggcgcgacagtccttatttcagctgctcccttttttgtgctgttcctgatccctgtcgaatcaaattctccacggcaccgttccctactccagatactgctatccttcgcttcagggggcttgctcggagacgcattcctccatctcatcccacatgctctcgaacctcatagccatcacacgctggagcagccaggccatggtcactctcacagcggccagggccctatcctcagcgtgggcctgtgggttttgagtgggatcgtcgcttttcttgtggtcgagaaattcgtcagacatgtcaagggcggccatggccacagccacggtcacgggcacgcgcacagccatactagaggaagtcacggtcacgggcggcaggaaagatcaacgaaagagaagcagtcttccgaggaggaggagaaagaaacccgaggagtacaaaaacggcggggcggttcaactgtgcccaaagacggtccggtccggccacagaatgccgaggaggaaaaaagagggctggacctccgagtctccgggtatctgaacctggcggccgatctcgctcacaactttaccgacggcctggctataggcgccagcttcaggggcggccgggggctcggcatcctcactaccatgacggtactgctccacgaagtcccccatgaggtcggagactttgctattctagttcagagtggctgcagtaagaaacaagccatgcgactccaactcctcactgccgtgggtgccctggcgggcactgcttgtgccctgctgactgagggaggcgccgtggggtccgaaatagcaggaggcgctggccccggctgggttcttcccttcactgctggcggattcatctacgtcgctaccgtctccgtgctgcccgaactgctgagagaagcaagccccttgcagtccctgttggaggtgctgggactgttgggaggggtgataatgatggtccttattgctcacctcgaatag

SEQ ID NO: 206160 - DNA, 663 bp, Artificial Sequence
  Description of Artificial Sequence: Synthetic coding sequence
atggacagcagcctgcccgagtgccggcacatcggcaagggcatccgtgctaaggtagagcgaaattttttattttcacgcgatctgaaggcaggtctgccccgcccttctaagccagggaaggaacgtattccggaacccgctctgggagctactgtcctgatttctgctgctccgttttttgtgctgtttctaatacctgtggaatctaatagccctcggcaccgctccctgctgcagatcctgttatcctttgcttctggaggactactgggcgacgcattcctgcacttaatacctcatgcgctggagccccactcccatcacacacttgagcagccagggcacggccactcacattccggccagggcccaattctttcagttgggttatgggtcctaagcggaatcgtcgccttcttggtcgtcgaaaagttcgttcgccatgtgaaaggtggtcacggccattctcatgggcacggtcacgcccacagccatactaggggatcccacggacatggcaggcaggagcggtctaccaaggaaaaacagagcagcgaggaagaggagaaagagaccaggggagtgcagaaaagaaggggagggtcaaccgtcccaaaagacgggcccgtgcggccacaaaatgcagaagaagagaaatag

SEQ ID NO: 206161 - DNA, 663 bp, Artificial Sequence
  Description of Artificial Sequence: Synthetic coding sequence
atggacagcagcctgcccgagtgccggcacatcggcaagggcatccgggccaaggtagagagaaattttctgttttccagggacctgaaggctggcctccctagaccctccaagccaggcaaggaaagaatccctgagccagctcttggcgccactgtactaatctcagccgcgcccttctttgtactgtttctcattcccgtggagtctaacagtccacgtcaccggtcactgttgcagatcctcctctcatttgcatctgggggactgctcggcgacgccttcctccatcttattccccatgctcttgagccccacagtcaccataccctggagcagccaggccacggacatagtcattctggtcaagggcccatcctgagtgtgggcctttgggtattgtccggaattgtggccttcctggtcgtcgagaaatttgttcggcacgtgaaggggggccatggccacagtcacggccacggtcacgcccatagtcacacaaggggatctcatggccatggaaggcaggagcgcagtaccaaagagaagcagtcctcggaggaggaagagaaagaaactaggggcgtgcagaaaaggcgcggggggtcaacagttcctaaggacggacctgtccgcccacaaaatgccgaagaggaaaaatag

SEQ ID NO: 206162 - DNA, 1410 bp, Artificial Sequence
  Description of Artificial Sequence: Synthetic coding sequence
atggcccggggcctgggcgccccccactgggtggccgtgggcctgctcacctgggcaacgcttgggctgctggtcgcagggctgggcgggcatgacgatctacacgatgatctgcaggaggacttccacggccatagccatcgacatagccacgaggattttcaccatggacactcacacgctcacggacatgggcatactcacgagtcaatctggcacgggcacacacacgatcacgaccatggacattcccacgaggatcttcaccacggccatagtcatggctattcccatgagagcctctaccacagaggccacgggcacgatcatgagcatagtcatgggggctatggagagagcggcgctcctgggattaaacaggatttagacgccgtgaccctgtgggcctacgccctcggcgccacggttctcatatctgcagcgcctttttttgtcttattcctcatcccagtggaaagcaattccccaaggcaccggagcttgctgcagattctactcagctttgcctctggaggcctgctgggcgatgcgttcctgcacctgatcccacatgccctcgagccccactctcaccataccctcgaacagcccgggcacggccattcccactctggacagggccccatactgagcgtgggactatgggtgctgagcggcatagtagcgtttctcgttgtggagaagttcgtgcgccatgttaagggcggccatggtcactcgcacggacacgggcacgcccactcccacactagaggctctcacggccatgggcggcaggagaggagtacaaaagagaaacagtctagtgaagaagaggagaaggaaaccagaggtgtgcagaaacgcagaggagggagcacagttccgaaagatggcccagtgcggccccagaacgcagaagaggagaagaggggactcgacctgagagtatctgggtatctgaatctcgccgctgacctcgctcataacttcaccgacggactggctattggagcctcctttcgcgggggtagggggttgggcatcctgaccacaatgacagttctgctccatgaggtcccacatgaagtaggtgatttcgcgatactggtgcagagcggctgctccaagaaacaggccatgaggctgcagctgctcacggctgtcggtgccctggctggcaccgcctgcgcactcttaaccgagggtggagcagtcggctctgagattgcgggcggcgccgggccgggttgggtccttcctttcacagcgggaggatttatatacgtggcgacagtaagcgtcctcccagaactgctgcgggaggcgtctccattgcagagcctgcttgaggtcttgggacttctcgggggggtgatcatgatggtactgatcgcccatttggagtag

SEQ ID NO: 206163 - DNA, 1410 bp, Artificial Sequence
  Description of Artificial Sequence: Synthetic coding sequence
atggcccggggcctgggcgccccccactgggtggccgtgggcctgctgacatgggctactctggggctgctcgtggccggcctgggaggtcatgatgacttgcacgacgacctgcaggaagattttcacggacattctcacagacacagccacgaggacttccaccacgggcactcacatgcccacggccacggccacactcacgaatcaatttggcacggtcatacccatgatcacgaccacggccacagccacgaggatttgcaccatggacactctcacggatattctcacgagtccctgtatcacagggggcacggtcatgaccatgaacacagtcatgggggttatggcgagagcggagccccaggcatcaagcaggatctggacgctgtgaccttgtgggcttatgccctgggggcaacagtcctgattagcgctgcccctttctttgtcctttttctgattcctgtcgaatccaattctccccgacaccggagtttgttgcagatcctgcttagcttcgccagcggtggcctgctcggtgatgcctttttgcacttgatcccacacgcccttgaacctcactctcatcacacacttgaacagcctggccacggacacagtcacagtggccaggggcctatcctgagtgtcggactctgggtgttatcgggcatcgtggcatttttggtggtagagaaattcgtgcgtcatgtgaaaggtgggcatgggcactctcacggccacgggcacgctcactcccatacccgggggagccatggacatggcagacaagaacggtctactaaagagaaacagagctcagaagaggaagagaaagaaacccggggggtgcagaaacgtagaggaggctcaacggtacccaaagacggacccgtccgcccccagaacgccgaggaggagaaacgaggtttagaccttagagtctcaggctacctcaacctggccgccgacctggcccacaactttaccgatgggctggctatcggtgcttctttcaggggcggtcgcggacttggcattctgactaccatgactgtcctgctgcacgaagtgccacacgaggtaggggacttcgcaatcctggtacagtcggggtgcagtaagaagcaagctatgaggcttcagttattgacagcagtaggggctcttgccggcacagcatgcgccctacttactgagggaggggctgttggttcagagatagcaggaggtgccggccccgggtgggtcctgccttttaccgccggagggttcatctacgtcgccactgtgagcgtgttacccgagctcctaagagaagcctcacccctgcagtctcttctggaagtattgggattattgggaggagtcattatgatggtccttatcgctcaccttgagtag

SEQ ID NO: 206164 - DNA, 1410 bp, Artificial Sequence
  Description of Artificial Sequence: Synthetic coding sequence
atggcccggggcctgggcgccccccactgggtggccgtgggcctgctgacctgggcaaccctgggacttctcgtggcagggctgggcggccacgatgatttgcatgacgatctgcaagaggactttcacgggcactcccacaggcattctcatgaagattttcatcacggccactcccatgcccatggccacggtcatactcacgaatctatctggcacggccatacacatgaccacgatcatgggcattctcatgaggacctccaccatggacactctcacggctacagtcacgagagtttgtatcacagagggcacggccatgatcacgagcactcccatggaggctacggcgaatcaggagcgcccggaatcaagcaagatctggacgccgtgaccctgtgggcttacgcgctgggcgcaaccgtactcataagtgccgcccctttctttgtgctgtttttgatccctgtagagtcaaactctcccagacatcggtcgctgctccagattctgctgagtttcgcctccggaggacttctgggagatgccttcctgcacctgatccctcacgccctggagccccactcacatcacacactcgaacagcctggccacggccacagccactctggtcaggggcctattttgtccgtcgggctctgggtgctgagcgggatagtcgccttcctcgtggtagaaaaatttgtgaggcatgttaaaggtggccatggacactctcacggccacggccatgcccattcacacactaggggaagccacggacatggtcgacaagagcgcagtaccaaggaaaaacagtcctcggaagaggaagaaaaagagactcgcggtgtgcaaaagcgaaggggcggcagcactgttccaaaggacggtccagtcagaccgcagaacgccgaggaggaaaaacgcggcctcgatttgcgcgtgtctggataccttaacctcgcggccgacctcgcgcacaatttcactgacgggctggccattggggcgagttttagggggggacgcgggctggggattctgactactatgacggtcctgcttcatgaagttccacacgaggttggggatttcgcgatcctcgtccagtccggctgctccaagaagcaggctatgcggctgcagcttctgacagctgttggagcccttgccggcaccgcttgtgccctcctgacggaaggcggggctgtcggaagtgaaatcgccggcggagccgggccaggatgggtgctgccttttacagccggcggctttatatacgtcgccaccgtaagtgttctgcccgagctgctgcgggaggcaagccccctgcagtcgctattggaggtgttaggtctccttggaggggtcattatgatggtgttgatcgcccaccttgagtag

SEQ ID NO: 206165 - DNA, 1410 bp, Artificial Sequence
  Description of Artificial Sequence: Synthetic coding sequence
atggcccggggcctgggcgccccccactgggtggccgtgggcctgcttacatgggccacactgggcctgcttgtggctggcctgggggggcatgacgacctgcatgacgatctgcaagaggactttcatgggcacagtcacaggcactcacatgaggatttccaccacgggcattcacacgcccacggacacggccatacacatgagtccatctggcacgggcatactcatgatcacgaccatggccacagccatgaagacctccaccacggccacagccatggctatagtcacgaaagtctctatcaccgcggacatggtcacgaccatgaacatagccacggcggttatggagagtcaggcgctcctggaattaagcaggatctggatgctgtgaccctgtgggcatatgccctgggcgccactgtgctcataagtgccgcaccattttttgtgctgtttctgattccagtggagtccaactctccgcgtcatagaagcctgctccagatattgctctcatttgcctccggggggctcctgggggacgcattcctacatcttattccacacgccttggagccgcactctcaccacactctggagcagcccggccacgggcactcacattctggacagggtcccattctaagtgtgggtctctgggtgctgtctgggatcgtagcttttctcgtggttgaaaaatttgtccggcatgttaagggtggccatggccactctcacggccacggacacgcacactcccacacaaggggatcacacggccacggcaggcaggagcgaagtactaaggagaaacagagttcagaggaagaggagaaagagaccaggggcgtgcagaagaggcgcggggggtctaccgtgccgaaagatggcccggtgcggccacagaacgctgaggaagaaaagcgggggctcgacctgagagtgtccggctatctaaatctagccgcagacttagcccacaatttcactgacggtctggcaatcggggcatccttcaggggcggtcgtggtttgggcattttaaccacgatgacagtcctgctgcatgaagtaccacacgaggtgggcgattttgcaatcttagtacaatccggctgtagcaagaagcaggctatgaggctgcagctgctcacagccgttggtgcacttgcggggactgcttgcgccctacttactgaaggtggggctgtgggcagcgaaatcgctgggggcgccggtcctggctgggttctgcccttcaccgctggcgggttcatatacgtggccaccgtgagcgtgctccctgaattgctgagggaagcaagccctcttcaatccctgctggaggtcctaggccttctcggcggcgtcataatgatggtccttattgcccacctggagtag

SEQ ID NO: 206166 - DNA, 663 bp, Artificial Sequence
  Description of Artificial Sequence: Synthetic coding sequence
atggacagcagcctgcccgagtgccggcacatcggcaagggcatccgcgctaaagtagaaaggaatttcctctttagtagagatttgaaggccggccttcctcgtcctagcaaaccaggcaaggagagaattcccgagcccgccctgggcgcaaccgtacttatctccgctgcccccttttttgtgctctttctcattcccgttgagagcaactcccctagacaccgctcactgctgcagattctcctgtcattcgccagcggcggcttattaggagacgcgttcctgcacctcattccccacgctcttgagccccactcccaccatacactcgagcagccaggccatggacactcccattcgggccagggaccaatcttgagcgtgggcctttgggtcttgtcaggcattgttgcgttcctagtcgtggagaagtttgttcgacatgtgaaagggggccacgggcacagtcacgggcacggacatgctcacagccacactcgaggatctcatggccatggccggcaggagcgctctactaaggaaaaacaaagttcagaagaagaagaaaaggagacccgcggagttcagaaaagacgagggggatcgacggttcccaaagacggacccgtcaggccccagaacgctgaagaggagaagtag

SEQ ID NO: 206167 - DNA, 1125 bp, Artificial Sequence
  Description of Artificial Sequence: Synthetic coding sequence
atggcccggggcctgggcgccccccactgggtggccgtgggcctgctgacatgggccacccttgggttgctcgttgcgggccttggcgggcatgatgaccttcacgacgatctccaggaggacttccacggtcattcccatagcgccgacttaagcagcagcatcttttgccccctaccatacccccgcggcgttgaactgtctcctgcatccttgtcaacttccgatttagcccaattctgttttcgctgggccccagggaggtgtttcctgcacctgatccctcatgccctggagccccactctcatcacacccttgagcagccagggcatggtcactctcactccggacaaggtccaatcctgagtgttggcttgtgggtcctaagcggaatagtggcttttctggtggtggaaaaatttgttaggcacgtaaaaggcggtcatggacactctcatgggcacggacacgctcactctcacacccgaggttcgcatgggcacggacgtcaggagagatcgaccaaagagaagcagtcaagcgaggaggaagagaaggagactaggggcgtccagaaaaggaggggaggctccacggttccaaaggatgggccagttaggcctcagaatgctgaagaggagaagcgtgggcttgacctgagagtgagcgggtatctgaatttggcagccgatctggcccacaactttacagatggactcgctatcggcgcgtcgttcaggggtgggagagggcttggcatcctcaccactatgaccgtgctactgcatgaggtcccgcacgaagtcggcgattttgcaatcctggtgcagagcggttgttccaaaaaacaggctatgaggctacagttgctgaccgccgtgggggctttggccggaacagcttgtgcactgctcacagagggtggagccgtgggctccgagatcgcagggggggcggggcccggctgggtgctcccgttcactgccggcgggtttatttacgtcgccaccgtgtcggtactgccagagttgctccgggaagcatcaccactccagtccctgctggaggtcctcgggctgcttggcggggtgataatgatggtactgatcgcccaccttgagtag

SEQ ID NO: 206168 - DNA, 1353 bp, Artificial Sequence
  Description of Artificial Sequence: Synthetic coding sequence
atggcccggggcctgggcgccccccactgggtggccgtgggcctgcttacatgggcaactctgggactgttagttgccggactcggaggacacgatgacttacatgacgatctgcaagaagatttccatggacatggccacacccacgagagtatctggcacgggcacactcacgatcacgatcacggacatagtcatgaggatcttcaccacggccatagccatggctattcacacgaatctctgtaccaccgcggtcatggccacgaccacgaacatagccatggcggttacggggagagtggcgcccctgggattaaacaggaccttgatgccgtgaccctgtgggcctatgcgcttggcgcaacagttcttattagcgcagccccctttttcgtgctgtttctcatccctgtcgaaagcaattcaccccgtcacagaagcctcttgcagattctactgagcttcgctagcggtggtctgctcggcgatgcctttctgcacctcattcctcacgctttggagcctcatagccatcacacattggaacagccagggcacgggcactctcatagcgggcagggccctatcctgtcagtgggactgtgggtgctcagtggaattgtcgcgttcctggtcgttgaaaaattcgtgcgtcacgtgaagggaggacatggtcactcccatggtcacggccatgctcacagccacacaagaggctcccatgggcacggtcgccaagagagatctacgaaggaaaagcaaagtagcgaggaagaagagaaagaaactcggggcgtccagaagcgccgaggcggcagcactgtgccgaaagacgggcccgtcagaccccagaatgctgaggaagagaagagggggctggacttgagagtctcgggctatcttaacttagctgccgacctcgcccacaactttactgacggcttggccatcggcgctagcttccgggggggcaggggcttgggcatattaacgactatgacagtacttcttcatgaggtcccccatgaagtcggtgactttgccattcttgtccaaagtgggtgctccaaaaaacaggctatgcggctgcaactgctcactgccgtgggagcacttgcaggcaccgcttgcgccttgttgaccgaggggggcgccgtcggttccgaaatcgcagggggggccggacctggctgggtattgcccttcactgcaggcggatttatttacgtcgcaaccgtaagcgtcctgccagagctattaagagaggcttctcctttacagtctctccttgaagtgttaggtctactcggaggcgtgatcatgatggttttgatcgcccatctggagtag

SEQ ID NO: 206169 - DNA, 663 bp, Artificial Sequence
  Description of Artificial Sequence: Synthetic coding sequence
atggacagcagcctgcccgagtgccggcacatcggcaagggcatcagagctaaggtcgaacgaaacttccttttctccagggacctcaaggcgggcctgccaaggcccagtaaacctggcaaagaacggatacctgaacccgctctcggcgccacagtgctgatctccgctgcccctttcttcgtgctttttctgatacccgtggagagcaactcacctcgacacaggagcttgttgcaaattctgctgtcgtttgcctcgggaggccttctgggcgacgctttccttcatctcatcccacacgccctcgaacctcacagtcaccatacactggaacagcctggccatggacactcacattcaggtcaaggccccatattgtcagtcgggctgtgggtcctgtccggcatcgttgcattcctggtggtggaaaaatttgtgcgtcatgtgaaggggggacacgggcactcgcacggtcacggccatgcacattcacatacccgcgggtcgcacggtcacggtcgacaggaaaggagtactaaggagaagcagtcgtctgaggaagaggagaaggagactcggggggtgcagaagcgacgcggaggttctactgtcccgaaggacggacctgtgcggcctcagaacgctgaagaggaaaagtag

SEQ ID NO: 206170 - DNA, 1410 bp, Artificial Sequence
  Description of Artificial Sequence: Synthetic coding sequence
atggcccggggcctgggcgccccccactgggtggccgtgggcctgctcacctgggctacccttggcctactcgtggccggcctgggagggcatgacgatctgcatgatgatttacaagaggacttccatggccatagccaccgccatagccacgaagattttcatcatgggcattctcacgctcacggccacggccacacccatgaaagcatctggcatgggcacacacacgaccacgaccatggacacagccacgaagatctgcaccacggtcattctcacggctattcccacgaatctttatatcatagagggcacggacatgaccacgagcattcccacggcggctacggagagtccggagccccagggatcaagcaggacctggatgctgtgaccttgtgggcatatgccctcggggctacagtgctcattagcgcagctccctttttcgttctcttcctgatccccgtggagagcaatagcccaaggcaccggtctttgttacaaatccttttaagcttcgcatctggggggcttctcggggacgcctttctgcaccttatccctcacgccctggagccgcactcacatcataccctcgagcagcccggacacggccatagtcattccggacaaggaccgatcctttcagtgggcctgtgggtgttatccggcatagttgcttttttagtggtcgagaaattcgtcaggcacgtgaaaggtgggcatggccatagccatggtcatggacacgcgcactctcacaccagagggtcccatgggcacggaaggcaggaacggagtaccaaagaaaagcagagcagcgaggaggaagagaaggagacaaggggcgttcagaaacgtcgtggcggcagcaccgtcccaaaggatgggcccgtgaggccccagaacgccgaagaggagaaacgcggactcgatctgagggtcagcggttacctgaacctggccgctgacctggcacacaactttaccgatgggctggccattggtgcatcgttcagagggggtagggggctggggattctgaccacaatgactgtccttctccacgaggtgccgcatgaagttggagactttgccatcctagttcaatcaggctgctcaaaaaaacaggctatgagactgcagttactgaccgccgtcggggccctagccggaacagcatgtgcactgttaaccgaaggcggtgctgtggggagcgagatagctggcggtgcgggccctggctgggtgctacctttcactgcaggaggcttcatttatgtggccacagtcagcgtgctgcctgagttgctgcgtgaggcctcaccactgcaaagtcttcttgaggttctgggtttactgggaggtgtcatcatgatggtcttaattgcacacctcgaatag

SEQ ID NO: 206171 - DNA, 1125 bp, Artificial Sequence
  Description of Artificial Sequence: Synthetic coding sequence
atggcccggggcctgggcgccccccactgggtggccgtgggcctgctcacatgggcaacattaggcctcttggtcgctgggctcggcggacacgatgatttgcacgatgatttgcaggaggatttccatggccacagccatagcgccgacctctcttcctcgattttttgtccactgccgtaccctcggggtgtggagttgtcccctgcatctctcagtacaagtgacctcgcacaattttgtttccggtgggcacccggccggtgctttttgcatctgatccctcacgcattagagccccactctcaccacacactggagcagcccggacatggacacagccattctggacaggggccaattctgtcagtgggcttgtgggtcctctctggtatcgttgccttcctggtagtcgaaaagtttgtgcggcacgttaagggtggccacggacattcacatggacacggccatgcacactcgcatacacgcgggagccacggacacggtcgccaggagcggtcaacgaaggagaaacaatcctcagaggaggaggagaaagagacccgcggggtccagaaaaggcggggcggaagcactgtgccaaaggacggacccgtgcgaccacaaaatgcagaggaagagaagcgtggactggatttgagagtttcaggatatctgaacttggcagcagatcttgcccataattttactgatgggctagccattggtgcttcgtttcgggggggaagaggtctgggtatcctcactacaatgactgtactgctccacgaggttccacacgaagtgggagacttcgccatcctcgttcagtcgggatgttccaaaaagcaggcaatgcgtctgcagctgttaacagccgtgggcgcacttgctgggacagcctgcgccctgttgactgaaggaggcgccgtgggaagtgagatagctggaggcgctgggccaggttgggtgctcccatttaccgctggcggattcatctacgtggccacggtgagtgtccttcctgagctcctgcgggaggctagcccattgcagagtctgttagaggtcctgggacttctcggaggagttattatgatggtactcatcgcccacctcgagtag

SEQ ID NO: 206172 - DNA, 1353 bp, Artificial Sequence
  Description of Artificial Sequence: Synthetic coding sequence
atggcccggggcctgggcgccccccactgggtggccgtgggcctgttgacatgggcaactttgggcctgctggtggcagggctcggtggacatgacgatctccacgatgacctccaggaggatttccacggacatggacatactcatgaatcaatttggcatggccacacgcacgaccacgaccacggccattctcatgaagatctgcatcacgggcacagtcacgggtattcacacgaaagcctataccaccgcgggcacggccacgaccacgagcactcccatggcgggtacggcgagtctggtgcgcctggtatcaagcaagacctggatgctgtgacactgtgggcttacgctttaggcgccactgtgttaatttcagcagccccattcttcgttctgttccttattcccgtggagagtaatagtcctcggcataggtctctgttgcagatcctgctgtcgtttgcaagcggaggactgctgggagatgcatttctgcatctaattccccacgccctggagcctcacagccatcatactctggagcagcctggacatggccattcacacagtggacagggtcctatactgagcgtgggcttgtgggtgctttctggtatagtcgcttttctcgtggttgagaaattcgtccgccatgtcaagggtggccatggccatagccatgggcacggccatgcccatagccatactcgggggtcccacggacatggccggcaggagagatcaaccaaggaaaagcaatcgtcagaggaagaggagaaagaaacccggggcgttcagaagcgtcgagggggttcaaccgtgcccaaagatggtcctgttagaccccagaatgctgaggaagagaaacgcgggcttgacctgagggtctccggatacctgaatttggcggccgatttagcccataatttcactgacggtttagctattggcgcctctttccgaggcggtcggggtttgggaatcctgacgaccatgactgtgctcctgcacgaagtgccgcatgaagtgggggactttgctatactggtgcaatcagggtgcagcaagaaacaggccatgagactgcaattactgactgcagtgggggctttagccggtactgcttgcgctctccttaccgaggggggcgctgtcggaagcgaaatagccggtggagccggcccaggttgggtgttgcccttcaccgccggtgggttcatctacgtggctaccgtgtctgtcttaccggaactgttgcgggaggcatccccattacagtccttgctcgaagtcctgggtctgctgggaggcgtcatcatgatggtgttgatcgcccatctggagtag

SEQ ID NO: 206173 - DNA, 1125 bp, Artificial Sequence
  Description of Artificial Sequence: Synthetic coding sequence
atggcccggggcctgggcgccccccactgggtggccgtgggcctgttaacgtgggcgacgctcggcctcctggtagctggattaggggggcatgatgatctgcatgacgacctgcaggaggactttcacggacatagccacagcgccgatctatcttcctctatcttctgccctctcccatatccccggggcgtggagctcagtcctgccagcctgagcacaagtgatctagctcagttttgtttccggtgggctcctggtcgttgctttctacacctgatcccacacgcccttgagccccacagccatcacacccttgagcagcctggccacggtcattcccattcaggccagggccccatcttgagcgtggggctgtgggtcctgtccggcatcgttgcctttttggttgttgaaaagttcgtccgccacgtgaaaggaggccatggccactcccacgggcacggtcatgctcactcccacacaagggggagccatgggcacgggcgccaggagcgctctacaaaagaaaagcagtcaagcgaagaagaggagaaagaaacacgcggtgttcaaaagcgaagaggcggctcaacggtgccaaaagatggtccagtgaggccccagaacgccgaggaagaaaagcgtggactggaccttagggtttccggatatcttaacctggccgcagacctcgcgcataatttcactgacggactagccatcggggccagttttaggggcgggcgcgggctgggtattctcacaaccatgactgttctgctccacgaggtgccccacgaggttggggactttgccattctggttcagtccgggtgctccaagaaacaggcgatgaggctgcagttgttgacagcagtgggcgcccttgcggggactgcatgtgcgctcctcacagaggggggcgcggtggggagcgagatagctggaggggctgggcccggctgggtgctgccctttacggctggaggattcatttatgtcgccacagtgtccgtcctccccgaactcctgagagaggcatctcctctgcaaagtctcttggaggtgctgggacttttaggaggggtgattatgatggtacttatcgcacacttggaatag

SEQ ID NO: 206174 - DNA, 1125 bp, Artificial Sequence
  Description of Artificial Sequence: Synthetic coding sequence
atggcccggggcctgggcgccccccactgggtggccgtgggcctgctgacctgggccaccttaggcctgctggttgctgggctgggggggcacgacgatttgcatgacgacctacaggaggattttcatggccacagtcatagcgctgatctgtcttcgagcattttttgcccactgccatacccaagaggcgtcgagctgtcaccagccagcctttccacttcagatcttgcccagttttgctttcgatgggccccaggcaggtgctttctgcatctgatcccccacgcattggagccgcattcgcaccacacgctggaacaacccgggcatggccattcacacagtggacagggtcctattctgagcgtgggactgtgggtacttagcggtattgttgcgtttttggtggtggagaaatttgttcgccacgtgaagggtggtcacgggcattcccatgggcatggccatgcccactcacatacccgcggtagccatggccatgggagacaagagaggagtaccaaggaaaagcagtccagcgaggaggaggagaaagaaacaagaggagtacagaaaagacgcggagggtcaactgtgccaaaagacggccctgtgagaccacaaaacgccgaggaagagaaaagaggcttggaccttagggtgagcggttatctcaatttagccgctgatctggcccataacttcacagatggccttgctataggtgcctccttccgcgggggacgcgggctcggcattttgacaaccatgactgtactactccacgaggtcccacacgaggtcggggatttcgctattctcgttcagtctgggtgcagcaagaagcaggctatgcgtcttcaactcctgaccgcagttggcgccctggccgggaccgcgtgcgctctgctcactgaggggggtgcagtcggttcagagattgccggtggcgctggcccgggctgggtattgcccttcactgccggagggttcatttatgtggcaaccgtctcagttctgcctgaactgctgagagaagcaagcccccttcagagtcttctggaagtgctgggtttgcttggcggagtgattatgatggtccttatcgcccacctcgagtag

SEQ ID NO: 206175 - DNA, 1353 bp, Artificial Sequence
  Description of Artificial Sequence: Synthetic coding sequence
atggcccggggcctgggcgccccccactgggtggccgtgggcctgctgacatgggccaccctcggtcttctagtcgctggtctgggggggcacgatgaccttcacgatgacttgcaggaagattttcacgggcacgggcacacccacgaatctatttggcacggccacactcatgatcatgatcacggacactcacatgaagatctgcatcacggtcacagtcatggttattctcatgaatccttataccatagaggacacggtcacgatcacgagcatagtcacggaggctacggggagtccggagctcccggtatcaaacaagatttggacgcggttactctgtgggcctacgccttgggcgcaaccgttctgatcagcgccgctccttttttcgtgctgttcctcataccagtagagtccaactctccccgccacagaagcttactgcagatcctgttgagctttgcctctggaggactgctgggcgatgcctttcttcatctcattccccatgcgttggagcctcattcccatcatacattagagcaaccaggccacgggcactcccactccggccaaggtcctatcctttccgtaggtctgtgggtcctcagcggcattgtggcctttcttgttgtggaaaagtttgtgaggcacgtcaaaggtggacacggccactctcatgggcatggacatgcccatagccacactagggggagtcatggacacggcagacaggaaaggtctactaaagaaaaacagtcttccgaagaggaagagaaagagactaggggcgtgcaaaaaaggagaggtggaagcaccgtaccgaaggatggacctgtgcggccacaaaatgccgaggaggagaaaagaggtttggacctacgggtgtccggataccttaacctcgctgcagacctggctcacaattttaccgatggcctggcaataggggccagcttcagggggggtcggggcctcggcatattgaccaccatgaccgtgcttctccacgaagttccccatgaggtgggggacttcgccattctcgttcagagtggatgctctaagaagcaggctatgaggctccaacttctgacagccgtgggggcactagccggcactgcatgtgctctgctcaccgaggggggggccgtggggagcgagattgctggaggcgccggcccgggctgggtgctgccatttactgccggtggcttcatttatgtggcaactgtctccgtattaccagagctgttgcgagaggcgtctccacttcaaagcctgcttgaggtacttgggcttcttggaggagttatcatgatggtcttgattgcccacctagagtag

SEQ ID NO: 206176 - DNA, 1353 bp, Artificial Sequence
  Description of Artificial Sequence: Synthetic coding sequence
atggcccggggcctgggcgccccccactgggtggccgtgggcctgctcacttgggctaccttagggcttctggtggctgggctgggcgggcacgacgatctgcacgacgacctccaagaggactttcatggacacggccacacacacgaatcgatatggcacggacatacacacgaccacgaccacggacatagtcatgaggacctacatcacgggcactcacacggttattctcatgaaagcctataccaccgaggacatggacacgaccacgaacacagtcacggaggttatggcgaaagcggcgctccggggatcaaacaggacctggatgctgtgaccttgtgggcgtatgccctgggagctaccgtcctgataagtgccgcccccttttttgtgctgttcctaattcccgttgaatcaaattcgcctcggcacaggtccctactgcagattctgctgagtttcgccagcggcggtttgctgggcgatgccttcctgcatttgattcctcacgccttagagcctcacagccaccacacgttggagcagcccggccatggccacagccattctggacagggtccaattctttcagttggcctctgggtactctctggcattgtcgcattcctggtggtcgagaagtttgtgcgccacgtgaagggagggcacgggcactctcacggacatgggcacgctcatagtcacacccgcggttcccacgggcacggacggcaggagcgatctaccaaggagaagcagtcttccgaagaggaagaaaaagagactagaggcgttcagaagagaaggggtgggtccacggttccaaaagacgggccagttcgcccccagaatgccgaggaagaaaagagagggctcgacttgagggtgtcaggatatctcaaccttgccgccgacctcgcacataatttcactgatggactagccatcggggcttcttttcggggcgggagagggctgggcattctaacaactatgaccgttctgctccatgaagtaccccacgaggttggcgattttgcaatcctggtgcagagcggatgcagcaaaaagcaggctatgcgcctgcagcttctgacggcagttggggccctcgctgggactgcttgtgccctcttgacggaggggggggctgtgggaagcgaaatagccgggggagctggtcccggctgggtgctgccttttaccgccgggggattcatctacgtcgccacggtgtccgtgctccccgagttactccgcgaggcgagtcctctgcagtctctgctggaggtgttgggcctcctgggcggtgtcataatgatggtactcatcgctcatctggagtag

SEQ ID NO: 206177 - DNA, 1125 bp, Artificial Sequence
  Description of Artificial Sequence: Synthetic coding sequence
atggcccggggcctgggcgccccccactgggtggccgtgggcctgttgacttgggcgactctgggtctgctggtcgctggtctgggaggacatgacgatctgcacgatgatctgcaggaggactttcatggacacagccattcggccgatctgagttcgtcaatcttctgtcccctgccttatcctcgtggggtggaactgagcccagcgtctcttagtacgagtgacttggcacaattctgcttccgctgggcccctggtagatgcttcctgcaccttatcccacatgccttggaaccacactcacaccacactcttgaacagcctggccatgggcattcacatagtggtcagggccccatactgtcggtggggctctgggtgctgtcagggatcgtggcatttctggtggtggaaaaatttgtccgccatgttaaaggggggcatggtcacagccatggccacggtcacgctcactctcacacaagaggtagccacggccacggcagacaggagcgtagcactaaggaaaaacagagttccgaagaggaagagaaagagacaaggggagtgcagaagcgcagaggcggctccacggtgccaaaagatgggcccgtgagaccgcaaaatgccgaggaggaaaaacggggactagatctgcgggtgtccggctacctgaacctggccgctgacctggcccataacttcaccgacggtttagcaatcggggcctcttttcggggcggccgggggctgggcatactgactacgatgaccgtgttactgcacgaggttccacacgaagtcggggactttgcgatcctggttcagtctggatgttcgaagaagcaggctatgaggcttcaactgttaactgcagtgggtgcccttgccggaacggcgtgtgctctcctcacagaaggcggagcagtggggtcagaaatcgctggcggagcgggtcccggatgggtgctcccgttcactgccgggggttttatctatgtggcgaccgtgtctgtgttgccagagttgctgcgagaagcaagtcctttacagtctctcctggaggtgctgggcttgctggggggcgtgattatgatggtcctgatcgcacatcttgagtag

SEQ ID NO: 206178 - DNA, 1353 bp, Artificial Sequence
  Description of Artificial Sequence: Synthetic coding sequence
atggcccggggcctgggcgccccccactgggtggccgtgggcctgctgacctgggcgaccttgggtctgctggtggctgggctcggcggacatgacgatctgcatgacgaccttcaggaggattttcatggtcatggccacacacacgaatctatctggcatggtcatacacatgaccacgaccatggacacagtcatgaagatctccaccatggccactcacacggatacagccacgagtctctttaccatagaggacatgggcacgaccacgagcactctcatggagggtatggagagtcaggagcaccaggcattaaacaggacctggacgcggtgactttatgggcttatgctcttggggccacagtcctaatctcagccgctcccttctttgtgcttttcttgatccccgtggagagcaactctccgcgccaccgttccctattacagattctcctgagcttcgctagcggtgggttgctgggcgacgcttttctgcatctgatcccccacgcacttgagccgcactcccaccacaccctggagcagcccggacacgggcactcccatagcggccaggggcctatcctctctgttggcctgtgggttctcagcggcatcgtggcgttcttggtggtagagaagtttgtaagacatgttaaaggaggtcatggtcactcgcacggccacgggcacgcccatagccatacgcggggcagccatggtcacgggcgccaggaacggtccaccaaagaaaagcagtcctctgaagaggaggagaaggaaacaagaggagtgcagaaaaggcgcggaggatccaccgtccccaaggacggacccgtgcggccccagaatgccgaggaggagaaacgcggtctcgacttacgcgtgagcgggtacctgaacctcgcggccgaccttgcacataatttcactgacggtttggctataggagcatccttcaggggaggaagagggctcggtattctgacaaccatgactgtgctgctccatgaggtgccccacgaagttggagactttgccattctggtgcagtctgggtgctcaaagaagcaagccatgcggctccaacttctaacagcagttggcgcccttgctggaactgcgtgcgccctgttgactgagggcggggccgtgggtagtgagatagccggaggcgccggccccggctgggtgcttccattcaccgcagggggcttcatctacgtcgcaacagtctcggttctgcccgaactgctccgggaagcttccccgctccagagtctgctggaagtgctgggcctgctgggcggagtcatcatgatggtgctgatcgcacatctggagtag

SEQ ID NO: 206179 - DNA, 1353 bp, Artificial Sequence
  Description of Artificial Sequence: Synthetic coding sequence
atggcccggggcctgggcgccccccactgggtggccgtgggcctgctcacatgggcaacactcgggctgttggtggcgggtctgggcgggcacgacgacctccatgatgatctgcaagaggatttccatggccacggacatacacatgaaagcatatggcatggccacacgcacgatcacgaccacggtcattctcacgaagacctgcaccatggccattcccacggttacagccacgagagcctgtaccaccgaggacacgggcacgatcatgagcatagtcacggaggctacggggagagcggtgctcctggcatcaagcaggatctggatgcagtgacactgtgggcatacgcactgggcgctacagtgttaatctctgccgctccttttttcgtgcttttcctcatcccagtggagtctaatagtccacgccacaggtcactactgcagattttgctgtcatttgcatccggaggcctccttggcgatgcgtttctgcatttgataccccatgccctggagcctcacagtcatcatacacttgaacagcctgggcacggccacagtcactctggtcagggacctatactttctgttgggctgtgggtgctctccgggatcgtcgctttcctagttgttgaaaaattcgtgaggcacgtgaaaggtgggcatggacactcccacggccacggccacgcgcacagccacacgagggggtcccacggccacgggcgacaggagagaagcaccaaggagaaacagtcttcagaagaagaggaaaaagaaacacggggcgtacaaaaaaggcggggtggttcaaccgtccccaaagacggccctgttcgcccccagaatgccgaggaagagaagcggggcctggacctccgcgtgtctggatacctaaacttagcagccgacctggcacataattttacagatggactggcgatcggcgcttcctttaggggcggtagaggacttggcattttgacaacgatgactgtacttttgcacgaggttccccatgaagtaggggatttcgcgattttagtgcagtccggctgctctaaaaaacaggccatgcggttacaacttctgaccgccgtgggtgccctggccggtaccgcttgcgctcttctgacagaggggggggctgtcgggtcggaaatagccggtggcgccggtccaggctgggtcctcccttttaccgcaggcggatttatttacgtagctaccgtctctgtgctaccagaattgctgagagaggcctccccactgcagtccctactcgaggtccttggcctcctgggcggggttataatgatggttctaatagcgcacctggaatag

SEQ ID NO: 206180 - DNA, 1125 bp, Artificial Sequence
  Description of Artificial Sequence: Synthetic coding sequence
atggcccggggcctgggcgccccccactgggtggccgtgggcctgctgacctgggccacgctcgggctattagtcgccggcctgggagggcacgacgatctgcacgacgatctccaggaagattttcatggtcattcccatagcgccgatctgtccagctctatcttctgcccccttccatacccaagaggcgtggagctatcaccagcttctctcagtacctctgacttagctcaattctgtttccgctgggcccctggaaggtgttttctccacctaattccccacgctctcgaacctcacagccaccatacgcttgaacagcctgggcatgggcatagccattcagggcagggacctattttgtcagtcgggctgtgggttctgagtggtatcgtcgcctttctcgtagtcgagaagtttgtgcgccatgtgaagggcggacatggacactcacacggccacggtcacgctcattctcacacacgtggctcacatggtcacgggaggcaagagaggtctactaaggagaagcagtcaagcgaagaggaggaaaaggaaaccaggggggtgcagaaacggcgtggcggcagtacagtgcctaaggatggcccggtgcgcccccagaacgccgaagaagaaaagcgcgggcttgatctgcgggttagcggatatcttaatctggcagccgatctggctcataatttcacggatggcctggcaatcggagctagcttccggggaggacgcggactggggatactcacaacgatgacggtcttgcttcatgaggtaccccacgaagtgggagattttgccatactggtgcagtccggctgcagtaaaaagcaagccatgagactccaactcctgacagcagtgggcgctcttgccggcactgcatgcgccctcctgacagagggcggcgcggttggatctgagatcgcagggggagccggacctggatgggtgctgcctttcaccgcaggtggattcatttacgtggccactgtgagcgtgcttcctgaattactcagagaagccagtcctctgcagtcactattggaagtactgggcctcttgggtggcgtaataatgatggtgttgatcgcccacctggagtag

SEQ ID NO: 206181 - DNA, 2391 bp, Artificial Sequence
  Description of Artificial Sequence: Synthetic coding sequence
atgctggcccccctgcggaacgcccccggccgggagggcgccacctctccaagccccccgaccgacgccaccggctcactaggcgaatgggatgtcgatcggaatgtaaaaacggaggggtgggtctcgaaagagagaatctcaaaactgcataggttgcggatggctgatattttgagccagagcgagacactggcttctcaagacctatctggggacttcaagaagcccgcgcttcccgtgtcccctgcagcccggtctaaggcaccagcctcctcatcttctaaccccgaggaagtccagaaggagggtcccacggctttgcaggattcaaacagtggcgaacctgatatacctcctccgcagcccgactgtggcgattttcgctctctacaagaggagcagtctcgcccaccaacagcggtctcttcaccagggggtcctgcgcgagcaccgccataccaggagcccccctggggtggcccagccactgcaccatactccctggagactcttaagggagggacaattctgggcactagatctttgaaggggacgtcatattgcctgtttggacgattatcgggttgtgacgtatgtcttgagcatcccagtgtgtctaggtatcatgccgttcttcagcatcgggcttccggcccggatggtgaatgtgatagtaacggacccggcttctacctgtacgatctggggtccactcacggtacgttcttgaataagacgcggatccctccaagaacatactgccgagtgcatgtgggacacgtcgtgcgtttcggaggttcaactcgcttgttcatccttcagggtcccgaggaggaccgggaagcagaatctgaacttacagtcacgcagttgaaggaactacgtaaacagcagcagattttgctagagaaaaaaatgctgggagaagactccgatgaggaggaggagatggatacttccgagcgaaagattaacgctggaagtcaggatgacgagatggggtgcacatggggcatgggagaggacgccgttgaagatgatgcagaggagaaccccattgtgttagagttccagcaagagcgagaagcgttttatatcaaggacccaaaaaaagccctacaggggttcttcgatcgcgaaggggaggagctggagtacgagttcgatgagcaaggacattccacatggctctgccgcgtcagactcccagtagacgatagcactgggaagcagctggttgccgaagccatacatagtgggaaaaaaaaggaggccatgatccagtgctcactggaagcctgccgcattctggacaccctaggcctactgcgccaagaagcggtctctcgtaagcggaaggctaagaattgggaagatgaagacttctacgactccgacgacgacacttttttggatagaactggacttatcgagaaaaaacgtctgaatcggatgaaaaaggcggggaaaatagatgagaagcctgagacttttgaaagcctcgtagctaagcttaacgacgctgaacgcgagttatctgaaataagtgaaaggttgaaagcaagttcacaagtgctgtccgaaagcccgtctcaagactcattagatgctttcatgtcggagatgaaatccggtagtactctggatggcgtctccaggaaaaaactgcacctgagaactttcgagctcagaaaagaacaacagaggcttaaaggtctgataaagatcgtcaagccagccgagattccagagttgaaaaaaaccgaaacacagactaccggagcagaaaataaagcaaaaaagctcacgctgcccctcttcggagctatgaaaggggggagcaagtttaagctcaagaccggcactgtggggaagttgccacctaaacgacctgagctgccacctaccctcatgagaatgaaggacgagcccgaggttgaggaagaggaggaagaggaagaggaagaagaaaaggagaaggaggaacacgagaaaaagaagctcgaggatggctcactctcaagaccccaacccgaaatcgagcccgaggcggccgtgcaggagatgcgcccacccaccgacttgacgcacttcaaggaaacacagacacacgagaatatgtctcagttgagtgaagaagagcagaataaggactaccaggactgtagcaagaccacgagtctctgcgcaggcccaagtgctagtaagaacgagtacgagaagtccagaggagaattgaaaaaaaaaaagacaccggggccagggaaactgcccccaactctcagcagcaaataccccgaggacgatcccgattattgcgtgtgggtgcctcctgaaggccagagcggcgatggtcggacacacctcaacgataaatacggctattag

SEQ ID NO: 206182 - DNA, 3699 bp, Artificial Sequence
  Description of Artificial Sequence: Synthetic coding sequence
atggacttcctgctgcggccccagcccgagcccgagagcctgggcccaggaacacccggctttccagagcaagaggaagatgaactgcatcgaaccctgggcgtcgaaagatttgaggaaatcttgcaagaggcgggcagtaggggtggcgaggagcccggacgttcctacggggaggaggacttcgaataccacagacagtcgtcccaccacatccaccacccactctccacccaccttcccccggatgcgagaagaagaaagacccctcagggcccagggcgcaagccccggagaaggccgggagcctctccaaccggagagaccccgaccatcgaggagggcgaggaggacgaagacgaagcctccgaggctgagggggctcgggccctgacccagccatcaccagtaagcacgccgtcctccgtgcagttcttcctgcaagaagatgattcggcagatcgaaaagccgagaggacatcgccatctagtcctgcgcccctgcctcaccaggaggctacacctcgggcgtctaaaggcgcccaggcaggaacacaagttgaggaggccgaagctgaagccgtggcggtcgctagcgggacagcaggaggtgatgatggcggcgcaagcggccggcctttaccaaaagcgcagccagggcaccggtcttataacctgcaggagagaagacggatcggcagcatgacaggagccgaacaggccttgcttcccagagtgccaaccgatgagattgaggcccaaacactggctaccgctgatctggaccttatgaagagccataggtttgaggatgtgccaggtgtgaggagacatctggtgcggaagaatgcaaaagggtctacacaaagtggtagagaagggagggagcctggtccgaccccccgggccaggcctcgggctccccataaaccgcatgaggtgtttgtggaattgaacgaactgctgctcgacaaaaaccaggagccacaatggagggagacagcaaggtggatcaaattcgaagaagacgttgaggaagagactgaaagatggggcaagccccacgtggcatccctttctttcaggtctctgctggagctgaggcgcaccctcgcccatggagccgtccttctggaccttgatcagcagactctgccgggagtggcgcatcaggtagtggagcagatggtcatctcggaccagatcaaagccgaggatagagccaatgttctgcgggcgctactgttgaagcatagccatcctagcgacgagaaagatttctccttccccaggaacatatcagccggttcgcttgggagcttattggggcatcatcacgggcaaggggccgagagtgatccacatgtgactgaaccactgatgggaggtgtacctgagacgcgactcgaagtggagcgcgagagggagctgcccccacccgcaccccctgccggcatcactcggtctaagtctaaacacgaactgaaactgttagaaaagattcctgaaaacgccgaagcaacagtggtgcttgtgggttgcgtggaattcctatccagacctacaatggccttcgtgcgcctgagagaggcagtggagctggatgctgttttagaggtgcccgtgcccgttagatttttatttcttctgctcggtccgtcctccgccaacatggactatcacgagatcggccggtccataagcactcttatgtccgacaaacagtttcacgaagctgcatatctggccgacgaaagagaagacctgctgacagctatcaatgcgttcctggattgctcagtggtgctgccgccctctgaagtccagggtgaagaactgctaaggtccgtcgcgcacttccagcgccaaatgttgaagaaacgcgaagagcagggacggctcctgccgaccggagccggtcttgaacctaagtctgcgcaggacaaagcattgctacagatggtggaggccgcgggagccgccgaagatgatcctctgcggcgaacaggacggccattcggggggcttattcgggacgttaggcgaagatatccacactacttgagcgactttagggacgccttagacccgcaatgcctggctgctgtgatttttatttacttcgctgctttatctcctgccattacttttggaggcctgctgggcgaaaagacccaggatttgatcggtgtgagcgagctcatcatgtcaaccgctctgcagggcgtagtcttttgcttgttgggagcccagcccctgctcgtgatcgggttctcaggcccactgctagtgtttgaggaagccttcttttctttttgttcatctaatcatctagaatacttggtgggtcgcgtgtggattgggttctggttagtgttccttgcactgttaatggtggctctggaaggctcatttctggtcaggttcgtatcccgttttacgcaagaaatcttcgccttccttatctcactgatttttatctacgaaacattctacaaactggttaaaattttccaggagcatcctctgcacggctgcagcgcctctaatagttctgaagtagacgggggcgagaacatgacttgggctggcgctagaccaacccttggaccgggcaataggtcattagccggccagagtggccaagggaaaccaagggggcagccaaataccgcgttgctctcgctagttctgatggccggcacattttttattgccttttttctcagaaaattcaaaaattccagatttttccctggcaggatccggagagttattggcgatttcggcgttccaatcgccatcctgataatggtgctggtagattattctatcgaggacacttatactcagaagctgagtgttccaagcggattctccgtaaccgcacccgaaaagaggggatgggtcattaacccactgggggagaaatccccattccctgtgtggatgatggtggcttctctactgcccgccatccttgtgttcatccttattttcatggagacccagattaccactctcatcattagcaagaaagaaaggatgctccaaaaaggctcaggcttccatcttgacctgctgctcattgtggcaatgggcgggatctgtgcccttttcggcttgccctggttagcagcagcaactgttcggtccgtaacccatgccaatgccctcaccgtcatgagtaaggctgtggccccaggagacaaaccaaaaatccaggaggtcaaggaacaacgtgtgacaggacttttggtggcccttctggtaggattgtctattgttattggcgacttgctgcgtcagattccactcgctgtgctcttcgggatatttttatatatgggggttacaagtctaaatggaattcagttctacgaacggctacacctgcttttgatgccaccaaaacaccatccagacgtgacttatgttaaaaaggtaaggaccttacgtatgcatctcttcaccgcactgcagcttctgtgcttggccctcctctgggcagtaatgtccacggcggcttccctcgccttccccttcatcttgatcctaactgtgccactgcgcatggtggtcctgacccggatctttacagatagagagatgaagtgcctggacgccaacgaggccgagcccgtctttgacgaacgggagggggtcgacgaatataacgaaatgcccatgcccgtgtag

SEQ ID NO: 206183 - DNA, 3684 bp, Artificial Sequence
  Description of Artificial Sequence: Synthetic coding sequence
atgacccagcccgagcccgagagcctgggccccggcacccccggcttcccagaacaggaggaggacgagttacatcgcacgcttggagtcgagcggttcgaagaaattttgcaggaagcaggctcccgtggcggcgaagaacccggcagatcttacggcgaggaagacttcgagtatcataggcagtcttcccaccacatccaccatcctctatctacgcacctgccaccagatgcaaggagaagaaaaactccccaggggccaggacgtaaacccaggaggcgccctggagcctctccaactggtgagacacctactatcgaagagggtgaggaggacgaggatgaagccagcgaagcagagggggcccgcgcactcacacagccatcacctgtgtcaaccccttctagtgtacaatttttcctgcaggaagatgactctgcagataggaaggccgaaagaacatccccttctagtcccgcccctctgccacatcaggaagcaacgccacgcgcttccaaaggggcacaagctggtacgcaggtggaagaagctgaggcagaggctgtcgcggtagcatctgggacagcgggcggcgacgatggaggtgcgtctgggaggccattgcccaaagcgcagcctggtcaccgcagctataatttgcaggagagacggcggatagggtctatgaccggggctgagcaagccctgctcccgagggtccccacagacgagatcgaggcccagacgctggcgaccgccgatctggatctgatgaagagccacaggtttgaagatgtgcctggagttcggcgtcacctggttaggaaaaacgccaaggggtcaactcagagcggcagagagggccgggagccaggtcctaccccacgtgcccgcccgcgggctcctcacaagccccacgaggtgttcgttgagctgaatgaactgctactcgacaagaatcaggagccacaatggcgagaaaccgccaggtggataaagtttgaagaagatgtagaggaggagacggagaggtggggcaaaccacatgtcgcgagcctgagcttccgatcattgttagagctgagacgcactttagcacacggtgctgtacttcttgaccttgaccagcagaccctgccaggagttgcacaccaggtggtcgagcaaatggttatctccgatcagataaaggccgaggatagagcaaacgtgttgcgcgccctattgctgaagcactctcatccttctgatgaaaaggacttttccttcccccggaatatctccgcaggatcactcggttctctgctggggcaccaccacggccagggtgcagaatctgatccacacgtcacagagcccctgatgggcggcgtgccggagacacgcctggaggtggagcgggagagagaattgccgcctcccgcgccccctgccggcattaccagaagtaagagtaagcacgaattaaaactcctggagaaaattcctgaaaacgcggaggccaccgtagtgctcgtcggctgcgttgagttccttagccggcctacaatggcatttgtgcgtctgcgtgaagcggttgaactggacgcagtactcgaggtacctgtccccgtcaggttcctttttttgctcctggggccgtctagcgccaacatggattaccacgagatcggacgttccattagtactctgatgagtgacaaacagttccacgaagccgcctacctggccgacgagcgggaggatctccttactgcaatcaacgccttcttggactgtagcgtagtcctgcctccatccgaggttcagggggaggagctgctgcgaagcgttgctcattttcagcgacagatgcttaagaagagggaagagcaggggagacttctgcctacaggagcagggttagaaccgaaaagtgcccaagacaaggctctgcttcagatggtggaagctgccggcgctgccgaagatgacccgcttcggaggaccggccggccatttggcgggctcatccgcgatgtgcgacggcgctatccgcattacctgagcgattttagagatgctctagaccctcagtgtttggccgccgtgatatttatctattttgcagctctgtcgcctgccatcacctttggaggactgctgggagaaaagacacaggacctcataggagtgtctgagctgattatgtccactgcactgcagggagtggtgttttgcctccttggggcccagcccttgctcgtcattggattttccggaccactgttagtgtttgaggaggccttttttagtttttgtagcagtaatcatctcgaatatttagtgggaagggtgtggatcggcttctggttggtgttcctcgccctgttaatggtggcgcttgagggtagtttcttagttcggttcgtgtcacgtttcacacaggagatttttgcatttctgatctcactcatctttatatatgagactttctataagctggtaaaaatatttcaggaacacccgctccatgggtgctccgcatcaaattcatctgaagtggacgggggcgagaatatgacatgggccggagctcgcccgaccctggggcccggcaacaggtccttagccggacagtctggccaaggcaagccaagaggccagcctaataccgctctcctgtccctcgtgctcatggcgggaacatttttcattgcttttttcttaagaaagttcaaaaattcccggtttttcccagggcgtattcggagagtcatcggcgacttcggcgtacccattgccatcctgatcatggtccttgtagattacagcatagaggacacttacacccagaagctgtctgtgccgtccgggtttagcgtcaccgctccggagaagagagggtgggtgattaaccctctcggggagaagtcgccctttccagtgtggatgatggtcgctagcctgctgccagccattctcgtcttcattttgattttcatggaaactcaaatcaccactttaatcatctcaaaaaaggaacgcatgcttcagaaaggaagcgggtttcaccttgatctgctgttgatcgtggcaatgggcggcatatgcgccctattcggattaccttggttagcagcggccaccgtcaggtcagtgacccacgcaaacgcactaacagttatgtccaaagctgtggctcccggagataaaccaaagatacaggaagttaaggaacagcgcgtgactggcctgttggttgccctgctggttgggctgagcattgttataggggacctgctgaggcaaattcccttggccgttctgtttgggatattcctttacatgggtgtgacctccctcaatgggatccagttctatgaacgacttcatttgctgctcatgccgccgaagcatcaccctgacgtgacttacgtgaaaaaagtgcgcactttaaggatgcacctttttaccgcccttcagctgctgtgtctcgccctcctgtgggcggtgatgtcaacagccgcgagcttggcatttcccttcattctcatattaactgtccctctgcggatggtggtgctgaccaggattttcaccgaccgtgaaatgaagtgtctggacgctaacgaagccgagcctgtgttcgacgagagggaaggtgtggatgaatataatgaaatgcccatgcctgtatag

SEQ ID NO: 206184 - DNA, 2406 bp, Artificial Sequence
  Description of Artificial Sequence: Synthetic coding sequence
gtgatggaggtggtggaggccgagaagatcgtgctgctgaccagcgctcgcttcctgttccttcttctgggaccagccggcaaggccccccaatatcacgagatcggaaggtcaatagctacccttatgactgacgaaatattccatgacgtagcttataaggcgaaagataggaacgaccttctgagcggaatcgacgagttcctcgaccaggtgaccgtgctgccccccggtgaatgggatccatcaatacggattgagccaccaaaaagcgttccttctcaggaaaagcgcaagattcccgtgttccacaatggatcaactcccaccttgggcgagactccaaaggaggccgcacaccatgccggcccagagctccaacggactggcagactattcggcggactcattctcgacattaagcgcaaagctcccttttttctgtccgattttaaggatgccctctctctgcagtgcctggctagcatcctgttcctatactgtgcatgtatgtcacccgtgataaccttcgggggcctactgggagaggcgactgagggaaggatcagtgccatcgagagcctttttggggcttctctcactggtattgcctactcattgttcgctggacagcctctgaccatcttgggttcaacaggtccggtgctggtgttcgagaaaatactttataagttctgtagggattaccagcttagctacctcagtctgcgaacgagtattggactctggacttctttcctctgcatcgtgctcgtggccaccgatgcttccagccttgtttgttatatcactcggtttacagaagaagccttcgcagccctgatctgcattatattcatttacgaagccctagaaaagctattcgatttaggtgagacatatgcatttaacatgcacaataacctggataagttaactagttactcttgtgtgtgcaccgagcccccaaacccctctaatgaaaccctagcacagtggaaaaaggacaacattacggctcataacatttcatggaggaatttaaccgtgagtgagtgcaaaaagcttcggggcgttttcctgggttctgcctgcggccaccatgggccctacatcccagacgttttgttttggtgcgtaatcctgtttttcaccacattttttctgagctcttttttgaagcaattcaagacaaaacgctacttccccactaaggtgcgatcgacaattagcgattttgcggtattcctgacaatcgtcatcatggtcacaatcgactatctggttggcgtgccttcccctaaattacatgtgccggaaaaattcgagccaacacaccctgaacgaggatggatcatttccccgctaggggacaacccttggtggacattgcttatagcagcaatcccagctctgctatgtaccatcttaattttcatggaccagcagatcacagctgtcattatcaacaggaaagagcacaagctaaagaaaggggctggctatcaccttgacctccttatggtgggggtgatgctgggcgtttgcagcgtcatggggctcccctggtttgtggccgcaactgtgctatcaatttcccacgttaattcactgaaagttgagtcagaatgctctgctccaggtgaacaacctaaatttctggggatccgcgagcagagagtcactggactgatgatattcatcctcatgggactttccgtgtttatgacaagtgttttgaagtttatacccatgcccgtgttatacggcgtctttctttacatgggcgtctcctctctgaagggaattcagctgtttgacaggataaagctcttcggcatgccggcaaaacaccagcctgatctgatatacttgcgatatgttcctttgtggaaagtgcacatttttactgtaattcaattaacctgtctggtactgttgtgggtaattaaggtctctgccgccgctgtggtcttccccatgatggtgttggcactagtcttcgtacggaaactcatggatctgtgtttcacaaagagagaattgtcttggctagatgatcttatgccagagtcaaagaagaagaaggaagatgacaaaaaaaaaaaagagaaagaggaggcggagcgaatgctacaggacgacgacgatacagtccatctgcccttcgagggaggtagcttgttgcaaattcccgtgaaagcccttaaatacagcgtggatcctagtatcgttaacatctccgatgagatggcaaaaacagcgcaatggaaggcactgtctatgaatactgaaaatgccaaagtaacaagatccaacatgtcccccgacaagcccgtatccgtgaaaataagcttcgaagacgaaccccggaagaagtatgtcgacgccgagacaagcctgtag

SEQ ID NO: 206185 - DNA, 2244 bp, Artificial Sequence
  Description of Artificial Sequence: Synthetic coding sequence
atgcccctgggccggcagagccaccggcaccaccggacccacggccagaagcacagaagacgcggacgcggcaagggggccagccagggtgaggaaggactggaggctctcgcccatgacacaccatcccagagagtgcaatttatacttggtactgaagaagacgaagaacacgtgccccacgagctgttcactgagttggacgaaatctgtatgaaagagggcgaagacgccgagtggaaggagactgcccgctggctgaaatttgaagaggatgttgaggacggaggcgagaggtggtcgaagccctatgtggccactctgagtctgcacagcctgtttgaactgaggtcatgcctgataaatgggacagtgcttctagatatgcacgccaactcaattgaggaaatctccgatttgatactcgaccaacaggaactgagcagcgatctgaacgactccatgagggtgaaggtaagggaagcactgctgaaaaaacaccatcatcagaacgaaaagaagcgtaacaacctgattcctattgtccggtcattcgctgaggttgggaagaagcagtctgatcctcacctgatggataaacatggtcaaactgtgagccctcagtccgtgcccaccacaaacctggaggtgaaaaacggcgtaaactgcgaacactcccccgtagacctgagcaaagttgacttgcactttatgaagaaaattccaacgggcgctgaggccagcaacgttttggtgggggaggtcgacattcttgatagacctatagtagctttcgtcagactgagccctgcggttctgttatccggtttaaccgaggttcctattcctaccagattcctgttcattcttctggggcctgtgggcaaaggacagcagtaccacgagattgggaggtccatggcgaccattatgaccgatgagatctttcacgatgttgcctataaagctaaagagagagatgacctgctggcagggatcgacgagtttctggaccaggtgaccgtgctgccaccaggcgagtgggacccgtccatccggatcgagcctccaaagaacgtcccatctcaggaaaagaggaagatgccaggtgtgccaaacggcaacgtgtgccatatcgaacaggaacctcacggcggccattccggacccgaactgcagcgaacgggcagactattcggcgggctggtcctcgatattaaacgcaaagccccatggtactggagcgattacagagatgctctctctctgcagtgtttagctagctttttgttcttatactgcgcctgtatgtcgcccgtgatcacatttggcggacttcttggcgaagccacagagggtagaatctcagccattgaatccctgtttggagcttcaatgaccggtatcgcttatagtctgttcgctggacaggccctgactattctaggctctactggaccagtgcttgtctttgagaagattctgttcaaattctgcaaggattacgcgctcagttacctttcactaagagcctgcataggactgtggacagcattcctctgcatcgttcttgtcgccaccgatgcttccagtcttgtgtgctatataacaaggttcacagaggaggccttcgcttctctgatttgcattatcttcatctacgaggcgatcgagaagctgatccacctggcggaaacataccctatccacatgcactcacagctagatcacctatctctttattattgcagatgcacgctgccagaaaacccgaacaaccataccttacaatactggaaagaccacaacatcgtgacggccgaggtacattgggctaatctgaccgttagcgaatgccaagagatgcacggggaatttatgggttccgcatgtggccaccacgggccatacacgccagatgtccttttctggagttgtatactgttcttcaccacttttatcctcagttcaacccttaagacatttaagacgtcacgctattttccgacaaggatggaaagttgcagtgtagcgtggctggagtgcggtggtgtaattctggcccactgcaaccttagactgctcccatcctcctgggactacaggcacgcacccccgcagcctgcgaatttctgtatttttagtagggacggtgtctcaccctgctggcccggttggagccagtcgctggatctagtgatttgccttccacggccccctaaaatgttaggactccaggcatag

SEQ ID NO: 206186 - DNA, 3135 bp, Artificial Sequence
  Description of Artificial Sequence: Synthetic coding sequence
atgcccgccgccggcagcaacgagcccgacggcgtgctgagctaccagagacccgacgaggaggctgtggtcgaccagggcggtacctctactattctcaatatccattacgagaaagaggaactggaaggtcatcggacactgtacgtcggcgtccgcatgccgcttggacgccagtcacatagacaccaccgcacgcacggacagaagcaccggcgaagaggccggggcaaaggagcgagccagggggaggaggggttggaagcactggctcatgataccccctctcagagagttcaatttatactgggcactgaggaggacgaggagcatgtaccccatgagctctttactgagctcgacgagatttgtatgaaagaaggtgaagacgcggagtggaaggaaacagcccggtggctgaaattcgaggaggatgtagaggacggcggagagaggtggagtaagccctatgtggccaccctttcactccacagtctcttcgagctgaggtcgtgcctgataaacgggaccgtgctgctggatatgcacgctaactctatagaggaaatcagcgacctgatccttgatcagcaggaattgtcctccgacctgaacgactctatgcgcgtgaaggtgagggaggccctgttaaagaaacatcaccaccagaacgaaaagaagcgtaataatctgatcccgatcgtgagaagctttgccgaggtcggcaaaaagcagtctgatcctcacctaatggacaaacacggacaaaccgtgtccccccagtccgttcccacaaccaatctggaggtcaaaaatggcgtaaactgcgagcactcccccgtcgatctgtccaaggtggacctgcacttcatgaagaaaatcccaacaggggcagaggcgtccaacgtcctggttggggaagtggatattctcgacagacctatagtcgccttcgtgcggctcagccctgcagtgctgctgagcggcttgacagaagtgccaattcctactcggttcctgttcatactgcttggccccgtgggcaagggccaacaataccacgagataggccgtagcatggcaacgattatgacagatgagatctttcatgacgtcgcatacaaggccaaagaacgcgacgacctactggccggtattgatgaattcctggatcaggttacagtgttgcccccgggtgagtgggatccttctattcggattgagccaccgaaaaatgtgccttcccaggaaaaacggaagatgcccggagtccctaatggcaatgtttgccacatagaacaggaacctcacggtggccactccggccccgagttacagcggaccggccgattgtttggaggactggtgctcgacattaagcgcaaggcaccatggtactggagcgattacagagatgctttgagcttgcagtgcctagcaagtttcctgtttctgtactgcgcttgcatgagcccagtgattacctttggaggacttctaggggaggcaaccgaaggtagaattagcgctatcgagtcgttgtttggcgctagcatgaccggcattgcttattctctcttcgctgggcaggctctgaccatcctcggttctaccggtcctgtactcgtctttgaaaaaattctgttcaagttctgtaaagactatgccctctcttacctttctctgcgcgcgtgtattggcctgtggactgcattcttgtgtatcgtgctggtagccacagacgcatcttccctagtgtgctatattacaagatttactgaagaagcattcgccagtctgatctgcatcattttcatttatgaggctatcgaaaaactcatccacctggccgaaacttatccgatccacatgcactctcagctggaccatctgagtttgtattattgtagatgcaccttacccgaaaatcccaacaaccataccttgcaatattggaaagaccataacatagtgacggccgaggtgcactgggccaacctgaccgtgtccgaatgccaggaaatgcacggggaattcatggggtccgcctgcggacaccatggaccttatacgccggacgttctgttctggtcatgtatcttattttttacgaccttcatattgagtagtactctaaaaacctttaagactagcagatacttccctacacgggtgagatccatggtcagcgacttcgctgtgtttctaacgattttcaccatggtgattatcgactttctaatcggggtccccagcccaaaactccaagttcccagtgtttttaagcccaccagagatgaccgcggctggatcattaatccgataggtccaaacccatggtggaccgtcatcgccgccatcattccagcgttactgtgtaccatattgatcttcatggaccagcagatcaccgcggtgataatcaaccggaaagagcacaagctgaaaaagggttgcggttaccacctagatctcctgatggtagccatcatgctgggggtgtgttcaattatgggcctgccttggtttgtggctgccactgtgctctccatcacacacgtcaattctctgaagttggagtcggagtgcagtgcccccggagagcagcccaagttcctgggcattcgggagcagcgtgtgacaggcctgatgatctttgtactgatgggctgctcagtttttatgacagctattctcaagttcatacccatgccagtgttatacggcgtttttctctatatgggggtatcttccctgcagggcattcaatttttcgaccggttaaagctgttcgggatgccagcaaaacaccaacccgactttatatatctgcgccacgtgccacttaggaaggttcatctgttcaccctcattcagctgacttgtttggtgctcttatgggtgattaaggccagtcctgccgctatcgtatttcctatgatggtcctggctctggtctttgtgcggaaggtcatggatctctgtttcagcaaacgcgagctgtcatggctcgatgatctgatgcctgagtcgaagaagaagaagctcgatgacgccaaaaagaaggccaaagaggaagaagtgatcgtgctggcccccacagtttacttaggtgctagcaattaccggacctag

SEQ ID NO: 206187 - DNA, 2736 bp, Artificial Sequence
  Description of Artificial Sequence: Synthetic coding sequence
atggaggagctgcaggacgactacgaggacatgatggaggagaacctggaacaggaggaatatgaggatccagatataccagagtctcaaatggaggagcctgcagctcacgacaccgaagcaactgctacggattatcatacaaccagccatcctggcacacacaaagtgtatgtcgagttgcaggagctggttatggatgagaagaaccaggagctgagatggatggaagctgcgcggtgggtacagctcgaggagaatctgggcgagaacggcgcctgggggaggcctcatttgagtcatctcaccttttggtcactgttagaactccgcagagtgttcaccaagggcacagtcctcctcgacctgcaggagacgtctttagcaggcgttgctaatcaactcctggataggttcattttcgaggaccagattcggccccaggatcgcgaagagcttctgagagcactcctgcttaagcactcacatgccggagagctggaagccctcgggggggtgaaaccagccgtgttgactcgaagcggggacccgtctcagcctctgctcccacagcacagcagcctggagacgcaactgttctgcgagcagggcgatggcggtacagaagggcacagtccttccgggatcttagaaaagattcctcccgattccgaggcaaccctggtcttagtgggtcgggcagatttccttgagcaaccagtgctaggtttcgtgcggctccaggaagccgccgagctggaggcagtcgagctaccagtgcctatccgcttcttatttgttctgctcggccccgaagcgcctcatattgattacacgcagttgggacgcgcagcagcaactctgatgtccgaacgcgtgtttagaatcgacgcatatatggcacagagcagaggggagttgctacactcgctggagggatttctcgattgctcactagtgctccctcccacagacgccccatctgagcaggcactgctgtctttggtgcctgtccagcgggaactgctgcgtcgaagataccaatcttcaccggcaaaacctgattcttctttttacaagggtctagacttgaacggaggacccgacgatccgctgcagcagacgggtcagttgtttggcggcctggtgcgggacatcagaaggagatacccctactatctcagcgacattaccgacgcttttagtccgcaagtcctggcagccgtaattttcatttattttgccgccctgtcccccgcaattacctttgggggccttctgggggagaagaccagaaaccagatgggagtgagtgaactgctgatttccaccgccgtgcagggaatcttatttgctctactgggagcccagcccctgctggtggtgggattctctgggccactgctggtgttcgaggaggctttcttttcattctgcgagaccaacgggcttgagtacatcgtgggtagagtctggatcggattctggctgatactactggtggtattagtcgtggcctttgagggctcctttttggtcagattcataagcagatatacccaggaaattttcagctttttgatcagcctcatctttatatacgagaccttcagtaaattgatcaagatttttcaagaccatcctctccagaaaacatacaattacaatgtcctgatggtgccaaaacctcaaggtccccttccaaacacagcccttctgtcgctggtgcttatggccgggaccttcttctttgccatgatgctgcggaagtttaagaattccagctacttccccgggaagctccgccgggtaattggcgatttcggagtcccaatttctattctaatcatggtgcttgtcgacttcttcatccaggatacatatacgcaaaaactgagcgtccctgacgggtttaaggtctcaaacagctctgcacgcggttgggtcattcacccactcgggctcagaagtgagttcccaatttggatgatgttcgcaagtgcgctccctgccctcttagttttcattctcatcttcctcgagagccagattacaactttgatcgtgtcaaaacctgaaaggaaaatggtgaaaggtagcggatttcatctggacctgctactggtggtgggtatggggggcgttgcagcgcttttcggcatgccctggctctccgccaccactgtcagaagcgtcacccatgccaacgcactcacagtcatgggcaaagcgtccactccaggagctgctgctcagattcaggaggttaaggaacaacggatatctggcttgctcgttgccgtgttggtagggttgtctatcctcatggaacccatcctctcccggattccacttgcggtcctgtttggtatatttttgtacatgggcgtgacaagcctgtccggcatccagttatttgaccgcatcctattactgtttaagccccctaagtaccaccccgatgtgccatatgtgaagcgtgtgaagacatggcgcatgcatttatttacggggatccagattatctgtcttgcagtactctgggtggtgaaaagcactcccgcatcactggccttacctttcgtgctcatcctgacagtgcccttgcgacgggtgctcttgccacttatttttagaaacgtcgaactgcagtgccttgatgcagatgacgccaaggcaacttttgacgaagaggagggaagggatgagtatgatgaggtggccatgcccgtttag

SEQ ID NO: 206188 - DNA, 3480 bp, Artificial Sequence
  Description of Artificial Sequence: Synthetic coding sequence
atgagcagcgccccccggcggcccgccaagggcgccgacagcttctgtaccccaggcccaggtcgtaagccccgtaggcgtcctggtgcttctccgactggagagacccccaccatcgaagaaggagaagaggacgaggatgaggcctccgaagctgagggggcccgggccctgactcagccgtcccccgtgtcgacaccttcaagtgtgcagttcttcctacaggaagacgacagtgcagatcgaaaagccgagcgcacgtctccgtcctccccagcccctttacctcaccaagaggctaccccccgcgcctccaaaggcgcccaggctggcacccaggttgaagaggcggaagccgaggccgtggccgttgcctccggcaccgctgggggcgatgatggcggtgcatcaggtagacctctaccaaaggcacagccaggacacagaagctataacctgcaggagcgccgacggatcggatcaatgacaggcgcagaacaggctctcttgccaagggtccctacagacgaaattgaagcacaaaccctggccacggccgatctggacctgatgaaaagccaccgatttgaggacgtcccaggagttcgacgccacctagtgcgcaaaaacgccaaggggtctacgcagtctggtagggagggcagagaacccggtcccaccccacgcgctcgccctcgcgccccccacaaacctcacgaagtcttcgttgaactgaacgaactcctcctggacaagaaccaggaaccacaatggcgggagacggcccgctggattaagttcgaggaagacgtcgaggaagagacagagcgatggggcaagcctcacgtcgctagcctgtcgtttaggagcctgcttgagctccggcgtaccctggctcatggggccgtcctgctcgatctagaccaacaaacactgcctggggtggctcatcaagttgtagagcagatggtcatctcagaccagatcaaagccgaagacagagccaatgtgcttagggctctgctcttaaagcatagtcacccaagtgacgaaaaggacttttccttcccaagaaacatcagtgccgggtcccttggcagtctgttaggccatcaccatggccagggagctgagtcagatccgcatgtcaccgaaccccttatgggcggtgtaccagagacacggctcgaggtcgaaagggagcgagagctccctcctcctgcccccccagccggaatcacacggtcaaaaagcaagcatgaacttaaattgctggaaaagatacctgagaatgcagaggcaacagttgtccttgtgggttgtgtggaatttctgtccaggcccacaatggcttttgtcaggttgagagaggccgtcgaattggacgctgtgcttgaggttccagtaccagttcgctttctgtttctcctgctgggtccaagtagtgctaacatggactaccacgaaatcgggaggagcatctctacactgatgtcagataagcagttccacgaggccgcctaccttgcggatgaacgcgaggatctactgacggcgatcaatgctttcctggactgctccgtcgttctgccacctagcgaggtgcagggagaggagttattgcggagcgtggcccactttcagcgacagatgcttaagaagcgggaagagcagggccgcttactaccaaccggggccggactagagccaaaatctgcgcaagacaaagctctgcttcagatggtggaagctgccggtgctgcagaagacgatcctctgaggcgaactgggaggccattcggcgggctgataagggatgtgcgcaggagatacccgcattacctgtctgatttcagggatgctctcgaccctcaatgtttggctgccgtgatcttcatatactttgcagcacttagcccagcaattaccttcggcggtttactgggggagaagacacaagatttgataggagtctctgaactcatcatgtcaaccgcactgcagggcgttgtgttttgcctgctgggggcgcagccgttattagtgattggcttctccggcccactcctggtgttcgaggaggcctttttttcgttctgttcttccaaccatttagaatacctggttgggcgagtctggattgggttttggttagtattcctcgccctgcttatggtcgcccttgagggctcatttctcgtgcgctttgtttctcggtttacccaagaaatctttgctttcttgatctcgctgatatttatttacgagacgttctataagctagtgaaaatattccaggaacaccccctgcacggatgctccgcctctaacagcagcgaggttgacggaggtgagaatatgacgtgggccggagccaggccaacgctgggaccaggtaataggtccctggctggacaatctgggcaagggaagcctcgcggccagccaaacaccgctttgctcagtcttgtgctgatggccggaaccttttttatcgcatttttcctccgcaagtttaaaaactctcgtttctttccaggtcgcatcaggagagtaattggagattttggcgttcctatcgccattctgatcatggtgctggtggattactcaattgaggatacctatacccaaaaactctcagtgcctagtggcttctctgtgaccgcccccgagaagcgtggttgggtcatcaaccctttaggcgagaagtcccctttcccggtgtggatgatggtggcatcccttctgccagccatcctcgtctttattttaattttcatggagacgcagataacaacactgataatctccaagaaagagagaatgctgcagaagggttccggcttccacttggacctgctcttgatcgtggctatgggcggaatttgcgccctttttgggctgccttggctggcagctgctacagttcggagtgttactcacgcaaatgccctgacggttatgagcaaagctgtagctcctggggacaaacccaagatccaggaggtgaaggagcagcgggtgaccggcctcttggtggcactgctcgtgggtctaagcattgtcataggagacctgcttcgccagatccctctggcagtactgttcggcatctttctatacatgggagtcacctccctcaatggtatccagttttacgaacgcctgcacctacttctgatgccaccaaagcaccatcccgatgtcacttatgtgaaaaaggtgaggacactcagaatgcacctgttcaccgccctacaactactttgcctggctctgttatgggctgtcatgtccactgcagccagtctggcattccctttcattttgatcttaaccgtgccactacgaatggtcgttctaactagaattttcaccgacagggagatgaaatgcctcgacgctaacgaggccgagcctgtgttcgatgagcgcgaaggagtggacgaatacaatgagatgcccatgcccgtgtag

SEQ ID NO: 206189 - DNA, 3726 bp, Artificial Sequence
  Description of Artificial Sequence: Synthetic coding sequence
atgagcagcgccccccggcggcccgccaagggcgccgacagcttctgcacacccgagcccgagtctctgggtccaggtactccgggattccctgaacaggaggaagacgagctccatcgcacacttggagtagaacggttcgaagaaattctacaagaggccggatcccgaggaggcgaagaaccgggtcgcagttacggagaagaagattttgaataccaccgacagtcatctcatcatatccaccaccccctgagtacccatctgcctcctgacgccagaaggaggaaaacaccgcaggggccagggcggaaaccgcgtcggcggccaggtgcctcccccactggtgagacgcccaccatcgaggagggcgaggaggacgaagacgaggcatcagaggccgaaggagcgcgcgccctcacccagccttcccctgtttcaacccccagttctgtgcaattcttcctgcaggaggacgattctgctgacagaaaagctgaaagaactagcccctccagccccgctccactgccccaccaggaagcgacaccaagggcttccaagggtgcacaggcaggaacccaagtcgaggaggccgaggccgaagctgttgccgttgctagcgggaccgctggaggcgacgacgggggcgcttctggccgtcccctccccaaagctcaacccggccatagaagctacaatctccaggaacgcagacgaattggctcaatgacaggggccgagcaggccctgctgccaagggttcctacggatgaaatcgaagcccaaactctagcaactgccgatttagatttgatgaagtctcatagattcgaggatgtaccaggcgtaagacgccacctggtgagaaagaatgccaagggtagcacacaatcgggccgtgaggggcgagaacctggccctactccacgagcccgccctagggccccccataagcctcacgaagtttttgtagaactgaacgaactcctgctagataagaatcaggagccccaatggcgggagacggctaggtggatcaaattcgaggaggatgtggaagaagaaaccgaaagatggggaaagcctcacgtagctagtctgtcgttccgtagcttactcgagctccgcaggaccctcgcgcacggtgctgtgctcctggatcttgaccagcagacattgcctggtgtggcccaccaggttgtggagcaaatggttatatcggaccagataaaggccgaggacagagcgaatgtgctgagggcactcctgcttaaacattcacacccaagcgatgaaaaggactttagctttcccaggaatatcagcgccggatccctgggcagcctgcttggccaccatcacgggcagggagccgagtctgatccacatgtcacggaacccctgatgggtggcgtgccagaaacgaggctcgaagtcgagcgcgagagagagctccccccgccggcgcctcctgccgggatcacccgctccaagtcaaagcatgaactaaagttgctcgagaagatccccgaaaatgccgaggctactgttgtactggtggggtgcgtggaattcctatctcggccgactatggcctttgttcgactccgggaggccgtcgaacttgatgctgttctagaagtccctgtcccagtgcggttcctgtttctgctgctgggcccatcttcagctaatatggactaccacgagatcggtagaagcatctccacattgatgtccgacaaacagttccacgaagctgcatacctcgcggatgagcgggaagacctgctgactgcgattaacgcctttctggattgctccgtggtgctccctccctctgaagtgcagggagaagaactactccggagcgtggcccatttccagagacagatgctgaagaagagagaggaacaaggtaggctcctgcctaccggtgcaggtcttgagcctaagagcgcacaagataaggccctcttgcagatggttgaggcagctggcgccgcggaagatgatccgttgagaaggaccggccggccatttggggggctcatccgcgacgtgaggaggcgttacccacactatctgtccgactttagagacgcactggatccacagtgcctggcggctgttatctttatctacttcgccgcccttagtcccgcaattacatttggagggctccttggtgaaaagacacaggatctgattggcgtctccgaactgatcatgagcacggctcttcagggggttgtattttgcctgctcggagcccagcccttacttgtgatcggcttcagcggacctctcctcgtgttcgaagaggcctttttttctttctgcagttctaaccacctggaatatctcgtcggccgagtgtggatcggattctggctggtatttcttgctttactgatggtcgccttggagggctccttcctggtgcgcttcgtgtcgaggttcacccaggaaatttttgcttttttgataagcctcatttttatctacgagaccttctacaagctggtgaaaatcttccaggaacacccgctgcatggctgctcagccagtaatagttccgaggtggatgggggagagaacatgacctgggcaggagctagacccactctggggccaggaaataggagcctggccggtcagagcggacagggcaaacccaggggccagcccaataccgcattgctgtctctggttttaatggccggcacctttttcatcgccttcttcctccgaaagttcaagaactctaggttttttcctgggcgtatccggcgggtgatcggcgattttggcgtcccaatcgcaatcctcatcatggtcctcgtcgactactcaatagaggatacttacacacagaagctgtctgtgccttcgggtttcagtgttactgctccagaaaagcgcgggtgggtcattaaccctctgggggagaagtcaccctttccagtgtggatgatggtagcctccctgctgcccgccatcctggtgtttatcttgatttttatggagacacagataacgaccctaatcatctctaaaaaggaaaggatgctgcagaaaggtagcggttttcacttagacctgctgttgatagtggcaatgggaggtatctgtgctctgttcggcctcccatggctcgcagcagctaccgtgagatctgtgactcacgcgaatgccctcacagtgatgtccaaggctgtggcccccggcgataagcctaagatccaagaagtgaaagaacagcgcgtgactggcctgctagtagcacttcttgtgggcctgtcaatcgtgattggtgacctacttcgacaaatacctctggctgttctgttcgggatttttctgtacatgggggtaaccagtctcaacggcattcagttttatgagcggcttcacctgctgctcatgccccctaagcaccacccggatgtcacctacgtcaaaaaggtccgaacccttcggatgcacctgttcacagcactgcagcttctctgtctcgctctgctctgggcagtgatgtctacggcagcttccttagcatttcccttcatcttgatactgactgtgccgttacggatggttgtgttgaccaggatcttcactgacagagaaatgaagtgtctggatgccaacgaagcagaacccgtgtttgacgaaagggaaggggtggacgaatacaacgagatgcccatgcccgtctag

SEQ ID NO: 206190 - DNA, 456 bp, Artificial Sequence
  Description of Artificial Sequence: Synthetic coding sequence
atgagcagcgccccccggcggcccgccaagggcgccgacagcttctgcacccccgaaccagaaagtctcggccctgggactccaggattccccgaacaagaggaagacgagctccatcgaaccctgggcgtcgaacgatttgaagagattctccaggaggccggaagccgcggcggcgaggaacccggccgctcttacggggaagaagactttgaatatcatcgccagtctagccaccacattcatcacccactgagcacccatctcccacctgacgcacgcagacgcaagacacctcaaggcccaggtagaaagccaaggcgaaggcctggcgcaagccctacaggcgagacacctaccatcgaggaaggagaagaagatgaggatgaggccagcgaggcagagggcgcaagagcgcttacccagccgagtccagtgtccaccccatcttcatag

SEQ ID NO: 206191 - DNA, 384 bp, Artificial Sequence
  Description of Artificial Sequence: Synthetic coding sequence
atgagcagcgccccccggcggcccgccaagggcgccgacagcttctgcactcccgagcccgagtcactaggcccaggaacccctgggtttccagaacaggaagaggacgagctgcacaggacgctgggcgtggagcggtttgaggaaatcttgcaggaagcggggtctcgaggaggcgaagaaccgggaaggtcttatggagaagaggacttcgagtaccacagacagagttctcatcatattcatcaccctctgagtacccatctgcctcctgatgcgaggcggcgaaagactccacagggacctgggcgcaaaccacgaagaaggcccggggccagccccacaggggagaccccaacaatcgaagagggggaagaagattag

SEQ ID NO: 206192 - DNA, 438 bp, Artificial Sequence
  Description of Artificial Sequence: Synthetic coding sequence
atgagcagcgccccccggcggcccgccaagggcgccgacagcttctgtacaccggagccagagtctcttggacccggcaccccaggattccctgagcaggaggaagatgagctgcacaggacactgggtgtggagagattcgaggagattctccaggaagcaggaagccgcggcggagaagagcctggccggtcttatggtgaagaggacttcgaatatcatagacagtccagccaccacatccaccatcccctctctactcacttgcctcccgacgctagaaggcgaaagacgccccaaggcccgggacgcaagccaaggagacggcccggggcaagccctaccggggagacccctactatcgaagagggcgaggaggacgaggacgaggccagcgaggccgagggagctcgagctctgacccaacccagtccctag

SEQ ID NO: 206193 - DNA, 3726 bp, Artificial Sequence
  Description of Artificial Sequence: Synthetic coding sequence
atgagcagcgccccccggcggcccgccaagggcgccgacagcttctgtacccctgagcccgagtccctagggccaggtacgccaggatttccagagcaggaagaagatgaactccaccgcacactgggcgttgaacgctttgaggagatccttcaagaggcaggttcacggggcggcgaagaaccggggcgctcctacggcgaagaagattttgagtatcatcggcagagctcacaccacatccaccaccctctgagcacccacctgccccctgacgccagacgcagaaaaacacctcaaggacctggacgaaagcctagacgccgtcctggggcttcacccacaggcgagactcccaccattgaggagggtgaggaggatgaagacgaagccagcgaggcagaaggcgcacgggcactaacacagccttcacctgttagcactcctagcagcgtccagttttttctccaggaggacgatagcgcggacaggaaggcagagcgcacttctccctccagtcccgctccgctgccacatcaggaggcaacccccagagcttccaagggggcgcaggctggcactcaggtggaagaggccgaagcggaggctgtcgctgtggcttcagggacagctggcggtgatgatggcggtgccagtggccgacccctcccaaaagcccagccaggacaccgcagctataatttgcaggagaggagacgcatcggttctatgaccggggctgagcaggcactgctgccacgagtgcctaccgatgagattgaagcccagactctggccacggctgatctcgacctgatgaaaagtcaccgattcgaagacgtgccaggcgtacggagacacctcgtccgtaagaatgccaaagggagtactcagtcgggccgtgagggccgcgaaccagggcctacccctcgtgcccgaccccgagctccgcacaagcctcatgaggtatttgtggagctcaacgaacttctgcttgacaagaaccaggaacctcagtggagggagacagcacggtggatcaagttcgaagaagacgtggaggaagagactgaacgctggggcaagcctcatgtggccagtctctccttccgtagcttattggaactgcgccggacactcgcacatggtgcagtgctcctggacctggatcagcagacactcccaggagtagcccaccaagttgtggaacagatggtgatttcggaccagatcaaggctgaggatagagccaacgtgttacgcgccctgctcttgaagcactctcatccaagcgacgagaaagacttttccttcccccgaaatatctctgccggctccctcggatccttgcttggccatcaccacggtcagggtgccgaatcggacccacacgtgaccgagccactgatgggcggagtccccgagacgcgcctggaagtcgagcgagagagagaattgcccccacctgcgccgccagccggtattaccaggagtaaaagcaagcacgaattaaagctcctggaaaagatccctgagaacgcagaagcgacagtagtcctggtcggctgcgtagaattcctgtcccgccctacaatggcctttgtgcgtctgcgagaggccgtggagttagacgccgtgttggaggtccccgtaccagttaggtttctgtttctcctgctaggcccatcttcagctaatatggattatcacgaaatcggccggtctatcagcaccctcatgtctgacaagcaatttcatgaggctgcatacttagcggatgagcgagaagatctcctgactgccatcaatgcattcctagactgctctgtggttcttccaccttccgaagtccagggtgaggagcttttgagatccgtggcacactttcagcgacagatgctcaaaaagagagaggagcaaggcagactgcttccaaccggggcggggctggaacctaagtccgcccaggacaaggcactgctccagatggtggaggccgcaggggcagccgaagacgaccccctcaggagaactggaaggccttttggaggactgataagggacgtgcggagaaggtacccacattatctaagcgatttcagagatgctctggatcctcaatgcctagccgccgttatttttatatatttcgctgcactatctcccgccatcacattcggaggcttgctgggagagaagactcaggatttgatcggggtatcagagctgataatgtctaccgcactgcaaggggtggtattttgtctgctgggtgcccaaccccttctcgttataggcttttccggtcccctcctggtattcgaggaggcgttcttctccttttgttcctccaatcatctggaatacctggtggggagagtgtggatcggcttctggctggtgtttctggccctgcttatggtcgccctagaaggctctttcctcgtgaggtttgtgtctcggttcacccaggagatctttgcgttcctcatctccctgatcttcatttatgagacgttctacaaactggtgaagatcttccaggagcatcccctccatgggtgcagtgctagcaattcctctgaagtcgacggtggtgagaacatgacatgggcgggagccagacccacattagggcccggcaaccgcagcctggccggacaaagtggacagggaaagcctcgtggacaacctaatactgccctgctttctctcgtgcttatggctgggaccttctttatcgccttttttctccggaagttcaagaactcaaggttttttcccggcaggataaggcgggtcattggcgactttggagtacccattgccatccttatcatggtgctggtggattacagtatcgaagatacttatacgcagaaactgtcagtgccctcaggttttagcgtgacagccccggaaaaacgaggttgggtaattaatcccctcggagagaagagccccttcccagtgtggatgatggtcgcgagtctgttgccggcaatcttggtgttcatcctgatttttatggaaacacaaataacgaccctcatcatcagtaagaaagagagaatgctgcagaaaggcagcgggtttcacctagatttgttgttaattgttgctatgggaggtatctgcgccctcttcggactgccctggctcgccgctgctacagtcagatctgtcacgcatgccaacgcgttgacggtcatgtccaaagccgtggctcctggggacaagcccaagatccaggaggtcaaggagcagagggttactggcctgttggttgccctgctagttggcttatctattgttatcggcgacttattgcgacagatcccacttgccgtgctattcggaatcttcttgtacatgggagtgactagcctgaacggtatccagttctatgagaggttgcatcttttgctcatgccacccaaacaccaccctgacgttacctacgtgaagaaggtcagaactttgcggatgcacctgttcactgccttacagttactgtgtctggctctgctgtgggccgtcatgagcacagcagccagcctggcgttccccttcatccttatccttactgtgcccctccgcatggtagtgcttaccagaatttttactgatcgggaaatgaaatgcctagacgccaatgaagccgagccagtatttgacgaaagagagggggtggatgagtataacgagatgccgatgcctgtctag

SEQ ID NO: 206194 - DNA, 213 bp, Artificial Sequence
  Description of Artificial Sequence: Synthetic coding sequence
atgagcagcgccccccggcggcccgccaagggcgccgacagcttctgtacacctgaacctgagagcttggggcccggcacccccggtttcccagaacaggaggaggatgaactccatcggaccctgggcgtggaacgttttgaggaaatactgcaggaagccggttccagggggggggaggagccaggacggagctacggtgaggaagattag

SEQ ID NO: 206195 - DNA, 510 bp, Artificial Sequence
  Description of Artificial Sequence: Synthetic coding sequence
atgagcagcgccccccggcggcccgccaagggcgccgacagcttctgtacccccgagcctgagtccctgggccccggtaccccaggcttcccagagcaggaggaggacgaactgcataggaccctaggggttgaaaggttcgaggaaattctgcaggaagccggttcccgaggaggggaagaaccggggcgctcttacggcgaggaggattttgagtaccaccggcaaagcagccaccacatccaccaccccctgagtacacatttgccccccgatgcacggaggcgcaaaacaccccagggacctggcagaaagcccaggcgcagacccggggcaagtcctaccggggagactccgacaatcgaggagggagaagaagatgaagacgaggcttccgaggcagagggggctcgcgctctgactcaaccctctcctgtgtccacaccctcgtccgtgcagtttttcctgcaggaagacgacagcgcagatcgtaaggccgagagaacgtag

SEQ ID NO: 206196 - DNA, 3240 bp, Artificial Sequence
  Description of Artificial Sequence: Synthetic coding sequence
atggaggacgaggccgtgctggaccggggcgccagcttcctgaagcatgtatgtgatgaggaggaagttgaaggacaccatactatctacattggggtgcatgtacctaaatcatacagaaggcgccggaggcacaagaggaaaacgggtcataaggaaaaaaaggagaaggagcggatctcagagaactattccgataagtccgatatcgaaaacgccgacgagtcatcttcctccatccttaaacctctcatttccccagccgcggagcggattagatttatccttggggaggaagacgactcacctgcccctccacagctgtttactgagcttgatgagctgcttgccgtggatgggcaggagatggagtggaaggagacggctagatggatcaaatttgaagaaaaggtagagcaggggggggaacggtggtccaaacctcacgttgccacactcagccttcactccctctttgaactccggacgtgtatggagaaaggctcaatcatgctggaccgggaagccagttcattacctcagctggttgagatgatcgtggatcaccagatcgaaacagggttgctcaaacctgagctcaaagataaggtgacatatactctgctcagaaagcatcgccatcagaccaagaagagcaacctgagatcactcgctgatatcggaaaaaccgtttcatctgctagtcggatgtttactaaccctgataacggttcgccagccatgacacatagaaacctgacatcaagtagcctcaacgatatctccgacaaacccgaaaaggaccagctgaaaaataagttcatgaagaaattgcctcgcgacgctgaagcaagcaacgtactggttggggaggtggatttcttagatacaccgtttattgcgtttgttcgcctgcagcaggccgtcatgctcggagccctgaccgaggtacctgtacctacacgctttctatttattcttctgggcccaaaggggaaagccaagtcgtaccatgaaattggaagagccattgccacactaatgtcggacgaagtcttccatgacatcgcatacaaggctaaggaccgtcacgacctgattgcagggatcgacgaattcctggacgaagtgattgtcctgcccccaggcgagtgggaccccgccatccgcattgaaccacctaagtcgctgccgtcgtccgataaaagaaagaatatgtactctggcggggaaaacgtccagatgaacggagatactccccatgatggcggccatggtggaggaggacacggcgactgcgaggagttgcagaggacaggccgcttttgcggcggattgatcaaggatattaaaagaaaggcccctttctttgcctccgacttttacgacgctcttaacatccaagccctgtctgccattcttttcatttatctggccacggtcacgaatgccattacgttcggagggttgttgggagacgccacggataacatgcagggcgtgctggagtcatttctgggaaccgcagtaagtggtgcaatattttgcctgtttgctggacagccccttactatcttgtcatcaaccggtcccgtcttggtgttcgagcgccttttgttcaacttcagcaaggacaacaacttcgattacctggagtttcggttgtggataggcctttggtcggcctttctgtgccttatcctagtggccacggacgccagcttcctggttcaatacttcactaggtttacagaagaagggtttagtagcttaattagcttcatcttcatttacgacgcattcaaaaagatgatcaaactggccgattactatcccataaacagcaacttcaaagtgggatacaacactctgttctcttgtacatgcgtgccacccgatcctgccaatatttcgataagcaacgataccacactggccccagaatatctccccactatgagcagtacagatatgtaccataataccacatttgactgggctttcctgagtaagaaagagtgcagcaagtatggcggaaatctggtggggaataactgtaatttcgtccctgacataaccctaatgtcttttatcctctttctaggaacctacaccagctcaatggcattgaaaaagttcaaaacctcaccctacttccctacgactgccagaaaactgatttctgattttgctatcatcctgagcattctgatattttgcgtgatcgacgcactcgtcggggtggataccccaaaattaatagtgcctagtgagttcaaaccaacttcacccaacagaggctggttcgttcccccattcggtgaaaatccttggtgggtgtgtctggccgccgccatccccgccctccttgttaccattctcatttttatggatcagcaaattacagccgtaattgttaaccgcaaagagcataagctgaagaaaggagctggctaccatctggacctgttctgggtggccatcctgatggtgatttgctccctgatggctctcccctggtatgttgctgcaacagtcatctctatcgcacacatcgactcacttaaaatggagaccgaaacctccgccccaggagagcagcccaaatttttaggggtaagagagcagcgggttacagggacgctagtgttcattctcacaggcctgtctgttttcatggcacccatccttaaatttattcctatgcctgtgctttacggggtctttttgtacatgggggtcgcttctctcaacggcgtgcagtttatggaccggctaaaactcctcctaatgcccctgaagcaccaacccgactttatctatctccgacatgtgccgctccggcgggtccacttgttcacattcttgcaagtgctgtgcctcgccctgctgtggattttgaagtccactgtggccgccataatcttcccagtgatgatactggccctggtcgctgtgaggaaaggaatggattatctctttagccagcatgatctgagctttctggacgacgtcattcccgagaaagacaaaaagaagaaggaagacgagaaaaagaaaaagaagaaaaaggggtcgttggacagtgataacgatgattcagactgtccatacagcgaaaaagtcccatccattaagatacccatggatattatggagcagcagccatttttgtccgatagcaagccaagtgatcgtgaaagatcccccacgtttcttgaacgccacacgtcctgttag

SEQ ID NO: 206197 - DNA, 3108 bp, Artificial Sequence
  Description of Artificial Sequence: Synthetic coding sequence
atgagcaccgagaacgtggagggcaagcccagcaacctgggcgagcgcggccgcgcccggtcctccacctttctgagggtggtacagccaatgttcaatcactcgatcttcacatcagcagtctcgccggcagcagagcgcatccgatttatcctgggcgaggaagacgattctccggcccctccgcaactttttactgagctcgatgagctactggccgtcgacggtcaggagatggaatggaaagaaaccgctcggtggatcaaatttgaggagaaagtggagcaggggggcgaacgctggtccaaaccacacgttgccacactctcactgcattctctgtttgaattgagaacgtgcatggaaaagggatcaataatgctcgatcgagaggcgtcctcattgccacagctggtcgaaatgatcgtggaccatcagattgagacaggtctcctgaaaccagagttgaaggataaagttacttataccctgcttaggaagcacagacatcagaccaaaaaatctaacttgcggagcctggctgatatcggcaagacggtgagttccgcgtcaaggatgtttaccaatcccgataacggtagccccgccatgactcatcgcaacctgacatccagctctctgaacgatatatccgataagccggaaaaggatcaactgaaaaataagttcatgaagaagctccctcgcgacgccgaggccagcaacgtgctggtgggcgaagttgacttcctagacaccccttttattgcctttgtccgcctccagcaggccgtcatgctcggcgccctgacagaggtgcccgtgccaaccaggtttctctttatcctcctgggccctaagggcaaggcgaaatcttatcacgagatcggccgcgctattgccacgctcatgtcagacgaggtttttcacgatattgcctataaagccaaagatagacacgatctgatcgccgggattgatgaatttctggatgaggtaattgtcctccctccgggtgagtgggacccagccatccggattgagccacctaagagccttcctagttcagacaaaaggaagaacatgtacagcggtggagagaatgtccagatgaatggcgacactccgcatgacggcggccatggtggcggtggtcatggggattgtgaggagctgcagcgcaccggtcgtttttgcggcgggctcataaaagacatcaagaggaaagccccattcttcgcaagcgacttctacgacgctctgaacattcaggcactgtctgctattctatttatatacttggccacagtaactaacgcgattaccttcggggggttgttgggtgacgcgacagacaacatgcagggcgtgttagagtcctttctgggaactgctgtctctggagctatattttgtctgttcgccggacagccactaacaatcctcagcagcaccggccccgtccttgtgttcgagcgcctactatttaatttttcaaaggataacaatttcgactatctggaatttcgcttatggataggattgtggagcgcgttcctgtgcctgatactggtggccactgacgcctcattcctcgtgcaatatttcactcgcttcacagaggaaggttttagttcactgatcagctttatttttatctacgacgccttcaaaaagatgattaagctggccgactactaccctataaactcaaactttaaggtcgggtacaacactctgttttcatgtacctgtgttcctcccgaccctgcaaacatcagtatcagcaatgatacgacactggccccagagtaccttccgacaatgtctagcaccgacatgtatcacaacacaacattcgattgggcttttctctccaagaaggaatgctctaaatatggaggaaacctggtaggaaataactgcaatttcgttccagatattacccttatgagtttcattttatttctggggacatacacatcaagtatggcattaaagaaatttaagacatctccatatttcccaactaccgcgagaaaactgatctcagatttcgccatcatactgtctatactgatcttctgtgtgatagatgccctggtcggcgtagacacacccaagctcatcgtgccatccgagtttaagcccaccagtcccaaccgcggctggttcgtcccacctttcggcgagaacccctggtgggtatgtctggcagccgctattcctgcattactggtgaccatactgattttcatggatcagcagatcactgccgtgatcgttaaccggaaggagcacaagctcaagaaaggggcaggctaccatctggaccttttttgggtggccattttgatggtgatttgctctctgatggcattaccatggtacgtggccgccacagtgattagcattgctcacatagatagtcttaagatggagacagaaacctccgcaccaggggagcaacctaagttcttgggtgtcagagagcagcgagtcacaggtacgctggtatttatacttacaggcctctccgtgttcatggcccccattctgaagtttattcctatgccagtgctctacggagtctttctgtacatgggcgtggcgagtttgaacggggtgcagttcatggacaggttgaagttgctcctcatgccactgaagcaccagcctgattttatctatctcaggcacgtcccactaaggcgtgtccacctgtttacgttcttgcaggtactgtgtctagctctgctgtggatcctgaagtctacagtcgctgccattatctttccagtgatgattttggccctggtggctgtgcggaagggcatggattatttgttctcacagcatgacctatcttttctggatgacgtcataccagagaaagataagaagaagaaggaagatgaaaagaaaaagaaaaagaagaagggaagtctggactccgacaatgacgactccgattgtccatattctgaaaaggtgccttctatcaagattcccatggatattatggagcagcagcccttcctgagtgactcaaagccatctgacagagagcggagtccaacctttctcgagcggcacacctcttgttag

SEQ ID NO: 206198 - DNA, 2988 bp, Artificial Sequence
  Description of Artificial Sequence: Synthetic coding sequence
atggaggacgaggccgtgctggaccggggcgccagcttcctgaagcacgtctgcgacgaagaggaggtcgagggacaccacacaatttacatcggggtccatgtgcccaaaagctaccgccgtagacgaaggcataaacgaaagacaggacacaaggagaaaaaagagaaggagcgtatctcagaaaattactctgataaatcagatattgagaacgcggacgaaagtagttcctccatcctgaaaccactgatctccccagccgcagaaagaataaggttcattttaggagaagaagacgactctccagctccacctcagctattcactgagctcgacgagctgctggccgtcgacgggcaggaaatggagtggaaagagacagcgaggtggataaagtttgaagaaaaggtggaacagggaggcgaacgatggagtaaaccacacgtggccaccctcagtcttcattccctcttcgaattgcgcacgtgcatggagaagggctctatcatgctggaccgagaagcttcctccctgccgcaactggtggaaatgatagttgaccaccagattgagacggggttgctgaaaccggagcttaaggataaggtaacatacactcttctgcggaagcacagacatcagaccaagaagtctaacctacgtagtctcgccgacatcggaaagacagtgagcagcgcaagccgtatgtttacaaatccggacaacgggtcacctgcaatgactcataggaatctaacgagcagtagtcttaatgacatctcagataagcctgagaaagaccagttaaaaaataaattcatgaagaagttgccaagagatgctgaagcctcgaacgttctggttggcgaggtcgattttctggacacaccctttatcgcctttgtgcgcctgcagcaggccgtcatgctgggagccctgacggaggtgccagtcccaactagattcttatttattctgttgggaccaaaggggaaggcaaagtcctatcacgaaatagggagggccatcgcaaccctgatgagtgacgaggtattccacgatatcgcctataaagcgaaagaccggcacgaccttattgccggaatcgacgagttcttagacgaggtgattgtgctgcctccaggggagtgggatcccgcaattcggattgaaccacctaaatctctgccctcaagcgataaacggaagaacatgtactcaggaggcgagaacgtacagatgaatggtgacactcctcacgacggaggacacggaggcggaggccatggtgattgtgaggagctccagcggactgggaggttctgtggcgggctgattaaggacatcaagaggaaggcaccattctttgcctcggatttttatgacgcgctgaacatccaggccttatcagctatcctgtttatatacttggcaaccgtaacaaacgccattacgtttggggggctgctgggggatgcaacagacaacatgcagggagtactggagtctttcctgggcacagcagtgtctggagctatcttttgcctgttcgccggacagcctttgacgattctttcctcaaccggtcccgttctagtgttcgagcggctcctttttaacttcagcaaggacaataactttgactatctggagttcagactgtggattggactgtggtccgcattcctgtgcctgattctcgtagccaccgatgctagtttccttgtgcaatactttacaagattcacagaagagggcttctcttctttaatctctttcatatttatctatgacgccttcaaaaaaatgatcaagctggccgactactacccaatcaattctaacttcaaagtgggttataacacattattcagctgcacatgcgtgcccccagacccagccaatatttctatttccaatgacacaacgctggccccagagtatctgccgacgatgtcatctaccgacatgtatcataacacgacttttgattgggccttcctgagcaagaaggaatgttccaagtacggcggaaacctcgtgggcaacaattgcaattttgtgcctgatattactctcatgtctttcatcctgtttctcggcacgtacacatcttcgatggcgttgaagaaatttaaaacctccccctacttcccgacaaccgcccggaagcttatttcagactttgccatcattctaagcattctgatcttctgtgtgattgacgcccttgttggcgtggacacccctaaactgattgtgccaagtgagtttaaacctacttctcctaacagaggatggttcgtgcctccctttggagagaatccttggtgggtgtgcctcgccgctgccattcccgcattactggtgaccattctgatcttcatggaccagcagattacagcggtaattgtgaatagaaaggaacacaagctcaagttcatcccgatgcccgtgctctacggcgtgtttttgtatatgggcgttgctagcttaaatggcgtacagtttatggacagactgaaactcctgttgatgccactgaaacaccaacctgatttcatctatttgcgacatgtcccactgcgaagagttcatctgtttacttttttacaggtcctctgcttggctctgttatggattctcaagagtacagtcgcggcaatcatcttcccggtgatgattttagctttggtcgcagtcaggaaagggatggactatctcttttcacagcatgacctgtcattcctcgacgatgtcattcctgagaaagataagaaaaagaaagaagatgagaagaaaaaaaagaagaagaagggttctcttgacagtgacaacgatgacagcgactgtccatactctgaaaaggtgccctccatcaagatcccaatggacataatggaacagcagccctttctaagcgacagtaaaccttccgatagggagaggagtccaacttttctggaaagacacactagttgctag

SEQ ID NO: 206199 - DNA, 3285 bp, Artificial Sequence
  Description of Artificial Sequence: Synthetic coding sequence
atggaggacgaggccgtgctggaccggggcgccagcttcctgaagcacgtatgcgatgaggaagaggtggaaggccaccacacgatatacataggcgtccacgtacctaaatcctaccggaggcgccgtaggcataaaaggaaaaccggacacaaggagaagaaagagaaagagagaatctctgaaaactattcggacaagtccgacattgagaacgcagatgagagctcgtcttccatcctgaaaccactgatcagtcccgccgcagaacgcatcaggtttatactgggggaggaagacgactctccagctccacctcagctgtttactgagctagatgaactcctagcagttgatggccaggaaatggagtggaaagagaccgccaggtggatcaaattcgaagagaaagtggaacagggcggagaacggtggagtaagccccacgtggcaaccctcagcttgcattccctttttgaacttaggacgtgcatggagaaaggctcaattatgcttgatcgagaagcctcttcccttcctcagctcgttgagatgatcgtagatcaccagatagaaacggggctcctgaagccagagttgaaagacaaggtcacctacaccctgttgaggaagcaccggcaccagacgaaaaagtctaatctccggtcactggccgacattggcaagaccgtgtcttcagctagccgtatgtttacaaaccccgataatggcagcccggcgatgacacacaggaaccttacatcatcttcactgaatgatatcagtgacaagcccgagaaggatcagttgaaaaataaatttatgaaaaagcttcccagagacgctgaggcttccaatgtgctggtgggtgaggttgatttcctggacacaccattcatcgcctttgtgaggctacagcaggccgtgatgcttggcgcattaaccgaagtgcccgttccgacccggttcctgtttatactcctaggaccaaagggaaaagctaagtcataccatgagatcggcagagccatcgccaccttgatgtccgatgaggtcttccacgatatagcctacaaagccaaagatcgtcatgatctgattgctggaatcgacgaatttttggacgaggtgatcgtgctgccgccgggagaatgggatccagcaattcgcatagaaccccctaagagcctcccatcttccgataagagaaagaatatgtactcaggtggcgagaatgtacagatgaacggcgacactccacatgatggaggtcatggcggcgggggtcacggtgattgtgaagagctgcagaggaccgggaggttctgcggcggacttattaaagacatcaaaagaaaggcccctttctttgcgtctgatttctatgacgctttgaatatccaggcccttagcgccattctgttcatttacttagcaactgtcactaacgccattactttcggaggcctgctaggagatgcgacggataatatgcagggagtattagagtccttcctcgggactgccgtctccggtgcgatcttttgtctcttcgctggacaaccattaaccattctcagcagcaccgggcctgttctggtgtttgagaggctgctctttaactttagcaaggacaacaatttcgactatttagaatttaggttgtggatcggtctctggtccgcttttctgtgcctcatcttagtggctacggacgccagcttcctggtccaatatttcactagatttactgaagagggtttcagtagtttgatctcttttatctttatctacgacgccttcaagaagatgatcaaattggccgactactatccaattaacagcaattttaaggtcggctacaacacacttttctcatgcacctgtgttccacctgacccagcgaatatttccatttccaacgacacgactttggccccagaatatctgcctaccatgtcatctactgatatgtatcataacaccacgtttgactgggcatttttgtctaagaaggaatgctccaagtatggtggaaatctcgtcggtaacaactgcaatttcgtccccgacattaccctgatgtccttcattttgttcctgggaacctacacatcttctatggcacttaagaagttcaaaaccagcccctatttccctaccaccgcccgtaagttgatttccgacttcgcaattatcctgtccatcctcattttttgtgtgattgacgccctcgttggcgtcgacacacccaaattaatcgtcccatcagagttcaagcccacaagtcccaatcgggggtggtttgtccctcctttcggtgagaatccatggtgggtttgcttggccgctgccatcccagctctactagtgacgatcttgattttcatggaccagcaaatcactgccgtgatcgtaaatagaaaggagcataagctgaaaaaaggcgctggataccatctcgatctcttttgggttgcaatcctgatggtgatctgtagcttgatggcactgccatggtacgtcgccgccactgtgatttcaatcgcccacatcgactctctgaaaatggagaccgaaacttctgcacccggagagcagccaaagtttctgggtgtgcgggagcagcgagtgactggcacactcgtattcatcctgactgggttatccgtttttatggctccgattttaaaattcattccgatgcctgttctctacggggtgtttctatatatgggggtggccagcctgaacggcgtccaatttatggatcggctgaaactccttctgatgcccctaaagcatcagcctgactttatctatttacgtcatgtgcccctgcgccgtgtgcatctctttacgtttttacaggtcttgtgcttagcccttttgtggattctgaagagcaccgtagctgccattatttttcccgtgatgatcttagccctggtcgctgttagaaagggaatggattatctctttagccaacacgacctcagctttctcgacgacgtaataccggaaaaggacaagaaaaagaaggaagatgagaaaaaaaaaaagaagaagaagggctcactggattccgataatgatgatgagaaagaccaccaacatagcctgaacgcaacacaccacgcagacaagatcccttttcttcagtcactcggcatgccgagcccgccaagaacacccgtaaaagtggttcctcagattagaatagaactggaaccggaagataatgattacttttggaggtccaaaggcaccgaaactaccctctag

SEQ ID NO: 206200 - DNA, 3123 bp, Artificial Sequence
  Description of Artificial Sequence: Synthetic coding sequence
atgaaggtgaaggaggagaaggccggcgtgggcaagctggaccacacaaaccaccgaaggagattcccggatcaaaaggagtgcccccctatccatataggtctgccagtccctacatatccacaacgtaagaccgatcagaaaggacacctcagcggcctccaaaaggtgcactggggcctgcggcccgatcaaccacagcaggagttgacagggcctgggagcggtgcttcctctcaagatagctcaatggacctcatttctcgaacacgcagtcctgcggccgaacagctccaggatattcttggcgaagaagacgaagcccccaatcctacactgttcacagaaatggacaccttacagcacgatggtgatcagatggagtggaaagaaagtgcccgctggataaagttcgaggagaaggtggaagagggaggagaacgctggtcgaagcctcacgtcagtactttgtccttacactctctgttcgagctacgcacctgtctgcagacgggcaccgtcctgctggacttggactccggctctctcccccagataatcgacgacgtaattgagaagcagattgaagatggtctccttaggcctgagctgagggagcgggtgagctatgttctcctcaggcgccatcgccaccagaccaaaaaacctatccacaggagcctcgccgacataggaaaatctgtgagcacgaccaaccgatctcccgctcggagcccaggagccggtccttcccttcaccactctacggaagatcttcgaatgaggcaatcggcaaactacggcaggctctgccatgctcaatcccgctccatgaatgacatatccctgacacccaacaccgatcagcgcaagaacaagtttatgaagaaaatacctaaagattcggaggctagcaacgtgctggttggtgaggtggacttcctggatcagcctttcattgccttcgtacgccttatccagtccgctatgctgggaggcgttaccgaagtccccgttccaacccgtttcttgttcattctgttaggaccaagcggaagggctaagagctataatgagattggcagggcgatagctacgctgatggtggatgatctctttagtgatgtcgcttacaaggcccgtaatcgcgaagatctcatagccggaatcgacgagtttctggatgaggttatagtgctgcctccaggcgagtgggatccgaacatccgcatcgagccaccgaaaaaggtaccatctgcagataaacggaagagtgtcttcagtttggcagaactgggccagatgaacggttccgtcggtggcgggggaggggccccaggcggaggaaacggtggcggcggaggtggaggctcgggtggtggagcaggctcaggcggcgcaggtggtactagtagtggcgacgacggggagatgcctgcgatgcacgaaattggagaagagctgatttggacgggaaggtttttcgggggtctctgcctggatataaagcggaaactcccctggttcccgtccgacttctatgatggtttccacatccagtccatttctgccatcctgtttatttatctgggatgtatcaccaacgcaattacttttggcggtctgctgggtgatgccacagataattaccagggtgtgatggagtcattcttagggaccgctatggccgggtcactgttctgtcttttttccggacaacccctgattatcttgagctctaccggccctatccttatcttcgagaaactgctcttcgattttagcaaaggcaatgggttagactatatggaattccgcctttggattggcctccattccgccgtccagtgcctgatccttgttgccacagatgcaagtttcatcataaaatacattacaaggtttacagaggaggggttttccaccctcatatcttttatcttcatttacgatgctattaaaaaaatgattggggcatttaagtattatcctattaacatggactttaaaccaaactttatcactacatacaaatgcgaatgcgtggcgcctgacactgtgaatacaacagtctttaacgcgtccgccccactagcccccgatacaaacgcttcactctataacctgctgaacttaacagccttggattggtccctccttagcaagaaggagtgcctatcttacgggggcagactgctggggaactcgtgcaaattcattcccgacctggctttaatgagcttcatactgttcttcggcacctacagcatgactctcaccctcaagaagttcaagttcagcagatacttccccaccaaggtgcgggccctcgtggcggatttttctatcgtctttagcatccttatgttttgtggcatcgatgcatgtttcggcctggaaacacccaagctccacgtgcccagcgttattaagccgacgcgacccgatcggggctggtttgttgccccattcggaaaaaatccatggtgggtgtacccggcatctatactaccagcactgctagtgacaatcctgatctttatggatcaacaaatcacagctgtaatagtcaacagaaaagagaacaaactgaaaaaggccgccgggtaccacctggatctcttttgggtgggcatccttatggccctttgcagctttatgggcctgccctggtacgttgctgcgacggtgatctctatagcgcacatcgactccttaaaaatggagaccgaaacctccgcccctggagaacaaccccagttcctgggagttcgtgagcagcgcgtgaccggcataattgttttcatccttaccggaatctcagtattcctcgctcccatcctgaaaatccttggcctgattatcgtgcgcaggctactcgactttatattctcccagcacgacctggcgtggatcgataacatcctgccagagaaagaaaaaaaggaaacagacaagaaaaggaaacgaaagaagggggcgcacgaagactgcgatgaggagccgcagtttccgcccccatccgttatcaaaatccctatggaatcggtccaatccgatcctcagaatgggatccactgcatcgcaagaaaacgaagcagtagttggtcctactctctgtag

SEQ ID NO: 206201 - DNA, 3414 bp, Artificial Sequence
  Description of Artificial Sequence: Synthetic coding sequence
atgaaggtgaaggaggagaaggccggcgtgggcaagctggaccacacgaaccatagaaggcggtttcctgatcaaaaggagtgcccccccattcacataggactgccagttccaacttaccctcagcgcaagaccgaccaaaagggccacctctcggggttacagaaggttcattggggacttcgaccagaccaacctcagcaggaactgacaggccccggctccggcgcctcatctcaggacagctccatggatctaatttccagaacccggtctcccgcggccgagcaacttcaggatatcctcggagaagaagatgaagcccccaacccaaccctctttaccgagatggatacgctccagcatgatggggaccaaatggaatggaaggagagcgctaggtggattaagttcgaggaaaaggtggaagagggcggtgagagatggagtaagccccacgtgagtacactctctctccactccctattcgagttgcgaacctgcctgcagactgggaccgtgctgctcgatctggattcgggctcactgcctcagatcattgatgatgtcatagagaagcagatcgaggacgggctgctgcggccggaactgcgtgagagggtgtcctacgttttgcttagacgccacagacaccagaccaagaagccgattcacagatctctcgcagacattggtaaatccgtgagcactacaaaccggagccctgccaggtctcctggagctggtccctctctgcatcactccacagaagacctgcggatgcgccaaagtgccaattacgggcgcctgtgtcatgcacagtctcgtagtatgaatgacattagcctcactccaaacactgatcaacgtaaaaacaagttcatgaagaaaatacctaaagactccgaagcgtccaacgtgctggtgggagaggtggactttctggaccagcccttcatagcatttgtcagacttattcaatcagccatgcttggtggagttacagaggttccggtgcccacccgattcctatttatcctcctgggcccatcgggaagggcgaaatcttacaacgagattggcagagccattgcgacattaatggtggacgacctcttctcagacgtagcctataaggcccgtaatagggaggatctgatcgcaggtattgatgaattcctggatgaagttattgtgttgcccccaggcgagtgggatccaaacattcgaatagaaccccctaaaaaagtcccctccgccgataagagaaaaagtgtcttctcactggcggaactgggtcagatgaacggctccgttgggggcggggggggcgctcccggcggaggtaacggcgggggaggcggtggcggaagcggcggcggggccggttccggcggcgcaggggggacaagctccggggacgacggggagatgcccgccatgcacgagatcggggaagagttaatttggaccggtaggttctttggcgggctctgcctggatataaagcgcaaacttccttggttccctagcgacttttacgacgggttccatatacagtccatctccgccattttgttcatttacttggggtgcataacaaatgccattacattcggggggctgttgggagacgcaacggacaactaccagggagtcatggagagttttttgggcaccgcgatggccgggtctttgttctgtttgtttagtgggcagcctctcatcattctatccagcaccggcccaattttgatatttgagaaactgctgttcgacttttccaaaggtaacggattggattatatggagttcagactttggatcgggctgcactcagctgttcagtgtttgattctggttgccaccgatgcaagctttattattaagtacattactaggttcacagaagagggtttcagcactctaatctcttttatttttatctacgacgccatcaagaagatgatcggggcttttaagtactatcctatcaacatggactttaagccaaacttcatcacaacatataagtgtgagtgcgttgcacctgatactgtgaacacaacagtgtttaacgcatctgcacccttggcccccgacactaatgcatctctatataacctgctaaacttgaccgccctggactggtcccttctgagcaagaaagagtgtctctcatatggtggacgtctcctggggaacagctgcaagttcatccctgatttagctctgatgtctttcattttattttttggcacttactcaatgacactaacgctcaaaaaatttaagtttagcagatatttccccaccaaggtcagagccctggtggctgacttctccatcgtgttcagcatcctgatgttctgcggtatcgatgcctgctttggactcgaaaccccgaagctccatgtcccctccgtgattaagcctacgcgcccagatcgaggctggtttgtggccccctttggaaagaacccttggtgggtgtaccccgcttcaattctacccgcgctgctggtcactattctgatttttatggatcagcaaatcaccgccgttattgtcaatcgtaaagaaaataagctgaaaaaagctgctggctaccacctagatttattctgggtcggcattctgatggcactctgtagctttatgggcctgccgtggtatgtagcagccactgtcatctctattgcccacatcgatagcctgaaaatggaaacagaaacttccgcccctggagagcagcctcagttcttaggtgttcgcgaacagcgtgtaacaggaataatcgtgtttattctcaccggtatttccgtttttctggccccgattctgaagtgtatcccactacccgtcctatacggcgtgttcctgtacatgggagtagccagcctaaacggtattcaaatgggtaccgggggaagcgaattcaaaattcaaaagaagttgacacctttttgggagaggtgcaagctgttccttatgcccgcgaagcaccagcctgaccatgcattcttgcggcatgtgcctttgcgccggattcatctgttcacattagtgcagatcctgtgcctcgcagtgttgtggatcttgaagtcaacggttgccgccattatttttccagtcatgatcttggggctgattatagttagaaggctgctggactttatttttagccagcacgacttagcttggattgataacattctgccagaaaaagagaagaaggagactgacaagaagcggaagaggaaaaaaggcgcccacgaagattgcgacgaggaaccccagttccccccaccctccgttatcaagattcctatggaaagcgtgcagagtgatccccagaatggaatccattgtatcgctcgaaaaaggagctctagctggagctatagcctctag

SEQ ID NO: 206202 - DNA, 3060 bp, Artificial Sequence
  Description of Artificial Sequence: Synthetic coding sequence
atgaaggtgaaggaggagaaggccggcgtgggcaagctggaccacacaaatcatcgcaggaggtttcccgaccagaagggaagccccgctgccgagcagctccaagatatcctaggcgaggaagatgaagcccccaatcctaccctattcacggagatggacaccctccagcatgacggcgaccagatggagtggaaggaaagtgcccggtggatcaagtttgaggaaaaggttgaagagggcggggagcgctggtccaagccgcatgtgtctacactgtcactccactcacttttcgagctgagaacctgtctccagactggcacagtccttctggatttggatagcggcagtctgccccagatcatcgacgacgtgatcgagaaacagatcgaggacggcttgctacgacccgagctgcgggagagggttagctacgtactgctcagacgtcatcgtcatcagaccaagaagccgatccacagatcccttgccgatattgggaagagcgtttccacaaccaacagaagcccagcgagatcgccgggcgcggggccatccctccaccactcaacagaggacctgaggatgaggcagtcagccaattatggcagactgtgccatgcccagtcgaggagcatgaatgacatttctctgacacccaacaccgatcagaggaagaacaagtttatgaaaaagatacctaaagactccgaagctagtaatgtcttggtaggcgaggtggatttcttggaccagcctttcatcgctttcgtgcgtcttatacagtcagccatgctaggaggggtcacagaggtgccagttccgactagattcctctttatcctgctcgggccaagcggcagagccaagagctataacgaaattggaagagcaatagctactctcatggtggacgatttgttcagcgacgtggcctataaggccagaaacagagaggacttgattgcaggaatagatgagtttctggacgaggtgattgtgctgcccccaggcgagtgggaccccaacatccgcatcgagcctccaaagaaggtgccatccgcagacaaacggaaatctgtattttccctcgccgaactgggtcagatgaatgggagcgtgggcggcggcgggggggccccggggggtggcaacgggggcggaggtggagggggatccgggggcggcgcagggagcggcggcgctggggggacatcatcaggcgacgacggtgagatgccagcgatgcatgagattggagaagaattgatctggactggcaggtttttcggaggactctgcctggacattaagcggaaactgccctggttccctagcgatttttacgatggatttcatattcaatccatcagcgcaatcttgttcatttatcttggatgtattaccaacgccatcacatttgggggactcctgggagatgcaacagacaactaccagggcgtcatggagagctttctcgggaccgcgatggcgggatccctattctgtctgtttagcggacagccccttataatcctgagttcgacgggccccatactgatatttgaaaagctgctgtttgatttttccaagggaaacggattggactatatggagttccggttgtggataggcctgcactcagccgttcaatgtctaatcctggtcgcgacagacgcctcattcatcatcaaatacattacacgctttaccgaagagggattttcaacgctgatcagctttatcttcatctacgacgctatcaagaagatgatcggcgcgttcaagtactacccgataaacatggattttaaacctaatttcattactacgtacaagtgcgagtgtgttgctcccgacaccgtaaacaccacagtgttcaacgcaagtgcgcctttagccccggacacgaacgctagcctttacaatcttcttaacctgacggccctggactggtccctactcagcaagaaggaatgcctttcctatggcggtcggctcctggggaattcatgcaaattcataccagatctcgcgctcatgagtttcatcctgttctttggaacgtactccatgacgctgactcttaaaaaattcaagttctctcgatacttccccacgaagccaacacggcctgataggggttggttcgttgctcccttcggcaagaatccatggtgggtatatccagcaagtattctgcccgcactgttggttaccatcctcatatttatggaccagcagattacggctgtgatagtgaacagaaaggaaaacaagctaaaaaaagcagcgggatatcatctggatttgttttgggttggcattctcatggctttatgttcattcatgggtctcccatggtatgttgcagctaccgtcatcagcatcgctcacattgactctttgaagatggagacggagacttctgctccaggcgaacagcctcagtttctgggcgtccgtgagcagagggttacaggcatcatcgtattcatcttgacaggtatttctgtgtttctggccccgatactgaaatgcatccccttgcccgtgctctacggcgtgtttctgtatatgggagtagcttccctgaacgggatccagttctgggagaggtgcaaactttttctcatgcccgctaagcaccaaccggatcatgccttcttacgacatgttccactgagaagaatccacctgttcaccttggttcagattctgtgtctcgctgtcttgtggatactgaaatccaccgtagcagctataatcttcccggtgatgatcctcgggttgattatcgtccggcgcctactagattttattttcagccagcacgacttggcatggatcgacaatattttgcccgaaaaagaaaaaaaggagactgacaaaaagcgcaagcgcaagaagggggcacacgaagattgtgatgaagagccacaattcccccccccatcagtgattaaaatacccatggaatccgtgcagtcagatccccagaacggaatccactgcattgcgagaaaacgcagtagctcttggtcctatagcctatag

SEQ ID NO: 206203 - DNA, 3060 bp, Artificial Sequence
  Description of Artificial Sequence: Synthetic coding sequence
atgaaggtgaaggaggagaaggccggcgtgggcaagctggaccacactaaccatcgacgccgctttccagatcagaagggcagtcctgccgcagaacaattgcaagacatattgggagaagaggacgaagcccctaaccctacgttgttcacagagatggatacgctgcagcatgacggagatcagatggagtggaaagaatcggccaggtggattaaattcgaagaaaaggtggaggaaggcggggagcggtggagcaagccccacgtgagcactctgtcattacactctctattcgagctgagaacatgcttgcagactggcacagtgcttctagacctcgacagcgggagcctgccccaaattatcgacgacgtcatcgaaaaacagattgaggatgggctgctgcggcctgagctgagggagcgagtgtcttacgtgctgctcaggagacaccgtcatcagaccaaaaagcctatacatagatccctggccgatatagggaaatccgtgtctacaactaacagatctcccgcaagatctccaggtgccggaccctccttgcaccattccaccgaggaccttagaatgagacaatccgcaaattacggcagactgtgtcatgcccagtccagaagcatgaacgatatcagtcttacccccaataccgatcaacggaagaataaatttatgaagaagatcccgaaagatagcgaagctagcaacgttttggtgggagaggtggatttcctggaccaacccttcatcgcgtttgtgaggttgattcagtccgccatgctaggcggggtcacggaggtccctgtgcctacacggtttctgttcattctcctgggtccgtcaggaagagccaagagctacaacgagattggcagagctattgccactctgatggtcgacgacttgttttctgatgttgcttataaagctcgcaatcgagaagacttgatcgctgggattgacgaattcctggatgaagttatcgtgctgcctccgggagagtgggatcccaatatcagaatcgagccacctaaaaaggtcccctctgctgataaaaggaaatccgtgttttctttggcagagttaggtcagatgaacggcagcgtgggtggcggcgggggcgctcctggtgggggcaacggcggaggcggcgggggaggatccggagggggcgcaggctcgggcggagcgggaggtacttcaagcggggatgacggggagatgcccgcaatgcatgaaatcggagaggagcttatatggacggggaggtttttcgggggattatgcctggatataaagaggaaactgccctggtttccgtcggatttctatgacggattccatatacaaagcatttctgcaatcctcttcatctacctcggttgcataaccaatgctattacatttggaggcctgctgggagatgccacagataactatcagggggtcatggaaagttttttggggacggcaatggccgggagcctcttctgcctgttcagcgggcagcctcttatcattctgtcctctacgggtccgatcttaatttttgagaaattattgtttgatttcagtaagggaaatggcttggactatatggagttccgtctctggatcgggcttcattcagccgtgcagtgccttatactggtggctaccgatgcaagtttcattattaagtacattacacggtttactgaagagggattctcaacactcattagttttatcttcatctacgatgcgatcaagaaaatgattggggcctttaaatattaccctatcaacatggactttaaaccgaatttcattaccacatataagtgtgaatgtgtggcccccgacactgtgaacaccaccgtctttaatgcatctgcccccctggcacctgacactaacgcctctctgtacaacctcctcaacctgacagcgcttgactggagcctgctgagcaagaaagagtgtctgtcttacggcgggcggctgctgggcaactcttgcaagttcatcccagatcttgcacttatgagctttattctcttcttcgggacctatagtatgactctgactctcaaaaagttcaagttctctcggtacttcccaaccaagcccacccggccagaccgaggatggttcgtagctccgttcggtaagaacccttggtgggtgtaccccgcgagtatcctcccagcactcttagtaaccatcttgatcttcatggatcagcaaattacagcggtgatcgtcaatcgcaaggaaaacaagctgaaaaaagcggccgggtatcatctggatctgttctgggtgggaatcctgatggccctgtgcagctttatggggttgccctggtatgtggcggcgacggtcatctccatcgcccacattgacagcctcaaaatggaaaccgagacatctgcacctggggagcaaccccaattcctgggcgtgagggaacaaagggttacaggcattattgtatttatcctcactgggatatcggtgttcttggccccaatcctcaaatgtattccacttccggtcttgtatggagtttttctgtacatgggagtggcctcattaaatggcatacaattctgggaacggtgcaagctctttttgatgcctgctaagcatcagcccgatcacgcctttctaaggcatgtgcctttacggaggattcacctgttcaccctcgtccaaattctgtgcctggccgtgctctggatattaaagtcaaccgtggcagcgattatctttcctgtcatgatcttaggattgataatcgtccgcagactactggacttcattttttctcagcacgacctggcctggatcgataatattttgccagaaaaagaaaagaaggaaactgataaaaagcggaaacgcaaaaagggggcgcacgaggactgcgacgaggagccccagtttcccccgccgtccgtgataaagattcctatggagagcgttcagtcggacccccagaatggcatccactgcattgctagaaaacgctctagctcgtggtcttactccctgtag

SEQ ID NO: 206204 - DNA, 3123 bp, Artificial Sequence
  Description of Artificial Sequence: Synthetic coding sequence
atgaaggtgaaggaggagaaggccggcgtgggcaagctggaccacactaatcatcgcagacggttcccggatcagaaggaatgccctcctatccacatcggactgcccgttccaacttaccctcagcggaagacagaccagaaagggcatctgagtgggctgcagaaagtacactggggtttgagaccggatcagccacagcaagagctgaccggtccaggttccggcgcatctagccaggatagcagtatggatctcatatcaagaacccgctctccagcggccgaacaactccaggacatcttaggagaagaggatgaagcacccaacccgacattgttcacagaaatggacacacttcagcacgatggcgatcagatggagtggaaagaatccgcccggtggattaaatttgaagagaaagtcgaggaaggcggagagaggtggtccaagcctcatgtaagtactttatcattgcactctttgtttgagctgaggacatgcctccagacaggaaccgtcctcctcgacctggattccggctctctgccacagatcatcgacgacgtgatagagaaacaaatcgaagacggactcctccgcccagagcttagagaacgagtgagttatgtgctgctccggagacacaggcatcagacaaagaagcccattcataggagccttgccgacataggaaagtccgtcagcactactaatcggtcccctgccagatctccaggagccgggccgtcactccaccactctacagaggatctgcggatgcgccagagcgcaaactacggacgtctgtgccacgcccagtctcgatcaatgaatgatatctcgctcacccctaacactgaccagcgaaaaaataagtttatgaaaaaaatcccaaaagactcagaggcatccaacgtacttgtgggagaggtcgatttcctggatcagccctttattgcctttgtaagacttatccagtccgcaatgctcggcggggttacagaagtgcccgttcccactagatttctgttcattctcttgggtccaagtggccgggccaagtcttacaacgagattggccgtgccatcgccaccttgatggttgatgatctttttagcgacgtggcatataaggcccgtaaccgggaggacttgatcgcgggtatagacgagtttctggacgaggtgatcgttctacccccgggggagtgggatcctaatattcgcatcgaacctccaaagaaagtaccctcagccgacaagcgcaagtccgttttctcattggccgagttaggacagatgaacggatccgtcggcggaggcgggggagccccagggggcggaaacggagggggcggaggcggtggatcgggcggcggagccggctcaggaggcgcgggaggaaccagcagtggggacgatggcgaaatgccggccatgcatgagatcggtgaagagctgatttggaccggcagatttttcgggggactgtgcctggatataaagcggaagctgccatggttcccatcagacttttatgatgggtttcatatccaaagcatctctgccatcctatttatctatctgggctgtattacaaatgccattacattcggcggcttgctcggggatgccacggacaattatcagggtgtaatggaaagcttcttaggcacagctatggccgggtcactattctgcctgttttctggacagcctctcattatactgagtagcacaggccctattctcattttcgaaaaacttctgtttgacttctctaagggcaatggactcgattacatggaattcaggctttggattgggctgcactccgctgtccagtgcctgatcctggtggccaccgatgccagctttattatcaaatacatcacacggttcaccgaagaaggattcagcaccctgatctcattcatcttcatttacgatgctattaagaaaatgatcggcgcctttaagtattacccaatcaatatggacttcaaacccaacttcattactacatacaagtgcgagtgtgtcgccccggacacagtcaataccactgtgtttaatgccagcgccccactggctcccgacacgaatgcttcgctgtataatctcctgaatttgacggccctcgactggtctctgctcagtaagaaggaatgcctcagctatgggggaaggcttctgggtaacagctgtaagtttatacctgatctggctctgatgtcattcatccttttttttgggacctactcaatgacgctgaccctgaagaagtttaagttttcccgctactttccgaccaaagtaagggcgctggtggcagattttagtatcgtgttttctatcctgatgttctgtggtattgacgcctgctttggacttgaaacccctaagcttcacgtcccaagcgttatcaaacccaccagaccagatcgtggatggttcgtggctcccttcggcaagaacccgtggtgggtgtatccggcttccatactccccgccctgctggtgacaattttaattttcatggaccagcaaatcacagccgtgatagttaaccgtaaggaaaacaagctgaaaaaggccgccggctatcatctggacttgttttgggtagggatacttatggcactatgctcgtttatgggactgccttggtatgtagcagcaacagtgatctcaattgctcacattgactccttgaagatggaaacagaaactagcgcccccggcgagcagccacaattcctgggtgtccgagaacaaagggtgacaggaattatcgtgtttatactcacagggatttccgtcttcttggccccaattttaaagattctggggctcataatcgtaaggaggctcctggatttcattttctcccagcatgacctagcctggatcgacaatattctgccagaaaaggagaagaaagaaacagacaagaagcgaaaacgaaaaaagggagcgcatgaagactgtgacgaggagcctcagtttccccctcccagcgtcattaagatacccatggaatcagttcagtcagaccctcagaacggaattcactgtattgccaggaaacgcagttcctcgtggagttattcattgtag

SEQ ID NO: 206205 - DNA, 3414 bp, Artificial Sequence
  Description of Artificial Sequence: Synthetic coding sequence
atgaaggtgaaggaggagaaggccggcgtgggcaagctggaccacaccaaccaccgccgtcggtttccagatcaaaaagaatgtccaccaattcatatcggcctgcccgtcccaacttatccccagagaaaaacggatcagaaaggccacctgtctggccttcagaaggtgcattgggggttgaggcccgatcaaccccagcaggagctgactgggcctggttccggggcgtcctcccaggattcctcaatggatctgatttcacgtacacgctcgcccgccgctgagcagttacaagacatactgggagaggaggacgaagcccccaacccaaccttattcaccgagatggacaccctgcaacacgatggagaccagatggaatggaaagaaagcgcccgatggattaaatttgaggagaaggtagaggaagggggggagcggtggagcaagcctcatgtgtcaaccttaagccttcacagcctgttcgaactgcgtacctgtctgcagaccggaacagtcctacttgatcttgactccggcagcctgcctcagatcattgatgacgtgattgagaagcaaatcgaagacggactcctgaggcctgaactgcgtgagcgcgtgagctatgtgttgttgcgaaggcacaggcatcagacgaaaaaacctatacatagaagcctggctgatattggcaagtctgtgagcaccaccaatcggtcgcctgcacgcagccctggtgctggtcccagcctccaccactcaaccgaggacctcaggatgcggcagtcagccaactatggccgattatgccacgcccagagccgcagcatgaatgacatttccctgacaccaaacaccgaccagagaaagaataagttcatgaagaagatccctaaagactctgaggcctccaatgtgctggttggtgaagtggacttccttgatcaaccttttatcgcattcgtacgtctcattcagagtgctatgctgggtggggtgacagaagtccccgtgccaacgcgctttctgttcatcctgctgggtccatctggccgggctaagagctacaatgaaatcggacgagcaatcgccaccttgatggtggatgatctgttcagcgatgtggcgtataaggcgcggaatcgcgaagatctcatagcagggatagacgagtttctggacgaagtgatcgtcctcccacccggggagtgggacccaaacatacggattgagccccctaagaaggtgcctagcgccgataagaggaaatcagtgttttctctggctgagctgggccaaatgaacggctccgtcgggggtggcggcggtgctcccggcggcggaaatggcggaggcgggggagggggcagcggaggcggcgcgggatccggaggcgcaggaggtacatcttccggggacgatggagagatgccggccatgcacgaaatcggagaggagctaatatggacaggaagattctttggcgggctttgtcttgatattaaaaggaagctaccgtggttcccttctgatttctacgacgggtttcacatccaaagcatcagcgccatactcttcatctacctgggatgcattacaaacgcaatcacctttggtgggctacttggcgacgcaaccgacaactatcagggggtgatggagtccttccttgggaccgccatggcaggctcactgttttgcttgttctccgggcaacccctgattattctgagttcaactggcccaattctcatcttcgagaaactgctctttgatttcagtaaagggaatggccttgattacatggagttcagattatggatcgggctccattccgcagtccagtgcctgattctggtggctacagacgctagcttcattattaagtatatcacgagatttactgaagagggcttctccactctgattagcttcatatttatatatgatgccatcaagaaaatgattggcgccttcaaatattatccgatcaacatggacttcaaacctaatttcataaccacctacaagtgtgaatgtgttgcccctgatacagttaatactacggtctttaatgcctctgctccactggcaccagacacaaacgcctctttgtacaacttactcaatctgaccgctttagactggtcactgctttctaaaaaggaatgcctctcttacggtggcagattgctgggcaattcatgtaagttcatccccgatctggcccttatgtccttcattctgttcttcgggacctattccatgacattgacactgaagaaattcaagttttcccggtactttccaacaaaggttcgagctctggtggcagatttctcaatcgttttctctattctcatgttttgcggcattgacgcttgctttgggcttgagacaccaaagcttcatgtcccctccgttatcaaacccacacgccccgatcgaggctggttcgtagccccattcgggaagaacccctggtgggtctatccagctagcatattgcctgctttgctggttacgattttaatttttatggaccagcagataacggcggtaattgtaaatcggaaggagaataagcttaaaaaagccgctggttatcacctcgatctcttctgggtgggaatcctgatggccctatgttcctttatggggctcccatggtatgtagcagctacagttatttctatagcgcacatcgacagtctgaagatggagactgaaactagcgcaccaggcgagcagccccagttcctaggggtgagggaacagcgggtaacagggatcattgtgtttatccttactggtatctcagtctttctggcccccattttgaaatgcattccattgccggtactatatggcgtgttcctatacatgggcgtcgccagcctgaatggcatacagatggggacgggcggaagcgagttcaagattcagaaaaagctcacacccttctgggaacgatgcaagctgttcctcatgcccgccaagcaccaacccgatcacgccttcctccggcatgtcccattgagacgcatccacttattcaccctggtccaaattttgtgtctggccgtcctttggatcctgaagtctactgtggctgcaattatattcccagtgatgatcttagggttaattatcgtgcgccgtctcctggactttatcttttctcagcacgacctggcttggattgataacatcctccctgaaaaggagaaaaaagaaacagacaagaaacgtaagagaaaaaaaggtgcccacgaagattgtgacgaagagccacagttccccccaccttctgttattaagattccaatggaatctgtgcagtcggacccacaaaatggaatccactgtatcgctagaaaacggagttcttcttggagctacagtctgtag

SEQ ID NO: 206206 - DNA, 3366 bp, Artificial Sequence
  Description of Artificial Sequence: Synthetic coding sequence
atgaaggtgaaggaggagaaggccggcgtgggcaagctggaccacacaaatcatagaaggcgcttccctgaccagaaggaatgtcccccgattcacatcggacttcctgtgcccacttacccacagcggaaaacagatcagaaggggcatctgagtggactgcagaaagtgcactgggggttgcgtccagatcaaccccagcaggaattgaccggtcctggcagcggtgcgtctagtcaggacagcagcatggacctgatctcaaggacgcggagcccagctgcagagcagcttcaggacatcctcggagaagaagatgaagctcctaatcccactctgtttacagagatggacacgcttcagcacgatggagatcaaatggagtggaaagaatctgctcgctggatcaagttcgaagagaaagtcgaggaaggtggcgagcgttggagcaaaccacacgtatcaacgctaagcctgcacagtctgtttgaacttcgcacttgcctgcaaaccggtaccgtcctgctggatctagattctggttcgctacctcagatcattgatgatgtgatcgaaaaacaaatagaggatgggctgcttcgtcctgagttgagggagcgggtgtcatatgtccttctcagacgccatcgccatcagaccaagaagcctattcaccgttcactggcggacatcggcaaaagcgtgtccaccaccaaccggtcgcccgccaggtcccctggggctggtccctcacttcatcactcaaccgaggacttgcggatgcggcagtcggccaattatggcaggctgtgtcatgctcaatccaggagcatgaatgatattagtcttacccccaatactgatcagcggaagaataagtttatgaagaaaatcccaaaagactcggaagcatctaacgtccttgtgggagaagttgactttcttgatcagccatttatcgcctttgtgagactcatccaaagtgctatgctgggtggcgtgacggaggtgccggtccccaccagattcttgttcatcctgctgggcccctcaggaagggctaagtcatacaacgagatcggccgggcaattgcaactctcatggtcgatgatttgttctctgatgttgcttacaaagctcgcaaccgtgaggacctcattgccggaatcgatgaatttctggacgaggtcatcgtgctccctcctggggaatgggatcccaatatcaggattgagccccctaagaaagtcccttcagctgacaaacgcaagtcggttttctcgttagccgaactgggccagatgaatggaagtgtcggaggtggcggaggagcaccaggtggggggaatggagggggcggcgggggcggcagcggaggaggcgcgggtagcggtggggctggtggtacgtcttcaggggacgatggtgagatgcctgctatgcatgagatcggcgaagagctcatttggactggacgctttttcgggggattgtgcctggacatcaaacgtaagctgccctggtttcctagcgatttctacgacggttttcatatccagagcatctccgcgatccttttcatttatctgggctgcattaccaatgcaatcaccttcgggggcctgctgggagatgctacagacaactatcagggagttatggaaagtttcctgggtacagcgatggcaggatcactgttttgcctgttttccggccagcccctgattattctcagttctaccggtcccatacttatcttcgaaaagttactgtttgatttctcaaaaggcaacggactggattacatggagttccgcctctggatcggcctccattcggctgtgcagtgccttattttggtcgctacagacgcaagcttcatcatcaagtacatcacaagatttactgaagaagggtttagtaccctgatttcctttatattcatctacgacgctatcaagaaaatgattggcgcatttaaatactacccgattaatatggattttaagcctaatttcatcacaacgtacaagtgtgaatgcgttgcgccagatactgttaataccactgtattcaacgcctccgcaccactcgctcctgacaccaatgcaagcctgtataacttactgaatcttactgccctcgactggtccctgctatccaaaaaggagtgtctgtcatacgggggccgtctactggggaactcgtgcaagttcattcctgatcttgccctcatgtcctttattttgttcttcggcacctactcaatgacgctcacactaaagaaattcaagttctcacgctattttccgacgaaagtaagggctctcgttgccgatttcagcatcgtgttctcgatcctgatgttctgcggtatagacgcctgttttggcctcgagacaccgaaattgcacgtacccagtgtgataaagcctacacgtcctgacagaggctggttcgtggcccccttcggcaaaaacccctggtgggtgtatcctgcctcaattctgccagccctcctggttaccatcctgatattcatggaccaacagattaccgccgtcatcgttaatcggaaagaaaacaaactgaagaaggcagccgggtaccacctggacctgttctgggtgggcatactgatggcactgtgctctttcatgggcctcccatggtacgtcgcggccacagtgatcagcatcgctcatattgacagcctcaaaatggaaaccgaaacgtctgcacccggagaacagcctcagtttttgggtgtgagggagcaaagggttaccggaatcatcgtgtttatcctaactggtataagcgttttcctcgccccgatcctgaaatgtattccactgcccgtgctgtacggcgtctttctgtacatgggcgtagccagcttgaacgggatccaattctgggaaagatgcaagctctttctcatgcccgccaagcaccagcccgaccatgccttcctccgacacgtgcccttaaggcgaatccacttgtttaccctcgtacagattctatgcctggctgtactttggatcttgaaatccacagttgctgcgattatattcccggttatgatcctggggcttatcatcgtgcgccgcctgctggactttattttcagtcagcatgatctggcttggatagataacatcctccccgagaaggaaaaaaaggagacagacaagaaaaggaagcgtaagaagggcgcccatgaagattgcgacgaggagccccaattcccgcctcccagcgtcatcaaaattccaatggaaagcgttcagagcgatccgcagaatggcattcattgtatagctagaaagcgaagtagctcctggtcctattcactgtag

SEQ ID NO: 206207 - DNA, 2982 bp, Artificial Sequence
  Description of Artificial Sequence: Synthetic coding sequence
atgaaggtgaaggaggagaaggccggcgtgggcaagctggaccacacaaatcatcgcaggcggttccccgatcagaaagagtgtccgcccatccacattgggcttcctgtcccaacatatccccagcgcaagaccgaccaaaaaggtcatctgtcagggctccagaaggtacactggggcttgaggccggaccagccccagcaagaactaacaggcccggggtccggcgcttcttcccaggactcttccatggacctgatttcaagaacacgcagccctgcggccgaacagctgcaagatattctcggggaggaggacgaggcccctaaccctactctgttcactgagatggatacactccagcacgacggcgatcagatggaatggaaggaaagcgctcgttggattaaattcgaggagaaagtcgaagagggaggcgaaaggtggagtaaaccacatgtgagtacactgagccttcacagcctgttcgaactcaggacctgcctccagactggcaccgttctgctagatctcgactcagggagcttgccgcagataatcgatgatgtgattgagaagcagatcgaggacggcttgcttagacctgaactaagggagagggtatcgtatgtgttactgagacggcaccgtcaccagacaaaaaaacctatccacagatccctcgcagatatcggaaaatctgtctctactacaaaccggagcccagcccgcagcccaggtgcggggccatctctccaccatagcacagaggacctgaggatgcgacagagcgctaattatggaagactctgccacgcccagtctaggagcatgaatgacatctcattgacaccaaataccgatcagagaaaaaataaattcatgaagaagatccctaaggattcagaagcaagtaacgtcctggtgggggaggtcgactttctggatcagccattcattgccttcgtgaggttgattcagtctgcgatgttgggcggcgtgactgaggtgcctgtgcccactcgcttcctgttcattctgcttggcccgtctggtagagccaagtcctataatgaaattggaagagctatcgctaccctgatggtggacgatctgttttcagacgtcgcttacaaggccagaaatagggaggacctgattgccggtatcgatgagtttcttgacgaggtgatagtgcttcccccaggtgaatgggatcctaacatacgcattgagcctccgaaaaaagttccctccgccgacaagcggaagagcgtattttccctggctgaactcgggcagatgaacgggtccgtcggcggcggcggaggcgcccctggcggcggaaacggaggaggcggcggcgggggaagtgggggtggcgcaggctccggcggagctggcggaacctccagcggcgatgatggtgaaatgccagctatgcacgagattggtgaagaactcatttggacggggcggttttttggcgggctttgtctggatatcaagcggaagctaccgtggtttccgagtgatttttacgatgggttccacatccaatctatttctgccatcctgttcatctatctgggctgtatcaccaatgccataacctttggcggcctgttgggggacgccactgacaactaccagggggtgatggagtcgttcctcggcactgctatggccggatcactgttctgcttgtttagcggccaacccctgattatactctctagtaccggtcctatactcatattcgaaaagctgctttttgacttcagcaagggcaacgggctggactatatggaatttaggctctggattgggctgcattccgccgtccagtgtctaatcttggttgccacggacgcctctttcattattaaatacatcacaaggtttactgaggaaggctttagtactctcatctcctttatcttcatttatgacgccatcaagaagatgattggcgcatttaagtactacccaatcaacatggattttaaaccaaacttcattacgacttataagtgcgaatgcgtcgcgcctgataccgtcaatacaactgtgtttaatgcctccgctcctctggcgcccgacactaacgcttcactgtacaacctcttgaatctgaccgccctggattggagtttactgagcaagaaagaatgcttgtcttacgggggtagacttctcggtaattcgtgcaagtttataccagatctggctctaatgtcctttatcctgttcttcggtacctattctatgacactcactctcaaaaagttcaagttctctaggtacttcccaaccaaggtacgtgcccttgtagccgacttctctattgtattcagcatattgatgttttgtggaattgacgcgtgtttcggccttgaaacccccaaacttcacgtgccatctgtgatcaagccaacaaggcctgacagagggtggtttgtggctccatttgggaaaaatccttggtgggtctatcccgcttctatcctccctgctctgctggttaccatcctgattttcatggaccagcagatcaccgccgtgatcgtcaatcgcaaggaaaacaagcttaagggcacagagtccaaccgccaccatcggctgcaccctgacggcaacctgtgtctgcctggttctcatcccaaggtgtatcctcctgcaggcgccgttaggtctttgccgttgcacgggaggggcttgcccgagtggcacccagttttaggtacactgcaggcactgccggatgcttcccaggctcccgccggtccttgcctaccagctgctcgggccgccgccccagatcccccgttacaccccggtgctgatcccctacccggtggcgccttagacccgcagatccacggcggctgccaccacctgccaggccatgaccccggaccccatcataggagcaaggccagcggcttccaccttttccctgcgcgcccaggccttgactag

SEQ ID NO: 206208 - DNA, 2895 bp, Artificial Sequence
  Description of Artificial Sequence: Synthetic coding sequence
atgaaggtgaaggaggagaaggccggcgtgggcaagctggaccacacaaatcatcgtcgcaggtttccggaccagaaagagtgcccaccgatccacattggcttgccggttcccacctacccgcaaagaaagactgaccagaaggggcatttgtctggactgcagaaggtgcattggggcctgagacctgaccagcctcagcaggagctgactggccccggttccggcgcgtcgagccaggactcctcaatggacctcatatctcgtactcggtcccccgcagcagagcagctccaggatatccttggagaggaggacgaggcccccaatccgaccctgttcacagagatggatacactgcagcacgacggcgatcagatggagtggaaagaaagtgcaagatggatcaagtttgaggagaaagtagaggaaggaggcgagcggtggagtaagccccacgtttcaaccctgtccctccacagtttgttcgaacttcgaacctgtctgcagacggggacagtgctgctcgacctggactccggttccctgccccaaatcattgacgacgttattgagaaacagatcgaagatggcctcctcaggcctgagctccgggagagagtgagctacgttctcctgagaagacatcggcaccagaccaaaaagcctattcataggagcctggccgacattggaaaatctgtttccaccacaaaccgatcccccgcccggtctcccggagcggggccatccctgcaccactcaactgaagacctccgcatgaggcagtccgcgaactacggcaggttgtgccatgcccagagcaggagcatgaacgatattagtctgacacccaataccgaccaaagaaagaataaatttatgaagaagattcccaaagattccgaggccagcaacgtgctggtcggagaagtggacttcttggaccagccctttatagcgtttgtgagactcattcagagtgcgatgctggggggcgtcacggaggtgcctgttcctactaggtttctgttcattttgctaggcccttccggcagagctaagtcctataacgaaattggccgtgctatagcaacactgatggttgacgatctgtttagcgacgtcgcctataaagcccgtaacagagaggatttaatagccgggatagatgagtttctggacgaggtgatcgtacttcccccgggagaatgggacccaaacatcaggatcgaaccccccaaaaaagtgccctcagctgacaaacgaaaaagtgtgttctctctcgctgagctcgggcagatgaacgggagtgtcggcggcggaggcggagctcccgggggcggcaatgggggcggtgggggtggcgggagtgggggcggggccgggtccggcggggctggcggtactagttctggggatgacggggaaatgccggctatgcacgagatcggggaggagctgatctggacgggaagatttttcggggggctctgtctggatatcaaaaggaaattaccatggtttccatctgacttttacgatgggtttcacattcagtccatttcggcaatcctgttcatatatctgggttgcattaccaacgccatcacgttcggcggactcctcggagacgccactgacaactaccagggtgttatggaaagcttcctcggaacggccatggccggatccctcttctgtctttttagcggacagccactgatcatcctttcctctaccggacccatcctgatttttgaaaaactgctgttcgacttctccaagggcaatggcctagactatatggagttcagactttggattggactccacagcgctgtacaatgtttgattctggtagccaccgatgcatctttcataattaagtacatcacgcgtttcaccgaagaagggtttagcacccttattagttttattttcatctacgacgccattaaaaaaatgattggagcgttcaagtactacccaatcaatatggatttcaagcccaacttcattaccacttacaagtgtgaatgcgtggcccctgatacagtgaatacgaccgtttttaacgcgagtgcccccctcgctccggatacaaacgctagtctgtataatctgctgaatctgactgccctggattggtctctgttgagcaagaaggaatgcttatcctatggcggaagactcctgggaaattcatgcaagttcataccggacctggccctgatgagtttcatcctattttttggcacttattccatgacacttaccctgaaaaaatttaaatttagtcggtattttccaactaaaccaacccgcccagatcgcgggtggtttgtggcacccttcggcaagaacccctggtgggtctatcccgcctcaattctcccagctctgctcgtcacaatcttgattttcatggaccagcagataacagcagtgatcgtaaaccggaaggagaataagctcaaaggcacagaaagcaaccggcatcatcggttgcatccggacgggaatctgtgtttgcctggctcccaccctaaggtgtatccaccggccggggcagtccgaagcttacctctgcacggccgcggtctgcccgaatggcacccagttctcgggacgctgcaggctctgcccgatgcctcccaggcaccggccggtccatgtcttcccgccgcccgtgccgccgcacctgacccccccttacatcctggcgcggatcctctccctggaggcgcccttgatccacagatccatggcggatgccaccacctgccgggccatgtttccctgcatcatagaagctgggcatctagctcatttgaagggttttggatttcctcctttccctccactacttggcccggtttgacgacttcctag

SEQ ID NO: 206209 - DNA, 390 bp, Artificial Sequence
  Description of Artificial Sequence: Synthetic coding sequence
atgaaggtgaaggaggagaaggccggcgtgggcaagctggaccacaccaatcaccggcggcgatttcctgaccagaaggaatgccctcccatccatatcgggctgcccgtccccacctatcctcagagaaaaactgatcagaaaggccacttgagcggcttgcagaaagttcattgggggctccgcccagatcagccacaacaagaactaaccgggcccggctctggtgctagcagtcaagattcgtctatggatctaattagtagaactcgctcccccgccgcggaacaattgcaggacatcctcggagaagaggacgaggcgcctaatccgacactctttactgagatggacacccttcaacatgatggcgaccaaatggagtggtag

SEQ ID NO: 206210 - DNA, 438 bp, Artificial Sequence
  Description of Artificial Sequence: Synthetic coding sequence
atgaaggtgaaggaggagaaggccggcgtgggcaagctggaccacaccaaccataggagacgctttcccgatcagaaggagtgtcctcctattcatattggtctgcccgtacccacttaccctcagcggaaaactgatcagaagggacatctgagtgggctgcaaaaagtgcattggggactgcgtccagatcagccacagcaggagctcactggacctggatccggagcatcatctcaagacagttccatggatctgatctctcggacccggagccccgccgctgagcaattacaagacattctgggggaggaagatgaggctcctaaccccacgctcttcactgagatggacacgctgcaacacgacggcgaccagatggaatggaaggagtcagccaggtggattaaattcgaggagaaagtggaagagggatag

SEQ ID NO: 206211 - DNA, 3429 bp, Artificial Sequence
  Description of Artificial Sequence: Synthetic coding sequence
atgaaggtgaaggaggagaaggccggcgtgggcaagctggaccacaccaaccacagacgacgtttccccgaccagaaggagtgccccccaattcacatcgggttgccagtgccgacttatcctcaacgcaagacagatcagaaaggacatctctctggactgcagaaggtgcattggggattacgtccagaccaaccgcagcaggaactgacaggacccggtagtggcgcatcttcccaagatagtagtatggatctgatcagtagaactaggtctcccgccgccgagcaactccaggacattctgggagaggaagacgaggcgcccaaccctacactgtttacagagatggacacactgcagcatgatggagaccagatggaatggaaggagtcagcgaggtggatcaaatttgaagaaaaagtcgaggaaggcggggaaaggtggtccaagccccacgttagcaccctgagtcttcactctcttttcgagctgcgcacttgcctgcagaccggaaccgtgctgttggacctggactccggcagcctgcctcagatcatcgacgacgtgattgaaaaacagatcgaggacggactgctgaggcctgagctccgtgagcgggtgtcttatgtcctgctacggcgccacagacatcagaccaaaaagccgatccaccggtccctggccgatatcggcaagagcgtgtctaccacaaataggagcccagcgcgcagccccggggccgggccatccttacaccacagtacagaggacttacgcatgagacagtctgccaactacggtcggctgtgtcatgcccagtcacgcagtatgaacgatatcagcctgacccctaacactgaccagcgcaagaataagtttatgaaaaagatcccgaaagatagcgaggcctccaatgtgctagtgggtgaagtcgacttcctggaccaacctttcattgccttcgttaggctaatccagtctgctatgttgggcggcgtgaccgaggtccccgttcccacaagattccttttcattctcctagggccttcagggcgggccaagagctataacgaaattggacgagccatcgccaccctcatggtagatgatttattctcagatgtcgcttataaggctcggaacagggaggatctaatcgctggtattgacgagttcctggacgaggtgatagtcctgccacctggggagtgggaccccaatattagaattgagccaccaaagaaagtgccttctgcggacaagaggaaaagtgtgtttagtctcgccgagttaggccagatgaatgggagcgtgggcggaggaggtggagcacctggtggagggaatggggggggaggcggagggggatccgggggcggggctggctctgggggagccgggggtactagctctggagacgacggggagatgccagctatgcatgagatcggcgaggaattaatttggacgggccgttttttcggaggtctgtgtcttgatattaaaaggaaactcccatggtttccgagcgatttctacgatggattccacattcagagtattagcgcaattttatttatttatctcggatgtatcacgaatgctatcacattcggaggattgttgggcgacgccacagataactatcagggcgtaatggagtctttcttgggaactgctatggcaggttctctcttctgcctgtttagcggccagcctctgatcatactttcatccaccgggcctatcttaatttttgaaaaactgctgtttgatttttccaagggcaacgggttggactatatggaatttcggctctggattggcctgcacagcgctgtgcagtgcctgattctcgttgcaactgacgcttcctttatcatcaaatacatcactaggttcactgaggaaggcttcagtaccctgatcagttttatctttatttatgatgcaattaaaaagatgataggggcctttaaatactacccaattaatatggattttaagcccaatttcataactacctacaaatgcgagtgcgtggcgccggatactgtgaacacaacagtattcaatgcttctgcgcctctggccccggataccaatgcatctctctacaacctcttaaacctcaccgcactggattggagtttgctctcaaaaaaagaatgcctctcctacggtggtaggctccttgggaactcgtgcaagtttatcccagatctggcattgatgtcgttcattctgttctttggaacatattccatgaccttgacactcaaaaaattcaaattttcccgatactttcctacaaaggtacgggccctcgtggcagacttttctatcgtgttctctatccttatgttttgtggtatcgacgcctgtttcggcttagagacaccaaaactgcatgtgccaagtgttataaaaccaaccaggccagaccgggggtggttcgttgctccttttggaaagaatccctggtgggtctatccagcttccatcctgccagccctgctggtaacgatcctgattttcatggatcaacagattacagctgtgattgttaatcgcaaggaaaacaaattgaagaaggcagctgggtaccacctcgacctgttttgggtcggcattcttatggcactgtgttcgtttatgggcttgccttggtatgtcgctgctactgttatcagcatcgctcatatcgactccctcaagatggagactgagaccagcgcccctggcgaacagccacagtttctcggcgtgagagagcagagagtcaccggcatcattgtattcatcttgaccggcatctccgtgtttcttgccccaattttgaagtgcattcccttgccagtgctctatggcgtttttctctatatgggcgttgcaagcttgaacggaatccaaatgggaaccggcgggtctgagtttaaaattcagaagaagctgacgccgttctgggagcggtgcaaactatttctgatgccagcaaagcatcaaccggatcatgcattcttaagacatgtgcctctccgccgcatccatttgtttacactggttcagatcctatgcctggccgtgctatggatcctgaaatctactgtggccgcaataatctttcccgttatgagcctgagcacgacagacctgggccttatcatcgtacgtcggctcctagacttcatctttagtcaacatgacctggcttggatagataatatcctgccagagaaggaaaagaaggagacagataagaaacgaaagcgtaagaagggggcccacgaagattgtgacgaggagcctcagttcccgccgcccagtgtcattaaaatccctatggaatccgtgcagtctgatccccagaatggcatacattgcattgctaggaaaaggtcaagttcttggtcctattccctgtag

SEQ ID NO: 206212 - DNA, 3645 bp, Artificial Sequence
  Description of Artificial Sequence: Synthetic coding sequence
atggagcggttccggctggagaagaagctgcccggccccgacgaggaagcagtggttgacctcgggaaaacctcaagcaccgtcaatacaaaattcgaaaaagaggaactggagagccatcgggccgtctatataggggtgcatgtgcctttttctaaggaaagccggagaagacaccgccacagggggcacaagcatcaccaccgacggcgaaaggacaaagaatccgacaaagaagacgggagagagagtccctcctatgatacacctagccaacgggtacagtttatcctgggcactgaggatgatgacgaggagcacatcccacacgatctctttaccgagatggacgagctctgctatagggatggcgaagaatacgaatggaaagagacggcccgctggctgaagtttgaggaggacgtggaggacggaggagacaggtggagtaaaccgtacgtcgctactctgtccctgcactccctttttgaactgagaagctgcattctgaacggcacagtcatgctcgatatgagagccagcactctggacgagatcgcagacatggtgctcgacaacatgatcgcctccggacagctcgacgaatctattcgagaaaacgtcagagaagccctcctcaagcgccaccaccatcagaatgagaaaagattcacaagccgaatccctcttgtccggtcatttgcagatattggcaaaaagcattctgacccccacctccttgagaggaatggtgagggcctgtccgcctctcgccactcactcaggacggggctgagcgcatcaaacctaagcttgcggggcgagtctccattgagtctgctgcttggtcacttattgcctagctctcgagccggcacacctgcaggaagtcgctgtaccaccccggtgccgaccccccagaactcacccccaagctcaccgtcaataagccgcctgactagtcggtctagccaggagtcccagaggcaagcacctgaactgcttgtctccccagcgagtgacgacattcccaccgtggtcatacatcccccagaggaggatttggaggcggctctcaaaggggaagagcagaagaatgaggaaaacgtggaccttacgcctggaattctcgcgagccctcaaagtgcacctggaaatctcgacaattccaagtctggagaaattaaaggtaacggctcaggtggatcgcgtgagaattccaccgtggacttttctaaagtggacatgaacttcatgaggaaaattcctactggcgcagaggcttcaaacgtcctagtcggggaagtcgatttcctggaacgtcctataatcgccttcgttcgcttagcaccggcagtcctgctcaccgggctcaccgaggtgcctgtccctacgcggttcttatttctgcttctcggccctgctggaaaggccccgcagtaccacgagatcggcagaagcatcgctacactgatgaccgacgagatatttcacgatgtcgcctacaaggcaaaagataggaacgacctattgtccggaatcgacgaatttcttgaccaggtcacggtacttcccccaggagagtgggatccatcaatacggatcgagccccccaaatccgttccctcacaagaaaagaggaaaatcccggtcttccataacggtagtaccccaacactcggcgaaacccctaaagaagcggcacaccacgctggccctgaattacagaggactggtcggttattcggaggcttgattctagacatcaaacgtaaagcgcctttttttctgtcagatttcaaagacgctctcagtttacaatgtctggcgtccattcttttcctgtactgtgcctgcatgagccccgtcatcacctttgggggtctgctcggcgaggctacggagggcaggatctccgcaattgaatctctgttcggcgcaagtctaactgggattgcttacagtttattcgcagggcagccgctcacaatattaggcagcaccggaccagtactggttttcgagaagattctgtataaattttgcagagattaccagctgtcctacctcagcctgcgcacctctatcggtctgtggacaagttttctttgcatagtgcttgtggccacagatgcctctagcctggtctgctacataactaggttcaccgaagaggcttttgccgccttgatctgtatcatctttatttacgaagccctcgagaagctatttgatcttggggagacttacgcgtttaacatgcataacaacttggataaactcactagttattcctgcgtctgcaccgaacccccaaacccgagtaacgagacccttgcacaatggaagaaagataatatcactgctcataatatctcttggcgaaatctgacggtatctgagtgcaagaaattgcgcggcgtttttctcgggtccgcgtgtgggcatcatggaccatacattccagacgtcttgttctggtgtgttatactgttttttacaacattctttctgtcttcatttttaaagcaatttaagactaaacggtacttccctacaaaggttagaagtacaatttctgatttcgcagttttcctaactatagtcattatggtcacaatcgattaccttgtcggcgtgccatcacctaaattgcatgtaccagagaaatttgaacctacgcaccccgagaggggatggatcatttcacctctcggcgataacccttggtggacattgctgatcgccgcaattcccgcactgctgtgcaccattttaatcttcatggaccagcagattacagcagtcataatcaataggaaggagcacaaactgaagaagggggccggctaccacctcgacttgctgatggtgggcgtgatgctgggcgtgtgttcagtaatgggtcttccctggtttgtcgctgctaccgttctcagtatcagccatgttaattcacttaaggtcgaatctgagtgctctgctccgggcgaacagcctaagtttctgggaatccgtgagcagcgtgtgacggggctgatgattttcatcttgatgggcttgagtgttttcatgacatcagtgctaaaatttatccccatgcctgtactgtatggagtgttcctgtacatgggagtgagttcccttaagggcattcaactgttcgacaggatcaagctgttcggaatgccagcaaagcatcagcctgatctcatttacctgagatatgttcccctgtggaaggtgcatatctttactgtcatccaattaacttgtctagtgctcctatgggtgataaaagtgtctgccgctgctgtggtgtttcccatgatggtcctggcactcgtgtttgtacggaaattaatggatctgtgtttcactaagcgcgaattgtcgtggctggatgacctaatgcctgaatctaaaaaaaagaaagaagacgataagaagaaaaaagagaaggaggaagccgagagaatgctccaggatgacgacgacaccgtgcacctcccatttgaaggcggatcattgcttcaaatccccgtaaaagccctcaagtattcacctgacaagcctgtaagcgttaagatctcattcgaggatgaacccagaaaaaaatatgtggatgccgagacttctctctag

SEQ ID NO: 206213 - DNA, 2403 bp, Artificial Sequence
  Description of Artificial Sequence: Synthetic coding sequence
atggaggtggtggaggccgagaagatcgtgctgctgaccagcgccagattcctgttcctgttgctgggtcctgccggcaaggctccacagtatcatgagatcggtcgtagcattgccactctaatgacagacgaaattttccacgatgtcgcgtacaaggcgaaggatcggaacgacctattgagcggcattgacgagtttttagatcaggttacagtgctgccacccggagaatgggatccctcgattagaatcgagccgccgaaaagtgtcccaagccaagagaagcgaaaaataccggtattccacaacggtagtaccccaactcttggggagactccgaaggaggcggcccatcacgccggacctgaacttcagcgtactggacgtctgtttggaggtctgattctcgatattaagcgcaaggcgcctttctttctttctgatttcaaggatgctttgtcgctccagtgtctggcctcaatccttttcctgtattgcgcatgcatgtcacccgttattacatttggtggcttgctgggggaggcaactgagggacggatctccgccatcgagagtctctttggggcctcgctaactgggatcgcttactcgctgtttgcaggacagccgctgacaatcctgggatcaaccggccccgtcctggtttttgaaaaaatcctctataagttttgtagggactaccagctgagctatctgagcctacggaccagcattggcttgtggaccagttttctgtgtatcgtgctcgtcgccaccgatgcctcttctctcgtgtgttacattaccaggttcacagaggaggcttttgctgcattaatctgcataatttttatctacgaggctttggagaagttgttcgatctaggagaaacctatgcgtttaatatgcacaataacctggataaactgacatcttactcgtgcgtatgtacagaacctcccaacccctctaacgaaacactcgctcagtggaagaaggacaacatcaccgctcacaatatcagttggagaaatctcacggtgagcgaatgcaagaagttacgaggggtgtttctcggatccgcttgtggacatcacggtccctatattccagacgtgctcttttggtgtgtcatcctgttttttacaacattctttctgtcttcattcctcaaacagtttaagaccaagcgctacttcccaacaaaggtgcgcagcacgatctccgatttcgccgtcttcctgaccatcgtgattatggtgacgattgattatttggtgggcgtgcctagcccaaaactccatgtgcccgaaaaattcgagcctacacatcctgagaggggctggatcattagtccccttggagataatccctggtggacactccttattgctgcaattccggctttgctgtgcactattttgatattcatggatcagcagattaccgccgtgattatcaataggaaggagcataaattgaagaaaggcgccggctatcacctggatctccttatggtgggagttatgctcggcgtgtgctccgtaatgggactgccttggttcgtggcagccaccgtgttgagcataagccacgtgaacagtcttaaggtcgaatctgaatgctcagcgcccggagagcagcccaaattcctgggtatccgagaacagagggtcaccggcctgatgatctttatcctcatgggactcagtgtcttcatgacaagcgtgctgaagttcataccgatgcctgtcctgtacggagtttttctttacatgggagttagctcgctcaaaggtatccaactgttcgacaggattaaactgttcggaatgcccgcaaagcatcaaccggacttgatctatttgcggtatgtgccactgtggaaggttcacatattcacagtgatccagcttacctgtctggtgctgttatgggtcatcaaagtctcggctgccgctgtggtgttccctatgatggtgcttgctcttgtctttgtgcgcaaactcatggatttgtgcttcacaaagcgtgagttaagctggctcgacgatctcatgccagagtccaagaaaaaaaaggaagatgataaaaaaaagaaagagaaagaagaagccgagcgcatgttgcaggacgacgacgatactgttcatttgccatttgagggcgggagcctcctgcagatccctgtgaaggctttgaagtattcagtagacccctcaatagtcaacatttccgatgagatggccaagacagcccagtggaaagccctatcaatgaacaccgaaaatgcaaaggtgacaaggtcaaacatgtctcctgataaaccggtcagcgtgaagatcagttttgaggacgagcctaggaagaaatacgtcgatgctgagacctctctctag

SEQ ID NO: 206214 - DNA, 1725 bp, Artificial Sequence
  Description of Artificial Sequence: Synthetic coding sequence
atggaggccgacggcgccggcgagcagatgcggcccctgctgacccggggtcctgatgaagaggcggtagtggacctcgggaagacaagcagtacagtgaacacaaaattcgagaaggaggaactagagtcacacagagccgtatacataggggttcacgtgcccttctccaaagaaagtcgacgcaggcatcggcatcgcggacacaagcatcaccatagaagacgcaaggacaaagagtcagataaggaggatggtagggaatcgccatcctacgacacccctagtcagcgagttcagtttatcctcgggacggaggacgacgatgaggagcacatccctcacgatctgtttactgagatggacgaactatgctaccgcgacggcgaggaatacgagtggaaggagactgcgcggtggctgaaatttgaggaggacgtggaggacggcggggacagatggagcaaaccctatgtcgccaccttaagcttacacagcctctttgagttgcggagttgtatcttaaatggtactgtcatgttagacatgagggcgtccacattggatgagatcgccgacatggtgctggataatatgattgctagtgggcagctagacgagtccattagagaaaacgtgcgcgaggccttgttgaagcgacaccaccaccagaacgaaaaacggttcacgagccggatccctctcgtgcgctcttttgccgacattggagaaggtctgagcgcctctagacacagtctgcgaaccggcctgtcagctagtaacttgtcccttaggggggaatcacccctgagcctgctcctgggccatctgctgcccagtagcagagcaggcacccctgccgggagcagatgtactacccctgttcccacgccgcagaactcccccccaagctccccaagcatctccagactcaccagtagaagctctcaagagagtcaacggcaggcaccagagcttctcgtgtccccagcctctgacgacataccaactgtcgttatccacccacctgaagaggacctcgaggccgcgcttaaaggtgaggaacagaaaaatgaggagaatgtggatctgacccccggaatcctggccagcccccagagtgcccccggtaacttggataattctaaatcaggagaaattaaggggaatggctctggcggttctcgagaaaactccactgtggacttcagcaaggtggacatgaatttcatgagaaagattccaaccggagccgaagcgtcaaatgtccttgtcggcgaagtggactttcttgaaagacctattatcgcattcgtacgattggctccagctgtcctccttaccgggctgaccgaggttcctgtgccgaccagatttctttttctactcctgggtcccgccggcaaggctccacagtaccacgagataggcagaagtatcgcgacacttatgacggacgagattttccacgacgtcgcctataaggcgaaggaccgcaacgacttactgtccggaattgacgaatttctggaccaagtgacggtcctgccacccggggaatgggatccttccataagaattgaaccccccaagtctgtgccctcgcaggagaagagaaaaattcccgtcttccacaacgggtccactcctacattgggagagaccccaaaggaggctgcacaccacgccggacccgaactgcaaaggaccggtagggtccaatag

SEQ ID NO: 206215 - DNA, 3273 bp, Artificial Sequence
  Description of Artificial Sequence: Synthetic coding sequence
atggagcggttccggctggagaagaagctgcccggccccgacgaggaagccgtcgtcgatcttgggaagaccagttccactgtgaatactaaatttgagaaagaggagctggaaagtcatcgtgctgtgtacatcggagtccacgtgcctttctcaaaggagagcaggcgccgccatagacacagaggacacaaacaccaccaccgccgcagaaaagacaaggagagtgacaaggaagacgggagagagagccccagctacgacactccttcacagagagtacaatttatcttaggcacagaggacgatgatgaagagcacatacctcatgacctgtttactgaaatggacgagttgtgctatagggatggggaggagtacgagtggaaggaaactgcaaggtggctgaagttcgaggaggatgtagaagacgggggagacaggtggtctaagccctacgtggccactttgtcgctccacagtctcttcgaactaagatcctgtatactcaatggcacagtgatgctggatatgagggcgtctactctggacgagatcgccgatatggtcctggataacatgatcgccagcggccagctggatgaatcaatccgagagaacgtgagggaggctctgctgaaacggcaccaccaccagaatgagaagcgatttacttctaggatacctttggtccggtcattcgccgacattggaaagaagcacagcgaccctcatttattagagcgcaacggtattctggcctcccctcaaagtgccccgggcaacctcgataacagtaagtcaggtgaaatcaaagggaacggttccggtggatcgcgcgaaaacagcactgtggatttcagcaaagtggacatgaatttcatgcgaaagataccaaccggcgccgaagcttccaatgtcctagtgggagaggtggactttttagaaagacccataattgccttcgttaggctggccccagccgtgctcctgaccggtttaacagaagtgcctgttcctacaaggttcctattcctcctgctgggtcctgccggcaaagccccccagtatcatgaaattggtcgttctatcgcgacattgatgaccgacgagatcttccacgacgtggcttataaagcaaaggatcgcaacgaccttttgtcgggaatcgatgaattcttggaccaggtgactgttcttccaccaggagagtgggacccaagcataaggattgaacctccaaaaagcgtgccgtcgcaggagaaacgaaagattccagtgtttcataacgggagtacacccaccttgggggagacccctaaggaagctgcacatcacgcagggcccgagctgcaaagaactggacgcctatttggcgggctgattctcgacataaaacggaaggctccgtttttcttgagtgacttcaaggacgctctttccttacagtgtctagcatctatactgttcctgtactgcgcctgcatgtcacccgtgattacatttggtggcttactcggggaggcgaccgaaggtagaatcagcgctattgagtctctgttcggagcctcacttacggggatcgcctactcactgttcgctggccaaccactaacaatccttggctcgaccggtcccgtgctggtgtttgagaagatcctgtacaaattctgtcgcgattatcaactgtcgtatttaagcctgcggacaagtattggtctctggaccagcttcctgtgtatcgttctggtggcgaccgacgcctctagtctcgtttgctacatcacgagattcacggaagaagcttttgccgcactcatatgtattattttcatctacgaggctttggagaagctgtttgatctgggagagacatacgccttcaatatgcataataatctggataaactcacgtcttactcttgtgtgtgcactgaacctccaaacccaagcaacgagacactggcccaatggaaaaaggacaacatcacggcccataatatatcctggcggaatctgaccgtctcggagtgtaagaaactgaggggggtgtttctgggcagtgcatgtggccaccacgggccttatattccagatgtcctgttctggtgcgtgattttgtttttcactacattcttcctctcttcctttttaaagcagtttaagaccaagcgctacttcccgaccaaggtgaggagtacgatcagcgacttcgcggtgtttctcaccattgttatcatggtaaccatagactatctagtgggcgttccaagccccaagctgcacgtgcccgaaaaattcgaaccgactcatccagaaagaggatggatcatatcacctttgggcgataatccttggtggacgctgttgatagccgctatccccgccctcctctgcacaatcttgatttttatggaccagcagatcacagcggtgatcattaacagaaaggagcacaaactgaagaagggggctggataccatttggacctgctgatggtcggagtgatgctgggggtgtgtagtgttatgggcctgccatggttcgtggccgcgaccgtgctgagcatttcgcacgttaactccctgaaggtcgaaagcgaatgtagcgcacccggggaacagcctaaattcctgggtattagggaacaacgcgtgactgggttgatgatctttatcctgatgggtcttagcgtgttcatgaccagcgttctgaagtttatacccatgcctgtcctgtacggcgtattcttgtacatgggggtgtccagcctcaagggcatccagttattcgatcgcatcaagctgtttggaatgccagctaagcatcagccggacctgatctatctcagatacgtgcctctttggaaagtccacatcttcactgtgatccagcttacatgcctggtgttgttatgggtcatcaaggtgtcggctgcagctgtggtgtttcctatgatggtgttagccctcgtgttcgtgaggaagctcatggatttatgctttaccaaaagggagctgtcctggcttgatgatctcatgccagagtccaagaaaaagaaagaggacgacaagaagaagaaagaaaaggaggaagccgaacggatgttgcaggacgatgatgacacagtgcatttgcccttcgaaggcggctctcttctgcagattcctgtaaaggccctgaaatacagccctgacaagccggtctccgtgaaaatttcattcgaagatgaaccgcggaagaagtatgtggatgcagaaacctctctgtag

SEQ ID NO: 206216 - DNA, 3408 bp, Artificial Sequence
  Description of Artificial Sequence: Synthetic coding sequence
atggaggccgacggcgccggcgagcagatgcggcccctgctgaccagagtgacctcacgggggccagacgaagaggccgtcgttgacctcggaaaaaccagtagtaccgttaatacgaaatttgagaaggaagagctggagtcccatcgggccgtgtacataggcgttcacgtcccattttctaaggaatctcgtcgacgacaccgacatcggggccacaaacaccatcacaggcgacgaaaagataaggagagtgacaaggaggatggccgggagagtccttcttatgatactccatcccagagggttcaattcatcctgggaacagaggatgatgatgaagaacacatcccccacgacctttttactgagatggatgagctgtgctacagagacggcgaagagtatgaatggaaggagactgcccgctggctgaagtttgaggaggacgtggaagacgggggagacagatggagtaagccctacgtcgcgacattatctcttcacagtctgttcgagctgcgatcttgcattctcaacggtactgtcatgcttgacatgcgcgcgtccacactcgacgagattgcagatatggtgttggacaatatgatcgcatccgggcagctagatgaaagcataagagagaatgtccgtgaggctctgctgaaacgccaccaccaccagaatgagaaacgtttcacaagtcggatccccctcgtgaggagcttcgcagacatcggtaaaaaacattccgatccgcaccttctcgaacgaaacggtatcctggcatctccccagagtgctccaggcaatctagacaactctaagtctggagagattaaggggaatggctccggagggtccagagaaaacagtacagtggacttctccaaggtggatatgaactttatgaggaagatccccactggggcagaggccagcaacgtgctggtgggtgaggtggatttcctggagaggcctataattgcatttgtgcgcctggcacctgctgttcttctaaccggtttaaccgaagttcctgtcccaacacggttcctgtttctgttgctcggtcccgctgggaaggcacctcagtatcatgagatcgggcgatctattgccaccttaatgactgatgaaatatttcacgacgtggcctacaaagccaaggacagaaacgatcttctgtccggaattgacgaatttctggaccaggtaacagtccttccacccggggagtgggacccatccatcagaatcgaacccccaaaatctgtgccgagccaagagaagagaaagatccctgtgttccataatgggtccacccccaccctgggagagacccccaaagaggccgctcaccacgccggccctgaattgcaaagaactgggagactgttcggagggctgatcctggatataaaaagaaaagctcctttctttctctcagacttcaaagatgctctttcgctgcagtgtctggcttcaatcctgttcctgtattgtgcatgcatgagtcccgttataacattcggcggactgctgggggaggccactgagggacgcatctccgcaatcgaaagcttgtttggcgctagtttgacgggaatcgcctactctttgttcgcaggtcagcccctgaccattctaggatctaccggtcctgtccttgtttttgagaaaatactgtataaattttgtcgcgactatcagctgtcttacctgtcactcaggacctccatcgggctgtggacaagcttcctgtgcatcgtccttgtggccacagacgcatcaagcctggtgtgctatattacacgctttaccgaagaggcattcgccgcactgatctgcattatctttatctacgaagctctggaaaagctctttgatctcggagagacctacgccttcaacatgcacaacaatctcgataagctcacctcatactcctgcgtgtgcactgaaccgccaaatcctagcaatgagactctagctcaatggaagaaggataatattactgcccataatattagttggcggaacctgacagttagtgaatgcaagaagttgagaggtgtgttcctagggtctgcttgtggccatcacggaccttatattcccgatgtcttgttttggtgtgtgattctcttctttacaacattcttcttgagtagctttctaaaacaattcaaaacgaaacgttatttccctaccaaggtgagatcaaccatcagcgattttgccgtgttcctaactatagtcattatggtgacgatcgattatttggtgggcgtcccgagccctaaactgcatgtgccagaaaaatttgagccaacccatcctgagagaggatggatcatcagccccttgggtgataatccttggtggactcttctgatcgccgctatcccagccctgctctgcacaattcttatcttcatggaccagcaaattacagccgtgattatcaatagaaaggagcataagctgaaaaaaggagccggctatcacctggacttgctcatggtgggcgtgatgttaggagtgtgcagcgtcatggggctgccatggttcgttgcggcgaccgtccttagtatcagtcacgtcaacagtctgaaggttgaatccgaatgttctgcaccaggagagcagcctaaatttctgggcattcgagagcagagagtgacgggcctgatgatttttatccttatggggctgagtgttttcatgacctctgtgctgaagtttatcccaatgccagttctgtatggtgtctttctgtatatgggagtctcttcactgaagggcatccaactgtttgacagaatcaagctgtttgggatgcctgccaagcatcagccggatcttatatacctcaggtatgtccccctgtggaaggtccacatttttacggtaattcagcttacttgcctggtactgctgtgggtcatcaaagtatcagccgccgccgttgttttccccatgatggtcttagcgctggtcttcgtgcggaaattgatggatctatgtttcactaagagggaactgtcctggttagacgatttaatgcctgaaagcaaaaaaaagaaggaagacgacaaaaagaaaaaagagaaggaggaggcggaacgtatgttgcaggatgacgatgacactgttcatctacctttcgagggcggaagtctcctacagatccccgtcaaggctcttaaatactcggtggatccgagtatcgtcaacatatccgacgagatggcgaaaaccgcacagtggaaggccctgtccatgaacacggagaatgctaaagttaccaggtcgaacatgagccctgataaacctgtgagtgttaagatctcttttgaggatgaacctaggaagaaatacgtggacgcagaaaccagcttgtag

SEQ ID NO: 206217 - DNA, 3288 bp, Artificial Sequence
  Description of Artificial Sequence: Synthetic coding sequence
atggaggccgacggcgccggcgagcagatgcggcccctgctgacccggggtccagacgaggaggccgtggtcgatctcggaaaaacttcaagcacggtaaatactaaattcgagaaagaagagctggagtcacatcgggctgtctatatcggagtgcacgtccctttctctaaggaaagcaggcggcgccatcgccacagaggacataagcatcaccaccgaagacggaaggataaggaatccgataaggaagacgggcgagaatccccgtcctatgacactccctcccaaagggtgcaattcatcctggggaccgaggatgatgatgaagagcatattccccatgacctctttaccgagatggacgagctctgttacagagatggtgaagaatacgaatggaaagaaaccgctcgttggttgaagttcgaggaggatgttgaggacggcggcgataggtggtctaagccatatgttgccactctgagtttacactcactgttcgagctgcgaagctgcattctaaatggtactgtgatgttggacatgagagccagtaccctagatgaaatagcagacatggtgctggataacatgattgccagcggccagctcgacgaaagcatccgcgagaatgtgcgcgaagccttgctcaagcgacaccatcatcagaatgaaaagaggtttactagccgaattcctttggtcaggagtttcgctgacatcggaaagaaacacagcgaccctcatctcctcgaacgtaacggtatactcgcctcacctcagtccgccccaggtaatcttgacaactccaagagcggggagataaaaggcaacgggtcagggggatcccgagagaattctaccgtggatttctccaaggtcgacatgaattttatgagaaaaatccccacgggcgctgaggccagtaacgtcctggtcggggaggtggacttcctggaaaggcctattatagctttcgtcagactagccccagcagtacttttgaccggcttgacagaggtccccgtccctacgcgatttctgttcctgctcctgggcccagcaggcaaggcacctcagtatcacgaaatcggccgcagcatagccacattaatgaccgacgagatcttccacgatgtcgcctataaggctaaagatcgcaatgacttgcttagcggcatcgatgagtttctggatcaggtgactgtgttaccacctggtgagtgggatcctagtatcagaatagagcctccaaagtcagtgccctcccaggaaaagagaaaaattccagtttttcacaacggcagtacccctactctaggcgagacgccaaaggaagctgcccaccacgctggccctgaactccagcgcacggggaggttatttggaggactcatcttggatattaaacgtaaggccccttttttcctttccgattttaaggacgccctgtccctgcagtgcctggcatctattttatttctgtattgcgcctgtatgtcccctgttatcacattcgggggcctcttaggagaggcgactgaagggcgcatcagcgccattgagagtctctttggagcctccctcacaggaatcgcctactctctttttgcaggtcagcctttaaccatccttggtagcaccggccctgtcctggtttttgagaaaatcctgtacaagttttgtcgagattatcagctatcctacctcagtttgcggacttcaattggtctgtggacatctttcctgtgtatagtgctcgtggcaaccgatgcctcttctttggtttgctatataacacgcttcacagaagaagccttcgccgcattgatatgtattattttcatatatgaggccctagagaaactttttgatttaggggaaacatatgcatttaatatgcacaataacctcgacaaactgacatcttattcctgcgtctgcacggaacctcctaaccctagcaatgagactctggcgcaatggaagaaagacaacattaccgcccataacatatcttggcggaatctgactgtgtccgagtgtaagaagctgcgtggagtcttcctgggatcagcctgtgggcaccatggtccttacattcctgatgtgttattctggtgcgtgatcttattctttaccacctttttcctctcttcgtttcttaagcagtttaagactaaaagatactttcctaccaaagtcaggtctaccattagcgatttcgccgtttttctgaccattgttataatggttacaatcgactacttggtcggcgttccctcccccaaattgcatgttcccgagaagttcgagcctactcaccccgagcgtggttggataatctcgccactgggggacaacccttggtggactttgctgatcgccgctattccggcactgctttgcacaatcttaatctttatggaccagcagatcacagccgtcatcatcaataggaaggaacataaactgaaaaagggagctggatatcacttggacctgcttatggtgggagtgatgcttggtgtgtgctccgtcatggggcttccatggttcgtagctgcaactgtgttgtcaatctcacatgtgaactcgttgaaagtcgagtcagaatgttcagcccctggcgagcagccgaaattccttggtatcagagagcaacgcgtcaccgggctgatgatctttatcctcatggggctgtcagtatttatgacctccgtgttaaaattcatcccaatgccagtgctgtacggcgtttttctgtatatgggtgtgtcttcccttaaaggaattcaactcttcgatcgcattaaactcttcggaatgcctgcaaaacatcagcccgatctaatctatctccggtacgtgcccctgtggaaagtgcacattttcactgtgatccagctaacctgcctggtcctactttgggttataaaggtgtcagcggctgcagtcgttttcccaatgatggtgctcgccctggttttcgtaaggaaattgatggacctgtgctttaccaagagagaattgtcttggcttgacgaccttatgcctgagtccaaaaaaaagaaagaagacgacaagaagaaaaaggagaaggaagaagctgagcggatgctccaggatgatgacgataccgtgcatctcccctttgaaggaggcagccttctgcagatcccagtaaaagcccttaaatacagtcccgacaaaccagttagcgtgaagatctccttcgaagatgaacccagaaagaaatacgtcgatgctgagacttccctttag

SEQ ID NO: 206218 - DNA, 1392 bp, Artificial Sequence
  Description of Artificial Sequence: Synthetic coding sequence
atggaggccgacggcgccggcgagcagatgcggcccctgctgacccgtgggccagatgaggaagccgttgtggatcttggtaagacatcatctaccgtgaatactaaatttgaaaaagaagaacttgaatcccacagggctgtgtatatcggcgtccatgtcccgtttagcaaggaaagtcggcgacgacatcgacatcgtggacataagcaccatcaccggcgtagaaaggacaaggaatctgacaaagaagacggtcgtgaatccccatcatatgataccccatctcaacgagtgcagtttattttaggtaccgaagatgatgatgaagagcacataccacacgaccttttcactgagatggacgagctatgctatagagacggtgaggaatacgagtggaaggaaaccgcacgatggcttaagttcgaggaggacgtggaggatggcggcgacagatggtccaagccatacgtggcaactttgtccctccattcgctcttcgaacttcgaagctgcattttgaacggcaccgtcatgcttgatatgagagcctctaccctggatgagattgcggatatggtcctggataatatgatcgctagcggtcagctcgacgaaagtattcgcgaaaacgtgcgcgaggccctgctgaaaagacatcatcatcagaatgaaaagaggtttacttctcggatcccactcgttcgtagcttcgcggatattggtaaaaaacattccgaccctcatctgctggaacggaacggcatcctggcgagtccgcaatcagcgcctggaaatctagacaactcaaagtccggtgaaatcaagggaaacggcagtggcggatccagggagaatagtacagtggacttcagtaaggtggacatgaatttcatgaggaaaattccaactggggcggaggcatcaaacgtgctcgttggggaggtggattttctggaacgacccataattgctttcgtacgcctcgccccagcggtgctcttgacaggcctcaccgaagtccctgtgccaaccagattcctatttctgctgctaggacccgcaggtaaagctccccagtaccacgaaatcggaagaagtatcgccacactgatgactgatgagatcttccatgacgtggcctacaaagccaaagatagaaatgatctgttatcggggatcgatgaatttctggatcaggtgactgttctgcctccaggtgagtgggacccatccatacggatcgagcccccaaagtccgtaccctcacaggagaaacgcaagatccctgtgtttcacaatgggagcactccgactttgggcgagacacctaaggaggcagcccatcacgccggccccgagctgcagcgcactggcagggtccaatag

SEQ ID NO: 206219 - DNA, 1725 bp, Artificial Sequence
  Description of Artificial Sequence: Synthetic coding sequence
atggaggccgacggcgccggcgagcagatgcggcccctgctgaccagggggcctgacgaggaggcggtggtcgatttgggaaagacatccagcaccgttaacacgaaattcgagaaggaggagttagagtcccatagagcagtgtacattggagtgcacgtccccttctctaaagaatctaggcgacggcaccgccatcgcggacataagcaccaccaccggaggcgtaaagacaaggaatcagacaaagaggatggtcgcgagagtcccagctatgatacccctagccaaagagtccagttcatattgggaacggaagacgatgacgaggaacacatccctcacgacctctttactgagatggacgagctgtgttatagagatggagaggagtacgagtggaaagaaactgcccgctggctgaagttcgaagaggatgtggaggacggcggcgacaggtggtccaaaccctacgtggcaacactgtcactgcactccctcttcgagctgagatcctgtatcttaaacggcactgtgatgctcgacatgagagcaagcacccttgatgaaatcgctgacatggtgctggataacatgattgcttcgggacagctcgatgagtccatacgcgaaaatgtgcgtgaggctctgttgaagcgccaccatcaccagaacgagaagcgatttacatctagaatcccactggtgcgaagtttcgcagatattggcgaggggctgtccgcatcacggcattccctgagaactggactctctgcctccaatctatctttgcgtggcgaaagcccactctcattgctgttaggacacctgctccctagctcaagagccgggacacctgctgggagcaggtgtactacccctgttccaacccctcagaactccccaccttcctctccgtcgatcagtcgcctgacatcgagaagcagccaggaatcacaaaggcaggcgcccgaactccttgtgtccccagcctctgatgatatccctaccgtggtgattcatccccctgaagaggacttggaagctgccttgaagggagaggaacagaaaaatgaagaaaatgtggacctgacccctgggattctcgcttccccgcagagcgcacctggaaatctagacaactccaagagcggcgagatcaaaggtaacgggtcaggagggtcccgcgaaaactcaaccgtcgactttagtaaagtggacatgaactttatgcgtaagattccgacaggagctgaggccagcaacgtattggtgggcgaggttgatttcctggagaggccgattatcgcattcgttagactggctcctgctgttctgctgactgggctgaccgaggtgcctgtaccaacaaggttcctgtttctgctgctcggcccagcgggcaaggccccgcagtaccatgagatcggcaggagcatcgcaacccttatgaccgacgagatcttccacgacgttgcctacaaggccaaagacaggaatgacctgctgtccgggatcgatgaatttctggatcaggtcactgttctgcctcccggggaatgggacccctcaatcaggatcgagccaccaaagtccgtgccatcacaggaaaagaggaagatacctgtgtttcacaatggctccacccctaccctcggagagactcccaaagaagccgcccatcacgctggcccggagctacagaggaccgggagggtacagtag

SEQ ID NO: 206220 - DNA, 3741 bp, Artificial Sequence
  Description of Artificial Sequence: Synthetic coding sequence
atggaggccgacggcgccggcgagcagatgcggcccctgctgaccagagtgacgagcagaggtcccgatgaagaggccgtcgtggacctcggcaagacaagtagcacagtgaatacaaaatttgaaaaggaagagctggagagccacagggctgtatacattggtgtgcatgtacccttctcaaaggagagcagacgccgacatcgccatagagggcataagcaccaccatcgccgaaggaaggacaaagagagcgataaggaggatgggcgggagagccccagttacgacaccccttctcagcgtgtgcagttcatcttaggcaccgaggacgatgatgaagaacatatcccacacgacctgttcaccgagatggacgagttgtgctaccgcgacggggaggaatacgagtggaaggagaccgcaagatggctgaagtttgaggaggatgtcgaggacggaggtgacagatggtcaaagccctatgtagctaccctgtctctacattccttgttcgaactgcgatcctgcatcttaaacggcacagtgatgcttgacatgcgggcgtccaccttggacgagatcgccgacatggtgttggataacatgatagcttcgggtcagcttgacgaatccattcgtgaaaatgttagagaggcactgctaaagcggcatcatcaccagaatgaaaaacgatttaccagccggatacctctggtccgatcattcgccgatatcggagaagggctgagcgcaagccggcactctctcagaactgggctctctgcatcaaatctcagtctgcgtggggaatctccattgtctctcctacttggccatctactgcctagctcaagggccggcacccctgctggctcaaggtgcactactcctgtgcctaccccccagaattcccccccatcctccccatcgatctccaggctgaccagccgctcgtcccaggagagtcagaggcaggcccctgaattgcttgtcagcccagcaagtgatgacatacctacagtggttatccatccacccgaggaggacttagaggcggcactgaagggtgaggagcaaaagaacgaagaaaatgtagatctgacgcccggcattctggcatctccacaatcagcccccgggaatctcgacaacagtaagtcgggcgaaattaaagggaatggatcaggcggcagtcgcgagaatagtacggtggatttcagcaaagttgacatgaactttatgagaaaaattcctaccggcgcggaagcctctaatgtgctggtgggcgaggtggatttcctggaaagacctatcattgcctttgtgaggttggcgcccgccgtcctgttgactgggctgaccgaagtgccggtccccacaaggtttttattcctgctgttgggcccagccggcaaagctccccaataccacgagatcggcagaagtattgcaacgcttatgacagatgaaatcttccatgacgttgcctataaggcaaaagacaggaacgacctgctgtccggcatcgacgagtttctggatcaagtgacagtgttgcctccaggcgaatgggaccccagcattcggattgaacctcccaagtctgtgccgagccaggagaaacgaaagatccctgttttccacaatggatcaacaccaaccctcggggaaacccccaaggaggccgcacatcacgcaggccctgagctgcagaggaccggccgtctgtttggtggacttatcctggatattaagcgtaaagctccatttttcctgagtgattttaaagacgcactttctctgcagtgtctggcctcgattctgttcttatactgcgcctgtatgagtcccgtaattacattcggtggactcttaggggaagctacggaaggacgtatctccgctattgagtccctgttcggggcatccctcaccgggattgcgtactctcttttcgccggtcaaccccttacaatcctcgggtcaacaggcccagtgctggttttcgagaaaatcctgtataaattctgccgtgattatcagttgtcatacttgagtctgcgcacttctattggcctgtggacatcatttctttgtatcgtccttgtggcaactgatgcttcatccctggtttgttacattacccgttttactgaagaggcattcgctgcactgatatgtattatttttatctacgaagcgctcgaaaagctgtttgatctgggcgaaacttacgcattcaatatgcacaacaatctcgataagctgactagttactcctgcgtgtgtactgaacccccaaacccatccaacgagacgttggcgcagtggaaaaaggacaacattaccgcccataatatctcctggaggaacctgactgtgtctgagtgcaagaagctacgcggcgtgtttctcgggtcagcttgcgggcaccatggaccatacattccagacgtgctgttctggtgtgttatcctattttttactacgttcttcctgtcaagctttctgaagcagtttaaaacaaagcggtactttcctacgaaagtcaggtctaccatttcagactttgcagtctttctcactatcgtgatcatggtgacaattgattaccttgtgggtgtcccaagtcccaagctgcacgtgccagaaaagttcgagcccacacatccagaacgggggtggattataagtcctctgggcgataacccttggtggacactgctgattgcagccataccggccctcctgtgcacaatccttatttttatggatcagcaaataaccgcagtgattattaaccgcaaagaacacaaactgaagaagggcgctggttatcacctcgacttgctgatggttggggtcatgctgggggtctgtagtgtgatgggactgccatggttcgtggccgctaccgttctgtccataagtcacgtgaactcactcaaggtggagagtgagtgtagtgcccccggagaacaacccaagtttctaggaatcagggagcagcgagtcactggacttatgatcttcatactaatgggactctccgtgtttatgacctccgtgctgaagttcatcccaatgccagtactgtatggagtcttcctgtatatgggggtctcctcccttaagggtatacagctgttcgacagaatcaagttattcggaatgccagccaagcatcaacccgatctgatttatttgaggtatgtacctctgtggaaggtgcatatcttcactgtgattcagctgacatgcctggtgctgctgtgggtcatcaaggtttccgctgctgcagttgtgttcccaatgatggttctggccctcgtctttgtccggaagctgatggacttgtgctttaccaagcgtgagcttagctggctggatgatctgatgccggagagcaaaaagaaaaaggaggacgacaagaagaagaaggagaaggaagaagcagagcggatgctgcaggacgatgacgacacagtccacttgcctttcgaaggggggtccctgctgcaaatcccagtcaaggccctgaaatactccgtcgacccgtcaattgtaaacatctctgatgaaatggccaaaaccgcccagtggaaagctctgtccatgaacactgagaatgccaaggtcacacgcagcaacatgtccccagacaagcctgtttccgtaaagatttcttttgaagacgagccccgcaaaaaatatgtcgacgccgagacttccctgtag

SEQ ID NO: 206221 - DNA, 3780 bp, Artificial Sequence
  Description of Artificial Sequence: Synthetic coding sequence
atggaggccgacggcgccggcgagcagatgcggcccctgctgacccgcgtcaccagtagggggcccgatgaagaggccgtggtggatttaggtaagacgtccagtactgtgaatacaaaattcgagaaggaagagctggaaagccacagagccgtgtacatcggagtgcatgtgcccttctcaaaagaaagcagaagacgccacaggcacaggggccacaagcatcatcacaggagacgaaaggataaagaatctgacaaggaggacggcagggagagcccatcatatgacacacccagccagcgagtgcagttcatcctcggaactgaggatgacgatgaagaacacattcctcatgatctgttcaccgaaatggacgagctgtgttatcgcgatggggaggagtatgaatggaaagagactgccaggtggcttaaattcgaagaggacgtcgaggatgggggagacagatggagtaagccttatgttgcaactctttccctgcacagcttgttcgagcttaggtcatgcatactgaatggcaccgtgatgctcgacatgcgtgccagtactctggacgagatcgctgacatggtgctggacaatatgatagcgtcaggccagctggacgagagtatccgggaaaacgtgcgggaggcactgctgaagaggcatcatcatcagaacgagaagagatttacgtccagaatcccgctggtacgctcctttgccgacattgggaagaagcattccgacccccacctcctggagagaaacggcgaaggcctcagtgccagtcgtcattcactcagaactgggctctcagcaagcaacctgtcgctccgcggcgagagcccactgagtcttctacttggacacctgctgccatcctccagggcagggacacctgctggaagccgctgtaccacccccgtgcccactccccagaactcacccccttcctcgccctcaatcagtcggctgacctctcggtcttcgcaggagtcgcagcgacaggcccccgaattgctggttagcccggccagtgatgacattcctacagtggtaattcaccctccagaagaagacctcgaggctgcactcaaaggcgaggagcagaagaacgaggagaatgtggatctgaccccaggcatcctggcttcgccgcagagcgccccaggcaacttagataattccaaaagtggagaaatcaaggggaatggaagtggggggtcaagagagaacagtaccgtcgacttctccaaagttgatatgaacttcatgcggaagatcccaacaggagccgaagccagtaatgtactggtgggggaagtagatttcctcgagaggccgatcatcgcctttgtgcgcctggcccctgcggtcctgctgacaggccttaccgaagttcctgtgcctacacggttcctatttttgctgctggggcctgcaggaaaggcccctcagtaccacgaaataggacgctcgatagctacactcatgacagatgagattttccatgatgtggcatataaggcaaaagaccggaacgatcttctaagtggaattgacgagtttctggatcaggtaaccgtgctgccacccggagaatgggatccttcgattcgaatagagccacctaaatctgtgccttctcaggagaagagaaagatccccgtttttcacaatgggtcaactcccacactcggggaaacacctaaggaagcagctcaccacgccggcccagagctccagcgcactggcaggctgttcggggggctgattctggatatcaaacggaaagcccctttctttctctcagacttcaaagacgccctaagcttacagtgcctggctagtattttgttcctgtattgtgcctgtatgtccccagttatcacatttggtgggcttttgggcgaagcaactgagggcagaattagcgccatcgagtcgcttttcggggccagtctgacaggtatagcctattctctgttcgcaggccaacccctgactatccttggctcaaccgggcctgtgttggttttcgaaaaaatcctgtataagttctgccgagattatcaactcagttacttgtctttgaggactagcattggactttggacttcatttctgtgcattgtacttgtggcgacggatgcctcctctctggtgtgttacataactcggtttacagaggaggccttcgccgcgctaatctgtatcatttttatatacgaggctttggaaaagctattcgatctgggcgaaacctatgcgttcaacatgcataataatctggataaactgaccagttactcttgtgtatgtacagagcccccgaatccatcaaacgagaccctggctcaatggaaaaaggataacattaccgcacacaatatttcctggcggaatctgactgtcagcgaatgcaaaaaactgagaggggtgtttctgggcagtgcctgcgggcaccacgggccctacattcccgatgttctgttctggtgtgtcatcctcttttttacaacgttcttcctgtccagcttcctcaaacagtttaaaacaaagagatattttccaactaaggtccggtcgacaatctccgattttgccgtctttctgactatcgtgattatggttacgatagattatctcgtgggtgtgccgtcaccaaaattgcacgtaccagaaaaatttgagcccacccaccccgagagaggctggattatctcacccctcggggacaacccttggtggacactgctcatcgcagccataccagccctattgtgcaccatcctgatctttatggaccagcagataacagccgtaattattaaccggaaagagcacaaattgaaaaaaggagcagggtatcacctcgacttgcttatggtgggggtgatgctgggggtctgcagcgtgatgggactgccttggttcgtggctgcaacggtcctctccataagtcacgtaaatagcctcaaagtggagtcggaatgtagtgcacctggcgagcagcctaaatttcttgggattagagaacagagagtcaccggtctcatgatctttattctgatgggactgtctgttttcatgacgagcgtgctgaaattcatccctatgcctgtgctatacggcgtcttcttatacatgggagtaagctccctaaagggcatccagctgtttgatcgcattaagttattcggcatgcctgccaaacaccagcccgacctgatatatctacggtatgtaccgctgtggaaggtgcacatcttcaccgtgatccagctcacctgcctggtgttgctgtgggtcatcaaggtgagcgccgctgcggtggtgtttccaatgatggtgctggccctcgtctttgtccgcaaacttatggatctctgcttcactaaacgcgaactctcgtggctcgatgacctcatgcctgaatccaaaaagaaaaaagaggatgacaagaagaagaaagagaaagaggaagctgagagaatgctccaggacgacgatgataccgttcaccttccctttgagggagggagcctgctgcaaatccccgttaaggccctaaagtattccgtagaccccagcatcgtgaatatttcggacgaaatggcgaagaccgcacagtggaaggccttgagcatgaataccgagaacgccaaggtcacgcgatcaaacatgtcacctgacaaacctgtgagcgtaaagatcagctttgaggacgaaccgcggaagaaatatgtagatgctgagacaagcctgtag

SEQ ID NO: 206222 - DNA, 3396 bp, Artificial Sequence
  Description of Artificial Sequence: Synthetic coding sequence
atggaggccgacggcgccggcgagcagatgcggcccctgctgaccagaggccctgacgaagaggcagtggttgaccttggcaaaacatcgtccacagtgaataccaaatttgaaaaagaggaactggagtcccacagagccgtctatatcggggtgcacgtgcccttttctaaggagtccagacgcagacataggcaccgggggcataaacatcatcataggaggcgtaaagataaagaaagcgacaaggaggatgggagggagagtccttcctacgataccccttctcagcgagtgcaatttattctcggaaccgaggatgacgatgaggaacacattccacacgatctcttcacagaaatggacgagttatgttaccgagatggcgaggagtacgaatggaaagaaacagctagatggctcaaattcgaagaggacgtggaagacgggggcgatcggtggagtaagccctatgttgcaaccctgtccttacactcactgttcgaacttaggtcgtgcatcctgaatggcaccgtcatgctggacatgcgggcctccaccctggatgagatagctgacatggtgctggataatatgatcgcctcggggcagttagatgagtcaattcgggagaacgtgagagaagctctgctgaagcgccatcaccaccagaacgagaaacgctttaccagccgcattccgttagtgcgctcattcgcagacatcggtaagaagcactcggacccacacctactggagcggaacggcatcttagcctcccctcagtcagcccctggaaatcttgataattcaaaatccggtgagataaaagggaatggtagcggtgggtcccgcgaaaactcaacagtcgatttctctaaggtggacatgaactttatgagaaagatccccaccggcgctgaggccagtaacgttcttgtgggagaagtggactttctagaaagaccaattattgccttcgtgcgcctcgctcccgccgttctcctgactggcctaactgaagtgccagttcccacccgattcctgtttcttctccttgggcccgctggcaaagcaccacagtaccacgaaatcggtaggagcattgccacattgatgactgacgagatcttccacgatgttgcctataaggctaaggataggaacgacctgctgtctggcatcgatgaattcctggaccaggtcactgttctgcccccaggcgagtgggatcctagtatccgaatagaacctcctaagtctgtccctagtcaggagaaacgaaaaatccctgttttccataatgggtctactccgaccctcggcgagacacctaaagaagccgctcaccacgcaggcccagaacttcagaggacagggaggctcttcggcggcctcattttggatatcaaacgcaaagctccgttttttctgtctgacttcaaggatgcactgtccctccagtgcctggcttccatattatttctttactgtgcatgtatgagcccagtaatcacattcggtgggcttcttggggaggccacagaggggcgcatttctgcgattgaatccttatttggagcatcactaaccgggatcgcctacagcctgtttgccggacagcctctaacgatactgggcagtactgggccggtgctggttttcgagaagattctctacaaattctgtcgggattaccagttgtcttacctttcccttagaacatccatcgggctctggacctccttcctctgcatcgtgctggtagccaccgacgctagctctctcgtgtgctacattaccaggttcacagaagaggcattcgcagctcttatttgcattatctttatttacgaagcgctggaaaaactcttcgaccttggtgaaacttatgcattcaacatgcataataatcttgacaaactgaccagttactcttgtgtatgtactgagccccccaacccctctaacgagactttggcgcagtggaaaaaagacaatattaccgctcataatatttcttggcgcaatttgaccgtctccgagtgcaaaaagctgcgtggggtttttcttggctcggcctgcggccaccatggcccgtatatccctgatgtgcttttctggtgcgtgattctcttcttcacaacctttttcctcagtagtttcctgaagcagttcaagaccaagcgatattttcctaccaaggtgagatccaccatctccgactttgccgtttttctgactatagttatcatggtgacaatcgactatttggttggagtacccagtccaaaactccatgttcccgagaagtttgagcccacccatcccgagaggggatggatcatatccccactgggtgataatccctggtggactttgcttattgctgcaattccggccttgttgtgcaccatattgatattcatggatcagcaaataacagccgttattattaatcggaaggaacacaaactcaagaagggcgccggctaccacctagacctactgatggtgggagtgatgctcggggtgtgcagtgtaatgggcctgccttggttcgtcgcggcaacggtgctgagtatctctcacgtgaattctctgaaggtagagtccgaatgcagcgcccccggtgagcagcctaaattccttggtatcagggaacagcgtgtcaccggcctgatgatcttcattctgatggggctgtcagtgttcatgacgagcgtgctcaaatttatccccatgcctgtgctctacggcgtgtttttgtatatgggagttagctccctgaagggaatccagctgtttgatcgaatcaaattgttcggtatgcccgcaaagcaccaaccggacctcatatatctgagatacgtacctctgtggaaggttcacatattcaccgtcattcagctcacctgtctggtacttctgtgggtaattaaagtcagcgcagcggccgtagtgtttcccatgatggttctagcattagtgttcgtgcgtaaacttatggacttgtgctttaccaaacgggagctgtcgtggttggatgacctaatgccagagagtaagaagaagaaggaggacgacaagaagaagaaggaaaaggaagaggctgagcgaatgttgcaggatgatgacgataccgtgcacctgccattcgaaggtggctccctgttgcagatccccgttaaggccttgaaatacagcgtcgatcctagtattgtgaatatttcggacgagatggctaaaaccgcccagtggaaagcgctgtcgatgaacacggagaacgccaaggttaccagatctaacatgtcaccagacaaaccagtttccgtgaagatcagttttgaggacgagccccgcaaaaagtatgtggatgccgagacttctctttag

SEQ ID NO: 206223 - DNA, 1392 bp, Artificial Sequence
  Description of Artificial Sequence: Synthetic coding sequence
atggaggccgacggcgccggcgagcagatgcggcccctgctgaccagggggccggacgaggaggccgttgtggaccttggaaaaaccagctccactgtaaataccaaattcgagaaggaagaactggagagccaccgcgccgtatacattggagtgcatgtgcctttctcaaaagaatcaagacgtagacaccgacataggggtcacaaacaccaccatagacgcagaaaggataaagagtcggataaagaggatggccgcgagtctcccagctacgatacccccagtcagcgagtgcagtttatcctcggaacggaagatgacgatgaggaacatattccccatgatctgtttaccgaaatggatgagctgtgttatagggacggcgaggagtacgagtggaaagaaacagccagatggctcaaattcgaagaggacgtggaggatgggggcgatcgctggagcaagccttacgtggccacgctgagtctgcacagcctgtttgagctccgctcttgcattctgaacggcacagtgatgctggacatgcgcgcatccaccctggatgaaatcgctgatatggtgttagacaacatgatcgcgagtgggcagctcgacgagtcgatccgcgaaaacgttagggaggctcttctgaaaagacaccaccaccaaaacgagaaacgctttactagccggatcccgctcgtcaggagcttcgccgatattggaaagaaacacagcgacccccatttgctggaaagaaatggcatcctggcctccccacagtccgcgcctgggaaccttgataattcaaagtctggagaaattaaaggcaatggctccggcggatcacgggagaattcaactgtcgatttcagtaaggtggacatgaatttcatgcggaaaatcccgaccggagccgaggcatctaatgtgttggttggcgaggtcgatttcttagaaagaccaataatcgctttcgtccgactggcgccagccgtgctcctcactggcctcactgaggttccagtaccaacccggtttctcttcctgcttctgggaccagctggcaaggctccgcagtatcacgaaatcggaaggagtatcgcaactctgatgactgacgagattttccacgacgtcgcctacaaggcaaaggacagaaacgatctcctatcgggaattgatgagtttctggatcaggtgaccgtgcttccccccggtgagtgggacccgagtattcgcatcgaacccccaaagtccgttccaagccaggagaaaagaaagattccagtatttcataatggatccacacccacccttggagagactcccaaagaggccgctcaccacgcgggcccagagttacaacgcactggaagagtgcagtag

SEQ ID NO: 206224 - DNA, 3135 bp, Artificial Sequence
  Description of Artificial Sequence: Synthetic coding sequence
atgcccgccgccggcagcaacgagcccgacggcgtgctgagctaccagcgtcccgacgaggaggcagttgttgatcaaggtgggaccagtactatccttaacattcactacgagaaagaagagctagagggacaccggaccctgtatgtgggcgtgaggatgcccctgggacggcagagccatcgccatcatcgcacccacggccagaagcacagacgcagaggccggggtaaaggagcctcgcaaggtgaggagggacttgaggctctcgcccacgataccccaagtcaacgagttcaattcattctgggaaccgaagaagacgaagaacacgtcccccacgagttgttcacagagctggacgagatttgtatgaaggagggtgaggacgcagagtggaaagagacagctcgctggcttaagtttgaggaagacgtcgaggacggtggtgagcggtggtcaaagccatacgttgcaactctgtctctacacagtttgttcgagctgcggtcctgcctgatcaatgggacagttctgcttgatatgcacgcgaattctattgaggagatctctgacctaattctagaccagcaggagttgtcttccgacctgaatgactccatgcgggtaaaggtgcgggaagctctactcaagaagcaccatcaccagaatgaaaagaagagaaataatttgatacccattgtgcggtcttttgccgaggtcggaaagaaacagagcgatccccacctgatggataagcacggacagaccgtgagtccacagtctgtcccaactactaatcttgaggtgaagaatggagtcaactgcgaacactccccagtggacctctccaaggtggatctgcacttcatgaagaagatcccaacaggcgccgaggcgtcaaacgtgttggtgggcgaggtagatatcctggaccgtcctattgtcgcttttgtcaggttaagtcctgctgtcctcctgtccggccttacagaggtcccaatacctacccgcttcttattcattctgttaggtcctgtaggaaagggccagcagtaccatgagatcggccgatctatggcaactatcatgaccgatgagatcttccatgacgtagcttacaaagcgaaagaaagggatgacctactagccgggatagacgagtttctggatcaggtcactgtcctgccgccgggcgagtgggacccttccattcgcatcgagccccctaaaaatgtgcccagccaggaaaagcgaaaaatgcccggtgtgccaaacggaaacgtatgccacattgagcaggaaccgcacggagggcactccggccctgaactgcagcgcaccggccgcctgtttggtggactggtgctggacatcaaacggaaggccccttggtattggagcgattaccgcgatgctttgagtcttcaatgcctggctagcttccttttcctgtattgcgcttgcatgagccctgtaattactttcggggggttactgggcgaagcaaccgagggtcgaatctctgcaatcgagagtttgtttggagcttccatgaccgggattgcctacagtctttttgctggtcaggctctgaccatcttaggctcaacggggccagttttggtcttcgagaaaattctgtttaaattttgcaaggattacgccctctcttatctgagcttgcgcgcttgtatagggttgtggacagccttcttgtgtatagtcctggtggcaacagacgcatcatcactggtatgttacataaccagatttactgaagaggcctttgcttccctgatctgcattatttttatttatgaggctattgaaaaactgatccacctagccgagacatatcctattcatatgcattctcaactggaccacctgagcctgtattactgccggtgcacactacccgaaaaccccaataaccatacattgcaatattggaaggaccataacatagtgactgcagaagtgcactgggcaaacctcacggtatccgagtgtcaggaaatgcacggcgagttcatgggcagtgcatgtgggcatcatggcccatacacccctgacgtgctgttttggtcttgcattttattctttacaactttcatcctatcctccactctcaaaacgttcaagacctccagatattttccgacacgggtacgctccatggtttctgattttgccgtcttcttgacaattttcacaatggtcattatcgactttctcattggggtcccatctccaaaactacaggtgccgtctgtttttaaaccaaccagagacgatagaggatggattatcaatcccattgggccaaatccatggtggacagtgatcgctgctatcatccctgccttgttatgcactattctcatttttatggatcagcaaatcactgcggtgataataaaccggaaagagcacaaactcaaaaagggctgtgggtatcacttggacctcctgatggttgctataatgctgggtgtgtgctctataatggggcttccgtggttcgttgccgctacggtcctcagcatcacccatgtaaacagtttgaaactggagtcagaatgttcagcccctggcgagcaaccgaagttcctggggattagggaacaaagagtcaccgggctgatgatatttgtgctgatggggtgtagcgtgttcatgaccgctatcctgaagttcatccccatgcctgtgttatacggggtgtttctctacatgggcgtctcctctctgcagggaatacagtttttcgaccgtcttaagctctttggtatgccggcaaaacaccagcctgactttatatacctaaggcacgtcccactgaggaaagtccatcttttcaccttaatccagttgacctgtctggtgctgctgtgggtgatcaaggcctcccctgcggccattgtcttccctatgatggtgctggccttggtgttcgtccggaaggtgatggacttgtgtttcagcaagagggaattatcctggctcgacgatttaatgccggaatcaaagaagaagaaactcgacgacgcaaaaaaaaaggctaaagaagaggaggtgatcgttctggctcctaccgtgtatcttggggcctcgaactatagaacatag

SEQ ID NO: 206225 - DNA, 3216 bp, Artificial Sequence
  Description of Artificial Sequence: Synthetic coding sequence
atgttcaacaagaacaacagcaacaagctgcggagcaccccccggtaccgcagaggagaccctggctatctgaactttaccgagctaggacccttgaagccggagcagaaggatcagtggagccagcataggccagacgaggaggcagtggtcgatcaaggcgggacatctacaatcctgaacatccactatgagaaggaagaactggagggccaccgcacattgtacgttggggtaagaatgccattggggcgtcagagtcataggcatcatagaacccacgggcagaagcatagaagaagaggccgcgggaaaggggctagtcaaggagaagaaggactggaagccttagcacatgacacgccatcgcagcgcgtgcagtttatattggggaccgaagaggatgaagaacatgttcctcatgagttgtttactgaactcgatgaaatctgcatgaaggagggagaggacgcggagtggaaggagaccgcaaggtggctgaagtttgaggaagatgttgaggacgggggcgaaagatggagtaagccctatgtcgcaaccctgagccttcactcactcttcgagctccgcagttgtctgataaatggcacagtgcttttggatatgcacgccaacagcatagaagagatttcagatcttatcttagaccagcaggagctatcctcagacctgaacgatagtatgcgggtgaaggtccgggaagcactgctcaagaagcatcatcaccagaatgagaagaaacggaacaacttaatacccatcgtgcgttcctttgctgaagtcggcaaaaaacaatcagatccacacctgatggataaacacggtcagaccgtatcccctcagagtgtcccgaccaccaatctggaagtgaagaacggggtcaattgcgagcacagtccagttgatttgtcgaaggtggatctgcatttcatgaagaagataccaacaggtgccgaagcttccaacgtgttggttggtgaagtcgacatcctcgatcgaccaatcgtggcttttgtgcgactgtcccctgcagtgttgctaagtgggcttactgaagttccaatcccaaccaggttcctctttattctgctgggcccagttggcaagggtcagcaataccacgagatcggcaggtctatggcaactatcatgactgatgaaatatttcatgacgttgcgtataaggccaaggagcgtgatgatcttttggcaggaattgacgaattcttggaccaggtgaccgtgcttccacctggagagtgggatccctccatccgcatcgaacccccgaagaatgtgccaagtcaggaaaaacgtaagatgcccggggttcccaatggaaacgtttgtcacatcgagcaggagccccacggaggacacagcggcccagaactacagagaaccgggcggctgtttggggggttggtcttagacattaagcgcaaggccccgtggtactggagcgactacagagatgccctgtccctccaatgcctggccagttttctgtttctgtattgcgcctgcatgtctcctgtgataacctttggcggcctgttaggagaagctactgagggacgaattagcgccatcgaatctcttttcggcgcttccatgaccggaattgcatatagcttgtttgctggacaggccctgaccatactcggcagcaccggcccggtgcttgtgttcgaaaaaatcttgttcaagttctgtaaagattatgcactcagttatctctctcttagagcttgcatcggcctatggacagcctttttatgtattgtgctcgtggcgactgacgcctctagtttggtatgttacattactcgcttcacagaggaagcctttgcctccctgatctgtattatcttcatttacgaagctatcgagaaactgattcacctcgctgagacttacccgatccacatgcacagtcagctggatcacctctctctatactactgccgttgtacactgcccgagaatcccaacaaccatacacttcagtattggaaggaccacaacattgtaactgcggaggtacactgggcgaacctgacagtttcagagtgtcaggagatgcacggggaattcatgggaagtgcttgcggccatcatggcccatacacaccagacgttctgttttggtcctgcatcctcttctttacaaccttcattctatcatcaacgctgaaaaccttcaagacatctagatacttccctactagggtccgctctatggtttcggactttgccgtgttcttgacaatcttcactatggttatcatcgatttcctgattggcgtgccaagccctaagttgcaagtaccatccgtctttaaaccaacaagggacgatagaggatggattatcaatcctattggcccaaacccctggtggaccgtgatagctgctatcattccggcgcttctgtgtacaatacttatttttatggaccagcagattaccgcggtgatcattaatcggaaggagcacaagctgaagaagggatgtggataccacttagacctgctgatggtggcaattatgctgggggtgtgttccataatgggcttaccttggttcgttgctgctacagtgctgtcaatcacccacgtaaacagcctcaaactggagtccgaatgcagcgcacctggggaacagccaaagttcctggggattcgggagcagcgtgtgacaggtctgatgatattcgtcctgatgggctgcagcgtgtttatgacagcaatcctgaaatttatcccaatgcctgtgctgtacggggtgttcctctatatgggagttagctcattgcaaggaattcaattcttcgatcgactgaaactgttcggcatgcccgctaagcaccagccagatttcatttatctgcgtcatgtgcccctgcggaaagttcacctgttcaccctgatacagctgacatgcctggtactgctttgggtgattaaagcctcacctgcagccatcgtgttcccaatgatggttctggctttggtgttcgtgcgaaaggtcatggacctctgtttcagtaaaagagaactctcctggctggacgacctcatgcccgaaagcaagaaaaaaaagctggatgatgccaaaaagaaggctaaggaagaggaggtcatagtcctggcgcccacggtgtatctcggagcatcaaactaccgcacttag

SEQ ID NO: 206226 - DNA, 2244 bp, Artificial Sequence
  Description of Artificial Sequence: Synthetic coding sequence
atgcccctgggccggcagagccaccggcaccaccggacccacggccagaagcacaggcgccgcgggcgcggcaagggcgcatcccaaggcgaagagggcctggaggctctcgcacatgacacccccagccagcgggtccagtttatcttgggcacagaagaagatgaggaacacgttccgcacgagcttttcacagagctggatgagatttgtatgaaagagggagaggacgctgagtggaaggagactgcgcgttggctgaagttcgaggaggacgtggaggatgggggggaacgatggtcgaagccatacgtggccactctcagtctccacagtctgttcgagcttcgctcatgtcttattaatggaaccgtcttacttgacatgcacgctaatagcatagaagaaataagcgatttaattctggaccagcaggagctttcatccgatttaaatgactcaatgagagttaaggtgagagaggcactgctaaagaagcaccatcaccagaacgaaaaaaagaggaacaatcttatccccattgtgaggtcgttcgccgaggtggggaaaaaacagagcgatccccatctcatggacaaacacggccagactgtgagtccacagtccgtgcctacgactaacctcgaggtgaagaatggtgtgaattgcgaacactcaccggttgacctgtcaaaagtagatttacactttatgaaaaaaattcctaccggggcggaagcaagtaatgtgctggtcggagaggtcgacatactagaccggcctatcgtagcttttgttaggctgtctcctgccgtactgctgagtggcctcaccgaagtgcccatcccaacacgctttctgtttatcctgctgggaccagtgggcaaaggccagcagtaccatgagatcgggagaagtatggccacaataatgactgacgagattttccacgatgtcgcatacaaggcgaaggaacgtgacgatctgctggcaggtatcgatgaatttctggaccaggtcactgtgctcccgcccggcgaatgggacccaagcatccggattgaaccaccaaaaaatgtgcccagccaggagaaaagaaaaatgcccggtgttcccaatggaaatgtgtgtcacatcgagcaagaacctcacgggggccactccggccccgagctacagcgcaccggtagactgtttggtggcttggtgctggacattaaacgtaaggccccctggtactggagtgattatcgcgacgccctgagtctgcagtgcctcgcctctttcctgtttctctattgcgcatgtatgtctccggtgataacctttggcggcttactcggggaagctacagaggggcgcattagcgctatcgagagcctgttcggggcctccatgaccggaatagcctactccctgtttgctggacaggcactgaccatcttgggatccaccgggcctgttctggtcttcgaaaagatactgtttaagttctgcaaggactacgcgctttcctatttgtctctgcgagcctgtataggcctgtggacggccttcctgtgtatcgttctggttgctacagacgcttcttccctagtgtgttacatcacccgcttcaccgaggaagcctttgcttctttaatctgtataatcttcatctacgaagcgatagagaagctcatccacctggcggagacctaccccatccatatgcatagccagctagatcatcttagcctatactattgtcgctgcacactgccagaaaacccaaacaaccacactcttcagtactggaaggaccacaatattgtgactgccgaggtgcactgggctaacctcactgtcagtgaatgccaggaaatgcacggcgagttcatgggtagtgcctgcggacaccatggcccatacaccccagatgttctcttctggtcctgcatcctgttctttaccacattcattctctccagcaccttgaagacatttaagacttccagatatttccccacacgaatggaatcttgctctgtcgcatggcttgagtgtggcggagtgattctagcgcattgtaatcttaggctcttaccaagctcatgggactatcgtcacgcccccccacagccagccaacttctgtattttttctcgggatggagtttctccctgttggcctggctggtcacagtcactggacttggtgatttgcctgcctagacctccaaagatgctgggccttcaagcttag

SEQ ID NO: 206227 - DNA, 3282 bp, Artificial Sequence
  Description of Artificial Sequence: Synthetic coding sequence
atgcccgccgccggcagcaacgagcccgacggcgtgctgagctaccaacgcccggacgaggaggctgttgtcgatcagggtgggacatcaacgatcctgaacattcactacgaaaaagaagaactcgaaggtcatcgtaccctttatgtgggggtgagaatgcctctcggccgacagagccaccggcatcatcggactcacggtcagaagcacagacgacgaggcaggggaaaaggcgcctctcaaggtgaagagggactggaggctcttgcccacgacacgccctctcaacgcgtgcaattcattctcgggaccgaggaggatgaagagcatgttcctcacgagctgttcacagaactggacgaaatatgtatgaaagagggggaggatgcagagtggaaggagaccgctaggtggttaaaattcgaagaagatgtggaggacggcggcgagcggtggtccaagccctacgtagctaccctgtcacttcatagcctgttcgagcttagaagttgcctgatcaatggaactgttctgttggatatgcacgcaaactctatcgaggaaatatcagacttaatcttagaccagcaggagctgtcaagcgaccttaatgattccatgcgggttaaagtcagggaagccctactcaaaaaacatcaccaccaaaatgagaaaaagcggaacaatttaataccgatcgttcgcagcttcgctgaggtcgggaaaaaacaaagcgatccccacctcatggataaacacggacagacggtgtcgccacaatccgtgccgacaacaaatctcgaggtgaaaaatggcgttaattgcgagcattccccagtggacttatcaaaggtggatctccactttatgaaaaagatccccacaggggccgaagcatctaacgtgctagtgggcgaagtggacatattagatagaccaattgttgcatttgtccgtctttcacccgcagtcctgttgtctgggctgacagaggttccgataccaacacggtttctctttatactgctcggacctgtagggaagggtcagcagtatcatgaaatcggccggagcatggccactattatgacagacgagatctttcacgacgtcgcctataaagccaaggaacgcgatgatttgctagccggcatcgacgaattcctcgaccaggttacggtcctgcctcccggcgagtgggacccaagcatcagaattgagccccccaaaaacgtcccttcccaggagaaacgtaagatgccaggcgtgccaaacgggaacgtttgtcatatcgaacaggaaccccacggcggtcacagcggtcctgagttgcaaagaaccggccggctcttcggcggtctagtcctcgatataaagaggaaggccccttggtactggtcagactatcgggatgccctcagcctacagtgcttggcatcattcctgttcctctattgcgcgtgtatgagtcctgtcattaccttcggagggcttctaggagaggcaacagagggccgcatcagtgcaattgagagcctctttggggcatctatgacgggcatcgcatatagcctgttcgctggccaagccctgactatcctgggatccacgggacccgtactagtgttcgagaagatcctgttcaagttctgtaaagactatgccctgagttacctttccctgcgcgcctgtatcggcctttggacagcttttctatgcatcgtcctggttgctacagatgccagttctctggtgtgttacattacaaggttcaccgaggaggcctttgcaagcctgatctgcattatcttcatctacgaggccattgaaaaattgatccatcttgctgaaacataccccatccacatgcactcacagttggatcatttgagtttgtactactgccgctgcaccttgcctgagaacccgaacaaccatacgctccagtattggaaggatcacaacattgtcacagccgaggttcactgggcgaacctaaccgtgagcgaatgccaggagatgcacggcgaatttatgggttccgcttgtggccaccatggtccatacacgcccgacgttctgttttggtcctgtatcctcttctttaccacatttattctaagttccacccttaaaacgttcaagacttccaggtattttcccacacgtgtccggtccatggtgtcagactttgctgtcttcctgactatctttacaatggtaattattgactttctgataggagtcccatcaccaaagctccaggtgcctagtgtgtttaagcccacgagggacgaccgagggtggataattaatccaatcggtccgaacccgtggtggactgtcatcgcagccataatacctgctctcctgtgcacaatacttatttttatggaccaacagatcaccgccgtcataatcaatcggaaggaacacaaattgaagaaaggctgcgggtatcatttagatctgctaatggtagcaatcatgttgggggtgtgctctattatgggccttccatggttcgtggccgctacagtgctttccattactcatgttaacagtttgaaattggagtctgaatgttcagcacccggcgagcagcccaagtttctagggataagagaacaaagggtgaccggcttaatgatcttcgtgttgatgggctgctccgtcttcatgaccgccatcttgaaatttatccccatgccagttctttatggtgttttcctgtacatgggcgtatccagtctacagggtatacagttttttgaccgcctgaaattgtttggaatgcccgcaaaacatcagccagatttcatctatctcagacacgttccactgcgcaaagtgcacttattcacgctgatccagctgacgtgcctcgtgttgttgtgggtgatcaaggcatctccggccgccattgtgttccccatgatggttctggcactcgtgtttgtacgtaaagtaatggacctgtgcttctcaaaacgcgaattgtcctggttagatgacctaatgcccgagtccaagaagaagaaactggatgacgcgaaaaagaaggccaaggaagaagaggaagctgaaaagatgcttgaaatagggggcgataaattcccgcttgagagtagaaaattgctgtcgagtcccggcaaaaacatttcatgtaggtgtgatcccagcgagataaatatcagcgacgaaatgcctaagacgacagtgtggaaagccctttcaatgaactctggaaatgccaaagagaaatcattatttaactag

SEQ ID NO: 206228 - DNA, 1917 bp, Artificial Sequence
  Description of Artificial Sequence: Synthetic coding sequence
atgcccctgggccggcagagccaccggcaccaccggacccacggccaaaagcataggcgtcgcgggcgcggcaaaggggcatctcagggcgaggagggactagaagcactagcccatgacacgccctctcaaagggtccagtttatactcggtacggaggaggatgaagaacacgttccacacgaactgtttactgagctggacgagatctgtatgaaggaaggtgaagatgctgagtggaaagaaaccgcccgatggctgaagttcgaagaagatgtggaggacggcggagaaagatggtctaaaccctatgtcgccactttgtcgcttcattcactatttgagcttaggtcatgtctcataaatggtactgtcttactggacatgcatgccaactcaattgaggaaataagcgacttgattttagaccagcaggagctgtcgtctgatttaaatgatagcatgcgagtgaaggtacgcgaggcattgctcaaaaagcatcatcatcagaacgagaagaagcgcaataatcttatcccaattgtcaggagcttcgccgaggtgggcaagaaacagtctgacccccatctcatggataaacacggccagacagtgtctccccagagcgtcccaaccaccaatctggaggtgaaaaacggagtgaactgtgagcatagtccagtggacttgagtaaggtggacctccattttatgaagaagatccctaccggcgctgaagcatctaatgtgcttgtgggagaagtggacatcctagacaggcctattgttgcgttcgtgcgactatccccggccgtgcttctaagcggcctgacggaagtgccgattcctactaggttcctcttcatattgctgggtccagtcgggaagggtcagcagtatcacgagatcggcaggtctatggcaacgattatgaccgacgagattttccatgatgtcgcttataaggcaaaagagagggacgatctgcttgctggtatagacgagtttctggatcaagtgactgtccttcccccgggtgaatgggatccgtccatacggattgaacctccaaagaatgtcccctctcaggagaagagaaagatgccgggcgtccccaatggaaacgtttgtcacatcgagcaggaacctcacgggggacattcggggcccgaacttcaacgcactggtcggctcttcgggggactggtgttggatataaagcggaaggcaccctggtattggtccgattatagagacgccctgagcctgcaatgccttgcctcatttctgtttttgtattgcgcgtgtatgtctccagtgattacattcggtggactcttgggcgaggcaactgaggggcgcatctcagcaattgaaagcctctttggtgcatctatgactggaatcgcctactctctcttcgccggtcaggcactgactatactgggcagtactggccccgtgctggtgttcgagaagatccttttcaagttctgtaaagattacgctctctcctatctgagcctccgagcgtgcatcggactctggacagcgttcctttgcatcgttctggtcgctacggatgcatccagcctcgtgtgctacatcacgcggttcactgaggaagcttttgccagtctgatttgtataatctttatatacgaagcaatcgaaaagctaattcatttggcagagacatatcccattcatatgcatagccagctggaccacttgagcttgtactattgccgatgcacacttcccgaaaacccgaacaaccacaccttacagtattggaaggaccataatattgtcactgctgaggtccattgggctaaccttacggtgagcgtgtcacttggagccgctagatgcccttcaatagtgactactgggctgggcgggaccagcaaatag

SEQ ID NO: 206229 - DNA, 2976 bp, Artificial Sequence
  Description of Artificial Sequence: Synthetic coding sequence
atgcccctgggccggcagagccaccggcaccaccggacccacggccaaaaacatagaaggagaggacgcggcaagggtgctagtcagggggaggagggactggaggccctggctcacgacacaccttcgcagagggttcagtttatcttagggacagaagaagatgaggagcacgtacctcacgagttgttcactgagttagatgaaatatgcatgaaagaaggcgaagacgccgaatggaaagaaacggctcgatggcttaagtttgaggaagatgttgaagatggcggggaacgctggtcaaaaccctacgtagccaccctgtctctccactctcttttcgagctgagatcgtgcctgattaatggaacggtcctcctcgacatgcacgcgaactcaatcgaggaaatttctgacttgatactggatcagcaggagctgagctcagatctgaatgatagtatgcgagttaaggttagggaggccctgctgaaaaaacaccatcaccagaatgagaagaagcggaataacctgatacctattgtgcgctctttcgccgaagttggcaaaaaacaatctgatccccatcttatggacaaacacggccagaccgtgtcccctcaatcagtgcctactaccaaccttgaagtgaagaatggcgtaaattgcgaacattccccagtggacctgagcaaggtagatctgcacttcatgaaaaagattcctaccggagccgaagctagcaacgtgctggtgggagaggtggatatcctcgacaggcccattgtagcctttgttaggttgagcccggctgttctgctgagcggattgacagaggtgccaataccgacccgcttcctgttcatcctgttgggtcccgtcgggaaggggcagcagtaccacgaaatcggacgcagtatggccactatcatgactgatgaaattttccacgacgtcgcctacaaagctaaagagcgggacgatctcctcgccggcattgacgagttcctagaccaggtcactgtactgccaccgggggaatgggacccgtctattcgaatcgagccaccaaaaaacgtccccagtcaggaaaaacgcaagatgcctggagttcctaacggaaatgtgtgtcacatcgagcaggaaccacatggcgggcactcaggacctgagctccagagaaccgggagactgtttggtggtctcgtgctggacattaagagaaaggccccatggtattggagtgattatcgcgatgctctgtcattacagtgcctggcatctttcctgtttctttactgcgcatgtatgtcccctgtcataactttcggaggactgctgggcgaggctacagaaggaagaattagcgcaattgagtccctattcggagcttccatgactgggatcgcatactcccttttcgcaggacaggccctcacaatcctgggcagcacagggccagtactcgtattcgaaaagattctcttcaagttttgcaaagattacgcactcagctatttatcgttgagagcctgcattggtttgtggactgcattcctatgtattgtgctggtcgccactgacgcttcttctctcgtgtgctatatcacaaggtttacagaggaggccttcgctagcttgatctgtattattttcatctacgaggcaatcgagaagctgatccacttagccgaaacttacccaatccacatgcactcgcaactggatcatctttccctctattactgcagatgtactctgcccgagaacccaaacaaccatactttgcagtactggaaggaccacaatatcgttacggcggaagtacactgggccaatctgaccgtctcagaatgtcaggagatgcatggggagtttatgggaagcgcgtgcggacatcacgggccctatactcctgacgtgttgttctggtcttgcatactgttttttacgacatttattctctcatcaaccctgaaaacgttcaagacttctaggtactttcctacgcgggtcagatccatggtgtctgattttgccgttttccttacaatctttacgatggtcatcatagattttctgattggggttccttcccctaaactgcaagtgccttctgtgtttaaacctactagagatgataggggctggataatcaatcccataggtcctaatccgtggtggaccgtcattgccgccatcattcctgcattgctgtgtactatccttatatttatggaccagcagataactgctgtgatcatcaaccggaaggaacacaagttaaagaaaggatgcggttaccacctggacctcctcatggttgcaattatgttgggagtgtgcagcatcatgggactgccctggtttgttgcagctaccgtcctgtctatcactcatgtcaatagtcttaagctggaaagcgagtgctcagctcctggcgaacagccgaaatttcttggtattcgggagcagagagtgactgggctcatgatctttgtgctcatggggtgctccgtgtttatgaccgccattctcaagtttattccaatgcctgtcctctatggagtgtttttgtatatgggtgtgtcatcgcttcagggtatccagttttttgaccgcctgaaactgtttggcatgcccgcgaaacaccagcctgacttcatctatctgcgacatgtgcctcttcggaaggtgcatttgttcactctcattcagctaacttgtctcgtgctcctatgggtgattaaggctagcccagccgcgattgtttttcccatgatggtgcttgcactggtgtttgtgcgcaaagtgatggatctgtgcttttcaaagcgtgaactgtcatggctcgatgacctaatgccagagagcaagaagaaaaagctcgacgacgccaagaaaaaagctaaggaggaggaagtgatcgtcttggcaccgacggtttatttgggagcctccaactacaggacttag

SEQ ID NO: 206230 - DNA, 3321 bp, Artificial Sequence
  Description of Artificial Sequence: Synthetic coding sequence
atggagatcaaggaccagggcgcccagatggagcccctgctgcccacacggaatgatgaagaggcagtggtggaccgcgggggtaccagaagcattctcaagactcacttcgaaaaggaagatctggaaggccaccggactctctttattggtgtccacgtgcctttgggcggccggaagagccaccgaaggcaccggcatcgcggccataagcacaggaagagggaccgggagagggactcaggcttggaggacggacgtgagtccccaagctttgatactccaagccaacgggtgcagttcattctaggcaccgaggacgatgatgaggaacacattccccacgatctttttacagaactggatgaaatttgttggagagagggcgaggatgccgagtggcgggagaccgcacggtggctgaagttcgaggaggatgtcgaagacggcggcgagcgttggagtaagccatatgtcgcaaccctgtcactgcacagcttattcgagctaaggtcatgtatcctaaacgggacagtcctgctagatatgcacgctaacactcttgaggaaatcgccgatatggtgctagaccagcaagtctcctccgggcagctcaatgaggatgtaaggcaccgcgtacacgaggccctaatgaagcagcaccaccaccagaaccagaagaaactgactaaccggatcccgatagtgcgctcttttgccgacattggaaagaaacagtccgagccgaacagtatggacaaaaacgcgggccaggtggtgtctcctcagtctgcccccgcctgcgttgagaataagaatgacgtgtctcgagaaaattctactgtcgacttctcaaaggtggacctccattttatgaagaagatcccacccggggctgaagcctctaatatcctggtcggtgagctagagtttctcgatcgcaccgttgtcgcctttgtccgcttgtctccagctgtgctcctgcaggggctggccgaagtgcccatccccacccgctttctttttatcctgctgggtccattaggaaagggtcaacagtaccacgagataggacggagcatagctaccctgatgaccgatgaagtttttcacgatgtggcttataaggctaaggaccgtaacgatctagtgagcggtatagacgaattcctcgatcaggttacagtcctgccaccaggggagtgggatcccagtattagaatagagccacctaaaaatgtgccatcgcaagagaaaaggaaaatcccagctgttcccaatggtaccgccgcacacggagaggccgagccccatggcggacattccggaccagagcttcagagaacaggaagaatttttggggggttaattctggacattaagagaaaggccccctatttctggagcgactttcgcgatgctttttcccttcagtgtctggccagcttcctgtttctctactgtgcttgtatgtcacccgttattacgtttggagggcttctgggggaagcaactgaaggcaggatcagtgccattgaatcactgttcggagctagcatgactggcatagcttacagtctgttcggtggccaacccctcacaattctcggcagtacgggtcctgtgctggtttttgagaagattctgtttaaattctgtaaggaatatggactgtcgtatctgtccttacgggccagcattggactatggactgctaccttgtgcatcatcctcgtcgccactgacgcatcttcactcgtatgctacattaccaggttcacggaagaggccttcgcatctctcatttgcattattttcatatacgaagctttggagaagctgtttgagctgtccgaggcatatcccataaacatgcacaatgatttggagctgctcactcagtacagttgcaattgcgtcgaaccccacaacccctccaacggcaccctcaaagaatggcgcgagagtaacattagcgcaagtgacattatttgggagaatttaaccgtaagcgagtgcaagtcactgcatggcgagtacgtgggccgtgcgtgcggccatgaccacccctacgtgccagacgtgttgttctggagtgttatcctcttcttttcaactgtgacgctgtcagccaccctcaagcaatttaagacctcacgatattttccaactaaagtccgttctattgtatctgatttcgccgtgtttcttaccattctgtgcatggtgctcatcgactacgcaattggcatcccttcccctaaattgcaagtaccatcggtgttcaaaccgactcgtgatgaccgtgggtggttcgtcacgccgttgggccctaatccttggtggacagttatcgcagcaataattcccgcactgctgtgcaccatcctcatcttcatggatcaacagatcacagctgtcatcatcaacaggaaggagcataagttgaagaaggggtgtggctaccacctagaccttctcatggtggccgtgatgctgggcgtgtgctcaattatgggacttccctggtttgtggctgccaccgttctgagcatcacgcacgtaaactcacttaaattagagtctgagtgttcagcaccgggcgagcagccaaaattccttgggatcagagaacaaagggttacaggtcttatgatctttatcctgatgggttcttcagtgttcatgacatccatactgaagttcatccccatgcccgtgctttacggcgtcttcctgtacatgggcgccagtagtctgaaaggtatccaattcttcgaccgcatcaaattgttttggatgcctgctaaacaccaacccgacttcatttaccttcggcacgtccccctgaggaaggtgcatctgttcaccatcattcagatgtcttgcctgggactgctgtggatcattaaggtgtctagagccgccatcgtgttccctatgatggttctggccctggtgtttgtgcgcaagttaatggatcttctgttcacaaagagggagctgagctggctcgatgacctcatgcctgagagtaaaaaaaagaaactggaggatgctgaaaaagaggaggaacagagtatgctggcgatggaggatgaaggtactgttcagctgccactcgaggggcattatcgggatgacccttcagttatcaatatttctgacgagatgagcaaaacagcgctctggagaaaccttctcataactgcagacaatagcaaagataaagagtcttccttcccttccaagtccattgagagtcggaaggagaagaaggctgattctggtaaaggggttgatagagaaacatgtctgtag

SEQ ID NO: 206231 - DNA, 3300 bp, Artificial Sequence
  Description of Artificial Sequence: Synthetic coding sequence
atgcagagcctgggcgtgagcggcaaccggaaggtgatgcagagcggcacctgcgagccctttcagagtcttagccaccagcgcaacgatgaggaggctgtggtagaccgcggaggcacacgatctatactgaagacccatttcgagaaagaggatctagagggtcaccgtacactgttcatcggggtgcatgtgccgctcggagggagaaagagccatcggcgtcatcgtcacagaggtcataagcaccgtaaacgcgatagggaacgagatagcggactggaagatgggcgggagtccccttcttttgatacgccatcccagcgtgtgcaatttattctcggcactgaagacgacgacgaagaacacattccacatgacctcttcaccgagcttgatgaaatttgttggcgcgagggggaagacgctgaatggagggagacagccaggtggctcaaatttgaggaagacgtggaagatggcggtgaacgctggagtaaaccatacgtggcaacactatctctgcattcgctgttcgaactcaggagctgtatccttaatggcactgtcctcctggatatgcatgcgaatacgcttgaggagatcgctgacatggtgcttgatcagcaggttagctcaggacagctgaatgaagacgtgcgtcaccgtgtgcatgaagccctgatgaagcaacaccatcatcagaatcagaaaaaactcactaatagaattcccattgttcgtagtttcgctgatatcggaaaaaagcagtccgagccgaatagcatggacaagaatgctggacaagtggtaagcccacagtctgcccccgcctgtgttgagaataagaatgacgtgtcgagggaaaacagtactgtggatttttcaaaagtagatttacatttcatgaaaaagattccccctggggccgaggcttccaacatccttgttggggagctggaattcctggataggacagtggtcgcctttgttcgactctctcccgctgtgttgctgcaggggctggccgaggtgccaatcccaactcgctttctgttcatcctcctgggcccgctgggcaaaggccagcagtatcacgaaattgggcgttccattgctactttaatgacggatgaggtttttcatgacgtggcttacaaggccaaggatcggaatgaccttgtcagtggtatcgacgaatttctcgatcaggtgaccgtcctccccccaggggaatgggaccccagcatcagaatagagccccccaaaaacgtgccatctcaggaaaaaaggaagatcccggccgtacccaacgggactgcggcgcacggggaagcagaaccacacggaggtcactcgggccctgagctccaacggaccggccggatcttcggtggtctgatcttagacattaaacgcaaggccccatatttctggtccgactttagggatgccttcagcctccagtgtcttgccagttttttattcctctattgtgcttgtatgtccccagtgatcacctttggcggtcttctcggcgaggccaccgaggggcggatttcggctattgagtcactttttggagctagcatgaccggcatcgcctattccctttttggtggtcaaccacttacaatcctaggcagcacggggcccgtgctcgtgttcgagaagatactgtttaaattctgtaaagaatacggccttagttacttaagcctccgagcaagtattggtctgtggacagctaccctgtgtattatccttgttgcaacagacgcaagtagtctggtgtgctacatcactcggttcacagaggaggcttttgctagtcttatttgcatcatattcatatacgaggctctagagaaactgttcgaactctctgaggcttacccgattaatatgcataacgatctcgagttgcttacacagtatagctgtaactgtgtagagccgcacaacccttctaacgggacactcaaagagtggagagagagtaatatcagcgcctctgatatcatttgggaaaatttgactgtatcagagtgtaaaagtctgcatggcgagtatgtgggtcgggcctgtgggcatgaccacccttacgttcccgatgtccttttttggtcagtcatcttgtttttctccaccgtgacattgtcagcaacccttaagcagtttaagacaagcaggtactttcccactaaggtcaggtccattgtgtcagactttgctgttttcctcacaatcctgtgtatggttctgatcgactacgcaattggaatcccctctcccaaactgcaggtgccctcagttttcaagcctactcgggatgacagagggtggttcgtgacccccctcggccccaacccatggtggacagtgattgcagctattatccccgcactcctttgtacaatcctcatctttatggatcagcagattaccgctgtcatcatcaatcgtaaggagcacaagcttaagaaagggtgtggatatcatctggatctgctcatggtggccgtgatgctgggagtttgttcaattatgggacttccttggttcgtggccgcaactgtgctgtccatcacacacgtaaacagtcttaagttggaatctgagtgctcagctccaggcgaacagccaaagttcttaggcatacgtgaacagagggtgactggactgatgatttttatattgatggggtctagtgtgtttatgacttcgatactgaagttcattccaatgcctgtgctctacggcgtattcctgtacatgggtgcctccagcctaaagggcattcagttctttgatcgcattaagcttttctggatgccggcaaaacatcaaccagactttatatatctgaggcacgtccccctgcgcaaggtgcatctctttacgatcatccagatgagttgtctgggccttctctggatcatcaaagtatccagagccgctatagtgtttccaatgatggtcctggccctcgtctttgttcgcaaactaatggacttattgttcaccaaaagagagctgagctggttggatgacctgatgccggaatctaaaaagaagaagctggaagacgctgaaaaggaggaggagcagtcaatgctggctatggaagatgaggggacagtgcaactgcctctagagggccactatcgagatgatccctcggttataaatatcagcgacgaaatgtctaagaccgcgctgtggaggaatctgctgatcactgccgacaattctaaggacaaagaaagctctttccctagcaaaagcagcccctcctag

SEQ ID NO: 206232 - DNA, 3354 bp, Artificial Sequence
  Description of Artificial Sequence: Synthetic coding sequence
atggagatcaaggaccagggcgcccagatggagcccctgctgcccactcgcaacgatgaggaggctgttgtcgatcggggcgggactcgtagtatcctgaaaacacattttgaaaaagaagatttggaaggacaccggacgttgttcatcggagtacatgttcccctcggcggtcgaaaatctcatagacggcatagacaccgaggtcacaaacacagaaagcgggacagagaaagagattcgggcctcgaggacgggagggaaagcccgtctttcgatactccttcccagagagtacagttcatcctcgggactgaagatgatgacgaggagcacatcccccatgacctattcactgaacttgacgagatctgctggcgtgagggcgaagatgcagaatggcgggagacagctcggtggctcaagttcgaagaggacgtggaggacggaggcgagagatggagcaagccttacgtagctacgctgagcctgcattcattgttcgaattgagatcctgcatcctgaacggcacagtcttattggacatgcacgctaacaccttggaagaaattgctgatatggttctggaccagcaagtcagtagtggacagctgaacgaggatgtgcgacaccgggtacatgaagccttgatgaaacagcaccaccatcagaatcagaagaagctgacaaatagaatcccaatcgttagaagcttcgccgacattggtaagaaacagtcagagcccaacagtatggacaagaacggccaggtcgtgagtccccagtcggcaccggcttgcgttgagaataaaaatgatgtgtccagagaaaactccaccgtggatttttcgaaaggtctgggggggcagcagaagggccacacttctccctgtgggatgaagcagcggcacgaaaaggggcctcctcaccagcaggagcgcgaggtggacctccatttcatgaagaaaatccctcctggggccgaagccagcaatatactcgtgggcgagctggaattcctggatagaaccgtagtggccttcgtacgcctaagccctgccgtgcttctgcaggggctggctgaggttcccattcctacccgttttctgtttattcttctcggtccactcggaaaggggcagcaataccacgaaattggacgtagtatagccaccctgatgacagatgaagtgttccacgacgttgcatacaaagccaaagaccgcaacgatctggtgagtggaattgacgagttcctggatcaggtcactgttctcccccctggtgagtgggatccctcgattagaatagaacctccaaagaatgtgccttcccaggaaaagaggaaaattcccgccgtcccaaacgggacagccgcacacggcgaagcagaacctcacggaggccattccgggccggaacttcagcggacggggaggatcttcgggggtctgattctcgacataaagcgtaaggctccttacttctggtcggattttagggatgccttcagccttcagtgcttggccagctttctgttcctgtactgcgcttgtatgagcccagtaattacgtttgggggattgctcggcgaagcaaccgagggcaggatcagcgccattgaatctttatttggcgccagcatgacaggtattgcatacagcttgtttggcggccaacctctgacaattctggggagtaccggccccgtgctcgtgtttgagaagatcttgttcaaattctgcaaggaatatgggctctcttatctctctttgcgggcctccattggattgtggacagctacactctgtatcattctggtcgcaacagacgccagtagtctcgtttgttatatcacacgtttcaccgaggaagcatttgcaagcttgatttgcatcatttttatatacgaggccctggaaaaattgttcgaattaagtgaagcctaccccattaacatgcacaacgatctggagctgctcacccagtactcatgtaattgtgtcgagccacataacccaagcaacgggactctgaaggagtggagagaatctaacatctcagcttctgatatcatttgggagaacctcacagtgagcgagtgcaagagtctgcacggcgaatatgtgggtcgggcctgcggacatgatcatccgtatgtccccgatgtgcttttttggtctgtcatattatttttttccaccgtcaccctgagcgcaaccctgaaacagtttaaaaccagccgctatttccccacaaaggtgcggagtatcgtgtcagactttgcggtattcctcacgattctctgtatggtattgatcgactacgcaattggaattccatccccgaagctccaggtgcctagcgtcttcaaacctactcgagatgaccgcggctggttcgtgacccctctgggcccgaacccctggtggacagtcatcgctgccatcatacctgccctgctgtgtaccatcttgattttcatggatcagcagataaccgccgttatcatcaatcgcaaggagcacaagctgaagaagggatgcggttaccatctggatttgctgatggtggcagtgatgctgggcgtgtgttctatcatggggctgccctggttcgttgcggccaccgtcctgagcatcactcacgttaatagcctgaagctagaatccgagtgttcagcacctggagagcagccaaagttcttggggatcagggagcagagagtgaccggcctgatgattttcatactcatgggcagcagtgtttttatgactagcattctaaagtttatcccaatgccggttctgtatggagtttttctgtacatgggcgcctcatctctgaaaggaatccagttttttgaccgaattaagctcttctggatgcctgctaaacatcagcctgacttcatttaccttcgccatgtgcccctgagaaaagtacatctgtttactattattcagatgagttgtttaggcctgttatggatcatcaaggtctcacgtgcagcaatcgttttcccaatgatggtactggccctcgtgttcgtgcggaagcttatggatctgctgttcactaagagagaactctcctggctggatgacttaatgcccgagagtaagaagaagaagttggaagacgccgagaaggaggaggagcaaagcatgctggcaatggaggacgagggtaccgttcagttgccacttgaaggccactatagggacgacccatccgtgataaatatttcagatgagatgtcgaaaaccgccctctggcgcaacttgttgatcaccgccgacaacagtaaggacaaagaaagctcctttccctccaaatcaagcccttcatag

SEQ ID NO: 206233 - DNA, 3267 bp, Artificial Sequence
  Description of Artificial Sequence: Synthetic coding sequence
atggagatcaaggaccagggcgcccagatggagcccctgctgcccacccgcaacgacgaagaggccgttgtcgacagaggaggtacacgatcaattctgaagacacatttcgagaaagaggacttagagggtcacaggaccttatttattggcgtccatgtgccactgggcgggcgaaagtctcatagaagacacagacacaggggccacaagcaccgcaagagggatagggagagagattccggattagaggacggaagggaatctccctcttttgacaccccttcccagagagtacagtttatcctcggcactgaagacgacgatgaggaacacataccccacgatcttttcaccgagctagacgaaatatgctggagagagggagaggacgctgagtggcgcgagacagcccgttggctcaaattcgaagaggatgtagaagacggaggggagcgctggtctaagccctatgttgcaacgctctccctacattcattatttgagctacgctcttgcatattaaatggcacggtgctgctggatatgcacgcaaacacgttagaggagattgcagacatggttctggatcaacaggtgtcctctggccagctgaatgaggacgtcaggcaccgcgtacacgaggcactgatgaagcagcaccatcaccaaaaccaaaaaaaactgactaatagaattcccattgtgcgcagttttgctgacatcgggaaaaaacaatcagagcctaactcgatggataagaacgctggccaagtcgttagcccacaatcggcaccggcatgcgtagagaataaaaacgacgtaagtcgggagaatagcacagtagacttttcaaaagtcgatctacatttcatgaagaagataccccctggtgccgaggcatccaatatcctggtcggggaactggagttcctggacagaaccgtcgtcgccttcgtccgtctctcccctgcagtcttgctgcaggggctcgctgaggtcccaatccctacccgttttctgttcattctgttgggtccgctggggaagggccaacagtatcatgaaatcggacgatcaatcgccacactgatgacagacgaagtgtttcacgacgttgcatacaaagccaaagaccggaatgacctggtttcaggcattgacgagttcttggaccaagttacggttctgccccccggcgaatgggatccttcgatcaggatagagccacccaaaaacgttccttcccaggagaagcgaaagattcctgccgtgcccaacggcacggccgcacacggagaagctgaacctcacggggggcacagtggcccagagttgcaaaggacaggccgcatctttggggggctgatcttagacataaaacggaaagcgccttatttttggtccgattttcgggatgccttctctctgcagtgcctggcatctttcctgttcctgtattgcgcatgtatgtcccctgttatcaccttcgggggcctcctaggggaggccactgaaggtcggatttccgccatcgagtcgctgttcggagcaagcatgaccgggatcgcctattctctgttcggaggtcaacctttaactattctgggttccacaggaccagtgctagtgttcgaaaaaatcctattcaagttttgcaaggaatatggtctctcttacctgtccctgagggccagcattggcctgtggacagcaaccctgtgcattatcctggtcgctaccgacgcatctagcctggtctgctacatcacaaggtttaccgaggaagcatttgcctctttgatctgtattatcttcatatacgaagcacttgaaaaactctttgaactttcagaggcttacccaatcaatatgcataatgacctcgaactgctcactcaatactcttgcaactgcgtcgagccccacaacccgtccaacggcactctgaaggagtggcgcgagagcaatatttccgcctctgatattatttgggaaaacctgacggtgagcgaatgcaagagcctccacggagagtacgtcggcagggcatgtggacatgaccacccttacgttcctgatgtgctcttttggtctgtcatccttttttttagtaccgtcactctctccgcaacactgaaacagttcaagacgtccaggtacttcccaactaaggtgaggtccatcgtttctgacttcgccgtattcctaacaatcctgtgcatggtcctcattgattacgctatcggaatacccagccctaagctgcaagtgcccagcgtgtttaagcccacacgggatgatcgaggctggttcgtgacaccattaggcccaaacccatggtggaccgttatagctgctatcattcctgctctcttgtgcaccatactgatctttatggaccagcagattaccgccgtgatcatcaaccgcaaagaacacaagctaaaaaagggatgcggataccatctggacttgcttatggtcgcagtgatgctgggtgtttgttccattatggggctgccctggtttgtggccgccacggtcctgagcattacccatgtgaactctctcaagttggagtcagagtgttccgccccgggggagcaaccaaagttcctgggaatcagagaacaacgagtcacaggtttaatgatttttatactgatgggaagctccgtgtttatgacttctatcttgaagtttattcccatgcctgtgctttacggggtttttctgtacatgggggcttcaagtctgaaaggcattcagttttttgaccggattaagctgttttggatgcctgctaagcaccaacccgactttatctatctgcggcatgtacctctacggaaggtgcacctgtttactatcatacagatgagctgcttggggctcctgtggattataaaggtcagcagagccgctattgtgttccctatgatggttctggcgctcgtctttgttcgcaagctgatggacctgcttttcacaaagcgcgaactgtcttggctcgacgacttaatgcctgagtctaaaaagaagaaactggaagacgcagaaaaagaggaagaacaatcaatgctggccatggaagacgagggtactgtgcagctccctcttgaagggcattatcgggacgacccatccgttatcaacatttctgacgagatgtcaaagaccgcactctggcggaatctgctgataacagctgacaactcaaaggataaggaatcatcattcccctcaaagtccagccctagctag

SEQ ID NO: 206234 - DNA, 3165 bp, Artificial Sequence
  Description of Artificial Sequence: Synthetic coding sequence
atggagatcaaggaccagggcgcccagatggagcccctgctgcccacacggaacgatgaagaagcagttgttgatcgtggcggtacccggagtattctgaagacccattttgaaaaggaagatctggaaggccatcgaaccttgttcatcggggttcacgttcccttaggcggccgaaaatcacataggaggcaccggcaccgggggcataagcataggaagagagacagagagcgcgactctgggttagaagacggtagggaatccccgtcatttgacacaccctcccaacgagtacagttcattctggggacggaagacgacgacgaggaacatatcccacatgacctgtttaccgaactggatgaaatttgctggagggagggcgaggatgcagagtggcgcgagacagcccggtggttaaagttcgaggaggacgtggaagatgggggagagcgctggagcaaaccgtacgtggccactttgagcctccactccctctttgagttgaggtcttgcatactgaacggcaccgtgttgttggatatgcatgctaacaccttggaagaaatagctgacatggtactggatcaacaggtgtccagtggtcagttaaacgaagatgtcagacatagggtgcacgaggctctgatgaaacaacatcaccaccagaatcaaaaaaagctcacgaatcgtatccccattgtaaggagcttcgccgatatcgggaagaaacagtctgagcccaatagcatggacaaaaatgctggacaggtagtctctcctcagagcgcccctgcctgtgtggaaaacaaaaatgacgtttctcgcgagaacagcacggttgatttctcaaagggcctgggagggcaacagaaaggccacactagcccgtgcgggatgaagcagaggcacgagaaagggccaccccaccagcaggaaagggaggtggacctgcactttatgaagaaaatcccaccaggggctgaggcctctaatatcctcgtgggcgagctcgagttcctggatagaaccgtcgttgcctttgtgagactatctccagctgtcctgctacagggcctggccgaagtcccaatcccgaccaggtttctctttatactgctgggccctctaggcaagggtcagcagtaccacgaaatcggacgtagcattgccactcttatgacggatgaagttttccatgatgtagcctacaaggccaaggaccgaaacgatcttgttagtggaattgatgagtttttagaccaggtaacagtgctgccacctggagagtgggacccatcgattagaatcgaaccgccaaaaaacgtgccctcacaggagaagagaaagatcccagcagtgcccaacggtacggctgcccatggcgaggccgaaccacacgggggacattcagggccagaactgcagcgtactggccgcatcttcgggggtctcatcctagatatcaaacggaaggctccatacttttggtcagacttcagggatgcatttagcctacagtgtctggcctcctttctcttcttgtattgcgcgtgcatgtccccggtgattaccttcggtggactattgggcgaagccaccgaggggaggatctctgcaattgaaagcctcttcggagcttccatgacgggaatcgcctattctttattcggtggccagcccctgacaatcttgggctctactggtcccgtgctggtcttcgaaaagatcctgttcaagttctgcaaagagtacggtctatcttatttgagtcttcgcgctagtatcgggctgtggacagccacactgtgcattatcctggttgctaccgacgcatcgtcactcgtatgctacataactaggtttaccgaggaagcatttgcttcactaatatgtataatcttcatttacgaggccctggaaaagcttttcgagctgtctgaggcctacccaattaacatgcacaacgacctggaacttctcacccaatattcttgtaattgcgtagaaccccacaacccgtccaatggtaccctcaaagagtggcgggagtcgaatatcagcgcatccgacatcatctgggaaaacttaactgtgagtgaatgcaagagcttgcacggagaatatgtgggccgcgcatgcggccacgatcatccgtacgttcccgatgtcctcttttggtctgtgatcctgtttttttcaacagtgaccctttcggccacccttaagcaatttaaaaccagtcggtacttcccgactaaagtgaggtcaatcgtatctgactttgctgtattcctaaccatcctctgcatggtcctcattgattacgccatcggcatcccttctccaaagttacaagtcccgtcagtgttcaagccgacgagagacgaccggggatggtttgtgaccccattgggccccaacccctggtggacagtgattgccgcgatcattcccgccttgctgtgcactatcctcatcttcatggaccagcagatcaccgcggtgatcattaaccggaaggaacataaactaaagaagggatgcggctatcatttggacttattaatggttgctgtgatgctgggagtctgtagcattatggggttgccttggtttgttgccgccacagtgctatctattacccacgtgaatagcctaaaactggaaagcgagtgtagtgctcccggggaacagcccaagtttttgggcatccgcgagcagagggtcactgggttaatgattttcatactaatgggcagcagtgtttttatgaccagtattttaaagtttataccaatgccagtgctttacggcgtgttcctgtacatgggtgcaagtagtctcaaaggaatccagttttttgatcggatcaagttgttctggatgccagcgaagcatcagcccgacttcatatacctccggcatgtgcccctgaggaaagtgcatttatttacgattatccaaatgtcatgcctgggtttgctgtggattattaaggtgagtagggctgccatcgtatttccaatgatggtgctcgctctggtgtttgtccggaaactcatggatctgttgttcaccaagagggagttgagctggttggacgacttgatgcctgagtccaagaagaaaaagctcgaagatgctgagaaggagcactag

SEQ ID NO: 206235 - DNA, 3357 bp, Artificial Sequence
  Description of Artificial Sequence: Synthetic coding sequence
atggagatcaaggaccagggcgcccagatggagcccctgctgcccacgcgtaacgatgaggaggccgttgttgatcggggcggaactcgttcaattttgaagacccactttgaaaaagaggatctagagggccacaggactttgtttattggagtccacgttcccctgggcggtaggaagagccatagaagacacagacaccggggccataaacacaggaaacgggaccgggagagagatagcggtttggaggacgggcgagaatcgcccagtttcgatacaccttcacagagggtgcagttcattctcggtaccgaggatgatgatgaagaacatatcccgcacgacctgtttacagagctggatgaaatttgttggagggaaggtgaggatgcggagtggcgagaaaccgcacggtggctgaaattcgaggaagacgtagaggatggaggggaaaggtggagcaagccttatgtggcaaccctgagtctgcattcactgttcgagctgcgctcttgtattctgaatgggacggttctgttagatatgcacgccaatacactggaggaaatcgcggacatggtccttgaccagcaggtctctagcggacagctgaacgaggatgtgagacacagggtgcacgaggcgctgatgaagcaacatcatcaccagaatcagaagaagcttacgaatcgcatcccaattgtgaggagcttcgcagacattggtaagaaacaatcagagccaaactctatggataagaacgcaggccaggttgtctcaccccaaagtgctcctgcgtgtgttgagaataaaaacgacgtcagtcgagagaattcaactgtcgatttttctaagggtcttggaggtcagcagaagggacacacgtccccttgtggcatgaaacagcggcacgagaaagggccacctcaccaacaagagcgagaggtagatttgcacttcatgaaaaaaatccctcctggagctgaagcaagtaacatcctagtgggagagctggagtttctcgataggacagtggtagcattcgtgcggttgtccccagccgtcttgctgcaaggtctggctgaggtacctatccccacaagatttctcttcatcctgctgggtcccctgggtaaaggacagcagtaccatgaaatcgggcgctctattgctacgcttatgacagacgaggtcttccacgatgtggcatacaaggcaaaggacagaaacgacctcgttagtggtatcgatgaattcctggatcaggtgactgttcttcctcctggagagtgggatccatcaatccgaatcgagccgccgaaaaacgtgccttcccaggagaaaagaaaaatcccagctgtgcctaatggaacagcagcccacggcgaggctgagcctcacggaggccatagtggccccgaattgcaacgcacagggcggatttttggtggactgatcctcgacatcaagagaaaagctccatacttttggagtgatttccgcgatgccttctcactccagtgtctggcatctttcttatttttatactgtgcctgcatgagcccagtgattacattcggaggattgctcggcgaggccacagaagggcgcattagcgctatcgagtctctgtttggggccagcatgactggcattgcctactccctatttggcgggcaaccgctgacaatcctgggctcaactggccccgtgttagtcttcgaaaagatcttgttcaagttctgcaaggagtacggactgtcctatctcagcttacgggcctcgattggtctgtggacagcaacactctgcatcatcctggtcgccacagatgccagctctctggtgtgctacataacgaggtttaccgaggaggcttttgcctctctgatctgcatcatcttcatctatgaagctctggagaagttatttgaactatctgaggcctaccctatcaatatgcacaatgatctggagctgttaacccaatacagctgcaactgtgtggaacctcataatccgtccaacggcacattaaaagaatggcgagaaagcaatattagtgcttccgatataatctgggagaatctgactgtttccgagtgcaaaagcttacatggcgaatatgtcgggcgagcttgcggccacgaccatccctatgtacctgacgtcctcttctggtccgtgattctgttcttcagcactgtgacacttagcgccacattgaaacaattcaagacgtcccggtattttccgacaaaagtacgaagcattgtcagtgacttcgcagtcttcctgaccatcctttgtatggtgctcattgactatgctattggtatcccctccccgaaactgcaagtaccatctgtgttcaagcccacacgggacgaccggggttggttcgtgacgccactcgggccaaacccatggtggacagtcatcgccgccatcataccagcccttctttgcaccatactgatcttcatggatcagcagatcacagctgtcattataaatcgaaaggaacataagctcaaaaaaggctgcgggtatcatctggatctactcatggttgctgtgatgctgggagtgtgctcaatcatggggcttccgtggttcgtagcggcaacagtcctatctattacccacgtgaacagcctgaaactcgagtccgaatgctccgctcccggggaacaacctaagtttctcgggatcagagaacagagagtaaccggcctgatgattttcattctgatgggttcctcggttttcatgactagtatattgaagttcattcccatgccagttctgtacggcgtcttcctgtacatgggagccagctccctcaaagggatccagttcttcgatagaattaagctcttctggatgcccgctaagcaccagccagactttatctatctacggcatgtgccactgaggaaagtgcacctgttcacaatcatccagatgtcctgtcttggcctcctgtggattattaaggtgagcagggcggccattgtgttccccatgatggtgctggccctcgtatttgttcggaaactcatggaccttttgttcacgaagagggaactctcctggttggatgatcttatgcccgagtcaaagaagaaaaagctagaggacgcggaaaaagaagaagagcaatccatgctcgcaatggaggatgaaggtacagtgcagctaccgcttgagggccattaccgcgacgacccgagtgttatcaacatctcagacgagatgtcaaaaaccgcgctttggaggaacctgttgatcactgcagataacagcaaagacaaagagagcagtttcccctctaagagttcaccctcatag

SEQ ID NO: 206236 - DNA, 3318 bp, Artificial Sequence
  Description of Artificial Sequence: Synthetic coding sequence
atggagatcaaggaccagggcgcccagatggagcccctgctgcccacacggaacgacgaggaagctgtggtcgacagaggaggtacccgttctattctgaaaactcacttcgagaaagaggacctcgaaggccacagaactctgttcattggtgtccacgtgccactgggtgggaggaagtcccacaggagacacaggcaccgcggtcacaagcacaggaagcgagacagagagagagactcgggactcgaggatgggagagagagtccctcttttgacactccttctcagcgcgtgcaatttattctcggaaccgaggatgacgatgaggagcatatacctcatgacttattcacagagcttgatgagatatgttggcgcgaaggggaggacgcggaatggcgagagactgcccgctggctgaaattcgaggaagacgtggaggatgggggcgaaagatggtctaagccatacgtggcgaccttatctttacactcactctttgagttaaggtcatgcatcctgaacggtaccgtcttattagatatgcacgcaaatacactggaggagatcgccgacatggtcctcgaccagcaggtctcctccggacagctgaacgaagatgtgcgacaccgtgtacacgaagccctcatgaagcagcaccatcatcagaatcagaaaaaactgaccaacagaattcccattgtgcgatcgtttgcagacattgggaaaaagcagtccgaaccaaacagcatggataagaatggccaggtggtgtcccctcaaagcgctcctgcatgtgtggagaataaaaacgatgtctccagagagaatagtactgtcgacttttctaaggttgatttacattttatgaagaagataccgcccggagcggaagcaagcaacatactggtgggagaactagaattcctcgaccgtacggtcgtggcgttcgtgagattgagcccggcggttctgttgcaaggactggcggaagttcccatacccacccgctttttgttcattctgcttggtccactaggcaaaggccaacagtaccacgaaatcggccgaagcattgctaccctcatgacagacgaagtgtttcacgacgtggcctacaaggcaaaagatagaaatgacctagtgtctgggatcgacgaattcctcgaccaggtgacagtgcttccgcctggggagtgggacccctccatccggatcgagccccctaaaaatgtgcccagccaggagaaacggaagattccagctgttcccaacgggaccgccgctcatggggaggcagaacctcacggcgggcactctggccccgagttgcagagaactggcagaatttttggagggctgatcctcgatatcaagcgtaaagcaccctatttctggtcagatttcagggacgcgttctctttgcagtgcctcgctagttttctgttcctgtactgtgcctgcatgagccccgtgatcacgtttggaggcctgctaggcgaggccacagagggccgaatcagcgcgatcgaatcgcttttcggtgcaagcatgacgggcatcgcgtacagtctgtttggagggcaaccgttgactatcctcgggagtacaggaccagtgttggttttcgagaaaatcctgtttaagttctgcaaggaatacgggctatcttacctctcactcagggcttccattgggctgtggacagccacactctgcatcattctggtcgccacagatgcatcatctctcgtgtgttatatcaccagatttacggaagaagcatttgcatcgcttatttgcatcatcttcatatacgaggcccttgagaaactgtttgaacttagtgaggcttatcccattaatatgcataacgatcttgagctactgacccagtattcgtgcaattgtgtggagccacacaatccatctaacgggactcttaaagagtggagagaatcaaatattagtgcttctgatataatctgggagaacctgactgtttcagagtgtaaatcactgcacggcgaatacgtgggccgcgcctgcgggcatgatcacccctatgtccctgacgtcctgttttggtccgtaatacttttcttctctaccgtcaccctgtcggcaaccctgaagcagtttaagactagcagatacttccctactaaagtacgcagcattgtaagtgattttgcagtgtttttaaccatcttgtgtatggtgttgattgactacgcgatcggaatccccagcccaaagctgcaagtgccgtccgtcttcaagccgacaagagatgaccgcggctggtttgtgacgccgcttgggcctaacccatggtggacggtgatcgcagctatcatacccgctctcctttgcactatccttatctttatggaccagcagatcaccgcggtcattatcaataggaaagaacataagttgaaaaagggttgtggctatcacttagatcttcttatggtggccgtgatgctgggagtctgcagcattatgggattaccttggttcgtcgccgctaccgtcttgagcataacccatgtgaactcgttgaagctggaatctgagtgcagcgcaccaggcgaacaacctaagtttctgggaattcgagagcagcgcgtgacaggtttaatgattttcatactgatgggtagcagtgtattcatgacatcgattctgaagtttatccccatgcccgtcctctatggcgttttcttgtacatgggggcgagctccctgaagggaatacagttttttgatcgaattaaacttttttggatgccggcgaagcatcagcccgacttcatttacctgcgacatgtgcccctgcgcaaggtgcacctcttcacaatcattcagatgagttgtttgggcctgttgtggataataaaagttagtagagcagccatcgtcttcccaatgatggtgctagccctggtctttgtcaggaaacttatggacttactgttcaccaaaagggagctatcatggttggacgacctcatgcctgaaagcaaaaaaaaaaaactcgaggacgctgagaaagaagaggagcaatctatgttagctatggaagatgaggggaccgtccaattgccattggaaggacactaccgagacgatccgagcgtgataaatatatcggacgagatgagcaaaaccgctctttggagaaacctcctcataacagcagataattcgaaagacaaggagtcttcctttccttcaaaatcaattgagtcgcgtaaggaaaaaaaagccgactcggggaagggcgtggatcgagagacctgtttatag

SEQ ID NO: 206237 - DNA, 1227 bp, Artificial Sequence
  Description of Artificial Sequence: Synthetic coding sequence
atggagatcaaggaccagggcgcccagatggagcccctgctgcccaccagaaacgatgaagaggcagttgttgaccgcggaggaacgcgatcgatactgaagacccactttgagaaggaggacctcgagggtcacagaacactgttcattggagtgcatgtccctctgggcggccgaaagtcacatcggaggcacaggcaccgcggtcataaacacagaaagagggaccgcgagagggactccggtctcgaggatggccgtgagagcccttctttcgacaccccttcccagcgggtgcagttcattcttggcacagaggatgatgacgaggagcacataccacatgatctctttacggagctggatgagatctgctggagggagggtgaggatgcagaatggcgagaaaccgctaggtggttaaaatttgaagaggacgtcgaagatggaggcgaacgatggtccaaaccttacgtggcaactctgtctctgcattccctttttgaactccgatcatgtatcctcaacggcacagttcttctggacatgcatgctaacacattagaggagattgccgatatggtcctggaccaacaggtgtcctccggacaactcaacgaagacgtcagacaccgagtgcacgaagctctgatgaagcagcatcaccaccagaatcagaaaaagctgacgaataggataccaatcgtgagaagctttgccgatattgggaagaagcagagtgagccaaactccatggacaaaaacgccggccaggttgtgtctccccagtcggctccggcatgcgtggagaataaaaatgacgtatcaagagagaatagcacagtcgatttctctaaggggcttggcggccaacagaagggccacacaagcccctgtggaatgaaacagcgtcatgagaaaggtccccctcaccagcaggagcgggaggtggacctgcactttatgaagaaaatccctcccggtgcggaggcttctaacatccttgtgggggaattggagttccttgaccgaaccgtggtcgctttcgtccggctcagccctgcagtgctcttacaagggctggctgaagttccaatcccaacaaggtactttatgatgctgcccattaagctgaagattgtcatgacctggtatcaggagctgatgagtttctggatccggctgttgttcagccttctcgaaaacggtatccaggcattcgaatag

SEQ ID NO: 206238 - DNA, 2676 bp, Artificial Sequence
  Description of Artificial Sequence: Synthetic coding sequence
atgagccaggtgggcggccggggcgaccggtgcacccaggaggtgcaaggactggtgcacggagctggcgatcttagtgcttcccttgccgagaatagccccaccatgtcccagaacggttacttcgaagactcaagctactacaaatgcgacaccgatgataccttcgaggccagagaagaaattctgggggacgaggccttcgacacagcgaactcctccattgtaagcggggagagtatacggttcttcgttaatgttaacctggaaatgcaggcaacaaatacagagaacgaagctacgagcggtgggtgtgtgcttctgcacaccagccgcaaatacctgaagctcaagaatttcaaagaggagattagagcgcaccgggatctggatggcttccttgctcaagcatccatcgtgctaaacgaaaccgccacctctctggacaacgttttgagaacaatgctcagacgctttgccagggaccccgacaacaatgagccaaattgtaatctagatttactgatggcaatgttgttcaccgatgcaggggcccctatgcgggggaaagttcaccttctgtctgacaccatccagggggtgaccgccaccgtgactggcgtgcgctatcagcagtcctggctgtgcatcatctgcacaatgaaggccctacagaagcggcatgtctgcatctcgcgactggtgcggcctcagaattggggcgaaaattcatgtgaggttagatttgtcattctggtgttggccccccctaaaatgaagtccacaaagaccgccatggaagtggcacgaacgtttgccacgatgttctcagatattgcgttcagacagaaactccttgagacccggactgaggaagagtttaaggaggccctggtccaccaacggcagctccttaccatggtgagccatggaccagtggccccccgcactaaggagcgttctacagtgtcactccccgctcatcgccaccctgaaccccccaagtgcaaggacttcgttccattcggcaaaggcatacgtgaggacatcgcacggcgtttccctctgtaccctcttgacttcactgacggtatcattggtaaaaacaaagctgtgggcaagtatataaccactactcttttcctgtactttgcctgtctacttcctacaatagccttcggatcactgaatgacgaaaacacggatggagccatcgatgttcaaaagacaattgcaggacagagcatcggcgggctgttgtatgccctgttctcgggacaaccccttgtgattttgctgactaccgctcccctcgcactgtatatccaggtgattcgcgtaatctgcgatgactatgacttggattttaatagcttctatgcttggacaggattatggaacagtttcttccttgccctgtacgccttttttaacctgagtctcgtgatgtccttgttcaaaaggagcaccgaagagataattgccctcttcatcagcataactttcgtcctcgacgctgtcaaaggcactgtgaaaattttttggaaatattactatggacactatctggacgattaccataccaaacgcacaagctcgcttgtgtctctgtctggccttggggccagcttaaacgcctccctgcacactgccctgaacgcttccttcctcgcctcccctaccgagttgccttctgcaacacattcaggtcaggctactgctgtcttgtctctgcttattatgctgggcaccctctggctgggatatacgctgtaccagttcaagaaaagcccatacctccacccttgcgtcagggagattttgtccgactgcgcgttgcctatagccgtactcgcattcagcctcatttcatcacacggctttagggagatcgaaatgtctaagttccggtataacccttcagagtcgccctttgcaatggcgcagattcagtctctgtcccttcgagccgtgtctggggcaatgggactcggtttcctgttgtctatgctcttcttcattgagcaaaatctcgtggccgcgctcgtgaacgctcctgagaaccggctcgtgaaggggactgcctaccactgggatcttcttcttctggctatcatcaatacagggctgtctctgtttggattaccttggatccacgcagcttatccgcattccccgttgcacgtgagggccctagctctggtcgaagagagggtggagaacggacacatctacgataccatcgtgaacgtcaaagaaacacggctgactagtctcggagcttccgttctcgtggggctgagtctgttactgttaccggtccccctccagtggatccctaaacccgtcctttacggtctgtttctttacatcgccctcaccagcctggacggaaatcagctagtgcagagggtggcccttttactcaaagagcagacagcgtacccccctactcattacatacggagggtaccacagagaaagatccactacttcaccggccttcaggtgctccagctccttctgttgtgcgcctttgggatgtcttcgcttccctatatgaaaatgattttcccgctcatcatgattgctatgatccctatacgatatattctgctccctcggatcatagaggcaaagtatctcgacgtcatggacgccgagcacagaccatag

SEQ ID NO: 206239 - DNA, 2757 bp, Artificial Sequence
  Description of Artificial Sequence: Synthetic coding sequence
atgggcgtgtacggcccccaggaccggagcgagagcgagaagcgggacgtgcaacgtgatcctcccccctggcatcccagacgggaaggcgaacggcctgctagggctagatccctgcctctggccgctgctgggcaggggtttctgcgcaagacatggatttctgagcacgaaaactcacccaccatgtcccagaacggatatttcgaagattcatcctattacaagtgcgatacggatgacacgtttgaagcgagagaggaaattctgggggacgaagcctttgatactgcaaacagctctatcgtgagcggagagtcaatcaggtttttcgtaaacgtaaacctggagatgcaagctaccaatactgagaatgaggcaactagtggcggctgtgttctgctccatacgagcaggaaatatctcaagctcaagaatttcaaggaggagattagagcgcatcgcgatcttgacggcttcctcgcccaggcatccattgtcctgaacgagaccgccaccagtctcgacaatgtgttaagaactatgctgagacgattcgctcgtgaccccgataacaacgaacctaattgcaatctcgacttgctgatggccatgctgtttactgatgccggcgccccaatgcggggcaaggtccatctcttatctgacaccatccaaggggtaacggcgacagtgacaggagttaggtaccagcaaagttggttgtgtattatttgcaccatgaaggctctgcagaagaggcacgtttgtattagtagactcgtgcgacctcagaattggggcgaaaacagttgtgaggtacggttcgtcattttggtgctggcccccccaaagatgaagtccaccaaaactgccatggaggtggctcgaacctttgcaactatgttctccgatatcgccttccgccagaaactgctagaaactcgcacagaagaagaattcaaggaagccttagtgcaccagcgacagttactcacgatggtcagccatggcccggtagcgcctcgtaccaaagagagatctaccgtctccctcccagcgcaccggcatccggaaccaccgaagtgtaaagacttcgttccatttgggaagggaatccgggaggacattgctagacgattccctctctaccccctggactttacggacggtattatcggcaagaataaggctgttggcaaatacatcacaacgacgctattcctgtactttgcttgcctgctgcctactatcgcctttggcagcttgaatgatgagaacacggacggagccatcgatgtgcagaagacaatcgccggacaatcaatcggcggcttgctctatgccttgttctccggccagccattggtgatactgctcacaaccgccccactggccctgtatatacaggttatccgcgtgatctgtgatgactacgacctcgactttaacagtttttatgcctggactggcctgtggaacagcttcttcctggctctgtacgcttttttcaatctgtctttggtaatgtctctgtttaaacgcagtactgaagaaatcattgctctgtttatcagtatcacgtttgtgctggatgctgtcaagggaacggtgaaaattttctggaaatattactatggacactatctggacgactaccatacaaagagaacatccagcctggtatcactgtcaggcctgggcgcttctcttaatgctagtctgcataccgccctgaacgcctcttttctcgcgtcacctactgagctgccctccgccactcattcagggcaggccaccgcggttttgagtctgctcatcatgttggggaccctgtggctgggttacaccttgtatcagtttaaaaagtccccttacttgcatccttgcgtccgcgagatcttgtctgattgcgccctacccatcgctgtgctagccttcagccttattagctctcatggattccgggagattgagatgtcgaagttccgatataaccccagcgaaagccctttcgctatggcacagattcagtccctctcgttgcgggcggtctccggcgcaatgggcctgggctttcttctgagtatgctgttctttatcgaacagaacctggttgccgccctggttaatgctcccgaaaatcgtctggtgaaggggactgcatatcattgggatctactgttactcgctatcataaatacgggacttagcctcttcggactaccttggattcacgctgcataccctcatagcccgctgcatgtcagagccctggctctggttgaagagcgtgtggaaaacgggcatatttacgatacaattgtgaatgtaaaagaaacccgcttgacttctctcggggccagtgttctggtgggactctctctattgctgctgcctgtgccgttgcagtggattccaaagccagtcctgtatggcttgtttctatatattgcactgacctctctggacggtaaccaattggtgcagcgggtcgccttgctgcttaaagagcagacagcctacccccctactcactacatccgtcgggttccccagcgtaagattcattatttcacaggattgcaagtactgcagctcttgttgttgtgcgcctttggcatgtcgtctcttccatacatgaagatgatctttccacttattatgatcgccatgattcccatcaggtacatcctgctccccagaatcattgaggcaaagtacctggatgttatggatgcagaacatcgtccgtag

SEQ ID NO: 206240 - DNA, 951 bp, Artificial Sequence
  Description of Artificial Sequence: Synthetic coding sequence
atggccgccgccacccggcgggtgttccacctgcagccctgcgagaacagcccaaccatgtctcagaatggttattttgaggactcatcatattataaatgtgatacagatgacacattcgaagctcgtgaagagatccttggtgacgaggcctttgataccgctaactcaagcatcgtcagcggtgaatcgatccgcttcttcgttaacgtgaatctggagatgcaggcgactaacaccgaaaacgaggcaacttcaggcggttgcgtcctcttgcacacatcgagaaagtacctgaagctgaaaaactttaaggaggaaattcgcgcgcatcgggaccttgacggattcctggcacaggctagtatagtgctgaacgagactgccacttcccttgataacgtgctgcggaccatgctgcggagatttgctcgggatcctgataacaatgaacccaattgcaacttggatctgctcatggcaatgctgttcaccgacgccggcgcaccgatgagaggaaaggtgcacctgctcagcgatacaatccagggcgtaacagctacagtcactggcgtgagatatcagcagagctggctgtgcatcatctgcaccatgaaagcccttcagaagcgacatgtttgcatctcaaggctagtccggcctcagaactggggtgagaattcctgcgaagtccgctttgttattctggtgctggcacctccaaaaatgaaaagcacgaagactgccatggaagtggcacggacttttgcaaccatgttttcagacatcgcattccgccagaaattattagagacgcgcacagaagaagaattcaaagaggccctcgtgcaccaacgtcagctcctaacaatggtctcacacgggcctgtcgccccccgcacaaaggaacggtcaaccgtttcactccccgcccatagacacccagaatag

SEQ ID NO: 206241 - DNA, 2628 bp, Artificial Sequence
  Description of Artificial Sequence: Synthetic coding sequence
atggccgccgccacccggcgggtgttccacctgcagccctgcgagaattctcccaccatgagccagaatggctactttgaagattcctcctactataagtgcgatactgacgacacctttgaggcacgggaggaaattcttggggatgaagcatttgacactgcaaattcaagtatcgtatcaggcgagtcaatcagattcttcgtaaatgtgaacttagaaatgcaggcgaccaacaccgagaacgaagcaaccagcgggggctgtgtcctactgcacaccagcagaaagtacctgaagctgaagaattttaaagaggaaatccgggcgcaccgagatctagatggattcctggcgcaggcatcgatcgtcctgaatgagaccgctaccagtttggacaatgtgctgaggaccatgctacgtcgatttgccagagaccctgacaacaacgagcccaactgtaacctggatctgcttatggctatgctgtttacggacgccggagctccaatgcgcggcaaagtgcatcttctctccgatacaatccagggagtgaccgccacagtgactggcgttcgctaccagcagagctggctctgtatcatctgtactatgaaagccttacaaaaaaggcacgtctgcatttcccgcctggtcaggccccagaactggggcgagaactcatgtgaagtccggtttgtgattctcgtcctggctccccctaaaatgaagagcactaaaaccgccatggaagttgcccgcactttcgccacgatgttctccgatatcgcttttagacagaagctgctggaaaccagaaccgaagaagaatttaaggaggcgctcgtgcatcagcgccagctactcaccatggtctcccatggacccgtggcccccagaaccaaagagcgaagcactgtgtcgcttccagctcataggcacccggagccgccgaagtgtaaggacttcgtgccctttgggaagggaataagagaagacattgctaggcgcttcccgctctatcctctcgacttcaccgatgggatcataggaaagaacaaggcagtcggaaaatacatcacgactacgctgtttctatacttcgcctgtctgctgccaaccatcgccttcgggtcactaaacgatgagaatacggacggcgccattgatgtccagaaaacaatcgcgggacagtccataggagggctcctctatgcactcttcagtggacagcctttggttatactccttaccaccgcacccctggctctctacattcaggtgataagggttatttgcgacgactacgacctggatttcaactccttctacgcctggaccggtttgtggaattcctttttccttgctctctatgcatttttcaacctctcattggtgatgtcactctttaagaggagcaccgaggagataattgccctcttcatcagcattactttcgtcttggacgccgttaaggggacagtcaagatcttctggaagtattactatggccactacctggatgactaccacactaaaagaacttcgtccctggtgtctctatcgggattaggggcttcactcaatgcatccctccacacagctttaaacgcctcttttcttgcctcccctacggagctcccgagcgcaacacacagtgggcaggcgaccgcggtgctgtccctgctgataatgttgggtacactctggctagggtatactctgtatcaatttaagaaaagcccctatttacacccttgtgtgagggagatattatctgactgtgccctgcctatcgccgtcctggcttttagcttgatatccagtcacggctttagagaaatcgaaatgtcaaaattccggtacaacccaagtgagagccctttcgctatggctcagatacagtccctgtcactcagggctgtgagtggcgcaatggggctgggctttctcctctccatgctgttcttcattgagcagaatctggtggccgctctggtcaatgcccctgaaaatcgactagtaaaaggcaccgcctaccactgggacttgcttctgctggcaatcattaatacaggtttgtccctgtttggtttgccctggattcacgccgcctatccacacagccccttacatgtgcgtgctctcgcacttgtagaggagcgggtggagaacggccacatttacgacacaatcgtcaacgttaaggagacccggctgactagcttaggcgcctcagtgctggtgggactttctctgctcctgctgcccgtccctcttcagtggatccctaagcccgtgctgtacgggctgtttctgtatattgcactaaccagtctagacggcaatcagctggtgcagagagtggccttgctgttaaaggaacagacggcctatcccccgacccattatattcgccgcgtcccacagcgtaaaattcattactttacagggttgcaggttctgcagctgctcctactctgtgcttttggtatgagcagcctaccttatatgaaaatgatttttccattgatcatgatcgctatgattcccatccgatatattctgctgccaagaatcatcgaggccaagtatctggatgtcatggacgccgaacatcggccgtag

SEQ ID NO: 206242 - DNA, 1113 bp, Artificial Sequence
  Description of Artificial Sequence: Synthetic coding sequence
atgaccctggccagccggctgagcaccgccgccaacaccggccagatcgacgatccccaggagcaacacagggtcatttccagcaacctcgcgcttattcaggtgcaggccacagtcgttggcctgcttgccgccgtcgccgccttgcttcttggcgttgtttctcgcgaagaggtggacgtggcaaaagtcgagctgctctgtgcctcaagtgtgctcaccgccttccttgccgccttcgcacttggggtgttaatggtctgtatcgtgattggggctcgtaaactgggtgtgaatcccgacaatattgcaactcccatcgcagcgtctctgggcgatctcattacactgagcatcttagcgctggtgagcagtttcttctacaggcacaaggattctaggtacctcacccctttggtctgcctttcctttgctgctttgactcccgtttgggtacttattgctaagcagtcccccccaatcgtgaaaatcctgaagtttggctggtttccaataatactcgctatggtgattagctcatttggaggactcattcttagcaagactgtgagcaagcagcagtataagggcatggctatttttacgcctgtgatctgtggcgtgggtggaaacctggtggcaatacaaacctctaggataagtacatacctccacatgtggtcagctcccggggttctgcccttacagatgaagaagttctggcctaatccatgtagcacattctgcacaagtgagatcaactccatgtcagcccgtgtgttgctgctacttgtcgtcccaggacacctcatatttttttacataatctacctcgtggagggacaatcagtcattaacagtcaaactttcgtcgtgctgtatctcctagccggtctgatccaagttacaatcctgctttacctggcagaggtaatggtgagattgacttggcatcaagctctagaccccgacaatcattgcattccctatttgactggtctgggtgacctgctcggcacaggccttctggccttgtgtttctttacagattggctgttaaagtctaaagccgaacttggaggtatcagcgagctcgctagcggtcccccttag

SEQ ID NO: 206243 - DNA, 1542 bp, Artificial Sequence
  Description of Artificial Sequence: Synthetic coding sequence
atgagcagcaagcccgagcccaaggacgtgcaccagctgaacggcacagggccaagtgccagcccgtgttcatcagacggaccaggccgcgagcctctggccggaaccagcgagtttctgggccccgatggggccggggtggaagtcgtgatcgagagcagagctaatgccaaaggcgtgagagaggaggacgctctgctggagaacgggtcccagtctaatgaatcagacgacgtgagcactgatcggggtccggccccgcccagtccattaaaggagacaagcttttcgatcggtctgcaagttctgtttccattcctgttggccggcttcggcacagtagcagctggaatggtgctggatattgtgcagcactgggaggttttccaaaaggtgactgaggtgttcattttagtcccagctctgcttggtctgaaggggaacctcgagatgactctggccagcaggctgagcacagctgccaacataggacatatggataccccgaaggagctgtggagaatgatcactggcaacatggctctgatccaggttcaggcgactgtggtgggcttcttagcctcaatcgcagctgttgtcttcggctggatccctgatggccacttctctatcccccacgcgtttttgctctgcgccagtagtgtggccaccgccttcatcgccagccttgtcctgggtatgatcatgataggggtgataattggcagtagaaagatcggaattaacccagataacgtcgctacccctattgcggcttccctcggcgacctgattactctagcattgctgtccggcatctcttggggtttgtacctagaactgaatcattggagatatatatatcccctggtttgcgcattttttgtggcccttcttcctgtgtgggttgtactcgctcggaggagcccggctactagagaggttctctattctggatgggaacctgtgatcattgccatggccatctcatctgtcgggggactaatactcgacaaaactgtgtcagatccgaattttgctggcatggcggtctttacccctgtcattaatggagtgggcgggaatttggtggcagtgcaggcgtcaaggatctccacatttctccacatgaacggaatgccaggggaaaacagtgagcaggcccccagaaggtgccccagtccttgcactactttcttttcgcctgacgttaacagcagatcagctcgcgtgctctttttgctggtagtgcccgggcatttggtgttcctgtataccatctcctgcatgcagggcgggcacaccacgctgacactgatattcattatcttctacatgacggccgctctccttcaagtactcatcttgctgtacattgctgattggatggtgcattggatgtggggtagggggctagaccccgacaacttcagtatcccataccttacggctctgggcgatttgctcggcaccgggttgctggccctgtcatttcatgtgttgtggttgattggggatcgcgacacagacgtgggcgactag

SEQ ID NO: 206244 - DNA, 1722 bp, Artificial Sequence
  Description of Artificial Sequence: Synthetic coding sequence
atgaccaacagcaagggccggagcatcaccgacaagaccagcggcggcccatcaagcgggggggggtttgtggattggactctgagactgaacaccatccagagtgacaagtttctgaacctgcttctgtcgatggtaccagttatctaccagaagaaccaggaggacaggcacaaaaaagccaatggcatttggcaggacgggctgtccaccgcagtacagaccttcagcaatcggagtgagcagcacatggaataccattccttctctgaacaatcctttcacgctaataatggacatgccagctctagttgctcacagaaatacgatgactatgcaaactacaactattgtgatgggcgcgagacatcggagaccactgctatgctgcaggatgaggatatcagtagtgacggggatgaagacgcaatcgtggaggttactccaaagctccccaaagagtcaagtggcataatggcactgcaaatcttggtgccctttttactggcggggttcggaacggtgtccgctggtatggtgctcgatattgtgcagcattgggaagttttccggaaagtaacggaggtgtttattcttgtccctgccctcctgggtctaaagggaaatctggagatgacgttggcgtccagactgagcacggctgtgaacatcggcaagatggactcaccaatagagaagtggaacctcatcatagggaatctggccttaaaacaggtgcaggccactgtcgtggggtttttagcggctgtggccgccatcatcttgggatggattcccgaggggaagtactatctcgaccattctatccttctatgctccagtagcgttgccaccgcctttatcgcgagcctgctgcagggtattattatggtcggggtgatagtcgggtcaaagaaaacaggaatcaacccagataacgtcgcgacacccattgccgcatccttcggtgatttgatcactttagccatccttgcttggatctcacagggcctctacagctgtttggagacttactactacatatcaccactcgtgggggtgttttttctggccctaactccgatttggatcatcattgctgctaagcatcctgcgaccaggacagtcctccactcaggatgggaaccagtcattactgccatggttatctcctccattggagggttgattcttgacaccactgtgtccgaccccaacttagtggggattgtagtttataccccggtcattaacggcatcggcggaaatctggtggctatccaggccagtcgcataagtacttatctgcatctgcattccatccctggtgagttaccagacgaaccgaagggctgttattatccttttcggaccttcttcgggccaggagtgaataacaagagtgcccaggtactgctgctcctcgtaattccgggacacctcatcttcctgtacacgatccatctgatgaaatccggccacacctctcttacaatcatctttatcgtggtctatttgttcggtgctgtgctgcaggtctttaccctgctgtggatcgcagattggatggtccaccacttttggcgaaaggggaaggaccccgactccttttccatcccatatctgaccgctctgggcgatctgctgggcacagccctgttggcgttgtctttccactttctgtggcttattggagatcgggacggggacgtgggtgattag

SEQ ID NO: 206245 - DNA, 369 bp, Artificial Sequence
  Description of Artificial Sequence: Synthetic coding sequence
atgaccaacagcaagggccggagcatcaccgacaagaccagcggcgggccttcaagtgggggcggctttgtcgactggactctcagattgaacacaatccaaagcgacaagttcctcaatctcttgctttccatggtgccagtgatttatcagaaaaaccaggaggaccgccataaaaaggcaaacgggatctggcaggatgggctgagcacagctgtccagacctttagcaatcgctccgaacagcatatggaatatcacagtttcagcgagcagtcatttcacgcaaataatggacatgcaagcagttcatgttctcagaagtatgacgactatgcaaactacaactactgcgacggcagggagtag

SEQ ID NO: 206246 - DNA, 432 bp, Artificial Sequence
  Description of Artificial Sequence: Synthetic coding sequence
atgaccaacagcaagggccggagcatcaccgacaagaccagcggcggaccgagtagcggaggaggatttgtcgactggaccctcagactaaatactatccagagcgacaagtttctaaatctcctgctgagcatggttccagtgatctatcagaagaatcaggaagacaggcacaagaaggccaatggcatctggcaggatggcctcagtacagccgtccagacgttcagcaaccggtcagaacaacacatggaataccactctttcagtgagcaaagctttcatgctaacaatggccacgcaagtagctcgtgctcacagaagtacgatgattacgctaattataattactgcgatggaagagagacctctgaaaccacagctatgctgcaagacgaagatattagctccgacggagacgaggacgcttag

SEQ ID NO: 206247 - DNA, 141 bp, Artificial Sequence
  Description of Artificial Sequence: Synthetic coding sequence
atgaccaacagcaagggccggagcatcaccgacaagaccagcggcggtcccagctcaggcgggggctttgtggattggacattacggctcaacactattcagagcgataagttcttgaacttgctgctctcgatggtgtag

SEQ ID NO: 206248 - DNA, 219 bp, Artificial Sequence
  Description of Artificial Sequence: Synthetic coding sequence
atgaccaacagcaagggccggagcatcaccgacaagaccagcggcggtccatcttccggcggcggattcgtggactggacactcagactgaatacaatccagagcgacaagtttctcaatctgcttttaagtatggtgccggttatttatcagaagaatcaggaagatagacataagaaagccaatggtatttggcaggacggccttagtacagcatag

SEQ ID NO: 206249 - DNA, 39 bp, Artificial Sequence
  Description of Artificial Sequence: Synthetic coding sequence
atgaccaacagcaagggccggagcatcaccgacaagtag

SEQ ID NO: 206250 - DNA, 231 bp, Artificial Sequence
  Description of Artificial Sequence: Synthetic coding sequence
atgaccaacagcaagggccggagcatcaccgacaagaccagcggcggcccttcatcaggggggggcttcgtggactggaccctgcgcctgaatacaattcagtccgacaaatttcttaatctcctcctgtctatggtacccgttatctatcagaaaaaccaggaggataggcataagaaggccaatggcatttggcaggatggcttgagcactgcggtgcagacgttctag

SEQ ID NO: 206251 - DNA, 285 bp, Artificial Sequence
  Description of Artificial Sequence: Synthetic coding sequence
atgaccaacagcaagggccggagcatcaccgacaagaccagcggcggcccttcaagcggtggcgggttcgtagactggacactacggcttaataccatccagagcgacaaattcctgaatctactcctgtccatggtgcctgtgatttaccaaaaaaatcaggaagaccgccacaagaaagctaacggcatttggcaggacggcctttctactgcagtgcagactttctccaataggagcgaacaacacatggagtaccactcctttagcgagcagagtttctag

SEQ ID NO: 206252 - DNA, 1524 bp, Artificial Sequence
  Description of Artificial Sequence: Synthetic coding sequence
atggacggcaccgagacccggcagcggcggctggacagctgcggcaaacctggagagcttggcctgccacacccactgtccacaggcggtctgccagtcgcaagcgaggatggcgccctcagagctcccgagtctcagtcagtgacaccaaagcccctagagactgagccctctcgcgaaaccacctggtccattggcttgcaggttaccgtgcccttcatgtttgccggtttgggactgagctgggctggtatgttgctagattatttccagcactggccggtctttgtagaagtgaaggatttgcttaccctggtgccgcccttggtaggcctcaagggtaacctggagatgactttggcttcaaggctttcaaccgctgcaaatacaggacagattgatgaccctcaggagcaacaccgggtaatctcatcaaacctggcgctaatccaagtccaagccacggtggtaggtttgctggcggctgtggcagctctcctcctcggagtggtatcaagggaagaggtggacgtggcaaaggtggaactgctttgcgcttcttcagtactgactgccttcctagcagccttcgcccttggcgtgctaatggtgtgtatcgtgatcggcgctaggaagttaggggtgaaccccgacaatattgcaacgccgatcgcagcttccttgggcgacctaataaccctcagcatacttgccctcgtgtcatccttcttttatcggcacaaggactccagatacctgacaccattagtgtgcctcagtttcgcggctctcactccggtgtgggtcttaatagctaagcagagccctccgattgtgaagatcttaaaatttgggtggtttccaatcattctagcaatggttatttccagctttggaggtcttattctatctaagaccgttagcaaacagcagtacaaaggtatggccatctttacgcccgtaatttgcggcgtcggtggcaacctggtggccatccagacaagccggatttccacctatctacacatgtggtctgcacccggcgtgttacctctccagatgaaaaagttttggccaaatccgtgttccaccttttgcacctcggaaatcaattctatgagtgccagagttctgctcctgttggttgtcccaggacatcttatttttttttatattatctacttggtagaagggcagtccgttattaacagtcagactttcgtcgtcctttacttgttggccgggctgatccaggtgaccatactcctgtatctagccgaagtcatggtaaggctcacatggcaccaggcgctggatccggacaatcattgtatcccttatcttacgggcctaggagacctgctcggttcttcctctgtgggtcataccgctgcggtccctagacgatgtacagcctcaccaggctgggggctcatacagccatttatttgcacccagcatctaattgtgagcctcctgagtttctactttccgttttgcttactagctaagactagtatatag

SEQ ID NO: 206253 - DNA, 1416 bp, Artificial Sequence
  Description of Artificial Sequence: Synthetic coding sequence
atggacggcaccgagacccggcagcggcggctggacagctgcggcaaaccaggggagctgggcttgccacaccctctatccacaggcggccttcccgtggcctcggaggacggggcgctacgggcaccagaaagccagtcggtgactcctaaaccactggagaccgagccctctagagagacgacttggagcataggcttgcaggtcacagtgccattcatgtttgctgggcttggactgtcatgggcagggatgctcctggactacttccaggccaatacaggccagatagacgacccccaggaacagcaccgcgtgatcagctccaatctggcgctgatccaggttcaggccaccgtcgtgggacttctggctgctgtggctgcgcttctgctcggagtggtgagccgggaggaagtggacgtggccaaagtcgagctgctgtgtgcctctagcgtcctcaccgccttcctggctgccttcgccttgggcgtcctgatggtgtgtatcgtaatcggcgcccgaaagctcggggttaatccagataacatcgctacccctattgcagcctccctgggggatctgataaccctttccatattagcactagtgtcatcattcttctacagacacaaggattctcgctaccttactcctctggtgtgtcttagcttcgcggcactcactcctgtgtgggtgctgatcgccaagcaatctcctcccatcgtaaagattttgaaattcggctggttccctataattctggccatggttattagctcctttggtggacttattctttcgaagaccgtgagcaagcagcaatacaaaggcatggcgatcttcacacctgtgatctgcggggttgggggaaatttagtcgccatccagaccagtagaatctctacctatctgcatatgtggtccgcacctggagtcctaccactccagatgaaaaagttttggcccaatccatgtagtactttttgtaccagcgagattaattctatgtcggccagggtgttactgctccttgtggtgcctgggcacttaatcttcttttacatcatctacctggttgaggggcaatccgtcatcaactcacaaacattcgttgtgctgtacctactggcagggctgatccaggtcacgattctgctgtatctcgccgaagtcatggtgcgtctgacatggcaccaggctcttgatcccgataatcactgcattccttacctcaccggcctgggagatctgctgggtagctcctctgtcgggcacaccgccgctgtcccccggcggtgcacagccagtcctggctgggggctgatacagcccttcatctgcacgcagcacttaatcgtctccttgctctctttttacttccccttctgcctcctggctaaaacaagtatctag

SEQ ID NO: 206254 - DNA, 1464 bp, Artificial Sequence
  Description of Artificial Sequence: Synthetic coding sequence
atggacggcaccgagacccggcagcggcggctggacagctgcggcaaacccggagagcttgggctcccccatccgctgtctacaggagggctgccagtcgctagcgaagatggggcactgagggctcccgaaagccaatctgtcacgccaaaacccttggaaactgaaccgtctcgggagaccacctggagtattgggttgcaggtcaccgtgccattcatgttcgcaggactgggcctgagctgggctgggatgttacttgattactttcagcattggccagtcttcgtcgaggtcaaggatctgctcactctcgtgcctcccctggtgggcctaaaaggaaaccttgagatgacactggcatccagactgagcactgcagccaacaccggccagattgatgatccccaagagcagcatagagtgatctccagtaacctcgccctgattcaagtccaggccacggtggttggcctcttggccgccgtggcagcgttactcttgggcgtcgtaagccgggaggaagttgacgtggcaaaagtggagctgctctgcgcctcctctgtgcttactgcatttctggctgctttcgcattgggcgtattgatggtctgcatcgtcatcggcgcccgaaagctcggtgtgaatcctgacaatatcgctacgccaattgccgctagcctgggagatctgattaccctgagtatcctggccctcgtttcatccttcttctaccgacacaaggactccagatacctgacgcctctggtgtgcttgtcgtttgctgctctgacacctgtgtgggtcctgattgccaaacaaagtccgcccatagtcaaaatcctgaagtttggctggttccctatcatcctggccatggtgatctcgtcctttggcgggcttatcctttccaagaccgtctctaagcagcagtataaagggatggcaatcttcacaccagtaatatgcggcgtgggggggaatctagttgcgatccagacttcccggatatccacgtatctgcatatgtggtcagctccaggcgtgctcccgctccagatgaagaagttctggccaaatccatgctcaactttctgtactagcgagatcaattccatgagcgctagagtgttgctgctcctagtagtgcccggacacctgattttcttctacatcatctacctggtcgagggccaaagtgtgatcaacagtcaaacctttgttgtgctgtacttacttgctggactgatccaggtgaccatcctgctctacctggcggaggtgatggtgagattgacttggcatcaagccttggaccccgataatcactgcattccgtacttgaccggcctcggtgacctgctgggcactggtttgctcgccttgtgcttcttcactgactggctactcaaatctaaggcagagcttggcggtatctctgagctggctagtgggccaccctag

SEQ ID NO: 206255 - DNA, 1386 bp, Artificial Sequence
  Description of Artificial Sequence: Synthetic coding sequence
atggtggtgacccagctgaacctggagttctgcttccagggcaagaagctgagaggcttctcttgcgaacttaccaggtcacctcatggtgttctcccggagtcattcttcaccataatgtgtcaggtcgtagtgcctattttgctcagcggactgtgcatgatgaccgctggcctcgttatgaataccatccagcactggcccgtattcgtggaggtgaaagacctgctgacattggtgcctccactcgtagggctcaaaggaaacttagaaatgactctggcgagcaggttgtctaccgctgccaacactgggcagatcgatgatccacaggagcagcatcgggtgatatcaagcaatcttgccctgattcaggtccaggctactgtggtggggctgctcgccgcagtggcagcactcctgctgggggtcgtctctcgcgaggaggtggacgtggcaaaggtagaactactttgcgcttcctcagtgttgaccgcttttctagcggccttcgcgttaggggtgctgatggtatgtattgtgatcggcgcccgcaagttgggggtaaatcccgacaacattgcaacacccattgctgccagtctgggtgacctcatcactcttagcatacttgcattggtcagcagttttttctacagacacaaagactcaaggtatctgactccactggtttgcttgagtttcgctgccctgacccctgtgtgggtcttaattgcaaagcaaagtccccccatagtcaagatcctcaagtttggctggtttccaattatcttggctatggtgatctccagtttcggagggctgatcctcagcaaaaccgtctcaaagcaacaatacaagggtatggctattttcacccccgtgatttgtggcgtggggggcaaccttgttgcaatccaaacaagtcggatttcgacgtacttgcacatgtggtccgctccaggagtgcttccccttcaaatgaagaagttttggccaaacccctgctccactttttgtacaagcgagatcaatagtatgtcagcaagggtattactcctcctggtggtgccagggcacctgattttcttttatatcatttatcttgtcgagggccaatcagtgataaatagtcagacatttgtggtcctttacttgttggcagggctcatacaggtcactattttactatatctggccgaggttatggtacgtctgacgtggcaccaggctctggacccagacaaccattgcattccatatctgaccggtctcggagatcttctcggaacgggcctgctagccctatgtttttttacagattggctcctgaagtcaaaggctgaactcggggggatttcagagcttgcaagcgggccgccctag

SEQ ID NO: 206256 - DNA, 1437 bp, Artificial Sequence
  Description of Artificial Sequence: Synthetic coding sequence
atggacggcaccgagacccggcagcggcggctggacagctgcggcaagcctggcgagcttggacttccccaccccttgtctactggagggctccctgtcgcctctgaagatggagcattacgcgcacctgagagtcaatctgttacacctaaacctctggagacagagccatctcgcgtgactgtcccattcatgttcgccggcttaggcctctcctgggcgggaatgcttctagattatttccagcactggcccgtatttgtagaagtaaaggatctgttgacgctagtacccccattggtaggcctgaagggcaaccttgagatgaccctggctagccgcctttcaaccgctgccaacacagggcagatagacgacccccaggaacagcatagagtgattagcagcaaccttgcgctgatacaggttcaagccactgtggtgggtctgctggccgccgtggccgcacttttgctgggagttgtctcacgcgaagaggtggatgtggctaaggttgagctcctgtgtgcctcatctgtgctgactgcttttcttgctgcattcgctctgggagtcctcatggtgtgtattgttatcggtgcccgaaagctgggagtgaacccagacaacatcgccacgcccatcgccgcttctctcggcgacctcatcacactcagcatcctggcgctggtgtcttctttcttttaccggcacaaggactcccgatacttaacaccgctcgtgtgcctttcattcgccgcactgacaccagtttgggttttgattgccaagcagtcccctccaatcgtcaaaatcttaaaatttggctggtttccgattatcttggctatggtcatttcgtcctttggaggcttgatcttgtctaaaactgtgtccaaacagcaatataagggtatggctatattcacacccgttatttgtggagtcggggggaatcttgtcgcgatccagaccagcaggatctcaacgtacctgcacatgtggagcgccccaggtgtcttacccctgcagatgaagaaattctggccaaacccttgtagcacattttgcacctcagagatcaattctatgtctgcacgcgtcctactcctgctggtggtccctggccacctcatattcttctatatcatataccttgtcgagggtcaaagcgtgatcaactcccaaacgttcgtggtgctgtatttactggcaggactgattcaggtgacaatcctcctctatctagccgaggttatggttagactaacctggcaccaggctttggacccagataaccactgtattccttacctaaccggtctgggggacctccttgggacaggcctgttggcattgtgcttttttaccgactggttattaaagagcaaagctgagcttgggggaatctctgaactggccagcggtcctccctag

SEQ ID NO: 206257 - DNA, 459 bp, Artificial Sequence
  Description of Artificial Sequence: Synthetic coding sequence
atggacggcaccgagacccggcagcggcggctggacagctgcggcaaacccggagagctcgggttgcctcacccactgtccaccggtgggctgcctgtggccagcgaagacggagcactccgagcgcccgaaagccagtcagtcacacccaagcccctggagactgagccttcccgggagactacatggagcataggtctgcaagtgaccgtaccctttatgtttgctggcctgggactgagttgggctggcatgctcttggactattttcaacattggccagtgttcgtcgaagttaaggacttgctcacactggtgccacctctggtggggctgaagggaaacctggagatgactctggctagcagattatccaccgctgcaaacaccggacaaatcgatgatcctcaggaacagcatcgcgtgatcagctccaatctggcactgatccaagtctag

SEQ ID NO: 206258 - DNA, 459 bp, Artificial Sequence
  Description of Artificial Sequence: Synthetic coding sequence
atggacggcaccgagacccggcagcggcggctggacagctgcggcaagccgggcgagttgggactcccgcaccctctgagtaccggaggtctgcccgttgcatctgaggacggcgcattgcgggcccccgagtcacagtcggttacaccaaagcccctggaaacagagccaagtagggagaccacatggtctatcggccttcaagtgaccgtaccttttatgttcgcagggcttggccttagctgggctggaatgctgctggactattttcagcactggccagtcttcgtggaagtgaaggatctcctcacattggtgccacccctagtgggccttaagggaaacctcgagatgaccctggcaagcaggcttagtaccgcggccaacactgggcagatcgacgatccccaggagcaacacagagtaatatcatctaatcttgctcttatacaggtgtag

SEQ ID NO: 206259 - DNA, 261 bp, Artificial Sequence
  Description of Artificial Sequence: Synthetic coding sequence
atggacggcaccgagacccggcagcggcggctggacagctgcggcaaacctggtgaacttgggctgcctcaccccttgagcacaggagggttaccagtcgcaagcgaagacggggccctccgcgcccctgagagtcaaagcgtgaccccaaagcccctagagacagagccctctagagagactacttggtcaatcggtctgcaggtgaccgtaccattcatgtttgccggattgggccttagttgggccggaatgctgtag

SEQ ID NO: 206260 - DNA, 606 bp, Artificial Sequence
  Description of Artificial Sequence: Synthetic coding sequence
atggacggcaccgagacccggcagcggcggctggacagctgcggcaaacccggcgaattgggcctgccacaccctctaagcaccggaggtctgcccgtcgcaagcgaggatggagcacttcgcgcccccgagagtcagtctgtgacacccaaacccttagaaaccgagccttctagagagacaacatggtctatcgggcttcaggtgacagtccccttcatgtttgctggactgggcctttcttgggcgggaatgttgttggattacttccaacactggccagtgtttgtggaggtgaaagacctcctcaccctggtccctcccctggtcggattaaaaggaaacttggagatgacactggcaagtcggctgtcaactgccgccaacacgggccaaatcgacgatccgcaggagcaacaccgggttatctcctcgaacctggcgctgatacaagttcaagctaccgtcgtgggtttgctcgccgccgtagcagccctgctgctgggggtcgtgagccgggaggaggtagacgtggcaaaagtggagctgttgtgcgcaagcagcgttctgacggcttttctggctgccttcgcgctgggtgagtag

SEQ ID NO: 206261 - DNA, 414 bp, Artificial Sequence
  Description of Artificial Sequence: Synthetic coding sequence
atggacggcaccgagacccggcagcggcggctggacagctgcggcaagcctggtgagttaggattacctcacccattaagcacgggcggcctacctgttgcctctgaagatggcgccctgagggcccctgagtcgcagtctgtaactcccaagcctctggaaaccgagccatctagagaaactacttggtctatagggctccaagtgacagtaccctttatgttcgcagggctaggtctgtcttgggccggcatgcttttagactactttcaggcgaatacaggtcagattgatgatccgcaagagcaacacagagtgatttcttcgaatctcgctctgatacaggtgcaggccacagttgtgggcctccttgccgcagtagccgcactgctcttgggcgtcgtgagtcggtag

SEQ ID NO: 206262 - DNA, 459 bp, Artificial Sequence
  Description of Artificial Sequence: Synthetic coding sequence
atggacggcaccgagacccggcagcggcggctggacagctgcggcaagccaggagagctgggcctaccccaccccctatcaacaggtggtctcccagttgcgtcggaggacggggcgcttcgagcccccgaaagccaaagcgtgactcctaagcccctcgaaactgaacccagtagagagactacttggtcaatcgggctgcaggtgaccgtgcctttcatgttcgctggcctgggcctgagttgggcagggatgttgctcgattactttcaacactggccggttttcgtggaggtgaaggacctactgaccttagtcccgcctctagtcggccttaaaggaaaccttgaaatgactcttgccagtcgactcagcacggccgctaataccggccagattgacgacccacaggagcagcatcgagtgattagttccaatcttgcgctgatccaggtgtag

SEQ ID NO: 206263 - DNA, 1680 bp, Artificial Sequence
  Description of Artificial Sequence: Synthetic coding sequence
atggcccccaccctgcagcaggcctaccggcggcggtggtggatggcgtgcacagctgtgcttgaaaatcttttcttctcagccgtgctcctgggctgggggagccttctgattatcctgaagaacgagggcttctactcctcgacatgtcccgccgaatctagcaccaatactactcaggatgagcagcgaaggtggccaggttgtgaccagcaagatgaaatgctgaatctcggctttactatcggaagctttgtccttagcgcgacaacgctgcctcttggaatcctgatggaccgattcggcccccggccagttcgtctggtgggctccgcgtgctttaccgcctcttgtaccctcatggccttggcttctagggacgtggaggcactgagtccactcatatttctggcactgtctctgaatggcttcggtggtatatgcctgaccttcactagcctgacgttacccaacatgtttgggaatctacgcagcacattgatggcactgatgatcggtagctatgctagctcagctataaccttcccggggattaagctcatatacgacgccggagttgcattcgttgtcatcatgttcacatggtccggattggcctgtttgatttttctgaactgtactctgaactggcctattgaggcttttcctgcaccagaagaggtcaattacacaaagaaaatcaagttgagcggcctggcactggaccataaagtaaccggggatttgttttacactcacgtgacgaccatgggtcagagactatctcagaaagcaccaagtcttgaggatgggagcgatgccttcatgagtccccaggacgttagagggacgtctgaaaacctgccagagcgctccgtgcctctgcgaaaaagcttgtgttcaccaacctttctgtggtctctgctgacaatgggcatgacccagctacggattatcttttatatggctgccgtgaataaaatgctggagtatttggttactgggggccaggaacatgagactaacgagcagcagcagaaagtggccgagaccgttggtttttacagcagcgtcttcggggccatgcagctgctgtgtctattaacgtgccctctcatcggctatattatggattggcggatcaaagactgtgttgacgctcctactcaaggcaccgtgctgggggatgcacgggacggcgtggctactaagagtattagacctcgatactgcaaaatccaaaagctgaccaatgctatctcggcattcacactgaccaaccttctcttagtcggctttgggatcacatgcctcatcaacaacctgcatctgcagtttgtcactttcgtgttgcacacaatagtgagaggcttttttcattccgcgtgcggcagcctctacgcagctgttttcccttctaaccattttggtacacttaccggcttacaaagcctaatatcagctgttttcgccctgctgcaacagccactttttatggctatggtgggcccgctgaagggcgagcctttttgggtcaatctgggactgctgctcttctcgttgctgggctttttgttgccttcctacctgttttattaccgtgcacggttgcaacaagaatatgctgcaaatggtatgggacctctcaaggttctgtctggctcagaggtgacagcctag

SEQ ID NO: 206264 - DNA, 1680 bp, Artificial Sequence
  Description of Artificial Sequence: Synthetic coding sequence
atggcccccaccctgcagcaggcctaccggcggcggtggtggatggcctgcactgccgtcctggaaaacctctttttctccgcggtgctcctcggttggggtagcctgctgatcatactgaagaatgaggggttttattcatctacctgtcccgctgagagctccactaataccacacaagacgaacagcggcggtggccaggttgcgaccagcaggacgaaatgttaaatcttggctttaccattggaagtttcgttttgagtgccaccacccttccactggggatcctgatggaccggtttggcccacggcccgttaggctggtggggtctgcatgttttacggcctcttgcacccttatggcgctggctagccgggacgtcgaggctctgtcccccctcattttccttgccttgtccctcaatggattcggcggcatctgtttgacatttacctccctcaccctccccaatatgtttggcaacttgcgctctactctaatggctttaatgatcggtagttacgcatcctcagccattacatttcccggcatcaaacttatctacgatgcaggggtcgcattcgtcgttatcatgtttacctggagcgggctcgcgtgtctgatcttcctgaactgtaccctcaattggccgatcgaggccttccctgcccctgaagaagtgaattacacaaagaaaattaagctttctggactcgcattggatcacaaggtgaccggggacctcttctacacacacgtgacaaccatggggcagcggctgagccaaaaagcgccttcgcttgaagatgggtcagacgcctttatgtcaccacaagacgtacgagggacatccgaaaatctgcccgaacgctccgtgccgctgagaaagagcctgtgttcgcctacctttctttggtcactgttaacaatgggcatgacccaactgagaattatcttttacatggcggctgtgaataagatgttagaatatttagtgaccggcggacaggagcatgagactaacgagcaacaacagaaagttgcggagaccgtgggattctactcctccgtgtttggtgcgatgcagctgctgtgcctgcttacctgtcctctgatcggttatattatggactggcgcatcaaggactgtgtagatgccccgacacagggcactgtcctgggtgacgcacgcgatggggtggctacaaagtcaatacggcctaggtactgtaagatccaaaaactcacgaatgcaatctctgcatttacactgacaaacctgctgttagtgggcttcgggataacatgcctcatcaataatttgcatctccaattcgtgacattcgtcctacacaccattgttaggggattcttccactccgcatgcggatccttgtatgctgccgtgtttcccagcaaccacttcggtacactgaccggactccagtcactgatatcagcggttttcgccctcttacaacagcccctgtttatggcaatggtcggccccttgaaaggtgagcctttctgggtcaacctggggctcctgctgttctcactgctgggctttctgctcccaagttacctcttttactatagggccaggctccagcaggaatacgcagcaaacgggatggggccccttaaggtactgtccggcagtgaggtgactgcttag

SEQ ID NO: 206265 - DNA, 333 bp, Artificial Sequence
  Description of Artificial Sequence: Synthetic coding sequence
atggcccccaccctgcagcaggcctaccggcggcggtggtggatggcctgcacggcagtgttagaaaacctgtttttcagtgctgtgctcttgggatggggttctctcctgataatcctgaaaaatgagggtttttacagtagtacttgcccagctgaatcatcaactaacactacgcaagacgagcagaggaggtggccaggctgtgatcaacaggacgaaatgctgaacctgggtttcacgattggcagcttcgttctttccgcgacaactctgccactaggcattctgatggaccgttttggccctcggcccgttcgcctggttggctag

SEQ ID NO: 206266 - DNA, 1710 bp, Artificial Sequence
  Description of Artificial Sequence: Synthetic coding sequence
atggcccccaccctggccaccgcccaccggcggcggtggtggatggcttgtaccgctgtgctggagaacttattgttctctgccgttttactagggtggggctctttgttgattatgctgaaatcagagggattttactcttatctgtgtacggaacctgaaaacgtgacaaatggaacggtcggcggcactgcagaaccaggccacgaggaggtgtcatggatgaacgggtggctgtcctgtcaggcacaagatgagatgctcaacctggcgttcaccgtcggctcattcctcctatcagccatcactctgccactggggattgttatggacaagtatggcccccgaaagctgcgtctcttgggatccgcttgttttgcagtatcatgcctcctgattgcatatggcgcttcaaaacccaatgccttgtcagtactgatttttatcgctctggcactgaatggcttcggtggaatgtgtatgaccttcaccagcttgacgcttccaaatatgtttggagacttgcgcagtacattcattgctctgatgatcggctcatacgctagcagcgcggttacgtttcctggaatcaagctaatctacgacgccggggtgtcctttatcgtcgtgttggtggtatgggcaggctgcagtggtctggtttttttgaactgcttcttcaactggccacttgaacctttcccagggccagaggacatggactatagcgtcaaaataaaatttagctggttgggatttgatcacaagatcacaggaaaacagttttacaaacaggtaaccactgtcggtaggaggctgtccgttggaagttcaatgagatccgccaaggagcaggtcgctctgcaggaggggcataaactatgcttgtccacggttgatcttgaggtgaagtgccagcctgacgctgctgtggccccatccttcatgcatagcgtgttttcacccattctgctgttgtctctcgtcacaatgtgcgtaacccagctaaggctgatattctatatgggagctatgaataatatcctgaagttcctcgtgtcgggtgaccagaaaacagtcggcctatacacatcaattttcggggtcctccagttattatgcctattaaccgccccagtgatcggatacatcatggattggagacttaaggagtgtgaggatgcgtccgaggaaccagaagaaaaggatgccaaccaaggagagaagaagaagaaaaagagggatagacagatccagaagatcacaaacgccatgagggcttttgccttcacaaacctgttgttggtgggttttggggtgacctgcctgatccctaaccttccactacagatactttcctttattctccacaccatcgtacgaggctttatccactccgcggtaggtggcctgtatgctgcagtttatccttcgacccagttcggcagtctgacaggtttgcaatctctgatttctgccctcttcgccttgttgcaacagcccctgtttttagcgatgatgggcccactccagggagacccgctgtgggtgaacgttggtctccttctacttagccttctcggcttttgtctgcctctgtaccttatatgttacagacgtcagcttgaacgccagctccagcagcggcaagaagatgataaattgttcctgaagataaacggaagctctaatcaggaggctttcgtctag

SEQ ID NO: 206267 - DNA, 1722 bp, Artificial Sequence
  Description of Artificial Sequence: Synthetic coding sequence
atggcccccaccctggccaccgcccaccggcggcggtggtggatggcctgtaccgcggtcctcgaaaaccttctgttcagtgccgtgcttctgggttggggatcactgcttatcatgctgaagtctgaaggattttacagctatctgtgcaccgagccagaaaacgtcacaaatggcaccgtcggtggaactgccgagccaggtcacgaagaagtgtcatggatgaacggctggttgtcctgtcaggcccaggacgagatgttgaatcttgccttcactgtgggctcgtttctcctgagcgccataacactcccgctcggaatagtgatggacaagtacggtccacggaagttgaggttgctgggttccgcatgcttcgcggtttcctgcctcctgatagcttacggagctagcaagcccaatgccctcagcgtgctcatcttcatcgccctggctctgaatggtttcggtggcatgtgtatgaccttcactagtctgacgttgccaaatatgtttggcgatctaaggtccacctttatcgccctgatgataggttcgtacgcgagcagcgctgttactttccccgggatcaaattgatatacgatgccggggtgagttttatcgtggtgttggtcgtttgggccggatgttctggactcgtgttccttaactgcttctttaactggccactcgagccctttcccggtcctgaagatatggattactccgtgaagattaagttcagctggttggggttcgatcacaaaatcaccggcaaacagttttataagcaggtgaccacggtgggccgtcgtctgagcgttggcagcagtatgaggtccgctaaagagcaggtggcacttcaggagggccataaactgtgcttgtctaccgtagacctcgaggttaagtgccagcctgacgcagccgtcgcgccaagttttatgcattccgttttctcccccatcctgctcctgagcttggtgacgatgtgcgtcacacaactgagactgatcttctatatgggggccatgaataacatcctcaagtttcttgtatccggcgaccagaaaactgcctcaagcactgtaggtctgtacacatctatcttcggggttctgcagctgctatgcctgctgacagcaccggtgatcggatacatcatggattggagactgaaagaatgtgaggacgcatctgaagagcctgaggaaaaggatgccaatcagggagagaaaaagaaaaaaaagcgtgatcgccagatccagaaaataactaatgcgatgagagcattcgcatttactaatttgctgttggtgggatttggcgtgacatgcctcattccaaacttgcccctgcagatcctgagttttattcttcatactattgtgagaggctttatccactcagccgtgggcgggctgtacgctgcagtgtatccatccacccagtttggttcactgaccggtctccagtcactgataagcgctctttttgccctgctccagcagcccctgttcctcgcaatgatgggacccctgcagggagacccactttgggttaacgtgggccttctgcttttgtccctgctgggcttttgtttgccactttacctgatctgctacaggcgccagctcgagagacaattgcaacaaaggcaggaggatgacaaactgtttcttaagataaacgggagtagcaatcaggaggccttcgtgtag

SEQ ID NO: 206268 - DNA, 1299 bp, Artificial Sequence
  Description of Artificial Sequence: Synthetic coding sequence
atgacctacggcagcccccaggccaacgccagccccagcgacgccgtcgccctcgatcatggcgaagtgtctcgccgccaacaacaggaactgcccaatatgtttggcgaccttcgtagcactttcattgcgctcatgatcggatcatatgcctcttccgccgtgaccttcccagggattaagctgatatacgacgcaggagtatcatttatagtggtgcttgttgtctgggccggctgctccggcctcgtgttcctgaattgtttcttcaactggcctctggagccctttcccgggccggaagacatggactattctgtgaagataaagttctcgtggttaggatttgaccacaagattactggcaagcagttctataaacaggtcacgacggtcggacggaggctaagtgtgggcagcagcatgcgtagcgccaaggagcaagtcgccctacaagagggacataagctgtgcctctccactgtggatctggaggttaagtgtcagccagatgccgcggtcgcgccaagttttatgcacagtgtcttcagccctatcctgctgctcagtcttgtgacaatgtgcgtgactcaactgagactgatcttttacatgggcgccatgaataacatccttaagttcctcgtgtcgggcgatcaaaagactgtggggctgtacacttctatctttggcgtactccagctactctgccttctcaccgctcccgtcatcggctacatcatggattggagactcaaggagtgcgaagatgcgtctgaagagcccgaggagaaggacgcaaaccagggggaaaagaagaaaaagaaaagagatcgacagatccagaagatcaccaatgcaatgagggccttcgcgttcaccaatctactgctggtcgggtttggagttacctgcctgatccccaatctccccttgcaaatcctgagcttcatcctgcacaccatagtgagggggttcattcacagcgcagttggtggattatacgccgcggtttatccttcaacccagtttggttcccttactgggctccaaagcctgattagcgcactgttcgctctgctgcaacagccgttattcctggcgatgatgggaccccttcagggtgatccgctgtgggttaatgttggcctgcttttgttgtctctgcttggcttctgcctccccctgtacctgatctgttaccgccgacagctggagcgacagctccagcagagacaggaggacgacaagcttttccttaagatcaatggcagctcaaatcaagaggcctttgtctag

SEQ ID NO: 206269 - DNA, 1341 bp, Artificial Sequence
  Description of Artificial Sequence: Synthetic coding sequence
atgaccagcaaggagatcatcctgggcctgtgcctgctgagcctggttctgagcatgatattgatggttattatccgatatataagcagagtcctcgtatggattctaacgattcttgtaattctcggaagtcttgggggtacaggtgtcctgtggtggttatacgccaagcagcgcagaagtcctaaagagaccgtcacgccagaacaactgcaaattgctgaggacaacctgcgcgctctgttgatctacgcaattagcgcaacagtttttactgtgatcctgttcctgataatgttagttatgcggaaaagagtggctctgaccatcgcgctttttcacgtcgctgggaaagttttcatccacctgccactcctggtctttcagcccttctggaccttcttcgcgctggtgctgttctgggtctactggatcatgacgctcctgttccttgggacaactggatccccagtccagaacgagcagggatttgtggaattcaaaatcagtggtcccctgcagtacatgtggtggtatcacgtcgtggggctgatttggatttcagaattcatcctggcatgtcagcagatgaccgttgccggagcagtggtaacttactacttcacccgcgacaaacgcaatttacctttcacgcctatactcgcctctgtcaacaggctgatcaggtaccacctgggaactgttgccaaaggatcctttattatcacccttgtgaaaatcccacgaatgatcctcatgtatatccatagtcagttaaagggcaaggaaaatgcatgcgccaggtgcgtattgaagagttgtatctgctgtctgtggtgtctcgaaaagtgtctgaattatttgaatcagaacgcctacacagccaccgccatcaacagcaccaacttctgtactagcgcgaaagacgcctttgtcattctggtcgaaaacgccctgcgtgttgctacaattaacacagtgggggattttatgctgtttctagggaaagtgctcattgtgtgctcaactggccttgcaggcataatgttgttgaactaccagcaggattatacagtttgggtgctcccccttattatagtatgcctttttgcctttctggtggcacactgtttcctctcgatctacgaaatggtggtggatgtgctttttctatgctttgcaatagacacgaagtataacgacggctcaccgggacgggagttttatatggacaaggtgctaatggagttcgtagaaaatagtaggaaggctatgaaagaagctggcaaaggcggcgtggccgattccagagaactgaaaccaatgctcaaaaagcgctag

SEQ ID NO: 206270 - DNA, 1974 bp, Artificial Sequence
  Description of Artificial Sequence: Synthetic coding sequence
atgggctgctgcagcagcgccagcagcgccgcccagagcagcaagagggaatggaagcctttagaggaccgttcatgcacagacataccatggcttctccttttcatcctgttttgtattgggatgggattcatctgcgggttcagcattgctaccggcgcagccgctcggctggtgagtggctacgatagttacggcaacatctgcggacaaaaaaacacgaagcttgaggctatccctaattccggaatggaccatactcaacggaaatacgttttcttcttggatccctgtaatctggatctgatcaatcgtaagatcaagtccgtagccctctgcgtcgctgcatgcccgagacaggagctaaagaccctgagcgacgtgcagaaatttgccgagattaacgggagtgcgctgtgttcatataatcttaaaccatctgagtacacaacttccccaaagtctagtgtcctgtgcccgaaactgcctgtccccgctagtgctcccatcccctttttccatcggtgtgcccccgtaaacatcagctgctacgctaaattcgccgaggccttaattacattcgtaagcgacaatagtgttcttcatcgtctcattagcggagttatgactagcaaagaaatcattctaggactttgcctgctgtcccttgtgctctccatgattctaatggtaattatacggtatatcagtagggtgctggtttggatcctcaccattctggtgatcttgggctcactcggcgggaccggcgtgctgtggtggctgtacgcaaagcagagaaggtccccgaaagaaaccgtgactcctgaacaactgcaaatcgctgaggacaacctgcgcgctctcctcatctatgccatctcagccactgtgttcaccgtgatcctgttcctgattatgctggtcatgcgcaagcgcgtggcactgactatcgcacttttccatgtagctgggaaagtctttatccacctgccactccttgtgttccagccattctggacctttttcgccctcgtgctgttttgggtgtattggataatgaccctgctgttcttgggtacaaccggttccccagtccaaaatgagcagggattcgtagagtttaagatcagcggaccattacaatatatgtggtggtaccacgtggtgggcctgatttggatcagcgagttcattctagcgtgtcagcagatgaccgtagccggcgctgtagtgacgtactactttacccgggataagagaaatcttccattcactccgatcttagccagcgtcaacagactcattcggtaccatttagggaccgtggctaaggggagctttattattacacttgtaaagatccctaggatgatcctcatgtacatccactctcagctgaagggtaaggaaaacgcgtgtgccagatgcgtcctgaaatcctgcatctgttgcctgtggtgtttggaaaaatgtctaaactaccttaatcaaaacgcatatacagcaacagccatcaattcaacaaacttttgcacgtcagcaaaagatgcgtttgtgattttggtcgagaacgctcttagagtggctacaattaacaccgttggcgattttatgcttttcttgggtaaagtgctgattgtttgcagcacaggactggccgggattatgcttctgaattatcagcaagattacaccgtctgggtgctgcctctcattatcgtctgcttatttgcctttttggtggctcactgctttctgtccatatacgagatggtggtcgatgtgctgtttctctgctttgccattgataccaaatacaacgacggctcccctgggcgggagttttatatggataaagttctcatggagttcgttgagaattcaaggaaagcaatgaaggaagcaggtaaaggcggagtcgccgatagccgggaactcaaaccaatggcaagcggtgctagctctgcttag

SEQ ID NO: 206271 - DNA, 1959 bp, Artificial Sequence
  Description of Artificial Sequence: Synthetic coding sequence
atgggctgctgcagcagcgccagcagcgccgcccagagcagcaagcgggagtggaagcctttggaagaccggtcttgtacagacatcccttggctacttctcttcattctcttctgtattgggatggggtttatttgtgggttctcgattgcgacgggagctgccgcgaggcttgtcagtggctacgattcctacggcaacatctgtggccagaagaacactaagctggaagccatacccaactccggcatggaccacacacaaagaaagtatgtcttcttcttagacccctgtaacttagatttgattaataggaagataaaatccgtcgccttgtgtgtggctgcctgcccacgccaggaactgaaaaccctctccgatgtccagaagtttgctgaaatcaacgggtctgctctatgctcctataacctaaaaccttctgagtataccacgagcccaaaatccagcgtgttgtgccccaagctgccagtacctgccagcgcaccaatccccttcttccacagatgcgctcctgtgaatatttcatgttatgccaagttcgccgaagcattgattacgtttgtttcagataatagcgtcctacatcgcttgattagcggcgtgatgacctccaaagagatcatccttgggctgtgcctgctgtctctggtgctttctatgatcctgatggttattataaggtacatatcacgggttcttgtgtggattttgacaattctggtcatactggggtctctcggcgggacaggcgtgttatggtggctgtatgccaagcagcgccggagtccaaaagagacagtgacccccgagcaactccaaattgctgaggacaacctgagagcccttttaatttatgcgatatctgcgacagttttcacagtgatcttgttcctcatcatgcttgtgatgcgcaagagggtggctctgactatcgccctgttccatgtcgccggtaaagtgtttatccacctgccactcctggtcttccagcccttttggactttttttgcgctggttcttttctgggtgtattggatcatgacactgctattcctgggtacaacggggtcccccgtgcagaacgaacagggcttcgtggagttcaaaattagcggcccacttcagtacatgtggtggtaccacgtggtgggcctgatctggatctccgaattcattcttgcctgtcagcagatgaccgtggccggcgctgttgtcacatactattttacacgggacaagcggaatctacccttcacaccgatcctggcatccgtcaaccggctaattcgttaccacttggggaccgtggctaaagggtcttttatcatcacactggtgaaaattccgcgaatgattctaatgtatatccatagccagctcaagggtaaagagaatgcctgcgccagatgcgtactcaagtcttgtatttgttgcctgtggtgtctcgagaagtgcctgaattatttgaatcagaatgcttataccgccacggcaatcaatagtacaaatttttgtaccagcgctaaagacgctttcgtcattcttgtggagaatgcgctgcgggtcgcgacgatcaacactgtgggggattttatgctgtttttgggcaaagttctcattgtctgctccaccggtctcgcgggtattatgctcctcaactaccagcaggattacactgtgtgggtgctgccactaatcatcgtgtgtctttttgccttccttgtggcgcactgctttctctcaatatatgagatggttgtagacgtgctgtttctgtgttttgctatcgacacaaagtataacgacggctcacccggaagagaattttacatggataaagtcctcatggaatttgtggagaacagccgcaaagccatgaaggaagcaggcaagggcggcgtcgccgactctagagaattgaaaccgatgattaagtag

SEQ ID NO: 206272 - DNA, 1965 bp, Artificial Sequence
  Description of Artificial Sequence: Synthetic coding sequence
atgggctgctgcagcagcgccagcagcgccgcccagagcagcaagagagagtggaagcccttggaagaccgatcctgcaccgacatcccttggctgcttttgttcattctgttctgtatcggaatgggctttatttgcggcttctctatcgccaccggcgctgcagccagactagtttccggatatgactcctacggcaacatatgtggccagaagaacactaaactggaggcaattccaaacagtggaatggaccatacacaacgcaagtacgtttttttcctggatccctgcaacctggatctgattaatcggaaaattaaatctgtggcactgtgtgtggcagcttgcccaagacaagaactcaagaccctctcagatgttcagaaatttgctgagattaatggaagcgctctatgttcctacaacctgaagcccagtgagtacaccacctcgcctaagtcctccgtgctctgccctaagctgcccgtgccggcctcagctcccatccccttctttcaccgctgcgcacccgttaacatcagctgttacgccaaatttgccgaagccctgatcactttcgttagtgacaacagcgtcctccatcgccttataagtggcgtgatgacaagtaaggagatcattcttggtctatgcctgctgtctcttgtgctgagcatgattctgatggttatcattaggtatatttccagagtcctggtttggatcctcaccattctcgtgatcttgggatccctgggggggacaggcgtactgtggtggctatatgccaaacagcgccgttcccctaaagaaacagtgactcctgagcagctgcagatcgccgaggataacctccgtgcgcttttgatctatgctatttctgcaacagtttttacggttatactttttcttatcatgctcgtgatgaggaagcgggtggcccttacaattgcactgttccacgtggccggcaaagtgttcatccatctacccctcctcgtcttccagcctttctggacgttttttgccctcgttctgttttgggtctactggatcatgactcttttgttcctcggaacaacaggtagccccgtacagaatgagcagggattcgtggaatttaaaatttctggacccctccagtacatgtggtggtatcacgtggtgggactcatttggatatccgaattcatccttgcttgccagcaaatgaccgtggctggagctgtggtgacgtactactttacaagagataagcggaatttgccattcacaccaattctggcgagcgtgaatcgtctgatcaggtatcatctcgggacagtcgccaaaggcagtttcatcatcaccttagtcaagatcccgaggatgatattgatgtatatacacagtcagctcaaggggaaagaaaacgcttgtgcccgatgtgtgttgaagtcatgtatctgctgtctgtggtgtctggagaaatgcttgaactatttaaaccagaatgcttacacagcaaccgcgatcaattcaacaaacttttgcacaagcgcaaaagatgcatttgtgatcctcgtggagaacgccctccgggtggctactatcaatacagtgggggacttcatgctctttttaggcaaagtgttaatcgtgtgcagtacaggcctggccgggattatgttgctcaattatcagcaggactataccgtttgggtgctgccgttgatcattgtttgtctgttcgccttcttggttgcacactgcttcctgagcatctacgaaatggtcgtggacgtgcttttcctgtgctttgctattgatactaagtacaacgatgggagtcccgggcgggagttctatatggacaaggtcctaatggagttcgtagaaaacagccgcaaagcaatgaaggaggctggcaaaggaggcgtggccgattctcgcgaactgaagccaatgcttaagaagcggtag

SEQ ID NO: 206273 - DNA, 1974 bp, Artificial Sequence
  Description of Artificial Sequence: Synthetic coding sequence
atgggctgctgcagcagcgccagcagcgccgcccagagcagcaagagagaatggaagccattagaggataggagctgtacagatataccttggctcttattgttcattttgttttgtattggaatgggatttatatgcggtttcagcattgccacaggcgccgccgctaggctcgtctcaggctacgactcctatggaaatatatgtggccagaaaaatacaaagctggaggccatacccaacagtgggatggatcacacccagagaaaatacgttttcttcctggatccatgtaaccttgacctgatcaacaggaagataaaaagcgtagcattatgtgttgctgcttgtcctcgccaggaactgaagaccctgagtgatgttcagaagttcgcagaaataaatggcagcgctctgtgctcctataatctgaagcccagcgagtacaccacttctcccaagagctctgtcttatgccccaaactgccggtgccagccagtgccccaatacctttctttcaccgttgcgccccagtgaacatcagctgttacgcaaagtttgccgaggcactgattacctttgttagcgacaacagcgtactccaccggctgattagcggcgttatgacctccaaagaaattatcctaggactctgtctgctgagcctcgtcctgtccatgatcttaatggtaatcatcaggtatatctctcgagtgctcgtctggatactaactattctggtaatcctggggtcgttaggggggactggcgtgttgtggtggctatacgctaagcagcgtcggtcacccaaagaaacagtcacgcctgagcagctgcagattgctgaagacaatttacgcgcattgctaatctacgctatctctgccaccgttttcaccgtgatcctgttcctgataatgctggttatgaggaaacgggtggcacttacaatcgcgctgttccatgttgctggtaaagtttttatacacctccctttattggtttttcagccattctggacattctttgcattagtgctgttttgggtgtattggataatgactttactttttctcgggacaacggggagcccagtccaaaacgagcagggctttgtcgagtttaagatctccggccccctccagtacatgtggtggtaccacgttgtgggcctgatttggatcagcgagtttatactggcctgccaacaaatgactgttgcaggcgcagtagttacatattatttcaccagagataaaaggaacctcccatttactcccatcctggcgtctgttaacagactgattaggtatcatctggggactgttgccaagggttcattcattatcaccctggttaagattcctcgaatgatattgatgtacattcattcacagcttaaagggaaggagaatgcttgtgctagatgcgtgctcaagtcttgtatatgctgcctgtggtgcctggaaaaatgtttgaactatttaaaccagaacgcgtataccgccacagccatcaactcaacaaacttttgcacatctgccaaggacgccttcgtgattttagtcgaaaacgctcttcgcgtcgctacgataaacactgtgggcgacttcatgttgttcctgggtaaagtgcttatcgtttgttctacagggctggctggcattatgctccttaactatcagcaggactacacagtgtgggttctccccctgatcatcgtatgcctgttcgcattcctggtggctcactgttttctgtccatctacgaaatggtggttgacgttctcttcctatgctttgccattgacaccaagtacaatgacggcagccctggccgagagttttacatggataaggtcctgatggagtttgttgaaaactctcgcaaggccatgaaggaggcaggcaagggcggtgttgctgattcacgcgaactcaagccaatggcatctggcgccagcagcgcgtag

SEQ ID NO: 206274 - DNA, 2121 bp, Artificial Sequence
  Description of Artificial Sequence: Synthetic coding sequence
atgggcgacgagcggccccactactacggcaagcacggcaccccccaaaagtatgacccgacctttaagggccccatctataataggggctgtacggacattatctgttgtgtcttcctcctgctggccattgtgggctacgttgcggtgggtatcatcgcctggacccacggagacccacgaaaagtcatttatccaactgactccaggggtgaattctgtggacagaagggaactaaaaatgagaacaagccctatcttttttactttaacatagtgaagtgtgcgtcacccctggtgcttctggaatttcagtgccctacccctcagatctgcgttgagaaatgtcccgatcggtacctcacttacctgaatgctaggtcaagccgagatttcgaatactacaaacaattctgtgtgccaggtttcaagaataataagggggtggccgaagtgcttcaggatggagactgccccgccgttttgattccttcgaagccattggccaggagatgcttccctgccatccacgcatataagggagtgctgatggtggggaatgaaacgacttacgaggacggccatggctctcgcaagaatattacggacctggtggagggcgcaaagaaggccaacggtgtccttgaggcccgccagctcgctatgcgcatttttgaagactacaccgtgtcttggtactggattattatcggcctggtcattgccatggctatgtcgctcttattcatcattctcctgcggttccttgccggtatcatggtatgggtgatgatcattatggttattctggtgctgggatatggtatattccattgttatatggagtactcgaggttgcgaggggaggccggcagcgacgtctccttggtggacctcggctttcagaccgatttcagggtgtatctacatctgcgccagacttggttggcattcatgatcatcctgtctatccttgaagtcattatcattcttctcctgatttttctgagaaaacgtattctgatagcaatcgctctgattaaggaggcctcgcgagctgttgggtatgtcatgtgttcgcttttgtatcctctggtgacgttcttcctgctgtgcctgtgcatcgcgtattgggcctctacggctgtcttcctgagtacctccaatgaagccgtctataagattttcgacgacagtccgtgcccttttacagccaagacatgtaaccccgaaacgttcccttcgtcgaacgaatctcggcagtgccccaacgcccggtgtcagtttgcattctacgggggggagagtgggtatcatcgggctttactcggcctgcagattttcaacgcctttatgttcttctggctggccaattttgtacttgcactggggcaagttacattggccggtgcatttgcctcttattactgggctcttaggaagccagatgatctgccagcctttccattgtttagcgcatttggcagagccttgagatatcacactggatcactggcctttggcgccctgatactagccatcgtccaaattataagggtgatccttgaataccttgatcagagactgaaggcggccgaaaataagtttgcaaaatgtctaatgacctgccttaaatgttgtttttggtgcttagagaagttcatcaagtttctaaaccgaaacgcctacataatgatcgcaatatacggcactaacttttgcaccagcgctaggaacgctttctttctgctcatgcggaatattattcgcgtagccgtgcttgacaaagtgacagactttctcttcctgctgggcaaactgttgattgtagggtcggttggcattctcgcgttctttttttttactcaccgtattcgcatcgtgcaggacactgcaccaccactgaactactactgggttcccatactgacagttattgtaggctcatacctcatcgctcatgggttcttctcggtctacggcatgtgcgtagataccttgtttctgtgcttcttggaagaccttgaaaggaacgacggctctgcagagaggccatacttcatgagcagcacactgaagaagctcctgaacaagaccaacaaaaaggccgctgaatcttag

SEQ ID NO: 206275 - DNA, 2121 bp, Artificial Sequence
  Description of Artificial Sequence: Synthetic coding sequence
atgggcgacgagcggccccactactacggcaagcacggcaccccccagaagtacgaccctacattcaagggtccaatttacaatcggggttgcaccgacatcatttgttgcgtgtttctcctcttagcgatcgtgggctatgtagctgtgggtataatcgcttggacccacggcgaccctcgaaaggtgatctaccctacagactctcgaggcgaattctgtggccagaagggaacgaagaatgaaaacaaaccttatctattttactttaacatagtcaagtgcgcttcccccctggtccttttagaattccagtgccctacaccacagatctgcgtagaaaaatgtcctgatcggtacctgacatatctcaatgccagaagcagtcgggacttcgaatactataaacagttctgcgttccggggtttaagaataacaaaggagtggcagaagtgctgcaggacggggactgccccgccgtattaattcccagcaagcccctggcccgaagatgttttcctgccattcacgcctacaagggtgtgctgatggtcgggaatgagactacatacgaagacggacacgggtccaggaaaaatattaccgacttagtggagggcgctaagaaagccaacggagtgctggaggctcgccaactcgctatgagaatttttgaggactacacggtctcgtggtattggatcattattggcctggtgattgcaatggccatgtctctgctgtttatcatactcttaagatttctggccggaataatggtctgggttatgattatcatggtgattcttgtgctgggatatggcatctttcattgttacatggaatattctcgtctgagaggggaagccggaagcgacgtaagcctggtcgatctgggcttccagacggactttcgcgtctacctgcaccttcggcagacctggctggccttcatgatcatcctatcaattctggaagtcatcatcatccttctgctcatttttctccggaagagaatactgatcgccattgcactcataaaggaagcgagcagagctgtgggatacgtgatgtgtagtctgctataccccctggtaacctttttcctcctgtgcctctgcatcgcctattgggctagcactgctgtgtttctgagtacgagcaacgaagccgtctacaagatatttgatgatagcccttgcccatttaccgcgaagacctgtaatccggagacctttccatcctccaatgagtctaggcagtgcccgaacgcgcgctgccaatttgcattctatggaggagagtctggataccacagagctctgttagggctgcaaatctttaacgccttcatgttcttctggctggctaatttcgtcctggccctcgggcaggtgactctggcaggggccttcgccagttattactgggctctcaggaaaccagacgatctgcccgcctttccactattctccgcctttggcagggcattacgctaccatacgggttctctggctttcggagcactgattttggccatcgtacagatcattagagtgattttggagtacctggaccagcgccttaaagcggccgagaacaagttcgccaagtgtctgatgacctgcctgaagtgttgtttctggtgcctggagaaatttattaagttcctcaacagaaacgcctatatcatgatcgctatctacgggaccaatttttgcacctctgcaaggaatgccttcttcctccttatgcgcaacatcatcagggtggcagtcctagacaaagtcacagattttctgtttctcttgggcaagttgctaatagtcggatcggtcggcatcctcgccttttttttttttacacatcgtatcaggattgtgcaagataccgcacctccactgaattattactgggtgcccattctcaccgtgatagtcggcagctacttaattgcccatgggtttttttcagtgtacggcatgtgcgtcgatacactgttcctgtgcttttgcgaggatctggagcgaaacgacggatctcaggagcggccttatttcatgagcccagaacttcgggacatcttattgaaaggcagcgccgaagagggcaagcggtag

SEQ ID NO: 206276 - DNA, 2115 bp, Artificial Sequence
  Description of Artificial Sequence: Synthetic coding sequence
atggaggacgagcggaagaacggcgcctacggcaccccccagaagtacgatccaaccttcaagggaccgatttacaacaggggctgtactgacatcatttgttgcgtgtttctgctcctggccatcgttggatacgtcgccgtaggcattatcgcctggacacacggagatccaaggaaagtcatctaccccactgattcacgcggggagttttgtggccagaaaggaaccaaaaacgagaacaagccttacctgttttacttcaatatcgtgaaatgcgcctctccactggtgctgcttgagtttcagtgtccaacccctcagatttgtgtggagaagtgccctgacaggtatttaacatatctcaacgcaagaagctcccgggatttcgagtactataagcagttttgtgtgcccggcttcaaaaacaacaaaggagtggctgaggtactgcaagacggagattgcccggcagtgctgataccatccaagcctctcgctaggcgatgcttcccggccatccacgcttataagggcgtcctgatggtcggcaacgagaccacttatgaggacggacatggctccaggaaaaatatcaccgaccttgttgaaggcgctaagaaggccaatggagtcctggaagccagacagctggcaatgcgcatctttgaggattacactgtaagttggtattggatcatcataggcctcgtaattgccatggccatgtcccttctttttatcattctccttagattccttgcaggcattatggtgtgggttatgatcatcatggtcatcctggtgctgggatacggaattttccactgttacatggagtattccaggcttcgtggggaggcaggatccgatgtctccctggttgacctgggattccagaccgactttagagtgtaccttcacttgaggcagacctggctagcatttatgatcatcctttccatcctggaggtgatcatcattctgctgcttatctttctgaggaagaggattctcattgctattgcactcattaaggaggcctcaagagctgttggctacgtcatgtgtagcctgttatatcctctggtgacctttttcctgctgtgtttatgcatagcctactgggcgtctactgctgtgttcctcagcaccagtaatgaggctgtgtataaaatattcgacgatagcccttgtcccttcaccgctaaaacatgcaacccggagacttttccatcaagcaacgagtcccggcagtgccctaatgcaaggtgccagttcgccttctacgggggcgaatccggctaccaccgggctctcctgggattgcagatttttaacgcctttatgtttttttggctggcaaacttcgtactggccctgggccaagtgacattggctggtgcctttgcctcatattactgggccctaagaaagccagatgacttaccggcctttccccttttctccgccttcggcagagccttgagataccataccggttctttggcttttggcgctctgatcctcgccattgtgcagatcataagagtgatactcgagtacttggaccagaggcttaaagcagctgaaaataaatttgcaaagtgtcttatgacatgcctgaaatgctgtttttggtgtcttgaaaagttcattaagtttcttaatcgcaatgcgtatattatgattgccatttacggaaccaacttctgtacttccgctcgcaatgccttttttcttttgatgaggaacatcattcgcgtagcggtgcttgacaaagtcactgattttctgtttctgctcggaaagctgttaatcgtgggttctgtgggcattttagcctttttcttctttacccatcggatcagaatcgtgcaggacactgcccctcccctgaattattattgggttccaattctcaccgtcattgtgggctcataccttatagcccatggttttttcagcgtctatggaatgtgtgtggataccctgttcctgtgcttcctggaagacctggagcgtaatgatggcagtgctgaacgtccgtattttatgtcctccaccttgaagaaattgttgaacaaaacgaataaaaaagcagccgagagttag

SEQ ID NO: 206277 - DNA, 1248 bp, Artificial Sequence
  Description of Artificial Sequence: Synthetic coding sequence
atgaccggcgagcggcccagcaccgccctgcccgaccggcggtggggccctcgcatactgggtttctggggcgggtgtcgggtctgggtgtttgccgccatcttcctccttctcagtctggccgcgtcttggtccaaagccgaaaacgatttcgggctggtccaaccgttggtgacgatggagcaacttctgtgggtctctggtaggcagatagggtccgtcgacactttccgaatccctttgataacagccactccccgcggaacactgttagcgttcgccgaggcccgcaagatgtcttcctctgacgaaggcgctaaattcatagcattgcggaggagcatggatcagggatcgacttggtcccccacagctttcattgtcaatgatggggatgtgcccgatggactcaatctaggggcggtggtgtccgacgttgagacaggggtagtgttcctgttctatagcctatgtgcccacaaagctggctgtcaagtcgcgtctactatgcttgtttggtctaaagacgacggggtgagctggagtactcctcggaaccttagcttagacattggcaccgaggtgttcgcaccaggccctggcagcggtatccagaagcagcgggagcctcgcaagggcaggcttatagtatgtggccacgggaccctggagcgggacggtgtgttttgcctactgtcagatgatcatggggcatcttggagatatgggagcggagtgagcggtattccgtacggtcaacccaagcaagaaaacgatttcaaccccgacgagtgccaaccttacgagctgcctgatggatcagtcgtcattaacgcacgaaatcagaacaactaccattgccactgtcggatcgtactgcggagttatgatgcttgtgacaccttgaggccacgcgacgtgacattcgatccagagttggttgaccctgtcgtagcagccggcgccgtggtgacgtccagcggtattgtgttcttttcgaaccccgctcacccagagttccgggtgaatctgacccttagatggtctttctcaaatgggaccagttggcgtaaagaaactgtgcagctgtggccaggccctagtggctactcctctcttgctactctggagggctccatggatggggaggaacaggctcctcagctctacgttctctacgagaaagggagaaaccattatacagaaagtattagcgtggctaagatctccgtgtatggaaccctttag

SEQ ID NO: 206278 - DNA, 2007 bp, Artificial Sequence
  Description of Artificial Sequence: Synthetic coding sequence
atgggcggcaagcagcgggacgaggacgacgaggcctacggcaagcccgtgaaatacgaccccagctttaggggcccaatcaaaaaccgatcatgcactgacgtcatttgctgtgtgctcttcctattattcatcttaggttacatcgttgtgggcatagtggcatggctctacggggaccctagacaggttctgtatccgagaaatagtaccggagcttactgtggaatgggggaaaataaggataagccctatcttctgtattttaacatcttttcatgtatcctgagttctaacattatttccgtggccgagaacgggttgcagtgcccaaccccgcaaacagtgatcaccagtctgcaacaggagctctgcccgtctttcctgctgcctagcgcccctgcgttgggacgatgttttccatggaccaacgtgacccctccagcactaccgggcatcactaatgatacaaccatccagcaaggcatcagcggcctgatcgactctctgaacgccagagacataagtgtgaaaattttcgaggatttcgctcagtcatggtactggatacttgttgccctcggcgtggccctggttctctccctgctttttatactcctcctgaggctggtggcgggacctctcgtccttgtcctaatcttgggtgttcttggtgtcctggcttacggcatttattactgctgggaggagtatagggtgctgagggataaaggcgccagcatctctcagctgggattcacaacaaatttaagcgcgtatcagagcgtgcaggagacttggcttgccgccttgatcgtactggccgtgctcgaggccatcctgctgctgatgctaatctttctgaggcaacggatccggatcgctatcgcactgcttaaagaggccagcaaggccgttggacagatgatgagtaccatgttctacccactcgtcacattcgtacttctcttaatttgtatcgcttattgggctatgactgcactgtacctagcaacttcgggccaaccacagtatgtgctgtgggcaagcaatatctcctcacctggatgcgagaaggtgccaatcaacacatcctgcaatcccaccgcccatttagtaaactcaagttgtccaggcctcatgtgcgttttccaggggtacagctctaaaggtcttatacaacggtccgtgtttaacctacaaatctacggcgtcctcggactgttttggaccttaaactgggtgctcgccctcggtcagtgtgttctggccggtgccttcgcaagcttctactgggcctttcacaagccccaggacatcccaacgtttccccttatttctgcttttatccgaacactgcgttatcacaccggatccctggcctttggagccctgatcttgacccttgtccagatcgctcgcgtcatcttggaatatatagaccacaagctgcggggtgtgcagaacccggtggccaggtgtatcatgtgctgttttaagtgctgtctgtggtgcctggagaaatttatcaaattcctaaacagaaacgcttatatcatgattgccatttacggcaagaacttctgtgtgagcgctaagaacgccttcatgctgttgatgaggaacatagttcgggtggtcgtccttgacaaggtgaccgaccttctccttttcttcggaaaactcctggtggtcggcggcgttggagttcttagctttttttttttttccggaagaatccccggcttggggaaggatttcaaaagtccgcatttaaactactattggttaccgatcatgacctccattctcggcgcgtatgtgattgctagtggatttttttccgtattcgggatgtgcgtagatacgctttttctctgtttcctcgaggatctcgaacggaataacggatctctcgatcgaccttattacatgagtaaaagcttactgaagatcttgggcaaaaagaacgaagcgcctcccgacaacaaaaagcggaaaaagtag

SEQ ID NO: 206279 - DNA, 2133 bp, Artificial Sequence
  Description of Artificial Sequence: Synthetic coding sequence
atgggcggcaagcagcgggacgaggacgacgaggcctacggcaagccggttaaatatgacccttcatttagggggccgatcaagaataggagttgcacagatgtgatttgctgtgtgctcttcttgttatttatactgggctacattgtggtcggcattgtcgcatggctttacggagacccaagacaagtcctgtatccccgtaactccactggtgcctattgcggtatgggcgagaacaaagataagccatacctactttattttaacattttttcatgcattctgtcttccaatattattagtgtagctgagaacgggctccaatgccccacaccacaagtttgcgtttccagctgcccagaagatccgtggaccgtcgggaagaacgagttctctcagaccgtgggggaggttttttacactaagaaccgcaacttctgcctacctggggtgccatggaacatgactgtcatcacttctttacaacaggaactttgtcctagcttcctgctgccttccgcacctgctctgggtcggtgctttccctggacaaatgtgacaccaccagcactacccgggattactaatgatactacgatccaacagggtatctctggactgattgatagcttgaacgcccgcgacatctctgtcaagatcttcgaagatttcgcccagtcatggtactggatcctggttgctctcggtgtcgccctggtgttgagcctgctttttatcctgctgctaaggctcgtggcaggacctctcgtgcttgtcctcatccttggtgtcttaggggtcctggcttatggaatctattactgttgggaggaataccgcgtactcagagacaagggcgcgtcaatctctcagcttgggttcaccacaaaccttagtgcctatcaatccgttcaggagacatggctagctgcactgattgtccttgccgtgttagaggctattcttctcctaatgttaatctttctccggcaaaggatacgcattgctatcgccctgctgaaagaagcatccaaggctgtgggacagatgatgtccaccatgttctaccccttggtgaccttcgtgctgctgctgatctgcatcgcatactgggctatgaccgccctgtatctcgcaacttcagggcagccgcaatatgtcctgtgggcatcaaatatctcatcccccggttgtgagaaggtccccataaacacatcctgcaaccccaccgcccaccttgtgaattcctcatgccccgggctgatgtgtgtctttcagggctactctagtaagggacttatacaaagaagcgtctttaacctgcagatttatggagtgttggggctgttctggacactgaactgggtgcttgccttgggacagtgtgtgcttgcaggtgcgtttgcatccttctattgggcgtttcataagccacaggatattcccaccttcccactgatttccgcctttatccgcacactgcgatatcatactggcagccttgcgttcggggccctaatcctgacccttgtgcaaattgcccgagtcatcctggagtatattgatcataaactgcgaggtgttcagaaccctgtcgctaggtgcataatgtgctgttttaaatgttgcctctggtgtctagagaagttcataaagttcttgaaccgtaacgcatatattatgattgctatctacggtaagaatttctgcgtgtctgctaagaacgccttcatgttgctcatgcggaacatcgtacgtgtggtagtgttagacaaggtcacagatttgttgctgttcttcgggaaacttctggtggtgggcggcgtgggcgtgctctcattctttttctttagtggcaggattccgggactggggaaggatttcaaatcacctcatctgaactattactggcttcctatcatgacgtcgatactgggagcctacgtgatcgcgagtggattttttagcgtgtttggaatgtgcgtagacaccctctttctgtgcttcctggaggaccttgagcggaataacgggtccttggacagaccgtattacatgagcaaatctcttctgaaaattcttggcaaaaagaacgaggcccccccggataataagaaaaggaagaaatag

SEQ ID NO: 206280 - DNA, 1236 bp, Artificial Sequence
  Description of Artificial Sequence: Synthetic coding sequence
tgacgggacgaggacgacgaggcctacggcaagcccgtgaagtacgatcccagttttcgagggcccatcaagaaccggagctgcacagacgtgatttgttgtgtcttattcctgctcttcatcctgggctatatcgtcgttggcatcgtggcctggctatacggcgaccctagacaagttctgtacccaagaaactccactggcgcatactgcgggatgggcgaaaataaggacaagccttatctcctgtacttcaatatcttctcttgcatcttgtccagtaatatcatttcagtggctgaaaacgggctgcagtgccccacaccccaggtgtgcgtctccagctgccccgaagatccttggacggttggaaaaaatgaattttcccaaactgtaggagaagtgttctacaccaagaataggaatttctgcctaccaggagtgccttggaacatgactgtgattacctcgctccagcaggagctgtgccccagcttcctgctccccagtgcccctgccttggggcggtgcttcccctggactaacgtaacgcctcccgctctccccggcattacaaacgatacaaccatccagcaggggatcagcggcttgattgattctctgaatgccagggacatatcggttaagattttcgaagacttcgctcagtcatggtattggatcctggtcgctgtgggtcagatgatgtcaactatgttctaccctcttgttacttttgtgttgctcctgatatgtatcgcctactgggccatgacagcactctatctggctacgtccggtcagccgcaatatgtcctgtgggcctcgaacatttctagccctgggtgtgaaaaggtgcctattaacacctcatgcaatccaactgctcatctcgtgaactctagctgtcccggtctgatgtgtgtgttccagggatacagctccaaagggctgatccaaaggtctgtattcaatctgcagatctatggagtcttgggacttttctggactttaaactgggtgctcgccctgggccagtgtgtgttggcaggtgctttcgctagcttctactgggcctttcacaaacctcaagatatccctacttttcccctcatctccgccttcattcggaccctccggtaccataccgggagccttgcatttggagctctcatcctgactctggtccaaatcgctagggtcattctcgagtatatcgaccacaagttacgctag

SEQ ID NO: 206281 - DNA, 1236 bp, Artificial Sequence
  Description of Artificial Sequence: Synthetic coding sequence
tgacgggacgaggacgacgaggcctacggcaagcccgtgaagtacgacccgtcattccgcggccccatcaagaataggagctgtacagacgttatatgctgcgtgctgtttctcctgttcattctcggatacatagtcgtgggcatcgtggcatggctgtatggggatcccagacaggtcctttacccccgtaatagcactggagcctactgtggtatgggagagaataaggacaagccatacctcttgtactttaacatattcagttgtatattgtcctctaatatcatatctgttgccgaaaatggattgcagtgcccgaccccccaggtgtgcgtgagctcctgtccagaggacccttggaccgtggggaagaacgaattctcacagactgtgggagaggttttttacactaaaaatagaaatttctgtttgccaggagtgccctggaacatgacagtcattacctctctgcagcaagagttgtgtccatcgtttctcctccctagcgcccctgctcttggacgctgtttcccctggactaacatcactcctcccgctctgcctggaattaccaacgacacaacaattcagcagggaatttcagggctcatcgatagtttgaacgccagggatatcagcgttaaaatcttcgaagacttcgcacaaagttggtactggattcttgtcgccgtgggccagatgatgtcgaccatgttttaccctcttgtgacatttgtgctactcctgatctgcattgcctattgggccatgacagcactgtacttggccacaagtggacagcctcagtacgtcctttgggccagtaatatttccagccctggatgcgagaaagtgcccattaatacttcttgtaatcccacagcccatctggtaaattcgtcttgtcccggcctgatgtgtgtcttccaagggtactcttctaagggactcatccagcgatctgtcttcaacctgcagatttacggagtgctggggctcttctggactctgaattgggtgctggctcttgggcaatgcgtcctagccggagcctttgcgagcttttactgggccttccacaaaccccaggacataccaactttcccactgatcagcgcattcatccggacactacgctatcacaccggttcgctggcttttggggccttgatcttgaccttggtgcaaattgccagagtgattctggaatatattgaccacaaacttagatag

SEQ ID NO: 206282 - DNA, 2133 bp, Artificial Sequence
  Description of Artificial Sequence: Synthetic coding sequence
atgggcggcaagcagcgggacgaggacgacgaggcctacggcaagccggtgaagtacgatccttcttttagggggcccattaagaaccgctcttgtaccgacgttatctgctgcgtgctgttcctacttttcatcctgggctatatagtggtcggcatcgttgcatggctctacggcgatccacggcaggtgctgtatccgagaaatagcacgggagcctattgtggcatgggcgagaacaaggataaaccttacctgctgtactttaatatcttttcttgcatcctgtctagtaatataatctctgtggcggagaatggcctccagtgccctacaccacaggtgtgtgtgtcaagttgccccgaggatccttggacggttggcaagaacgaattttctcagactgtgggagaggtgttctacactaagaatcgtaacttctgcctgcctggggtcccgtggaacatgacagtgataacaagtttgcagcaagagttgtgtccatctttcctgcttccaagtgcgcctgccttgggccgctgcttcccatggaccaatataactccccccgccctgccaggcatcaccaacgacaccactattcagcagggtataagtgggttaattgatagcttgaacgcccgcgatatctctgttaagatcttcgaggattttgcccagtcatggtattggattctcgtggcactgggtgtggctctggtcctctctctgctctttattctgctgctcaggctcgtggccggccccctggtgctcgtactgattttaggcgtgctgggggtgttggcttatggaatttactattgctgggaggagtaccgagtgctgcgcgacaagggcgccagtatcagccagcttggatttacgactaacctttccgcctaccaatcagttcaagaaacatggctcgccgccctcatcgtcctggctgtcttggaggctatcctgctgcttgttttaatttttctcagacagaggattcggattgccattgcactgctgaaagaagcatcaaaagccgtggggcagatgatgtctacaatgttttaccccctggtgacattcgtcctcttactgatctgtattgcttactgggccatgacggcattgtaccttgctactagtgggcaaccccagtatgtgctgtgggcttctaatatctcgagcccgggatgcgagaaagtcccaattaacaccagctgtaacccaaccgcccacctggttaacagttcttgccccgggcttatgtgcgtgtttcaggggtatagttctaaaggactcatccaacgctctgtttttaacctccagatatatggcgtgctggggctcttttggacactcaactgggtgttggccctggggcagtgcgtcctcgccggggcttttgcaagcttttactgggccttccataagccccaggacatacctactttccccttgatatctgcatttattcgaactttgcggtaccacacagggagcctagcctttggtgctttaattctgacgctggtgcagatcgcccgagtgattttggaatacatcgatcataaactcaggggggtacaaaatcctgtggccaggtgcatcatgtgttgctttaagtgctgtctgtggtgtctagagaagtttattaagttcttaaacagaaatgcttatataatgattgctatctatggcaaaaacttctgcgtaagcgcgaaaaacgcattcatgctgctcatgagaaacatcgtgcgcgtggtcgttctggataaggtgacagatttgctgttgtttttcggcaaactgcttgtggttgggggagtcggtgtgctgagcttctttttcttttctggtaggatacctggcttgggcaaagactttaagagcccccacctgaactattattggcttccaatcatgacttccattcttggggcctacgtgatcgcatccggtttcttctctgtgtttgggatgtgcgtggataccttatttctgtgttttctggaggatctggagagaaataacggaagcctcgaccgaccctactatatgagtaagtctttgctcaagattctgggaaaaaagaacgaagctccccccgataataaaaaaaggaagaagtag

SEQ ID NO: 206283 - DNA, 2133 bp, Artificial Sequence
  Description of Artificial Sequence: Synthetic coding sequence
atgggcggcaagcagcgggacgaggacgacgaggcctacggcaagccagtcaagtacgacccctccttccggggacccatcaaaaatagatcatgtacggatgtcatctgctgtgttctgtttttgttattcattctcggttatatagttgtcggaattgtcgcctggctctacggggatcctagacaagttctgtacccccgaaattcgaccggggcgtattgcggcatgggtgaaaacaaggacaaaccctaccttctctacttcaacatctttagctgtatactgtcctcgaatatcataagcgtagcagagaacggattgcaatgtcctaccccacaagtgtgtgtgtcttcttgtcctgaggacccatggacagtcggaaagaacgagttttcacaaactgtgggtgaggtattttatacaaagaacaggaacttctgcctacccggtgtcccttggaatatgactgtgataacgtctctgcagcaggagttgtgcccttcatttttgcttcccagtgcaccggctctggggcgatgcttcccttggaccaatattacaccacccgccctgccgggcatcaccaacgacaccacaatccagcagggtatctcaggcctgatcgattctctcaacgccagggacatatctgtcaagatattcgaagacttcgcacagtcctggtactggatcctcgtggccctaggagtggctctggttctctcccttcttttcatattgctgctacggctggtggcaggtcctctggtacttgttctcattctaggcgtgcttggcgtgttggcctatgggatttattactgctgggaggagtatcgcgtcctccgcgataagggcgcctcaatttctcaattgggattcacgacgaatttgagcgcataccagagcgtccaggagacttggctggctgctctcatagtccttgcagttcttgaggcaattctgctgttagtgctcattttcctgaggcagagaattaggatagctattgctttgttgaaagaggcaagcaaggccgtggggcaaatgatgtcaacaatgttctaccccctggtgacctttgtgttattgttaatctgcatcgcatattgggcaatgacagccctgtacctggctacttccggccagccccagtatgtgctctgggcaagcaacatcagttcgcccggatgcgagaaggttcctataaacacgtcatgtaatccgactgcacacttagttaattcctcttgtcccggtctcatgtgcgtgttccagggttacagctccaaaggtctgatccagagaagtgtgtttaacctgcagatatatggcgtgctcggactattctggaccctaaactgggttttagcgctgggacagtgtgtgctggccggtgcctttgcttcattttattgggcctttcataagccccaagacatcccaacttttcctctcatttcagctttcatccgcactttacggtaccatacaggcagcctcgcgttcggcgctctaattctcaccctggtacaaatagccagagtaatactagagtacatagatcacaagctgcgaggcgtgcagaatcccgtcgctcggtgtatcatgtgctgcttcaaatgttgcctctggtgtttggaaaagttcataaagttcctgaatcggaatgcctatatcatgattgctatctatggcaaaaacttttgcgtaagtgctaagaatgcgttcatgctgcttatgcggaatattgtccgcgttgtggtcttggacaaagtgacagacctcctgctcttctttggcaaacttttggtcgtcgggggagtcggcgtgctatcattttttttctttagtggcaggatacccggccttggtaaagatttcaagtctccacacttaaattattactggctgcctatcatgacctctatcctgggcgcatatgtgattgcctccggatttttttccgtgttcgggatgtgtgttgacaccctgttcctctgttttctcgaggatctcgagagaaataatggttctcttgaccggccatattacatgagtaaatccctattgaagatattggggaagaagaatgaagcaccaccagataataagaagagaaagaaatag

SEQ ID NO: 206284 - DNA, 2133 bp, Artificial Sequence
  Description of Artificial Sequence: Synthetic coding sequence
atgggcggcaagcagcgggacgaggacgacgaggcctacggcaagcccgttaagtacgacccctcgtttcgagggccaatcaaaaatagaagttgtaccgatgtaatatgctgcgttttgtttctgttgtttattctcggatatattgtggtgggaatagtggcatggctgtatggcgatccccgccaggttctttatccgcgcaattccacaggcgcttactgtggcatgggagaaaataaggataaaccctaccttttgtattttaacatcttttcttgcattctgtcctccaacattatttccgttgcagaaaacgggctgcagtgtcccaccccccaagtgtgtgtatcctcatgtcccgaggatccgtggacagtcggcaagaatgaattctcacaaaccgtcggagaggtattctacaccaagaatcggaacttctgtctacccggagtcccatggaacatgaccgtgatcacaagtctgcagcaagagctttgccctagtttccttctgcccagcgcccctgctctcggtaggtgcttcccttggaccaacgtgacccccccggccctgcctggtattactaacgataccacgatccaacagggtatttcgggcctgatagatagtttgaacgcccgtgacatttcagtgaagatcttcgaggactttgcccaatcctggtattggatcctggtggccctgggcgtggccctcgtactctcgcttttattcattcttttgttaagactggtcgcaggccctcttgttctcgtgctgatcctgggggttcttggtgttctggcttacggtatttattactgctgggaggaatacagggtattacgtgataagggcgcctcgatatcccagctcggatttacaacaaatctgtcagcatatcaatccgtgcaggagacttggctggcggctctcatagtgctggccgttctggaagcaatcttgttgttgatgttgatcttcttgcgccagcggatcagaatcgccattgcgctccttaaggaggcgtctaaggccgtggggcaaatgatgagtactatgttctatcctctggtgaccttcgtgctgctcctcatatgcattgcctactgggcaatgaccgccctatacctggccaccagcggccagcctcagtatgtgctatgggcatcaaatatctcgtccccgggctgtgaaaaagtgcccataaatacctcctgtaatcccacagcacaccttgtgaattctagctgtccgggcctgatgtgcgtcttccaggggtacagctctaagggactgatccagagatctgtgttcaacctgcagatctatggggtgctggggctgttctggacgctgaattgggtattggcgctgggccagtgtgtgcttgccggggctttcgccagcttctactgggccttccataagccgcaagacataccaaccttccctctgatctccgcattcatcagaactttacggtatcacaccggctcgctcgcttttggcgctttgatcctcactttagtacagattgcccgagtgatcttggaatacatcgatcacaaattgcgcggtgttcaaaatccagtggcaaggtgcatcatgtgttgtttcaaatgctgtctctggtgcctcgaaaagtttataaaattccttaatcggaatgcctacattatgatagcaatttatggcaagaatttttgtgtgtcagccaagaacgcattcatgttgctgatgcgcaatatcgttagggtcgtcgtcttggataaagtgacagacctgctgctgttcttcgggaagctgttggtcgttggcggcgtgggagtcctgtccttttttttcttcagtgggcggatccccggcttaggcaaggatttcaaaagcccccacctgaattactattggctcccaattatgacatccatcttaggagcatacgtgattgcttctggattcttttccgtgtttggcatgtgcgtggacactttgtttctgtgttttcttgaggacctggaacggaataacggcagcctcgaccggccgtactacatgtcgaaatcactcctcaaaatattgggtaaaaaaaatgaagctcccccagacaataagaaaaggaagaaatag

SEQ ID NO: 206285 - DNA, 1236 bp, Artificial Sequence
  Description of Artificial Sequence: Synthetic coding sequence
tgacgggacgaggacgacgaggcctacggcaagcccgtgaagtacgaccccagcttccgtgggccaattaagaacaggagctgtaccgacgtgatttgctgcgtcctgttcctgctgttcattctgggttacattgtggttgggatcgttgcatggctgtatggggatcccaggcaagtgttatatccccgtaacagcacgggagcttactgtggcatgggtgagaacaaggacaagccatacctcctctatttcaacattttcagctgtatcctgtctagcaacatcatatcagtcgcagagaatgggcttcagtgcccaactcctcaggtctgtgtgtcgtcttgtcctgaggacccgtggacggtgggaaagaacgagttctcacagacagttggcgaagttttttacacaaaaaatagaaacttctgcctgccaggcgtcccctggaacatgaccgtgattactagtcttcagcaggagctgtgtcccagtttcttgctgccgtccgcccccgcactcggacggtgcttcccttggacgaatgttacacccccggcgctgcccggtataactaacgatactacaatacagcagggtatcagcggacttattgactctctgaacgcccgggatattagtgtcaagatattcgaggactttgcgcaaagttggtactggatcttagtcgccgtaggacaaatgatgtctactatgttttaccccctagtgacatttgtgctactgttaatctgtatagcctattgggctatgacggccctgtacctggccacgagcgggcagccccagtacgtcctctgggcatctaatatatccagccctggctgtgaaaaggtgcctatcaatacttcttgtaatcctaccgctcatctggtgaattcttcctgccccggcctgatgtgtgtcttccagggctattcaagtaagggactgatccagcgaagtgtgtttaacttgcagatttatggagtgctaggcctgttctggaccctaaattgggtgctggctctcgggcagtgtgtgctcgctggggcttttgcttctttctactgggccttccataagccacaagatattcctaccttccctctcatctccgcatttattagaaccctgcgctatcatactgggtcactggccttcggggctttgattctgacactcgtacaaatcgcacgtgtgattctggaatacattgatcacaagctgaggtag

SEQ ID NO: 206286 - DNA, 1236 bp, Artificial Sequence
  Description of Artificial Sequence: Synthetic coding sequence
tgacgggacgaggacgacgaggcctacggcaagcccgtgaagtacgacccttcgtttcgggggcccataaagaatcgatcttgcacagatgtcatctgctgtgtgcttttcctgctcttcatcctaggctacatcgtcgtggggatcgtggcctggctgtatggcgacccgcgccaggtgctgtaccctagaaattctactggtgcctactgcgggatgggcgagaacaaagacaaaccttatctactgtacttcaacatctttagctgcattttgagtagtaatatcatatcagtggctgagaatggcctgcagtgccccaccccccaggtttgtgtgtctagttgccccgaggacccttggacagtgggtaagaacgaattctcccagacagtgggagaagtgttttatacaaagaaccggaacttctgcttgccgggggttccgtggaacatgactgtgattacttcattgcaacaggaattatgtcctagcttcttgctgccctcagcacccgctctgggacggtgtttcccctggacaaatgtcactcccccagcgctgccgggaatcacaaacgacactaccattcagcagggaatctctggcctcattgattccctgaacgctcgcgacatctccgtgaaaatctttgaagattttgctcagtcgtggtattggatcttagtggcagtcggacagatgatgtctaccatgttctacccactcgtcaccttcgtgctcctcctcatctgcatagcctactgggccatgactgctctctatctggctacgagcggacagcctcaatacgtgctgtgggccagtaatatcagctccccggggtgcgaaaaagtgccaatcaacacgtcgtgcaaccctaccgcccatctggtgaattcgtcatgtcctggactcatgtgcgtgttccaggggtatagtagcaaagggctcatacagaggtccgtctttaacttgcagatttacggcgtgcttggcctgttctggaccttgaactgggtgcttgcattgggccagtgtgtcttggcgggcgcatttgctagcttttattgggctttccacaagcctcaggatattcctactttccccttgattagtgccttcatccggactctccggtaccatacaggctcactcgcatttggagccctgatccttacactcgtacagattgcccgcgtgatcctggagtacattgaccacaagttgcggtag

SEQ ID NO: 206287 - DNA, 1236 bp, Artificial Sequence
  Description of Artificial Sequence: Synthetic coding sequence
tgacgggacgaggacgacgaggcctacggcaagcccgtgaagtacgatccatcctttcgcggaccaattaaaaatcggagttgtaccgatgtgatttgttgtgttctgtttcttctgtttatcctgggctacattgtagttggaatcgtcgcctggctgtatggcgatccccgtcaggtcttataccctagaaactccacaggggcctattgtgggatgggtgagaataaggataaaccctatctgctgtattttaacatattctcctgtatcctgtcctccaacattatcagcgtcgccgagaatggactacagtgtcctacaccccaggtttgtgtgtcctcctgtccggaagacccatggacagttggaaagaatgaattttctcagactgtcggagaagtgttctacactaagaatagaaatttctgcctccccggggtaccatggaacatgacagtgatcacatccctacaacaagagttgtgccctagctttttactgccttccgctcctgctctaggcaggtgttttccttggacaaatatcaccccacctgctcttccaggaatcactaatgataccactatccaacagggcataagcgggctgatagactccctgaatgcccgagatatctccgtgaagatctttgaggattttgcgcagtcttggtactggattttggtcgctgtggggcaaatgatgagtactatgttctacccactcgtgacatttgtcctcctcttgatctgtatcgcgtactgggccatgactgctctctatctggctacctcgggccagccccagtacgttctgtgggcctcaaacatatccagccctggctgtgagaaggtgcctattaatacatcgtgcaaccccacagcccacctggttaattcctcttgcccaggtctgatgtgtgtcttccagggatactcatccaaaggcttgatccaacggtcagtatttaacctccaaatctacggagtgctcgggcttttctggactctgaactgggtgctggcactgggacaatgtgttcttgccggagctttcgcgagtttctactgggcttttcacaaaccacaggacattcctaccttccctcttatttcggcctttatacggacactcagatatcataccggttccctggcctttggggcactaatattgacactagtacagattgcacgcgtgatcctggagtacatcgaccataaattacggtag

SEQ ID NO: 206288 - DNA, 2133 bp, Artificial Sequence
  Description of Artificial Sequence: Synthetic coding sequence
atgggcggcaagcagcgggacgaggacgacgaggcctacggcaagccagttaaatatgacccgagtttcagagggcccataaaaaaccgctcatgcacagacgtgatttgctgtgtcttgtttctcctgttcattctgggatacattgtcgtaggcattgttgcatggctgtatggggatccaagacaggttttatatccccgcaattccacgggtgcctactgcggaatgggcgagaataaggataagccgtacctcttatatttcaatatattttcttgtatcctgagcagcaacatcatttcagttgcggaaaacggcctgcagtgccccacccctcaagtgtgtgtatccagctgcccagaggatccttggacggttgggaagaatgagttttcccaaaccgtgggcgaggttttttatacaaaaaataggaatttctgtctaccaggtgtgccttggaacatgaccgtcatcacatcccttcagcaggagctatgccctagtttcctgctgccttcagcaccagccctcgggcgctgctttccatggactaacatcacccctcccgccttacccggcataacaaacgatactacaattcaacagggaatatcaggactgatagactccttaaatgccagagatatctcggtgaagatttttgaggacttcgcgcaaagctggtactggattctggtggccctgggggtggcactggttctttcactgctatttattctgttacttcgattggtggcgggtcctctagtgctcgtcctgattcttggagtcctgggagtgctggcctatggtatatactactgctgggaagagtaccgggtattgcgggacaagggcgcatcgattagccagcttggctttactaccaaccttagcgcttatcagtcagtgcaggaaacatggctggctgccctgatagttctcgcagtgctggaagcaatcttactgctagtgctcatattcctaaggcagagaatacggatcgcaatcgccctgttaaaagaggcaagcaaggccgtcgggcagatgatgagtaccatgttctaccccctggtgacgtttgtgctcttacttatctgcatcgcctactgggctatgacagctctgtatctggccaccagcgggcagccacagtatgtgctgtgggcgtcaaacatctcctcccccggctgcgaaaaggttccgattaataccagctgtaatccgacagcacatttggtaaattcttcctgcccaggcttgatgtgcgtcttccagggctattcctcaaaagggctgatccaacgctccgtttttaatctgcagatctatggcgtcctggggctgttctggaccctcaactgggttctggcgctaggccaatgcgtcctggcaggggcgtttgcttcgttctactgggcgtttcacaagccccaagatatccctacgttcccgttaatttctgctttcattcgcactctgaggtaccacaccggcagccttgcatttggcgcactcatactgactctggtccaaatcgcgagggttatcttggaatacatcgatcacaaattgcgtggagttcagaaccctgtggcccggtgcattatgtgttgcttcaaatgttgtctctggtgtcttgagaaatttataaagtttttaaataggaatgcctacataatgattgccatttatgggaagaacttctgcgtgagtgcaaaaaacgcgttcatgctgcttatgcggaatatagtccgggtcgtagtgcttgataaggtgactgacctcctcctgttctttggcaagctgctcgtggtaggcggtgttggcgtcctatcctttttttttttttctgggcgcattcccggcctcggcaaagattttaaatctcctcacctcaattactactggttacccatcatgaccagcatactgggtgcttacgtcattgcctccggcttcttcagtgtctttggcatgtgcgttgacactctgtttctttgtttcttggaagacctggagaggaataacggctcactcgatcgtccttactacatgtcgaagtctttgctcaaaatcttgggcaagaaaaacgaggctcctccagataataaaaaaaggaaaaagtag

SEQ ID NO: 206289 - DNA, 1236 bp, Artificial Sequence
  Description of Artificial Sequence: Synthetic coding sequence
tgacgggacgaggacgacgaggcctacggcaagcccgtgaagtacgatccttctttcaggggccccatcaagaaccggtcttgtaccgatgtgatctgttgcgtcctgtttctgttgtttatcctgggatatatagtggtgggaattgtcgcctggctttatggtgacccacggcaggtgttgtatccacggaacagtacaggtgcttactgtggaatgggagaaaataaagataaaccatatcttctctatttcaatatttttagctgcattttaagcagtaatatcatatccgtggccgagaacggcttgcaatgtcctactccccaggtctgtgtttcttcatgcccggaagacccatggaccgtgggaaagaacgaattcagtcagacagtcggagaggtcttctatacaaaaaaccggaatttctgtctgcccggcgtgccatggaacatgactgtgatcacttccctgcagcaggagttatgcccatcttttctattaccctccgcccccgcgctgggcaggtgctttccctggaccaatattactccaccagctctccccggcattacgaacgacacaactatccaacagggcatcagcgggctgattgactccctaaatgctcgggacatctcagtgaaaatctttgaggacttcgcccagtcctggtattggattcttgtcgcagtcgggcagatgatgtctacaatgttctaccctctggtgacattcgtgctgcttctcatatgtatcgcatactgggcaatgacagccttgtaccttgccacctcagggcagcctcaatatgttctttgggcctcaaacattagtagccccggatgcgagaaagtgccaataaatacatcttgcaatcccacagcccacctcgtgaattcctcctgtccgggtttaatgtgcgtgttccaagggtatagctccaagggcctgatccagcggtcagtgtttaaccttcagatttacggcgtgttgggcctgttttggaccctcaattgggtgctcgcactagggcaatgcgtgttagcgggagcctttgcctcgttttattgggcattccacaagccacaggatatacccactttccccctcatttcggcttttataaggactctccggtatcataccggcagcctcgcctttggagctctgatacttaccctggtacaaatcgcccgtgtgattcttgaatatattgaccataagctgcggtag

SEQ ID NO: 206290 - DNA, 2133 bp, Artificial Sequence
  Description of Artificial Sequence: Synthetic coding sequence
atgggcggcaagcagcgggacgaggacgacgaggcctacggcaagcctgtgaaatacgacccaagctttcgcggtcctattaaaaaccggtcttgcaccgatgtgatatgttgcgtactgttcctgttgtttattctgggctatatcgtggtaggcattgtggcctggctgtatggtgacccccgacaggtcctgtacccccgtaattctacaggcgcatactgcggcatgggggaaaacaaagacaaaccttatctcctgtactttaacattttctcatgcatactttcctctaacataatctccgtggctgagaatggactccagtgcccaacacctcaggtgtgtgtttcctcttgccctgaagatccttggaccgttggtaaaaacgaattctcccagacagtcggggaggtcttttacactaagaatcgaaatttctgcctcccaggcgtgccctggaacatgactgtcatcacttctctccagcaggagctctgtccgagcttccttctccccagcgcacctgcccttgggcgatgcttcccttggaccaatgtgaccccccccgcactgcctggaattactaacgacaccaccattcagcaaggcatcagcgggctcatcgatagtcttaacgcccgcgacattagtgtgaagattttcgaggattttgcccagtcttggtactggatactagtggcgctgggcgtcgcgcttgtcctgagtttactttttatcctgctgctgcgtctcgtggccgggcctcttgttctggtgttaattctgggcgtgcttggtgtcttggcctatgggatttactactgctgggaggagtatagggtacttagggacaagggcgcttccatttctcaacttggctttacaacaaacctgtctgcataccaatcagtccaggaaacctggctggccgccttgatcgtgctcgctgttctcgaagccattctgctactaatgcttatctttctcaggcagcggattcgtatcgccatagccttactgaaagaggcatctaaagctgtcgggcagatgatgagtaccatgttttatcccttggttacgttcgtcctcctgctaatatgcatagcctactgggccatgactgcactgtacttggctacaagtggccagccacagtacgtcctctgggcctccaatataagcagtcctggatgtgagaaggttcctataaatacttcctgtaatcctaccgcccatctggtaaatagcagctgtcctggactcatgtgtgtgttccagggctactcttccaaaggactgatacagcgttcagtattcaacctgcagatatatggagtgttaggcttgttttggacacttaactgggtgctggccctgggccagtgtgtcttggcgggcgccttcgcctctttctactgggcatttcataaaccccaagatatccctacctttcctctcatttctgcttttattagaacactgagatatcacacgggcagtctagccttcggtgctctcattctcacactggtacagattgcccgggtcatcctagaatacattgaccacaaactgagaggggtgcagaaccccgtagcacgttgcatcatgtgttgttttaaatgctgcttgtggtgcttggagaagtttataaaattccttaaccgcaacgcatacatcatgatcgctatctatggaaagaatttctgcgtcagtgccaagaacgctttcatgctgctcatgcgaaacattgtgcgcgtggtggtcctggataaggtcacggacttgctgctgtttttcgggaaactcctcgtggtggggggggtcggcgtgctcagttttttttttttcagcgggcggattccaggtcttggcaaggacttcaaaagtccccatctgaactactactggcttcccattatgacatctatcttgggagcctacgtgattgccagcggcttcttttctgtctttggaatgtgcgtcgacacattgttcttatgtttcctcgaggatctagaacggaacaatgggagcctggataggccctattatatgtctaagtccttgcttaagatcctcggcaagaagaatgaagcccctccagataataagaagcgaaagaagtag

SEQ ID NO: 206291 - DNA, 1236 bp, Artificial Sequence
  Description of Artificial Sequence: Synthetic coding sequence
tgacgggacgaggacgacgaggcctacggcaagcccgtgaagtacgacccatcattcagaggaccaatcaagaacagaagctgcacagacgtgatctgttgtgtgctgttcctgctcttcatcctagggtacattgtggtcggaatcgttgcgtggctttatggagacccccggcaggtgctctaccctcgcaattccactggcgcctactgtggcatgggcgaaaataaagataagccttatctcttatatttcaatatatttagctgcattctctcgtccaatatcatctctgtggctgagaacggactgcagtgcccaacgccccaggtgtgcgtgtctagctgtccagaggatccctggacagtgggcaagaatgaatttagccaaacagtcggagaagttttttacactaaaaatcggaacttctgtctgcctggggtaccctggaacatgacagttatcacttctttgcaacaggaactttgtcccagctttctcctgcccagtgcaccagcactggggcgctgtttcccatggacaaacgtgacaccacctgcactgccgggtataacaaatgatacaactatccagcagggtatatcgggtctgattgatagcttgaatgccagggacatcagtgtgaaaatcttcgaggattttgcccagtcatggtattggatcttggtggcagtggggcagatgatgagcaccatgttttatccgcttgtaacctttgttttgcttctgatctgtatagcatactgggcaatgactgcactgtatctcgctacatccggacaaccacagtacgttctctgggcttcaaacatcagcagccctggctgcgaaaaagtgcctattaatacctcttgcaatcccacagctcacctggtgaatagctcctgtcctggcctgatgtgcgtgttccaaggctactcgagtaaaggtttgattcaaaggagcgtgttcaatctacaaatctacggtgtgctgggcctattttggacactgaactgggtactggcactgggccagtgcgtgttagcaggtgcttttgccagtttttattgggcctttcacaaaccccaggacattcccaccttcccgctgatcagtgcattcattcgtacccttcggtaccatactggctcgctagccttcggtgcgctgatcctgacgctggtgcagatcgctcgcgtgattctggagtatattgaccataagctgcgatag

SEQ ID NO: 206292 - DNA, 1905 bp, Artificial Sequence
  Description of Artificial Sequence: Synthetic coding sequence
atgggcgagaacaaggacaagccctacctgctgtacttcaacatcttttcatgtatcctctcctcaaatatcatttccgtggcggagaatgggctgcagtgtcccacaccacaggtgtgcgtctcaagctgtcctgaggatccctggactgtggggaagaatgagtttagccagaccgttggcgaggtattctatacaaaaaatcggaacttctgtctgcccggcgtgccttggaacatgacggtaatcacctccctgcagcaggagctgtgccccagctttctgctgccttccgctcccgcactaggacgctgttttccctggactaacgtaacgccccccgctctcccgggcattacaaacgatacaaccatccagcagggaatctcaggcttgatcgacagtcttaacgcacgtgatatctccgttaaaatctttgaggattttgcacagagttggtattggatcctggtcgcgttgggggttgccttggttctttctctgctctttattctgctactgcgcctcgttgctggtcctctggtgctggtgctgatcctcggcgttcttggggtcctggcctacggtatctattattgttgggaagaatatcgagtcctcagggacaaaggtgcatctatcagtcagcttggattcaccactaatttgtccgcataccaaagcgtgcaggaaacttggctcgccgccctgatcgtgctcgcagtgctagaggctatcctgctgcttatgctcatttttctgaggcagcggattcgtatagccatcgcccttctgaaggaggcctctaaagccgtggggcaaatgatgtcaacgatgttttatccattggtgacttttgtcctcttgctgatttgcatagcctattgggcaatgaccgccctctacctcgctacttcaggccagcctcagtacgtcctgtgggcgtcaaatatttctagcccgggttgcgagaaggtacccatcaacacctcttgtaatcctactgctcatctggtgaattcatcatgtccaggattgatgtgcgtttttcagggctacagttcaaaggggctgatacagaggtctgttttcaatttgcagatctacggggtgctgggattgttttggacgctcaattgggtgctcgcccttggtcaatgtgtcttggccggcgcctttgcttcgttctactgggcctttcataagccacaagacataccaacattcccactgatctcagcgttcatcagaacgctgcgataccacactggatctctcgccttcggagcactaatactcaccctcgttcagatcgctagagtgattctcgagtacatcgaccataaacttcgtggcgtacaaaatcccgtcgcaagatgcattatgtgttgctttaagtgctgcctgtggtgcttggaaaaatttatcaaattcctcaaccgtaacgcctacattatgatcgccatctacggcaaaaatttctgcgttagcgcaaagaacgccttcatgctgctcatgaggaatattgtccgagtagtggtgctagataaagtaaccgatctgctgttattctttggcaaactcctggtcgttgggggggttggtgtgttaagtttctttttcttttcaggccgtatccccggtctcggcaaagatttcaagtctccccaccttaactactattggttaccaattatgacctccattctcggcgcatacgttatcgcatctgggttcttcagtgtcttcggaatgtgcgtggacacactgttcctttgtttcctggaagatttggaaagaaataacggcagcctcgatcgcccttactatatgtcgaagagtctcctgaagatcctgggaaagaaaaacgaggctccaccagacaataagaaaagaaagaagtag

SEQ ID NO: 206293 - DNA, 1905 bp, Artificial Sequence
  Description of Artificial Sequence: Synthetic coding sequence
atgggcgagaacaaggacaagccctacctgctgtacttcaacatcttctcctgtatcctgtctagcaacatcataagcgtggccgaaaacggccttcagtgtcccacccctcaggtctgcgtgtccagctgccctgaagacccttggactgttgggaaaaatgaattttctcaaactgtcggagaagtgttttacaccaaaaaccgcaatttttgcctacctggcgttccctggaacatgaccgtgattacatctttgcaacaggaactgtgccccagctttcttttgccgtccgcccctgccctggggaggtgcttcccttggaccaacgttacacctccagctctacccggcatcacgaacgacactacaattcagcaggggatcagtggactaatcgattccctaaacgcccgcgatatatctgtcaaaatctttgaggacttcgctcagtcctggtactggattcttgttgcgctgggggttgccctagtcctgagtctgctgtttatcctgctgctgcgacttgtcgccggcccgctcgtcctcgttctgattctgggagtgttaggcgttctggcctacggaatttactattgttgggaggagtaccgtgtcctgagagacaagggcgcttccattagccagctcgggttcactaccaatctatcggcgtatcagagcgtgcaggaaacctggctggctgccttgatcgtgctcgccgtcctggaagccatcctcctactgatgctgatcttcttgagacagaggatcaggatcgccatcgcactgctgaaggaggcaagtaaagccgttggtcagatgatgagcaccatgttctatccgctcgttaccttcgtcctgctgctcatttgtattgcctattgggcgatgactgctctgtaccttgcaaccagtgggcagccgcaatatgttctgtgggcaagcaatatcagcagtccgggttgtgagaaggtacccataaacacaagttgtaaccctaccgcgcacctggttaactcttcctgtcctggcctaatgtgtgtttttcagggttacagtagcaaaggactaatccagaggtctgtgttcaatctgcaaatctatggggttctcgggctgttttggacactgaactgggtcttggcactcgggcagtgcgtgctggccggcgcatttgccagtttttattgggccttccacaagccgcaggacattcccactttccctttaatctcagcgttcatccgcacactgcggtatcatactgggtctttggcattcggcgcactgattctcacacttgtgcaaattgcccgtgttatccttgaatacatcgaccataaactgcgcggagtgcaaaaccccgttgcccgatgcataatgtgttgcttcaagtgttgcctctggtgcctggagaagttcatcaagttcctcaatcggaacgcttacatcatgatcgccatttatggcaagaacttttgtgtgtccgccaagaatgcctttatgctactgatgagaaacatcgtgcgggttgtggttctcgataaagtgacagatctacttctttttttcggaaaactcctcgtcgttgggggagtcggggtgctatcctttttcttttttagcgggcggatccctgggctcggtaaagattttaagagcccccacttaaactactactggttacccatcatgacctcaattctgggagcctatgtcattgcatcgggcttcttttccgtgttcgggatgtgcgtcgatacactgttcttatgttttttggaggacctcgaaagaaacaatgggtcacttgatcggccatattatatgtctaaatcccttttgaaaatcttaggaaaaaaaaacgaggcccctcccgataacaaaaaaagaaagaagtag

SEQ ID NO: 206294 - DNA, 1905 bp, Artificial Sequence
  Description of Artificial Sequence: Synthetic coding sequence
atgggcgagaacaaggacaagccctacctgctgtacttcaacatcttctcgtgtattctttccagcaacatcatctcggtggccgagaacggcctccagtgtcctacccctcaggtttgtgtttcctcatgccctgaagacccctggacagtgggcaagaatgagttctcccagacagtgggcgaagtcttctacacaaagaatcgcaacttttgtctgccgggagtgccgtggaatatgacagtcatcactagcctgcagcaggagttgtgtccgagctttctgcttccttctgctcccgccctgggtaggtgtttcccgtggacgaatatcaccccacccgccctgccaggcatcacaaacgatacaactatccagcaggggattagtgggctgattgactccttgaatgcccgtgatatttccgttaaaatcttcgaggacttcgctcagtcttggtattggattctggtggccttgggcgtggctttagtgctttctctcttattcatcctattgttgagactcgttgcgggtcctctcgtgctggtgttgatccttggagtcctgggtgtgcttgcctacgggatttattactgctgggaggagtatcgagtgctgcgtgataagggggccagtatctcacagctgggctttacaactaatctgtccgcttaccagtccgtccaggagacatggctggctgctctcatcgtgcttgccgtcctggaggccatattgcttttagtcttgatttttctccggcagcgcatccgaatcgcaattgcactgctaaaggaggcgtccaaggcagtaggccagatgatgtccacgatgttctaccctcttgttacgttcgtgttgttgctcatttgcatcgcctactgggctatgaccgcactgtacctcgccaccagcggtcagccccaatacgtcctttgggcctccaacatctcgtctccgggttgcgaaaaagtccccatcaacacttcgtgcaatccgactgcccacctggttaatagttcctgccctggcctaatgtgcgtcttccaaggttatagttccaaaggacttattcagcggagtgtgtttaacttacagatctatggggtcctgggcctattctggactctgaactgggttctggctttgggccagtgcgtgttagcaggggcattcgcttctttttactgggcttttcataaacctcaagacatcccaaccttcccactcatttccgccttcatcaggaccttaaggtatcacacgggaagtctggccttcggggccctgatccttaccctggtccagattgctagggtgatcctggagtatatagaccacaagcttcgcggagtgcagaatcccgtcgctagatgtatcatgtgctgtttcaagtgttgcctgtggtgcctcgaaaagtttatcaagtttctcaacaggaatgcctatatcatgatcgctatctacggaaaaaatttttgtgtgtctgctaaaaatgcctttatgctactcatgaggaatatcgtgcgtgtcgtcgtacttgacaaggttacagacttgcttcttttttttggcaagctgctggttgttgggggcgtcggcgtcctaagtttttttttctttagtggaagaattccaggccttggcaaggattttaaaagtccgcacctgaactactattggctgccaataatgacgagtatcttaggagcttacgtcatcgcgtctggctttttcagcgtgttcggcatgtgtgtggacacactgttcttgtgttttttggaggatctggaacggaataacggctcgctcgatcgcccttattatatgtcaaagagcctgctaaaaatactcggtaagaagaacgaggccccaccagacaacaagaaaagaaaaaagtag

SEQ ID NO: 206295 - DNA, 2007 bp, Artificial Sequence
  Description of Artificial Sequence: Synthetic coding sequence
atgggcggcaagcagcgggacgaggacgacgaggcctacggcaagccggtgaagtatgatcccagctttagggggccaattaaaaaccgctcatgtactgacgtcatctgttgtgtgctgtttctcctcttcatactgggatatatagtcgtgggaatcgtcgcctggctgtacggcgaccctcgccaggtcctgtatcccaggaattctaccggggcatactgcgggatgggcgagaacaaggacaaaccatacctactgtatttcaatattttctcttgcattctgtctagtaacattattagcgttgctgagaacgggttacagtgtcctactccacagactgtgattactagcttgcagcaggagctgtgtcctagttttctccttccttccgcgcccgccctgggtagatgttttccttggacaaacatcacccctcctgccctcccaggtatcacaaatgacaccacaatacagcaaggtatttccggtctgattgattccctaaacgcgagggacataagcgtgaagatttttgaagacttcgcacagtcgtggtactggatactggtcgcgctcggagtggcattagtgctgtctctactctttatcctcctgttgcgcctcgtggctggacccttagtgctggtactaatcttaggggtgctgggcgtgctcgcatatgggatttactattgttgggaggagtatcgagtccttagagataagggagcttctataagccagctcgggtttacgactaacttgagcgcatatcagtccgtgcaggaaacgtggctggcggcactgatcgtactagccgtgctggaagcaattctgctgctggtcctaatcttcctgcgccaacgcatcagaatcgctattgccctccttaaagaggcctccaaggcagtgggtcagatgatgtcgactatgttctatcctctggtcacattcgtgcttctgcttatctgcatcgcatactgggctatgacagctctgtatctagcaacatcagggcagcctcagtatgtactctgggctagcaatatcagcagcccaggatgcgaaaaagtgccaatcaacacttcctgcaatcccaccgctcacctggtgaactcatcatgcccagggctaatgtgcgttttccagggatactcaagcaaaggcctgatacagcgctccgtgtttaacttacagatctacggagtactcggattgttttggacgctaaactgggtactggctctaggccagtgtgtgctggcaggggcctttgcctccttttattgggcattccacaagcctcaggatatccccactttccccctaattagtgcattcattaggacactccgttaccacaccggctcacttgcgttcggagcacttattctgacgctggtgcagatagcaagagtcatactggagtacattgatcacaaactgagaggcgttcaaaatccggtggctaggtgtattatgtgttgcttcaagtgctgtctgtggtgcctcgaaaaatttattaagtttctcaaccgcaacgcctatatcatgatcgccatctatggtaaaaacttctgcgttagcgccaagaatgcctttatgctgctgatgagaaacatcgtgcgcgtcgtcgtgttggacaaagtcaccgatttgctcctcttctttgggaagctgctcgtagtgggaggcgttggcgtccttagcttcttttttttctccggacgaataccaggtctgggcaaggactttaagagtccccatttgaattactattggcttccgatcatgacatccatccttggcgcctacgtgatcgcctctggattcttctcagtcttcggcatgtgcgtggacaccctgtttctgtgcttcctggaggatctcgagcgaaataacggctctcttgaccgcccgtactacatgtccaaatcactgcttaaaatcctgggcaagaagaacgaagcgccacccgacaacaaaaagcgcaaaaagtag

SEQ ID NO: 206296 - DNA, 1905 bp, Artificial Sequence
  Description of Artificial Sequence: Synthetic coding sequence
atgggcgagaacaaggacaagccctacctgctgtacttcaacatcttttcatgcatcctgtcgagcaacataatcagcgtggctgagaatggcctgcagtgtccaactccacaggtatgcgtttcctcctgtcctgaggacccctggacagtagggaagaacgagttcagccagactgtaggggaggtgttctatacaaagaaccggaatttctgcctgccaggggtcccttggaatatgacggtaatcaccagcctccaacaggagctgtgccctagctttctcctccctagcgcaccggctctgggaaggtgcttcccatggaccaatgtgacacctccggcgctgcctggaattacaaacgatactacaattcagcagggcatttctgggctgattgattcactcaacgcacgagacatctccgtgaaaatctttgaagactttgcacaatcttggtattggatcctggtggcacttggggtcgccctggtgctgagtctgctgttcatactcctgcttaggctggtagccggcccgctggtcctggtactcatcctcggcgtgctgggggtcctggcctatggaatctattactgctgggaggagtaccgggtgctgagggacaagggggcctcaatcagtcaactcggattcacaacaaatctgagtgcttaccagtccgttcaggaaacgtggctggccgcattaattgtgcttgcggtgctagaagctattctcctgttgatgttgatcttccttcggcagcgcattagaatagcaatcgcacttctcaaggaagcttctaaggccgtgggccagatgatgtcaacaatgttctacccactggtgacattcgtcttactccttatatgcatcgcatactgggctatgaccgcattatacctcgccacgagtggccagcctcagtacgttctgtgggcttcaaacatctcttctcctggctgtgaaaaagtgcccatcaatactagctgcaatccaacagcgcatctcgttaatagttcctgccctggactgatgtgcgttttccagggctactctagcaaaggcttgatccagagaagcgttttcaatctacagatatatggagtcctgggtctgttctggaccctgaattgggtgctggctctgggacagtgcgtacttgccggcgcctttgccagtttctactgggctttccacaagccccaggatattcctactttcccactgatctcagcattcatacgtacccttcgttatcacacaggatccttagccttcggggcacttatcctaacactcgttcagatcgcccgggttatcctggagtatattgaccataagctacggggtgtgcaaaacccagtggcccggtgcatcatgtgttgctttaagtgttgcctgtggtgcttagagaaattcatcaagttcctgaaccggaatgcatatatcatgattgccatctacgggaagaacttttgcgtgtctgccaagaacgcattcatgctcctcatgagaaatatcgtgagagtggtagtgctggacaaagtcaccgatttactgctatttttcggtaagctactcgtggtaggaggcgtaggagtactctctttctttttcttctcaggcaggatccctggactcggcaaggattttaagtctcctcacctcaattactactggctcccaataatgaccagcattcttggcgcctacgtgattgcgtcgggatttttctcagtgtttggaatgtgcgtcgacacactttttttgtgctttttagaagatcttgaacgcaacaacggcagcctggaccgcccatactacatgagcaaatccctgttgaagatcctaggcaagaagaacgaagctccacctgataacaagaaacgaaagaagtag

SEQ ID NO: 206297 - DNA, 1905 bp, Artificial Sequence
  Description of Artificial Sequence: Synthetic coding sequence
atgggcgagaacaaggacaagccctacctgctgtacttcaacatcttcagctgtattcttagcagtaatatcattagtgttgccgagaacggcctgcagtgtccgactcctcaggtgtgtgtgagctcctgccccgaggacccatggactgtgggaaagaacgagttcagccaaaccgtcggtgaagtgttttacactaaaaatcgaaacttttgcctccctggagtgccctggaacatgacagtcatcacatcattgcaacaggagctgtgccccagttttctgctcccaagcgcacccgccctggggaggtgttttccgtggacaaatgtgacaccaccggccctaccagggatcaccaacgatacaaccatccagcaaggaatcagcgggctgattgacagtctgaatgctagggacatttctgtgaagatcttcgaggattttgcacagtcctggtactggatcctggtcgctctcggcgtggctctcgtgctttccctcctcttcatacttctcctgaggctcgtcgctgggcctctggtcttggtgttaattctgggagtgcttggcgtgttggcctacgggatctactactgctgggaggagtacagagtcctacgggataaaggtgcgagcattagccagttgggttttaccaccaacctgagtgcataccagagcgtgcaggagacgtggcttgctgcattgattgtgttggctgttctagaggccatcctgctacttatgctcatcttcctgcgccagcgaatcagaatagccatagccctgctgaaggaggcgagtaaggcagtgggtcaaatgatgagcacaatgttctacccattggtcacattcgttctgctcttaatctgcatagcctactgggccatgacagctctgtatctcgctacctcaggccagcctcagtatgtgctgtgggcgtctaacatatcttcccccgggtgcgagaaagtgccaatcaatacaagttgtaatcccaccgcccatcttgtcaacagcagctgtcctggtctcatgtgcgttttccagggatactcaagcaagggtcttatccagagaagtgtgttcaacctgcagatttacggtgtcctggggcttttctggacactgaactgggtcctggccctaggccagtgcgttctggccggagctttcgcctctttctattgggctttccacaaaccacaggatatcccaaccttcccactcatttctgccttcataaggacactcagataccatacaggaagcctggccttcggagcgctcattctgaccctggtacagatcgctcgcgtgattctcgagtacatcgaccataagctcaggggcgttcaaaaccctgtggctcgttgtatcatgtgttgctttaagtgctgcttgtggtgtctggaaaagttcatcaaattcttaaaccggaacgcctatataatgatcgctatctacgggaaaaacttctgcgtgtccgctaaaaacgccttcatgctgctgatgcgaaacattgtgcgggtggtggtgcttgataaagtgacagacttactcctcttctttggtaagctcctggtagttggtggagttggcgttctgtcctttttcttcttttctggtcgtatccctggcctgggcaaggacttcaagtctccgcatttgaactactattggctgcccatcatgacgagtattcttggcgcatacgtcattgccagtgggtttttttctgtcttcggcatgtgcgtggacactctcttcctgtgttttctcgaagatctcgagcgcaataacggctcgttggacagaccatactatatgagcaaatctttgttaaaaattcttggtaaaaagaatgaagctccgcccgataacaagaagaggaagaaatag

SEQ ID NO: 206298 - DNA, 2007 bp, Artificial Sequence
  Description of Artificial Sequence: Synthetic coding sequence
atgggcggcaagcagcgggacgaggacgacgaggcctacggcaagcctgtgaaatatgaccccagcttccggggccccataaagaacagatcttgtacagacgtcatttgttgtgtgctgttcctgctctttattctgggctacatagtggtgggcattgttgcgtggctctatggagatcccaggcaggtactgtatccgaggaacagtaccggcgcttattgcggcatgggcgagaacaaagacaagccctacctgctctatttcaatatcttttcttgtattctctcctccaacatcatttccgtggccgagaatggtctgcagtgtcccaccccccaaaccgtgattacaagcctgcagcaggagttgtgcccttctttcctgttacccagcgcccccgctctggggagatgtttcccctggactaatgtgacaccccccgccctgccaggtatcactaatgataccaccatccagcagggaatctctggtctcatcgatagcctgaacgctagggatatttccgtaaagatcttcgaggactttgcacagtcctggtattggatcctggtggcactcggggtggccctggtgcttagcctcctgttcatactgcttctgcgtctcgtcgctggccccctagtgttggtacttatcctgggtgtactgggcgtgttagcctatggtatttattattgttgggaagaataccgcgtgcttcgggacaaaggagcatctattagccagctcggattcactacgaacctttcagcgtaccagagtgtgcaggagacctggcttgctgccctgatcgttctcgcggtgttggaggctatcctgctgttgatgttgatctttctgaggcaacgcattaggattgctatcgctcttcttaaagaggctagtaaagcagtgggacagatgatgtccacaatgttctatccactggtcacttttgtcctgctgttaatctgcatagcctactgggcaatgaccgctctttacctggccaccagtggccagcctcagtatgtgctctgggcatctaacattagttcccctggctgcgaaaaagtaccaatcaacacgtcctgcaatccaactgcccacctggtgaacagcagctgccctggcctaatgtgtgtgtttcagggttattcctctaagggtctgatccagcggagtgtgttcaatcttcagatatatggggtgctgggactgttctggacacttaactgggtgctcgcactcggccagtgtgtcctggccggagcctttgcaagcttctactgggccttccataaaccccaagacattccaacattcccactgatttccgctttcatccgcacactcagataccacactgggtcattggccttcggcgctctcatattgacacttgttcagatcgctagggttatcctggaatacatcgatcacaaactgagaggcgtacagaacccagtggcgagatgcataatgtgttgcttcaagtgttgtttgtggtgcttagagaaattcatcaagtttctcaacaggaacgcctatatcatgatcgccatttatggaaagaacttctgtgttagcgccaagaacgcctttatgttgctaatgagaaatatcgtaagagttgttgtattggacaaggtcacggacctgcttttgttcttcgggaaattgctcgtggtaggcggggtcggtgtcctctccttcttcttctttagtggcaggatcccaggcttagggaaagacttcaaaagtccacatcttaactactactggttgcctataatgacttcaatactgggcgcctacgtcattgcgtcgggcttcttctctgtatttggcatgtgcgttgacacactgttcctgtgttttctcgaggacctggaacgcaataacggttctcttgaccgcccttactacatgtcgaagagcctcctgaaaattctgggtaaaaaaaacgaggcacctcctgacaataagaagcggaaaaagtag

SEQ ID NO: 206299 - DNA, 2007 bp, Artificial Sequence
  Description of Artificial Sequence: Synthetic coding sequence
atgggcggcaagcagcgggacgaggacgacgaggcctacggcaagcccgttaagtacgaccctagcttccgcggcccgatcaaaaataggagttgcacagatgtcatctgctgcgtcctgttcctgctgtttatccttggttatattgtggtcggcattgtggcttggctctatggtgacccgcgacaggttctatacccccggaactccaccggggcctactgcggcatgggtgagaataaagacaaaccatatctgctgtatttcaacatcttttcgtgcattctctccagcaacattatcagcgtagccgagaacggattgcagtgtcccacccctcaaactgtgataacatccctgcaacaggagctgtgccccagttttttactcccatcagcacccgctttaggtaggtgtttcccatggactaatgtgactccgcctgcgctcccaggcataactaacgatactacaatccagcagggcatttcgggcctgattgactcactgaatgcacgcgacatatccgtcaagatcttcgaggactttgcccagagctggtactggatcttggtggccttgggtgtggctctcgtgctgagccttctgttcatcctgctgctgcgattagtcgctgggcctcttgtcttggtgctgatcctgggtgtattgggcgtgcttgcgtatgggatttactattgctgggaagaatatagagtcctgcgggacaagggtgcgtccatatctcagcttggttttactacaaacctgagcgcctaccagtccgtgcaggagacttggctggctgctctgatcgtcctggccgtacttgaggcaatccttctgctgatgctgatatttctaaggcaaagaataagaatcgccattgccctgctgaaggaggctagtaaagccgtcggacagatgatgtcaaccatgttctatcctctcgtcaccttcgtcctgctgctgatctgtatagcatattgggccatgacggccctttatctcgcaacttcaggtcagccccaatacgtgctctgggcctcgaatatctctagtcctggatgcgaaaaggtacctattaatacctcatgcaatccgacagctcacctggtcaattcaagttgccccggtcttatgtgcgtgttccagggttactcatccaaggggctgattcagagatctgtttttaacctccagatctatggcgtcctcggccttttctggacactgaattgggtcctggccctgggtcagtgcgtgctcgcaggggcttttgcttccttctactgggccttccacaaaccacaggacatccctacattccctctcatcagcgcttttatccgcactctcaggtaccacaccggatctttggcatttggtgccctgattctaaccctggtgcagattgctagagttatcctggaatacatagatcataagcttcggggcgtccagaatcccgtggcccggtgtatcatgtgttgctttaagtgttgcctatggtgtctggagaagttcatcaaattcctgaataggaatgcatacataatgattgctatctacggaaagaatttttgcgtatccgccaaaaatgcctttatgctgttaatgcgaaacattgtacgtgttgttgtactggacaaggtgaccgatctcctactgttcttcggtaagctccttgtagtgggcggagttggtgtgttgtcttttttcttttttagcgggagaatccctggccttggtaaggacttcaagagcccccatttaaactattactggctccctataatgacttctattctgggcgcttacgtgatcgccagcggatttttcagcgtttttggaatgtgtgtggacaccctgttcttgtgcttcctcgaggatctggagcgtaataacggaagcctggacaggccctattatatgtccaagtccttgctgaagatcttgggtaaaaaaaatgaggccccccccgataataagaagaggaagaaatag

SEQ ID NO: 206300 - DNA, 2007 bp, Artificial Sequence
  Description of Artificial Sequence: Synthetic coding sequence
atgggcggcaagcagcgggacgaggacgacgaggcctacggcaagccagtgaagtacgatccaagcttcagaggcccaattaagaaccggtcttgcactgatgtgatttgctgcgtcttgttcctcctgtttatactcggctatattgttgtcgggatcgtggcttggctgtatggggacccacgccaggttctgtacccccgcaactcaaccggggcctactgcggcatgggcgagaataaggacaaaccctacctgctttactttaacatctttagctgtattctctcttcaaacatcatctctgtagccgaaaacggacttcagtgccctacgccacagaccgtgattacttcactgcagcaggagctgtgccccagctttctccttcccagcgcacccgcccttggcaggtgcttcccttggaccaacatcacgccacctgcactaccaggtatcaccaacgatacaaccatccagcaaggcatctcggggctgatcgattcgttaaacgccagggacatctcggttaagatttttgaggacttcgcccagtcttggtactggatcctggtggccttgggtgtggccctggttttgtccttgttgtttatacttttgctgaggctggtggccggacccctggtactggtgctaattttaggggtgctgggagttctggcttatggtatttactattgctgggaggaataccgtgtcctgcgggataagggtgcatccatttcgcagctgggattcactacaaatctcagcgcttaccagtctgtgcaggagacgtggctggccgcgctgatcgttctcgccgtcctcgaggccatactcctgctggttctgatattcttgcgccagcgcatccgcatagccatcgcgctgctgaaagaggccagtaaagccgtcggccagatgatgagcacaatgttctaccctttagtaacttttgtgcttcttctgatttgcatagcctactgggctatgactgcattatatttagccacgtctggacagcctcagtacgtgttatgggccagcaacatctcatcaccagggtgcgaaaaggttcccatcaatacatcatgtaatccaaccgcccacttagtgaactcgtcgtgcccgggtctgatgtgcgtgtttcagggatatagctctaagggtttgatccagagatctgtgtttaacctgcagatttatggggttttgggcctgttctggacgttgaactgggtgctagctcttggacagtgcgttctggccggggctttcgcatcattctattgggcgttccacaaaccccaagacatcccaacctttcctctcatttccgcctttattcgtacacttcgctaccatactggcagcctggctttcggggcgctcattttgaccttggtccagatcgcccgggttatcctggagtacatcgatcacaaactgaggggtgtccagaatcccgtggccagatgtatcatgtgctgcttcaagtgctgtctgtggtgtttagagaagttcatcaaattccttaaccgtaatgcctacatcatgatagctatttacgggaagaatttttgcgtttccgcaaagaatgccttcatgctcctaatgaggaatatcgtgagggttgtggttctggacaaggtgaccgacttactcctgttttttgggaagctactcgtagtcggaggagtgggagtcctcagcttcttcttcttctcagggcgcattcctgggttagggaaggatttcaaatcaccccacctgaattactactggctgccaataatgacatccatattgggggcttacgtgatcgcctcaggcttcttctctgtattcggaatgtgtgtggacacactgtttctgtgcttcctcgaagatctggagaggaacaacggatcccttgataggccctactacatgtcaaagtccctcctaaaaatactgggaaagaagaatgaggccccacccgacaataaaaagaggaagaagtag

SEQ ID NO: 206301 - DNA, 1905 bp, Artificial Sequence
  Description of Artificial Sequence: Synthetic coding sequence
atgggcgagaacaaggacaagccctacctgctgtacttcaacatctttagttgtatcctgtcatccaatataatctcggtggccgagaacggcctgcaatgccccactccccaggtgtgcgtgtcctcctgtccagaggacccttggactgtggggaaaaacgagttctcccaaaccgtcggagaagtattctacaccaaaaaccggaatttttgtctccctggtgtaccatggaacatgacagtgattacctctctgcagcaggagctgtgtccctctttcttattaccatcggccccagcccttggcaggtgctttccttggaccaatattactccgcccgcactgcctggaattaccaacgatactacgattcaacaaggaatctctggcctgattgattctctcaatgctagggatatctccgtaaagatctttgaggactttgcccaatcctggtactggatactggtggctttaggcgttgccctggtgctttctctgctctttatactgcttctgagactagtggccggccccttagtgcttgtgttgatccttggagtacttggagtgctggcctacggcatatattactgttgggaggagtatcgggtgctaagggacaagggcgctagcattagtcagctcggttttaccacaaatttgagcgcctatcagtcggtgcaagaaacgtggctggctgcacttatcgtcctcgcggtgctggaggccattttgctacttgtcctcatcttcttgaggcaaaggattcgaatcgcgattgcactgctgaaggaggcttctaaagcagtgggccaaatgatgtcaactatgttctatcctctagtgacattcgtactacttttaatctgcatcgcctactgggccatgacagccctctatttggccaccagcggccagccacaatacgtgctttgggcctctaacataagcagtcctgggtgcgagaaggtccctatcaatacctcttgtaaccccaccgcacacctggtcaactccagttgcccaggactgatgtgcgtgttccaaggatactcatctaagggcctcatccagcgttctgtctttaacttacaaatatacggtgtccttggactgttttggacgctcaattgggtgctcgctctagggcagtgcgtgttggccggcgccttcgcgtccttctattgggcattccataagccccaggacattcccacattccccctgatatctgcctttatacgtactctgagataccacacgggcagcctggcgtttggagctcttattcttactcttgtacagattgctcgagtcatcctggagtatatcgatcacaagcttcggggcgtgcagaacccagtggcacgctgtattatgtgttgctttaagtgctgtctctggtgtctagagaaatttatcaagtttttaaatcgcaatgcttatatcatgatagccatttatggaaagaatttctgcgtgtccgcaaaaaacgcatttatgctcctcatgcggaacattgtcagagtagtggttctcgacaaggtcacagatttgctgctgttctttgggaagttgttagtggtaggtggagtgggagtgctgtcattcttttttttctccggccgcattcccgggttgggaaaagactttaagtccccacacctcaactattattggcttcccattatgacatccatcctcggagcctacgtgatcgcctcaggattttttagtgtctttggaatgtgcgtcgatactttgttcctctgcttcctggaggatctagagcggaacaatgggagcttagaccggccatactatatgtcaaagtctctattgaaaattctcggcaagaagaatgaggcaccccctgacaacaagaaaagaaagaaatag

SEQ ID NO: 206302 - DNA, 2007 bp, Artificial Sequence
  Description of Artificial Sequence: Synthetic coding sequence
atgggcggcaagcagcgggacgaggacgacgaggcctacggcaagccggtgaagtatgatccatcctttcgcggacccataaagaacaggtcgtgcacggacgtcatttgctgtgtgttgttcttgctattcattttgggctatatcgtagtgggcattgttgcttggctgtacggcgatcctagacaggttctgtacccccgcaattcaaccggcgcttattgcggcatgggcgaaaacaaggataaaccctacctgctatacttcaacattttcagctgcattctgtctagtaatataatcagcgtggccgagaatggtctgcagtgtcctaccccgcaaaccgtcataacgtctctccagcaagaactgtgtccctccttcttgctcccaagtgcgccagcactggggcgttgcttcccgtggaccaacgtgaccccacccgcactgcctggaatcaccaatgacacaacgatccagcaagggatcagtggtctgattgatagtttgaatgcccgggatatctccgtgaaaatcttcgaggacttcgcgcaaagctggtattggattcttgtagcacttggagtggcactggttctgtccttgctcttcatcttgctgttgcggctggtggccggacccctcgtcctggtccttatacttggagtacttggcgtgctcgcctatgggatctattattgctgggaggaatatagagttctgcgcgacaaaggggcgagtatctcccagctgggctttacaactaacttgagcgcctaccagagcgttcaagagacctggctggccgcactgatcgtgttggccgtcctggaggcaatactgttgctcatgcttattttcttgcgacagcggatccgtattgccatcgccctacttaaggaagcttcaaaggccgtcggacagatgatgagcaccatgttctatccactggttaccttcgtactgctcctgatctgtatagcctactgggctatgacagccctctacctggcaacatccggccagcctcagtacgttttgtgggcctccaacatctcaagtcctggttgcgagaaagtcccgatcaatacatcctgcaatcctaccgcccatctggttaatagcagttgtccaggactgatgtgcgtcttccagggatactcctcgaaaggtctgatccaaagaagcgtcttcaacttgcaaatttacggcgtgctcggtctcttttggaccctaaactgggtgctcgctctggggcagtgtgtgcttgctggggccttcgccagtttctattgggctttccataagccacaggatatcccaacgtttcctctgatctcggcctttattagaaccctccgctatcacacaggaagccttgctttcggagctttgattctgacacttgtgcagatcgctcgcgtgatcctcgagtacatcgaccacaagctccgtggcgtgcagaatcccgtagctaggtgcattatgtgctgtttcaagtgttgcctgtggtgcctggagaagttcatcaagtttctgaatcggaatgcctacattatgatcgcaatttacgggaaaaacttttgcgtgagcgcaaagaacgcattcatgctgctgatgaggaacattgtcagggtggtcgtattggacaaggttacggaccttctgctgtttttcggcaagctcctggtggttgggggggttggcgtgcttagcttcttcttttttagcggtaggatccctgggctgggcaaggattttaaatccccccatctcaattactattggcttcccataatgacgtccattctcggggcgtatgtgattgcttctgggttcttctcagtatttggtatgtgcgtcgatactctgttcctgtgtttccttgaggatcttgagcgcaataatggcagcttggacaggccctactatatgtctaagtcattactcaaaatcctggggaaaaagaacgaggcccccccggataacaagaagcgcaaaaagtag

SEQ ID NO: 206303 - DNA, 2007 bp, Artificial Sequence
  Description of Artificial Sequence: Synthetic coding sequence
atgggcggcaagcagcgggacgaggacgacgaggcctacggcaagcctgttaagtatgaccccagctttcgaggccccattaagaatcgctcttgtacggacgtgatttgctgcgtgctgttcttgctgtttatcctgggctacatcgtagtgggcatcgtagcctggctctatggagaccctagacaagtgctgtacccaagaaactctaccggcgcgtattgcggcatgggggagaataaggataaaccatacctcctgtacttcaacattttttcctgtatcctgtcctctaacataatcagcgtggctgagaacggactccaatgtcccacaccccagaccgtaattacgtctctgcagcaggagctgtgtccatcctttctgctcccctccgctcctgcactgggccgctgtttcccttggacaaacattactccgcccgcactgcccgggatcacgaacgacaccacaatccagcagggtatatcagggttgatcgattccttaaacgcacgggatatttcggtgaagatctttgaagattttgctcagtcatggtactggatcttggtggctcttggcgtggcacttgtcctatcactcctcttcatcctattgctgagattggtagccggtccacttgttctggtgttgatactgggtgttctgggcgttctcgcctacgggatatactattgttgggaggagtaccgcgttctgagagacaagggggcctcgatatctcagctcggcttcactacaaatctttccgcttaccagtcagtccaagaaacctggctcgccgctttgatagtacttgctgtcctcgaggcaatactgctcctggtgttaatctttcttaggcaaagaatcaggatagctatcgccctgctcaaggaggcgagtaaagctgtgggtcaaatgatgagtaccatgttttaccctctggtgacttttgtgctgctgctgatttgcattgcctattgggcaatgactgccctgtacttagcaacaagtgggcagccacagtacgtcctctgggcatccaatatttctagccctggttgcgaaaaagtgccaatcaacacatcctgtaaccctacagcccatctggttaactcaagttgccccgggttgatgtgtgtgttccagggctacagttccaaaggtttgatccagagaagtgtattcaacttacaaatctatggcgttcttggactgttctggacactgaactgggtacttgcgctcggccagtgcgtgcttgccggagcctttgcgagtttctactgggcctttcataaacctcaggatattcccacgttccctcttatcagtgcctttatacggactctgagataccacacgggttcactggcttttggggccctgattctgactctagtccagattgcaagggtcatcctagaatacattgatcacaaactaagaggcgtgcaaaaccctgtcgcacggtgcatcatgtgttgcttcaaatgttgtttgtggtgccttgagaagttcatcaagttcctgaacaggaacgcgtatatcatgattgccatctatggcaaaaatttttgcgtgtccgccaagaacgcctttatgctcctgatgagaaacattgtcagagtagtcgtgctggataaggtgactgacttactgttgttttttggcaaattgctcgtggtcggtggggtgggcgttctgagcttttttttttttagcgggcgcattcccggattgggcaaggattttaagagtccgcacctgaactactattggctgccgatcatgacctctatcctgggggcttacgtgattgcatccggtttcttctccgtgttcggcatgtgcgtagacacactgtttctgtgcttcttggaagatctagagaggaacaatggctctctggacaggccatactatatgtctaagtcactcctaaagattctcggcaaaaagaacgaggccccccctgacaataagaagaggaaaaaatag

SEQ ID NO: 206304 - DNA, 1905 bp, Artificial Sequence
  Description of Artificial Sequence: Synthetic coding sequence
atgggcgagaacaaggacaagccctacctgctgtacttcaacatcttttcatgtattttgtcatccaatattatcagcgtggccgagaacggcctgcagtgtcccacccctcaggtatgcgtgagttcttgcccagaggacccctggacggtcggtaaaaacgagttttctcagacagtcggtgaggtattttataccaagaaccgtaatttctgtctgccgggcgtgccctggaatatgactgtgataacctctcttcagcaagagctctgccctagcttcttgctcccatccgcacccgcgttaggtagatgcttcccgtggacaaatatcactccaccagccctccccggcattacaaatgacacaacgattcaacaaggcatatctgggttaatcgactctctgaacgccagagatatcagcgtgaaaatcttcgaagatttcgcacaatcctggtactggatcttggttgcactcggtgttgccctggtgctttcactactctttatcctcctgctgcgcttagtcgctggacctctagtcctagtgctcatattaggagttctgggggtcctcgcctacgggatctactactgctgggaagagtaccgggtgcttagggataaaggagcctccatcagtcaattgggattcacaaccaacctctccgcctatcagtcagtgcaggagacgtggctagcagcccttatcgtattagcagtgttggaggcgatcttactgctggtgctcatattcctcagacagcggatccggattgctatcgctctgctgaaggaggcatccaaggccgtgggccagatgatgtccacgatgttctatcccctagtcacattcgtgctcttgctcatctgtatcgcttactgggctatgacagccctgtatctggccacttcgggtcagccgcagtacgtcctgtgggcttcaaacatcagtagcccagggtgtgaaaaggtgcctatcaacacatcgtgtaacccaactgctcatttggtgaactcttcctgtccaggactgatgtgcgtctttcagggatactcttctaaaggacttatccagaggagcgtatttaatcttcaaatatatggtgtgctgggtctcttctggactctcaattgggtgctggcacttggccaatgcgtgctggccggagcattcgcctccttctactgggccttccacaaacctcaggacataccaaccttcccgttgatcagcgccttcatcagaacattacgataccacacgggttcactggcctttggggcacttatacttacactcgtgcagatcgccagagtgattttggaatacattgaccataaacttagaggggtccagaacccagtggccaggtgcattatgtgctgtttcaagtgttgtctgtggtgcctggaaaagtttattaaattccttaaccggaatgcatacatcatgatagcaatctacggaaaaaacttttgcgtgtctgctaagaacgcctttatgctgctcatgagaaatatcgtgcgtgtcgtagtcttggacaaggtgacggatctcctcctcttttttggaaagttgctcgtggtgggcggggtcggagtgttgtctttttttttcttcagtggtaggatccccggactgggaaaggacttcaaaagcccccacctcaattactactggctcccaatcatgacctccattcttggggcttatgttatcgcaagtggattctttagcgtgttcggtatgtgtgtcgatacccttttcctttgcttcctggaggatctcgaacggaataatggctcgctggaccgcccctactacatgtctaaaagcctcctgaagattctgggcaagaagaatgaggcccctcctgacaacaaaaaaaggaagaaatag

SEQ ID NO: 206305 - DNA, 2247 bp, Artificial Sequence
  Description of Artificial Sequence: Synthetic coding sequence
atgatccccgccgccagcagcaccccccccggcgacgccctgttccctagcgtcgctccacaagatttctggcgcagccaggtcaccggatacagcggatcagtgacaagacacctctcccacagggctaataactttaagaggcacccgaagcgccggaaatgcataagacctagtcctccccctcctcccaacaccccctgccctctcgaactggtcgatttcggagacctccacccacagagatcctttagagagcttttgttcaatggctgtatcctgttcggaatcgagttctcttacgccatggaaacagcctatgtcactcctgtgctgttacagatgggactgcccgaccaactttacagtctggtgtggtttatctcccctatccttgggttcctgctgcagccccttctaggggcatggtcagaccggtgtacttctagattcggtaggaggagaccgttcatattggtcctggccattggcgccttacttggtttgagtctgttactgaatggcagggatatcggcattgctctggccgacgtcaccggaaaccacaaatgggggcttcttctgacagtctgcggggtcgttttgatggatttctcggctgattccgccgacaatccctctcacgcttatatgatggatgtctgctccccagctgaccaggaccgaggccttaatatccacgctttattagcgggattagggggaggtttcggctacgtggtggggggaatacactgggataaaaccggcttcggtcgcgctctggggggacaattacgcgtaatctacctgtttaccgccgtgaccctttctgttactactgtattgactttagtgagcatcccagagcgaccactgagaccgcctagcgagaaacgtgctgccatgaaatccccgtctttgccacttccacccagcccccccgttctgccggaggagggtccaggcgatagtctgccatcccatacagcaaccaacttcagctcccctatttcccccccctcaccacttacacctaagtacgggtcttttatcagtagggattcgagtttaactggtatttccgagtttgcctctagctttggaaccgccaacatcgattccgtgctcatcgactgttttactggtgggcacgactcatatctggcaattccaggctcagttccacgccccccaatctctgttagtttcccacgggcacccgacggattttaccggcaggaccggggcctactagaaggcagggaaggcgcgctcactagcgggtgcgacggcgacatcctcagagtaggatccttagacacatccaagcctcgctcctccgggatcctcaaacggccacagacgcttgcgattcccgatgctgccggcggtggcggtccagagaccagcaggcgtcgcaacgttacgtttagccaacaggtagctaatatcttactgaatggtgttaaatatgagagtgagctaaccggcagctctgagagggctgaacaacccctcagcgtaggcagactgtgcagcaccatatgtaatatgccgaaagcactgcggacactttgcgtcaatcacttccttggttggctgtctttcgagggtatgctgctattttataccgactttatgggagaggtcgtttttcaaggggaccccaaggcgccccatacatcagaggcttaccaaaagtacaactccggagtaacaatgggatgctggggcatgtgtatttacgccttcagcgccgctttctattccgcaattctagaaaagttagaggagttcctgagcgtcagaaccttatatttcatcgcatatcttgccttcggactcggaacggggctggccaccctttctagaaacctctacgtggtcctttccttatgcataacgtacggtatactcttttcaactctgtgcacactcccatactctctgttatgcgactactaccagtcaaaaaagtttgctggtagtagtgcagatggtactcgtagaggaatgggggttgacatatcgctgctcagttgtcaatacttcctggcgcagatattggtgagtctggtgctaggtccgctcacctcggctgtggggtctgcaaatggagtcatgtattttagctccttggtcagctttctgggctgcctctactcatctctttttgttatttacgaaattcctccaagcgatgctgccgacgaagaacaccggccactactgttgaatgtctag

SEQ ID NO: 206306 - DNA, 2349 bp, Artificial Sequence
  Description of Artificial Sequence: Synthetic coding sequence
atgctgcagcagcccggcccccggcccggccggcagcagcccagcggcgaccgggacgcttgtcggctccatccccagggtcggcctcccgccctgccaaccatgatccctgctgcaagtagtacgccacccggtgacgcacttttcccctccgtggccccccaagatttttggaggagccaagtaacagggtattctggaagcgtgaccagacacctgtcgcatcgagcaaacaattttaaaaggcaccccaagcgcagaaaatgtattcggcctagcccccctcccccacctaatacaccctgcccactggagctggtggattttggcgacctgcacccccagaggtccttccgggagctgctcttcaatggttgtatcctgtttggtattgaattctcatatgccatggaaactgcatatgtaacacctgtccttctgcaaatgggcttgccagaccaactttacagtctagtgtggttcatctcgccaatactgggattcctcctacaaccactgctcggcgcttggtccgatcgctgtacttcacgtttcggccgaaggaggccatttatccttgtgctggccattggcgcgctgttgggtctctcactcctgctgaatgggcgagacatcgggatagcactggcagacgttaccggcaatcataaatggggactcctgctgacagtttgcggagtcgtcctgatggatttctcagccgactcagccgacaatccatcccatgcttacatgatggacgtatgcagtcccgcagaccaggaccgcgggctcaatatacacgctcttctagcagggctgggcggtggcttcgggtatgtggttggcgggatacattgggataagacaggctttggtcgggcccttgggggccagcttcgggttatttacctgttcaccgccgtaaccctgtcggtgactactgtgctcactctggtgtcaatccctgaacggccactaagacccccaagcgagaaacgagctgccatgaaatctccatcgctgccacttccccctagcccccccgtgcttcctgaagaggggcccggagacagtctgccaagtcatacagccaccaatttctcttcacctatcagccctccctccccattgacacctaagtatggatcatttattagccgtgattccagcctaacaggaattagcgaattcgctagctcctttggcactgccaatatcgatagtgtgttaatcgactgctttactggtggccacgactcctacctcgcaattcctggctctgtgccacgcccccccattagtgtgtctttccctagagcaccagacgggttttataggcaggaccgtggactattggagggcagagaaggcgccctgacatccggctgtgatggggacattttaagggtgggtagtctggatacctctaagccccgtagttctggaattctcaagcgaccacagactttagccatcccagatgcagccggcggcggcgggcccgaaaccagccgacggcggaatgtcaccttctcgcagcaggtggccaatatccttctgaatggtgttaaatacgagtctgagcttacgggtagttctgaacgggccgagcagcctctgtctgtaggtcgcctgtgtagcactatatgtaacatgcctaaggcacttcgcacactgtgcgttaatcattttctaggatggctgtcatttgaagggatgttattgttttataccgattttatgggggaagtcgtgttccagggcgacccaaaagctccccataccagtgaggcttaccagaagtataacagcggcgttaccatgggttgttggggcatgtgtatttatgccttttcggctgccttctacagcgctattctggaaaagttagaagaatttctgtctgtgcggaccctctactttattgcttatcttgccttcgggttgggtaccggcctggcaactctatcaaggaatctctatgttgtgctgagtctgtgcatcacatacggaatactatttagtaccctctgcaccctgccgtactcactgctttgcgactattaccagagcaagaaattcgctggatcctctgctgatggcacaaggcgcggaatgggcgtagatatttccctgctctcctgccaatactttctggcacaaattctggtcagtctggtcttgggtcctctgacttccgctgtgggctccgctaatggggtcatgtacttttcatctctggtaagcttcctgggctgtctgtattcaagtttattcgtcatttatgaaatcccaccgtccgatgcagccgacgaagagcacagacctcttctgctgaatgtgtag

SEQ ID NO: 206307 - DNA, 2247 bp, Artificial Sequence
  Description of Artificial Sequence: Synthetic coding sequence
atgatccccgccgccagcagcaccccccccggcgacgccctgttcccctccgtggcaccacaagatttttggagatcacaggtgacaggctactccggatcagtgactcgtcatctgagtcatagagcgaataactttaaacggcacccaaagcgtagaaaatgcatccggcctagcccccctcccccaccaaatactccatgtccactggaactagtcgactttggggacctccaccctcagagatctttcagagagctcttattcaacggctgtatattgttcggtattgagttttcctacgcaatggaaactgcatatgtgacaccagtgctgcttcagatgggtctccctgatcagttatacagtcttgtgtggttcatatccccaattctcggctttctattgcagcctctgcttggagcttggtcagaccgatgtacctccagattcggacgacggagacctttcatcttagtgctcgctatcggtgcactgttgggcctgagcctgctcctaaatggcagagatattggaatcgctctggccgacgtaacaggaaaccacaaatggggtctgctcctgacggtttgcggtgtggttctcatggatttttctgccgactccgccgacaacccctcccacgcgtatatgatggatgtgtgtagtccggcagatcaagaccggggactgaacatccacgccttgctcgcggggctgggcgggggcttcgggtacgtcgtgggcggcatccattgggacaaaaccggctttggtagggctcttggcggacagctgagagtaatttaccttttcaccgctgttactctctctgtgacaacagtactgactctggtttccattccagagcgacctctgcgccctcccagcgagaagcgcgcagcaatgaagagcccctctctgccactaccaccatcacctcccgtactgcctgaggaggggcccggcgactcactgccctcacacactgcaaccaatttcagctcccccatctcccctccttctcctttgactcccaagtatggctcctttataagcagggacagttcattgactggcatcagtgaatttgcctcatccttcggcacggcaaatattgacagcgtgctgatcgactgctttacgggtggccacgattcctacttggccatccccggaagcgtgcccaggccccccatttcagtctcattcccacgagcgccagatggtttctatagacaagacagggggctcctcgaaggaagagagggggccctgacaagtgggtgcgatggagacattctcagggtggggtcacttgacacatcaaagcctagatcttccggaattctcaaaaggcctcagacactggccatccctgacgccgcaggcgggggaggccctgagactagtcggagaaggaacgtgactttctcacagcaagtggcaaatattctcctaaatggggtgaagtatgagtcagaactgacggggtcctctgagcgcgccgagcagcctttatccgtcggcagattgtgctccaccatatgtaatatgcccaaagccttacgcaccctgtgcgtcaaccattttctcgggtggttatccttcgaaggtatgctgctgttttatactgactttatgggcgaggtagtttttcagggagaccctaaagctccccacacctcagaggcgtaccaaaaatataacagcggcgtcacaatgggctgttggggtatgtgtatctacgctttcagtgcagctttttattcagctatcctcgaaaaactggaagaattcttgagcgtccggactctgtacttcatcgcttacctcgcattcggtctcggtacaggtctggctactctgagtcggaacttatacgtcgtgttgtccctgtgtataacatatggaattttgttttctactctatgtacacttccctactcactcctgtgcgactactatcagtccaagaagttcgctggctcttctgctgatggaaccaggaggggcatgggggtagacatctccttactcagttgccaatacttccttgcacagatcctcgtctccctagtccttgggcctctcacgagcgctgtcggatctgcgaatggagtgatgtatttcagctctctggtgtccttcctcgggtgcctgtactccagtttgtttgtcatctatgaaatcccgccatccgacgctgccgacgaggaacatcgcccgctcttattgaacgtctag

SEQ ID NO: 206308 - DNA, 1593 bp, Artificial Sequence
  Description of Artificial Sequence: Synthetic coding sequence
atgggcagcaacagcggccaggccggccggcacatctacaagagcttggcagacgatggcccattcgatagcgtggagcctcccaagcggccgacatctcggctgatcatgcactccatggccatgttcggtcgagagttctgctatgccgtcgaggctgcttatgtgacgcccgtcctgctgtctgttgggttgccttcctctctgtatagcatagtatggttcctgtcccccattctcggatttttactccagcccgtcgtggggtctgcatccgatcactgccgaagtcgctggggtagaagaagaccctacatcttaaccttaggagtgatgatgctggtgggtatggcgctttatcttaacggggccaccgtggttgctgcacttattgccaacccccggagaaagttagtttgggcgatttcagtgaccatgatcggagttgtgctattcgacttcgcggccgacttcatcgatggtccaattaaggcatacttgtttgacgtgtgttcccaccaggacaaagagaaaggcttgcattatcatgcactttttaccggatttgggggcgcccttgggtaccttctaggagccatcgactgggcccacctagaactgggtcgtttactgggcacagagttccaggttatgttcttcttctcagctcttgtgctgactctttgctttaccgtacacctatgctccatttccgaagcaccattgacagaggttgccaaaggcatcccaccgcagcagacaccacaagaccccccattatctagcgacggtatgtatgaatacgggtctatcgagaaggtaaagaacggctacgtgaatcctgagctcgccatgcagggggccaaaaataagaatcacgccgagcagacgaggagggctatgactctgaagtcactgctgagggcactggtgaacatgccccctcattataggtatctgtgcatctcccatctaatcggctggacagccttcctctcgaatatgctgttcttcactgacttcatgggtcaaatcgtatatcgtggagacccatactcagcccacaattcaactgagttcctgatttatgaacggggggttgaggtcggatgctggggtctgtgtataaacagcgtattctctagcctgtactcctatttccagaaggtgctcgttagctacattgggctgaaaggactgtacttcaccgggtacctgctgttcggccttgggacaggttttataggcctttttcctaacgtgtattctactctcgttctctgtagcctcttcggtgttatgagctcaacactgtatacagtgcccttcaacctcattactgagtaccacagggaagaggaaaaggaacggcagcaagcacctggtggcgatcccgacaacagcgtgagagggaaagggatggattgcgccactctgacctgcatggtgcaactggcccaaattctcgtgggcggcggcctgggcttcctcgtcaataccgcagggaccgttgtagttgtggtgatcactgcctccgccgttgcgctgatagggtgttgcttcgtggccctgttcgtgcgttatgtagattag

SEQ ID NO: 206309 - DNA, 1416 bp, Artificial Sequence
  Description of Artificial Sequence: Synthetic coding sequence
atgggcagcaacagcggccaggccggccggcacatctacaagagcctggccgacgacggaccctttgacagtgtcgagccaccaaagcggccaacaagcagattgattatgcactcaatggccatgttcggacgggagttttgctatgccgtggaggccgcttatgtgacccctgtactgctttccgtcggcctccctagttccctgtacagcatcgtgtggtttctgtctcctatactgggattccttctccaacctgtagttggcagtgcatctgaccattgtcggagtagatgggggcgtaggcgcccctacattttgacccttggggtgatgatgctcgtggggatggctctgtatctgaatggggccaccgtcgtagctggatttggtggggctttgggctacttgctaggggcaattgattgggcccatcttgagctcggtcggctcttaggcaccgagttccaggtcatgtttttttttagtgccctcgtactgactttgtgcttcacggtgcacctttgttcgatcagcgaagcccccctcaccgaggtggccaaaggcatacctccccagcagacaccgcaggacccacctctgagctccgacggcatgtatgagtacggcagtatcgagaaagtcaagaacggttatgtgaaccctgaactcgccatgcaaggagccaagaacaagaatcatgctgagcaaaccagacgcgctatgacgctcaagtcccttctgcgcgccctcgttaatatgccaccacattatcggtatctgtgtatctcccatttgatcgggtggactgcattcctgtcaaacatgttattttttacggacttcatgggccaaatagtctataggggcgatccctacagcgctcacaactctactgagttccttatttatgaacgtggcgtggaggtcgggtgctggggtttgtgtattaatagtgtcttcagtagcctgtacagttacttccaaaaagtcctggtcagctatatcggtctaaaaggactgtacttcaccggatatctcctgttcggccttggaacaggatttatcgggctgtttccgaacgtttatagtaccttggttttatgcagcctgttcggtgtgatgtcctccacgctatacaccgtgccgttcaaccttattactgaataccatcgagaggaagaaaaagaacgccagcaagcacctggcggggaccccgataacagcgtcagaggcaaaggcatggattgcgcgacacttacttgcatggtgcagctggcccagattttagttggaggggggctgggcttcctcgtgaacaccgctggcacagttgtcgtggtcgtcattacagcctccgccgtcgccctgattggatgctgcttcgtagcacttttcgttcggtacgtggattag

SEQ ID NO: 206310 - DNA, 897 bp, Artificial Sequence
  Description of Artificial Sequence: Synthetic coding sequence
atgggcagcaacagcggccaggccggccggcacatctacaagagcctggctgacgatggacctttcgattctgtggagcctcctaaaagaccgacctcccgcctgatcatgcactccatggctatgttcggacgcgaattctgctacgcagtcgaggcagcctacgtgactcctgtcctccttagcgttggacttcccagctctttgtacagtatcgtgtggttccttagcccaatcttgggtttcctgctgcagccagtcgtcggaagcgcgagcgaccactgtcgctcacgttggggtcggaggagaccatacattctgacccttggtgttatgatgttggtcggcatggccctctaccttaacggggcaacggtggtggccgcgctgatcgccaatccccggagaaagctggtgtgggcaatctccgtgacaatgattggagttgtgctgttcgacttcgccgctgatttcatcgatggccctatcaaggcgtacttgttcgacgtttgctcccatcaagacaaggagaaagggctgcattaccatgctctgttcactggcacgagaagagctatgactctgaaaagcctgctgagggccctcgtgaacatgcctcctcattatcgctacctttgcatcagccacctcatcggatggacggcctttctgagtaacatgctgttcttcaccgactttatgggtcaaatagtgtacaggggggatccgtatagtgcccataactcgactgagtttctgatttatgaaaggggagtggaagtgggctgctggggattatgtataaactccgtcttcagctcgctgtatagttgcaagtccttctctttattacgcatgagcagtaagtctttctggtcctccaccacatggatttag

SEQ ID NO: 206311 - DNA, 1383 bp, Artificial Sequence
  Description of Artificial Sequence: Synthetic coding sequence
atgggcagcaacagcggccaggccggccggcacatctacaagagccttgccgatgacggcccttttgacagtgtggaaccgcctaagcggcccacatcacggttaatcatgcactccatggcgatgttcgggcgcgagttttgttatgcggtcgaggctgcctacgtgactcccgtcctgttgtctgtagggcttccctctagtctctactccatcgtgtggtttctgagtcccattttaggatttctgctccagcctgtagtgggaagtgcaagtgatcactgtaggagcagatggggccgacgccggccctacatactgactctgggcgtgatgatgctggtcgggatggccctctatctcaacggagccactgtggtagcagcgctgattgctaacccccgcagaaaattggtgtgggcgatttctgtgaccatgattggggtcgttctgtttgactttgcggctgacttcattgatggcccaattaaagcctacttgtttgacgtctgctctcaccaagataaggagaaaggcctgcactatcacgccctgtttaccggatttgggggcgctctaggttacctgttgggtgccattgattgggcccatcttgaacttggccgcctgctaggaacggaatttcaggtgatgttcttctttagcgcactcgtcctgactttatgctttactgtgcacttgtgttctatctccgaagcgccacttaccgaggtagccaaggggatccccccccagcagacgccccaggacccaccgctttcttctgacgggatgtacgagtacgggtctattgagaaggttaagaatggatatgtcaatcctgagctggcaatgcaaggagctaagaacaagaatcatgctgaacagacacggagggctatgaccctgaaaagtctgctccgcgccttggttaacatgccaccgcattataggtatttgtgcatttcccacctgattggatggactgccttcctctccaatatgctgttcttcacagattttatggggcaaatcgtgtataggggcgatccctacagcgcccacaactcgacagagtttctgatctatgagaggggcgtcgaagtgggctgctggggcctgtgcattaattctgtctttagctctttgtattcctatttccagaaagttctcgtctcatatatcggcttaaaagggctttacttcactggatacctattattcggactaggcactggtttcatcgggctgttcccaaacgtctattccaccctcgtcctgtgtagcctcttcggcgtaatgagtagcactttgtacaccgttcccttcaacctcattactgagtatcatcgcgaagaggagaaagaagtgtgttgtcactag

SEQ ID NO: 206312 - DNA, 732 bp, Artificial Sequence
  Description of Artificial Sequence: Synthetic coding sequence
atgggcagcaacagcggccaggccggccggcacatctacaagagcctggctgacgacgggccatttgactctgtggagccacccaaaagacctacttctcggctgatcatgcattctatggctatgtttggccgggagttttgctatgccgtcgaggccgcttatgtcacgccagtgctgctctcagtggggttgccctcttcactgtactctattgtgtggtttttatctcctatcctcggtttcttactgcaacccgtcgtcggctctgcttccgaccattgcaggtcacggtgggggcgcaggcgcccctacatattgacccttggcgtcatgatgttggttggtatggctctgtatctcaacggagctactgtcgtggcagccctgattgcaaatccacggaggaagctggtttgggcaatctcagtgacaatgataggagttgtattattcgattttgcagcggacttcatcgacggacccataaaggcatacctgttcgatgtctgcagccaccaggataaggagaaaggtctccactatcacgcactgttcaccgactcgcaggggaacgatatcaaggtgaccgccgaaagcacaggcgaacacgcctctagcctgcccttacctcttcatcagccaccccactggatggatagcctccctgtccagcatgcggtgttgcacaggtttcacggaccggattgtgtgccccgcgggtccctctag

SEQ ID NO: 206313 - DNA, 741 bp, Artificial Sequence
  Description of Artificial Sequence: Synthetic coding sequence
atggccctgtacctgaacggcgccaccgtggtggccggcttcggcggtgcactggggtatctgcttggcgctatcgattgggctcacctggagctcggaagactcttagggacggagttccaggtaatgttctttttctccgcgctcgttctcacactctgctttacagtgcatttatgcagcatctccgaagcgcctttaaccgaagttgctaaaggaatccccccccaacagacaccgcaggacccaccccttagtagtgatggcatgtatgaatacgggtctatcgaaaaagttaagaacgggtacgtgaatccagagctggctatgcagggagcaaaaaacaagaaccacgcagaacagacacggcgagccatgaccctgaaatcccttctgagggcactggtcaacatgccacctcactatcgctacctgtgcatctcacacctgattgggtggactgcgtttctttcaaatatgctcttcttcaccgacttcatgggacagatagtatacagaggcgacccttattctgcccataacagcacagaatttctgatctatgaaagaggcgtcgaagtgggctgctgggggttgtgtattaacagtgtgtttagctcgctgtactcatactttcagaaggtgttggtgagttacattggactgaagggcttatatttcaccggctatctcctgttcgggctgggtacgggctttattggccttttccctaatgtttag

SEQ ID NO: 206314 - DNA, 1662 bp, Artificial Sequence
  Description of Artificial Sequence: Synthetic coding sequence
atggtgcagcggctgtgggtgagccggctgctgcggcaccggaaggcacagctgctcctcgtgaatttattaacatttggattagaggtatgtctggcagctggcattacctatgttccaccactccttcttgaggtgggcgttgaagaaaaattcatgacgatggtgcttggcataggacctgttctgggactcgtctgtgtgccactactgggctctgcgtctgaccactggagaggcagatacggtagacgacgaccctttatctgggcattgagcctgggaatcctactttctttgtttttaattcctcgggctggttggctggccggcctgctgtgcccagatcctagaccacttgagctcgctctgctgatcctgggtgtgggacttctcgacttttgcggccaggtctgtttcacacctcttgaagcactgttgtcagacctattccgcgatcccgaccattgccggcaggcgtactccgtctatgcttttatgatctctctgggcgggtgtctgggctatcttctacccgcaattgactgggatactagcgcactagctccgtatcttggaactcaggaggaatgtttgtttggcctcctgaccctgatctttctcacatgtgtggctgccaccctgctagtggccgaggaagctgctcttggaccgacagagcccgcagaagggctgtccgccccgtctctgtccccccattgttgtccttgtcgtgcgcggcttgctttccggaacttgggagccctgctgccaagactgcatcaactctgttgcagaatgccccgtactcttcgccgcctgttcgtggcagaactgtgctcatggatggccctaatgacgtttaccctattctacactgacttcgtgggggagggcctttaccagggagtacctcgcgctgagcctggaacggaggcacggcgccactacgacgagggggtacgtatgggcagtttggggttatttctccagtgtgcaatttcattagtttttagcctcgtgatggacagacttgttcaacgatttgggactagagctgtttatctggcaagcgtggccgccttccctgtggcagccggggcaacctgtctttcacactccgtggctgtcgtaactgccagcgccgctttgacaggctttactttttcagcactacaaatccttccctacaccttggcaagcttgtaccatagggagaagcaggtttttcttccaaagtaccggggcgataccggaggggcctctagcgaagacagcttgatgactagtttcctgcccggaccaaagcctggcgccccctttcccaatgggcacgtgggcgccggcggatctgggctgctgccgccaccccctgccctgtgtggggccagtgcatgcgatgtttccgtgcgtgtggttgtaggcgagccgacggaggccagggttgtgcctggacgcggaatctgccttgacctggccattctcgacagcgctttccttctgtcacaggtcgcacctagcctgttcatgggctctattgtgcagttatcccaatccgttacagcctatatggtttccgctgccggcttggggctagtggctatctactttgcgactcaagtcgtgtttgacaagtcagatcttgccaaatacagcgcctag

SEQ ID NO: 206315 - DNA, 1293 bp, Artificial Sequence
  Description of Artificial Sequence: Synthetic coding sequence
atggagggcagcgccagcccccccgagaagccccgggcccggcccgccgctgctgtgttgtgtagagggccagtggagccactggtgttcctggcaaactttgccctggtattgcaagggcctctgaccacgcagtatctgtggcaccgcttctccgccgacctggggtacaatggcactaggcagcgcggaggatgctcaaatcgcagcgcagacccaactatgcaggaggtggagactctgaccagtcattggaccttatacatgaatgtcggagggttcctggttgggctgttctccagtacgctgctgggcgcttggtcggattcggtgggccgacggcccttactggtgctggcctccctcgggctgcttctgcaagccctggtttccgtcttcgtggtccagctgcagctccacgtgggctattttgtgttgggacgaatcctgtgcgccctcctgggagatttcggaggcctgctcgctgcctccttcgcctctgttgccgatgtgagttcatctaggagtagaacattcagaatggctcttctggaggccagtatcggggttgccggaatgctggcgagcctgttaggcggccactggctgagggctcagggctatgctaacccattctggctggcactggcccttctgatcgccatgactctctacgcagccttctgtttcggggagactctgaaagaaccaaagtctactagactgttcacattccggcaccatcggagtatcgtccagctatacgttgcgcctgcaccagaaaaaagtcggaaacatctggccctatacagcctagctatttttgtggtgatcaccgtgcacttcggcgcccaggatatactcactctgtacgaactgtctacaccgctgtgttgggactctaagctcataggatacggatccgcagctcagcacctgccatacctcacctcactgctggctctcaaactcctgcagtactgcctcgccgatgcttgggttgcagagatcggattagccttcaatattttgggcatggtggttttcgccttcgctacgatcacaccacttatgttcacaggcgcgctgtttagtgctgttgcctgcgtcaacagcttagccatgttgacagcctccggcttcaacagcctatatcctgccacacttaattttatgaagggcttccctttccttctgggagctggtctgctgctaatcccagccgtgctcatcggtatgctggagaaagcagacccgcacctcgagttccagcaattcccccagtcaccttag

SEQ ID NO: 206316 - DNA, 1380 bp, Artificial Sequence
  Description of Artificial Sequence: Synthetic coding sequence
atggagggcagcgccagcccccccgagaagccccgggcccggcccgccgcggccgtgctgtgcagagggccggtagagccacttgtctttctcgccaacttcgcgctggtgctacagggtccccttaccacccaatacctttggcacagattctctgctgacctcgggtacaacgggacccgacagagaggcggctgcagcaaccgctcagcagaccccacaatgcaggaagtagagaccctcacatctcactggaccttatacatgaacgtgggtggttttttagtcggtctgttctccagcacactgctgggcgcgtggtccgattctgtcggccgacggccgttactcgtcctggcttccttgggactgctgctgcaagccctggtgtctgtctttgtcgtacagctccagcttcacgtagggtactttgtgcttggacgaattttgtgcgccttattaggggatttcggaggcctactggccgctagtttcgcaagcgttgccgacgtgtcgtcatcaaggtcgagaacctttcgtatggcccttcttgaagctagcattggagtggcaggcatgttggctagcctgcttggcgggcattggctacgtgcccagggctacgctaatcctttttggttagcactggctctcctcatcgccatgacactatatgcggcattctgttttggtgagaccctgaaggaaccaaaatctactaggttattcacgtttaggcatcaccgctctattgtccagctatacgtggcccctgcaccggagaagagtaggaagcacttagcgctctattctctcgccatttttgtcgtcatcacagtgcatttcggcgctcaggacatcctgacactgtacgaactaagcacgccgctttgttgggatagcaaactcatagggtatgggtcagctgcacaacacctgccctacctgacctcgctgctggccttgaagctgttgcaatattgtctcgctgacgcttgggttgctgaaattggactcgcgttcaacattctaggaatggtggtgtttgcctttgctacgatcacccccctcatgttcactggttacggtctcctgtttctgagtttggttatcacaccggtgatacgggcaaagttgagtaagctcgtgagagaaacggaacaaggagcattgttcagtgcggtcgcttgcgtgaatagccttgccatgctgactgcatccggaatctttaatagtctgtatccagcaacactcaatttcatgaaggggttcccatttctccttggcgctgggctgcttctgattcccgcagtgctcattggcatgctggagaaagctgatccccatctcgagtttcagcagttcccacagtcaccttag

SEQ ID NO: 206317 - DNA, 1428 bp, Artificial Sequence
  Description of Artificial Sequence: Synthetic coding sequence
atgagccccgaggtgacctgcccccggcggggccacctgccccggttccacccacggacatgggtcgaacccgtcgttgccagtagtcaggttgctgcctccttgtacgacgccgggctgttgctcgtcgtgaaagcttcttatggtaccggtggtagttccaaccactcagcatccccctccccaaggggagctttggaggatcagcagcagcgcgccatttccaacttttacatcatttacaacctggtggtgggcctgtcccctctcttgtctgcctacgggctggggtggctctccgataggtaccacaggaaaatcagtatatgtatgagccttctggggttcctcttgtcacgcctgggccttttgttgaaggttctgctggactggccagtcgaagtcctctatggggccgcagccctcaacggcctgttcggaggcttcagcgccttctggtccggtgtaatggctctggggagcctgggcagttctgaggggcgccgctcagtgcgcctgattctgatcgatttaatgctaggtctggctggtttctgcgggagtatggctagcggacacttgtttaaacagatggcgggtcatagcggacaaggtctgattttaaccgcatgcagcgtatcatgcgcttcctttgcactgctatactctctgctcgtccttaaagtgccagagagcgttgcaaagccaagtcaggagctgccagccgtcgacaccgtctccgggactgtgggtacctaccggaccctcgaccccgatcagctcgaccagcagtacgcggtggggcatcctccatctccggggaaggctaagccccataagacaaccatcgccctgctgttcgtaggagcaataatatatgatctcgccgtggtgggcactgttgacgtgatccctctctttgtcttgcgggagccattaggctggaatcaggtccaggtcggctacgggatggccgcagggtatactatatttattacttcttttctgggtgtcctcgtgtttagcaggtgcttcagagatacaaccatgattatgatcggcatggtgtccttcggctccggagcactgctccttgcttttgtaaaagagacatatatgttctacattgcccgcgcggtgatgctgtttgccttgattccagttaccacgatccggagcgcgatgtcaaagctaattaaggggtctagctacggcaaggtgtttgtcatccttcagcttagcctggccctcacgggtgtggtcaccagcacactgtacaacaaaatctaccagctgacaatggacatgttcgtgggaagctgctttgccctgagctcattcctctctttcctcgctataataccgatctctatcgtggcatataagcaggtgccactgagtccatacggggatatcatcgagaaatag

SEQ ID NO: 206318 - DNA, 1713 bp, Artificial Sequence
  Description of Artificial Sequence: Synthetic coding sequence
atggaggcccccgaggagcccgcccccgtgcggggcggccccgaggctacgcttgaagttaggggatcccgttgcttaaggttgtctgccttcagggaagaactgcgggctcttctggttttggccgggcctgcatttttagtgcagcttatggtcttcctcatctcatttatctcaagcgttttctgcggacatctgggcaagttggagctggatgcagtcacactcgcgattgccgtaattaacgtcactggtgtgtcagttggcttcgggttgagttcagcttgtgatacactgattagccagacgtacgggtcgcaaaacctgaaacatgtgggggtcatcctgcagaggagtgccttggttctgctcttatgttgctttccgtgttgggccttatttttaaacacccagcatatcctgttactttttcgccaggaccctgacgtgtcacggctgacccagacctacgtgacaatctttatccctgccttaccagctacatttctctacatgctccaagtaaaataccttttgaaccaggggattgtcctcccccagatcgtgacgggtgttgctgccaatcttgttaacgcccttgccaactatctgtttcttcatcagcttcacctgggcgtgattggcagtgcccttgctaatctcattagccaatacacgcttgctctccttctctttctatatattttaggtaagaaactacatcaggcaacctggggaggctggagcctggagtgcctccaagactgggccagtttcctcaggttagccattccgtcaatgctcatgctgtgcatggaatggtgggcatatgaagttggatcttttctgtctggaatacttggaatggttgagttaggagcacagtcaatcgtgtatgaactggccataatcgtttatatggtgccagccggcttttctgtggccgcgtctgttcgggtgggcaacgccctcggggctggcgacatggagcaagctcggaaatctagcaccgtttccctcctgatcacggtcctgttcgctgtggcattcagcgtactgctgctttcctgtaaggatcatgtaggatacattttcaccacagatcgcgatattatcaacctagtggcccaggtggttcccatctacgcagtatctcatttgttcgaggccctggcttgcacatctgggggtgttttgcggggatccggtaatcagaaagtgggcgccatagtcaatacaatcggatattacgttgtcggcttacccattgggattgcgctcatgtttgcaaccacactaggtgtaatgggcctgtggagcgggatcatcatctgtaccgtattccaggccgtgtgtttcttaggcttcatcattcagttgaactggaaaaaggcctgccagcaggcacaagtccatgctaacctgaaagttaacaatgtacccaggtccggcaactctgcactgccacaggacccacttcatcccggatgcccagaaaacctcgaggggatattgactaatgatgtcgggaaaacgggggagccacaaagcgaccaacagatgagacaagaggagccactgcccgaacatcctcaagacggcgctaaactcagccggaagcagctggtgctaagaagaggcctgctgctgctcggcgtatttttaatccttctggtgggtattctcgttcgcttttacgtccgtatccagtag

SEQ ID NO: 206319 - DNA, 1761 bp, Artificial Sequence
  Description of Artificial Sequence: Synthetic coding sequence
atggaggcccccgaggagcccgcccccgtgcggggcggccccgaggccaccctggaggtgagaggctcccggtgcctccgcctcagcgcctttagagaggaactgagggctctattagtgctcgcgggccccgcatttctggtgcaactgatggtcttcttgattagctttatctcttctgttttctgcggccatctggggaaattggaactcgatgccgtgaccttagccattgcagtgatcaatgtgacaggtgtatctgttggatttggactgagttcggcatgcgacaccctgattagtcagacctacggctcccagaacctaaaacacgtgggcgtgatcttacagcgaagtgcacttgtgttgcttttgtgttgttttccctgttgggcattatttttgaacactcagcacatcctcttgctgttccgccaggatcctgatgtctcccgcctgactcaaacttacgtcacgatttttattcccgcgctgccagcaaccttcctatatatgttgcaggtgaaatatctgttaaatcagggaatagtgttaccccaaattgtaacaggagtggccgccaatctcgtcaatgcacttgcaaactacttgttcctacaccagttacatcttggcgtcattgggtccgctttggccaacctgatctctcagtatacacttgccctgcttttgttcctctatatcctgggaaagaaactgcaccaagcaacttgggggggctggagtctggagtgtctgcaggactgggctagctttctgcgactggcgatccccagcatgctgatgctgtgtatggagtggtgggcatacgaggtcggcagctttctcagtggtattctgggcatggtagagttgggtgcacaatccatagtctacgaactcgcaattattgtttatatggtacccgccggcttctctgtggctgcatctgtgagggtcggcaacgcgctaggggccggagacatggagcaggcacgcaagtctagcacagtgagcttgctgattacagtcttgttcgcagtagcatttagtgtgctgctgttatcatgtaaagaccatgtgggctatatttttactacagatcgagacataataaacctcgttgcccaggtggtccccatctatgctgtgagtcacctgttcgaagctctggcctgcacatccggcggagtcctccgcggatctggaaatcagaaggttggtgcaatcgtgaacacaatcggctattatgtcgtggggcttcccatcgggattgcgttaatgttcgctacaaccctgggcgtaatgggcctatggagtggtataatcatatgcacagttttccaggcagtgtgcttcttggggtttataatccagctgaactggaagaaggcatgccagcaggcccaagtccacgctaacctgaaggtgaataacgttcccagatcaggtaattcagcattacctcaggatcccctgcatcccggttgcccggagaatcttgagggcatcctgaccaatgatgtgggcaagactggagagccgcagtccgatcagcagatgagacaggaggaacctttacctgagcacccgcaggacggcgcaaagctctcacgcaagcagctggtcctgcggcggggattgctactgctgggtgtgtttctgattctcctcgcaggagtgcgctggtgcgatcattcttccctgcaaccccgaaccttgggactacaagccatcttactgtgccaaccccctgagtag

SEQ ID NO: 206320 - DNA, 849 bp, Artificial Sequence
  Description of Artificial Sequence: Synthetic coding sequence
atggtggagctgggcgcccagagcatcgtgtacgagctggccatcattgtgtacatggtgcctgccgggttttccgtggcggcaagcgtgcgggtaggtaatgctctaggagctggtgacatggagcaggcgcgcaaatcttccacagttagcctcttgatcaccgtgctattcgccgtggccttcagcgtgttgttgctttcctgtaaggaccatgtgggttatatttttactactgaccgggatatcattaatctggtcgctcaagtagtgcccatatacgcggtgtcacatctgtttgaagccctggcttgcacctccggaggcgtccttcgcggcagtggaaaccagaaggtcggtgctatcgtgaatactattggttactatgtagtaggactccccatcggaatcgccttgatgtttgcgaccacactaggagtcatggggctctggagcgggataattatctgcaccgtatttcaggcagtctgctttctgggattcattatacaacttaattggaaaaaggcttgccagcaggcccaggtgcacgcgaatttgaaggtgaacaatgtgcctagatcaggcaattccgctctgccccaggacccgctccatcctggatgcccagaaaatttggaggggatcctgaccaatgatgttgggaaaaccggtgaacctcagagtgaccagcaaatgcgtcaagaagaacctctacctgagcatccacaagacggagccaagctgagtaggaagcagctagtgctgagaaggggattgctattgttaggggttttccttatcctactggtcggcatcctggtgcggttctatgtcagaattcaatag

SEQ ID NO: 206321 - DNA, 1332 bp, Artificial Sequence
  Description of Artificial Sequence: Synthetic coding sequence
atggaggcccccgaggagcccgcccccgtgcggggcggccccgaggctacattagaggtgagaggcagcaggtgcttgcggctgtctgctttccgggaggaattgcgcgcgctcctggttctcgccggacccgctttcttggtccaactaatggtgttccttatcagcttcatttcttcagtgttttgtggccacctggggaagctggagctcgacgcagtgaccctggctatagctacctatggcagtcagaatttaaagcatgtcggcgttatcttacaacgcagtgcactggtgctcttgctttgttgcttcccatgttgggcactttttttaaacactcaacacatcttactgctgttccgacaagatcccgatgtctcaaggctgacccagacgtacgttacgatctttattccagctctgcccgccacgttcctgtatatgctccaagtgaaatacctgttaaatcaaggtatcgttctcccgcagatcgtcacaggagtggctgccaatttggtaaacgcactggccaactatctgtttctacatcagctgcatctaggcgtcattgggtcagccctggcgaaccttatcagccaatacaccctcgcattgctcctgtttctgtatatcctgggcaaaaaactccaccaagcgacttgggggggctggtctttggagtgtctgcaggactgggcatcttttctgaggctcgccattcccagtatgctgatgctttgcatggaatggtgggcatacgaagttgggtcctttctgtccgggatcctggggatggtagagctgggcgcccagtccatcgtttacgagctggcaatcatcgtctacatggtgcccgcggggttcagcgtggccgcatcggtacgcgttgggaatgctttaggggccggcgatatggaacaggcacgaaaatccagcacggtaagcctgctcataactgtgctgtttgctgtggcattttctgttttactgttgtcctgcaaggaccatgtggggtacatctttacgacagaccgtgacatcattaacctggtggcccaggtggtccccatttatgcggttagccacctgtttgaggcacttgcttgtacatcagggggggtgttacgcggtagtggtaaccagaaggtcggggccatcgtgaatacaattggctactatgtggtaggcctgccaatcggcatagctctcatgtttgctaccactttgggtgtgatgggctccgggacacggcagttcgaaagtaagcaacgtgcgtcagagtgggaattctgttcaccctctggaagcgctagcccccgcgtaccgtag

SEQ ID NO: 206322 - DNA, 738 bp, Artificial Sequence
  Description of Artificial Sequence: Synthetic coding sequence
atgctgatgctgtgcatggagtggtgggcctacgaggtgggcagcttcctttctggaatcctgggcatggtggagttgggagcccagagcatcgtttatgaactcgccatcattgtctatatggtcccagcaggattttctgtggctgccagcgtccgtgtaggtaacgctctgggagctggggatatggaacaggcccgcaagtccagcaccgtaagcctcttaattaccgtgctcttcgccgtcgctttttcagtattgttgctgtcttgtaaggaccacgtgggctacattttcaccactgatagagatatcatcaacctcgtcgcccaagtggtcccgatctatgccgtgtcccatctgttcgaggcccttgcgtgcacgtccggcggtgtcctccgtgggtctggaaaccagaaggtgggagccattgtaaacacaatcggttattatgtcgtgggactgcctatcgggatcgccctgatgtttgccactaccctcggggttatgggatgtcccgaaaatctcgaggggattctgacaaacgatgtgggaaaaacaggcgaacctcagtctgatcagcagatgaggcaggaggaacctctgcccgaacacccccaagatggagcaaagctgagccgcaagcagctggttttgcgacgtggcctgctgctactgggggtctttctgatcctactggtgggaatccttgtgaggttttatgtgcggatccagtag

SEQ ID NO: 206323 - DNA, 1761 bp, Artificial Sequence
  Description of Artificial Sequence: Synthetic coding sequence
atggaggcccccgaggagcccgcccccgtgcggggcggccccgaggcgactctggaagtgcgtggctcccggtgtctgagattgtccgctttcagggaagagctgcgggcactcctcgtgctcgctgggccagctttcttagtacaattgatggtattcctcatcagcttcataagcagcgtgttctgcggtcacctcggtaagttggaacttgacgcggtcactttagccatcgcggtgattaacgtgaccggcgtttctgtaggttttggcctttcatccgcgtgcgacaccctgatctcgcagacatatggcagccagaacttgaagcacgtgggggtcatattgcagcgctctgccttagtgctgctgctgtgctgcttcccgtgttgggcattgtttcttaatacgcagcacatcctgttgctttttaggcaggaccccgatgtgtcacgactcacccagacttacgtgacaattttcattcctgcactgcctgccaccttcctgtatatgttgcaagtgaagtacctattaaaccaggggatcgtcctgcctcagatcgtgacgggcgtagcagccaacctggtaaatgcgctggccaattatttatttctacaccagctgcacctgggagtcatcggtagtgcactggcaaacctcatctcccagtataccttggctcttctactctttctttatattctcggaaagaagctgcaccaggcaacctgggggggttggagcctggaatgccttcaggactgggccagctttctgcggctagctatcccttccatgctcatgctttgcatggagtggtgggcctatgaagtaggttccttcctcagtgggattttaggtatggtggagcttggcgcccagagcattgtctatgagctggctatcattgtttacatggtgcctgccggcttctcagtggccgcaagcgttagggtgggaaacgccctgggcgctggcgacatggagcaagccaggaagtctagcacggtgagtctgttaatcactgttctgtttgcggtcgcttttagcgtcctgctactcagttgcaaagaccacgttgggtatatttttacgaccgatagagacattataaacttggtggcgcaggtggtacccatttatgcggtttctcacctttttgaggccctcgcatgcacttccgggggagtcctgcgagggagcggcaatcagaaagttggagctatcgtcaacacgataggttactacgtcgtaggccttcccataggcattgcactgatgttcgccaccaccctcggggttatgggactttggtctgggatcatcatttgcacagtttttcaggccgtctgtttcctggggtttatcatccagctgaactggaagaaggcctgccagcaagcacaagtgcacgctaacttgaaagtcaataacgtgcctcgaagcggcaacagtgcactgccccaagatcccctacatccaggatgccctgaaaacctggaggggatactcacgaatgacgtgggcaaaacgggagaacctcaatctgaccagcagatgagacaggaggaacctctgccagagcatcctcaggacggcgcaaagctctcacggaagcagctggtgctgcgtcggggtttactgttgctgggcgtatttctgatcctccttgcgggggtacggtggtgcgaccatagctctctgcagccaagaactctcggacttcaggctattttactctgccagcctccagagtag

SEQ ID NO: 206324 - DNA, 735 bp, Artificial Sequence
  Description of Artificial Sequence: Synthetic coding sequence
atggaggcccccgaggagcccgcccccgtgcggggcggccccgaggccacgcttgaagtgcggggatccaggtgcctgaggctgtcagccttccgtgaagagctaagagcactgctcgttctggcagggccagctttcctcgtgcagctcatggtctttctgatctcattcatcagctccgtattctgcgggcatttggggaagctagaactggatgccgtcactctggccattgcagtaatcaacgtgacaggagtgtctgtaggttttggactgtcttctgcctgcgatactttgatttcacagacctatggatcacagaacttaaagcacgtaggcgtgatcctccagcgctccgcactcgtgttacttctctgttgcttcccttgctgggctctgttcctcaacacccagcacatactgctgctcttcaggcaggacccagacgttagccgtctgacgcagacatatgttaccatcttcatccccgcccttcccgccacattcctgtacatgctgcaggtgaaatacttgcttaatcagcgtctgtgcactggaaaactggactttccagttcatccaggcagcactccccttagcctgcacccacgcgagaagaccgcctcctcctatatgggaagattggtgccccgggtgccagctgggcttggccttttacccccgcctggccacccacaacacgcccacgccgtgcatggtgtggtcggattgtag

SEQ ID NO: 206325 - DNA, 1809 bp, Artificial Sequence
  Description of Artificial Sequence: Synthetic coding sequence
atggacagcctgcaggacaccgtggccctggaccacggcggctgctgccctgcactctcacgtctggtgccgcggggcttcggaaccgaaatgtggacattatttgctctctccggtcctttgttcttgttccaagtgctcaccttcatgatctacatcgtaagtaccgtgttctgtggccaccttggcaaggtagaactcgcctccgtgacccttgcagtggctttcgtgaacgtctgcggggtctccgtgggcgtcggactttcctccgcgtgcgataccttaatgagtcagagctttggctctcctaataagaagcacgttggggtgattctgcagaggggggctctcgtcctgttgttgtgctgcctgccctgttgggcattgttcttgaatacacaacacatcctgcttcttttcagacaggaccctgatgtgtcgagactgacgcaagattacgtgatgatctttatccccggcctgccggttatcttcctgtataacttgctggctaaatatctccagaaccaaggctggctgaagggacaggaagaggagtctcctttccaaacccccggcctgagtatcctccatccctctcactctcatttaagtcgcgcctcctttcacttgtttcaaaaaatcacctggccccaggtgctgtccggagtggttggtaattgtgtgaatggggtggctaattacgccctcgtttccgttttgaacttgggggtcagaggaagtgcctatgcaaatattatttcgcagttcgcgcagacggtttttctgctgctgtacatcgtcctcaaaaagctccacttggagacctgggccgggtggagctcccagtgcctacaggactggggccccttctttagtctcgctgtgccaagtatgctgatgatctgcgtggagtggtgggcctacgagattggcagttttctgatggggcttttatcggtggttgacttgagcgctcaggcggtcatctatgaggtagctactgtgacctacatgatccctctgggactgagtatcggtgtttgcgtccgggtgggcatggcactgggcgctgcagacaccgtccaggcgaaaaggagcgcagtgtcaggggtgttaagcattgtgggtataagcctcgtcctcggtactcttatttcaattcttaaaaaccagcttgggcatatctttactaacgatgaggacgtgatcgcattagttagtcaggtgctccctgtatatagtgttttccatgtgtttgaggccatctgttgcgtgtatggaggcgtgttgaggggtaccggaaaacaggcattcggagcagccgtcaatgcaatcacctactacatcatcggactcccccttgggatcctcttaacatttgtggttcgcatgcgtattatgggactgtggctggggatgctcgcttgcgtgtttctggctacggccgccttcgttgcctacaccgccaggctggattggaagctcgcagccgaagaggcaaagaagcactccgggcggcagcagcagcagagagccgaaagcactgcaaccagacctgggcccgaaaaagcagttctctcctcagtggccacgggcagttctcccggtatcactctgacaacatacagccgttcagaatgccacgttgacttcttccggacgcctgaggaggctcatgctctctcggctccgaccagtcgactctctgtcaaacaactggtgattcggagaggagctgccctgggtgccgcaagcgctacattgatggtaggactcaccgtaagaatcctcgccactcgacactag

SEQ ID NO: 206326 - DNA, 1743 bp, Artificial Sequence
  Description of Artificial Sequence: Synthetic coding sequence
atggacagcctgcaggacaccgtggccctggaccacggcggctgctgcccagccctgtcaaggcttgtgccccgaggattcggtacagaaatgtggacactgttcgcgctgtcaggccccctcttcttatttcaggtgcttaccttcatgatctatatcgtgagtacggtgttttgtggccatctgggaaaggtcgagctggcctctgtgaccttggcagtggccttcgtgaacgtctgtggagtgagcgtcggggtgggcttgtccagcgcttgcgacaccctaatgagtcagtcctttggttcccccaataagaaacacgtgggggttatcctgcaacgcggagcccttgtgctgctgctgtgttgtctgccctgctgggcattgttccttaatacgcagcacatcctgttactttttcgacaggaccccgacgtgagtcgtcttactcaagactacgtgatgatttttatcccagggctgccggtgatattcctgtacaacctgctggcgaaatatctacagaaccagaagatcacatggccccaggtcctgagtggggtcgttgggaattgtgtcaacggagtagccaactatgccctggtatcagtcctgaatctcggggttcgcgggtcggcttacgctaatatcattagtcagtttgcacagacagtgttcctgctgctgtatattgtgctgaagaagctgcacctggagacttgggctggctggagtagccaatgtctgcaggactggggaccttttttctccttggccgtgccatctatgctgatgatctgcgtggagtggtgggcttacgaaatcggtagttttctaatgggcctgttgagtgtggtagacctgagcgcccaagccgttatttacgaggtggcaacagtaacctatatgcgacactcccacaggctagcctacgctgctcatgtgacaaggatccctctgggattgtccataggagtgtgtgtgcgggtcggaatggccctaggggcggcggacaccgtccaggctaagagatccgcggtcagcggagtcctgtcgattgttggaatcagtctggtgctgggcactttgatcagcatcctgaaaaatcagttaggtcacatctttaccaatgatgaagacgtcattgccctggtgagccaagtgcttcctgtgtactctgtgtttcacgtttttgaggccatctgctgtgtctacggtggggtgctccgggggaccggcaaacaggccttcggagcagcagtgaatgcgattacttactacatcataggactcccactgggaatactgctgacgtttgttgttagaatgaggatcatgggcttgtggcttggcatgctggcctgcgtctttctggctacggctgcattcgtggcttatacagcacggctggattggaagctggcagcggaggaggccaagaaacattctggtaggcaacagcagcagcgcgctgaatccacggccacgagacctgggccggagaaagctgtactcagctcagtcgcgaccggatcttcacctggcattacactcaccacgtattcccgctctgaatgccacgttgacttcttcagaacccccgaagaggctcatgcgctcagcgctcccaccagccgtctttccgttaagcagctggtaatccgaagaggcgccgcccttggagccgccagtgctactctgatggtcggacttacggtccggatcctcgcaacacgccattag

SEQ ID NO: 206327 - DNA, 1092 bp, Artificial Sequence
  Description of Artificial Sequence: Synthetic coding sequence
atggacagcctgcaggacaccgtggccctggaccacggcggctgctgcccagccttgtcccgcctggtgccgagggggttcggtacagaaatgtggacactcttcgcgttgtcgggccctctgttcctgtttcaagtgctgaccttcatgatttacatcgtgagcaccgtcttttgcggccacttgggcaaagtcgaactggcctccgtgacactggcggtggcctttgtgaatgtctgcggcgtgtccgtgggggtgggactgagtagcgcctgtgataccctaatgtcacaatccttcggctctccaaacaagaaacacgttggtgtgatcctccaacgtggggctcttgtgctgctgctgtgctgcttgccttgttgggccctgtttctgaatacccagcacattcttttgttatttcgtcaggacccggatgtgagcaggctcacacaagactatgttatgattttcataccaggcctccccgtaattttcctctataatctgttggcaaagtacttgcagaaccagaagataacctggcctcaggtgctgtctggtgtggtggggaattgcgtcaatggcgtggccaattatgcgctcgtaagtgtcctcaacctgggagttcgcggatcagcctatgcaaacattatctctcaatttgcccagactgtgttcctcttgctctatattgttttgaagaaattacatttagagacttgggccgggtggagctcccagtgtttgcaggactgggggccattcttctctctggccgtaccaagtatgctcatgatttgcgtcgagtggtgggcgtacgaaatcggtagctttctcatgggccttctgagcgtagtggacctcagcgcacaggctgtcatctatgaagtcgcaacagttacctatatgatcccacttggactgtctataggcgtttgcgtgcgggtagggatggcactgggggcagccgataccgtgcaggccaagcgcagcgcggtatcaggcgtgcttagcattgtaggcatttcattggtgctaggcaccttgattagtatcttgaagaatcagctgggacacatcttcacgaattag

SEQ ID NO: 206328 - DNA, 891 bp, Artificial Sequence
  Description of Artificial Sequence: Synthetic coding sequence
atgatctacatcgtgagcaccgtgttctgcggccacctgggcaaggtcgagttggcgtcagtcacccttgctgttgcatttgtgaatgtgtgtggcgtaagcgttggcgtgggtctgagctcagcttgtgatactcttatgagtcagtccttcggctcgccaaataaaaagcacgtcggggtgatcttgcagagaggggccctggtgctgctgctgtgttgcttgccatgctgggccctgttcctgaacactcagcatatcctgctgctctttaggcaagatccagacgtgagcagacttactcaggattacgtcatgatcttcattcctggcttgcctgtcatttttctctacaacctgctggccaagtacctgcagaaccagaagattacatggccacaagtgctctcaggtgtcgtagggaactgtgtcaacggtgtcgcgaactacgcgctggtctctgtgctgaacctgggtgtgcggggcagcgcctacgccaacattatatcccagtttgcccagaccgtcttcctgcttttgtatatcgtccttaaaaaactgcacctggaaacttgggcaggatggagctcccagtgcctacaggactggggcccttttttctctctcgccgtgccatccatgctgatgatctgcgtggaatggtgggcctacgagatcggatcattcctcatgggactgctgtctgtggtagatctgtccgcccaagcggtcatttacgaggtggctacagttacgtacatgatccctctgggactcagtataggcgtgtgcgtgagagtcggaatggccctaggagcggcagacaccgtccaggccaaacggagcgccgtgtccggggtgctgagtatcgctcggtctgatccttggtag

SEQ ID NO: 206329 - DNA, 531 bp, Artificial Sequence
  Description of Artificial Sequence: Synthetic coding sequence
atgaaggccagcggcaccctgcgggagtacaaggtggtgggccggtgcctgcctacacctaaatgtcacacaccacccctctaccgtatgcgcatattcgcacctaaccatgttgtggccaagtccaggttctggtatttcgtctcccagctcaaaaaaatgaaaaagtccagcggggaaatcgtgtattgcgggcaggtcttcgagaaaagcccactcagagtgaagaactttggaatttggttgagatatgacagtcgatctggtactcacaatatgtacagggagtaccgtgacctgacgaccgctggagccgtcacacaatgttatcgcgacatgggggctcggcacagagcacgagcccattcgattcagatcatgaaagtcgaggagattgctgccagcaagtgccgcagaccagctgtgaaacagtttcacgattcaaagatcaaatttcctctcccacatcgagtcttaaggcgacagcacaagccccggtttaccacgaagcgtccgaatacctttttctag

SEQ ID NO: 206330 - DNA, 1995 bp, Artificial Sequence
  Description of Artificial Sequence: Synthetic coding sequence
atggacagcagcacctggagccccaagaccaccgccgtgacccggcctgtggaaactcacgaattgattaggaacgccgcagacatctcaatcattgtgatctacttcgtcgtggtgatggccgtgggcctctgggcaatgttttctacaaatagaggcactgtaggaggtttttttcttgccgggagatctatggtttggtggccaattggggccagcttgttcgcctccaatattgggtccggtcacttcgtgggactagccggtaccggtgcggcatcaggaattgccattggcggcttcgagtggaatgccctcgtcctagttgtagtgctcgggtggttgttcgtccccatatacattaaggctggggtcgttaccatgcctgagtaccttcggaagcgatttgggggtcagagaattcaagtctatctgtccttgctgagcctgttactgtatattttcacaaagatctcagccgacattttctccggcgctatttttatcaatctagccctggggcttaacttgtacctagcgatttttctgctgctcgccatcaccgcactctatactataacaggcggactcgcagccgtgatctatacagatacactgcagacggtaataatgttggtgggaagccttatacttaccggattcgccttccacgaagtaggtggttacgatgccttcatggagaagtatatgaaagccattcccaccattgtgagtgatggcaacaccacattccaggagaagtgttacactcctcgcgctgactcttttcacatctttagggaccctctcacaggggacctgccttggccggggttcatcttcggcatgagcatcctcactttgtggtattggtgtactgaccaggtgattgtgcagagatgcctttctgcgaaaaacatgtcccacgttaaaggcgggtgtattctgtgcggctatttgaagctcatgccaatgttcattatggtgatgccaggaatgatttcacggattttatatacagaaaaaattgcatgcgtggtcccatctgagtgcgaaaagtattgtggcaccaaagtaggatgtaccaatatagcctaccctacactggttgtggagttaatgcccaatgggttgcgaggcctgatgctgtcggtgatgcttgctagtctgatgtccagcctgactagcatcttcaattctgcctcaacactgtttactatggacatatacgccaaggtgcgcaaaagagcctcggagaaggagctgatgatcgctgggcgattgtttattctcgtgcttattgggatcagtattgcgtgggtgcccattgtccagagcgcgcagagtggacagttatttgattatatccagagcatcactagctatctgggtccccccatcgcagctgtgtttctgctcgccatattttggaagagagtcaacgagcccggggctttttggggtctgattttaggcctcctgatagggatatctcgcatgatcacagagttcgcctacggcacaggaagctgcatggaacccagcaactgtcccaccataatttgtggggtgcactatctttattttgccatcatccttttcgcaattagcttcattactatcgtggtgatctcactactaacaaagccaattcctgacgtgcatctctaccgactgtgctggagcctgcgtaactccaaggaagaacgtatcgaccttgacgccgaggaggagaatatacaggagggcccaaaggaaacaatcgagattgagacccaagtcccagagaagaagaagggtatcttccggagagcttatgacttgttctgcggcctggaacagcatggtgcacccaagatgacagaagaagaggaaaaagctatgaaaatgaagatgaccgacaccagtgagaagccgctgtggcggacagttctgaacgtgaacggcatcatacttgtaaccgttgcagttttttgtcatgcatatttcgcttag

SEQ ID NO: 206331 - DNA, 1614 bp, Artificial Sequence
  Description of Artificial Sequence: Synthetic coding sequence
atgcccgagtacctgcggaagcggttcggcggccagcggatccaggtgtacctttccctcctaagcctccttctgtacatctttacaaagatctctgctgacatcttttcaggcgccatcttcatcaacttggctttgggcctcaacttgtatttagcaatattcctgctcctggcaattacggcattgtataccattacaggaggactggccgccgtgatctacaccgatacacttcagaccgtgatcatgctggtgggaagccttatcttaaccggcttcgctttccacgaggttggtggttacgacgcctttatggaaaagtacatgaaggcgatccccactatcgtttcagatgggaacaccacgtttcaggagaagtgctatacaccccgagctgatagctttcacatctttcgagacccactcacaggcgacctcccatggccggggtttatcttcggcatgtcaatccttactctgtggtactggtgcaccgaccaagtgatagtacagagatgcttaagtgcaaaaaacatgtcacatgtcaaaggcggttgcattctgtgcggatatttgaaactgatgcccatgtttatcatggtgatgccaggcatgatatccaggatcctgtatacggaaaaaatagcatgcgttgtgccatcggagtgcgagaaatattgcggcaccaaagttggctgcacgaacattgcctatcctactctggtagttgagctgatgccgaacggccttcgagggctgatgttaagcgtgatgctcgctagcctaatgtcttccctgacctccatctttaattcagcttccacgctctttacaatggacatctacgccaaagtcaggaagagagcttccgagaaagaacttatgatagcggggcgactgttcatactggtactcatcggaataagcatagcctgggtgccgattgttcagagtgcccaatctggtcagctgtttgattacattcagagtattaccagctatctggggccccctattgcggccgtgtttctattagcaattttctggaagcgcgttaatgagcctggagccttctggggtcttatacttgggctccttattgggatttcccgtatgattacagaattcgcctacggcacgggtagttgcatggaacccagcaactgtcccacaatcatctgcggagtgcactacctgtatttcgcaattatcctctttgcaatcagtttcatcacgatcgtggtcatcagtctgctcacaaagccaattcctgatgtgcacctctaccggctgtgctggagcctgagaaacagcaaggaagagcgcatagacttggatgccgaagaagagaacattcaggaaggtcccaaggaaacaatcgaaattgagactcaagttcccgagaagaaaaaaggaatttttcgcagagcttatgacctgttttgtgggctagagcagcatggagccccaaagatgacagaagaggaggagaaggccatgaaaatgaagatgacggatacgtctgaaaaacccctatggcggactgtattaaatgtaaacggcatcatcttagttaccgttgccgtcttttgtcacgcgtattttgcttag

SEQ ID NO: 206332 - DNA, 1191 bp, Artificial Sequence
  Description of Artificial Sequence: Synthetic coding sequence
atggaggtgaagaacttcgccgtgtgggactacgtggtgttcgccgctttgttctttatctcatcgggcatcggggtgttctttgctatcaaagagcgtaaaaaagctaccagcagggagtttcttgtggggggccgccagatgtcttttggcccagttgggctgtctttaaccgcctcatttatgtccgccgtcacagtcttgggaacaccctccgaggtctatcggttcggcgcctcatttctggtgtttttcatcgcctatttgttcgtgatcctgctaacctcagagctcttccttccagttttctatcggagcggcattaccagcacctatgaatatctgcaattacgctttaataaacccgtgcgctacgccgccaccgtcatctatatagtgcagaccatcctctacacaggtgttgtcgtctacgcccctgctttggccctgaatcaagtcaccggattcgatctatggggcagtgtttttgctacggggatcgtctgcaccttctactgcacacttggaggactgaaagctgtggtatggacagatgcattccaaatggtggtgatgatcgtcggcttccttaccgttctcatccaagggagtactcatgcaggaggcttccataatgtgctggagcagtctactaatgggagtagactacatatattcgacttcgacgtggatccattaagacggcatactttttggactattacagtaggaggcacatttacttggcttggcatctatggagtgaaccagagcaccatccagcggtgtatttcatgtaagactgaaaagcacgcaaagctggccctctactttaatctactgggcctgtggatcattctcgtgtgtgccgtgttttctgggctgataatgtacagccactttaaagattgcgatccatggacatcaggcattatctccgcgccagatcagctgatgccttatttcgtgatggagattttcgctaccatgcctggccttccaggtctgttcgtagcctgcgctttcagtggcactctctcaacagttgcttcatcaatcaatgccctggccactgtgactttcgaggactttgttaaaagttgttttcctcacctgtctgacaaactatcaacctggattagtaaagggctgtgcaggtactcatggtggaccttctattccattagctag

SEQ ID NO: 206333 - DNA, 1857 bp, Artificial Sequence
  Description of Artificial Sequence: Synthetic coding sequence
atggaggtgaagaacttcgccgtgtgggactacgtggtgttcgccgcactgttttttatttcgagcggaatcggggttttttttgccatcaaagaacggaaaaaagcaactagtcgggaattccttgtgggaggacgccaaatgagctttggccctgtgggcctgtctttgacagcctccttcatgtctgccgtaaccgtcctcggaacaccttcagaggtgtatcgtttcggagcaagcttcctagtgttcttcattgcttatctgttcgtaatcctcctcacatctgaactcttcctaccagtcttctataggtctggcatcacatccacttacgagtacctacagcttcgtttcaataagccagttagatacgccgctacagtcatatacatagtgcagaccatcttgtatacaggcgtggtggtgtatgcccccgcactcgctttgaatcaggtgacgggcttcgatctttgggggagtgtctttgcaaccggtatcgtgtgcacattctactgcaccctaggggggctgaaggccgtggtatggacagacgcctttcagatggtggttatgattgtgggctttctgacagtcctgatacagggcagtacccacgccgggggctttcacaacgtcctggaacaatctacgaacggtagcaggctgcatatattcgacttcgatgtggaccccctgcgccgccacaccttttggaccataactgtgggcggtactttcacatggcttgggatctacggggtgaaccagagcaccatccagagatgtattagctgtaaaaccgagaagcatgccaaactcgctctctatttcaatctcctcgggctctggataattcttgtctgtgccgtttttagcggcctgataatgtacagccacttcaaggattgtgatccgtggacttccgggatcatcagcgccccggatcagctcatgccttacttcgtgatggagatcttcgcaacgatgcctggccttcctggactgttcgtcgcctgcgcattttccgggaccttatccaccgtagcgtcatctataaatgcccttgctacagtgactttcgaagatttcgtgaagtcctgcttcccacatctctccgacaaattatcaacatggatctccaaggggctgtgcctcctctttggcgtaatgtgcacatcaatggccgtagctgctagcgtcatgggtggggtggtgcaggcatcactcagtatccacgggatgtgcggtggccctatgcttgggttgttttctcttggcattgtgttcccttttgtgaattggaaaggggccctcggagggctgctgaccggcattactctgtctttttgggtggctatcggcgcattcatttaccccgcacccgcttccaaaacctggcccctgcccctgtctacagatcaatgcattaagagtaatgtgaccgcgaccggcccgcctgttttgtctagtagaccagggatcgctgacacctggtattctattagctatttgtattattcggccgtcggctgccttgggtgtatcgttgccggtgtaataattagcctaattacgggaagacagcggggagaagatatacagccgttgctgatacgccctgtgtgcaatctattctgcttttggtctaaaaaatacaagacactgtgctggtgcggcgttcagcacgacagcgggacggagcaagaaaatctcgagaacggaagcgcccgcaagcaaggagcggaaagtgtcctccagaacggactgcggcgtgaaagccttgtgcatgtccctggatatgacccaaaagataagtcctataacaatatggcctttgaaacaactcacttctag

SEQ ID NO: 206334 - DNA, 834 bp, Artificial Sequence
  Description of Artificial Sequence: Synthetic coding sequence
atggtggtgatgatcgtgggcttcctgaccgtgctgatccagggctctactcatgccggtggcttccacaacgtgctggaacagagcaccaatgggagtcgcctccacatatttgacttcgacgtggaccctttgcggaggcataccttctggacaataaccgtcgggggcacgttcacatggttgggcatttacggcgtaaaccagtcgacaattcaaaggtgtattagttgtaaaactgagaaacacgctaagcttgcactgtacttcaacttgctgggcctatggatcatcttagtttgcgctgtctttagtggactgattatgtactcccacttcaaggactgcgatccctggacttctggcatcataagcgctccagaccagttgatgccatatttcgtaatggaaatcttcgctactatgcccggtctgccggggctcttcgtcgcctgcgcttttagcggaacactgtctacagttgcaagcagcatcaatgctttagcaactgtgacattcgaagattttgtgaagtcatgtttccctcacctgtctgataagttgtccacctggatctcaaaaggcttgtgccgcagtctgatctggcgcgacgtttacctatacggctgcggatgtatatgtcacggaaggtgttgtgcgggcttcccacagcacagtaggcacgtttggcggaccaatgccgggcttattttacccggcaacagggtccctttctgcgaattggaggggtgcacacgcagatcctcctattggaaccatctggtcattcttgggggccactggggactgcatctcccgtgtacatctctgtag

SEQ ID NO: 206335 - DNA, 2019 bp, Artificial Sequence
  Description of Artificial Sequence: Synthetic coding sequence
atggaggagcacaccgaggccggcagcgcccccgagatgggcgcccagaaagcccttatcgacaacccagccgacattctcgtaatcgccgcatatttcctattggtgattggcgtgggcctgtggagcatgtgtagaaccaatcgcggcaccgtaggcggctattttctggccggacgctctatggtctggtggccagtgggagcgtctctgttcgcatcaaacattggctcaggccacttcgttggtctagctggcactggagcagctagtggactggctgttgcaggattcgaatggaacgccctgttcgttgtcctgttactgggatggttatttgcgcccgtctatctgaccgccggagtgataactatgccgcagtacttgcggaagaggttcggggggcgaaggattcgtctgtatctgagcgtccttagtctcttcctttatattttcactaagattagcgtcgatatgttttcaggagcagtattcatacagcaggcccttggctggaatatttatgcttcggtaatagccctgctgggtattaccatgatttataccgttacaggggggttggctgctctgatgtatacagataccgttcaaacattcgtcatcttagggggggcctgcatactcatgggatatgcattccatgaagtgggcggatacagtggattgtttgataagtacctcggtgccgcgacttccctcacagtttctgaagaccccgccgtgggcaacattagcagcttttgctatagaccgaggcccgattcctatcatctcctgaggcaccctgtgactggagacttaccctggccggcgctcctcctgggactgacgattgtttctggctggtactggtgttcagatcaggtaatagtgcagaggtgtttagccggaaaatccctgacacacataaaggctggctgcattctctgtggctatctgaaactgacaccaatgttcctgatggtgatgccgggcatgatttcccgaatactataccctgacgaggtcgcctgtgtagttcccgaggtgtgcaggagagtttgtggtaccgaggtgggttgcagcaacattgcatatccacgtctagtcgtaaaattgatgccgaatggactcagagggctcatgctggccgtcatgctcgccgcgctgatgtcttctttagcaagcatttttaactctagctccacactattcacaatggatatctacacccggctgagaccgcgggccggagaccgtgagctacttctggtcggcagactctgggttgtgttcattgtggtggtttccgtggcctggctcccagttgtacaggctgcccagggcggtcagctgtttgattacattcaggccgtgtcttcctacttggctcccccagtgtccgctgtgttcgttcttgctctatttgtaccccgggtgaacgagcaaggcgctttctggggactgatcggtggccttctgatggggcttgctagactgatacccgagttttcctttggatccggcagctgtgtccagccttccgcctgtccagctttcctgtgcggtgtccactacctgtattttgctatcgtactattcttttgctcaggactcttaaccctgaccgtgagcttgtgtacagcccccataccaaggaaacacctccaccgcctggtcttcagcctgagacattccaaggaagagcgcgaggatctggacgctgatgaacaacaggggagttctctccctgtgcagaacggttgtcctgagtcagccatggaaatgaacgagccacaggcccccgctccctccctgttcagacagtgcctgttgtggttctgtggaatgtcacgagggggggtgggctcccctcctcctctcacccaggaagaggctgccgccgctgcacgcaggctcgaggacattagcgaagaccccagttgggcccgcgttgtcaacttaaacgcactcctcatgatggctgtggcagtgtttctgtggggcttttacgcatag

SEQ ID NO: 206336 - DNA, 1377 bp, Artificial Sequence
  Description of Artificial Sequence: Synthetic coding sequence
atggaggagcacaccgaggccggcagcgcccccgagatgggcgcccagaaggccttgatcgataaccctgcagacatcctggttatcgccgcctactttctactggtgataggggtgggcctatggagtatgtgcagaaccaaccggggcacggtggggggctactttctggcggggagatccatggtgtggtggcccgtaggcgcaagcctcttcgctagcaacatagggagtggacactttgtcggtttggccggcacaggagcagccagtgggctggcggtcgccggcttcgagtggaatgccctgttcgtagtgttacttctgggttggttgttcgctcccgtgtacctcaccgccggcgtcatcactatgccacagtatttgaggaagagattcggcggccgccgcatacggttgtacctgagcgtgctttcactctttctttatatttttactaagatttctgtggatatgtttagcggcgccgtatttattcagcaggccctggggtggaacatctacgctagtgtcattgccctgcttgggattactatgatatacaccgtaactggcggtctggccgctctaatgtacacagacaccgtgcaaacgtttgtcattctggggggcgcctgcatcctgatgggatacgcatttcatgaggtcggtggctatagtgggctttttgataaataccttggggcagctacatctctgaccgtgtccgaagacccagccgtgggcaacattagcagtttctgctatcgcccccggccggattcgtaccatctacttagacacccagtgacaggtgacctcccatggccagccctgttgttgggcctcacaatcgtgagcggctggtattggtgttccgatcaggtgatcgtccaacgctgtctcgccggcaaaagcctcacccatattaaagctggttgcatcctgtgcggatatctgaagctgacaccaatgtttctgatggtgatgccggggatgatctctagaatcctataccccgacgaagtcgcatgtgtggttcctgaggtgtgcagacgggtgtgtggcaccgaagtgggctgtagcaacattgcataccctaggctggtggtgaagctcatgccaaacggcagattgcttggtactcacaggggaccagctgatggccccgggacccctgacagcagagtcctgcttaggcttggccagttgtgcgcagcactgggagtgccctctttcccgctgcgccgcgccctgcctctcttgaggcactgcgcggtattgctgctttggccgccccacccccacggacttcctgtgcaccgagcccatccacagaaagccccccctccaccagggttgcaatcgcccgcatag

SEQ ID NO: 206337 - DNA, 2157 bp, Artificial Sequence
  Description of Artificial Sequence: Synthetic coding sequence
atgcgggccgtgctggacaccgccgacatcgccatcgtggccctgtacttcattctggtcatgtgcattggattttttgcaatgtggaagtctaacagatcgaccgtgtcaggatacttcctggccggccggagcatgacctgggtgactatcggcgcatctttattcgtgtctaacattggcagtgaacatttcattggacttgcggggagcggcgccgctagcgggttcgctgtgggcgcttgggaattcaacgcactgttactgctgcagcttctgggatgggtgtttattcccatctatataaggagcggagtttacacaatgccagagtacctatctaaaaggtttggtggccaccgtattcaggtctacttcgcagctttgtcactcatcctgtatattttcaccaaactttccgtggatctttattccggtgctctttttatccaggagagcctgggctggaacctctacgtcagcgtcatactgctcatcggcatgacagccctcctgacagttaccggaggcctcgtggcagtgatttataccgatacgcttcaagctctgctcatgattatcggtgctctgaccttaatgatcatcagtataatggaaatcggcgggttcgaggaagtgaagcgacgatacatgttggctagccccgatgtcacgagcatccttctgacctacaacctgtctaacaccaattcctgcaatgtcagtcctaaaaaagaagccctgaaaatgctgcgcaatcctacggatgaggatgtgccgtggcccgggttcattctgggccagacaccagcatccgtatggtactggtgtgctgaccaggtgattgtccagagagtacttgcagctaaaaatattgcccatgcaaaggggagtacccttatggcaggttttctgaaactcctgcccatgttcataatcgtagttcccggtatgatttctaggattctgtttacagacgacattgcctgcataaatccagagcactgcatgctcgtttgtgggtccagggcaggctgctccaacattgcctatcccaggctggttatgaagctcgtgccagtgggcttaaggggtctgatgatggccgtgatgatcgccgcgctcatgtctgatctcgattcaattttcaactctgccagtactattttcaccctggacgtgtacaaactcatccgtaaatccgcaagtagtcgagagctgatgattgttggccggatcttcgtggcgttcatggtcgtgatctccatcgcctgggtgcctattatagtggaaatgcaaggaggacagatgtatctgtacattcaggaggtcgcagactatctcaccccccctgtcgcagccctcttcctgctggcaatcttctggaaacgatgcaacgagcagggagccttttacggcgggatggcgggctttgtgctgggggccgtccgcctcatcctggcctttgcttacagggcgccggagtgcgaccaaccagataatcgacctggatttataaaggacatccattacatgtacgtagcgacagggctgttttgggtgacaggactgatcaccgttatcgtgtcactgctgacgcctccaccaaccaaagagcagatacggaccacaactttttggagtaaaaagaacctggttgtcaaggagaactgttcccctaaagaggagccttatcagatgcaagaaaagagtattcttaggtgttccgaaaataatgaaaccattaatcacattattcccaatggtaagtcagaggacagcattaaaggcttacagcccgaagacgttaacctcctcgtcacatgccgggaagaggggaacccagtcgctagtctaggacactctgaagccgagacccccgtggatgcctattcaaatggacaggcagccctgatgggcgaaaaggaacgaaagaaggaaaccgatgatggagggcggtactggaagttcatagactggttctgcgggtttaagtctaagtccctgagcaagaggtctctgagggacctgatggaggaagaggcagtttgtcttcagatgctcgaggaaactaggcaggttaaagtgatactgaacattggactgttcgccgtgtgttcactaggcatttttatgtttgtctatttctcactctag

SEQ ID NO: 206338 - DNA, 504 bp, Artificial Sequence
  Description of Artificial Sequence: Synthetic coding sequence
atggaggccggcggcttcctggacagcctgatctacggcgcctgcgttgtctttaccctggggatgtttagtgccggtctgtcggatcttaggcacatgcggatgaccaggtctgttgacaacgtgcagtttttaccattcctaacaaccgaggtgaacaacttagggtggctcagttatggagcactgaagggagatggaattctgattgtggtaaacacggttggggcagcgttacagactctgtacattctggcgtatctgcattattgccctagaaaagctaaagtgatccagacgaaatcaacccagtgcctctcgtatcctctgactatagcaacattattgactagtgccagctggtgcctctacggtttccgcctcagggacccttacattatggtaagtaactttcccggcatcgtgacaagtttcattagattctggttgttttggaaatatccccaggagcaggatcgtaactattggctgcttcagacctag

SEQ ID NO: 206339 - DNA, 501 bp, Artificial Sequence
  Description of Artificial Sequence: Synthetic coding sequence
atgcggggcctgcacccctggcacgtgctgcggcggcccctgggcccacaggcacacgcaaatgacccagagtgtggtcaaaggcccgtccccgcgctgtcccaccacggatctcagcgcgtcgtgcttttgcagactgctactctgctgggggtactgcttttgggatacggatacttctggcttctggttcccaatcccgaagccaggctccagcagctgggactgttttgcagtgtctttaccataagcatgtatcttagccccctggcagatctagccaaagtgatccagaccaagtccacacagtgtctgagttaccctttaacgatcgcaacccttttgacttctgcctcctggtgcctgtatgggttcagactcagggatccatacatcatggtgtccaatttcccaggcatcgtgacctcattcattagattctggctgttttggaaataccctcaggagcaggatcgaaactattggttactgcaaacgtag

SEQ ID NO: 206340 - DNA, 666 bp, Artificial Sequence
  Description of Artificial Sequence: Synthetic coding sequence
atggaggccggcggcttcctggacagcctgatctacggcgcctgcgttgtgttcaccctgggcatgttttcggccggactgagcgatctgcgacatatgcgcatgaccagatcggtcgacaatgttcagttccttccgtttctcacgaccgaggtaaataatctcgggtggctgagttacggcgcactgaagggagacggaatattaattgtggttaacactgttggcgccgccctccaaaccctgtacattctggcttacttgcattactgccccagaaagagagtcgtgctgctccagacagctacgctgctgggcgtgctgctcctaggttatggatatttttggctgctagttcctaatccagaggcaaggctgcaacaactgggactgttttgttctgtcttcaccatctctatgtacctttcaccactggctgatctggctaaggtcatccagacgaagtctacgcagtgtctgagctaccctctgaccatagcaacactcctcacttccgccagctggtgcctctatggtttccgtttgcgggacccttacattatggtctctaactttccgggcatagtgacatctttcattcgattctggctgttctggaaatacccacaggaacaggacaggaactactggttactgcagacgtag

SEQ ID NO: 206341 - DNA, 471 bp, Artificial Sequence
  Description of Artificial Sequence: Synthetic coding sequence
atggaggagctgggcccccaggcccacgccaacgaccccgagtgcggacagcgtccagtgccagccctatcccaccacggtagtcaaagagtcgtgctgctacagaccgctactctgctgggcgtgctgcttcttggctatggttatttctggctgctggtgcccaaccccgaagctcgtctgcagcagttgggcctgttctgctctgtctttacaatttctatgtatctcagtccacttgccgatctcgctaaggtgattcaaactaaatcaacgcagtgcctctcataccctctgactatcgccacgttactgacatctgcgtcatggtgtctatatggattccggctgcgagacccctatataatggtgtctaattttccaggaatagtgacatcctttattaggttctggctattttggaaataccctcaggagcaggatcgaaactactggctcctgcaaacctag

SEQ ID NO: 206342 - DNA, 1929 bp, Artificial Sequence
  Description of Artificial Sequence: Synthetic coding sequence
atggacaagctgaagtgccccagcttcttcaagtgccgggagaaggaaaaggtgtctgcgagctcagaaaattttcacgttggggaaaacgacgagaatcaggatcggggcaactggtctaaaaaatcagattacctcctcagtatgataggctacgcagtcgggttaggcaacgtgtggcgattcccatacttgacctactctaatggaggcggtgctttcctgatcccatacgctataatgcttgctttggctggattgccactgttcttcctggaatgctcacttgggcaatttgccagcttagggcctgtgtcagtgtggaggatcctccctctattccagggagtcggcataacaatggtcctcatcagcattttcgttaccatctattacaatgtgatcatagcatacagtctgtactatatgttcgcctcattccagagcgagcttccctggaagaactgcagctcatggtctgataaaaactgttctaggagtcccattgtgacccactgtaacgttagcacagtgaataagggtattcaggaaattatccagatgaacaaatcctgggtggacattaataactttacatgtatcaacggaagcgagatttaccagccgggtcagttaccatccgagcagtactggaacaaagtggcacttcagcgctccagcggtatgaacgagacaggagtgatcgtgtggtatcttgccttgtgccttcttctggcttggttgatagtgggcgccgccctcttcaagggaattaaatccagtgggaaagtggtctacttcactgccttatttccatacgtggttcttctaatactactcgtgaggggtgcaacgctggaaggagccagcaaagggatttcgtactacatcggcgcccagtccaacttcacaaagttgaaggaagctgaagtttggaaggatgccgcaacacagattttttattctctatcagtcgcctggggcggcctcgtggcactgtcaagttacaataaatttaagaataactgtttctcagatgcaatcgtggtatgcctgactaactgccttacaagcgtatttgctggattcgcgatcttttctatactcggacacatggcccatattagcggtaaagaggtgagccaggtggtcaaaagtggctttgacctggcattcatagcatacccggaggccctagctcagctgcccggcggtcccttctggtctatattgttttttttcatgctacttacactgggactggactctcagtttgcttccattgagaccataaccactaccatacaagacctcttccccaaggtaatgaagaagatgagagtgcctattacgctggggtgttgtttggtgctcttcttactcgggctggtttgcgtgacgcaggctgggatttactgggttcacctgattgaccatttctgcgcggggtggggcatactcattgcggcgattctggagttggtcggtataatctggatttacggcgggaaccgctttatcgaggacaccgagatgatgataggtgcaaagaggtggatattctggctgtggtggcgggcctgttggttcgtcatcacccctatcctcctcattgcaatctttatctggtccctggtacagtttcaccgcccaaactatggcgccatcccctatcctgactggggcgtggccttggggtggtgtatgattgtcttctgcatcatctggataccgataatggccataatcaagattattcaggccaagggaaacatttttcagcggctcatctcttgttgcagaccagcctcaaattgggggccctatctggaacagcaccggggagagaggtataaggatatggtggatcccaagaaagaggctgaccatgagattcccaccgtgtcgggctccagaaaacctgaatag

SEQ ID NO: 206343 - DNA, 1539 bp, Artificial Sequence
  Description of Artificial Sequence: Synthetic coding sequence
atgggcgtgcagtggtggagccacacccagggcgaggtggccgtgggcctggggttgggtgactcttacctgactccttgcccctgccctggggtcggctatgccgtgattttgatagccctgtatgtgggtttctattacaatgtcattattgcatggtccctgtattaccttttcagcagcttcacactgaatctcccatggaccgactgtggacacacatggaatagccctaactgcactgaccccaagctgttgaacgggagtgtcctgggaaatcacacaaaatattccaaatacaaatttactcccgctgcagaattttatgaaagaggggtgcttcacttgcatgaatcaagcggtatccacgatatcggcctcccccagtggcaactcctgctgtgtttaatggtcgtggtcattgtgctgtatttcagcctctggaagggcgtgaaaacgtccgggaaagtggtgtggattactgccaccctcccttacttcgttctgttcgtgcttctggtgcacggtgtgaccttgccaggcgctagtaacggtatcaacgcgtacttacacatcgatttttaccgcctgaaagaggcaacggtgtggatcgatgccgcaacgcagattttctttagcctcggggcagggttcggggtgctaatagcctttgcatcttataacaaattcgacaacaattgctatagggacgcacttctgacatccagcattaattgtattacatcgtttgtatccggattcgctattttctctattcttggctacatggcgcatgagcacaaggtcaacatagaagacgtagccaccgaaggagcaggtctggtgtttatcctgtatccagaagccattagcacgctttccggaagtacattttgggctgtggttttcttcgtgatgctgctggcactgggtctcgactctagcatgggtggcatggaagcggttattaccggccttgccgacgacttccaggtattgaaaagacatcggaagcttttcacctttggagtaacgttcagcacctttctgctcgccctcttttgcattactaaagggggaatctacgtgctgacgctgttggatacgttcgccgctggtacgtcgatcctgtttgcggtccttatggaggccataggcgtgagttggttctacggtgtggatcgctttagcaacgacattcagcagatgatgggcttcaggccgggtctttattggcgcctatgctggaagttcgtgagccccgcctttcttttgttcgtcgtggtggtgtctattatcaacttcaagccactgacatacgatgactacattttccccccgtgggccaattgggtcgggtggggcatagccctgtcttcgatggtactcgtgccaatctacgtgatttataagtttctctctacacaaggaagcttgtgggagcgacttgcttatggaatcaccccggagaatgagcatcatctggtagcccagagagatatccggcagttccagctgcagcactggctggccatctag

SEQ ID NO: 206344 - DNA, 1845 bp, Artificial Sequence
  Description of Artificial Sequence: Synthetic coding sequence
atggacggcaaggtggccgtgcaggagtgcggcccccccgccgtgtcctgggtccccgaagaaggggaaaagttagaccaagaggatgaggatcaggtcaaggaccgggggcagtggaccaataaaatggagtttgtactctctgtggccggagaaatcattggactgggtaatgtgtggcgctttccctatctgtgttacaaaaatggcggcggggccttcttcattccttactttattttcttcttcgtgtgcggcatcccagtcttcttcctcgaggttgccctggggcagtatacctcccaagggtcagtgacagcctggcgtaagatttgtccgctttttcagggtatagggctcgcctcagtcgtcatagagtcatacctaaacgtatattacattatcatcttggcatgggctcttttctatttgttttctagcttcacctccgaacttccatggaccacatgcaacaatttttggaatacagagcattgcacagactttctgaatcatagtggagcgggaactgtgacaccattcgagaactttacctcaccagtaatggagttttgggagcgacgcgtgttaggcatcacctccggcatacacgatctcggcagcctgcggtgggagttggctctctgcctgttactggcctgggtgatatgttacttctgtatctggaaaggcgttaagtccactggaaaggtggtctattttacagcaactttcccttacttgatgctagtgattctgttgatccgaggcgtcactctgcccggggcttaccagggaattatatattacctgaaacctgacctgttccgcctgaaggatccgcaggtctggatggatgccggcacccagatatttttttcttttgcgatctgtcaaggctgtttgaccgccctgggaagctataataagtatcacaacaactgttacaaggattgcatcgctctgtgctttctgaattcagccacttcttttgtggcaggatttgtagtattttctatcctgggattcatgtcacaagagcagggggtgcctattagtgaagttgcggagagcggcccagggctcgcctttatagcgttccccaaggctgtgaccatgatgcccttgagccagctttggtcttgtctgttttttattatgctcatatttctgggcctcgatagccagtttgtctgcgtagagtgtctggtaactgcaagcattgatatgtttccgaggcagctgaggaaatctggacgaagagagctgctgatcctgactattgcagtgatgtgttatttaattggtctgtttcttgtcactgaaggaggtatgtatattttccagttgtttgattattacgcctcctccgggatctgcttactatttctaagtttgttcgaagtcgtgtgtatatcttgggtctatggggcagaccggttctatgataatatagaagacatgattggctaccggccctggcccctcgtgaaaataagctggctctttctcacaccaggattatgtctggcaacattcctgttctcactgagtaagtatacgcccctgaagtataataatgtgtatgtgtatcctccctggggctattcaatcggttggtttttggccttatcctccatggtgtgtgtccctctttttgtggtgattacccttctcaagaccagaggtcccttccgaaagcggctgcgccagctcatcacaccagactcatcccttcctcagcctaagcagcacccctgcctagatgggtctgccggccgaaactttggaccatcacctactagagaaggtctgattgctggagaaaaggaaacacatctgtag

SEQ ID NO: 206345 - DNA, 1845 bp, Artificial Sequence
  Description of Artificial Sequence: Synthetic coding sequence
atggacggcaaggtggccgtgcaggagtgcggcccccccgccgtgagttgggtccctgaggagggagagaaactcgatcaggaagacgaagaccaggtgaaggatcgcggacagtggactaacaagatggagttcgtattgtctgtcgccggagaaatcataggactcggtaacgtgtggcggttcccctacctctgctacaagaacggcggcggggcattcttcatcccatacttcatctttttcttcgtgtgtggcatccccgtgttcttcctagaggttgcgttagggcaatacacctctcagggttccgtcaccgcctggcggaagatctgtccactattccagggcatagggttggcgtcggtggttattgaaagctacctcaacgtgtactatatcattattttagcctgggctctcttctacttattctccagctttacaagcgagttaccgtggactacatgcaacaatttttggaatactgaacactgtacggatttcctgaaccattcgggcgctggcacagttactccatttgaaaacttcacctcaccagtgatggagttctgggagagacgggtccttgggatcacatccggtatccacgatctgggctctttgcggtgggaactggctctttgtctgctgctagcttgggtgatttgctacttttgcatttggaaaggggtcaagagcactggcaaggtggtctacttcactgcgacattcccctatctgatgttagttatcctactgatcagaggcgtgaccttaccaggagcataccagggaattatatattatctcaagccggaccttttccggctgaaggatccacaggtatggatggatgccggtacccaaatattcttcagctttgcaatctgccagggatgtcttaccgctctcggctcttacaataaataccataacaattgttacaaggattgcatcgccctttgcttccttaactccgccactagcttcgtcgctggtttcgtggtgttttccatcctcgggtttatgtcacaggaacagggagttccaataagcgaagtagccgaatccgggcctggcttagccttcatcgccttcccaaaggcagtgactatgatgccgctctcacaactgtggtcatgcctgtttttcatcatgttgattttcctgggcctcgacagccagtttgtctgcgtcgagtgcctggtcacggctagtattgacatgttcccacgccagctgagaaaatcgggtcgacgcgagctgctcatcttgactatcgcagtcatgtgctacttgattggactgtttctggtaacggagggcggcatgtacatattccagctttttgattattatgcttctagcggcatttgcctactgtttttgagcctgtttgaggttgtctgcataagttgggtttatggggctgaccgcttctatgacaatattgaagacatgatcggatacaggccgtggccactggtaaagattagttggctatttttaactccaggtctgtgcctcgctacatttttgttcagtcttagtaagtatacacccctaaaatataataacgtctatgtttatcccccgtggggatattcgataggatggtttctcgctttgtcctccatggtctgtgtgccactcttcgtggtcatcacactgttaaaaacccgcggacccttcaggaaacggctgcgacagctgatcacccccgatagcagcctcccccagcctaagcaacatccctgtcttgacggctctgctggtcgcaacttcggcccgagccctactcgggagggcctaattgccggcgagaaggaaacgcatttgtag

SEQ ID NO: 206346 - DNA, 1845 bp, Artificial Sequence
  Description of Artificial Sequence: Synthetic coding sequence
atggacggcaaggtggccgtgcaggagtgcggcccccccgccgtgtcctgggtgccagaggagggggaaaagctcgaccaggaggatgaggatcaggttaaggatcgcggacagtggacaaacaaaatggagttcgtcctcagcgtggctggcgaaattattggactcggtaatgtatggcgctttccttatctctgctacaagaatggcgggggagctttctttattccctatttcatctttttcttcgtctgcgggattcctgtgttttttctcgaggttgccttggggcagtacacgagccagggcagtgttaccgcttggcgcaaaatctgtcctttgtttcagggtatcggcctcgcctccgtggtcatcgagtcctatcttaacgtgtattatatcatcatccttgcctgggcccttttttacttgttcagtagttttacttcagagctgccttggacaacctgtaataacttctggaataccgagcactgtacagattttctgaaccattccggtgctgggactgttaccccatttgaaaacttcacatcccccgtgatggaattctgggagcgacgtgtactgggtatcacttcaggcatccatgatctgggctccctcagatgggagttggcattatgcctcctgctggcatgggtcatctgctacttctgcatctggaagggggtaaaatctactggcaaggtcgtgtattttaccgcaactttcccctacctgatgctggtgatccttcttatccgcggggtaacactacctggggcttatcagggtatcatttattatttgaagcctgacttgttccgcttgaaagatccacaggtttggatggacgctgggacccagatctttttctcttttgccatttgccagggctgtctgaccgccctcgggagttacaacaaataccacaataactgttacaaggattgcatcgccctgtgtttcctgaattctgccaccagttttgtggcgggctttgtcgtgttcagtatcttgggctttatgagtcaggagcagggcgtccctatctctgaggtcgccgaatctggccctgggctggcttttattgccttccctaaagcagtcacaatgatgccgctgtcccagctctggtcttgccttttcttcattatgttgatattcctcggtctggattctcagtttgtttgcgtcgagtgcctggtgacagcttccatagatatgtttccccgccaactgagaaaatcaggcagacgcgaactgttaatactgacaatcgccgtgatgtgctatctcatcggcctgttccttgtgacagagggtggaatgtatattttccagctcttcgattattacgcatcctctggtatttgtctcctgtttctttcactgtttgaggttgtttgcatcagctgggtttacggcgctgatagattctacgacaacatagaagacatgatcgggtaccgcccatggccattggtgaaaatatcttggctgtttcttacacccggtctctgtctcgccacttttctgttttctttgtctaagtacacccccttaaaatacaacaacgtgtacgtgtatccaccatggggttattccatcggatggttcttggccctgtcaagcatggtgtgtgtgcccctattcgttgtgatcacactgcttaagactcgcgggccttttcggaagcgcctgagacaactcataacgccagattcctcactgccacagcccaaacagcatccctgcttggacggatctgcaggaaggaattttggaccttcacccactagagaagggcttatcgccggcgaaaaggagacccatctgtag

SEQ ID NO: 206347 - DNA, 1845 bp, Artificial Sequence
  Description of Artificial Sequence: Synthetic coding sequence
atggacggcaaggtggccgtgcaggagtgcggcccccccgccgtgagctgggtgcccgaggagggagaaaagctggaccaggaggatgaggaccaggtaaaagatcgggggcagtggaccaataagatggagtttgtgctgtctgtcgcaggggagatcatcggacttggtaatgtttggaggtttccctatttgtgttacaagaatggcggaggcgccttcttcatcccctatttcatcttcttcttcgtctgtggcatacctgtatttttcttggaggtggcgctgggacaatatacctctcaggggagtgttacagcttggaggaaaatttgcccactctttcagggtatcgggctggctagcgtggtgatcgaatcttacctcaacgtatactatatcattatcctggcctgggctttgttttacttattttccagttttaccagcgaactcccttggacaacatgcaacaatttctggaacaccgagcactgcacagatttcctgaaccactcaggggctggaaccgtgactccattcgaaaacttcacatcgcccgtgatggagttctgggaaagaagggtgttggggattacaagtgggatccacgatttaggctccctgagatgggaacttgctttatgcctgctcctggcctgggtcatctgttacttttgtatatggaaaggggtgaaaagcactgggaaagttgtgtatttcaccgcgacctttccttacctgatgttggtgattctgcttattagaggcgtgaccctacccggagcctatcaggggatcatatactacctgaaacctgacttgtttcgacttaaggaccctcaggtttggatggatgccggcacccagatcttcttctcctttgcaatctgtcagggctgcttaaccgccctcggctcatacaataaataccataacaactgctataaggattgtatcgcactttgcttcctaaattcagcaacttccttcgtggctgggttcgtggtgttctctatcctgggatttatgtcccaggagcagggggtgcccatctcagaggtcgcggagtccggacctgggctagcgttcattgcttttccgaaggccgtgacgatgatgccactgtcccagctctggtcttgtctgttttttatcatgctgatctttctcggcctggattcacagtttgtgtgcgtcgagtgcctggtaaccgcgagcatcgacatgttcccacgccagctccgaaagtccgggcgtcgtgaactgttgatactgacaattgccgtcatgtgttatctgattgggctttttttggttacagaggggggcatgtatatctttcagttgtttgattattacgccagcagtggaatttgtctactcttcctgagcctctttgaggtagtgtgtatttcttgggtttacggcgccgatcgcttttacgataatatcgaggatatgattggttacaggccctggcccctggtgaagatctcttggctgtttctcacacctggcctttgtttggctacatttttgtttagcctatctaaatacactccactgaaatataataacgtgtatgtgtaccctccctggggctacagcatcggctggtttcttgcgctgtccagcatggtgtgtgtgcctctgtttgtcgtcatcaccttactgaagacaagaggacccttccgaaagagactgcgtcagctgataacccctgacagctcgctgcctcagccaaagcagcacccatgccttgacggctcagccggtagaaattttggcccttccccaacacgggaggggctcatagctggcgaaaaagaaactcacctctag

SEQ ID NO: 206348 - DNA, 1845 bp, Artificial Sequence
  Description of Artificial Sequence: Synthetic coding sequence
atggacggcaaggtggccgtgcaggagtgcggcccccccgccgtgtcctgggtccccgaggaaggagagaaactggatcaggaagatgaggaccaagtgaaagatagagggcagtggacaaataaaatggaattcgtgctgtccgtcgcaggggagatcatcggtctgggtaacgtgtggcgcttcccatacctctgttacaagaacggaggaggtgccttctttatcccttacttcattttctttttcgtttgcggaattcccgtctttttcctagaagtcgctctgggccagtacacaagccaaggatccgtgaccgcttggcgtaaaatatgtcctctcttccaaggcattgggttggcaagtgtcgttatcgagagctatttgaatgtgtactacattatcatcctagcttgggccttattttacctgttctcctccttcacctccgagctcccttggaccacgtgtaacaacttttggaacaccgaacattgtactgacttcttgaaccattccggtgcagggaccgtgaccccctttgagaatttcaccagcccagtgatggaattctgggagcgcagagtcctgggcataacatccggcatccatgacctgggcagtctgagatgggaactggccctctgcctcttgctggcctgggtaatttgctatttttgcatttggaagggagttaagtcaaccggcaaagttgtgtattttactgctacttttccatacctcatgctggtgatactactgatccgaggagtgacacttcccggggcttatcaggggattatctattatcttaagcccgatctttttcgcctgaaagacccccaggtgtggatggacgctgggacccagatattcttctcttttgctatctgccagggctgtctgactgccctgggatcatacaacaagtatcacaataattgctacaaggactgcatcgccttatgtttcttgaactcggccacctcttttgtggcgggctttgtcgtgtttagtatcctaggatttatgtcgcaagaacagggcgtacccatttccgaagtggcagagtctgggccaggtctggctttcattgccttccccaaagccgtgaccatgatgcctctgagccagctgtggagctgcctttttttcataatgcttattttcctgggtttggattctcaattcgtgtgtgtggaatgcctggtgactgcgtccatcgatatgtttccacgccaactgaggaagagcgggcggcgtgaactcctgattctcactatcgcagtgatgtgctatctgatcggtctattcctggttacagagggaggcatgtacatcttccagctctttgattattacgcctcatctggtatttgtttgctgtttctcagccttttcgaagtggtttgtatttcatgggtgtacggagccgaccgcttctacgacaatatcgaggatatgataggttaccggccctggccactcgttaagatttcatggctgttcctgactcctggtctgtgtctggccacattcctcttctccttgagtaagtacacccctttaaaatacaacaatgtctacgtgtatccgccgtggggatactcgatcgggtggttcttagcattatcttctatggtatgcgtgccactgttcgtggtgattacactgctcaaaactcgcggcccttttcggaaacgtctgagacagctgatcacacccgactcaagccttccacagccaaagcagcacccatgtttagacgggagcgccgggaggaattttggaccctcacccacacgggagggcctgatagcaggagaaaaagagacccatctgtag

SEQ ID NO: 206349 - DNA, 441 bp, Artificial Sequence
  Description of Artificial Sequence: Synthetic coding sequence
atggacggcaaggtggccgtgcaggagtgcggcccccccgccgtgtcttgggtgccagaggaaggagagaaattggatcaagaggacgaggaccaggtcaaggatcggggacagtggaccaataaaatggaattcgtgctcagtgttgccggggagattattgggttagggaatgtctggaggtttccttacctgtgttacaaaaatggcggcggagcattctttattccgtatttcatctttttctttgtctgtgggatccccgtcttctttctggaagtggccctaggccagtatacttcccagggctccgtgaccgcctggagaaaaatctgcccactctttcaagggattggcctggcgtctgtggttattgagtcctatctgaacgtgtactacattattatcttggcttgggctcttttttatttatttagctag

SEQ ID NO: 206350 - DNA, 1908 bp, Artificial Sequence
  Description of Artificial Sequence: Synthetic coding sequence
atggccaagaagagcgccgagaacggcatctacagcgtgagcggcgacgagaagaaaggcccgcttatcgccccggggccggacggagcccctgccaaaggggacggccctgtgggtctcgggactcccggagggagactggctgtgccaccgcgcgagacatggacgcgccagatggactttattatgagttgcgttggctttgccgtaggcctggggaacgtctggcgcttcccgtacctatgctacaagaacggtgggggggtttttctgatcccctatgtactaatcgccctggtgggcggcattccaatctttttcctggaaatcagcttgggacaatttatgaaggctggttcaatcaacgtgtggaatatttgtcccctcttcaaaggactgggttacgcttctatggtaatcgtgttttattgcaatacctactacatcatggtgctggcctggggattctattacctggtaaaatccttcacaacaacgctcccttgggccacttgtgggcacacctggaacactcctgattgcgtagagatttttaggcacgaggactgtgcgaacgcaagtttggctaatctgacctgcgatcagcttgcagatagacgcagcccagtaattgaattttgggaaaataaagtcttgcgccttagcggaggactggaagtacccggagccctcaactgggaagtgaccctctgtctgcttgcctgttgggtgctggtttacttttgtgtgtggaagggagtgaaatcaacaggaaagattgtctacttcaccgccactttcccttacgtcgtgctggtagtgctgttagtgaggggcgtgctcctgcctggcgcactggacggtataatttactacctcaagccagattggtcaaagctgggcagtccacaggtctggattgacgcagggactcagatctttttcagctacgcgattgggctgggtgccctcacagcgctcggatcatataataggtttaataataactgttacaaggacgccatcatcctcgcccttatcaacagcgggactagctttttcgccggattcgttgttttttctatattgggcttcatggccgctgagcagggcgtccatatttccaaggtggccgagtccggtcccggtttagccttcattgcttaccctagggcagtgaccctgatgcccgttgcaccgctctgggcagcgctctttttctttatgctgctgctcctgggcctggacagtcaatttgtaggagtagagggtttcataaccgggctgctcgatctcctgccagcatcatattattttcgatttcaaagggaaatcagcgttgctttgtgctgcgccctgtgctttgtaatcgatctctccatggtcaccgatggtggaatgtacgtgttccagctattcgattattattctgcatccggcacaactctactctggcaggccttttgggaatgtgtggtggtcgcttgggtgtacggcgcagatcgcttcatggatgacattgcgtgcatgattggatatagaccctgcccttggatgaagtggtgctggtccttctttactccgctagtgtgtatgggcattttcatttttaacgtcgtgtattacgaacctctggtatacaataacacatatgtgtacccctggtggggagaggcaatgggatgggcctttgccttaagttctatgctttgtgtgccattacacctgctgggatgtctcctccgcgccaagggaacaatggctgagcgctggcagcatcttacccagcctatttggggactgcatcatctggaatatcgagctcaggacgccgatgtgagaggactgaccaccctgacccccgtgtcagagtcctcaaaggtggtcgtcgtcgagagcgtaatgtag

SEQ ID NO: 206351 - DNA, 2190 bp, Artificial Sequence
  Description of Artificial Sequence: Synthetic coding sequence
atgctgcccaccctgcagatccagggccccgccgccttcgcccccggtgatcggggtccagggcggcattgcccctttcccgtgcctatcaccccaaccggagccctgctgccagtgagcgacagttgcgactcgctcgttgacctagtctggccctctgtcacatacttagcactgggcacccagtccagggtgtggccacaccctttgggggctcctggccaggccggcgaaagcccagagcagcggcgccaatgcctggaactctgggacatggcctctagtttgggtgacaaagtgccaagagcagcatgtggcaagcggggacagactgtgtggcagctgcatctggcctgcctctgtctggcacaatttcacagtcctccggcccagcctcctccattgtcgagacgtgggggtgggcccgatcccgatcccatttcacgctcactccccgggccaccaacccctgccctgcccacccactcatacagctcacattcaccgagggctccacgcctgctttcacccctcaggcgggcgccaagaggctcacccgctccccaccgtcacgcctccctgcagaccaatgaagcccccagagagttgccccattgcacatggcccggcttacccggacggagcttagccccctctttcctgtggagggagccgtggcttggtggacagtggggcccacttaacatcccagcccgaaagggcgacaggcgtaggtgggagtggggctgcgagggtggaggcgcaacagcaagtgctgagcagccggggccccagatagtctactttactgcgacttttccttacgtagtcctggttgtgctgctagtcagaggtgtcttgctccctggagcattggatggaatcatttattatttaaaacctgattggagtaaattggggagcccacaggtgtggatcgatgctgggacgcagatcttcttctcctacgcaataggattgggggctctgacagccctgggatcttacaatcgcttcaacaataactgttataaagatgccatcattctcgcgctgattaatagtggcacttcgttctttgctgggttcgtagtgttttcgatcttaggatttatggctgctgagcagggcgttcatatttcaaaagtcgctgagagcggccccggtcttgcttttatcgcctaccctcgcgcagtgaccctgatgccggtcgcacctctttgggcggcacttttcttttttatgcttcttctcttaggcctggacagtcaggtgtgcatgggcttgtgggaccgcgagccaggtggagggagaagggaggggtgtcggcagggaaagggatggcggcgttgtggggctcgacccgagctcccctggccccagttcgtgggagtcgaggggttcattaccggcctcttggacttgctccccgcctcctactatttcagatttcaacgggaaatcagtgtcgcattatgttgtgccctttgtttcgtgattgatttgtccatggtgaccgacgttagtggcgtgggcggcttgccggtcacctccggaggcagactgccttcttctctcacaggactgtgcccacaagggggtatgtatgtcttccaacttttcgactactacagtgcttccggcaccactctgttatggcaggctttctgggagtgtgtagtcgtggcctgggtgtatggcagatcatggctccgcgccgggctgggtgatgggggcggcgagggcaggtcccccgcttggcctgctagtccacggggggcagacaggtttatggatgatatagcctgtatgattggttaccgaccttgtccttggatgaagtggtgttggagtttttttacacctctcgtttgcatgggcatctttattttcaatgtggtgtattacgaaccactcgtttacaacaatacatatgtttacccgtggtggggcgaagccatgggctgggcctttgctctttcttccatgctgtgcgtgcctctccatctgctcggatgtctcttgcgggccaagggtacgatggccgagcgctggcagcatctcacccagccaatctggggactgcaccatctggaatacagagcacaggatgcagacgtacggggacttaccactctgaccccagtaagcgagtcaagcaaggtcgtagttgtcgagtctgtcatgtag

SEQ ID NO: 206352 - DNA, 471 bp, Artificial Sequence
  Description of Artificial Sequence: Synthetic coding sequence
ctgctgcacagccccacctggagctggagctgctgctggtgcgtggaatgctgttgcctcgctccatggatggcctcttttactattagctcactgactggtcagtcatggggccccctgtctcccggccagctgcagcctctgcagcagcagttgctgcaatgggaccagctcctgtgttggttgcggggcctgttgcatcctggtcttcacggatgtagagcgggccgtgcgcacctccagggcggacgtgttagggagatttcagttgctttgtgttgcgctctttgtttcgtcatcgatctgtccatggtgacagacggaggaatgtatgttttccaactgttcgactactattctgctagcggtactacgttactgtggcaggcgttttgggagtgcgtggtcgtggcgtgggtgtatggtgcggacagatttatggatgacattgcatgtatgatcggatattag

SEQ ID NO: 206353 - DNA, 339 bp, Artificial Sequence
  Description of Artificial Sequence: Synthetic coding sequence
tgattccggcacgaggactgcgccaacgccagcctggccaacctgacatgcgatcagctggcggacagaaggtcacccgtgatcgagttctgggaaaacaaagttctgaggctatctggaggcctggaggtgcctggggctctgaactgggaagttaccttgtgcctgcttgcctgttgggtactcgtgtatttttgcgtctggaaaggagtcaagtctaccgggaaagtgccattagaagcctgttcgggcgaaggaggcagcgctctcggtgccggctgtctttgtcaagcacatctgtggcagcgtgaagttacaagacagtctctagcgttgtag

SEQ ID NO: 206354 - DNA, 1563 bp, Artificial Sequence
  Description of Artificial Sequence: Synthetic coding sequence
atgaaggccggcagcatcaacgtgtggaacatctgccccctgttcaagggtctgggttatgcatctatggtgatcgtattctattgcaatacatactacatcatggtgctggcgtggggtttctattacttggtgaagtccttcacaacaacattaccttgggccacctgtgggcatacttggaacaccccagactgcgtggagattttcagacacgaggactgcgcaaatgcttcactggccaatctgacctgtgaccaactggccgatcgtagatccccagtcatcgagttttgggagaataaagtgctccggctgagcggtggcctagaggttcctggtgctctgaattgggaagtgaccctgtgtctgcttgcttgctgggtcttagtgtacttctgtgtgtggaaaggggtgaagagtacaggcaagattgtatattttacagccactttcccgtatgtggttttggtggtgttgctcgtgcgtggggtcctactgccgggggcactggacgggataatctactacctgaagcccgactggtccaagctggggtcaccacaagtgtggatagatgcgggcactcagattttttttagctacgcaataggcttgggagcactgaccgccctcgggtcctataaccgattcaacaataattgttataaggacgctataatcctggcactcataaatagcggcacatctttcttcgcaggctttgttgtgttcagcatcctgggcttcatggccgcggagcaaggtgtgcacatttctaaggttgctgagtccggccccggcctcgctttcattgcgtaccctcgagcagtcactctgatgccagtcgccccgttatgggccgcactgtttttcttcatgctcctgctgctcggactggatagccagtttgtgggagtcgaaggttttatcactggactccttgacctgcttccagcaagttattatttccggttccagcgggaaatctctgtggcgctatgctgtgccttatgctttgtcatcgatcttagcatggtaacggacggcggaatgtatgtatttcagttattcgattactactccgcgagtggtacaacattgctgtggcaagccttttgggagtgtgtcgttgtggcctgggtgtatggcgccgatcgctttatggacgacattgcatgcatgatcggataccgcccatgtccttggatgaaatggtgttggagcttcttcacccccttggtgtgcatgggcattttcatcttcaacgtcgtttactacgaaccgctggtttacaataacacctacgtctacccatggtggggagaggccatgggttgggcctttgcactgtcttccatgctgtgcgtacctctccaccttctggggtgtttgcttagagccaaaggaaccatggctgagcgttggcagcatcttacgcaacccatttgggggcttcatcacctggagtatagagctcaggatgctgacgtgagaggacttaccactctcacccctgtgagtgaaagtagcaaagtcgtagtggtcgagagcgtgatgtag

SEQ ID NO: 206355 - DNA, 525 bp, Artificial Sequence
  Description of Artificial Sequence: Synthetic coding sequence
tgaatcgacgccggcacccagatcttcttcagctacgccatcggcctaggcgcacttactgctctgggttcatataatagattcaacaacaactgctacaatgggacctctttctttgccggattcgtggtgttcagcattcttgggtttatggcagccgaacagggagtacacatcagtaaggtggccgagtctggccccgggctggcattcattgcctaccctagggctgtcacgctcatgcctgtcgcgccactgtgggctgccttgtttttcttcatgttactgcttctcgggctggactcccagttcgtgggtgtagaggggttcattacgggacttttggatctgctgccggcctcatactacttcaggttccagagggagattagtgtggctctttgttgtgccctctgcttcgtgattgatctgagcatggtcacagacggaggcatgtacgttttccagttgttcgactactatagtgcgtctgggaccactcttctgtggcaggctttttggtag

SEQ ID NO: 206356 - DNA, 270 bp, Artificial Sequence
  Description of Artificial Sequence: Synthetic coding sequence
ggccggcaccaccccggcagccaccagcagtgggaccagctgctgtgctggctgagaggtttgctccatcccggtttgcatgggtgtcgtgccggtagggcgcaccttcagggagggcgcgttagggctggacccggtctgcatcgactgccagctggctgtcacgccgacgctagtggacctaccctaggatgccctgtgttactccatgcagtagccgcttggtcccgtcagccgggcgtggaaggctttattacagggttactttag

SEQ ID NO: 206357 - DNA, 1863 bp, Artificial Sequence
  Description of Artificial Sequence: Synthetic coding sequence
atgagcaagagcaagtgcagcgtgggcctgatgagcagcgtggtggctcccgctaaggaaccaaacgccgttggtcccaaagaggttgaacttatcttagttaaggagcagaacggggtgcagttgacaagctccaccctcactaatcccaggcagagccccgtggaggcccaggacagggaaacatggggcaaaaaaatcgacttccttctgtcagtcatcggatttgcggtcgatctggccaacgtgtggagatttccatacctttgctacaagaatggagggggagctttcctggtgccctacctgctgttcatggtgattgcagggatgccgttgttttacatggagctggctctaggtcagtttaatagggagggcgctgccggcgtatggaaaatctgccctattctgaagggagtggggttcacagtgattttgatctcactgtacgtcggctttttctacaacgtaattatagcctgggcgctgcactatctcttctcttcttttaccacggagctcccctggatccactgtaataactcttggaacagccccaactgttctgacgcgcacccaggagacagctctggggacagtagcggactcaacgatacattcggaacgaccccagccgctgagtattttgagcggggagtccttcacctccaccaatcacacggaattgacgacctcggccccccccgctggcaattaactgcatgcctcgtgctcgtgatcgtgctgctctatttctcactgtggaaaggcgttaagaccagtggaaaggtggtgtggatcacggccaccatgccttacgtcgtcctgacggcattacttctgagaggcgtaaccctccccggagccatcgacgggatccgcgcctatttatcagttgacttctatcggctctgcgaagcaagcgtctggatagatgctgcaacgcaggtgtgtttctccctcggcgtgggatttggagtgctgatcgccttttcctcgtataataaattcacgaacaattgctacagagacgcaatagttacaacaagcatcaacagcctgactagtttcagcagtggattcgtggtctttagtttccttggctacatggctcagaagcatagtgtgcccatcggcgatgtggctaaagacggacctgggctcattttcattatctatcccgaggcaatcgccacactgcctctcagctcagcttgggctgtcgtattcttcattatgctgctgacgctgggcatagattccgccatgggcgggatggagtccgtgattacaggcctgatcgacgaattccagttactccatagacatagagaactgtttactttgttcattgttctggctacatttttattgtctctgttctgcgtcaccaacgggggtatctacgtcttcaccttgctcgaccacttcgcagctgggacaagcatattattcggggtgctcattgaagctattggggtcgcctggttctatggcgtcgggcagttctctgacgacattcagcagatgacggggcagcgcccgtccctgtactggagactatgttggaagctggtttcaccttgttttcttttgtttgtcgtagtggtgtctatcgtaacattcaggcctccacactacggggcatatatcttccctgattgggctaacgctctgggatgggtgattgccacatcaagcatggcaatggtgcctatatatgccgcctataaattctgtagtttgcctggttcctttagggaaaaacttgcctatgccatagcaccggaaaaggacagggaattggtggaccggggggaggtccgtcaattcaccctgagacattggttaaaggtgtag

SEQ ID NO: 206358 - DNA, 1863 bp, Artificial Sequence
  Description of Artificial Sequence: Synthetic coding sequence
atgagcaagagcaagtgcagcgtgggcctgatgagcagcgtggtggcacctgccaaagagccgaacgccgtgggcccaaaagaagtggagctgatactggtgaaggaacagaatggggtccaacttactagttccacccttactaatcctcgccagagtcccgtggaggcacaagatagagagacttggggaaaaaaaattgacttcttactgtccgtaatcggatttgccgtggacctcgcaaatgtatggaggtttccttacctgtgctataagaacggcggtggcgcgtttttggtcccttatctgctctttatggtcatcgccgggatgcctttgttctacatggaactcgcattaggacagttcaatagggagggagcagcgggtgtctggaaaatctgcccaattctaaagggagtcggctttactgtgattctgatcagtctgtacgttggttttttctacaatgtcatcattgcgtgggcactccattatctcttctcatcatttaccacagaactcccatggattcactgcaataacagttggaactctcccaattgctcagatgcccatcctggggattcttctggcgattcttcgggtctgaacgatactttcggaaccacaccagctgcagagtattttgaaagaggagttctacacctgcaccagtcccatgggattgatgacctaggccccccacggtggcagctaaccgcatgcctggtcctggtcattgttctgctgtacttctccctgtggaagggggtgaagacatccggaaaagtagtctggatcactgctactatgccatatgtggtgttaaccgccctgttgctgcgaggggtgacactacctggagcaatcgacggtattcgggcatatctctcagtcgatttctaccgactttgtgaagcgagcgtctggattgatgccgcaactcaggtgtgttttagtctgggcgttgggtttggggtgctcatagctttttcctcatataacaagttcactaataattgttatcgcgacgcaatagtgactaccagcatcaacagcctgacaagcttctcgagtggcttcgtcgtcttttcttttctggggtatatggcccagaaacattcagtgcctatcggagacgtggccaaggatggtccggggctaattttcattatctacccagaggcgatcgccactttacccctcagcagcgcctgggccgttgttttctttatcatgctgttaaccctcggaattgacagtgcgatgggtggcatggaaagcgtaatcacggggctgattgacgaattccagttgctgcacagacaccgggaactgttcacacttttcatcgtactggccacctttctgctttcgctattttgcgtgactaacggtggcatttatgtgtttacactcttagatcactttgctgccgggacttcaatcctctttggtgtattaattgaggcaatcggtgtcgcttggttctatggtgtgggccagttctccgacgacattcagcagatgaccggacaaagacctagcctgtattggcgtctgtgctggaagcttgtaagcccctgctttctgctgttcgtggttgtggtgtccatcgtcacatttaggccgccacattacggcgcctacatctttcccgattgggccaacgcactgggatgggttatcgccacttccagcatggctatggtgccaatctatgctgcatataagttttgttccttgcccggcagttttcgcgagaaattggcatatgcaatcgccccagagaaggacagagagctggtcgaccggggcgaagtgaggcagtttaccctcaggcattggctgaaagtatag

SEQ ID NO: 206359 - DNA, 1800 bp, Artificial Sequence
  Description of Artificial Sequence: Synthetic coding sequence
atggccaccaacggcagcaaggtggccgacggccagatcagcaccgaggtgtctgaagcgcccgtggcaaacgacaagcctaagactctggtcgttaaagtacagaagaaagctgctgacctccctgaccgagacacgtggaaagggcgctttgatttcctgatgagttgcgttggatacgcaatcggactcggcaacgtgtggaggttcccgtatctgtgtggaaagaatgggggtggagccttcctgatcccttacttcctcacactcatcttcgctggagttcccctctttctgttggaatgttccctgggccagtacacctccattggaggactcggcgtttggaagctcgctcctatgtttaagggagtcggcctggcagctgcagtgctgagtttttggctgaacatatattacatcgtcatcatttcttgggccatatactatttgtacaacagcttcacaaccacgctgccctggaagcagtgtgacaacccatggaacaccgatagatgtttttccaactatagtatggttaatactactaatatgacctcagccgtggtcgaattctgggagagaaacatgcaccagatgactgatggtctggataagccgggccagattcggtggcctttggctatcactctagcaatcgcctggatcctcgtctatttctgtatttggaagggagtgggttggaccggaaaagtggtttacttcagcgcaacctacccttacattatgttaatcatactgtttttccggggagtgactctcccaggagccaaagaaggaattctgttttatatcacaccaaacttccggaagctgtccgacagcgaggtctggctggacgccgccacccagatctttttttcatacggcctgggcctcggaagtctgattgcactgggtagctacaactcctttcacaacaacgtgtaccgggactccatcatcgtgtgttgtattaacagttgtacaagtatgttcgctgggttcgtgatcttttcaatagtgggattcatggctcacgttaccaagaggtccatagcagacgttgctgctagcggtcccggcttggcttttcttgcttacccagaagcagtgactcagctgcctattagtccgctgtgggcaatcctattcttttcaatgttgctgatgctgggaatcgatagccagttttgcaccgtcgaaggctttatcactgcccttgtggatgagtatcctagacttttgcggaacagacgtgaattatttattgcagcagtgtgcatcattagctatctgattggattgagcaatatcactcagggcggcatctatgtctttaaactgttcgattactactctgcttctggcatgtctctcctgtttctagtgttcttcgagtgtgtgtccatctcatggttttacggggtcaacagattctacgataatatccaggaaatggttggctccagaccttgcatctggtggaagctctgctggagcttctttacaccaattatcgtggccggcgttttcatcttctccgccgttcagatgacccctctgaccatggggaactacgtttttcccaagtgggggcagggcgtagggtggctaatggctctgtcctcaatggtgctgatcccaggatacatggcctatatgtttcttacactgaaagggtctctaaaacaacgtatccaggtgatggtacagccgtcggaggatatcgtacgccccgaaaatgggccagagcagcctcaggcagggtcatccaccagtaaagaggcctacatttag

SEQ ID NO: 206360 - DNA, 120 bp, Artificial Sequence
  Description of Artificial Sequence: Synthetic coding sequence
atggccaccaacggcagcaaggtggccgacggccagatcagcaccgaagtgtccgaagcccccgtcgcgaatgataagcctaagactctggtggtcaaggtccagaagaaggcggcatag

SEQ ID NO: 206361 - DNA, 1266 bp, Artificial Sequence
  Description of Artificial Sequence: Synthetic coding sequence
atggtgaacaccaccaacatgaccagcgccgtggtggagttctgggagcgcaatatgcaccagatgactgacggcctggacaagccaggccagattcggtggcccttggcaatcaccctcgccatcgcctggattctggtttacttttgtatctggaagggtgttgggtggactgggaaggtggtctacttcagtgctacttatccctacataatgctgattatccttttttttcggggggtgaccttacctggagctaaggaaggcatcttgttctatataacccccaattttcgaaaattgtctgacagcgaagtatggctggatgccgctacacaaatctttttctcctatggattgggtcttgggtcattgatcgcactgggctcgtataatagtttccacaacaatgtctacagagacagcatcatcgtgtgttgcatcaactcttgcacctctatgttcgccggctttgtaatcttcagcatcgtggggtttatggcccatgtaacgaaaagatctatcgcggacgtcgccgcctccgggcccggcctggcttttctggcataccccgaagcggtcacgcaactcccaatctctcccctctgggctatcctcttttttagtatgctgttgatgctgggtatcgactctcagttctgcaccgtcgaagggtttatcactgctctggtagacgagtacccccggctactcaggaacagacgggaactctttatcgccgctgtctgcattattagctacttgattgggctgagtaacattacccagggaggcatttatgtgtttaaactttttgattattattctgccagcggaatgtcgctgctgttcttagttttctttgagtgcgtcagcatctcttggttttacggcgtgaataggttctatgataacattcaagagatggtgggctccagaccctgtatttggtggaagctgtgctggtccttctttactccgatcatcgtcgccggagtcttcatcttttcggccgtacaaatgaccccattgaccatgggcaattacgtctttccaaagtggggccagggcgtggggtggttgatggctctgagctcgatggtgctgatccccggatatatggcctacatgtttctcaccctgaaggggagcctgaagcagaggatccaagtcatggttcagccctccgaggatatagttagacccgaaaacggccccgaacagcctcaagctggatcgtctacctccaaagaggcttacatctag

SEQ ID NO: 206362 - DNA, 1899 bp, Artificial Sequence
  Description of Artificial Sequence: Synthetic coding sequence
atgaccgccgagaaggccctgcccctgggcaacggcaaggccgccgaagaggcgcgggaatctgaagccccaggcggggggtgttccagcgggggtgccgctcccgcgaggcacccaagggtcaagagagacaaagctgtccatgagcgaggtcactggaacaacaaggtagaatttgtgctgtcagtggcaggcgagataattggattgggtaacgtatggcgcttcccttacctctgctacaaaaatggagggggtgccttcctgatcccatatgtggtgttctttatctgttgcgggattcccgtttttttcctggagactgcgttgggccagtttacatccgagggaggaattacgtgctggagaaaagtctgcccgctgtttgagggcattggatatgcaacacaggtgatcgaagcccacctgaatgtctactatatcatcatcctcgcatgggccatcttctatttgtcgaactgctttactacggaactgccttgggccacctgcggtcacgagtggaataccgagaactgtgtggaattccaaaaactgaatgtcagcaactactcacacgttagcctgcagaacgccacaagccccgttatggagttctgggagcaccgggtgctggctatctctgatggcattgagcatatcggaaatctgcgatgggagctggcactgtgccttttagctgcttggactatctgctacttctgcatttggaagggcaccaaaagtactgggaaggtggtgtacgtaacagctacctttccctacatcatgttgttaattctgctgattagaggagtgacccttcctggagctagtgagggcatcaaattctatctttaccccgatcttagtcgcctcagtgacccccaggtgtgggtggatgcgggaacccagatcttcttctcatatgccatctgcttgggctgccttactgcactcgggagctataataactacaataataattgctaccgggactgcatcatgttgtgctgcctgaattccggaacaagtttcgtggctgggtttgcaatcttttcggtcctgggctttatggcttacgaacagggggtccccattgccgaggtggccgaatcaggacccggactagccttcatcgcataccctaaggcggtcactatgatgcctctttccccactttgggcaacattattctttatgatgttaatctttttaggactcgacagtcagttcgtctgcgtcgaaagcctggtgaccgctgttgtcgacatgtatcccaaggtgtttcggaggggatataggcgcgaactgttaatcctggctctgagcgttatatcttatttcctgggattggtgatgctcacagaaggcgggatgtatatcttccagctctttgacagttatgcggcctccggtatgtgcctgctattcgtagcaatttttgagtgcatctgcatcggctgggtctacggaagtaaccgcttttacgacaatatcgaggatatgattggttacaggcctccatcactgattaagtggtgctggatgattatgactcctggaatttgcgccgggatttttattttttttctgataaagtataaaccactcaaatataataacatatacacttacccggcttggggttacggaatcggctggctcatggctctctccagtatgttgtgcatcccattatggatatgtattacagtctggaaaaccgagggaactctccctgagaagttgcagaagctcacgactcctagtaccgatcttaagatgaggggtaagctaggggtcagtccccgcatggtgacagttaatgattgcgacgcgaaattgaaaagtgacggcaccattgctgccataaccgaaaaggagactcacttctag

SEQ ID NO: 206363 - DNA, 627 bp, Artificial Sequence
  Description of Artificial Sequence: Synthetic coding sequence
atgaccgccgagaaggccctgcccctgggcaacggcaaggccgccgaggaggctcgcgagtccgaggcccccggaggtggctgctcctctgggggggctgcacccgcccgtcatcccagggtgaaacgcgataaggcagttcatgagaggggtcattggaataataaagttgaattcgtcctgagcgtcgctggggagataatcggcctaggaaacgtttggaggttcccttacctctgctacaagaatggaggaggcgcttttttgataccgtatgtggtatttttcatatgctgtgggatcccagtgttttttctcgagaccgctttgggccagtttacgagcgagggtgggatcacctgttggaggaaggtttgtccattgtttgaaggcatcggttacgctacacaagtgatcgaggctcatctgaatgtttactacataattattttggcatgggccattttttacttgtcaaattgcttcacgacagagctaccctgggccacttgtggccacgaatggaacacagaaaactgtgttgagtttcaaaaactaaacgtgagtaactactcacatgtgagcctgcagaatgctaccagcccagttatggagttttgggagtag

SEQ ID NO: 206364 - DNA, 2394 bp, Artificial Sequence
  Description of Artificial Sequence: Synthetic coding sequence
atggactgcagcgcccccaaggagatgaacaagctgcccgccaactcccctgaagccgccgccgcacaaggccaccccgatggcccttgtgcaccccggactagcccagagcaggagttgcctgctgcggccgccccccctccgccacgggtaccgcgtagtgcgtccacgggcgcgcagacattccagagcgccgacgctcgggcctgtgaggcagagcgtcctggagtgggctcatgtaaactttcctccccgagggcccaagcggcttctgccgcactgcgtgatttgcgcgaggcccagggagcccaggccagtccccctcccggctccagcggcccaggaaacgcgcttcattgcaaaatcccttttctccgaggaccggagggggatgccaacgtgtcagttgggaaaggcactttggagagaaataacacccccgttgtgggctgggtgaatatgagtcagtcaacagtagtgctggcaacagacggaatcactagcgttttgccagggagcgttgctactgttgcaacccaagaagacgaacagggggacgagaacaaagccagaggcaactggtccagcaagctcgacttcatcctgtctatggtgggatacgccgtcggcctcgggaatgtgtggcgttttccttatctagcttttcagaacgggggaggagcgtttctcatcccttatctgatgatgttagcactcgcaggcctgcctatctttttcctagaggtatccctgggccagtttgcctcccagggcccggtgtcagtttggaaggccattcccgccctgcagggatgtggtatcgctatgctgatcatcagcgtgctgatcgccatctattacaacgttatcatctgctatacattgttttatctgttcgcatcctttgtgtccgtgctgccttggggttcctgcaataatccctggaacacgcctgaatgtaaggacaagaccaagctgctgctcgattcatgcgttatatctgaccatccaaaaatacagataaaaaatagtaccttttgcatgacagcatatcccaacgtgacaatggtcaatttcacaagccaagcaaataagactttcgtttccggtagcgaggagtacttcaaatactttgtcctgaaaatctctgccggcatagaataccctggcgagattcgctggccactcgcgctatgtctgttcctggcgtgggtgattgtgtatgcctcattggccaaaggcatcaaaaccagcggtaaggtagtctacttcaccgctacgtttccatacgtggtactcgtgatcctgctgattcgtggggtgaccctgccgggtgccggtgccgggatctggtactttattacccccaagtgggagaagcttaccgacgctaccgtgtggaaagacgcggccacgcagatattcttctcgctctctgcagcctggggcgggttgataaccctgtctagctacaacaagttccataacaactgttatcgggacacattaatcgtgacctgtaccaacagtgctacttccattttcgccggcttcgtgatcttctctgtgattggattcatggccaacgagcgcaaagtcaacatcgagaatgtggcggaccagggacctggtatcgccttcgtagtgtaccccgaggctctcacccgtctgcctctgagtcctttttgggcaatcatctttttccttatgctgttgacacttggacttgataccatgttcgctaccatcgaaaccattgtgacctcaatctccgacgagttcccaaaataccttcgaacccacaagccggtgttcacactgggctgttgcatatgttttttcattatgggcttccccatgatcactcaaggcggtatctacatgttccaactggtcgatacttatgcagcgagttacgctttggtaattattgccatttttgaactcgtggggatctcctacgtctatggattgcaacgcttttgtgaggacattgaaatgatgatcggcttccagcccaacattttctggaaagtgtgctgggcattcgtgacacccaccatattgacttttatcctgtgtttttctttctaccaatgggagccaatgacctatggcagttatcgctatcctaactggtctatggtattgggatggttgatgcttgcgtgttccgtgatctggatacctatcatgtttgtgatcaagatgcatctggctcccggcaggttcatcgaaagacttaaactcgtgtgcagcccccaacccgactggggacctttcttagcgcagcacaggggcgagcgctacaagaatatgattgacccactgggcacaagttcgctcgggctcaagctgcccgtgaaagacctcgaattaggaactcagtgttag

SEQ ID NO: 206365 - DNA, 1959 bp, Artificial Sequence
  Description of Artificial Sequence: Synthetic coding sequence
atgagcggcggcgacacccgggccgccatcgcccggccccggatggccgcagcacacggacccgtcgcaccatcttccccggaacagaacggcgcggtgcctagtgaagcaactaagagggaccagaacctgaagcgcggcaattggggtaaccagattgagtttgtgctcacctccgttggctacgcggtgggccttgggaatgtatggagattcccctacctgtgctacaggaacggcgggggggccttcatgtttccatattttatcatgctgatcttttgcggcattccactgttcttcatggagctgtcttttgggcagttcgctagccagggctgtctgggggtttggaggatctcacctatgttcaaaggcgtcgggtatggcatgatggtcgtttccacttatatcggcatctactacaatgttgtgatctgcatcgccttttactactttttttcttccatgacccatgtgctgccttgggcgtattgcaacaatccctggaatactcatgactgcgctggagttctggatgccagcaatctgaccaacggaagcagacctgccgcactgcccagtaacctgagtcacctgctgaaccattccctgcagcgcaccagcccaagcgaagaatattggcgcctgtatgtccttaagctgagcgatgacattggcaacttcggcgaagtgcggctccccttgctgggttgtctcggcgtcagttggctggtagttttcctctgtcttatccggggcgtgaaatctagtggcaaagtagtttacttcaccgccactttcccctacgtggtcctcacgatcctgtttgtcagaggcgtgacgttggagggagctttcgatggcatcatgtattaccttacaccacaatgggataaaatactggaagccaaagtctggggagacgccgccagtcagatcttttacagtctgggatgcgcctggggaggactaataacaatggccagctacaacaagttccataataactgctatcgggatagtgttattatttcaataaccaattgtgctacaagcgtctacgctgggttcgttattttctctattctgggatttatggccaaccaccttggcgtggacgtgtctagggttgcggatcacggacctgggctggcttttgtggcgtaccctgaggccctaactctgcttcccatttctcccttgtggtcccttctgttcttcttcatgctgatccttctgggactgggtactcagttctgtttgcttgagaccctggtaaccgccatcgtggatgaagtcgggaacgaatggatccttcaaaagaagacctacgtgacccttggcgtggcagtcgccggattcctgttaggcatccccttgacctctcaagcaggcatctactggcttttgctgatggataactacgccgcatcctttagtttggttgtgatttcctgtataatgtgcgttgcgattatgtatatctacgggcatcgaaattattttcaggacatccagatgatgttggggttccctcctccgctctttttccagatctgttggcgctttgtgagccctgcaatcatcttcttcatcctggtctttacagtaatacagtaccagcccatcacttataaccactatcagtaccccgggtgggccgtcgctattggctttctgatggctctgtcttctgtgctgtgtataccgctctacgcaatgtttagactgtgtcggacagatggggacactcttctccaacgcttaaaaaacgccacgaagcctagccgggattggggcccagccctgctggagcaccggactggcagatacgcccccactattgctccctcacctgaggatggatttgaagtgcagcccctccacccagacaaagcccaaattccgatcgtggggagtaatggatctagtcgactgcaagactctaggatctag

SEQ ID NO: 206366 - DNA, 2121 bp, Artificial Sequence
  Description of Artificial Sequence: Synthetic coding sequence
atgagcggcggcgacacccgggccgccatcgcccggccccggatggctgctgcccacggtcctgtcgccccatcatctccagaacaggtgactctcctgcctgtgcagaggtcgtttttcctgccacctttttctggagccactccttcaacgtcacttgccgaatctgtacttaaagtctggcatggtgcgtataactctggccttctgccgcagctgatggcccaacacagcctcgcaatggcccagaatggtgctgttcctagcgaagctaccaaacgtgaccagaatttgaaacgtggaaattgggggaaccagattgagtttgttctcaccagcgtgggctatgctgttggcttaggaaatgtgtggcgattcccgtatctgtgttatcgcaatggcgggggcgctttcatgtttccctattttattatgctgattttttgtgggatccccctgttcttcatggaactaagctttggacagtttgccagtcaaggttgtcttggtgtttggcggatatctcctatgttcaagggggtgggttacggaatgatggttgtcagcacgtacattggcatatattacaacgtcgtgatctgcatcgctttctactatttcttctcctccatgacacatgtcctgccatgggcctactgcaacaatccctggaatacccacgactgcgccggcgtgctcgacgcttccaacctgactaatggctccagaccagcagcattaccatcaaatctgtctcatcttctgaaccactctctccagcgaacgtcccccagtgaggaatactggaggctctacgtcctcaagctgagtgacgacatcggcaactttggagaagtacgtttgccattgttaggatgcttgggcgttagctggctggtggtgttcctctgtctgatcaggggagtaaagtcttcaggcaaagtggtgtattttaccgccactttcccctatgttgtactcactatcctgtttgttagaggcgttacactagagggcgcatttgacggcatcatgtattacctcacccctcagtgggacaaaatattggaggccaaggtgtggggcgatgcagcttcccagattttttactcactcggctgtgcctggggcggtctgatcactatggcctcttataataagtttcacaacaactgttatcgcgactcagttataatctccataacaaattgcgctactagcgtgtatgcgggattcgtgatttttagcatcctaggtttcatggccaaccaccttggcgttgatgtgtcacgggtggcagatcatggcccagggctagctttcgtggcatacccagaagcgcttactctgctgcccatttccccgctatggagcttactgtttttttttatgctgattctgctaggcttgggaacccaattttgtctcctcgagactctggtcaccgcgatcgtcgacgaggtgggaaacgagtggatcctgcaaaagaaaacatatgtcactctaggcgttgcagtggcagggttcctgctcggcattcccctcacgtcacaagcgggcatctactggcttttactgatggataactacgccgctagcttctctctggtggttatcagctgcattatgtgtgtggccattatgtacatttacggacatagaaactacttccaagacatccaaatgatgctgggattcccgcctcctctgtttttccagatatgctggcgtttcgtatcccctgcaataattttctttatcctcgtttttacagtgattcaataccagccgattacctacaatcactatcagtatcccggctgggctgtcgcgataggctttcttatggcactttctagtgtcctgtgtattcctctctatgcaatgttcaggttatgtagaacagacggcgatacgttattacagcggctcaaaaacgccacaaagccttcaagggattggggaccagctcttcttgaacataggaccggccgctacgcaccaactatagcgccatcccccgaagacggcttcgaggtgcagccacttcatcctgacaaggctcagattcctatcgtcgggtcgaatggctcttccagattacaggattcaagaatttag

SEQ ID NO: 206367 - DNA, 1725 bp, Artificial Sequence
  Description of Artificial Sequence: Synthetic coding sequence
atgttcccctacttcatcatgctgatcttctgcggcatccccctgttcttcatggagctcagctttggtcagtttgcatcacaaggctgtctcggagtctggagaataagtccgatgttcaaaggtgtggggtacggaatgatggttgtgtccacatatattggcatttactacaacgtcgtcatttgtattgcgttctattatttcttctcttcgatgactcatgttctgccctgggcctattgcaacaacccgtggaacactcacgattgcgccggggtgctcgacgcctccaacttaaccaacggcagtcggcccgctgctttaccctctaatctgagtcatctgctgaaccattccctgcagcgcactagtcccagcgaggagtactggagactctatgtgttaaagttaagtgacgacataggcaacttcggtgaagtcagactccccctgcttggttgcctcggcgtgtcatggctcgtagtgttcttatgcctcattagaggcgtgaaatctagcgggaaagtggtctactttaccgctaccttcccctatgtggtccttacgatcctgttcgtccgaggcgtaactctggagggggcctttgacggtattatgtactacctcaccccccaatgggacaagatcctcgaggccaaagtatggggcgatgccgccagtcaaatattctactcactgggttgcgcatggggtggtctaatcactatggctagctataataaatttcacaacaactgctatagggactcagtgattatttctatcaccaattgtgccacctctgtctacgcaggtttcgttattttcagcattctgggcttcatggcgaaccacctgggggtggatgttagcagggtggcggaccatggccccggactcgccttcgtcgcttaccccgaagcactcactctgctgccgattagccctctgtggtccctgctgtttttctttatgttgattctgctggggctggggacacagttctgcctccttgagacgttggtcacggctatcgtggacgaggtcggtaatgaatggatcctgcaaaagaagacctacgtcactctcggcgtggctgtggcgggcttcctgctcggcatcccgctgacctcccaggctggcatctactggctactgctcatggacaactacgcagccagctttagtctcgtcgtaatctcctgcatcatgtgcgtggccatcatgtatatttacggacaccgtaactattttcaggacattcaaatgatgttggggtttccacctcctttattttttcagatctgttggagatttgtcagtccagctatcatctttctccaggcccaggtccataggcgcctcccccagaatcccctacattttgcttctttgcccgaaagaaacgtgctgctgcaccaacttcctcaaaggggcggggtccccgaacacgatcctcctactccaccctcgcctgctagaacctatggaccccaggtgcgtgtgagggaggtgccacgggcccggcggcagcgatcccccaaccccgctccgctgtgggcacctccatctcccaaaccgcacccctgttcggctgccggaccactcggatgggattgtccctttaggaactgtcagtctcttgccctcagctctgctcgcctgctggcagactctgatgcaggaggtccagaaacccggcagtgggagcctggaccctag

SEQ ID NO: 206368 - DNA, 1902 bp, Artificial Sequence
  Description of Artificial Sequence: Synthetic coding sequence
atggtgggcaagggcgccaagggcatgctgaacggcgccgtgcccagtgaggccactaagagggaccagaacctgaaaagaggcaactggggcaatcagatagagtttgtgctcacgtcagtagggtatgccgttggcctgggaaacgtgtggagattcccatacctttgctaccgaaacggtgggggcgctttcatgtttccctactttataatgcttatcttttgcgggattcccctgttttttatggagctgtccttcggccaatttgctagccagggttgtctgggcgtgtggagaattagcccaatgtttaagggagtcggttacggcatgatggtggtgagcacatatattggtatctactacaacgttgtcatttgcatcgccttctactacttctttagctctatgacacacgtattgccgtgggcatattgcaataacccatggaatactcacgactgtgccggcgtgcttgatgcgtcgaatctgacaaatggaagcagacccgctgctctgccttctaatctctcacatctcttaaaccactcgttacaacgcacaagtccatccgaggagtactggaggctgtatgtcttaaaattgtccgacgacatcggcaactttggcgaggttcggctccccctgctaggatgtcttggagtctcctggctcgtcgtattcctgtgtctgattagaggcgttaagagttccgggaaggtggtctattttaccgccacgtttccttacgtcgtccttacaatcctttttgttagaggcgttaccttggaaggcgcctttgatgggatcatgtactacctgacccctcagtgggataaaattctagaggccaaagtgtggggagacgctgcctcacagattttttatagccttggttgcgcctggggtggattgattactatggcatcgtacaataagttccataacaattgttacagagactccgtgattatttctattacgaattgtgcgacgtctgtgtatgcaggtttcgtcattttcagcatattaggattcatggctaaccatctaggtgttgacgtctcaagggttgctgatcacgggcccggcttggcctttgtagcttacccagaggccctcaccttacttccaatcagtccgttatggagtctgctcttcttttttatgctcatattgttggggttgggcacacagttttgccttctggagacactcgttaccgcaatcgtcgatgaggttgggaatgaatggatcctccaaaagaagacctatgtgacactgggcgtcgccgttgccggatttctactgggcatcccattgacttcgcaagcaggcatctactggttgctactaatggacaattacgccgcaagcttttcactggttgtgatctcctgcattatgtgtgtcgctattatgtatatctatggccaccgcaactatttccaggatatccagatgatgctaggttttccaccacctttgttcttccagatctgttggagatttgtcagccctgccatcatcttcttcattttggtgttcaccgttatacagtaccagcccattacctataatcattatcaataccctggctgggccgttgccatcggcttcctgatggctttgtcctcagtgctctgcatccctttatatgcaatgttcaggctgtgccgaacagacggtgacactcttctccagaggctcaaaaacgctacaaaacccagcagagactgggggcccgcccttttggagcaccgtaccggaaggtacgccccgactattgccccctctccagaggacggctttgaagtgcagcctctccatcccgataaggctcagatccccatcgtggggtcaaacgggtctagccggcttcaggacagtaggatatag

SEQ ID NO: 206369 - DNA, 1569 bp, Artificial Sequence
  Description of Artificial Sequence: Synthetic coding sequence
atgatggtggtgagcacctacatcggcatctactacaacgtggtgatttgtatcgctttctattactttttctcatcaatgacccatgtgctgccttgggcctattgcaacaatccttggaacacacacgactgcgcaggtgtgttggacgcttccaatctgaccaacggctctagacctgccgctcttcccagcaacctgagtcaccttctgaaccattccctgcagcgcacaagcccatctgaggaatactggcggctgtacgtgctgaagctatctgacgatatcggcaactttggcgaggtacgcctgcccctgttagggtgtctaggagtctcctggttagtcgtcttcctctgcttgatccgcggcgtcaagtcttctggtaaggtagtctacttcaccgccacatttccatatgttgtgcttactattctcttcgtccggggcgtgacgctagaaggggcattcgatgggatcatgtattacctcacccctcagtgggacaagatcctagaggccaaggtttggggcgacgccgccagtcagattttctactccctcggctgtgcatggggcgggcttatcactatggcatcctacaacaaattccataataactgttatcgtgatagtgtaattatctccattactaactgtgcaacgtccgtttacgccgggtttgtcatattctcaatcctgggttttatggccaaccaccttggcgtggacgtgtctcgagtagccgaccatggtccgggcttggcatttgtcgcttatcccgaggccctcacacttcttcctatttctccactatggagcttgctgttcttctttatgcttatcctgctgggccttggaacccagttctgtctactggagaccctagtgaccgccattgtggacgaggtaggaaatgaatggatactccagaagaagacatatgtgactctcggtgttgcagttgcagggtttctgctagggatccccctcacatcccaggctggcatatattggttgctgcttatggacaactacgccgcctctttttcactcgttgtcatcagctgtatcatgtgcgttgctatcatgtacatctatggacatcgtaactattttcaggatattcagatgatgctggggtttcccccacctctgttctttcaaatttgctggagatttgtgagccccgctatcatcttctttatcttggtcttcacagtgatccaatatcagccgatcacttataatcattatcaataccccggctgggccgtggcaattgggtttttgatggcgctttcctctgtactctgtatccctttatacgctatgttcaggctctgccgtacagatggcgataccctgcttcaacgtctgaaaaacgcgactaaaccttccagggactggggacccgccctgctggaacacagaacaggaaggtacgcacctacaattgcgcctagcccggaggatggtttcgaagtccaacctctgcacccagataaagctcagatccccattgtgggtagcaatggttctagccgactgcaggactcccgtatatag

SEQ ID NO: 206370 - DNA, 405 bp, Artificial Sequence
  Description of Artificial Sequence: Synthetic coding sequence
atgagcggcggcgacacccgggccgccatcgcccggccccggatggctgccgctcacggcccagtcgccccgagttcccccgaacaaaacggagcggtaccgagtgaagctaccaagcgagaccagaatcttaaaagagggaattggggcaaccaaatagaattcgttttgacatccgtcggatacgcagtgggcctgggaaacgtgtggagatttccttatctgtgctatcgtaacgggggcggcgcctttatgtttccatatttcatcatgcttattttttgcggcattccattgtttttcatggagttgagctttggccagttcgctagtcagggctgtctcggcgtgtggcggatctccccgatgttcaaaggggttgggtatgggatgatggtggtgtag

SEQ ID NO: 206371 - DNA, 1161 bp, Artificial Sequence
  Description of Artificial Sequence: Synthetic coding sequence
atgttcccctacttcatcatgctgatcttctgcggcatccccctgttctttatggagctgtcattcggtcagttcgcctcacagggatgtctgggcgtgtggaggatcagcccaatgttcaaaggggtcggctacggaatgatggtcgtgtccacctatatcggcatttattacaatgtggttatatgcatcgcattttactacttcttctcttccatgacccatgtactgccatgggcatattgtaataacccttggaatacacacgattgtgcgggggtacttgacgccagcaacctgacgaacgggtctaggcccgccgctttaccttcaaacctctcccacctgctcaatcatagccttcagcggacctctcctagcgaggagtattggcggctctacgtgctgaaactgagtgacgacatcggtaacttcggggaggtccggttacccttattggggtgcctgggcgtttcgtggctggtggtgttcctgtgcttgatacgcggagttaaaagttctggcaaagtcgtttactttacagccacatttccctacgtggtgctgaccatcttgttcgttaggggggtaacgctggaaggggcgttcgacggaatcatgtactaccttacgcctcagtgggataagatcctggaagccaaggtttggggcgacgccgcttctcagattttctatagcctgggatgcgcatggggtggattaattaccatggcatcctataataagtttcacaataactgctacagagacagcgtgatcatttccatcaccaactgcgcaacttctgtatatgcagggtttgtcatattttctattctgggttttatggctaatcatctaggcgtcgacgtctctagggtggctgaccatgggcctggactggcttttgtggcttatcccgaggctttaacacttttgcctataagcccattatggtccttgctgttctttttcatgctgatactcctcggtctggggacccagttttgtttgttagagaccctcgtgacagcaattgtcgatgaagttggaaacgaatggatactccagaaaaagacatacgtgactctgggcgttgccgtggctggctttctcttagggattccacttacttcgcaagctagcatcggctgctgttag

SEQ ID NO: 206372 - DNA, 1050 bp, Artificial Sequence
  Description of Artificial Sequence: Synthetic coding sequence
atgggcgacatgggcgacccccccaagaagaagcggctgatcagcctgtgcgttggctgtggcaaccagatacacgaccagtatattctgcgagtgtcccctgacctggaatggcacgccgcctgtctaaaatgcgccgagtgtaaccaatatctggatgagagctgtacctgcttcgtgagagacggtaaaacctattgcaagcgcgactatatcagattgtatgggattaagtgtgcaaaatgtagcatcgggttctctaagaacgacttcgtgatgcgagcaagatctaaggtgtatcacatagagtgcttccgttgcgtggcctgctctagacagctcatccctggcgacgagttcgctctgagagaggacgggctcttttgcagggccgatcatgacgtggtggagcgcgcttcgctgggcgccggcgatcctctgtcccccctgcatccggcacgacctctgcagatggcggctgaaccaatctcagcccgacagcctgctcttcgtccacacgttcacaaacagcctgaaaagacgacacgcgttaggaccgtgctgaacgagaaacagctgcatacactgcgtacctgctatgccgcaaatcccaggcccgacgccctgatgaaggaacaactggttgagatgactgggctgagcccccgcgtgattagagtgtggttccagaataaaaggtgtaaggacaagaaacggtccattatgatgaagcagctgcagcagcagcagccaaatgacaaaacaaatatacagggtatgaccggcacccctatggtagccgcttctccagagcgacatgacggtggtctgcaggccaacccggttgaggtccagtcctaccaaccaccttggaaggtattgtctgattttgcactacagtcggacattgaccagcccgcctttcagcagttggttaactttagcgagggggggcccggcagcaactcgacaggtagtgaagtggcatctatgagctctcagttgcccgacacacctaattctatggtagctagtcccatagaggcgtag

SEQ ID NO: 206373 - DNA, 2283 bp, Artificial Sequence
  Description of Artificial Sequence: Synthetic coding sequence
atgctgagcgacgaccacgtgaacgagatcatcatccaggtggagaatgtgtcgtctggtgtccaaagccatccatccagcaaccagatctttcaggaaaaagtgctgctagactcctctattaacatggttttgagcatctccgatatcgatgtgattgatagtcagacagtatcgaagcggaacgaccagaaaggtaaccaggtcctgaggtttagcaccagcctcaacgaaagtatgtcccagaccctgcacagcctcgaatgcatgggaattgatacaccagggtctagccatgaaactgtgcaggggcagaaactaatcgcttcgctcataccaatgacgtccagggatcgaattaaggcaattcggaaccagcctagaaccatggaagaaaaaagaaatttgcgtaagattgtggataaagaaaagtccaaacagacccatagaattctgcagttgaattgttgtattcagtgcctgaactctatcagtagagcttataggcgctctaaaaactcactgtccgagattctcaactctatatctctctggcagaaaaccctcaaaataattggtggcaaatttggcacgtctgtcctgtcctacttcaacttccttaggtggctcctgaaattcaacatatttagctttatcctgaatttcagtttcattattattccccagtttactgtcgcgaagaaaaatacacttcaatttacaggcctggagtttttcaccggggtcggttacttccgtgataccgtaatgtactacggcttttatacaaactcgactatccagcacggcaattcaggtgcctcatataatatgcagctcgcttatatcttcactattggggcatgccttactacttgtttcttttccctgctgttctctatggccaaatatttccgaaacaattttattaatcctcatatttactcaggtgggatcactaaattgatcttttgctgggatttcactgtaacccatgaaaaagcagtcaagctgaaacagaagaaccttagcactgaaattcgggaaaacctctccgagctgcggcaggagaactctaaactgacttttaaccaactgcttacaagattctcggcctacatggtcgcatgggttgtctccactggagttgccattgcttgttgtgcggccgtctattacctagccgagtataaccttgaattcttaaagacacattccaatcctggtgccgtgctccttctcccctttgtcgttagctgtatcaacctggccgtcccctgcatctattcaatgttccgtttggtggagaggtacgagatgccccgtcatgaggtttatgtcctgctgattcgtaacatcttccttaagatttccatcatcggcatcctgtgctattactggctgaatactgttgctctctctggagaggaatgctgggagacattgattgggcaggacatctaccggcttctattgatggattttgtgttcagccttgtgaacagtttccttggggagtttctccgacggatcataggcatgcagctcatcacatccctgggcttgcaggagtttgatattgccaggaatgttctggagctgatttacgctcaaacactggtatggatagggatcttcttctgtccattgctcccattcatacagatgattatgcttttcatcatgttctactctaagaacatttcactgatgatgaactttcaaccgcctagcaaggcctggcgtgccagccagatgatgacgttttttatattcctgctgttctttccttcatttacgggcgtcctttgtacactggctatcacgatttggaggcttaagccgtcggccgattgcggtccttttcgcggcctccctctctttatacattcaatttactcctggatagacaccttatcgactagacccggctatctgtgggtggtctggatctatcgtaacctgatcggtagtgtacattttttcttcatcctgacgctgatcgtcctcataattacttacctctactggcagatcacagagggcaggaaaattatgatacgtctgctgcatgagcagataattaatgaaggcaaggacaaaatgttcttgatagaaaagctcattaagctgcaggacatggagaagaaggcaaaccctagtagtcttgttctagaaagacgggaggtcgagcaacaggggttcctccacttgggagaacatgacggcagcctcgacctgcgttccagacgctccgtccaagaggggaacccccgagcctag

SEQ ID NO: 206374 - DNA, 1854 bp, Artificial Sequence
  Description of Artificial Sequence: Synthetic coding sequence
atgctgctggcccggatgaacccccaggtgcagcccgagaacaacggcgccgacacaggacctgagcagccgctacgtgcccgtaagaccgcagagctgctggtggtgaaagagagaaatggggtgcagtgcctcctggctccacgagatggtgatgcccaaccaagagagacctggggcaaaaagattgacttcctgctgtcggtggtaggttttgccgtggatctggccaacgtgtggcgcttcccctatctctgctataagaacgggggaggcgccttcctcataccctataccttgttcctgatcattgcgggaatgcctcttttctacatggagctggccctggggcagtataatagagagggagcagctactgtgtggaaaatctgtcccttttttaagggagttggatacgcagtcattcttatcgctttgtacgttggcttttactacaacgtgattatcgcttggagtctgtactacctgtttagttcgttcaccctcaacctgccttggactgactgtggccatacatggaactcgcctaattgcacagatcctaagctactcaacggctcagttctgggcaaccataccaagtacagtaagtataaattcactcccgccgccgaattttacgaacggggggtcctgcacctgcacgagagctccggtattcatgacataggattaccccagtggcaactgttgctgtgcttaatggtggtagtaatagtcctgtactttagtttatggaagggagtcaagaccagcggtaaagtggtctggattaccgcaactttaccttatttcgtcctgttcgtgctgctggtccacggtgtgacgcttcctggggcgtctaatggcatcaatgcgtacctgcacattgacttttatcgcctgaaagaggcaactgtctggattgacgcagccacacagatcttcttctccctaggagccggtttcggcgttttgatcgcattcgccagttataacaagttcgacaacaactgttatagggacgcactgcttacgtcatcaataaattgcataacaagcttcgtgtctggcttcgccatctttagtattctgggttacatggcccacgagcacaaggttaatatcgaggacgtggctaccgagggtgccggactggtcttcatcctctatccagaagctattagtacactctcaggttctactttctgggctgtcgtgttttttgtcatgctcctggcactgggtctggatagtagcatgggagggatggaggcggtgatcactggcctcgcagatgatttccaggtacttaagcggcatcgaaaactctttaccttcggcgtcactttttcaacttttttgctagccctattttgcataacaaagggcggcatctacgtccttactctcctggacaccttcgccgccgggaccagcattcttttcgccgtgctcatggaagccattggcgtgtcgtggttctatggcgttgatcggtttagcaatgacatccagcagatgatgggcttccgacctggcctgtattggagactgtgttggaagttcgtgtctcccgctttcctcctattcgtggtcgtggtgtctataattaattttaaaccactgacctatgacgattacatattcccaccttgggctaattgggtggggtgggggatagcacttagctcaatggtgctggtgccaatttacgttatttacaagtttctcagcacccagggatctctgtgggagagactggcctacggcattactcccgagaatgagcatcacctcgttgcccagagggacatcagacagttccagctccaacattggctggctatttag

SEQ ID NO: 206375 - DNA, 1854 bp, Artificial Sequence
  Description of Artificial Sequence: Synthetic coding sequence
atgctgctggcccggatgaacccccaggtgcagcccgagaacaacggtgcagatacgggtcctgaacagccactccgggctcgcaaaacagctgaactgctggtcgtcaaagagaggaatggggtacagtgcctgctcgcgccaagggacggtgacgcccagccccgagagacttggggcaagaaaatcgactttctgctgagcgtcgtggggtttgcggtggacttagctaatgtctggcgctttccctacctgtgttacaagaacggcggcggtgcgtttttaataccttatacgctgttcctaataatcgccggcatgcccctgttttatatggaactggctctgggtcagtataaccgcgagggggcagcaaccgtatggaagatttgccccttctttaagggtgttggctacgccgttatactcatcgctctctatgtcggattttactataacgtcatcattgcttggtctctttactacttgttctcctcatttactctgaacttgccgtggaccgattgcggtcacacgtggaactcaccaaactgcactgaccctaagctgttgaatgggtccgtgctgggcaatcatactaagtattctaagtataagtttactcccgccgccgagttttacgagcgaggcgtgctgcacctccatgaaagttccggaattcatgatatcggactgcctcagtggcagttgctgctgtgtctgatggtggttgtgatagtgctttattttagtctgtggaaaggcgttaaaacttcaggcaaggtggtttggattaccgccacactcccttacttcgtcctgtttgtgttgttggttcacggtgttactctgccaggggcttcaaacggaatcaacgcctatctgcatattgacttctaccggctcaaggaagcaacagtttggatagacgcagcaacacagatttttttttccctgggagctggttttggcgtgctgattgccttcgcgtcatataacaagttcgataataattgttatagagacgcgctcctgacaagctccattaactgtattacctcgtttgtgtccggtttcgcgatcttcagcattctcggctacatggctcacgagcataaagtcaatatcgaggatgtagctaccgagggggcgggattggtctttatactgtatccagaggctatcagcacactgtcagggagcacattctgggcggtggtgttctttgtgatgctgttggctttgggactggactccagcatgggaggaatggaggccgttataacaggcctggccgatgatttccaggttttgaaacgccaccgcaagctgtttacgttcggcgtgacattctccacatttctgctcgccctgttctgcatcacaaagggcgggatctatgtgctgaccttgcttgacacattcgcagcgggtacatcgatccttttcgccgtgttgatggaggccatcggcgtgtcttggttttacggtgtagaccgattctccaacgatatccagcaaatgatgggttttcgccccgggttgtactggcggctatgctggaagtttgtctctcctgcatttctgttgtttgtcgtggtcgtctctattatcaatttcaagccactgacatatgatgattatatcttccccccttgggccaattgggtggggtggggaattgccctgagcagcatggtgctggttcccatttatgtcatctataaattcctcagcacccagggcagcttgtgggaaaggcttgcgtacgggatcactccggagaacgagcatcacttagttgctcagcgcgatatcagacagtttcaactgcagcactggttggcaatatag

SEQ ID NO: 206376 - DNA, 996 bp, Artificial Sequence
  Description of Artificial Sequence: Synthetic coding sequence
atggtggtggtgatcgtgctgtacttcagcctgtggaagggcgtgaagacctctggaaaggtctggatcgatgctgccacccaaatttttttttccctcggggccggcttcggcgtcctcatcgcatttgctagctacaacaagtttgataataactgttatcgcgatgccctgctgacatccagtattaactgtataaccagtttcgtctcaggttttgctatcttttctatccttggttacatggcccacgagcataaagtgaatattgaggatgtggccacagaaggcgccgggcttgtatttattttgtaccccgaagctatttcaaccctgagtggaagcacattctgggcggtggtgtttttcgttatgctccttgccttaggactagattcttccatgggggggatggaggctgtgatcaccgggcttgcggacgactttcaagttctcaagcggcatagaaagctgttcacattcggtgtgaccttctccacgttcctcctggctttgttttgcatcaccaagggcggtatctatgtgctgactctactggataccttcgctgctgggaccagtatcttgtttgctgtgctcatggaggcaataggcgtgtcgtggttctacggtgtcgatcgattctctaacgacatccagcagatgatgggtttccgacccggcctgtattggaggctgtgttggaagtttgtgagtccagcatttctgttattcgtagtggtcgtctcaataattaactttaaaccactgacttacgacgattacatctttcccccttgggcgaattgggtgggctggggcatcgccctcagcagcatggttctcgtccccatctacgtaatatataagtttctctcaacacaaggtagcctctgggaaagattggcttatgggatcactcctgaaaacgaacaccacctggtggcacagagagacatccgtcagtttcagctacagcattggcttgccatctag

SEQ ID NO: 206377 - DNA, 1893 bp, Artificial Sequence
  Description of Artificial Sequence: Synthetic coding sequence
atggagaccacccccctgaacagccagaagcagctgagcgcctgcgaggacggcgaagattgccaggaaaacggagtcctccagaaggtggtgccgaccccaggcgacaaggtcgaatccgggcagatcagcaacggctactctgctgtgccaagccccggggcaggagatgacactcgccacagcatccctgcaaccaccaccacgctagtggctgaactgcatcagggggagcgggaaacctgggggaagaaggtggacttcctcctttctgtgatcggctacgcagttgaccttgggaatgtttggagatttccctacatttgctatcaaaatggcggaggggcatttctcctaccttacacaattatggcaatatttggcggcattccactgttttatatggaactggcccttgggcagtaccaccgaaacggctgtatatccatttggaggaaaatttgcccaatttttaaagggatcggctatgcaatctgtatcatagccttctacatcgcctcctattacaatactattatggcctgggcactgtattatcttattagttccttcacggatcaactgccctggactagttgtaagaatagttggaacacagggaactgcacgaattatttttcagaggataatattacctggactctccattccaccagcccagcagaagagttctatacgcgccacgttctgcagatacaccgaagcaaggggctacaagacctgggagggatttcctggcagctggctctgtgcattatgctgattttcacagtgatttacttctcaatatggaagggcgtcaagacgtcaggcaaagtcgtgtgggttaccgccacattcccttatatcatcctcagcgtccttctggttcgcggagctaccctccctggcgcctggcggggcgtgctgttttatcttaaacccaattggcagaagctgctggaaacaggggtttggatagacgcagccgcccagatcttcttttccctagggcccggttttggtgtgctccttgctttcgcatcatacaacaagttcaataacaattgctaccaggatgccctggtgacgtctgtggtgaattgtatgacatctttcgtgtctggattcgtgattttcacggtactcggctatatggcggaaatgcgcaatgaggatgtgtctgaagtcgcaaaagacgccgggccttctctgctttttatcacatacgctgaggccattgccaatatgccagcttccaccttctttgcaatcatattcttcctgatgctcataaccctgggtctggactccactttcgccgggctggagggcgtcatcaccgccgtattggacgagttcccacacgtgtgggcgaaaagaagagagcggtttgtcttggcggtggtgattacgtgcttcttcgggagcctggtcacactcactttcggcggcgcttacgtcgtaaaactgctggaagagtacgcaactgggccagctgtcctgactgtcgccctgattgaagctgtcgccgtctcctggttctatggcataactcagttctgccgggatgtgaaagagatgctgggatttagcccaggttggttttggcggatctgctgggtggcaatctcaccacttttcttgctgtttattatttgcagctttttgatgtcccctccccagctgcgtctgttccagtataactacccatactggtcaatcatactcggatactgcattggcacatcaagtttcatctgtatccctacgtacatcgcttaccgccttataatcacaccaggcacatttaaggaacgcatcattaagagcatcactcctgagacgcctactgagatcccatgtggggatatcagactcaatgccgtatag

SEQ ID NO: 206378 - DNA, 2019 bp, Artificial Sequence
  Description of Artificial Sequence: Synthetic coding sequence
atgagccagagccggcgggtgaaccccgacgaccgggagctgggcggagatccgcaaattcaggcaccacgagatcagttgggtagcctcgctgacggccaccagtgtcatttactgacaagcagaatggaaactaccccgctgaacagccagaagcagctttccgcctgtgaagacggtgaagactgtcaggagaatggcgtgttgcagaaagtcgtccccactcccggcgataaagtggagagtgggcagatctctaatggttatagtgccgtccccagccccggggcgggcgatgatacacggcatagcatcccagcgaccaccaccacactggtcgcagagctccaccaaggagagcgggaaacttggggtaaaaaagttgactttctactcagtgtgattgggtacgcagtcgacttggggaatgtgtggcgctttccctacatctgttaccagaatggcggcggcgcgttcttactgccctacaccatcatggcaatctttggcggaatccccttattttacatggagctggccctggggcaataccataggaacggctgcatctcaatttggcgaaaaatttgtcctatatttaaaggcatagggtacgccatatgcataatcgctttctatattgcatcgtactataacaccattatggcgtgggccctctattacctgatctcctcattcactgatcaactgccatggaccagttgcaaaaacagctggaacacgggaaattgcacaaactacttctctgaagacaatatcacctggaccctgcacagtaccagtccagccgaagagttctatacaaggcacgtcttgcagattcaccgctctaaaggtctgcaggacctcggcggtatctcatggcaactggctctttgtatcatgctgattttcacagtcatttacttcagcatttggaagggggtaaagacttctggaaaggtggtctgggtgaccgccacctttccttacataattctttcagtcctcctggtgagaggggctaccctccccggtgcatggagaggtgtgcttttttatctgaaaccaaactggcagaagctactagagacaggcgtctggatcgatgccgccgcccaaatttttttctcacttggaccagggtttggtgttctactggcctttgcatcttataataaattcaataacaactgttaccaagacgcactagtgacgtccgtcgtgaactgcatgaccagctttgtgagcgggttcgttattttcacagtgttagggtatatggcagaaatgcgcaatgaggacgttagcgaggtggctaaggacgcaggtccatctctgttgttcatcacctacgcagaagcgatagcaaacatgccagcctctacattcttcgcaattatcttcttcttgatgctgatcactctcggcctcgacagcaccttcgccggactggagggcgttatcaccgctgtattggatgagtttccacatgtgtgggctaagcggcgggaacggttcgtcctggccgtggtcataacatgttttttcggcagtttagtcacgctcacattcggcggcgcctacgtcgtcaagctcctggaagagtatgccaccggcccagcggtgttgaccgtcgcactgatcgaagccgtggcagttagttggttttacggtattacgcagttttgccgtgatgtgaaagagatgctcggtttcagtccgggatggttctggaggatctgttgggtagccatatctcccctgtttctactatttattatatgttcattcctgatgtcacctccccagctgcgtctatttcagtataattacccctactggtctatcatactgggctactgcataggaacgagctcattcatttgtatacctacatacattgcatacagattgatcattacccctggaacgtttaaggagagaatcataaagtccatcaccccagagacccctactgagataccctgtggagacataaggctgaacgctgtgtag

SEQ ID NO: 206379 - DNA, 1893 bp, Artificial Sequence
  Description of Artificial Sequence: Synthetic coding sequence
atggagaccacccccctgaacagccagaagcagctgagcgcctgcgaggatggtgaggactgccaggagaacggggtcctgcagaaggtagtgcccacgcctggcgacaaggttgaaagcggacagataagtaatgggtactcggcagttccgagcccaggggccggagacgacaccagacacagcatacccgccaccacgaccacactcgtagccgaactgcaccagggggaaagagagacctggggaaagaaagttgactttcttctgagcgttattgggtacgccgtagacctgggaaatgtgtggagatttccctacatctgctaccagaatggaggcggagcgtttctcctgccttatacgattatggctatttttggtgggattcccttgttttacatggagctcgcactgggacagtaccatcgaaatggctgcattagcatttggagaaagatctgtccaatcttcaagggcatcggctatgctatttgtattatagccttctacatcgcgtcgtactacaatactattatggcctgggccctgtattatctaatatcgagctttacagatcagctgccgtggacatcttgtaagaacagctggaacacaggcaattgcaccaactatttctccgaggacaacattacctggaccttacattctacctccccggccgaggaattttacacacggcacgtcctccagattcatcggagcaagggactgcaggaccttggaggtataagttggcagttggctttgtgtatcatgctgatcttcaccgtgatctacttctcaatatggaagggcgtaaagacatctggcaaagtggtgtgggtcactgcaacatttccctacatcatactgagtgtgttactggttagaggtgctacactccccggggcttggagaggtgtgcttttttatcttaaacccaattggcaaaagctgcttgagaccggggtatggatcgacgcagcggcacagatcttcttctcgctcggccccggtttcggggtgctactggcatttgcctcttacaataagtttaacaacaactgctaccaggacgccctcgtgacctcagttgtgaactgcatgacctccttcgtgtcgggcttcgttatatttaccgtcctaggatacatggctgagatgagaaatgaagacgtgtctgaagtcgcaaaggatgctggcccgagcctactctttatcacctacgcggaagccatcgcgaatatgcctgcttcgacctttttcgctataatcttcttcctcatgcttattacgctgggtctggactcgacatttgctggattagagggcgtgatcaccgcagtgcttgacgagtttccccatgtttgggccaagagaagagagcggttcgttttagccgtcgtgatcacctgtttctttggaagcctggtcaccctgacattcggaggcgcctacgtggtgaaactgctggaagaatacgcaaccggacccgcggtgctgactgttgcactcatcgaggccgtagctgtgtcatggttctatggaatcacccaattctgtagagacgtcaaggagatgttaggcttttcccccgggtggttctggcggatctgttgggttgctatctcacctctgtttctcctctttatcatttgctccttcctcatgagccccccacagctgagattgtttcaatataactacccgtactggtccatcattcttggctactgcatcgggacatccagctttatctgtattccaacgtatatagcttatagacttataatcacccctggcacattcaaggagcggattatcaaatctatcaccccagaaacacccactgagatcccatgcggcgatattcgactgaacgccgtttag

SEQ ID NO: 206380 - DNA, 1863 bp, Artificial Sequence
  Description of Artificial Sequence: Synthetic coding sequence
atggccaccaaggagaagctgcagtgcctgaaggacttccacaaggatatcttaaaacctagccctggaaagagccctggcacccgacccgaggacgaggccgagggaaagccacctcagcgggagaaatggagttctaaaattgactttgtgctgtcggtggcaggaggattcgtgggcttgggtaatgtgtggcggttcccctacctatgttacaagaacggcggaggcgctttcctgattccatactttattttcctgtttggctccggactgcctgtgtttttcttagagatcataattggccagtatacttcggagggggggataacctgttgggagaagatctgtccgttgttctctgggattggctacgcatctgtggtgattgtgtcgctgttgaacgtttattatatcgtaatcctggcatgggccacctactatctgttccagagcttccaaaaagagctgccctgggcgcactgtaaccactcctggaatactccccactgcatggaggatactatgcggaaaaataagtctgtatggatcaccattagttctaccaatttcacttcaccggtaattgaattttgggagaggaacgtattgagcttaagccccggaatcgatcaccctggttctctgaagtgggatctagccctctgcctgttgcttgtttggctagtctgctttttctgtatttggaagggcgtgaggtcgacagggaaggtcgtatatttcacagccacgttcccattcgctatgctgttagtccttctggtgcgtggactaactctgccaggggctggtgccggaatcaaattttacctgtaccccgatatcacgcgactcgaggacccccaggtgtggattgatgccggcacacagatattttttagctacgcaatctgcttaggagctatgacatctctggggtcctataataaatataagtacaattcctacagagattgcatgcttctgggatgtctcaatagtggtaccagcttcgtgagtgggttcgccatcttctcaattctgggattcatggctcaggagcaaggcgttgatatagccgacgtagctgaaagtggcccaggtcttgcattcatcgcctatcccaaggccgtgaccatgatgcccttgccaactttttggtccattctcttctttatcatgctgctccttctcggattggacagtcagtttgtggaggtggagggacagatcacctccctggtcgatctgtatccttcgtttctgcgtaaaggctatagaagggaaatcttcattgccttcgtgtgttccatcagctatttgctggggttgacaatggtgacggagggaggtatgtacgtttttcaactgtttgattattacgccgcatccggcgtctgcttgctgtgggtagcctttttcgaatgctttgtgatcgcctggatctatggcggagacaacctgtacgatgggattgaggatatgattgggtatcgccctgggccgtggatgaagtacagctgggctgtaatcaccccagtgctttgtgtcggctgtttcatattctccttggtaaagtatgtgccgctgacctataacaaaacctatgtgtacccgaattgggcaatagggctgggttggtccctcgctctatcgagcatgctctgcgtgcctttagtaatcgtcattaggctgtgtcagaccgagggccctttcctggtcagagtaaaatatttgctcactcccagagaacctaatcggtgggccgtagaacgagaaggggcaacgccttacaattcccgtacagtcatgaatggggctctggtgaagccgacccacatcatagtggagacaatgatgtag

SEQ ID NO: 206381 - DNA, 603 bp, Artificial Sequence
  Description of Artificial Sequence: Synthetic coding sequence
atggccaccaaggagaagctgcagtgcctgaaggacttccacaaggatattctcaaaccctcgcccggcaaaagtcctggcactcgtcccgaagatgaagctgaagggaagcctccgcagagagagaagtggagcagcaaaattgacttcgtgttatcagttgccggcggctttgtgggcttggggaacgtctggaggtttccttacctttgctataagaacggaggcggtgccttccttattccatactttatctttttgttcggctcggggctccccgttttttttctcgaaatcataattggacagtatacttctgagggaggcataacatgttgggagaagatctgccccctcttttctggtattggctatgccagcgtggtcatagtgtccttgctcaacgtatattatatcgtcatccttgcctgggcaacatactatctgtttcagagtttccagaaggagctgccatgggctcattgcaaccacagttggaacacccctcattgtatggaagacacaatgaggaagaacaagtcggtttggataaccatcagcagcaccaatttcacctccccagtgattgaattttgggaatag

SEQ ID NO: 206382 - DNA, 1080 bp, Artificial Sequence
  Description of Artificial Sequence: Synthetic coding sequence
atggccaccaaggagaagctgcagtgcctgaaggacttccacaaggatatcctgaaaccctcgcccggaaaaagtccaggcactaggccggaggatgaggccgaagggaaacctccacagagggagaaatggagcagcaaaattgacttcgtcctttctgttgccggcgggttcgttggcctcggaaatgtgtggcggttcccctatctgtgttataagaacggcggcggggcgtttttgattccatatttcattttcctgttcggctctggactacccgtgtttttcctcgagataattattgggcagtatacgtccgaggggggcattacttgttgggagaagatttgcccactattcagcggaatcggttacgcatcagtggtgattgtgtcgttactgaatgtctactatatcgtgatcctcgcctgggcaacctattacctgttccagagcttccaaaaagagttaccctgggcccactgtaaccactcttggaacacgcctcactgtatggaggacaccatgagaaagaataaaagcgtgtggatcaccatctcatccaccaattttacaagcccagtgatcgaattttgggaaagaaacgttctgagcttatcaccaggcattgatcatcctgggtccttgaagtgggatctggcactatgcctcttgctagtctggcttgtttgcttcttctgcatctggaagggggtgcgaagcacgggaaaagtagtctactttaccgccacatttcctttcgcaatgctgctggtcctgctggttaggggtctaaccttaccaggcgcaggagctggtatcaagttctatctgtacccagacatcaccaggctagaagatccacaagtctggattgatgcaggcacacagatcttcttctcatacgctatttgtttgggcgctatgacttctctgggctcatataataagtataagtacaattcttaccgtagttggccaggattgcactgcctcccaaaatcgtgcgataatgatgcggctgcacatattctggttcattctttcttttattatgcctctcttgcctggacgggatag

SEQ ID NO: 206383 - DNA, 330 bp, Artificial Sequence
  Description of Artificial Sequence: Synthetic coding sequence
atggccaccaaggagaagctgcagtgcctgaaggacttccacaaggacattctgaaacccagtccaggcaaaagcccaggcaccaggccagaggacgaggcagaagggaaacctccacagcgggagaaatggagctccaaaatagattttgtcttaagcgtggccggtggctttgtcgggctgggtaatgtatggcgcttcccctacctctgctacaagaatggcggaggggcctttctaataccttattttatctttctgttcggaagcggattacctgtgtttttcctggaaataattatcggacaatacacctcagagggcggctag

SEQ ID NO: 206384 - DNA, 1863 bp, Artificial Sequence
  Description of Artificial Sequence: Synthetic coding sequence
atggccaccaaggagaagctgcagtgcctgaaggacttccacaaggatattctgaaaccaagccccggcaaaagccctggcaccaggccagaagacgaagcagaaggtaagcccccccagagggagaaatggtccagcaagattgacttcgttttgtcggtggcaggagggttcgtgggacttggcaacgtgtggcggtttccatatttgtgttacaaaaacggggggggtgcctttctaataccctactttatttttctctttggctctgggctgcccgtgtttttccttgagatcatcatcgggcagtacacttctgaggggggaatcacatgctgggagaaaatctgccccctgttctccgggattgggtacgctagtgttgtgatcgtctcattgctcaatgtgtactatatcgtcatactggcctgggcaacgtactaccttttccagtcctttcaaaaggaactgccctgggcacattgcaatcacagctggaacacgccacactgcatggaagacaccatgcgcaagaataaatccgtttggatcaccattagctcgaccaacttcacttcccccgtgatagagttttgggagcggaacgtactaagtctctcccccggcattgatcaccccggcagccttaagtgggatttggccctgtgtctgctgctggtatggctcgtgtgctttttctgtatttggaaaggtgtgcggagtaccggcaaagtcgtttatttcacagccaccttccctttcgccatgttactggtgcttctggtccgcggcctgacactgcctggcgctggagcgggaattaaattctacttgtatcccgacattacgcgactggaagacccccaagtgtggattgacgcagggacccagatcttcttttcgtatgcaatttgcctgggcgccatgacctctctcggatcatacaataagtataagtataatagctaccgcgactgtatgctcttgggctgcctcaacagcggcacatccttcgtgtcaggcttcgcaatctttagcatactgggatttatggcacaagaacagggggtcgatatcgctgacgtggcagaatccgggccgggtctggcttttattgcctaccctaaggctgttaccatgatgcccttaccaactttctggtcgattctattcttcataatgctgctcctcctgggcttggacagccagtttgtggaagtggagggacagatcacttctctggtggacctctacccatcattcttacgaaaaggttataggcgagagatatttatcgcttttgtgtgtagtatatcctacttgctcgggctcacaatggtcacagagggtggaatgtacgtttttcagctctttgattactatgctgcctcgggagtctgcttgctgtgggttgctttcttcgagtgtttcgttatcgcttggatttacggaggggacaatctttatgacggcattgaggatatgatcggatataggccaggtccctggatgaagtatagctgggccgtgatcacacctgttctgtgcgtaggatgctttatcttttcactggtcaaatacgtgcctttgacttacaataagacctatgtatatcccaactgggccataggcctagggtggtccttagccttatctagcatgctttgtgtgcctctggtgattgtgatccgcctttgtcagactgagggtccatttctggtaagggtaaagtacctcctcacccctcgcgagccaaaccggtgggctgtcgagcgcgaaggcgctaccccctacaacagccgaaccgtgatgaacggcgcgctcgtaaagccaacccacattatcgtggagactatgatgtag

SEQ ID NO: 206385 - DNA, 1080 bp, Artificial Sequence
  Description of Artificial Sequence: Synthetic coding sequence
atggccaccaaggagaagctgcagtgcctgaaggacttccacaaggatatcctgaagccttccccggggaaaagcccaggaaccaggccagaggatgaggccgaagggaaacctcctcaacgggaaaaatggtcaagtaaaatcgacttcgttttatctgtggctggaggctttgtgggcctcggaaacgtctggagatttccctacttgtgctacaagaacgggggcggggctttcctgataccctacttcatctttttgtttggatcaggactgccggtgttcttcttggaaattatcatcggacagtacactagtgaggggggcattacctgctgggaaaaaatatgccctctgttctcaggcattgggtatgcatcagtggtgattgtgtctttgcttaatgtgtattacattgtgatcctcgcctgggccacttactaccttttccagagctttcagaaagaactgccgtgggcacactgcaaccatagttggaatactccccactgcatggaggacaccatgcgcaagaacaagtcggtgtggattacaatttcctcaacgaacttcacaagtcccgtgatcgagttttgggagcggaacgttctcagcctgagtccaggcattgatcacccaggcagcctgaaatgggaccttgccctctgtctgctcctggtttggcttgtttgctttttctgtatttggaaaggcgtgcgctctactggtaaagtggtgtattttacagcaacatttccttttgcaatgctgttagtgttgctggtacgcggcttaactttacctggcgcaggagccgggattaagttctatctgtacccggacatcacccgtttggaggacccacaggtgtggatcgatgccggtactcagattttcttcagctacgctatctgcttgggggcgatgactagcctgggcagctataacaaatataaatacaacagctaccgctcatggccagggctccactgcctgccaaaatcctgcgataacgatgcggccgcacatatattggttcatagcttcttttattatgcgtctctcgcttggaccgggtag

SEQ ID NO: 206386 - DNA, 1905 bp, Artificial Sequence
  Description of Artificial Sequence: Synthetic coding sequence
atggtgcggctggtgctgcccaaccccggcctggacgcccggatcccaagtctcgctgaactggagacaattgagcaagaagaggcttcttctcgaccgaaatgggataataaggctcagtacatgctcacttgcctcggattctgtgtcggcctgggtaatgtatggcggttcccgtatctatgtcagagccatggcggtggagcattcatgataccatttctaattctgttagtcctggaaggaatcccactcctctaccttgaatttgccatcggacagcgcctaagaaggggctccctgggcgtgtggtcgtcaatccaccctgccctgaagggcctggggttggcttccatgctcacctcgttcatggtagggctatactataataccatcattagctggatcatgtggtaccttttcaatagcttccaagaaccgctaccgtggtccgattgcccattaaatgagaatcagaccggctacgtggatgagtgtgcacggtcctcaccggtcgactacttttggtacagagaaaccttgaacatctctacctcaatcagtgactctggtagtatacagtggtggatgctcctttgtctggcatgcgcatggagtgttttgtatatgtgtacaatcagaggaattgaaacaaccggcaaggcggtctacattactagtactctgccatatgtagttctcaccatctttctcataaggggattgacgctcaaaggtgccacaaatggtattgtgttcctgtttacccccaacgtcactgaactggcgcagcccgatacctggctggacgcaggggctcaagtgtttttctccttttccctggcgttcgggggtctgatatcattttcttcctacaacagtgtgcataataactgtgaaaaggactcagtaattgttagcatcatcaacggattcacatccgtgtatgttgctatcgtggtctattctgttatcggatttcgcgcgacccagcgatacgacgattgtttttccacgaatattttgaccctcatcaacggcttcgacctgccagagggtaatgttacccaggagaattttgtcgacatgcagcagaggtgcaatgcttcagaccccgccgcatacgcacagctggtgtttcagacctgtgatattaatgcattcttgagcgaggccgttgaaggtacaggcctggcttttatcgtcttcaccgaggccatcaccaagatgcctctctccccactctggtccgtcctgttctttatcatgctgttctgtctgggtctgagctctatgttcgggaacatggaaggcgtcgttgttcctttgcaagatttacgggtgataccgccgaaatggcccaaggaggtgctgaccggtctcatttgtctgggaactttcttaattggattcatcttcaccttgaacagtggccagtattggctgtctttgctcgactcctatgctggttcaatcccactgctcatcatcgctttctgcgagatgtttagcgtagtttatgtgtatggcgtggaccgattcaataaggacatagagtttatgattggccataagccgaacattttttggcaggtgacatggcgcgtggtgtcaccccttctgatgctgattatctttctctttttctttgtggttgaagtctctcaggagctcacttactcaatctgggatcctggatacgaggaattccctaagtctcagaagatctcatatcccaactgggtatacgtggttgtcgtcattgtggcgggcgtgccttccctcaccatccctggatatgccatttataagctaattaggaaccattgccaaaagccaggcgatcaccaagggctagtgtctacattatctaccgcaagcatgaatggtgatctgaaatactag

SEQ ID NO: 206387 - DNA, 1668 bp, Artificial Sequence
  Description of Artificial Sequence: Synthetic coding sequence
atggagaaggcccggcccctgtgggccaacagcctgcagttcgtgtttgcttgtatctcctacgctgtgggcctcgggaatgtatggagattcccatacctttgtcagatgtatgggggcggatcattcttggtcccttatataattatgctcatcgtggaaggtatgccgttgctgtatctggaattggctgtgggacagcgcatgagacaggggtcaatcggggcttggcgcaccataagcccatatttgtcaggtgtgggcgtggctagtgtcgtcgtcagcttttttctatcaatgtactataacgttattaacgcctgggcgttctggtacctcttccattctttccaggatccgctaccttggtctgtctgtcccctgaatggcaaccatacaggatacgacgaagaatgtgagaaagcctcctctactcagtacttctggtaccgcaaaaccttgaatatctccccttctctccaagagaacggaggcgtgcagtgggagccggccttatgcttgctgctagcgtggctcgttgtctacctttgcatcctcagggggaccgagtcaaccggcaagatcgagcagctcgccaatcccaaagcctggatcaatgctgccacccaaattttcttctcactgggccttgggttcggtagcctcatcgcgtttgcctcttacaatgagccctccaataattgccagaagcatgctatcattgtgagccttattaactcctttaccagcattttcgcgagtatcgtgacattctccatttatggctttaaagccacttttaattacgaaaattgcctaaaaaaagtgtccctgttgctgacaaatacctttgatctggaagacggctttcttaccgcaagcaacctagaacaggtgaaaggctacctggcatctgcctatcccagcaagtactccgagatgtttccccagatcaagaactgcagtctagagagcgagttggatacagccgtacaggggacaggcctggcctttatcgtgtacaccgaagccatcaagaacatggaggtttctcaattgtggtccgtgctctatttttttatgcttttaatgctaggcattggctcaatgttgggcaacacagcagccatacttacccccctgacagactcaaaaattatttcgagccatctcccaaaagaagccattagcggtctggtctgtttggttaattgcgccatcggtatggttttcacaatggaggccgggaactactggtttgatattttcaatgactatgcagccaccctgagtctcctcctgatcgtgctcgtcgagaccattgccgtctgctatgtgtatggactgcggaggttcgagagcgatctgaaggcaatgacagggagggcggtaagttggtattggaaagttatgtgggcaggggtgtcccctctgctaattgtgtcactgtttgttttctacctgagcgactatattctcacaggaactttaaaatatcaggcgtgggacgctagtcagggacagcttgtgaccaaggactaccctgcgtacgcattggctgtcattgggctgttggtggcctcatctaccatgtgcatccccctcgcagccttggggacattcgtccagcgacgcctgaaacgcggtgatgccgacccggtggcatag

SEQ ID NO: 206388 - DNA, 1779 bp, Artificial Sequence
  Description of Artificial Sequence: Synthetic coding sequence
atggagaaggcccggcccctgtgggccaacagcctgcagttcgtgtttgcctgcatttcctatgcagtcggtctgggaaacgtctggagatttccctacttatgccaaatgtatggcggcggaagttttttagtgccctatatcatcatgctgatcgtggaaggcatgccattgctgtatctggaactggccgtaggccagaggatgcggcaaggaagtataggagcctggaggactatctcaccgtacttaagcggtgttggagtggccagtgtggtggtgtcctttttccttagcatgtactataatgtaatcaatgcatgggcattttggtatttgttccatagctttcaggatccattgccatggtccgtctgtccgctgaacggcaaccacactggatatgatgaggagtgcgagaaggcatcgtctacccagtatttctggtatagaaaaacacttaatatctcaccgtccctccaggaaaacgggggcgtccaatgggagccagctctctgtctcttgttggcctggctagtcgtgtacctctgtatcctgcgtgggaccgagtccaccggaaaagtggtgtacttcacagcctctctcccatattgtgtgctcatcatctatctgattcgggggctcacacttcatggagctacaaatggtttaatgtacatgtttactcctaaaatcgaacagctcgccaatcctaaggcgtggattaacgctgccacacaaatattcttctctctcgggctcggcttcggctccctgatcgcatttgccagttataacgagccaagcaacaactgtcagaaacatgccatcattgtgtcgttaattaacagctttacctccatcttcgcctctatagtcactttttccatctacggatttaaggccacatttaactacgaaaactgtctgaaaaaggtctctctgctgctaacaaacacatttgacctggaagatggctttctaaccgcctctaatctggagcaggtaaaggggtatcttgcctcagcctacccgtctaaatatagcgagatgtttccccagatcaagaactgttcactggaatccgaactggacaccgcggttcagggcactggacttgccttcattgtatacactgaggctatcaagaacatggaggtttcccagctatggagcgtgctgtacttttttatgttgctgatgctggggatagggtccatgctgggaaatacggcagccattttgaccccacttactgactcaaaaatcatctctagccatctcccaaaagaagctatatctggactggtgtgtctcgtgaactgcgcaatcggaatggtcttcacaatggaagctgggaattattggttcgatatctttaacgattacgctgctaccctgtctctgctactgattgtgctcgtcgaaactatagcggtctgttacgtttatgggttgcgccggtttgagtccgacctcaaagccatgactgggagagcagtcagctggtattggaaagtgatgtgggccggagtctccccactgttgattgtgtccctttttgttttctacctgtccgattacattctgacaggtaccctgaaataccaggcatgggatgcatcccagggacagctcgtcacgaaggactacccagcatatgctttggccgtgataggtctgcttgtggcgagtagcacaatgtgcatccctctggctgccctggggacattcgtccaacgacggctaaagcggggcgatgccgatccggtggcctag

SEQ ID NO: 206389 - DNA, 1644 bp, Artificial Sequence
  Description of Artificial Sequence: Synthetic coding sequence
atggagaaggcccggcccctgtgggccaacagcctgcagttcgtgttcgcttgcatctcctacgccgtcggcttgggcaatgtatggaggtttccttatctgtgccaaatgtatggcggagggagtttccttgtgccgtacattatcatgctgattgtcgaaggcatgcccctactgtatctagagctggctgtgggacagcggatgcggcaaggtagcataggagcctggcgcaccatctctccctatttatctggggtgggagttgcgtctgtggtggtttcattctttctgagcatgtattataacgtcatcaacgcttgggctttctggtatctgtttcatagttttcaggaccctttaccttggtccgtgtgccctctgaatggtaatcatacaggttacgatgaagaatgtgagaaagcgagctctacacagtacttttggtacagaaaaaccttgaacatcagcccttccctgcaggagaacggaggcgtccagtgggagcctgcattgtgcttgcttctggcatggctcgtggtctatctatgcattctgcgggggaccgagtcgacagggaaagtggtctattttacagcttctcttccctattgcgtgctgattatttacctcatcagaggcctgactttgcatggcgctactaatgggctgatgtatatgtttacacctaagatcgagcagctcgcaaacccgaaggcttggatcaacgctgccactcagattttctttagcctgggtcttgggttcgggtcccttatagcattcgcaagttataatgagccatctaacaattgtcagaagcacgcgattattgttagtttgattaacagctttaccagcatttttgcgagcatagtgacattttcgatctatggattcaaagcaactttcaactatgagaactgcctgaaaaaagtgagtctcctgctaacgaacactttcgacctagaagacgggtttctgaccgcatccaatctggagcaggtcaaggggtacctggccagcgcttatcctagtaagtatagcgagatgttccctcagattaaaaattgctctctcgagtcagagctggatacggcagtccagggtaccgggctggcgtttattgtttacacagaagcgatcaaaaatatggaagtgtcacagctgtggagcgtgctttatttttttatgctgctcatgctaggtatcggtagcatgttggggaacacagccgccatcctgacacctttgaccgattctaaaatcatctcttcccacctgcccaaggaggcaatatccggactagtatgtctggttaattgcgcaattgggatggtgtttacaatggaggcagggaattattggttcgacatatttaatgattacgccgccacgctatcccttctgctgattgtgctggtggagaccatagccgtatgctacgtctacgggctaaggcggttcgagtccgatctcaaagccatgaccgggagggccgtatcatggtattggaaagttatgtgggcgggggtgagcccgctgctcatcgtgtccctttttgttttctacctctccgattacatcctgaccggcacacttaagtatcaggcctgggatgctagccaggatgataagttatag

SEQ ID NO: 206390 - DNA, 1194 bp, Artificial Sequence
  Description of Artificial Sequence: Synthetic coding sequence
atggcccacgcccccgagcccgaccccgccgcctgcgacctgggcgacgagaggccaaaatgggacaataaagcacaatatttactgtcctgtaccggctttgctgtgggccttggtaatatctggcgattcccctacttgtgtcagacctacggtggtggagcctttctgattccgtatgtcattgccctcgtattcgagggcatcccgatctttcacgttgagctggccattggacagagacttagaaagggcagtgttggtgtgtggacagcaatcagtccatacctttccggggtggggctgggctgtgtgactttgtctttcttgatttctctctactacaacaccattgtggcttgggtcctgtggtacctgttaaattccttccagcacccactcccctggagctcgtgtcctcctgatctcaacagaacaggtttcgtggaggaatgccagggatcttccgccgtatcttacttctggtaccgacagaccctgaatatcactgctgacattaatgattccggatccattcaatggtggctcttgatctgccttgcagccagttgggctgttgtgtacatgtgtgtaattcgagggatcgagacaacgggcaaggtgatatactttaccgccttgttcccttaccttgtgctcaccatttttctcatcagaggtctgactctgcccggcgccacgaaagggctgatatacctgttcacaccaaacaaccccagggtgtggctagatgcagcaactcagatcttctttagcctctctctggccttcgggggccacattgcctttgcgtcttataactcgcctagaaacgattgccaaaaggacgccgtggtcatagcgctcgttaatagaatgactagtctatatgcgtctattgctgttttttctgtgttaggtgcgtccgggcctggacttgcttttgttgtgttcacagagaccgatctgcacatgccaggggcacctgtgtgggccatgctgtttttcggtatgcttttcaccctcggcttgagcaccatgttcggtaccgtggaggccgtgataacacctcttttggattcggggaattattggttggagattttcgacaattttgccgcctctcccaatctactgatgctcgctttcttggaagtggttggggtggtgtacgtttatggcatgaagcgctag

SEQ ID NO: 206391 - DNA, 1887 bp, Artificial Sequence
  Description of Artificial Sequence: Synthetic coding sequence
atggcccacgcccccgagcccgaccccgccgcctgcgacctgggcgatgagcgacccaaatgggataacaaagcacaatacctgctctcttgtacagggttcgcggtaggacttgggaacatatggagattcccttacctctgccagacttacggcgggggcgcttttttaattccctatgttatcgcactcgtgttcgagggtataccaatatttcatgttgagctcgcaattggtcagcgacttcgcaaaggctctgtcggcgtgtggacagcaatctccccctacttgagtggggtgggtttgggttgtgtgacattaagttttctgattagtctgtattacaataccattgtcgcttgggtgttatggtacctgctgaactccttccagcaccccctgccttggtcctcctgccccccagacttaaatcgcacaggtttcgtcgaggagtgccaaggcagctcagcggtctcttatttttggtatcgccagactctcaacatcaccgcggacatcaatgactccgggtccatccagtggtggcttctgatttgtctggcggccagctgggctgtcgtgtatatgtgcgtgatacgtggaatcgaaacgaccggcaaagttatttatttcaccgcactgttcccatatttggtcctgacgatattcctgatcaggggtcttacgctgcccggcgccaccaagggactcatctatctctttactcctaacatgcacatcctccagaaccctcgggtgtggctggacgccgcaactcagatcttcttcagcctgtccctagcctttgggggccacattgccttcgcatcttacaattccccacggaacgactgccagaaggacgctgtggtgatcgcactggtgaatcgcatgacctcactatatgctagcatagctgtgttttccgttctcggattcaaggcgactaacgactacgagcactgtctcgataggaatatcctgtccctgatcaatgattttgactttcctgaacagtccattagcagggacgactatccagcagttctgatgcatctcaacgcaacatggcctaagagggtggcgcagctgcctctgaaagcttgcctgttggaggacttcctcgacaaaagtgcttctggccccggcctcgctttcgtggtctttacggaaacagatttgcatatgcctggggctccagtgtgggcaatgcttttcttcggcatgttattcactttaggcctctctacgatgtttggtaccgttgaggcggtcatcacaccgctgctggacgtcggcgtcctgccccgctgggttcccaaagaagccctgaccggtctagtatgcctcgtgtgctttcttagcgccacatgcttcaccctgcagtccggtaactattggctcgaaattttcgataacttcgccgcaagtccaaacctgctgatgctggcctttctggaagttgtcggggtcgtgtacgtgtatggaatgaagcgcttctgtgatgatatagcctggatgacaggtcggcgaccttctccttactggcggctgacatggagggtggtttctcccctcctgctgacgatcttcgtcgcctatatcatcctgttgttctggaagcctcttagatacaaggcatggaaccccaaatacgagttgtttccctcaagacaggaaaagctttacccaggttgggctagagcagcatgtgtcctgctctccctgcttccagttttgtgggttcccgtggcagcgctggctcaacttttgacccgccgccgccgcacctggcgcgaccgggacgcacgtcccgatacagacatgaggcccgacactgacacccgccctgacactgacatgaggccggatacagacatgaggtag

SEQ ID NO: 206392 - DNA, 1548 bp, Artificial Sequence
  Description of Artificial Sequence: Synthetic coding sequence
atggaggcccgggagcccggccggcccacccccacctaccacctggtacctaacacaagtcagtctcaggtggaggaagacgtgtcttctcccccccagcgcagcagcgaaacaatgcagctgaagaaggagatctctttgctcaatggagtaagcttggtggttggcaatatgattgggtcgggcatttttgtgtcacccaagggcgttttagtacataccgccagctatggcatgtccctgatagtgtgggccataggcggtctgttcagcgtagtgggggccctgtgctacgcagaacttggaactaccatcacgaagtcaggcgcaagctacgcatatattctggaggccttcggcggttttattgcttttattcgactttgggtgagcctactcgtggtcgagccaaccggccaggccataattgctattaccttcgccaactacatcatacagccctcatttccctcttgtgacccaccttacctagcatgtcgacttctggccgcggcttgcatctgcctcctcacctttgtgaattgcgcgtatgtgaaatggggcactcgggtgcaggacacttttacgtatgcaaaggtggttgcccttattgccatcattgtcatgggcctagtgaaactctgtcaaggacactctgagcacttccaagacgctttcgaaggcagtagttgggacatgggcaatcttagcctggcattgtattctgcactcttctcgtactctggctgggacaccctgaatttcgtcacggaagagatcaagaatcctgagaggaacttgccgctagctatcggaataagtatgcctatcgtgaccctgatttatatcttaaccaatgtcgcatactataccgtccttaacattagtgatgtgctttcttccgatgccgtagccgtcacatttgcagaccagactttcggcatgttctcctggaccattccgatcgcagtggcgctgtcttgtttcgggggacttaatgcttcgattttcgcgagctcccgactattcttcgtcggctcacgggaaggtcacctcccagacctgctttcaatgatccacattgagcgttttacaccaatccccgcactgctcttcaattgtaccatggccttaatttacttgattgttgaagacgtgtttcagctcatcaactacttctccttctcttactggttctttgtgggcctgtccgtcgtgggccaactgtacctgagatggaaagaaccgaagcgcccacgaccattgaagctttccgttttcttccccatcgtgttctgtatctgcagtgttttcctcgtaatcgttcctttgttcacagacacaatcaattcgctgatcggaattggaatcgccctgtcgggtgtgcccttctacttcatgggcgtgtacctccccgaatcccggagacctttattcattcgaaatgtgctggctgctatcaccaggggcacacagcagctttgtttttgtgttctcacagagctggacgtggctgaggaaaagaaggacgagcgaaagactgattag

SEQ ID NO: 206393 - DNA, 1524 bp, Artificial Sequence
  Description of Artificial Sequence: Synthetic coding sequence
atggccggcgccggccccaagcggcgggccctggccgcccccgccgccgaggagaaagaagaggcccgcgagaagatgctggcggctaagtccgcggatggctcggcccccgctggcgagggtgagggcgtcacactccagaggaacataaccctgctgaacggtgtggcaatcatcgtcggcacgataatcggctccggcatatttgtgacaccgacgggagtgctgaaagaagctggttcccccgggctggccttggtggtctgggctgcatgtggtgtattctctatcgtcggtgcattatgctacgccgaactagggaccacaatcagcaaatctggtggagactacgcctatatgctcgaggtttatggctcactacctgcatttctgaagttatggatagagctgctgattataagacctagctctcagtacatagtcgcgttagtttttgctacatatctgctcaagcccctcttcccaacctgcccagtgcctgaggaagcggccaagctggtggcctgtctgtgtgtcctcttactgaccgccgtaaactgctactcggtgaaagccgctaccagggttcaggacgcatttgccgcagcaaagcttctggctttggccttaattattcttctgggatttgtccagataggaaagggggatgtgtcaaacctcgacccaaacttctcattcgaaggcacaaaactcgacgtgggtaatattgtactggcactctactccggcctcttcgcatacggcggctggaattacctgaacttcgtgactgaggagatgataaacccctataggaatctgcctctcgccatcattatttctctgccgattgtgacgctcgtgtacgtgctgaccaaccttgcttactttactacgctttctacggagcagatgctctcatccgaggccgtagcggtagatttcggaaactaccatttgggcgttatgtcatggataatccctgtcttcgtaggtctcagctgttttgggtccgtcaatgggtccctgtttacatcctcgcgcctgttcttcgtgggctctagagagggccatctgccatctatactctcaatgatacacccccagcttttgactccagtcccatcactggtattcacatgtgtgatgacattactttatgcattcagtaaggatatattttctgtgatcaactttttcagttttttcaactggctgtgtgtggcgttagcaattatcggaatgatttggctgcgtcaccgcaaaccagagctcgaacggcctataaaggtgaatctagctctacctgtgttctttattcttgcatgtctgtttcttatcgctgtcagcttttggaagacgccagtcgaatgtggcatcgggttcaccattattttaagcgggctgccagtgtacttcttcggtgtgtggtggaagaacaagccaaagtggctgcttcagggtatcttttcgaccactgtcctatgccagaaattgatgcaagtggtcccccaggagacctag

SEQ ID NO: 206394 - DNA, 846 bp, Artificial Sequence
  Description of Artificial Sequence: Synthetic coding sequence
atgagccacggcacctactacgagtgcgagccccggggcggccagcagcctttggaattctccgggggaagggccggtcccggtgagctgggagacatgtgtgaacacgaagcatcgattgatctgagtgcatacatagaatccggcgaggagcagctgttgagcgacctatttgccgtaaaaccggccccagaggcccggggcctcaaagggcccggcacccctgcttttccacactatctcccacccgaccctaggcccttcgcctatccccctcacacattcggacccgatcggaaggcgctgggccccggaatttactcttctccaggcagttatgacccacgggctgtggcggtgaaggaggaaccgcgaggacctgaaggctcaagagcagcatcgcgcggatcctacaacccactgcagtaccaggttgcgcattgtgggcagactgcaatgcacctgccccccactctcgccgccccagggcaacctctacgggtgttaaaggctccactggccactgcggcacctccatgtagtccgctcctcaaagctccttcccctgccggcccactgcacaagggtaaaaaggccgtgaataaagacagtttggaatatcgtctgaggcgcgagaggaacaacatcgctgttcgaaaatctcgtgacaaggccaagcgtagaatcctggagacacagcagaaagtgttggaatacatggcagaaaacgagcgcttgcgctctcgcgtagaacagctcacccaggagctggacacccttcggaatctgtttcggcagataccagaggccgcaaatctgatcaagggtgtcgggggatgttcctag

SEQ ID NO: 206395 - DNA, 1608 bp, Artificial Sequence
  Description of Artificial Sequence: Synthetic coding sequence
atggaggagggcgcccggcaccggaacaacaccgagaagaagcaccctggggggggtgagagcgacgcatctccagaggcagggtccgggggaggtggcgttgccctgaagaaagaaattggcttagtgtctgcatgtgggatcattgtcggaaatatcataggctcaggaatattcgtgagtcccaagggtgtcctggaaaacgcaggctctgtcgggctcgcgctcatcgtttggattgtgacaggattcattactgtggtgggggcgttgtgctatgccgagctgggggtcaccattccaaagtcgggaggcgactacagctatgtaaaggatatatttggcggcctggccggctttctgaggctgtggattgccgttctagttatttaccctaccaaccaggcggtgattgcattgaccttttcaaactatgttcttcagccattattccctacctgtttcccccctgagtcagggttaagactattggcggcgatctgtctgctgctgctcacatgggtgaattgttcatccgtccgttgggctacaagggtacaggatatattcaccgctgggaagttattagccctcgccttgattattatcatgggaatcgtgcagatatgtaaaggggagtatttttggcttgaaccaaagaatgcatttgaaaacttccaggagccggatatcgggctggtggcccttgccttcctccaagggagtttcgcatacgggggctggaacttcctcaattatgtgaccgaggaactggtggacccctataaaaatctgccaagagcgatcttcattagtattcctttggtcacattcgtttacgtctttgcaaatgttgcatacgtaacagccatgtctcctcaggagctgttggcgtccaacgcggtcgcagtgacatttggggaaaagttgttgggtgtcatggcctggatcatgcccatttctgtggcacttagtacattcggaggtgtgaatgggtctctgttcacctctagtcgcctctttttcgccggtgctcgtgagggccaccttcctagcgtgcttgccatgatccatgttaaacgctgcactcctatcccagcgctcttattcacttgcattagcaccctgctcatgctggttacgtcagatatgtacactttaattaattacgtcggctttattaactatctgttctacggtgtgaccgtggctggccagatcgtgttgcgatggaaaaaaccagatattcctagacctattaagattaaccttctgttccctattatttatctacttttttgggcttttctgctggtgttctccctctggagtgagcccgtcgtgtgtggaattggcctggccatcatgttgaccggcgtgcccgtgtacttcctgggcgtttactggcagcataagccaaagtgcttttctgacttcatcgaactgttaacactcgtgtctcagaagatgtgtgtcgttgtgtacccagaggttgaacgggggagtgggacggaagaggccaacgaggacatggaggagcagcaacagcccatgtatcagcctacgccaaccaaagataaagacgtagccgggcagccccagccatag

SEQ ID NO: 206396 - DNA, 633 bp, Artificial Sequence
  Description of Artificial Sequence: Synthetic coding sequence
atgggcatcgtgcagatctgcaagggcgagtacttctggctggagccaaagaatgcgttcgagaactttcaggagccggacatcggacttgtggcactggccttcctgcagggctcattcgcttatggaggctggaactttttgaattatgttaccgaggagctcgttgacccatacaagaacctccctcgtgccatcttcatttctatacccttagttaccttcgtgtacgttttcgcaaatgtggcgtatgttacagcaatgtcgccccaggagcttctggcttctaatgctgttgcagtgacatttggcgaaaaactattgggggtgatggcctggataatgcctattagcgttgcactgtccacatttggtggggtgaacggaagcttgcacctgttgagcgcagtgttaagatggtcaccgcgggggccccctagtcagtgcgtgggacatgacccgcgcgaggctctccatcctaaccctagtcccgctcttcatatgcatctccacccagctgacgctggtcaccaacggcatgtgcacactcaccaactctgtgggctgcaccagctgcccttgttatgggggcatggctgttggacagattcgccctccctggaagaggcatag

SEQ ID NO: 206397 - DNA, 693 bp, Artificial Sequence
  Description of Artificial Sequence: Synthetic coding sequence
tgatgcctgcaggagcacagccagcccagccagctgctgtgcaccctgctcctgtgttggtgcgtgctaggccgagagcgcccttttaggaaagcccagtctacaagctcacctctggaaggcgtgccccgcttcctgaagaggctattgctgacatgggttaactgttcaagcgtacgctgggccactagagtacaggacatctttactgccggcaagctgctggcattggccctcattataattatgggaattgtgcagatttgcaagggagaatacttctggttggagcccaaaaacgcttttgaaaactttcaggaacccgatattggactagtggccctggcttttttgcaggggtcgttcgcctacggtggatggaacttccttaactatgtaactgaggagcttgtggatccgtacaaactgttcttcgcaggagcccgcgaggggcacttaccaagcgtgcttgccatgatccacgtgaaaaggtgcacacccattcctgccctgcttttcacgtgtatttcaactctgctgatgctagtcacatccgacatgtatactctgattaactatgtggggttcattaactacctgttctacggagtcaccgtcgcagggcagattgttctgagatggaaaaagcccgatatacctagacctattaagcctcttccttatcagggatag

SEQ ID NO: 206398 - DNA, 936 bp, Artificial Sequence
  Description of Artificial Sequence: Synthetic coding sequence
atgggccagctgttccagtgcgccgtgggccaccccggcagccggcacctacactcatgggaggcccctggactgggtccagactatcatcatggagactgtacagatatgcagcgcaatctcccccgggccatctttatatctattccgctggtgactttcgtgtacgttttcgcaaatgtcgcctatgtaacggctatgtcgccacaagagctgctagcaagcaacgcagtggcagtgacctttggcgaaaagctgctgggcgtcatggcatggataatgcccatttcagttgccctatcaacgtttggtggtgtaaatggaagcctatttaccagtagtaggctcttctttgccggtgcgcgtgaaggtcacctgcccagtgtgttggcgatgatccacgtcaaacgctgcacgcccattccagctctcctatttacttgtatctcgaccctcctgatgctagttactagcgacatgtataccctgattaattatgttggtttcatcaactatcttttttacggcgtaactgttgccggccaaatcgtgttgcgctggaagaagccggatataccgcggcccattaagatcaatctactgtttcccattatatatttgttgttctgggcgttccttctcgtgtttagtctctggtctgagcccgtggtctgcggcatcggactcgccatcatgctaacaggcgtacccgtttactttcttggagtttactggcagcacaagccgaagtgcttcagcgacttcatcgaacttttgaccctcgtatcccaaaagatgtgtgttgttgtttatccggaagtggagagagggtcaggcaccgaggaggcgaacgaggacatggaggaacaacagcaacccatgtaccaaccgacgccgaccaaagataaggatgtagcaggtcagccccaaccttag

SEQ ID NO: 206399 - DNA, 999 bp, Artificial Sequence
  Description of Artificial Sequence: Synthetic coding sequence
atgggcatcgtgcagatctgcaagggcgagtacttctggctggagccaaagaatgctttcgaaaattttcaggagccggatataggcctggtggcccttgcatttctgcagggatccttcgcctatgggggctggaatttcctgaactacgtgaccgaggaactggtggatccttataagaacctccctagggctatcttcattagcattcctctggtcacattcgtctatgtgtttgctaacgtcgcgtacgtcactgctatgagtccacaggagctcctcgcttctaacgccgttgctgtgacatttggagagaagctgctcggcgtgatggcctggattatgccaatttctgtggccctgtcaacttttggcggtgtgaacggatccctgtttacgagcagtaggctgttctttgctggcgcccgggaggggcacctgccatcagtgctggccatgatccacgtcaagaggtgtactccaatccctgctctgctatttacttgcatctcaacgctactcatgctggtaacttccgacatgtatactctcatcaactatgttgggttcattaactaccttttctacggagtcaccgtggccggacagattgttctgaggtggaagaagcccgatattccccgccctataaagatcaacttactgttcccaatcatataccttcttttctgggctttcctccttgttttcagcctctggagtgagccagtggtctgcggaattggtctggccatcatgctgaccggcgtgcctgtttacttcctgggagtgtactggcagcacaaacctaagtgcttttcggattttatcgagcttcttaccctggtgagtcaaaaaatgtgtgtagtggtctaccccgaggttgagagaggttctggaacagaagaagccaacgaagacatggaggaacaacagcaaccgatgtatcagcctacacccaccaaagacaaggacgtggccggtcagcctcaaccttag

SEQ ID NO: 206400 - DNA, 285 bp, Artificial Sequence
  Description of Artificial Sequence: Synthetic coding sequence
atggaggagggcgcccggcaccggaacaacaccgagaagaagcacccgggtggtggggaatctgacgcctcccccgaagcggggtccggagggggcggggtggccctgaagaaagaaatagggctggtgagtgcttgtggcatcatcgttggtaacatcattgggagcggaatctttgttagtcccaagggcgtcctggagaacgccgggagtgtggggctcgcgttgattgtttggattgtgacaggctttatcacagtagtgggtgccctttgttatgcgtag

SEQ ID NO: 206401 - DNA, 237 bp, Artificial Sequence
  Description of Artificial Sequence: Synthetic coding sequence
atggaggagggcgcccggcaccggaacaacaccgagaagaagcaccctggggggggtgagtctgatgcctcacccgaagccggcagtggagggggcggcgtcgccctcaaaaaggagatcgggctggtgtctgcatgtggaataatcgtaggaaatatcataggttccggtatatttgtctcacctaaaggggtgctcgaaaatgctggttcagttggcttggccttgatcgtctag

SEQ ID NO: 206402 - DNA, 1293 bp, Artificial Sequence
  Description of Artificial Sequence: Synthetic coding sequence
atgggccagtacggccaggagctgagctggaagtgcctggtgaaggcagtgtgcctgcaggagcattcgcaacctagccagcttctctgcacactgctgttgtgctggtgtgtgttggggcgcgagcgacccttccgcaaagcacagagcacctcctcccctctggaaggcgtgccacggtttctaaagaggctgctgctaacatgggttaattgtagctcagtaagatgggccacccgggtccaggacatttttacagccgggaaactgctggccctggccctgatcatcatcatgggcatcgtccagatatgcaagggagaatacttttggcttgagccgaagaatgcatttgagaactttcaggaaccagacattggactcgtcgccctggcctttttacagggctcattcgcatatgggggatggaacttcctgaattacgtcacagaggagttggtggacccttacaagaacttgccacgggccatatttatatctatccccttggtgacttttgtttacgtctttgccaatgtggcttacgtcactgcgatgtctccacaggaattgttagcttctaacgcagttgcagttactttcggtgagaaactgctgggagtgatggcatggatcatgcctatctcagtcgccctgtcaacgttcggtggcgtgaatggtagcctgtttactagttcaaggttatttttcgccggcgcccgggaggggcatctccctagcgttctggctatgatccatgtgaaaagatgcacccccattcccgctcttctgtttacatgcattagcactctgctgatgttagtgactagtgacatgtataccctaatcaactatgtcggatttattaactatctcttctacggtgtgaccgtggcaggccaaatcgtgttgaggtggaaaaaacccgatattcctcgcccgatcaaaatcaatcttcttttccctatcatctacctcctgttctgggctttcctgcttgtcttcagcctgtggtcagagccggtcgtctgcgggataggactcgccatcatgctgaccggcgtccccgtctacttcctgggcgtatattggcagcacaagccaaaatgcttctctgacttcatagagctcttgaccctggtctctcaaaagatgtgcgtggtggtgtatccagaggtggaaagaggatctggtaccgaagaagctaatgaggatatggaggaacagcaacagcctatgtaccaacccactccaactaaggataaagacgtcgccggacaacctcagccatag

SEQ ID NO: 206403 - DNA, 1968 bp, Artificial Sequence
  Description of Artificial Sequence: Synthetic coding sequence
atggtgctgtacaccacccccttccccaacagctgcctgagcgccttgcactgcgtgagttgggctcttatcttcccctgctactggctcgtggacaggctggccgcttccttcatccctaccacttatgagaagaggcagagggccgacgacccctgttgcctgcagttgttgtgtactgcgttgtttacgcccatctatttggctctgctggtggctagcctgccctttgcttttctgggctttcttttctggagtccactgcagtctgcaaggcgtccctacatctactcgcgccttgaggacaaaggacttgcaggaggggctgctctcctgagcgaatggaagggcactgggcccgggaaaagcttttgctttgctacagccaacgtttgtctgttacctgatagcttggcacgtgtgaacaacctgtttaacacgcaggctcgagctaaggagattgggcagagaattaggaatggagctgctagaccccagataaagatctacatcgactcacccaccaacacctccatatccgccgctagctttagtagcctggtgagccctcagggcggtgatggggtggcacgggccgtccccggatcaatcaagcgaactgcctccgtcgagtacaagggcgacgggggccgccacccgggagatgaggccgcaaacggaccagcaagtggtgatccagtggatagctcctccccagaggatgcttgtatcgtccggatcgggggggaggaaggggggaggcctcctgaggctgatgatcctgtacccggtggccaggcaaggaatggcgctggcggagggccccgaggccaaaccccaaatcataaccagcaggatggcgatagtggcagcctgggaagcccctcagcatcacgcgagagcctggtgaagggtagagcggggcccgatacctcggctagcggagaaccaggagcaaactcaaaactattgtacaaagctagtgtcgtgaaaaaagccgcagcgagacggagacgccaccccgatgaagcctttgaccatgaggttagcgccttcttccctgcaaacctggacttcttatgcttacaggaggtttttgataaaagagccgctaccaaactcaaggagcaactgcacgggtattttgaatacatactatatgacgtcggggtgtacggatgtcaagggtgttgcagcttcaagtgtctgaactccggcctgttatttgccagccggtatcctattatggacgtggcataccattgctatcctaataagtgtaacgatgatgcactagctagtaagggcgccttatttttgaaggtgcaggttggctcaacaccccaggatcagcgcattgtggggtatatcgcctgtactcacctgcacgccccgcaggaagattccgctataagatgtggacagctggacctgctgcaggactggctggccgattttcggaagtccactagcagctccagtgccgctaaccctgaagaactagtggccttcgatgttgtttgcggagattttaactttgacaactgttctagcgacgataaattggagcaacagcactccctgttcacccactaccgggatccctgtcggctcggtcctggagaggaaaagccctgggctattggtactctgttggacacaaatggcctgtacgacgaggatgtgtgcacaccagacaacctgcagaaggtgttagaatccgaggagggacgaagggagtatctggctttcccaacctcaaaaagtagtgggcagaaaggcagaaaggagttgctgaaaggcaatggccgccggattgattacatgttgcacgctgaagagggattatgtcctgactggaaagccgaagtcgaagaattctccttcatcacccaattaagtgggctcacagaccacctccccgtggccatgaggttaatggtaagcagtggtgaggaagaagcctag

SEQ ID NO: 206404 - DNA, 690 bp, Artificial Sequence
  Description of Artificial Sequence: Synthetic coding sequence
atggaggcccgggagcccggccggcccacccccacctaccacctggtgcctaacaccagtcagagccaggtcgaggaagatgtctctagtccgccccagcgcagctccgaaacaatgcaattaaagaaggagatttcactgctgaatggtgtgtccctagtcgtgggcaatatgataggcagtggcatctttgtgagcccaaaaggtgtgctggttcatacggcgagctacggtatgagcctcatcgtctgggccatagggggcttgttttccgtggtgggagccttgtgttacgcggagctgggcactactataactaagtcaggggcatcctacgcgtatatactagaagccttcgggggctttatagccttcatacgtctctgggtgagtctcctggtggtggaacctactgggcaggcgatcatcgctattacattcgccaactatatcattcaaccctcttttcctagctgtgacccaccctaccttgcatgtagactgctggccgccgcgtgtatttgtctgctaaccttcgtgaactgcgcgtacgtaaaatggggcacacgagtacaagatacctttacctatgcgaaagtcgtggctctgattgctataattgtgatgggactggttaaactttgccaagagatatgcccctggcccctcgggttcctgtgccaactgtag

SEQ ID NO: 206405 - DNA, 1536 bp, Artificial Sequence
  Description of Artificial Sequence: Synthetic coding sequence
atggtggacagcaccgagtacgaggtggccagccagcccgaggtggagaccagtcccctgggagatggagcaagtcccggacccgaacaggtgaagctcaagaaagaaatcagcctcctcaatggcgtatgcctgatcgtgggaaacatgattgggagtggcatctttgtgtctcctaagggcgtgctgatttactccgcgagcttcggactgtctctcgttatttgggccgttggaggtctgttcagcgtcttcggcgctctgtgctatgccgagctcgggacaaccatcaagaagtccggggcctcctacgcatacatccttgaagccttcgggggatttctggcttttattcggctgtggaccagcctgctcatcatcgaacctacttcacaggccatcatcgccatcacttttgccaattatatggtgcagccgctgttccccagctgcttcgccccatacgccgcgagtcggcttctggcagccgcttgcatctgtcttctgacattcattaattgtgcctacgtaaaatggggcacccttgtgcaggacatttttacctatgcaaaagttttagccctcatcgcggtcatcgttgctgggatcgtcagattgggccagggagccagcactcattttgaaaatagtttcgagggttccagtttcgctgtgggcgatatcgctctggctttgtacagtgccctgttttcatactctgggtgggatacactgaactacgtgactgaagagatcaagaaccccgagcgaaacctgcccctctcaattgggattagtatgccaattgtcacaatcatctacattcttaccaatgtagcctactacacagtcttggatatgagggacatcctggcaagtgacgcggtcgccgtcacgtttgctgatcagatatttggcatatttaactggattatacctctgtcagtagcactgtcttgtttcggcggcctaaatgcctcaattgtcgccgcctcgagactcttcttcgtgggatccagagaaggccacctgccagacgccatttgcatgattcacgtggagcgtttcactccggtgccctccttactgttcaatggcattatggcactgatctatctgtgcgttgaagacatcttccagttgatcaattactacagcttctcatattggttttttgtgggtttgtcaatcgtggggcagctgtatttgcgttggaaagaacccgaccgaccacgtcctttaaagctgtcagttttcttccctattgtgttctgtctatgcacgatctttctggttgctgtgcccctgtatagcgacactatcaactccctgataggcatcgccattgccttgtctggacttcccttttactttctaatcatccgcgtacctgagcacaagaggcccctctatctcagaaggatcgtgggctcagcaaccaggtatttgcaggtcctgtgcatgagtgtagccgcagagatggaccttgaggatggaggggaaatgccgaagcagcgagacccaaaaagcaactag

SEQ ID NO: 206406 - DNA, 1536 bp, Artificial Sequence
  Description of Artificial Sequence: Synthetic coding sequence
atggtggacagcaccgagtacgaggtggccagccagcccgaggtggagacttctcctctgggagacggagccagtcctggacctgagcaggtcaaactgaagaaagagatctcactcttgaacggggtgtgcctgatagtaggcaacatgatcggctccggtatatttgtgagtcccaaaggagtgctcatctacagcgcatcttttgggctttccctggtgatttgggccgtgggggggcttttcagcgtctttggagcactgtgttacgcagagctaggcacaactataaaaaagagcggggcgtcttacgcgtacatactcgaagccttcgggggattcttggcttttatacggctgtggacgtcactgctgatcatcgagccaacgtcccaggccattatcgcaatcaccttcgcaaactatatggtacagccactcttcccttcatgcttcgccccctacgcagcttctagactgttggccgccgcctgcatttgtcttttgacattcatcaattgcgcatacgtcaagtggggcacactggtgcaggatatcttcacctacgccaaggtcctggccctcatagcggttatcgtagctggcattgtgagactcggtcagggcgcaagtacccatttcgagaattcattcgaaggttcatccttcgccgtcggggatatcgctctcgctctctactcagcattgttttcctactctggttgggacactctaaattatgttacagaagagataaagaaccctgaacgaaacctgcccttgagcatagggatttctatgcctatcgtcactatcatctacatcctgacgaatgtggcatactacacagtgctcgatatgcgggacatcttggcgtcagacgccgtggcagtgacctttgccgatcagatattcggaatctttaattggataatccccctttctgtggccctgagttgtttcggaggcttgaacgcttcaatcgtggcggcttccaggctgttcttcgtgggcagccgcgagggccacctacccgatgcaatctgcatgatccatgtggaaaggttcactcctgtgccaagtcttctcttcaacgggatcatggctttaatttacctttgtgttgaggatatctttcagctgatcaactactacagtttttcttattggtttttcgttggcctatctattgtgggacagctgtacttacggtggaaggagcctgatcgccctagaccactgaagctcagtgtgttctttccaattgtgttctgcctttgcaccattttcttggtggctgtgccactttacagcgatacaatcaactcccttatcggaatagctatcgccctgtctggtcttccattttactttctgatcattagggttcctgaacataagaggcctctttatctaagacgcatcgtcggaagtgcaaccagataccttcaggtactgtgcatgtccgtcgccgctgaaatggatttggaagacggtggcgaaatgcccaaacagagagatcccaaatccaattag

SEQ ID NO: 206407 - DNA, 1536 bp, Artificial Sequence
  Description of Artificial Sequence: Synthetic coding sequence
atggtggacagcaccgagtacgaggtggccagccagcccgaggtggaaacctcaccattaggggacggcgctagccctggtcccgagcaggtgaaactgaaaaaagagatctcactgctgaatggagtgtgcctgattgttggcaacatgatcggctccggaatcttcgtttctccaaagggcgttctcatttatagtgcctcctttggcttgagtcttgtgatatgggcagtgggcggcctttttagtgtgttcggggcgttgtgttacgctgagttgggaacaacaatcaaaaaaagcggggcgtcatacgcctatattttggaggcttttggcgggtttttggcattcatcaggctctggacttccctgcttatcattgaaccaacctcccaagctattatcgccatcacattcgccaattatatggtccagccgctgttcccgtcttgctttgccccttatgccgccagccgcctgctcgccgccgcctgcatctgcctgctcacattcatcaactgcgcttacgtcaagtggggcaccctcgttcaggacatcttcacttacgccaaggtcctggcactcatcgctgtgattgtggcgggcatcgtgcggttaggacagggagcctcaacacacttcgaaaactcgttcgagggcagtagtttcgccgtgggggacattgcactggccctgtattctgcactttttagctactccggctgggataccctgaactatgttactgaggaaatcaaaaatccagaaaggaacttgcccttgagcattggcatctccatgcccatcgtgactatcatatatatcctgacaaacgtggcatattacacagtgcttgacatgagagatatactcgcctccgatgccgtggccgttacattcgcggaccagatatttggcatttttaactggatcattccactatctgtggccttatcgtgctttggcggcctgaatgccagcattgtggcggctagccggctgttttttgtgggatctcgggaggggcatttgcccgatgctatttgcatgatccatgtagagcggttcacccctgtgccgtcactcctgtttaacgggatcatggcacttatatatttatgcgtagaagacatcttccagctcataaactactactcattttcctattggttcttcgtcgggttgtccatcgtgggacagctctatctacgatggaaagaacccgacaggcccaggcctctgaaactgtccgttttcttccctattgtgttctgtttgtgtactatattcctcgtggccgtccccctgtattcagacacgattaattcactgattggcatcgctatcgctctgtcaggactgcccttctactttctgatcattcgcgtccccgagcataagaggcccctctatctgagaaggatcgtaggctcggcaacacggtatctgcaggtgctgtgcatgtccgtggccgcagaaatggaccttgaggacggaggcgaaatgcccaagcagagggacccgaaaagcaattag

SEQ ID NO: 206408 - DNA, 1536 bp, Artificial Sequence
  Description of Artificial Sequence: Synthetic coding sequence
atggtggacagcaccgagtacgaggtggccagccagcccgaggtggagacgagcccactgggcgacggcgcctcacctggaccagagcaagtgaaactgaagaaggagatcagtctgcttaatggggtctgcttaatcgtggggaatatgatcggttcaggtatatttgtatctcctaagggcgtacttatctactcagcatctttcggtctgtctctggtgatctgggcagtgggtggcctgttcagtgtcttcggagcactgtgctatgcagagctcgggacaactatcaaaaaatccggagcaagttacgcttacatcctagaagcgtttgggggattcctggcctttattaggctgtggacctccctgttgataattgagcccaccagccaagctattattgcaatcacattcgctaactacatggtgcagccgctgttcccctcatgcttcgccccatatgccgcttcaaggctgctagccgctgcatgtatctgtctcctgactttcattaactgcgcttacgtgaagtggggcaccctggttcaagacatttttacatacgcaaaggttctcgcacttatagcggtgattgtggctgggatagtacggctgggccagggggcgagtacacacttcgaaaactctttcgaaggcagctcttttgctgtcggggacatagccctcgccttgtacagcgccttattctcctactctggttgggacacactgaactatgttactgaggagataaaaaatccggagaggaatctacctctctcaattggcatctctatgccaatagtgaccattatatacatccttactaacgtggcttactatactgttttggatatgagagatattctggcctctgacgcggtcgccgtcaccttcgccgaccagatcttcggaattttcaattggattatccctctcagtgtcgcgctgtcatgctttggcggtctcaacgcttccatagtcgccgctagccgactgttcttcgtgggcagtcgcgagggccatctgcctgacgcaatctgcatgatccatgtcgaacgttttactcctgtgccgtccctcctcttcaatggtattatggccctcatttacctgtgtgtcgaggatatatttcaattaattaactattatagtttctcctattggttcttcgttggcctcagtattgtagggcagctctacctgagatggaaggagcccgatcgaccccggcccctgaagctgagtgtgttcttccccatcgtattttgcctctgcaccatcttcctggtggcagtgcctctttactccgatactatcaactctctcattggaattgctattgctttgagcggcctgccattctatttcctgatcattagagtgcccgaacacaagcgccccctctatctccgccgcattgtgggatctgccacgaggtatctgcaggtgctctgtatgtcagtggcagccgagatggatctggaagatggaggcgaaatgccgaagcaacgcgatccaaaaagcaattag

SEQ ID NO: 206409 - DNA, 1455 bp, Artificial Sequence
  Description of Artificial Sequence: Synthetic coding sequence
atggtggacagcaccgagtacgaggtggccagccagcccgaggtggagacctctcccctcggagatggggcttcacctgggccagagcaagttaaactgaaaaaggagatctactccgcttccttcggactaagcctcgttatatgggcggtgggcggcctcttttccgtatttggcgcactgtgttatgccgaactcggaactacaattaagaagtccggagcctcgtacgcgtacatccttgaggccttcggcggtttcttagctttcatccgtctctggacttcattattgattattgagcctacatctcaggccattattgcaataacgttcgccaattacatggtccagcccctcttcccgagttgttttgccccgtacgcagcgagtcgattgttggccgcagcctgcatatgccttctcaccttcattaactgtgcctatgtgaagtggggtaccctggtgcaggatatcttcacatatgcaaaagtgttagctctgatcgcagttatagtggcaggaatagtgcggctgggccaaggagctagtactcactttgagaacagcttcgagggatcgtcatttgctgtgggggatattgctctcgccctgtacagtgcgttgttcagctacagcgggtgggataccctgaattatgtgacagaagaaatcaagaatccggaaagaaacctccccctttccatcggaatttcaatgcctatcgtgacaatcatctatatcttgaccaacgtcgcctactacacggtactggatatgcgtgacatcctggcctctgatgctgtggctgtcacttttgctgatcaaatattcggaatctttaattggatcatacccctgtctgttgctctttcctgctttggaggcttaaacgcaagcatcgtggcagcctcacgactcttctttgtcggcagccgggagggacatctgcctgatgccatatgcatgatccacgtagaacgcttcacacctgtgcctagtctgctgttcaacggaatcatggccctgatttacttgtgcgtcgaggatatctttcagctgatcaactactacagcttctcgtattggtttttcgttgggctttccatcgtggggcagctttatctgcgctggaaggagcctgacaggcccagacctctcaagctgagtgtgttctttccaatcgtcttttgcctttgtaccatcttcctggtggccgtgcctctgtatagcgacaccataaactcactcattggcattgccattgcactgtctggactccccttctatttcctgataatcagggtcccagagcacaagcggcccctgtacctccgccggattgtgggttcagcaacacgctatttacaggttctctgtatgtccgttgcggcagagatggacctcgaggatggcggagagatgcccaaacagcgcgaccccaagtcgaactag

SEQ ID NO: 206410 - DNA, 426 bp, Artificial Sequence
  Description of Artificial Sequence: Synthetic coding sequence
atggtggacagcaccgagtacgaggtggccagccagcccgaggtggagacctccccattaggcgatggtgcgtccccaggacctgagcaggtcaaactgaaaaaagagatatctctactgaacggtgtatgtctgatcgttggaaacatgattggatcaggtatttttgttagccctaagggagtcctcatctactctgcttcatttggcctgtctctggtgatatgggctgtcgggggactgttttctgtctttggcgcactgtgttacgcagagttgggcacaaccatcaaaaaatctggcgcttcttacgcttatattctggaggcgttcgggggatttctggcctttatccggctgtggaccagcctgctaatcatcgaacctactagccaggcaataatcgccatcacctttgcaaactag

SEQ ID NO: 206411 - DNA, 135 bp, Artificial Sequence
  Description of Artificial Sequence: Synthetic coding sequence
atggtggacagcaccgagtacgaggtggccagccagcccgaggtggagacctcccctctgggtgatggggccagccctgggcccgagcaggtcaaacttaaaaaagaaatctctctcctgaacggggtgtgttag

SEQ ID NO: 206412 - DNA, 495 bp, Artificial Sequence
  Description of Artificial Sequence: Synthetic coding sequence
atggtggacagcaccgagtacgaggtggccagccagcccgaggtggaaacatccccattgggggatggcgcaagcccagggcccgagcaggtaaaactcaaaaaagagatttccttgctcaatggcgtgtgcctgatcgtgggcaacatgatcggtagcggcatcttcgtgtccccaaaaggggtcctgatttatagcgcgtctttcgggctctcactggtcatctgggcggttggcggactcttttccgtgtttggcgcactctgttatgctgagctcggaacgaccattaagaagtctggagcgtcttatgcttatatcctggaggccttcggcggttttctcgccttcattaggctttggacgagtttgctgattatcgagcctacgtcccaggcaatcattgcaataacctttgccaactacatggtccagcccctgtttccttcctgcttcgccccgtacgctgcctctagattgctagccgcggcatag

SEQ ID NO: 206413 - DNA, 369 bp, Artificial Sequence
  Description of Artificial Sequence: Synthetic coding sequence
atggtggacagcaccgagtacgaggtggccagccagcccgaggtggaaacttcacccctcggagacggcgcctcccccggacctgagcaagttaaattgaagaaggagataagcctcttgaatggagtatgcctcatagtggggaacatgatcggctctggcatatttgtctcacctaaaggagtgctcatctactccgcttctttcggcttgagcctggttatctgggcagtgggagggctgttttcagtgtttggagctctgtgttacgccgaattagggaccacaatcaagaaaagcggtgcgtcttatgcatatattttggaggccttcggtggctttttagcctttatcagactttggacatag

SEQ ID NO: 206414 - DNA, 1536 bp, Artificial Sequence
  Description of Artificial Sequence: Synthetic coding sequence
atggtggacagcaccgagtacgaggtggccagccagcccgaggtggaaacatccccattgggggatggtgccagccctggtcctgaacaagtaaaactcaaaaaagaaatttccctgctcaacggcgtttgtctgattgttggcaatatgattggcagtggaatatttgttagcccaaagggtgttttgatatactccgcgagctttgggttgagtctcgtgatttgggcagtggggggtctcttcagcgtgtttggggctctgtgctatgcggaactggggactaccataaaaaaatcaggtgcctcctacgcctacatcctggaggcttttggaggcttccttgcctttattaggttgtggactagcctgctcatcattgagcccacttcccaggctattattgcaattacctttgccaactatatggttcagccgctgtttcccagctgctttgcaccgtatgcggcctccagacttttggccgcggcctgtatctgcctcctgacatttatcaactgtgcatatgtgaaatggggtacactcgtgcaggacatatttacctatgctaaagtgcttgcactgattgccgttatcgtggcgggaattgtcaggctgggacagggcgcctccactcacttcgaaaattctttcgagggatccagctttgcggtgggtgatatcgccctagccctttacagcgcgctgttcagctattccggttgggatacactgaactatgtgacggaagaaattaaaaacccggagaggaaccttcctctgtcaattggaattagcatgcccatcgttaccatcatctacatcctcacgaacgttgcctattatacagtgcttgacatgagggatatcctcgcgtcagatgcagtagccgttacgtttgccgatcagatctttgggatctttaattggattatcccattgtccgtggcgctgagttgcttcggaggacttaacgctagcatcgtggcggcctcaagactcttcttcgtgggatctagagaggggcacttgccggacgccatttgcatgattcacgtggaaagattcactcccgttccttcgctgctctttaatgggatcatggcactgatttacctctgtgtcgaagacatcttccagctcataaattactacagtttctcttactggttttttgtgggtcttagtattgtcggccaactttacctaagatggaaggaacccgaccgaccccgccccttgaaactgtctgttttcttccccatagtgttctgtctttgcacaatttttctcgtggccgtgcccttatacagcgacacaattaatagtctgatcggaatcgcaattgctctcagtggcctccccttttatttccttattattagggtgcccgagcacaagcgtcctctgtaccttaggcggatcgtgggctccgctacaagatacctgcaggtcttgtgcatgtccgtggcagccgagatggacctagaagacggaggtgaaatgccaaaacagcgggatcctaaaagcaattag

SEQ ID NO: 206415 - DNA, 348 bp, Artificial Sequence
  Description of Artificial Sequence: Synthetic coding sequence
atggtggacagcaccgagtacgaggtggccagccagcccgaggtggagacctctccactcggcgacggagcatcacccggccccgagcaggtgaagcttaagaaggaaatatctctcttgaatggcgtttgcctgatcgtcgggaacatgatcggctcaggtatatttgtttctcccaagggcgtgttgatctactcagcttcctttggcctaagtctggttatttgggctgtgggcggactcttttctgtgttcggggcactctgttatgctgaactcggcacgaccattaagaagagtggggcgagctatgcctacattcttgaagccttcggcggcttcctgtag

SEQ ID NO: 206416 - DNA, 93 bp, Artificial Sequence
  Description of Artificial Sequence: Synthetic coding sequence
atggtggacagcaccgagtacgaggtggccagccagcccgaggtggagactagcccactgggtgacggcgcgtcccctgggcccgagcaatag

SEQ ID NO: 206417 - DNA, 933 bp, Artificial Sequence
  Description of Artificial Sequence: Synthetic coding sequence
atggtggacagcaccgagtacgaggtggccagccagcccgaggtggagacctccccactgggggatggcgctagtcctggccccgagcaagtgaagctgaagaaggagatctcgctgctaaatggtgtgtgtctgatcgttgggaacatgattggctctggcatcttcgtgtctccgaagggtgtgctcatctactccgcctcattcggactgtcgctggtgatttgggctgtgggcgggttattctccgtctttggggcgttgtgttacgctgagctggggaccaccataaagaaaagtggcgccagctacgcgtacattctggaggccttcggaggctttttggccttcattcgtctgtggacctccttgctgatcattgagcccacgagccaggcgataatcgcaattacgttcgccaattatatggttcaacctctgtttcctagttgtttcgctccctacgccgcaagtcgcctactcgcagcggcctgcatttgtctcctaactttcattaactgcgcatacgtgaaatggggaacactggtacaggacatcttcacctatgcaaaagttctggctctcatcgccgtgatcgttgccggaatcgttcgcttgggccaaggcgctagcacgcatttcgagaattcattcgaaggctcctctttcgctgtgggagatatcgctctggcactgtactctgccctgtttagctacagcggctgggatacactgaactacgtaacggaagaaattaagaatccagagcggaatttgccactctcaatcgggatctctatgcccattgtaaccatcatttacatacttaccaacgtggcttattacacagtcctggacatgcgggatattctggcctccgacgctgtagccgtggccttcctctgcggactcaagcgcaggccttcgccctag

SEQ ID NO: 206418 - DNA, 321 bp, Artificial Sequence
  Description of Artificial Sequence: Synthetic coding sequence
atggtggacagcaccgagtacgaggtggccagccagcccgaggtggagacctccccactcggcgacggagcttctcctggtccagagcaggtgaagttgaaaaaggaaatttccttgttaaacggcgtctgccttatcgtaggaaacatgattgggagcggtatctttgtgagtcccaagggcgttttgatttacagcgccagctttggactgtctctggttatttgggctgtcggcggtttgtttagtgtctttggagccctctgctatgccgagctcggcacaaccataaaaaagagcggagcgtcttatgcttattag

SEQ ID NO: 206419 - DNA, 351 bp, Artificial Sequence
  Description of Artificial Sequence: Synthetic coding sequence
atggtggacagcaccgagtacgaggtggccagccagcccgaggtggaaacctctcccctgggtgacggagcttcccccggtcctgagcaagtgaagcttaagaaagaaatttcgctgctgaatggcgtatgcctcatagttgggaatatgataggctccgggatttttgtctcacctaaaggagtactgatctacagcgcgtcctttggactttctcttgttatttgggcggtgggtggcctgttctccgtcttcggagcactgtgttacgccgaacttggaaccacgatcaagaaaagcggagctagttatgcatacatcctggaagctttcggcggttttctcgcatag

SEQ ID NO: 206420 - DNA, 1890 bp, Artificial Sequence
  Description of Artificial Sequence: Synthetic coding sequence
atgggctgcaaggtgctgctgaacatcggccagcagatgctgcggagaaaggtagtcgactgcagccgcgaagagacgagactttcacggtgcctaaatacattcgacctggtcgctcttggggtgggtagtacccttggcgccggcgtctatgtgttggccggcgcagtggctagagagaatgccggtccagcgatcgtaatttcattcctcatcgctgccctggctagtgtgcttgcagggctctgttacggggagttcggggcccgggttccaaagacaggctcagcttacctatatagctacgtgactgtaggtgagttgtgggctttcatcaccggatggaacctcatcctttcttacattattggaacgtcatctgtggcaagagcttggtccgcaacttttgatgagttaattggtaggcctatcggggagttcagccgaacacacatgaccttgaacgcccccggagttctggctgagaaccctgatatcttcgcagtaatcattatcctaatactgaccggcctcttgacactcggagtgaaggagagtgcaatggtcaacaagatattcacatgtatcaacgtactcgtacttggctttataatggtgagcgggttcgtaaaagggtccgtcaaaaactggcagctgaccgaggaggattttgggaatacctcagggaggttatgtttaaataacgacacaaaagagggcaagcctggggtggggggcttcatgccctttggattttcaggcgtactgtcgggtgcagcaacttgcttttacgcattcgtcggtttcgattgtattgctacaacgggagaggaagtaaagaatccccagaaggcgatccccgtgggcattgtggccagcctgctgatctgttttattgcgtacttcggggttagtgcagcccttactctaatgatgccatacttttgccttgacaacaacagcccattacctgacgccttcaaacatgtcggatgggaaggcgctaaatatgctgtggcagttggaagcctgtgtgctctgagcgctagtctcttaggttctatgttccctatgcctagggttatatatgctatggctgaggacgggcttctgttcaaattcctggccaatgtcaacgacagaactaaaacgccaattatcgctacattggcaagtggggctgtggctgccgtgatggcctttctttttgatctgaaggacctagtggacctcatgtccattgggacccttttggcttactcactcgttgcagcatgtgtgctcgtactcagataccagcccgaacagcccaacctggtgtaccagatggcttccacttccgacgaacttgatcctgctgatcaaaacgagctggcctctacaaatgattcccagctaggcttcctgcccgaagccgagatgttctctcttaaaaccatcctcagccccaaaaatatggagccttctaagatatctggcttgatcgtgaatatttctacttcccttatcgctgtgctgataattacattttgcatcgtgacagtgctgggtagggaagccctaactaaaggcgctttatgggctgtgttcctcctggctggatcagctctgctgtgtgcagtggtcaccggtgtgatttggagacaaccagaatccaaaactaagctcagctttaaggtcccttttctccctgtccttccaattctcagcatattcgttaacgtttacctgatgatgcagctggatcagggaacttgggttcgattcgctgtgtggatgttgattggatttatcatctacttcggatatggtctgtggcactctgaggaggcttccctcgatgcagatcaggccagaacccctgacggcaatctggatcagtgtaagtag

SEQ ID NO: 206421 - DNA, 366 bp, Artificial Sequence
  Description of Artificial Sequence: Synthetic coding sequence
atgggctgcaaggtgctgctgaacatcggccagcagatgctgcggcggaaagtcgtcgattgtagcagagaagagacaaggctgtccaggtgcctgaacaccttcgatctggttgctttaggagtgggatctacactgggtgctggagtttacgtgcttgccggcgccgtggctcgagaaaacgctggccctgccatcgtgatttctttcctcatcgcagcgttggcatcagtactggccggcctgtgctatggagagtttggcgctcgtgtcccgaagacaggaagcgcatatctctatagctacgtgaccgtcggcgaactatgggcctttatcaccggttggaacctcattctatcctactag

SEQ ID NO: 206422 - DNA, 2097 bp, Artificial Sequence
  Description of Artificial Sequence: Synthetic coding sequence
atgaagatcgagaccagcggctacaacagcgacaagctgatctgcaggggcttcataggaacgccagctcccccagtctgtgatagtaagttccttctgtctccgtcaagcgatgtgagaatgattccctgtcgcgcggccttgacgttcgcaagatgcctcatcagaagaaaaatagtgacgctagatagcctggaggacaccaagttatgccgctgtctctcgacgatggatcttattgctctcggcgtggggtccactctgggggcgggggtctatgtattggcaggagaggtcgctaaggccgattcaggtccatccatcgttgtgagtttcttgatcgcagctttagcctcagttatggcaggtctttgctacgccgagtttggtgcacgggttcccaagacaggttcagcatacctctatacctacgttaccgttggcgagctatgggcctttattacaggatggaacctgattttgtcctatgtgatcggaacaagttccgtggctcgtgcctggagcgggacgtttgacgagctcctcagcaagcagattggtcagtttctccggacctatttccggatgaattacacaggcttggcggaatatcctgatttttttgctgtctgcctgattctactgctggctggcctattgtcctttggcgtcaaggagtctgcatgggtaaataaggtgttcacggcggtgaacattttagtgcttttgtttgtcatggtagccggcttcgtaaaagggaacgtggctaactggaaaatctcagaggagtttctgaaaaatatcagcgccagcgccagggagcctcccagtgaaaacggaaccagtatttacggcgccggtggttttatgccttacgggtttaccgggaccctggccggggctgccacatgtttctatgcctttgtgggatttgattgcatcgccacaaccggagaagaagtgcgcaatcctcaaaaggcaattcctataggtatagtgacaagcctgttagtctgttttatggcctacttcggcgtatctgcagctctcacacttatgatgccatattacttgctggacgagaaatcacctctgccagtggctttcgaatatgtgggctgggggccggccaaatacgtcgttgcagctgggagtttgtgtgctctatcgacctcgcttctcggctctatcttccccatgcctcgcgtgatttacgcgatggcggaggatggactattattcaaatgtttggcccagatcaactccaaaactaagacacctattatcgccacgctctccagtggtgcagtggcggccctgatggctttccttttcgatctgaaggcactggtcgatatgatgtccatcgggacactgatggcctattcactggtagcagcctgcgttcttattctgcggtatcagccaggtctttcctatgaccaacccaagtgttcccctgaaaaggacggtctagggagcagtcccagggtcacaagcaaatctgaatctcaagtgaccatgcttcagaggcagggcttcagtatgcgtaccctgttttgcccctctctgctgcctactcaacaaagtgccagtttggtgagcttcctagtaggcttcctcgcgttcttagtcctgggtctgtcagtgctgacaacatacggcgtccacgccatcacccgtttggaggcgtggtctctggctctgttggctctgttcctggtgctctttgttgctattgtcctgacaatttggcggcagcctcagaatcagcagaaagtggcattcatggtgcctttcttgcccttccttcccgcctttagcatcctagtgaatatctacctgatggtccagctgagcgcggatacctgggtccggttttccatctggatggctatcgggtttctgatttacttctcctatgggatccgtcactcgctggaaggacatctgcgcgatgaaaataatgaagaggacgcgtacccagacaatgtgcacgcagccgctgaggagaaatccgcaatccaggctaatgatcaccatccaagaaacctgtcaagcccctttatctttcacgagaagacatcagagttttag

SEQ ID NO: 206423 - DNA, 2094 bp, Artificial Sequence
  Description of Artificial Sequence: Synthetic coding sequence
atgaagatcgagaccagcggctacaacagcgacaagctgatctgcaggggattcatcggcaccccagcgccacccgtgtgtgacagcaaattcttgctgtcccctagctccgacgtgagaatgattccttgtagggctgccctgacattcgcccggtgtctgatccgtaggaaaattgttactctcgactcgttagaggacaccaaactgtgtaggtgtctttccacaatggatctgattgccctgggggtcgggtccaccctcggtgcgggggtctacgtattggccggtgaagtcgccaaggctgactcagggccaagcatcgtcgtctcttttcttattgccgcacttgcttcggtgatggctggcctttgttatgcagagttcggagctcgcgtcccgaagactggatctgcttacctatacacctatgtgacagtgggtgagttgtgggcattcataaccggttggaatctgattctcagttatgtaattggcaccagttctgtcgcccgagcatggtctgggacattcgacgaactgctaagcaaacagatcggccagtttttgagaacgtatttccgtatgaattacactggccttgcagaatatcccgactttttcgccgtctgtttgatactcctgttggcagggctcctctctttcggggttaaagagtcagcttgggtgaataaggttttcaccgcagtgaacattctggtgctcttgttcgtcatggtagccgggttcgtgaagggaaacgtagccaactggaagatcagcgaggaatttctgaaaaatatctccgcgtctgcacgtgaaccaccatccgaaaatgggactagcatctatggtgctggcggctttatgccctacgggtttaccgggacgctggctggcgccgccacctgcttctatgcatttgtaggatttgattgcatagcaaccacaggggaggaagtgagaaaccctcagaaggccatccctatagggattgtaacatcactgcttgtgtgctttatggcttactttggagtgtctgctgccctgaccctgatgatgccatactatctgcttgacgagaaaagccctctgccagtggcatttgaatatgtggggtgggggcctgctaaatacgttgtagcagctggaagtttgtgcgctctgtccaccagtctgctaggaagcatgtttccactcccaagaattctatttgctatggctagagacggactactgttccgctttctggctcgcgtgtctaagcgacagtccccggtcgccgctactctcacagctggagtaatcagcgcactgatggcattcctatttgacctgaaggccctggtcgacatgatgtctattggaacccttatggcctatagcctggtggccgcctgcgtgctgatcctaagataccagcctggcctctcctatgaccaaccgaaatgttcaccagagaaggacggccttgggtccagtcccagagttacatcaaagagcgagtcccaggtgacaatgctgcagcgacagggcttttcaatgagaaccctattctgtcctagccttctgcctacgcagcaatctgcttctcttgtttcttttcttgtcggctttctggcttttctcgtcctggggttatccgtgctcacaacctacggagtgcatgcaatcactcgtctggaggcttggtctctggccctcttagctctattcctcgtgctgttcgttgctattgtgttaaccatttggcggcaacctcaaaaccagcagaaagtggcatttatggtccctttcctcccgttcctgcccgctttctcaatccttgtcaatatttatcttatggtccagctctctgcggatacttgggtgagattttccatttggatggccattgggttcctgatctatttttcttacggtatcaggcactcgttagagggccacttgagggacgaaaataatgaggaagacgcgtaccctgacaatgtgcatgctgctgcagaggagaaaagcgctattcaggcaaacgaccaccatccacgcaatttgtcttccccatttatatttcacgagaagacctctgaattctag

SEQ ID NO: 206424 - DNA, 2094 bp, Artificial Sequence
  Description of Artificial Sequence: Synthetic coding sequence
atgaagatcgagaccagcggctacaacagcgacaagctgatctgccgagggtttatcggaacacccgccccccctgtgtgtgatagtaaattccttttgagcccgagtagcgatgttagaatgatcccttgtagagcggctttgactttcgcccggtgcctgattagaagaaaaatagttactctagattcattggaagacaccaagctctgcaggtgtctctctaccatggatctcatcgccctgggcgtggggtccactttgggcgcgggagtctatgtgttggccggtgaggtggcaaaagccgatagtggcccctccatagtggtttcgtttctgatcgctgcgctggcttcggtgatggcaggattatgctacgctgagtttggagctcgagtgcccaagaccggcagcgcctatctgtatacctatgtcaccgtgggggaattgtgggcttttatcaccgggtggaacctgatcctgagctacgtgattggtacctcatccgttgcacgagcctggtctggaacctttgatgagttactgtccaagcaaataggccagtttctccgaacctacttcagaatgaattataccgggctggctgaataccccgacttttttgcggtgtgcctgatacttctcctcgccgggctgttgagcttcggcgttaaagagagcgcatgggtgaataaagtcttcaccgcggtcaacatcctggtgttgctcttcgtgatggtggccggttttgtaaagggcaacgtggccaattggaaaatctccgaggagttcctgaagaacatcagtgcatctgcacgcgagccgccaagcgaaaatggcacatcgatatacggggcgggaggtttcatgccctacggcttcacggggaccttagctggagccgccacatgcttctacgcttttgttggctttgattgtatagccacgactggggaagaggtgcgcaacccacagaaggccatcccgattggtattgtgaccagtctgctcgtatgcttcatggcctattttggcgtctcagctgctctcacactcatgatgccctactacctgctggacgagaagtctccgctgcccgttgcatttgagtacgtcggctgggggcccgctaaatatgttgttgcagcaggttcactttgcgcattatctacttctttgctgggctccatgtttcctctgcctcgcatcctgttcgctatggcccgggatggccttctcttccgattcttggcccgagtgagtaagagacagtctcctgtcgctgccactctgaccgcgggagttattagcgctttgatggccttcttgtttgacttaaaggccctggtggacatgatgtccattggtaccctcatggcgtattctctcgtcgccgcctgtgttctgatcctacgataccagcccggactcagctacgatcagcccaaatgcagcccagagaaagatggcctaggtagcagcccacgcgttacatctaagtccgagtcccaggtaacgatgcttcagagacagggattcagcatgcggacactgttctgccccagcctgctgcctacacagcagtccgccagtctggtgtctttcctggtaggctttctcgcatttctagtactggggctttccgtcctgactacctacggggtgcatgctattactcggctggaggcctggtctcttgcgctgctagccctctttctggtgctcttcgtggctatcgtgctgacaatttggcgccaacctcagaaccagcaaaaggtagcattcatggtccctttcctgccctttttacctgcattctcaatattggtcaatatctacctaatggttcagctatccgccgacacctgggtgaggttctcaatttggatggcgatcggatttctaatatactttagctatggcatcagacattcactggagggtcaccttcgcgacgagaacaacgaagaggatgcttatccagataacgtgcacgcagccgcggaagagaaatccgccatacaggccaatgaccatcatcccaggaatctcagttccccgtttattttccacgagaaaacatctgagttctag

SEQ ID NO: 206425 - DNA, 1977 bp, Artificial Sequence
  Description of Artificial Sequence: Synthetic coding sequence
atgatcccctgccgggccgccctgaccttcgcccggtgcctgatccggcgtaaaatcgtcacgctcgattccttggaagacaccaaattgtgccggtgccttagtaccatggacctgattgcactgggtgtggggtctacccttggcgcaggggtctacgttttagctggcgaggtggcgaaggccgactccgggcctagtatcgttgtctcattcttaatcgctgccctcgccagtgtgatggccggactgtgctacgccgagttcggtgcccgtgtaccaaaaactggatctgcctacctgtacacatacgttactgtgggtgaactgtgggcctttataaccggatggaacctcatcctcagttatgtgattggcaccagcagcgtcgcccgagcctggagtggaacttttgatgagctcctaagtaaacagatcggacagttcctgcggacatactttagaatgaattacactggcctggctgagtatcctgatttctttgcggtctgtctcatcctcttgctcgctgggctcctgtcatttggagtcaaagaatcagcttgggttaacaaggtgttcaccgccgttaatatcctggtgttgcttttcgtgatggtggcaggctttgtgaagggcaacgtggccaattggaagatatcagaggaatttctgaaaaatataagcgcctcagccagggaacctccctctgagaacggcactagcatttatggcgccgggggcttcatgccgtacggtttcactgggaccttggcgggtgccgctacttgcttttacgcctttgtcggcttcgactgcattgctacaaccggggaggaagtaaggaacccacagaaagctatcccaatcggcatcgttaccagcctgctagtttgctttatggcctattttggcgtatcggccgccctcaccctaatgatgccctattatctcctggacgagaaaagtccccttcctgtggccttcgagtatgtcggctgggggcccgcaaagtatgttgtcgcagctggtagtctgtgtgctctcagcactagcttacttgggagtatcttcccgatgcctagagtgatctatgccatggccgaggatggtttactgttcaaatgcctggcccagattaactctaaaaccaagactcctataatagccaccctttcctctggggcggtagctgccctcatggcttttctgttcgatctgaaggcgctcgtcgacatgatgtctatcgggactcttatggcctattcccttgtggccgcctgtgttctgattctgcgttatcagccaggactcagttacgatcagcccaaatgttcaccagagaaggacggcctcggaagttctcccagggttacctccaagagcgagagccaggttactatgctccagcgccagggcttctcaatgagaacactgttttgtccttccttgctccctacccagcaatcagcgtcattagtttcctttctcgtgggctttctggctttcttagttttggggttatccgtattgacaacatatggcgtgcacgccattacccgactcgaggcctggtcccttgctctgctggccctgttcctggtgctgtttgtcgctatcgttttgacaatatggagacagccccagaatcaacaaaaggtagctttcatggttccatttctaccctttctgccggcctttagtatcctagtaaatatctacctgatggttcagctttccgcagacacgtgggtacggttttctatctggatggccattggatttctcatttacttttcctacggcattaggcattccctggagggccacctgcgggacgaaaataacgaggaagatgcttacccggataacgttcatgccgcggccgaggagaaatcagctatccaggctaacgatcaccaccctagaaacctgagtagccccttcatctttcacgaaaagacctccgagttctag

SEQ ID NO: 206426 - DNA, 1977 bp, Artificial Sequence
  Description of Artificial Sequence: Synthetic coding sequence
atgatcccctgccgggccgccctgaccttcgcccggtgcctgatcagaaggaaaatagtgaccttggatagtctcgaggacaccaagctgtgtcggtgtctcagtacgatggacctgatcgccctgggcgttggttcgaccttgggcgcaggcgtgtatgtactggctggagaggtggcaaaagccgacagcggccctagcattgtggtgtccttcttgatcgcagctctggcctccgtgatggcgggactgtgttatgccgaatttggagcccgggtgcccaagaccggttcagcatacttgtacacctatgtgaccgtgggcgaactttgggcatttattacagggtggaacttgattctctcatatgtcatcggcacatcaagcgtcgctcgcgcatggagcggtactttcgacgagctgctctccaagcagattggccagtttttgaggacctattttagaatgaattacacggggctggcagaataccccgactttttcgctgtgtgcctgatcctgctgctcgctgggctgctcagcttcggtgtcaaagaatccgcttgggtcaataaggtgttcacagccgttaatattcttgttcttctcttcgttatggtggctgggtttgtcaaaggcaatgtggctaactggaaaatctcggaggaattcctgaaaaacattagcgctagcgcccgtgagccgccctctgagaacggcacgagcatctatggagcaggcgggttcatgccttacggcttcacaggcaccctggccggagcagccacatgcttctacgcattcgtgggatttgactgtatcgcaaccactggcgaggaagttagaaatccgcagaaggccatcccaattgggattgtgacgagtttgctcgtgtgtttcatggcttactttggagtgtccgcagctttaactctaatgatgccatactacctacttgatgaaaagtccccactccccgtcgctttcgaatacgtggggtgggggcccgcaaagtacgtggtggcggcgggcagcttgtgcgccctcagcaccagtcttcttgggtccatcttccctatgccgagggtgatatacgcgatggcagaggacggtctcctgttcaagtgtttggcccagatcaactctaaaactaaaacccccattattgctaccttatcatctggcgctgtagcagcactaatggcttttctgttcgatctgaaggcccttgttgacatgatgagtatcggcacactgatggcgtatagtcttgttgccgcttgcgtgctgattctgcgatatcagcctggcctgagttatgatcaacccaaatgttctccggagaaagatggcctgggtagctctcccagggtaacctccaaaagcgaaagccaagttacaatgctgcaacgccagggattttccatgcggaccttgttctgcccctctctgctccctacacagcagagcgcttccctggtctcatttttggtcggctttttagcttttttggttcttggattgtctgtgttaaccacttacggtgtacacgccatcacaagactggaagcttggagccttgctctgctcgctctgttccttgtactgtttgtggccattgtccttactatttggcgccagcctcagaaccagcaaaaggttgcttttatggtaccattcctcccctttctgccggccttctcgatactcgttaatatatatttgatggtgcagctttccgcagatacttgggttaggttttcgatttggatggccataggcttcttaatctatttctcttacggcatacgtcatagtctggagggccatctgagagatgagaacaacgaggaggatgcctacccagacaatgtgcacgccgccgcagaggagaaatcagctatccaggccaatgaccaccatccacgcaacctcagcagtccatttatcttccacgaaaaaaccagtgagttctag

SEQ ID NO: 206427 - DNA, 1464 bp, Artificial Sequence
  Description of Artificial Sequence: Synthetic coding sequence
atgggcgacaccggcctgcggaagcggcgggaggacgagaagagcatacagtcacaagagcctaaaaccactagcctccagaaagagctgggccttattagcggcatttcaatcatcgtcggaaccattattggatctggcatatttgtgtccccgaaaagtgttctcagcaatactgaggcggtgggaccatgcctcatcatttgggccgcttgtggtgtcctcgcaacactgggcgccctgtgcttcgccgagcttggcacaatgattaccaagagcggaggcgaatatccctacctcatggaggcttatggccctattcccgcctacctgttctcctgggcctccctgattgttatcaagcctacaagtttcgctattatatgcctgagtttctctgagtacgtgtgtgcccctttctatgttggatgcaagccaccgcagatcgtggtcaagtgcttagccgccgctgcaatcctgttcatctcaacggtaaactccctttctgtaagactgggttcttatgtacaaaacatcttcaccgcagcaaaactagtaatcgttgctatcattattatatctggcctcgtgctgctggctcagggaaacacaaagaacttcgataatagctttgagggcgctcagttgtccgtgggcgccatatctctcgctttttataacggattgtgggcatacgatggatggaaccagctgaactacattaccgaggagctgcgcaatccatatcgtaacctcccactcgccataataataggaatccctttggtgactgcttgctacattctcatgaacgtcagctacttcaccgtgatgacagccactgaacttcttcagagccaagccgtggctgtgaccttcggggatcgcgtgctctacccagcttcatggattgttcctctgtttgttgcattctctacaataggcgctgctaatggaacatgtttcaccgccgggagacttatttatgtagcaggacgtgagggtcatatgctgaaagttctctcatacatcagtgttcggaggctgactccagcgccagcgattatcttttacggaattattgccactatctatattatcccaggagacatcaattcacttgtgaattactttagttttgccgcttggctcttctatggcctgaccatactggggctaattgtcatgcgcttcactagaaaagagttggagcgcccaattaaggtcccagtggtgatccccgtccttatgactctaattagcgtgttcctggtccttgccccaatcatctcaaagccaacctgggaatacttgtactgtgtgttattcattctctcaggtctactgttttattttctgttcgtgcattacaagtttgggtgggcccagaaaatctccaagcctatcaccatgcacctccagatgctcatggaggtggttccccccgaggaggatccagaatag

SEQ ID NO: 206428 - DNA, 1464 bp, Artificial Sequence
  Description of Artificial Sequence: Synthetic coding sequence
atgggcgacaccggcctgcggaagcggcgggaggacgagaagagcattcaatctcaggaacccaaaacaaccagcctgcagaaagagttaggcctgatcagcggaatcagcatcatagtgggcaccattattggcagtgggatatttgtcagcccaaagtctgtcctctctaacacagaagccgttggcccatgtctgattatctgggctgcctgtggggttctggctaccctcggcgctctgtgcttcgccgaactggggacaatgatcactaaatccggtggcgagtatccgtatttgatggaagcttacgggccgatcccagcttacctcttttcctgggcttccctcatcgtgattaagccaacctccttcgctattatctgtctctcgttcagtgagtatgtgtgcgctcccttttacgtgggctgtaagcctccgcaaatcgtcgtgaaatgtttggcagcagccgccatcctgtttatctccaccgtaaattccctcagcgtgcggctgggatcatacgtgcagaatattttcaccgcagccaagctagtaattgtggccataataatcatctctgggctagtcttactcgcgcaagggaataccaagaattttgacaatagttttgagggggctcagttgtccgtgggcgccatcagcctggccttctacaatggcctttgggcctacgacgggtggaaccagcttaattatatcaccgaagagttgaggaatccgtacagaaatctgccactggctataatcattgggatccccctggtgactgcctgctacatcctcatgaatgtctcctattttacggtcatgaccgcaacagaattgctccagagtcaggccgtggcggtgacctttggtgacagggttctgtacccggcttcctggattgtgccacttttcgtcgccttctctactataggcgccgctaatggcacctgctttacggctggtaggcttatttacgtcgcaggacgggaagggcacatgttgaaagtgctgtcatatattagcgtgcggcggctaaccccagcccctgccattatcttctatgggatcattgctacaatttacataattccaggcgatattaacagtctggtcaattacttctcattcgccgcctggctgttctatggcctcactattttgggcctgatagtgatgcggtttactcgcaaggaactggagagacctatcaaggtgccggtggtgatcccagtgctgatgacactgatttctgtatttctggtgctcgcacccataattagtaaacctacctgggaatacctgtattgtgttctgtttatcctgagtggactactgttttacttcctgttcgtccattataaatttgggtgggcacagaagatatctaagcctatcacaatgcacctacaaatgctgatggaggtggtgccaccggaagaagacccggagtag

SEQ ID NO: 206429 - DNA, 1908 bp, Artificial Sequence
  Description of Artificial Sequence: Synthetic coding sequence
atggcccggggcctgcccaccatcgccagcctggcccggctgtgccagaagctcaacagattgaagcctctcgaagattccacaatggagacctccctgcgaagatgcctctctacgttggatctgaccctgctgggcgttgggggcatggtgggatcggggctttacgtcctgaccggtgcagttgcaaaagaggtggcagggccggccgtcctgttgtccttcggggtggcagccgtggcctctcttctggctgccctttgctatgcagaattcggggcgcgagtacccagaactggatccgcatacctgttcacttatgtgtcaatgggcgagctttgggccttcttgattggctggaacgtgttactcgagtacatcattggaggcgccgccgtggccagagcgtggtctgggtacttggattctatgttcagtcactccattaggaactttacggaaacgcacgtgggctcatggcaagtccccctgcttgggcactaccctgacttcctggcggctggaataattctgctcgcgtctgcgtttgtgagctgcggagctcgcgtctcaagctggctgaatcatactttcagcgcaattagccttctggtgatcctgttcattgtgatcttgggcttcatcctggctcagccacacaactggtccgctgacgagggcggtttcgcgccttttggcttcagcggggtcatggctggcaccgccagctgtttctacgcttttgtgggctttgatgtgatagcggcctctagtgaggaggctcagaaccctcgaaggagcgtgcccttggcaattgctatttccctcgcaatcgcagctggcgcctacatactggtatctacggtcctgactctgatggtcccctggcacagtctggaccctgactccgcgctcgccgacgccttctatcagcggggctatcgttgggccggattcatcgtagccgccgggagcatctgcgccatgaacaccgtgttattgtccctgttattttcccttcctcgaatcgtgtacgctatggccgcagatggtttgttctttcaagtgtttgcacatgtgcaccccagaacacaggtgcctgtcgctggaactctagctttcggcctgctcacagcattcttggcacttctgctggatctggaatcccttgttcaatttctctctctcggcacgcttctcgcctacacctttgttgccaccagcataattgtgcttcggttccagaagagcagccctccatcctcccccgggccggcgtcaccaggacctcttacaaagcagcagagctcattctccgatcacttgcagctggtaggaacggtgcacgcgagtgtgcctgagccaggggagctgaagccagcactgagaccctacttaggcttcttagatggatattcaccaggtgcagtggtcacatgggccctgggggtcatgctcgctagcgctatcactatcggatgcgtgctggtgttcggtaattcgacactgcacctgcctcactgggggtatatactactgctcctgcttacctcggtgatgttccttttgagtttattagtgctgggcgcccatcaacagcagtatcgggaggacctgtttcagatcccgatggtcccattgatccccgccctttctattgttttgaacatctgtttaatgttgaagctgagctaccttacctgggtccgtttctctatctggcttttgatgggactggccgtctacttcggatacggcattcggcacagtaaagaaaaccagagagaactccccggcttgaacagcacacattacgtggttttcccaagaggcagcctggaagaaaccgtccaggccatgcagccaccctcacaggcacctgctcaggatcccgggcacatggagtag

SEQ ID NO: 206430 - DNA, 1908 bp, Artificial Sequence
  Description of Artificial Sequence: Synthetic coding sequence
atggcccggggcctgcccaccatcgccagcctggcccggctgtgccaaaagctgaaccgcctgaagcccttggaggatagtaccatggagactagcctccgacgctgcctgagcacgctagacctcaccttgttgggcgtgggtgggatggtgggtagcggactctatgtactgacgggtgcggtcgccaaggaggtggctggcccagccgttcttctgtcttttggggtagccgccgtagcctccctgttggctgcgctgtgctacgcagagtttggggctagagtcccgcgaactgggtccgcctacctattcacctatgttagcatgggggaattgtgggcattccttatcgggtggaacgtgttgctagaatatatcatcggaggcgcggccgttgcccgggcttggagtggctatcttgatagcatgttcagccattcaatccggaattttaccgagacacacgtgggttcgtggcaggtgcccctgctggggcactatcccgatttcctggccgctggaatcatcctgctggcctccgcttttgtgtcatgcggggcccgtgtgtccagttggctgaaccacacttttagtgcaatctcacttctggtgatccttttcatcgtgatccttgggtttatactggcacagccccacaactggagtgccgatgaagggggcttcgcgcccttcggtttctccggagtaatggcaggcacagcctcttgcttttacgccttcgtgggattcgacgtcattgcagccagcagtgaggaagcacaaaatccacgacgctcagtccccttggccatcgccatcagtctcgccattgccgctggtgcatacatcttggtgtctactgtgttgacactaatggttccttggcacagcttagatcctgatagtgcactggccgacgccttctaccagcgcggctacaggtgggcgggattcatcgttgcagccggaagcatctgcgccatgaacacagttctgctcagcttgctcttcagtctcccaagaatcgtttatgccatggcagccgatggcttgttcttccaagtctttgcacacgtgcaccctagaacccaggtgccagtagcagggaccttggccttcggcttgctaacagcttttctcgccctactactggatctggagagcctggtccagttcctgagtttgggtacccttttagcatatacatttgtggcaacatcaatcatagtgttgcggttccagaaatccagccccccgagtagcccagggccagcaagcccaggcccacttaccaagcagcaaagcagcttctcagaccacttgcagctggtggggacggttcacgcaagtgtgcccgaacccggcgaactcaagcctgccttgaggccttacctcgggtttttggacggttatagccccggggctgtggtgacgtgggcactgggcgtgatgctggcttctgccattacaatagggtgtgtcctcgtcttcggcaactccactctccacttgccgcactggggttacatcctcctgttactgctcacctcagtgatgtttcttttgtcactgcttgtgttgggggcccaccagcagcagtacagggaagatctcttccagattccgatggtaccgctcatacccgccttaagcatcgtcctcaacatctgcctgatgctcaaactgagttatctgacatgggttcggttttccatttggcttctcatgggactagcggtatacttcgggtacggaatacggcatagtaaagaaaatcagcgtgagctgcccggcctcaattctacccactacgttgtgtttccaagaggttctctagaggagacagttcaggcaatgcagcccccctcccaagcacctgcacaggatcccggccatatggagtag

SEQ ID NO: 206431 - DNA, 249 bp, Artificial Sequence
  Description of Artificial Sequence: Synthetic coding sequence
atggcccggggcctgcccaccatcgccagcctggcccggctgtgccaaaaacttaatcgtctaaagccactggaagacagcacaatggagacatcccttcgaaggtgtcttagcactctggacctgacccttctgggcgtgggcggaatggtaggctctggcctttatgtgttgaccggggcggttgccaaggaagtggctggtcctgccgtcctgctatctttcggtgtggccgccgttgcctcttag

SEQ ID NO: 206432 - DNA, 2922 bp, Artificial Sequence
  Description of Artificial Sequence: Synthetic coding sequence
atgtacaacatgcggcggctgagcctgagccccaccttcagcatgggcttccacctgcttgtaactgttagcctcctgttcagccatgtggaccacgtgatcgccgagaccgagatggaaggcgagggcaatgaaacaggggaatgcaccgggtcttattactgtaagaaaggagtgattctccccatctgggaacctcaagacccatccttcggtgataaaatagcaagagccaccgtttatttcgtggcgatggtgtacatgtttctgggagtgtccattatcgctgatcgcttcatgtcttcgatcgaggtcataaccagccaagaaaaagagataaccattaaaaagcccaacggcgagaccactaagactaccgtcaggatctggaacgaaacagtgtctaatctcaccctgatggctctaggatcgagcgcccccgaaattttgctctccgtcatagaggtgtgcggccataactttaccgcaggggacctcggcccttccacaatcgtaggcagtgccgcgtttaatatgttcatcatcatcgccctgtgtgtgtatgttgtcccagatggtgaaacccggaagatcaagcacctccgcgtcttttttgtcactgccgcttggagtatctttgcttacacctggttgtacattattctgtccgttatttctcctggggtggtagaagtttgggagggactgttgacttttttcttttttccaatatgcgtggtcttcgcatgggttgccgacagacggctcttgttctataaatacgtctacaaacgataccgggcgggcaagcagagggggatgatcatcgagcacgagggtgaccggccaagttccaagactgagatagaaatggacggcaaggtggttaattctcacgtcgagaatttcttggatggcgcacttgtgcttgaagtcgatgaacgcgatcaagatgatgaagaagctagacgtgagatggccagaattctgaaggagctgaaacagaagcatccagataaggaaattgaacagctcatagaactcgccaattatcaagtcctcagccagcaacagaagtcgcgggcattttaccgcattcaggctacaaggttgatgacgggggcgggaaacatactcaaacgccacgcagcggaccaggctcgaaaagctgtgagcatgcacgaggtgaataccgaggtgaccgaaaatgatcctgtctctaaaattttttttgagcagggcacctaccaatgtctcgagaactgtggaacagtggccctcacaatcattcgccggggtggcgatctgactaacactgtgttcgtggatttcagaacagaggacggaaccgctaacgccggttctgactacgagttcaccgaaggaactgttgttttcaaacccggcgacacacagaaagagattagggtgggcatcattgacgatgatattttcgaagaagacgaaaacttcctggtccacctgtcaaatgtaaaggtgagctcggaggcttcggaagatgggatcctggaagccaatcacgttagcaccttggcctgtcttggctccccctcaacagctactgtcactatctttgatgatgatcacgcagggatttttaccttcgaggaacccgtgacacatgtctcagagtccatcgggatcatggaagtcaaggtgctgaggacttcaggcgcaagaggcaacgtcatcgtgccctataagaccatcgaaggcacagctcggggaggcggcgaggacttcgaggacacctgcggtgaattagagtttcagaacgacgagatcgtgaaaaccatatctgtaaaagtcattgacgacgaagaatatgaaaaaaacaaaacctttttcctggagatcggcgagccaaggttagtggaaatgagcgaaaaaaaagctctcttgcttaacgagctggggggattcactatcactggtaagtacctcttcggccagccagtcttccggaaagtgcacgcccgggagcacccaatactctcgaccgtaattaccatcgcagacgaatacgatgacaagcagcccctgacttcgaaagaggaggaggaaaggagaattgccgagatgggtcggccaattttaggcgagcacaccaagctggaggtgatcatagaagagtcctacgagttcaagtcgactgtggataagcttataaagaagacaaacctcgccctggtcgtgggaaccaattcgtggagggagcagtttattgaggctatcactgtaagcgccggcgaagacgacgatgacgatgaatgtggtgaggaaaagttgccctcgtgtttcgactacgtgatgcatttcctgaccgtcttctggaaggtgctcttcgcctttgttccccccactgagtactggaacggctgggcttgttttatcgtttccattctaatgatcggcctccttacagcctttattggggacctggcttcccacttcggatgtacaatcggtctgaaggattctgtgacagctgtggtatttgttgccctcgggacgtccgtcccagacaccttcgccagcaaagttgccgctactcaagaccagtacgcagatgccagcatcggcaacgtgactggctctaatgccgtgaacgtgttcttagggatcggcgttgcatggtctattgcggcgatatatcatgctgctaacggggaacagtttaaggtttcccccggtactctggccttctcagtgaccctattcacgatttttgcattcattaacgtgggtgtcttgctgtatcgtcggcgcccagaaattggaggagaactcggcggcccacggacagccaaacttctgactagttgcctttttgtacttctttggctcctctatatcttcttcagctccctggaagcgtactgtcacatcaagggcttttag

SEQ ID NO: 206433 - DNA, 2922 bp, Artificial Sequence
  Description of Artificial Sequence: Synthetic coding sequence
atgtacaacatgcggcggctgagcctgagccccaccttcagcatgggcttccacctactggtgaccgtctccctgctgttttcacacgtagatcatgtgatcgctgagacggagatggagggtgagggcaacgaaaccggggagtgcactggatcgtactactgtaagaagggggtgatcctgcctatatgggagccacaggacccttcctttggggataagatcgcccgagctaccgtgtactttgtggcaatggtttatatgtttctgggggtgtcaattatagcagacaggttcatgtcctccatcgaggttataacatcccaagagaaagagattacaattaaaaagccaaacggcgagaccacgaaaacgactgtgcgcatttggaacgaaaccgttagtaacctaaccctgatggccctgggctcctctgcgcccgagatcctattatctgtgatagaagtgtgcggacataatttcacagccggtgacctgggcccatcaaccatcgtgggaagcgcggccttcaatatgttcataattatcgcactatgtgtttacgttgtgccagacggagaaacccgtaagattaagcacttaagagtcttttttgtgaccgccgcatggtccatcttcgcctatacgtggctctatatcatcctgagcgtgatctctcccggcgtggtcgaggtgtgggaagggctcctgacattttttttctttccaatctgcgtggtgtttgcctgggtagccgatcggagactgcttttttacaaatacgtgtacaagcgctaccgagcaggcaagcagagggggatgattatcgagcacgagggggacagaccgtcaagtaaaacagaaattgaaatggacgggaaagtggtgaactctcacgtcgaaaattttctggatggggcgctcgtgctggaagtcgacgaaagagaccaagatgatgaagaagcaaggagggagatggcccgaattctgaaggagctgaagcagaagcatccagataaagagatcgaacagctcattgaacttgcaaactatcaggtcctgtctcagcagcagaaaagccgtgcattctacaggatccaggccacgcgcttaatgacgggcgctggaaacatccttaagaggcatgctgctgaccaggctaggaaagccgtgtctatgcacgaggtgaacacagaggtgacagagaacgaccccgtctctaaaatattcttcgaacaaggtacatatcaatgcctggagaactgcggcactgttgcacttaccatcatacggcgcggtggcgatttgactaatacagtgtttgtggactttcggaccgaggatggcaccgccaatgccggctcagattacgagttcacagaagggactgtggtcttcaagcctggtgatacccagaaggagatcagagtgggaattattgacgacgacattttcgaagaagacgagaacttcctggtccacctgtcaaatgttaaggtatccagcgaggcatctgaggatggcatcttagaggccaatcacgtgtctacactcgcctgcctgggctctccaagtactgccactgtgacaatcttcgatgatgatcatgctgggatattcacctttgaagagcctgtgactcatgtgtctgagtctattggcattatggaagtcaaagtcctgagaactagtggagctagagggaatgtcatcgttccttacaagactatagaaggtaccgctcgaggaggtggcgaggactttgaggatacctgtggagagctggagtttcagaatgatgagattgtgaagactatcagtgtgaaagtaatcgatgacgaagagtatgagaagaataaaaccttcttcttagaaatcggagaaccgcgcttggttgaaatgtccgaaaaaaaggccctgcttctgaatgaactgggagggttcaccatcaccggcaagtatttgtttggtcaaccagtattcagaaaggtacacgcccgcgagcacccaattttgagtacagttatcaccatcgctgatgaatatgatgacaaacagccgcttaccagtaaagaggaggaggaacggcgcatcgccgaaatgggccggccaatactgggagagcacacaaaactggaggtcatcattgaggaatcctacgagttcaagtccactgttgacaagctgattaagaaaacaaatcttgctctggtggtgggcactaattcttggagagaacaattcatcgaagctattaccgttagcgctggggaagacgacgatgatgacgaatgcggagaagaaaaacttccatcgtgctttgactatgttatgcactttttgactgtgttctggaaggtgctgttcgcgtttgtgccacctaccgaatactggaatgggtgggcttgttttatcgtgagcatattaatgatcggactgctgaccgccttcataggggatctggcttctcactttggatgcacgatcgggctgaaggacagtgttacagccgtggtgtttgtagcactcgggacttccgtccccgacactttcgcaagtaaggtggccgccacccaggatcaatatgcagatgcttcaatcgggaatgtcacaggctctaacgcagtgaacgtattcttgggtatcggggttgcatggagtattgccgccatttatcacgccgcaaacggcgagcagtttaaggtgtctcccggtacactagcatttagcgttacacttttcaccatcttcgccttcatcaacgtaggagtgttgttatatagacgccgacccgaaattggcggcgagctgggcgggccccggactgctaagcttttgacctcctgtctatttgtcctgctctggctgctttatatctttttcagtagtctggaagcctattgccacattaagggcttttag

SEQ ID NO: 206434 - DNA, 2814 bp, Artificial Sequence
  Description of Artificial Sequence: Synthetic coding sequence
atgtacaacatgcggcggctgagcctgagccccaccttcagcatgggcttccatctgctggttaccgtcagcctcctgttttcccacgttgaccacgtcatagcagagacagagatggagggtgaagggaacgagaccggagagtgcaccggctcttactactgcaaaaagggtgtcatcttgccgatctgggaaccacaagatccatccttcggcgacaaaatcgccagagccaccgtctacttcgtggccatggtctacatgtttttaggtgtaagcattatagcagataggttcatgtcctctatagaggttatcactagccaggagaaggagatcaccataaaaaaacccaacggcgaaacaacaaaaactacggtaaggatctggaacgaaacggtgagcaatttaactctgatggcactgggttccagcgcacccgagatcctgctgtccgtcatagaggtgtgtggacataattttacagcaggcgatctaggcccctcaactattgttggatctgcggctttcaacatgtttattattattgctctgtgtgtctatgttgtgccagacggagagaccagaaagatcaagcacctcagagtgttctttgttaccgctgcctggagcatattcgcctacacttggttgtacatcatcctatctgtgatctcacctggggtggtagaggtgtgggaagggctgttaacttttttcttttttcctatctgtgtcgtcttcgcctgggtagccgaccggagattgctgttctacaaatacgtgtacaaacggtatcgcgccggcaaacagagaggcatgattatcgagcacgagggcgacaggccctcatctaaaactgaaatcgaaatggacggaaaggttgtcaatagccacgtggaaaatttcttggatggcgcacttgtgttggaggtggacgagcgtgaccaagacgacgaggaggctagaagagaaatggctcgcattctgaaagagttgaagcagaaacatccagataaggagatcgagcaattgatagagctcgcaaactatcaggtgcttagccagcagcagaagtcccgggctttctaccggattcaagctaccagactgatgaccggagccggaaatatcctgaagagacatgctgcggaccaggcccgcaaggcggtgagtatgcacgaagtgaataccgaggttaccgagaatgatcctgtttcaaaaatctttttcgaacagggtacataccagtgtctagagaattgtgggaccgtcgccctaacaataatacggcgcggaggcgacctaacgaacacagtgttcgtggactttcggaccgaggatggcaccgcaaatgccgggtccgactatgagttcactgagggcacggtcgtgtttaaacctggtgacacacaaaaagagatacgtgtaggcataatagacgacgatatctttgaggaagacgagaattttttggtgcacttgagtaatgtcaaggtctcgagcgaggctagtgaggatggcatcctggaagccaaccacgtctctacattggcatgtctgggcagcccctccacggccaccgtaaccatatttgatgatgatcacgccgggattttcacattcgaggagccggtgacgcatgtaagtgagagcattgggatcatggaagttaaggtcctgcgcaccagtggagcccgtggcaatgtaatagtgccttataagacaattgaggggacagcgcgaggcgggggcgaggatttcgaggatacttgcggggaactcgagtttcagaacgatgagatcgtaaaaatcattaccattaggatattcgatagggaggagtacgaaaaagagtgtagtttctcactggtgcttgaggagcctaagtggatcaggcgcggcatgaagggtggatttactatcaccgatgaatacgatgacaaacagccgcttacctctaaggaagaggaggaaaggcgaattgccgagatgggccgaccaatcctgggcgagcacacaaaactcgaggtgatcatagaggagtcgtatgagttcaaaagcaccgtcgataagttaataaagaagacgaatctcgccctagtcgtcggcaccaattcctggagggagcagttcatagaggcgatcacagtgagcgcgggagaggacgacgacgatgatgagtgcggcgaagagaagttgccatcctgtttcgactatgtgatgcatttcctcaccgtcttctggaaagtactcttcgccttcgtaccacccaccgaatactggaacgggtgggcatgctttatagtatcgattttgatgatcgggttactcactgcttttatcggcgacttggcatctcactttggctgtaccatcgggcttaaagattccgtgaccgcagtggtgttcgtagctttggggacttctgtcccggatactttcgcgtcaaaggtggccgcaacccaggatcagtatgccgacgcgagcatcggcaacgtgaccggatcaaatgcagtgaacgtgtttctgggaataggcgtggcttggtctattgcagctatttatcatgcagccaacggagaacagttcaaggtttcccctggcactttggccttttccgtgacgctgttcactatttttgccttcattaatgtgggagtactgctgtaccggagaagacctgagattggaggagaactcggaggcccacgaacagcgaaactgctcacttcctgtctgttcgtgctgctgtggttgctatacattttcttctccagcctggaagcctattgccatatcaaaggcttctag

SEQ ID NO: 206435 - DNA, 2922 bp, Artificial Sequence
  Description of Artificial Sequence: Synthetic coding sequence
atgtacaacatgcggcggctgagcctgagccccaccttcagcatgggttttcatcttctcgtcacggtcagcttgctcttcagccacgtggatcacgtgattgcagagacggagatggagggagagggcaatgagacaggcgagtgtacaggcagctactactgcaagaagggggtcatcttgccaatctgggagccccaggacccaagtttcggggataaaattgctagagccacagtatatttcgttgccatggtgtacatgttcttaggcgtgagcatcatcgcggaccggttcatgagctccattgaggtgattactagtcaggaaaaagagatcacgatcaagaagcccaacggtgaaaccacaaagacgactgtcaggatatggaacgagaccgtgagtaacctaacactgatggctttgggatccagcgcgcccgaaatccttctgagcgtgatcgaggtgtgcggacacaattttactgcaggtgatctgggcccctccaccatcgtcggcagcgctgccttcaacatgttcattatcatcgcactgtgcgtatacgtggtgccggacggtgaaacacgcaagattaaacacttgagagtcttctttgtgactgccgcctggagcatttttgcctacacgtggctgtatattatcctgtccgttatttcccccggagtggtggaggtttgggaaggcctactcacgtttttttttttcccaatctgcgtcgtgtttgcgtgggtagcagacagaaggcttcttttctacaaatacgtttacaagagataccgagccggaaaacagcgtggaatgattatagagcacgagggcgatcggcccagtagcaaaacggagatcgaaatggatggcaaagtagttaactcccatgtggagaactttctggatggagctctggtgttggaggtggacgaaagagaccaggatgatgaggaggctcgacgggaaatggctcgtatcctgaaggaattgaaacagaagcatcccgacaaagagatagagcagctaattgaactggcaaactaccaggttctttcccaacagcagaaaagcagagcattctatcgtatccaggctactagactgatgactggcgcaggaaacattctgaagagacatgcggccgaccaagcgagaaaagcagtctccatgcatgaggtcaacacagaggtgaccgaaaacgatccagtatctaaaattttctttgaacagggcacatatcaatgtctggaaaattgcgggactgtggctctgaccattataaggagaggaggtgacctgacaaacacagtgtttgtggattttcgaacggaagatggcacggccaatgccgggtcagattacgagtttacagagggaacggtggtgttcaaaccaggtgacacccagaaagaaatcagagtgggcattatagacgatgatatcttcgaagaagatgaaaattttttagtccacctgagcaatgtgaaggtcagttcagaagcatccgaggatgggatcctcgaggctaatcatgtgtccacgctggcttgcttagggagtccatcgacggccacagtgaccattttcgatgacgatcatgccggtatatttacattcgaagagcctgtgacccacgtgagcgagagcattggcattatggaagtgaaagttctgcgtacttctggagccaggggcaatgtgatcgtcccttacaagactattgagggcacagcgagggggggcggagaagacttcgaggacacatgtggcgaactcgaatttcagaacgacgaaatcgtaaaaaccatcagcgtgaaggtaatcgatgacgaagaatatgagaagaataaaacgtttttcctggagattggagagcccaggttggttgaaatgtctgaaaagaaagccctgcttctgaacgaactcggtggctttactatcacaggaaaatacctgtttggccagccagtttttagaaaggtgcatgcgagagaacatccaattctgtcaaccgtcattacaatcgcagatgaatacgatgataaacagcccctgacgagtaaggaggaggaggagcggagaatcgctgagatggggcgccccatcttaggtgagcacacaaaattggaggtgattatcgaggagtcctatgaatttaagagcaccgtagacaagttgataaaaaagactaaccttgccctggttgtgggaacaaacagttggagggagcagtttatcgaagcaattacagtatctgctggagaagacgacgacgatgatgaatgtggggaagagaagctgcccagctgctttgactatgttatgcattttctgaccgtattttggaaggtcctcttcgccttcgttccacctactgaatattggaatggctgggcctgctttatcgtgagcatcttgatgataggcctgctaactgcgttcatcggtgatctggcatctcatttcggatgtaccattggtctcaaggatagtgtaactgccgtggtgtttgtggcccttggcacatccgttccagacacatttgcgtcaaaggttgcagctactcaggaccaatatgcagatgcaagcatcggcaacgtgaccggctcaaatgcagttaacgtattcctgggaattggcgtcgcgtggtcaatagcagcaatttaccacgcagcgaacggggaacagttcaaagtgagtcctggaaccctggccttcagcgtcaccctgtttactatatttgcatttatcaacgttggtgtgctgttgtatcgccgccgccccgagatcgggggtgaactcggggggcccagaactgcaaagcttctcacttcttgcctctttgtgcttctttggctgctttatatcttcttcagctccttagaagcctattgccacataaagggtttctag

SEQ ID NO: 206436 - DNA, 2814 bp, Artificial Sequence
  Description of Artificial Sequence: Synthetic coding sequence
atgtacaacatgcggcggctgagcctgagccccaccttcagcatgggatttcacctgctagtcaccgtcagtttgctgttttcccatgttgatcacgttatcgctgaaaccgaaatggaaggagagggaaacgaaactggtgagtgcacgggtagctattattgtaaaaagggtgtgatcctcccaatatgggaaccgcaggatccttccttcggggataaaatagcgagggccacagtttattttgtggctatggtctacatgtttctcggcgtgtccattatcgctgatagattcatgtcctcaatcgaagtgattacatcccaggagaaagagatcactatcaagaaaccaaacggcgagaccacaaaaactaccgtacggatttggaatgaaactgttagtaatttgaccctgatggccctgggcagttctgcaccagagattctgctgtccgtgatagaggtgtgcggtcacaacttcacagctggcgatctgggtcccagcacgattgttgggtcagcagctttcaacatgttcatcataattgcactgtgcgtgtatgttgtaccagacggggagacacggaagattaagcatcttagagtattcttcgtgacggccgcctggagcatattcgcgtacacctggctgtacattattctgagtgtaatcagccccggcgtggtggaggtgtgggagggtctgctgaccttttttttcttcccaatttgtgtggtatttgcatgggtggctgatcggcggctgctgttctataaatatgtgtacaagcgctatcgggctgggaagcagcgggggatgatcatcgagcatgagggtgaccgtcccagctccaagacagagatcgagatggacgggaaagtagtgaattctcacgtggaaaatttcctggacggcgccctcgtgctggaggtggatgagcgggatcaggacgatgaggaggcaagacgcgaaatggctaggatcctcaaggagctgaagcaaaaacatccggataaagagatcgaacagcttatcgagttggccaactaccaggtgcttagtcaacaacagaaatctcgtgccttttacaggatccaagccactcgcctaatgaccggtgccgggaatatactcaaaagacacgccgcggaccaggccagaaaagcagtttcaatgcacgaagtgaatactgaagtgaccgagaatgatcctgtaagtaagatattttttgagcagggaacttaccaatgtctggaaaactgcggaactgttgccctgacaatcattcgtcgaggaggcgatctaaccaatacagtctttgtagactttcggacggaagacggcacggcaaatgcaggatctgattatgagtttactgaaggcacagtggtcttcaaaccaggcgacacacagaaggagattcgtgtcggcattatcgacgacgatattttcgaggaggatgaaaattttctcgtgcacttaagtaatgtgaaggtttcttcagaggcctcagaagatggaatcctggaagccaatcatgtgagtactctggcctgtctgggaagccccagtacagccacagtgacaattttcgatgatgatcacgctgggatatttacgtttgaagagcccgtaactcatgtgagcgagtcaatcggaatcatggaggttaaagtccttaggacctcaggcgcacgcggcaacgttattgtcccatacaaaacgatcgagggaacggccaggggaggaggagaggacttcgaggacacatgtggagagctcgagttccagaacgacgagattgtgaaaatcatcaccatccggattttcgatagggaggagtatgagaaggaatgctcttttagcctggttctggaggagcctaagtggatacgccggggcatgaaaggggggttcaccattaccgacgagtacgatgataaacagccactaaccagtaaagaggaagaagaaagacgaatcgctgaaatgggacgtccaatactgggcgagcataccaagctagaagtcattatcgaggaaagctatgagttcaagagcaccgtggacaagctgataaagaaaacaaacctagccttagtagttggcacaaacagctggagggaacagttcattgaggccattacagtctccgcgggagaggacgatgatgatgacgaatgcggggaggagaaactgccctcctgttttgactacgtgatgcacttccttaccgtcttttggaaagttctgttcgccttcgtgcccccaacagaatactggaatggctgggcctgttttattgtatctattctgatgattgggttgctcacagctttcatcggtgatttagccagtcacttcggttgtaccatagggttgaaagacagtgtgaccgccgtcgtatttgttgcactgggaacctctgtgcccgacacttttgcaagcaaggtggccgctacccaagatcagtacgccgatgcctctattgggaacgtgaccggatctaacgccgtgaatgtgtttttgggcattggtgtggcatggagcattgccgcaatctaccatgccgcaaatggcgagcaatttaaggtgtccccggggacccttgccttcagtgtgactctcttcacaatcttcgcgtttattaacgtaggggtgctgttgtaccgccggaggcccgaaatcggtggcgagttagggggtcctcgaactgcaaagctgctcacatcatgcctttttgtgcttctgtggctcctgtatatattcttctcatccctcgaggcttactgtcacattaagggattctag

SEQ ID NO: 206437 - DNA, 2907 bp, Artificial Sequence
  Description of Artificial Sequence: Synthetic coding sequence
atgtacaacatgcggcggctgagcctgagccccaccttcagcatgggttttcatctcctcgtaacagtatcccttctgttctcccatgtggatcatgtcattgccgaaaccgaaatggagggggagggcaatgaaacaggtgaatgcacgggatcatattattgcaagaagggagtgattctacccatttgggagccacaggaccccagtttcggcgacaagatagcccgtgcaaccgtgtactttgtggccatggtgtatatgtttctgggcgtgtcgatcatcgccgataggttcatgagtagcatagaagtgatcacgtcccaagagaaagagatcacaatcaaaaaacccaatggtgagactactaaaaccacagtcagaatatggaacgaaactgtttcgaatctcaccttgatggcactgggaagctccgcaccagagatcttgctgtccgtgatagaagtgtgcggccataactttacagcaggcgacctgggaccctccacaattgtgggcagtgctgcgtttaacatgtttattatcatagctctgtgcgtgtacgtggttccagatggcgagactaggaaaatcaaacatctgagggtttttttcgtgaccgcagcatggtcaatctttgcctacacatggctctatatcattctgagcgtgatctctcccggggtggtggaggtgtgggagggcttgttaacattctttttctttccaatctgcgttgtttttgcatgggtcgctgataggcgactgctgttctacaagtatgtgtacaaacgttaccgcgccggcaaacaacgaggaatgattatcgagcacgaaggcgaccggccttcatctaagacggaaattgaaatggatggtaaggtggttaactcgcatgtggaaaactttcttgatggcgctcttgttttggaagtggacgaacgagatcaggacgacgaagaagcacgaagagagatggctaggatcctgaaggagttgaaacaaaaacatcctgacaaagagatcgaacagctcattgagctggccaactatcaggttctctcacaacagcagaaatctcgcgccttctaccgaatacaggctacccgccttatgaccggagccggtaacatcctcaaacgccacgccgccgatcaggcccgaaaagctgttagtatgcacgaagttaacacagaagtgacggagaacgacccagtttccaaaatcttctttgagcaaggcacataccaatgtctcgagaactgcggcacagtggctctgactatcatccgccgggggggagatctgactaacacggtgttcgtagattttcgcacagaggacggaactgccaacgccggttccgattatgagtttaccgagggcacggttgtcttcaagccaggtgatacccagaaagaaattagggtggggataatcgatgatgatattttcgaagaggacgagaacttcctggtacacctctctaacgtcaaagtgtcctcggaagccagtgaggacggaattctggaggcgaatcacgtcagcactttggcctgtcttggttcccccagcaccgcaacagtcacgatttttgacgacgaccacgcaggcattttcaccttcgaggagccagtgacccacgtatccgagtcgatcggaatcatggaggtgaaagtactgaggacctcaggggcccgcggcaacgtcatcgtaccttataagaccattgaggggactgctcgaggcggaggcgaagacttcgaggacacttgtggtgaactggaatttcagaacgacgagattgtaaaaaccatctcagtcaaagtcattgacgatgaggagtatgaaaagaacaagacattcttcctcgaaatcggagaaccacgcctggtggagatgagcgagaagaaggctttattgctgaatgaactaggggggttcacaataaccggacagcccgtgttccgaaaagttcacgcccgggaacatccaattctttccaccgttatcactatcgccgatgagtacgatgacaagcagccattgaccagcaaggaagaagaggagcgacgcattgccgagatgggaaggccaatactgggagagcatacaaagctggaggtaatcatcgaggaatcctatgagtttaaatccacagtggacaagctgatcaaaaagactaatctcgctctggtggtgggcaccaattcctggagagagcagtttatcgaggctatcactgtaagcgcgggagaagacgatgacgatgacgagtgcggggaggaaaaactcccatcctgtttcgattacgttatgcactttcttacggtgttttggaaagtgttattcgcattcgttccccccacggaatattggaacggatgggcctgctttattgtgagcatactgatgattggactgttgacagcctttattggtgaccttgcatcccacttcggctgtaccatcggcctgaaagacagtgtgaccgctgttgtgttcgtggcacttggaaccagtgtgcccgacacattcgctagcaaggtcgccgccacccaggaccagtatgctgacgcaagcatcggcaatgtcactggctctaacgccgttaacgtcttcctggggatcggagtggcctggtcaatcgccgcaatttaccatgccgctaacggcgagcagttcaaggtgtccccagggacgctcgccttttcggtcaccttattcaccatcttcgcctttatcaatgtgggtgtgcttctctatagacgccgcccggagataggcggggaactcggaggtccccgtactgctaagctgttaacctcctgcttatttgtcctgctctggctgctatacattttttttagctctctggaggcgtattgtcatattaagggcttctag

SEQ ID NO: 206438 - DNA, 2814 bp, Artificial Sequence
  Description of Artificial Sequence: Synthetic coding sequence
atgtacaacatgcggcggctgagcctgagccccaccttcagcatgggttttcacctgctagttactgtttccctgttgtttagtcacgttgaccacgtaattgccgagactgaaatggaaggtgaagggaacgaaaccggggaatgtaccggatcctattattgcaaaaaaggagtgatcctacccatctgggagccccaggaccctagcttcggagacaaaatagcccgcgccaccgtgtacttcgtcgcaatggtgtatatgttcttgggcgtttccataattgccgaccggttcatgtccagcattgaggtgatcacttcacaggagaaagagataacaatcaaaaagccaaacggggagactaccaagacaacggttcggatttggaatgaaacggtttctaacctaactctgatggccctgggctccagcgcccccgagatactcctgagtgtcatcgaggtgtgtggacacaacttcaccgctggcgacttagggccttcaaccattgtcgggagcgcagccttcaatatgttcattatcattgcattgtgcgtgtatgttgtgcccgacggtgaaaccaggaagataaagcacctccgagtcttcttcgttaccgcagcgtggtccatcttcgcttatacctggctatacatcatcctgtctgtcatctctccaggggtggtagaagtatgggagggactgctcacattctttttctttcctatctgtgttgtgttcgcttgggtggcagaccggaggctattattttacaaatatgtctataagcgctatcgtgcaggcaaacagcggggaatgatcatcgaacacgaaggagaccggccaagctccaaaacggagattgaaatggacggaaaggtagtaaactcacatgtcgaaaacttcctggatggagccctggtgttagaggtcgacgaacgggaccaagatgacgaggaggcaagaagagagatggccagaatcctgaaagagctaaaacagaagcacccagataaagagattgaacagcttattgagctcgcaaattatcaggttcttagccagcagcagaagagtagagccttctacagaatccaggcgacccgtttaatgactggcgccggcaatattctgaagagacatgccgcagaccaggctcggaaggcggtttctatgcatgaagtcaacaccgaggttaccgagaacgatccagtgagcaaaatcttcttcgagcagggtacatatcagtgtctcgaaaactgcggaacagtggccctcacgattatccggaggggaggcgacttaactaataccgttttcgtggatttccgtacagaggacggaactgcaaacgcaggctccgactacgaattcacagaagggaccgttgtttttaaacccggggatacacagaaagagatacgtgtcggcattattgatgacgatatattcgaagaggatgaaaatttcctggttcatctgtctaacgtaaaggtatctagtgaggcttctgaggacggaatcctggaagccaatcacgtgtcaacactggcttgcctaggaagtcctagcacagctaccgtgacgatatttgacgacgatcacgctggaatctttaccttcgaggaacccgtgacccacgtgtctgagtcgattggaatcatggaagtgaaagttctgcgtacctccggggcacggggcaatgtgattgtgccttataaaacaatcgagggcaccgctcgaggcggtggcgaggatttcgaggacacctgcggagagctagaatttcagaatgacgagatcgttaaaatcatcactatcagaatctttgatagagaggagtacgagaaagagtgtagtttctccttggtgctggaagagccgaagtggattcgtaggggcatgaagggaggattcactatcacagatgagtacgatgataagcaacctctgacaagcaaggaagaggaagaacgacgtattgcagagatgggccgacctatactcggtgagcataccaagctcgaggtcataattgaggaatcctatgagtttaaaagcaccgtcgataaacttattaagaagacgaacctagcccttgtcgttggaaccaactcttggcgcgaacagttcatcgaggcaattactgtgagcgccggcgaagacgacgatgacgatgagtgcggcgaagaaaagcttccatcttgctttgactatgttatgcactttctcacagtcttctggaaggttctgttcgctttcgtgcctccgacggagtactggaacgggtgggcatgtttcatcgtctcaatccttatgataggcctgctcaccgctttcataggtgacttagcctctcattttggttgcactattgggttaaaggactctgttacggctgtggtcttcgtggccctcggaacctctgtgcctgacacctttgctagtaaggtcgcagcaacacaggaccagtatgcagatgcttccatcggaaatgttactggatccaacgccgtgaacgtcttcctcggtatcggcgtggcatggagcattgccgctatctaccatgccgctaacggcgagcagttcaaagtcagcccgggcacgctggcctttagcgttacactgtttaccattttcgctttcatcaatgttggggtactgctctacagacgacgtcccgagatcggcggagagcttgggggtcccagaaccgccaaactgctgacgagctgcctgtttgtattactctggcttctgtacatcttcttctcatcactcgaggcctattgccacatcaaaggtttttag

SEQ ID NO: 206439 - DNA, 2814 bp, Artificial Sequence
  Description of Artificial Sequence: Synthetic coding sequence
atgtacaacatgcggcggctgagcctgagccccaccttcagcatgggcttccacttactggtcactgtctccctgcttttctcccacgtggaccacgtgattgcagagacagagatggaaggcgagggcaacgagactggggagtgcactggctcctattactgcaaaaaaggggtcattctgcccatctgggagccccaggatccctcgtttggagataaaatcgccagggcgacagtttattttgtcgcgatggtgtatatgtttctaggagtgtccattatagcggatagatttatgagctcaattgaagtcattacaagccaggaaaaggagataactattaagaaaccaaacggagaaaccaccaagacaaccgttcgaatctggaacgagaccgtgtcaaaccttacgctgatggcactgggctccagcgcgcctgagattttacttagtgttatcgaagtatgcggtcataatttcacggccggcgatctcggacccagtaccatagtcgggtctgccgctttcaacatgttcatcattattgctctttgtgtgtatgtcgtgccagatggggaaacgagaaagattaaacacctgcgggttttctttgtcaccgcagcttggagtattttcgcgtacacctggttatatatcatcctgtccgtaattagccccggcgtagtggaggtgtgggaaggcctgctgacgttctttttcttccctatatgcgttgtgttcgcctgggtggccgacaggcgactgctgttttacaagtacgtgtataagcgttatagagccgggaaacagcgggggatgatcatcgagcatgaaggagatagacctagcagcaagacagagatcgagatggacggaaaggtggtcaattctcatgtggagaacttcctcgatggagcactcgttctcgaagtggatgagagagaccaagacgacgaagaggctagaagagagatggccagaatcctgaaggagctgaaacagaagcatccagacaaagaaatagaacagctcatcgaactggctaactaccaagtcctgtcccagcaacaaaagtccagggcattctataggatccaggccactcgcctgatgaccggtgccgggaatatccttaagcggcacgctgctgatcaggcacgtaaagctgtgagcatgcatgaggtcaatacagaagttaccgagaacgacccagtcagcaagattttctttgagcaggggacttaccaatgtctggaaaactgcggcacagtggccctgacaattatccgtcgaggaggagatctcacaaatactgtgtttgttgactttcgaacagaggacggcacagccaatgcgggatctgattacgagttcaccgagggaactgtggtcttcaagccaggcgacacacagaaagaaataagggtcggaattatcgacgatgacatttttgaggaggacgaaaacttccttgtccacctgtctaatgtgaaagtctcgtctgaggctagcgaggatgggattctggaagctaatcacgtgagcacactggcttgcctggggtccccatctacagccaccgtgactatatttgatgatgatcacgcaggaatttttactttcgaggagccggttactcacgtgagcgagtccatcggtatcatggaagtgaaggtgttgagaacgagcggagctaggggtaacgtgatcgttccgtacaaaactatagagggcaccgctagaggcgggggagaagactttgaggatacttgtggggagctcgagttccaaaacgacgagatcgtaaaaatcattacaataaggatcttcgatcgggaagaatacgagaaggaatgttccttttctctggttttggaggagcccaagtggataagacgaggtatgaaaggtggatttaccattactgacgagtatgacgataaacagcctctaacttctaaggaagaggaagagagacgtatcgctgagatgggaaggcctattctgggagaacacaccaagttagaggtcatcatcgaggagagctacgagttcaagtcaaccgtcgacaagctgataaaaaaaacaaaccttgccttggtagtaggcactaatagctggcgcgagcagtttattgaagctattaccgtctctgcaggggaagacgatgacgatgatgagtgcggcgaagagaaattaccatcgtgttttgattacgtgatgcatttcttgactgtgttttggaaagtgttgttcgcctttgtgccgccgaccgaatattggaacggttgggcatgttttatcgtgagcattttgatgattggcctcctgaccgccttcatcggggatctcgcatctcatttcggttgtaccataggcctgaaggattccgtgacggccgttgtcttcgttgcactgggtacctccgtgcccgatacttttgcatccaaagtggccgccactcaggatcaatacgcagatgcttctattggaaacgtcactgggagcaatgcagtgaatgtctttttgggaataggagtcgcttggtctatcgcagccatttatcacgcagccaacggggagcagttcaaggtaagcccaggtactctcgccttctccgtgacgctgttcacgattttcgcgtttataaatgtaggtgttttactgtatcgaagaagaccggagattggcggcgaacttggaggcccacgcacggcaaaacttctcacctcttgtctgtttgtccttctgtggctcctttatatttttttcagttccttagaagcctactgtcacatcaaggggttttag

SEQ ID NO: 206440 - DNA, 1995 bp, Artificial Sequence
  Description of Artificial Sequence: Synthetic coding sequence
atgcggcggctgagcctgagccccaccttcagcatgggcttccacctgttggtgaccgttagccttctgttttcccatgtcgatcatgtcatcgctgagacggagatggagggggagggcaacgaaaccggggagtgcaccggatcctattattgtaaaaaaggagtgatcttgcccatatgggaacctcaggatccatccttcggagacaaaatcgcacgggcgactgtctactttgtggccatggtatatatgttccttggagtttctatcattgctgatagattcatgtcatctatcgaggtgattacctcacaggaaaaggagatcacaataaaaaagccaaatggtgagaccacaaagacaacagtgagaatctggaacgaaaccgtcagcaatctgacgctgatggcactcggttcatccgctccagaaattctactgtcagtgatcgaggtgtgcggacacaatttcacagctggagacctgggcccctcaactatcgtcggctctgcggcatttaatatgttcatcattatcgctctgtgcgtgtatgtggtcccagacggagaaacacgcaaaatcaagcatctgagggtgtttttcgtcaccgcagcctggtccatttttgcatacacctggctttatataatcctgagcgttatttctcccggggttgtcgaagtgtgggaagggttgctgacttttttcttctttccaatttgtgttgtgtttgcttgggtggccgaccgcaggctcttgttctacaagtatgtctataagcgctaccgtgctgggaaacagagaggcatgatcattgaacacgagggtgatcgcccttccagtaagaccgagattgagatggacgggaaagtggtgaatagccacgtcgagaatttcctggatggggcactcgtccttgaggtggacgaaagggatcaggatgacgaggaagccaggagagagatggcaagaattctgaaagaacttaaacagaagcatccagacaaagagatcgagcagttgatcgagctggccaattaccaggtgctttcacagcagcagaaaagtcgcgctttttatcggattcaagcaacccgactcatgacaggcgccggaaacatcctcaaacggcacgccgctgatcaggctagaaaagctgtgagcatgcacgaagttaatacagaagttactgaaaatgaccctgtgagcaaaattttctttgagcaagggacctaccaatgtctcgagaactgtggcacggtagcgttgacgatcatccggcgcggtggcgatctgactaacaccgtgttcgtcgatttccgaactgaggacggcaccgcaaacgccggatcggactacgagtttacagaggggaccgttgtcttcaagccgggcgacacacagaaggaaatacgcgttggaatcattgatgatgacatctttgaggaagacgaaaacttcctggtgcatctgtcgaatgtgaaagtctccagcgaggcctctgaggatggtatattagaagctaatcatgtgtcaacattagcctgcctcggctctccaagcacagctacggtgactatcttcgacgacgatcatgccggcatcttcacttttgaggagccagtgacacatgtctcagagtctatcggcattatggaggttaaggtgctgcggacatccggcgctagaggcaacgtgatcgttccttacaagaccattgagggcactgcccggggagggggagaggatttcgaagacacctgtggagagctggagtttcagaatgacgagatcgttaagacaatttctgtgaaggttattgatgacgaggagtacgaaaaaaacaagaccttcttcctggagatcggcgagccacggctggttgagatgtccgagaagaagggccgctctctgcccttagaatacctcaccgtgcggaacatgcggaaatcagccgtcagccctctgtgtctgaggaaccaaaacggctag

SEQ ID NO: 206441 - DNA, 2898 bp, Artificial Sequence
  Description of Artificial Sequence: Synthetic coding sequence
atgtacaacatgcggcggctgagcctgagccccaccttcagcatgggtttccacctccttgtcacggtcagcctcttatttagccacgtggaccacgttatcgccgagacagagatggagggtgaaggcaacgagactggcgaatgtaccggatcctactactgcaaaaaaggcgtaattctgcccatttgggaacctcaggacccatcattcggagacaagatcgcgcgcgcgacggtgtacttcgtggccatggtctacatgttcctgggagtctctatcatcgccgatcgatttatgagcagcatagaggtaataacctctcaggagaaggaaataaccatcaaaaagcctaatggagagaccacaaagaccactgtgagaatctggaacgagaccgtgagcaacctgactctgatggccctgggatcttccgccccagaaattctgctttcagtgatcgaggtctgtggtcacaattttaccgccggcgacctgggtccgtctactatagtcggtagcgctgcatttaatatgttcatcattatcgctctgtgtgtgtacgtagtgcccgatggcgagactaggaagatcaaacaccttagggtcttttttgtgaccgccgcctggtctatcttcgcctacacatggttgtacattattctgtctgtcatcagtccaggagtcgtggaagtttgggaggggctcctaactttcttcttcttcccaatctgtgtagttttcgcttgggtcgccgatcgcaggttgcttttctacaaatacgtgtataaaaggtaccgagctggaaagcaaaggggcatgatcattgagcatgaaggagaccggccttcctccaagacagagatcgagatggacggaaaagtggtcaactcccatgtcgagaattttctggacggcgccctggtgcttgaagtagacgagcgcgaccaggatgacgaagaagccaggcgcgaaatggcccgaattctgaaggagctgaagcaaaaacatccggacaaagagattgagcaacttatcgaattggctaattatcaggttctcagccagcagcagaaatcgagggccttttacaggattcaggccacgcgcctgatgactggggctggcaacattctgaagcgccatgccgctgaccaggcacggaaggctgtgagcatgcatgaggtgaacaccgaggtgacagagaacgaccccgtcagcaaaattttctttgagcagggtacataccagtgtctggaaaactgcggcaccgttgccctcacaatcataaggcgagggggtgaccttactaacactgtctttgttgacttccgcactgaggatgggactgccaacgcaggctctgattacgaatttaccgagggcaccgtggtgttcaaaccaggagatactcagaaggagattcgtgtcgggatcatcgacgacgacatcttcgaggaggatgagaactttctggtgcatctgtccaacgtgaaggtgagctctgaagccagtgaggatggaatcttagaagctaatcacgtctcgaccctcgcttgtctggggagcccctctacagctaccgtgactatctttgacgatgaccatgccgggatcttcacctttgaagaacccgttacacacgtgtccgaaagtattggcattatggaggtgaaagtgttacggaccagcggggcacgtggcaatgtgattgttccatacaagaccatcgagggtactgccagagggggcggtgaggactttgaggatacttgtggggagctggaattccagaacgacgagatagtgaagattatcactatcaggatttttgacagggaggagtacgagaaggagtgttctttctccctggtgcttgaagaacccaagtggattcgtcggggaatgaaggggggcttcacaatcaccgggaagtatctctttggacagccagtgttccggaaggtacacgcacgcgaacatccaattctctccacagtgattactattgcagacgagtatgatgacaaacagccactgacaagcaaagaagaggaagagcgaaggattgcggagatgggaaggcctatattaggggagcataccaagctggaagtcatcatagaagagtcatacgagttcaaaagtaccgtggataagctcataaagaagacaaatttggccctcgtggtgggcacaaacagttggcgcgaacagttcatcgaggctattaccgtgtccgccggtgaagatgatgatgacgacgaatgcggggaggagaagctaccttcgtgttttgattatgtgatgcatttcttaactgtcttttggaaggttcttttcgcgttcgttccgcctacggaatactggaacggttgggcttgttttattgtgagcatattaatgatcggtctgctcactgcctttataggagacttggccagccacttcggctgtactatcgggttgaaagattcagtgactgccgtcgttttcgtggctcttggtactagtgtacccgatacttttgcaagcaaagtagccgcgacacaggaccagtacgccgacgcgtccatcggtaatgttacaggatctaacgcagtgaacgtgttcctggggatcggggtggcctggagcatcgcagccatttatcacgctgctaacggggagcagtttaaggtgtcccctggcactttggcgttttcagtgactctttttactattttcgcatttataaatgtgggggtgttgctctacagaaggcgcccagaaattggcggcgagctgggaggaccccgaaccgccaaactgctgacctcatgcctgttcgttttactatggctgttgtatatatttttttcgtccctagaagcttattgccatatcaagggcttctag

SEQ ID NO: 206442 - DNA, 222 bp, Artificial Sequence
  Description of Artificial Sequence: Synthetic coding sequence
atgtacaacatgcggcggctgagcctgagccccaccttcagcatgggattccacctccttgtgactgtatcattacttttttcccacgtggaccacgtcattgccgaaacagaaatggagggtgagggaaacgaaacgggagagtgcacagggtcctattactgtaaaaaaggtgtgatcctgcccatttgggaaccccaggacccgtcattcggtgactag

SEQ ID NO: 206443 - DNA, 264 bp, Artificial Sequence
  Description of Artificial Sequence: Synthetic coding sequence
atgtacaacatgcggcggctgagcctgagccccaccttcagcatgggatttcacctgctcgtgacggtgagcctgttatttagtcatgtggaccacgtgatcgctgaaaccgaaatggagggcgagggaaatgagacaggggagtgtaccggaagctactactgtaaaaagggtgtcattctccctatttgggagccacaagaccccagcttcggggacaaaattgcgagagcaaccgtttatttcgtagccatggtttactag

SEQ ID NO: 206444 - DNA, 264 bp, Artificial Sequence
  Description of Artificial Sequence: Synthetic coding sequence
atgtacaacatgcggcggctgagcctgagccccaccttcagcatgggcttccacctccttgtaaccgtgtctctgctcttctcccatgtcgaccatgtgatcgcagagactgaaatggaaggtgaaggcaatgaaaccggggagtgtaccggatcttactattgtaagaagggtgtgattcttcccatatgggagcctcaggacccttcctttggcgataagattgctcgcgctaccgtgtatttcgttgccatggtttactag

SEQ ID NO: 206445 - DNA, 2883 bp, Artificial Sequence
  Description of Artificial Sequence: Synthetic coding sequence
atgtacaacatgcggcggctgagcctgagccccaccttcagcatgggcttccatctgctggtaacagtcagtctcctgttctcacacgtggaccatgtgatcgccgaaacagagatggagggagaaggcaatgaaaccggagagtgtactggatcatactattgtaagaaaggggtcattctaccaatatgggagccacaagacccatcgttcggcgacaaaattgcgcgagctacagtgtatttcgtggcgatggtctatatgttcctaggcgtttctattattgccgaccgttttatgtccagtattgaggtgataacaagccaggagaaagagattacgatcaagaagcccaacggagaaactacaaagaccaccgtgcggatctggaacgagactgtgagcaacctcaccctgatggccctggggtcatccgcccctgagatactcctgtccgtgattgaggtttgtggccacaacttcacggccggcgacctcggcccctctaccatcgtaggttccgccgctttcaacatgttcataatcattgctctatgcgtctacgtggtgccagacggcgagactcggaagataaaacacctccgcgtcttcttcgtcacagcggcctggagtatcttcgcctacacgtggctttacattatcctttcagtgatttctcccggcgttgtagaggtttgggaaggcctgctcacctttttctttttccctatctgcgtcgtttttgcatgggttgccgaccggcggttactcttctacaaatatgtctataaacgctacagagctgggaaacagaggggaatgatcattgagcacgagggcgaccgtccttcaagcaagacagaaattgaaatggatgggaaagttgtgaatagtcacgttgaaaactttctggatggggcattggtccttgaggtggacgagcgcgaccaggacgacgaagaggcaaggcgcgagatggcccgcattctcaaagagcttaagcaaaagcatccagataaggaaatcgagcagctgattgaattggctaattatcaggtgctgagccagcagcagaaatcccgggccttctatcgcatccaagcaacgcgtctaatgacgggggcaggaaatatcctgaagagacacgctgcagatcaggcccggaaggccgtgtccatgcatgaagtaaatacggaggttactgagaacgaccctgtgagtaaaatcttcttcgaacagggcacctaccagtgtttagagaattgtggcacagtggccttgactatcataagaaggggaggcgatttgaccaacaccgtgttcgtggacttccggacagaagatgggaccgcaaacgccggtagtgactacgagttcactgagggaactgttgtgtttaaaccaggcgatacccagaaagagattagagtcggcattattgatgacgatatattcgaggaagacgagaattttttggtgcacctctctaacgtgaaagtatcttccgaggccagtgaggacggtattctggaagccaaccacgtgagcaccttggcatgcctagggtcgccctcaaccgccactgttactattttcgatgacgaccatgcagggatatttacattcgaggagcccgtcacccatgtgagcgaaagcataggcataatggaagttaaagtgttgcgaacgtctggcgcgcgcggaaacgtcatcgtgccctacaaaactatcgaagggacagctcgcggggggggcgaggactttgaggacacctgcggagagctcgaatttcaaaacgatgagatcgtcaagatcatcaccatacgcatcttcgacagggaggagtatgagaaagaatgcagcttttccctggtgctggaggaacccaagtggatacgacgggggatgaaggagggtttctggctgtctagccagccggtgttcagaaaggtgcatgctcgagaacacccaatcctgtctacagttatcactattgccgatgagtatgatgataaacagccattaaccagcaaagaagaggaggagcgcaggatagccgagatggggcgccctatcctaggtgagcacaccaaactcgaggtaattatcgaagagtcttacgagtttaagtctactgttgacaagctgatcaagaaaacaaatctggccctcgtagtagggaccaacagctggagggagcagtttattgaggcaatcactgtatccgctggagaggatgacgacgacgacgagtgcggagaagagaaattgccatcttgtttcgactatgttatgcactttttaactgtgttctggaaagtgctctttgctttcgttcctccaacagagtactggaatgggtgggcctgtttcatagtatcgattctgatgatcggacttctcaccgccttcatcggtgacctcgcgtctcacttcggctgcactattggtctaaaggacagtgttaccgcggtggtcttcgtggcgttaggtacaagcgtgcccgacacatttgccagcaaggtggcagccactcaagaccagtacgcagatgcatctattggaaatgtcaccggcagcaacgccgtcaatgtgtttctcggcattggcgtggcatggtctattgctgccatttatcacgctgctaacggggagcaatttaaggtgtcgcccggcacactcgcattcagtgtgaccctctttacaattttcgcctttatcaacgtgggtgtactcctgtaccggcgacgcccagagataggaggcgaacttggcgggcctcggaccgctaaattgcttacctcctgtttgttcgtgcttctctggctcctatacattttcttctcgtcactcgaagcctactgccacattaagggcttctag

SEQ ID NO: 206446 - DNA, 2814 bp, Artificial Sequence
  Description of Artificial Sequence: Synthetic coding sequence
atgtacaacatgcggcggctgagcctgagccccaccttcagcatggggtttcacctgctggtaaccgtgtcactgctgttctcacacgtggatcatgtgatcgccgagaccgaaatggaaggggaaggcaacgagacaggagagtgtactggctcatactactgcaagaagggcgtgattctgccgatttgggagccacaggatcccagctttggagataaaattgcccgagcgactgtgtactttgtcgcgatggtttatatgttcttgggcgtctctataatcgctgaccggttcatgtcatcaatcgaagtgattacaagtcaagagaaggaaatcacgatcaagaagcccaatggtgagaccacaaagacaacagtgcgcatctggaatgaaacagtttcaaatctcacattgatggccctagggtctagcgctcctgagatattactgagtgtgattgaagtgtgtggacacaacttcaccgcgggggatctggggccttccacaatcgtaggctcggctgcttttaatatgttcataatcattgccttgtgtgtgtatgttgttccagatggagagacccgcaagatcaagcatctacgtgtattcttcgtcacagcagcttggagtattttcgcttatacctggctatatatcattctgtctgtgattagccccggagtcgtggaggtgtgggagggacttctaacctttttcttcttcccgatctgcgtcgtgtttgcgtgggttgccgatagacgccttttattttataagtacgtgtacaaacgctaccgagctgggaagcagcgaggcatgatcattgagcacgagggcgatcggcccagcagtaagactgagattgagatggacgggaaagtggtcaactcccatgtcgaaaatttcctggatggggccctcgttctggaagtagatgagcgggaccaggacgacgaagaggctcgcagagagatggcccgcatccttaaagaactgaaacagaagcacccggacaaagaaatagagcagctaatcgaactcgctaattatcaggtactctctcagcagcagaagtctcgcgcattctataggatccaggccacacgcctgatgactggggccgggaacattttaaaacggcatgctgccgaccaagcacgaaaagccgttagcatgcatgaagtcaatacggaggtgacggagaacgatcctgtcagcaaaatatttttcgagcagggcacctaccagtgtttggagaattgcggaacagtggcactgacgatcattagacggggcggcgatctgacaaacacagtctttgtcgactttcggaccgaagatggcacagccaatgcaggcagcgattacgaattcacagagggcactgtggttttcaagccaggcgacactcaaaaggaaatacgggtcggaattattgacgacgacatattcgaagaggacgaaaatttcctggttcatctttcgaacgtgaaagtgagctctgaggcatcagaggacggcattttagaagcaaaccatgttagcacattagcatgcctagggagcccatcgacggcaacagtgacgatttttgatgacgaccatgctgggatctttactttcgaggagcccgtgacgcacgtaagtgagagcatcggcatcatggaggttaaagtactgcgcaccagcggggcaagaggcaatgtgatcgttccctacaaaaccatagaaggtactgctcggggcggcggcgaggatttcgaggacacctgcggcgaactcgagttccaaaacgacgaaatcgttaagatcattactataagaattttcgacagagaagagtacgagaaggaatgttcttttagcttggtcctcgaggaacctaagtggatccgccgggggatgaaggaagggttctgctttacggatgaatatgatgataaacagcctctaactagcaaagaagaagaagagcggcgaatcgcggagatgggacgccccatcctgggagagcacaccaaactggaggtgatcatagaggaaagctacgaattcaagagcacagtagacaagctcatcaagaagaccaacctggccctggtcgtgggtactaatagctggcgagagcagttcattgaagcgatcactgtgtctgcaggcgaagacgacgatgatgacgagtgtggggaggagaaacttccaagctgcttcgactatgttatgcattttctgaccgtgttttggaaggtgctgtttgcatttgttcctcccactgaatactggaatggctgggcttgctttatcgtgagtattctgatgatcggcctgcttactgcttttattggcgacctcgccagtcatttcggatgtaccattgggttaaaagactccgttaccgcagtcgtgttcgtggcactggggacctccgtgccagataccttcgctagcaaggtcgcggcaacgcaagatcagtatgccgatgcttcgattggcaacgtaacgggctccaatgctgtaaatgtgtttctgggcataggcgtcgcttggtccattgctgccatttatcacgcagctaacggggagcagtttaaggtttcccctgggactctggctttttcagtgactctgtttacaatctttgccttcattaacgtgggggtcctcctgtatcggcggagacctgaaattggaggcgagctgggcggccccagaaccgccaaacttcttacgagctgtctgttcgtgctcctctggctgttatatattttctttagcagccttgaggcatactgtcatattaagggcttttag

SEQ ID NO: 206447 - DNA, 417 bp, Artificial Sequence
  Description of Artificial Sequence: Synthetic coding sequence
atgtacaacatgcggcggctgagcctgagccccaccttcagcatggggtttcacttattggtgaccgtttccttattgttcagccatgttgatcacgtaattgccgaaacagaaatggagggcgaaggcaacgaaaccggcgaatgtactggatcatactactgtaagaaaggcgtcatcctacctatctgggaacctcaggaccccagctttggggataagatagcaagagcgactgtctacttcgtggcaatggtgtacatgtttttaggcgttagcattatcgcagaccgctttatgagcagcattgaggtcattacttcccaggagaaggaaatcacgatcaaaaagcctaacggagagacgacaaagacgaccgtgcggatctggaatgagactgtctccaacttgacctag

SEQ ID NO: 206448 - DNA, 2907 bp, Artificial Sequence
  Description of Artificial Sequence: Synthetic coding sequence
atgtacaacatgcggcggctgagcctgagccccaccttcagcatgggattccacctgctcgtaaccgtcagccttctgttcagccatgttgaccacgtgatcgccgagaccgagatggagggtgagggtaatgagaccggcgagtgcaccgggagctactattgcaaaaagggcgttatcttaccgatttgggaaccacaggacccctcattcggtgacaagattgctcgggccacggtttactttgtggccatggtatacatgttcctgggtgtgagtattatcgccgataggttcatgagctcaattgaggttatcacgtcccaggaaaaggagattaccatcaagaagccaaatggggagaccacgaaaaccactgttagaatctggaacgagacagtcagtaatctcacacttatggctctcggatcatccgcacccgagatcctgctgtccgtcatagaggtctgtggacacaattttaccgctggagatctgggcccatccacaattgtggggtcagccgcctttaatatgttcatcatcatagctttgtgtgtgtacgtagtgcctgacggggaaactcgaaagatcaagcacctgcgggtctttttcgtgacggcagcctggagtatattcgcgtacacttggctgtatatcattctgtccgtcataagtcccggtgtggtggaagtgtgggagggattgctaacttttttctttttccctatctgcgtggtgttcgcctgggtcgcagatcggaggcttctgttttacaaatatgtttataagagatatcgtgccgggaagcaaagggggatgatcattgagcacgagggcgacaggccgtccagcaagactgaaatagagatggatggcaaggtggttaatagtcatgtcgagaattttctcgatggagccctggtactggaggtcgacgagcgggaccaggacgacgaggaagcacgtagagaaatggctaggattttgaaggaattaaagcagaagcatcccgacaaagagattgagcagttgatcgaactcgccaactaccaggtcctgagccaacagcagaaaagtagggccttttaccggatccaggctactcgactgatgaccggtgctgggaacattctgaagcgtcacgctgccgaccaggctagaaaagctgtctcaatgcacgaagtgaacacagaagttacagagaacgaccccgtgtcgaagattttctttgaacagggcacataccagtgtttggaaaactgcggaactgtggctttgaccatcataaggaggggtggtgacctgactaatactgtatttgtcgattttaggaccgaggatggaacagctaacgccggtagcgactacgaattcaccgaaggaaccgtagtattcaaacccggagacacacaaaaagagatccgcgtgggaattatcgatgatgacatttttgaggaagatgagaattttcttgtgcacctgagtaatgtcaaagtctcaagtgaggcctccgaagacggaatcttggaagctaaccacgtgagcaccttggcttgtctgggcagcccttcgacagctactgtcaccattttcgatgacgatcacgcggggatatttacctttgaagagcctgtgacgcacgttagcgaatcgattggaatcatggaagtcaaggtgttgcgtacctccggagcccgagggaatgtaattgttccctacaaaactattgaagggacagccaggggcgggggggaagatttcgaggatacttgcggcgaacttgagtttcagaatgacgaaatcgtgaagaccatttcagtgaaggtgatcgacgacgaggagtacgaaaagaataagaccttctttctcgaaatcggcgaacctagactggtggaaatgtctgaaaaaaaagctctgctgctgaacgagctcggaggattcacaatcacagggcagccagtattccgcaaggtgcatgctcgagaacacccgattttaagcacggtgatcacaattgctgatgagtacgacgacaaacaaccactgacgagcaaagaagaagaggaacgaaggatcgccgagatgggccggccgatactcggagagcatactaaattagaagtaatcatagaagagtcttacgagtttaagagcactgttgataagctcattaaaaaaactaatcttgcattggttgtcggaactaatagctggcgagagcagttcattgaggcaattacagtatcagctggcgaggatgatgatgacgacgaatgtggcgaagagaaactccccagctgtttcgattacgtaatgcactttctgaccgttttctggaaggtgctgttcgcctttgtgccccctactgaatattggaacggctgggcctgttttattgttagcattctgatgattggactgttaacagcctttatcggtgacttggcctcccactttggctgtacaatcggattgaaagacagtgtgaccgcagtggtcttcgtcgctcttgggacatccgtgcctgatacctttgcatccaaagtagcagccacacaggaccagtatgctgatgcttccatcggaaatgtgaccggctccaacgctgtaaatgtattcctgggcattggggttgcctggtccatagctgctatttaccacgccgccaacggagaacagtttaaggtgtcgcccgggaccctcgcattttcggtcactctctttaccatatttgcattcataaacgttggcgttctactctacaggcgccgccctgaaataggcggtgagctgggcggccccagaacggctaaactgcttacatcatgtctttttgtactgttgtggttgttatacatattcttctctagcctggaagcttattgccacatcaaggggttctag

SEQ ID NO: 206449 - DNA, 2766 bp, Artificial Sequence
  Description of Artificial Sequence: Synthetic coding sequence
atggcccccctggccctggtgggcgtgaccctgctgctggccgccccaccatgtagtggcgcagccacaccgacaccctcattaccaccaccacccgccaacgactccgatacttcgaccggagggtgtcaaggcagctatcgctgtcagcctggcgtactgcttcccgtgtgggaacccgacgatccctcgctcggagataaagccgcccgggctgtggtgtactttgtggctatggtctacatgttcctcggtgtgtccattatcgccgaccgatttatggcagcaattgaggttatcacctcaaaggaaaaggaaattactatcacaaaagcaaacggagagacaagcgttggaacagtgagaatctggaacgagacggtgtcgaacctgactctaatggctttggggagcagtgccccggaaattttgctgtccgtaattgaagtttgtgggcacaatttccaggcgggcgaattggggcctggcacaatcgtcgggagcgcagcgtttaacatgttcgtggtgatagccgtgtgtatctatgtgatcccagccggcgagagcaggaagataaaacatctgcgggtgtttttcgtaactgcgtcctggtccatcttcgcttatgtctggctctacctgattttggcagtttttagtcccggcgtggtgcaggtttgggaggccctcctgaccctggtgttcttccccgtttgtgttgtgtttgcctggatggcagacaagcggctgttgttctataagtacgtatacaagcggtaccggactgatccaagatctggtatcatcataggcgcagagggagatccaccaaagagcatagaacttgacggtacctttgtgggcgctgaagcacccggcgagctgggtggcctaggtcctggcccagcggaagcccgggaacttgatgcctcaaggagagaagttattcagattctcaaggatctgaaacaaaagcaccctgataaggatttggagcaactggtgggcatcgccaactactacgctctattacatcagcagaagtctcgagccttctaccgcatccaagctactcgcctcatgacaggcgcaggcaacgtgctgcgaagacacgccgcagatgcctctaggagagcagccccggccgagggtgccggggaagacgaagatgatggggcatcaagaattttcttcgagccatctttgtatcactgcctggagaattgtggtagcgtgctgctgtccgtgacctgccagggcggagaggggaacagcactttctatgttgactacaggaccgaggatggatcagcgaaggccggcagcgactatgaatattctgagggaacacttgtgtttaagcccggcgagacacagaaggaactaagaatcggtattatcgatgacgatatctttgaagaggatgagcatttttttgtcagactgcttaatctgcgcgtgggggacgcccaaggtatgttcgaacccgatggcggggggcgaccaaagggcaggctggtcgcccccctgttagccaccgtcaccatccttgacgacgaccatgccggtattttttcctttcaagatagactcctgcacgtcagcgaatgcatgggaacagtcgatgtgagagtggtgagatcctcaggcgccagggggacagtcaggcttccataccgtaccgttgacggcaccgctagaggaggaggagttcactatgaggacgcctgtggagagctggaattcggcgacgatgaaaccatgaaaacccttcaggtgaaaatcgtggacgatgaagagtacgagaagaaggataactttttcatcgaactgggccaaccccagtggttgaagcgcgggatcagtgccctgctgcttaaccagggagatggtgacagaaaattgactgccgaagaagaagaagcccggaggatcgccgagatgggcaagcctgttcttggggaaaactgcaggctggaggtaattattgaagaatcatatgactttaagaatacagtagataaacttataaaaaagaccaatctcgccctcgtaattggcacccactcttggagggagcagttcctcgaggccatcacggtatcagctggagatgaagaagaggaggaggatggctcacgcgaggagcggctgccctcttgttttgactatgtgatgcattttttaactgtcttttggaaggtgctgtttgcctgtgtgccaccaacggaatattgtcacggatgggcctgtttcggagtctcaatactggtcatagggctcctcacagccctcataggggacctggcaagccattttggttgcacagtcggcttgaaggactctgtgaatgctgtcgtgtttgtggccttgggcacctccatcccagatacatttgcttccaaagttgcagcattacaggatcaatgtgccgacgccagcatcggcaacgtcaccggatccaatgccgtgaacgtatttctaggactcggggtcgcatggtcggtggctgcggtttattgggcagtccagggcaggccattcgaggtcaggactgggactctcgcatttagcgtaacactgtttacagtatttgctttcgtggggatcgctgttctcctgtacaggcggcgtccgcacattgggggagaactgggggggccgcgcgggccgaagctggctaccaccgctctcttcctggggctgtggttgctatacatcttatttgcctccttagaggcctactgtcatataagggggttttag

SEQ ID NO: 206450 - DNA, 2478 bp, Artificial Sequence
  Description of Artificial Sequence: Synthetic coding sequence
atgttcgtggtgatcgccgtgtgcatctacgtgatccccgccggcgaaagtaggaaaatcaaacatcttcgcgtcttttttgtaacggcctcttggagcattttcgcttatgtttggctgtatctcatactcgctgtgttctcccccggagtggtgcaggtgtgggaagcactcctgacactggtattttttccagtctgcgtggtattcgcttggatggcagataaacgcctgcttttctacaaatacgtatataaacggtaccggacggacccacgttctggcatcatcatcggagccgagggcgatcctcccaagagcattgagttggacgggacttttgtgggagctgaggcccctggagagctcggagggttaggacccggacctgctgaggccagagaattggatgccagtcgtagggaagttatacagatactcaaagatcttaaacagaagcatcccgacaaagaccttgagcagctggtgggaatcgccaattactacgcactgctgcatcagcagaagtctcgggcgttctatcggatccaggccacgaggttgatgaccggcgccggaaacgtgttgagacggcatgctgccgacgcttccaggcgggctgccccggcggagggggctggcgaagacgaggacgacggtgccagtcgcatttttttcgagcccagtctctaccattgcctggaaaactgtggttccgtcctgctgagtgtcacatgtcaaggcggagaaggcaactccaccttctatgttgactaccgcacagaggatggttccgccaaggcgggaagcgattatgagtatagtgagggaactctggttttcaaacctggcgagactcagaaagagctgcgcattggtatcattgatgacgacatcttcgaggaagacgaacacttctttgtgagactgctgaatttacgcgtgggagacgcccagggaatgttcgaacctgatggaggaggaagaccaaagggccggctggtagcccctctgctagccactgtgaccattctagatgatgaccacgccggaatattctcattccaggatcgccttttacacgtttcagaatgtatgggaacagtggatgtgagggtggtccgcagctcgggcgcaaggggcacagttagacttccataccgaaccgtcgacggtacagcccgaggggggggggtgcattacgaggatgcatgcggagaactggagttcggcgacgatgaaacaatgaagacattgcaggtgaagatagttgacgatgaggaatatgagaagaaagacaacttcttcatagaactcggacaaccccaatggctgaaaaggggaatatcagcgcttctcctcaaccagggggacggcgatagaaagcttacggctgaggaggaggaggccagacgaatcgcggaaatggggaaaccggtgctgggggagaactgccgcctggaggtaatcatcgaagaatcatacgattttaagaacacagttgacaagctcattaagaagacgaacctagccctagtgattgggacccacagctggcgagagcaatttctggaggctatcactgtgtctgcgggcgatgaggaggaagaagaagatggctcccgcgaagagcgcctgccatcatgtttcgactacgtcatgcactttcttacagtgttttggaaagttctgtttgcttgtgtgccacccacagagtattgccatggctgggcttgttttggcgtctcgatcttagtgattgggttacttacagctctgattggggacctggcttctcacttcgggtgtaccgtagggctcaaagatagcgtcaacgcagtggtgtttgtggctctgggcactagcatccccggtaacacattaggggatttcgggggggtcgggagtcagatgagtcaggccggcgccacccaggaccctgcgaaaatgcgtcacgtgagacagcagggtggcggggcagcgggcccagtcaggcggagggtgcaccggcagcgcgatcgcctgcagcgaggcgaacgcgtgccatggcccggccggaggctggtttgcggaaggagggtgctgggcggagccgggccacctctcaggggtgcccattggcatgctggcctgctaaggcatgctctacaccggttgcggcttcgaggtcactgtagggcagctgttcctgcccctgctgctcatcgccgtcgcgccggacgccctgcccgaacacaagctaggcatcaccgggccctgcccggacccctagcgcccgttcatcccctgaggcagcccggcggcgtactcccccatcccggtttgctaggacctagagcagaaacgagaccgcatagacctcctggcgcgcgggacagcgccgccccagccctcggcccttggtccccctttcccccgcgactgggcctcctttcctgggattctgccagcctgctgcggccactgccttggctctag

SEQ ID NO: 206451 - DNA, 1155 bp, Artificial Sequence
  Description of Artificial Sequence: Synthetic coding sequence
atgggcaccgtggacgtgcgggtggtgcggagcagcggcgcccgggggactgtaaggctaccctaccggaccgtggacggtacagcaagaggaggcggagttcactatgaagatgcttgcggcgagctggagtttggcgacgacgagaccatgaagaccttgcaagtgaagatcgtggacgacgaggaatacgaaaagaaagataattttttcatagaattaggacagccccagtggctgaagcggggtatatcagccctcctgcttaatcagggtgacggagacaggaagctgacagcggaggaagaagaagccagaagaatcgctgagatgggtaaacctgtgctgggtgagaattgcaggctggaagtgattatcgaggaaagttacgacttcaagaacaccgtggataagctgataaaaaaaacaaacctcgccctggttatcggcacacactcatggcgggagcaatttctggaagccatcacggtgtctgccggagatgaggaagaagaagaggacggatctcgcgaagagcgcctgccatcttgctttgattatgtaatgcacttcctgaccgtgttttggaaagtgctgttcgcatgcgtgccccctacagaatactgccacggttgggcgtgtttcggcgtaagcatactggtcatcggcctgctgacagccctgataggggatctcgcttctcactttggatgcacggtgggcctgaaagacagcgtgaacgccgtggtctttgtggcgctgggcacatctatccctgataccttcgcttctaaggtcgccgcactgcaagaccagtgcgccgacgctagtatcggtaatgtcactggctctaatgctgtcaatgtgttcctgggcctgggcgtcgcatggtcagtggcagcagtctattgggcagtgcagggccggcccttcgaagtgaggacaggtaccctggctttctcagtgacattgtttactgtctttgccttcgtggggattgccgtgctgttgtatcgtaggcgcccccatatcggaggggaattgggcgggcccagaggacctaagttggccaccacagccctgttcctgggtctgtggttgctgtatatcctgtttgcttctctggaggcctattgccatatcaggggcttctag

SEQ ID NO: 206452 - DNA, 2034 bp, Artificial Sequence
  Description of Artificial Sequence: Synthetic coding sequence
atggccgacaagcggctgctgttctacaagtacgtgtacaagcggtataggactgatccccgaagtggaatcatcattggagccgaaggagacccacccaaatcaattgaactcgacggtacttttgtaggggctgaggctcccggggaactgggaggactcggcccgggcccggcggaggctcgggagcttgatgcctctaggcgggaggtgatccagatcctcaaggatttaaaacagaaacaccccgacaaagacctggaacagctcgtcggaatcgccaattattatgccctccttcaccaacaaaagtctcgagcattctaccggatccaggctacaagactgatgacgggggccggcaacgttttaagacgacacgccgcagacgctagcagacgcgccgcaccagccgagggcgccggcgaggacgaggatgacggcgcctctcgcatcttcttcgagccttctctctaccactgcctcgaaaattgtggatctgtattactgtccgtgacctgtcagggaggagaaggcaattccacgttctatgtggattatagaactgaggatgggagtgcaaaggctggctctgattatgagtattccgagggaaccctcgtgtttaagcctggcgaaacacagaaggagctgcgtataggcattatcgatgacgacatcttcgaagaggacgaacatttttttgtgagactcctgaaccttcgagtgggcgatgcacaggggatgttcgagcctgatggggggggccggcctaaggggcgattggtggcaccgctgctggctacggttaccatcctcgatgacgatcacgcaggaattttcagtttccaggacaggctgcttcatgtgtccgaatgtatgggtaccgtggatgtccgcgtggtccgatcctctggtgcacgcggcacggtgcggctgccctaccgcacagtagatggaaccgcgcgcgggggcggcgtgcactacgaggatgcttgcggcgaactggagtttggggatgacgagacaatgaaaacccttcaggtgaaaattgttgacgacgaggaatatgagaagaaggacaacttctttatagagctagggcaaccgcagtggttgaagagaggcatatcagccttactactaaaccagggcgacggagataggaagctgaccgccgaagaggaggaggctcgacggatcgcggaaatggggaaacccgtcctcggcgaaaactgtagacttgaggtgattattgaagagtcatatgactttaagaacactgtcgacaaattaatcaagaagacaaatctggccttggtgattggcacacatagttggagggaacagttcctcgaggctatcaccgtgagcgccggagatgaggaagaagaggaagatggctctagagaggaacggctgcctagttgtttcgactatgtgatgcacttccttactgtgttttggaaggttctgttcgcctgcgttccccctaccgaatactgccacgggtgggcttgtttcggtgtctctatattggtaatcgggctcttgacagcactcattggagacctggcaagccactttgggtgcacagttggattgaaagacagtgtaaatgccgtcgtattcgtagcactgggcacatcaatccccgataccttcgctagcaaggtagcggccctgcaggatcagtgtgccgacgcctccattggcaacgtaaccgggagtaacgcagtaaacgtgtttctgggtctaggcgtggcttggagcgtggcggctgtatattgggccgtgcaaggtcgccctttcgaagtgagaaccgggaccttggcctttagcgtgaccctcttcactgtgtttgcgtttgtgggcattgctgtgctcctctaccgccgtcgcccgcacattggtggagaactgggcgggccacgtgggcccaaactagctactactgccttatttctgggcctatggctcctgtatatcttgtttgcctcccttgaggcctactgtcacatcagaggtttttag

SEQ ID NO: 206453 - DNA, 2448 bp, Artificial Sequence
  Description of Artificial Sequence: Synthetic coding sequence
atggtgctgcggagcggcatctgcggcctgagcccccaccggatcttccccagcctcctggtagtcgtggcgctggtcggccttctccccgtcctcagatcgcatggcctgcagctttccccgacagcatctacgattaggagctctgaaccaccacgcgagaggagtattggcgatgtgacaactgctccccctgaagttactcccgaaagtagacctgttaaccactccgttacggaccatgggatgaagccacgaaaagctttccccgtgttggggatagactatacccacgtgagaacccccttcgagataagtctgtggatactgctggcttgcttgatgaagattggcttccatgtgattcctaccatctcctctattgtgcctgaatcatgtctcctgatcgtggtgggattgctcgtggggggactgattaagggcgtcggcgaaactccaccctttcttcagtccgatgtgttcttcctgttcctgctaccccctatcatcctggacgcagggtacttcctgcctctgcggcagttcaccgaaaacctgggcactatcctgattttcgccgtagtgggcacgttgtggaacgcatttttcctcggggggctgatgtacgctgtttgcctcgtggggggagaacagatcaacaatatcggcttacttgataacctcttatttgggagcatcatctccgccgtcgaccccgttgctgttctggctgtatttgaagaaatccatattaacgaattgttgcacattctggtcttcggcgaaagcttattaaacgacgctgttacagtcgtcctgtaccacctgttcgaagagtttgccaattacgaacacgtcggcatcgtggatatctttctcggatttctcagctttttcgtcgtggctctcggtggagtgctggttggagtggtgtacggagttatcgctgccttcaccagccgatttacatctcatatccgggtgattgaaccactgttcgttttcttatactcttacatggcctatctgagcgccgagttgtttcatctaagtgggataatggccttgattgcatcaggagtcgtgatgagaccctacgtggaagctaacatcagtcataagtcacacacaactattaagtactttctgaagatgtggagtagtgtttcggagaccctaattttcatcttcctgggggtcagcacagtagccggtagtcaccattggaactggaccttcgtgatttcaacgctgttgttttgcctcattgcccgcgtacttggagtgctaggactgacatggttcattaacaagtttaggattgtcaagctcactccaaaagatcagttcatcatcgcttatggaggactgcgcggtgcaatcgctttctccctcggatatctcctggacaagaagcactttcccatgtgcgacctctttctcaccgccattattactgttatcttttttacagtatttgtacagggcatgacgattcggccattagtggatttgctcgccgtcaagaaaaagcaggagaccaagagaagcatcaacgaagagattcatacccagtttttagaccatctattaaccggaattgaagacatttgcgggcactatggtcatcatcattggaaggataagttgaataggtttaataaaaaatacgttaagaaatgtctcattgcaggggagagatccaaggagcctcagctgatcgcattttatcacaaaatggaaatgaagcaggccatcgaactggttgaaagcgggggaatgggcaaaattccctccgccgtgtccaccgttagtatgcagaatattcatccaaaatctctgccatcagaacggatcctgcccgccctgagcaaggacaaggaggaagagatcagaaaaatcctgcggaataaccttcagaagacccggcagcggctgagaagttacaatcgtcacaccctcgtggctgacccgtatgaggaggcatggaaccaaatgcttcttcggcgacagaaggcacggcagctagagcagaagataaacaattatctgactgtgcccgctcacaaactggactccccgaccatgtcacgcgcaagaatcgggtccgatcctctggcttacgagccgaaggaggatctgcctgtgatcacgatcgacccggcctcaccccagtctcccgagtcagtggatttggtgaacgaggagttgaagggtaaggtgctgggattatccagagacccagccaaggtcgctgaggaagatgaggatgacgatgggggcattatgatgcgctccaaggaaacaagtagccctggcactgacgacgttttcacacctgcacccagcgattctccctctagccagaggattcagaggtgtttgtcagaccccggacctcacccagaacccggcgagggagagcctttcttccctaaaggacagtag

SEQ ID NO: 206454 - DNA, 408 bp, Artificial Sequence
  Description of Artificial Sequence: Synthetic coding sequence
atggtgctgcggagcggcatctgcggcctgagcccccaccggatctttccctctttgctcgtggttgtggcactcgtgggcttactgccagtgcttcgatcgcacggccttcagctcagccccacggccagcaccattcgatcttcggaaccccctagagaacggtctattggcgatgtcactaccgcaccacctgaagtcactccagagtcaagaccagtcaatcattccgttaccgatcacggcatgaagccccgcaaagcttttccagtcctgggcatcgactatacccacgtgagaactccctttgagatatccctgtggatcctcttggcatgcctgatgaagatcggctttccatgtgacccacattacctgaaacaccgacctggtgaacttcccgcctag

SEQ ID NO: 206455 - DNA, 1668 bp, Artificial Sequence
  Description of Artificial Sequence: Synthetic coding sequence
atggtgctgcggagcggcatctgcggcctgagcccccaccggatcttccccagtctcttggtggttgtggcgttagtcggattgctgcccgtgttacgaagccatggtctgcaactatctcccactgccagcaccatcagatcctcagagcctcctcgggagagatccattggggatgtcactacagcgccacctgaagtgacccccgaatcgagacctgtgaatcactccgtcaccgaccatggaatgaagccaaggaaagcctttccagtgctcggaatcgattacacgcacgtgcgtacaccttttgaaataagtctgtggatactccttgcatgtctcatgaagatcggctttcacgtgattcctacgattagttctatcgttcccgagtcatgcctccttatcgttgtcgggctgctcgttgggggattgatcaaaggcgtgggtgagacccctccattcttgcagtccgacgttttttttctcttcctgcttccaccaatcatactggacgctgggtacttccttcccctccgacaattcaccgagaacttaggaacaatactcattttcgctgtggtgggaaccctctggaatgcattttttctgggtggactgatgtacgcggtttgcctggtgggaggagagcaaattaacaatattggcctgctggacaacttactgttcggctccatcatcagtgccgtagatcccgtcgcagtgttggcagtgtttgaggagattcacattaacgagctgttgcatatcctcgtctttggcgaatcacttctgaatgacgcagtcacagttgtgctttaccacctgttcgaggaatttgcaaactatgaacacgtcggtatcgtggatatattcctcggttttttgtctttcttcgtggtggcactgggcggtgtgttagtgggcgtggtctatggggtaatcgctgcatttacgagtagattcacaagtcatatccgagtgattgaaccactgttcgtctttctgtacagctacatggcctatctctccgcggagttgttccacctgtcgggcattatggccctcattgcttcaggagtggtgatgaggccttatgtggaggccaatatatcccacaagtctcacaccacgatcaaatattttcttaaaatgtggtcctccgtgtctgagacacttatattcattttcctgggagtgtcgactgtggcgggcagtcaccactggaactggacctttgtgattagtaccttgctcttctgtttgatcgcacgcgttctcggcgtgctgggcttgacttggttcattaataagtttcggatcgttaagctgacaccaaaggatcagttcattattgcctatggagggctgaggggcgcaatcgcattctcgctggggtatctgctcgacaaaaagcacttccctatgtgcgacttgttcctgactgccattattacggttatcttcttcacagtattcgtacaggtccttgggcagggcagggcaggtccttgtttaggagatccacataggcttttcccctggaaggagcgaaaagcctgcgacctcaagtgtgactcatcgccaagcagtacaactaacctgctctgcgatttaggaagagcgactcctccgttttgggcgagtgtgagctctatagtgaaatag

SEQ ID NO: 206456 - DNA, 960 bp, Artificial Sequence
  Description of Artificial Sequence: Synthetic coding sequence
atgaccatccggcccctggtggacctgctggccgtgaagaagaagcaggaaactaaaagatctataaacgaggagattcacacccaatttttagaccatctcctcacaggcattgaggacatctgtggacactatggccaccatcactggaaagataaattaaaccgttttaataagaagtatgtgaaaaagtgtctgatcgcaggagagcggtctaaggagccgcaactgatcgccttctatcataaaatggagatgaagcaggccattgagctcgtagaatccggcggtatgggcaagattccatcagcagtctccacagtgagcatgcaaaatattcacccgaagtctttgcccagcgagcggatcctcccagctctgagcaaggacaaggaggaagagattcggaaaattcttcggaataacctgcagaagacacgtcagcggctccgcagttataaccgtcacaccctggttgcagacccatacgaggaagcctggaaccagatgctcctgagacggcagaaagcccggcagctggaacagaaaattaacaactacctcactgtccctgctcacaagctggacagccctaccatgagtcgggcccggattggctcagatccgctggcctacgagcccaaggaggatttgcccgtgattacgattgaccccgcttctccacagagtccagaatctgtggacctggttaacgaagagctcaaggggaaggtgcttggactatcgagagatccagctaaagtggctgaagaggatgaggacgacgacggcggaattatgatgagatctaaggagaccagttcacctgggacagacgatgtatttacccctgcaccgagtgatagcccaagttcacagcggattcagagatgcctgtctgacccgggaccacaccctgagccgggcgagggggagccattctttccaaaaggacagtag

SEQ ID NO: 206457 - DNA, 675 bp, Artificial Sequence
  Description of Artificial Sequence: Synthetic coding sequence
atggagatgaagcaggccatcgagctggtggagagcggcggcatgggcaaaattcctagtgctgtgtcgactgtgagcatgcagaacatccatcctaagtctctgccctcagagcgcattttgcccgccctgtccaaggacaaggaagaggagattaggaaaatactccgcaataatctacaaaaaacgcgacaacgacttcgctcctataaccgccatacgcttgttgcagacccatacgaagaggcctggaatcagatgctcctgcggagacaaaaggcccgacaactagaacagaaaatcaacaattatctaaccgtacccgctcataaactcgattcccctactatgtcacgcgccaggatcgggtcagatccgctcgcatacgagcctaaagaagacctccccgtcattactatcgaccccgccagcccccagtctcccgagagcgtggacctggtgaacgaagaattgaaagggaaggtactgggactgagccgcgaccctgccaaagtcgccgaggaggacgaggatgatgacggggggatcatgatgaggtccaaagaaacgtctagccctggcacagatgacgtatttactccggctcccagcgactcgccttctagccagagaatacagcggtgtctgagtgatcctggccctcatccagagtag

SEQ ID NO: 206458 - DNA, 1431 bp, Artificial Sequence
  Description of Artificial Sequence: Synthetic coding sequence
atggcctacctgagcgccgagctgttccacctgagcggcatcatggcactaatcgcgagcggggtggtgatgcgcccttacgttgaagctaacatatcgcacaaaagtcacactacaattaagtattttctcaaaatgtggagctcagtgtccgagaccttgatcttcatcttcctaggggtgtcaaccgtggctggaagccaccactggaattggacatttgtgatctcaaccctgttgttttgtctgattgcccgggtgctgggagtcctggggctgacctggttcatcaataagtttcgaatcgtaaagctaacacctaaagaccagtttatcattgcctatgggggcctgcgcggcgccattgctttctccctgggctatctcttagacaagaaacatttccctatgtgcgacctgttcctcactgccatcatcacggttattttcttcaccgtcttcgtgcagggcatgaccatacggcccctcgtcgatctgctggcagtgaagaaaaagcaggagacgaagcgctctattaacgaagagatccacacgcagtttctggatcacctgttgactggcattgaagatatctgtgggcattacggccaccaccactggaaggataagctgaatcggtttaataagaagtacgtgaagaagtgtctgattgcaggtgagcgcagcaaggagcctcagctgatcgcgttctatcacaagatggaaatgaagcaggctattgaactggtcgaatcaggaggaatgggtaaaattccatccgcagtctcaactgtgagtatgcaaaacatccatccaaagtcactgccatctgagcggatcctgccagcactatcgaaagataaggaggaggaaatcagaaaaattctaaggaataatcttcagaagacaaggcagcgactacgcagctacaatcgtcatactttggtggccgacccctacgaagaggcatggaaccagatgttgctcaggcgacagaaggcgcgccagcttgagcagaagatcaataattatctgaccgtccctgcacataaattagacagcccaaccatgagtcgggccaggattggatccgacccactggcgtacgagcccaaggaagatctgcccgtgataactattgacccggcctcacctcagagtcctgaaagcgttgatttggttaatgaagagctcaagggcaaggtcctgggactgtctagggacccagccaaagttgcggaagaggacgaagacgacgatggtgggattatgatgcgcagtaaggaaacatcctcccccggcacagacgatgtgttcacccctgccccttctgattccccctctagccagcgcatacagaggtgcttaagcgaccccggtccccaccccgagccgggggaaggtgagcctttctttcccaagggtcagtag

SEQ ID NO: 206459 - DNA, 1626 bp, Artificial Sequence
  Description of Artificial Sequence: Synthetic coding sequence
atgaactgccgggagctgcccctgaccctgtgggtgctgatcagcgtctccaccgcggaaagttgcacctctagaccccacattaccgtggtggagggagaacctttctacctgaaacattgctcttgttcacttgcacatgaaattgagaccacaacaaaatcctggtacaagtcatctggaagtcaggaacacgtggagctgaaccctaggagctccagtagaattgccctgcacgattgtgtccttgaattttggcccgttgagctgaatgacaccggtagctacttcttccagatgaaaaattacacgcagaaatggaaactgaatgtgattcgccgaaacaagcacagttgttttaccgagagacaagtgacttccaagatcgttgaggtgaagaagttctttcagatcacttgtgagaattcctattaccagacattagtcaactctacctcactgtacaagaattgtaagaaacttctcctagagaacaacaagaacccaactatcaagaaaaacgccgagttcgaagatcagggctactatagctgcgtccattttctccaccacaacggcaagctgtttaatattaccaagacattcaatataacgatcgttgaggatagaagcaacattgtgccagtcttgctgggacccaaactaaaccacgtggcggttgaattgggcaagaatgttagattgaactgcagcgcactacttaatgaagaggacgtcatctactggatgtttggagaagagaacggatccgaccccaatattcacgaggaaaaagagatgcgaatcatgactcctgaggggaagtggcacgcttctaaggtgctgagaatagaaaacatcggtgagagcaatctgaatgtattgtataattgtactgtcgcctctacagggggaaccgacacaaagagctttatcttagtccggaaggccgatatggcagatattcccggccatgtgtttacacggggaatgatcattgcagtcctcatcctggttgccgtcgtgtgtctagtcacggtatgcgtgatataccgcgtggacttagtcctgttttataggcacctaacacgccgggacgagacattgaccgacggtaagacatatgacgcattcgtctcatatctcaaagaatgtagacccgaaaatggggaggagcacacatttgccgttgagattcttccacgggtcctggaaaagcatttcggatataagttgtgcatcttcgagagggatgtggtgccaggcggcgccgtggtggatgagatccacagcctgatcgagaaatcacgacggcttattatcgtactctctaagtcatacatgagcaacgaggtcagatacgaattggaatctgggctacacgaggcactcgtggagaggaagatcaagatcatcctgatagaattcactccagttaccgatttcacttttttgcctcagtccctcaaactgttgaagtcccatcgagtccttaaatggaaggccgacaaatcacttagctacaattcccggttttggaagaacttactatatctgatgcctgccaagaccgtcaaaccgggtagagacgagcccgaggtcctgcccgtcctgtcagaatcttag

SEQ ID NO: 206460 - DNA, 2505 bp, Artificial Sequence
  Description of Artificial Sequence: Synthetic coding sequence
atgtggggcctgggcgcccggggccccgaccggggcctgctgctggcccttgccctgggaggactggccagggctggaggggttgaggtggagcccggcggggcccatggggagagtggtggttttcaggtggtcaccttcgaatgggcgcacgttcaggacccttatgtaattgcactgtggatactcgtggcttctctcgctaaaattggtttccatctttcacataaagtgacctccgtggtgcccgaatctgctttgctcatcgtgctcgggttggtgctaggcggtatcgtttgggcagcggaccacattgcaagtttcactctgacacccacagtgttctttttttacctactccccccgattgtgcttgatgctggatatttcatgcctaatagattattctttggaaacctaggcactattctgctctatgcagtggttggaaccgtgtggaacgccgctacaactggcctgagcctgtatggagtgtttctgtctggtctaatgggggacctgcagattggactcctggactttctgcttttcgggtctctcatggcagccgtggacccagtcgccgtgttggcggtattcgaggaggttcatgtgaacgaagtgctgtttatcatcgtttttggggagagcctgctgaatgacgcagtgacggtggttctgtacaatgtgtttgaatcctttgtggctcttggcggcgacaatgtgaccggcgtggactgtgttaaaggaatagtctccttttttgtcgtgtcacttggcgggaccctggtgggcgtggtgtttgcctttcttctcagcttggttacccgtttcacaaagcatgtgaggatcattgaacccggatttgtgtttatcattagctatctgtcttacctcacttctgagatgttaagtctttccgctatccttgctataacattctgtggaatctgttgccaaaagtatgtaaaggctaacatatccgaacagagcgccacaacagtcagatacaccatgaagatgttggcaagcagcgccgaaacaattatcttcatgtttctcggcatttctgctgtaaatccatttatctggacatggaacactgccttcgtattactgacactggtgttcattagcgtgtatcgggcaatcggtgtcgtactgcagacttggctcctcaacaggtatcgtatggtgcagctcgagcccattgaccaagttgtgctgtcctacggaggcctgagaggtgcggtggcttttgcccttgttgttctgctggacggtgacaaagtcaaggagaaaaacttatttgtcagcaccacaatcatagtggtattctttactgtcatttttcaggggctaaccatcaagccacttgtccaatggctgaaagttaaaagatccgagcaccgggaaccccgtctgaatgaaaagttacacggaagggctttcgaccatattctttccgctatcgaagatattagcggccaaatcggtcacaactatctgcgggacaagtggagccacttcgaccgcaaatttctgtcccgggtcctgatgcggagatctgcccagaagtcgcgcgaccgtatcctaaacgtgtttcacgagctgaatctcaaagatgctatcagttatgttgcagagggtgaacgccgcggatccttggcattcatacgcagcccctccacagacaatgtggtaaatgtggattttacgccccggagttccactgtggaagccagcgtgtcatatcttctgagggagaatgtgtccgccgtttgcttggatatgcagagtctggagcagcgtaggcgctccatcagagatgctgaagacatggtgacccaccacaccctgcagcagtatctttacaagcctcggcaggaatacaagcatttgtatagccgccatgagctgaccccaacagaggacgagaaacaggacagagagatttttcacaggacaatgcgcaagaggttagaaagcttcaagagtactaagctgggacttaatcagaacaaaaaggctgccaagctgtataagcgtgagcgggcacagaagcgccgcaactccagcatccctaacggaaaactgccaatggagagtcccgcccagaacttcaccattaaagaaaaggacttagaattatcggacacagaagaacctcccaactacgacgaggaaatgagcggcggcatcgaattcctggctagcgtgacaaaggacacagcttctgacagtccggcggggatcgacaatcctgtgttttcgccggatgaagcacttgaccgctctctcctggctcgtttgcccccctggctctctccaggggagaccgtggtgccatcccaaagggccagaacccaaataccctactctcccgggactttctgcagattgatgccattccggctcagttctaagtccgtggacagctttctgcaggccgacgggccagaggaacgcccccccgccgcattgccagagagcacccatatgtag

SEQ ID NO: 206461 - DNA, 1077 bp, Artificial Sequence
  Description of Artificial Sequence: Synthetic coding sequence
atgagcgccgacgccgccgccggcgcccccctgccccggctgtgctgccttgagaaaggtccaaacggatacggttttcacctgcatggcgagaagggcaagctggggcagtacatacgattggtggagcccgggtccccagctgagaaggctggcctgttggcaggcgaccgactcgtagaagtcaatggggagaacgtggaaaaggagacgcaccagcaggttgtatcaagaatccgagcagcactgaacgctgtaaggctcctcgtggtggaccctgagacagatgagcagctgcagaaacttggtgtgcaagtcagagaagaactcctgagggctcaggaagcaccaggccaggcagagcccccggctgcagccgaggtccaaggggcaggaaatgaaaacgagcctcgcgaggccgacaaatcccacccggaacagcgcgaactgaggccaaggctatgtacgatgaaaaaaggccccagtggctatggcttcaatcttcactctgacaaatctaagcccggccagttcatccgcagtgtggaccctgactctccagcggaagcaagtggcctgcgtgcccaggatcgcattgtcgaagtcaacggagtctgcatggaggggaagcagcatggagacgttgtgagcgcaattagagcggggggcgatgaaactaaattattggtagtggacagagagaccgatgaattttttaaaaaatgccgtgtcataccatcccaagaacacctgaacgggccgctgcctgtgcccttcaccaatggggagatccagaaggaaaactcacgggaggctctggcagaagctgcactagagagcccgcgcccagctttggtcagaagcgcctcgtccgatacctctgaggaacttaattctcaggactctccacctaagcaggactcaactgcacccagtagcacaagtagctcagaccccatcctggatttcaacatctcacttgccatggcaaaggagcgggcacaccagaagcgtagctccaaaagagccccgcagatggactggtcgaagaaaaacgagctgtttagcaatctgtag

SEQ ID NO: 206462 - DNA, 822 bp, Artificial Sequence
  Description of Artificial Sequence: Synthetic coding sequence
atgagcgccgacgccgccgccggcgcccccctgccccggctgtgctgtctggagaaggaaacgcaccagcaggtggtatccaggattagagcagcccttaacgcggttcggttgctcgtagttgatcctgagactgacgaacagctgcagaaactgggggtccaagtgcgcgaggagttactgcgcgcccaggaagccccaggacaggccgaaccacccgctgccgccgaagtgcagggggcaggaaacgagaacgagcccagagaagctgacaaaagtcatccagaacagcgagagttgaggcctcgactttgcaccatgaagaagggaccatccggatacgggtttaacctgcacagcgataagtccaaaccgggacaattcattcggtccgtggacccagattcgccggctgaagcatctggccttcgggcacaggataggattgttgaggtgaacggcgtgtgtatggaaggtaagcagcacggcgacgtcgtttccgccatcagagctggcggtgatggttccgggggggggaatcagagaggcgccgagttcccccgacagccccccaagaccggattacatagcgctttggtgtatttgttgctgcggccacacccaagactccagcatttgcctggacacgggcagcgggagggtcctccagagacccaacagcaaaccggacctgccgatggcctggaacaggagaaacggaccctgcagcaacccttgtccgcgctgctgcccccgtctgactggcaaggcagggcgtccatacctccacacctctttcctagccctcaactgctgccctag

SEQ ID NO: 206463 - DNA, 1014 bp, Artificial Sequence
  Description of Artificial Sequence: Synthetic coding sequence
atggccgcccccgagcccctgcggccccggctgtgccggctggtgcgcggagaacagggctacggattccacctgcacggggagaaagggagacgcggacagttcatcagaagagtcgaacctgggagccccgccgaggccgcagctttgcgtgctggcgaccgcctggtggaggtgaacggcgtgaatgtcgagggagagactcatcatcaagttgtgcagaggatcaaagctgtggaagggcaaactaggcttctcgtggtggatcaggagaccgatgaggagcttaggagaaggcagctgacctgtacggaggaaatggcccagcgcggactcccacctgctcacgacccttgggaaccaaagcccgattgggcccatactggctcacattcctctgaggccggcaaaaaggatgtgagtgggcctctccgtgagctgcgacctcggctctgccacctgagaaaaggaccgcaggggtatggattcaatctgcattctgacaaaagccgacccggacaatacataaggagtgtcgaccctgggtcccctgctgcacgatctggtctccgggctcaggaccgcctgatcgaggtgaacgggcaaaatgttgaaggcctgagacacgcagaggtggtcgcaagtataaaagcacgggaagatgaagcacgactccttgtggtggacccagaaactgatgaacactttaagcgcctacgagtaactcccacagaggaacacgtagagggccctttgccttctcctgtgactaacgggacctccccagcccagctcaacgggggtagtgcttgtagctccagaagcgacctgccgggaagtgacaaagacacagaggacggcagtgcttggaagcaggacccattccaggaaagcgggctccacctgtcgcccaccgcggccgaggctaaagaaaaggctcgggcgatgcgtgtaaacaaaagggcccctcagatggattggaaccgaaaaagagagatcttcagtaatttttag

SEQ ID NO: 206464 - DNA, 981 bp, Artificial Sequence
  Description of Artificial Sequence: Synthetic coding sequence
atggccgcccccgagcccctgcggccccggctgtgccggctggtgaggggagagcaggggtacgggtttcacctgcacggcgaaaaggggcggcggggtcagttcatcaggagagtcgaaccaggttcccctgccgaagccgcagctctgagggcaggagatagactcgtggaagttaacggcgtgaacgtggaaggcgagactcaccaccaggtcgtgcagcgcatcaaagccgtggaagggcagacacggttgctggtggttgatcaggagactgacgaagagctccggagacgtcagctcacctgcactgaggagatggcacagcgcgggctcccacctgctcacgacccttgggagccgaagccagattgggcccataccggatctcatagttccgaggccggaaagaaggacgtgtctggcccactccgcgaattgagacctcggctttgccatctgcggaagggcccacagggctacggatttaacttgcacagcgataaaagtcggccagggcagtacatacgcagtgtggatcccgggagtcccgcagcgaggtctgggttgcgagctcaggatcgcttgattgaggtgaatgggcaaaacgtggaggggctgcggcatgccgaggtggtcgccagcatcaaggcgagggaagatgaagcccgattgcttgtggtcgaccctgaaacagatgagcattttaagagacttagagtaactccaacagaagaacatgtcgaggggccactcccctccccagtaacgaatggtacgtcgcctgctcaactgaacgggggctcagcgtgttcttctcggagcgaccttccagggagtgacaaagacactgaggaatcaggactacacctctctccaacagctgctgaagccaaagaaaaggctagggctatgcgtgtgaacaaaagagccccccagatggactggaatcggaaacgcgagatcttttcaaacttctag

SEQ ID NO: 206465 - DNA, 2397 bp, Artificial Sequence
  Description of Artificial Sequence: Synthetic coding sequence
atggccctgcagatgttcgtgacctacagcccctggaactgcctgttgcttctggttgccctggaatgttccgaagcctcgagcgatctgaacgaaagcgcaaattcgaccgcccaatatgccagcaacgcctggttcgcggcagccagcagtgaaccagaggaaggtatttccgtgttcgagctcgattatgactatgttcaaattccatacgaggttacactttggattttgctcgcttcactcgccaaaatcgggttccacctctatcatcgcctccctgggctgatgcccgaatcttgcctgctaatcctagtgggcgcgctcgtcggaggaattattttcggcaccgaccacaagtccccccccgtgatggattcttccatttattttctgtacctcctgccccctatcgttctcgaggggggatattttatgcctacgagacccttcttcgagaatatcggtagcatattgtggtgggctgttttgggagccctgatcaacgcgctgggcatcggattatcgttgtaccttatctgccaggtgaaagctttcggtctcggagatgtgaatctgctccagaatctgctcttcggctcacttatttccgcagtcgatcctgtggccgtgttagcagtgttcgaagaagcaagggtgaatgaacaactgtacatgatgatctttggggaggcactccttaatgacggcataactgtggtcctgtataacatgctaatcgctttcaccaagatgcacaagttcgaagacatcgaaaccgtagacatcctggctggatgtgcaaggttcatcgttgtcgggctgggtggggttttgttcggcatagtgttcggcttcattagcgcattcatcacccggttcacgcagaatatcagcgccatagagccactgatcgtgtttatgttctcctacctgtcatatctggctgctgagactctgtacctgagcggcatactggcaataaccgcgtgtgcggtcacgatgaaaaagtacgtggaagaaaatgtctcacaaacctcctacaccacaatcaagtatttcatgaagatgctctcttctgtctcagaaactctaatatttatatttatgggggtgagtaccgtgggtaaaaaccatgaatggaactgggcttttatctgcttcactcttgcattctgtcagatctggcgcgccatctccgtgtttgctctcttctacatttccaatcagtttcgcacctttccttttagcataaaggatcaatgtatcatcttctactcaggagttagaggtgcggggtccttctccctggccttcctcctgcctctctccctattcccacggaagaaaatgtttgtgaccgcaaccctcgtagtcatttacttcacagtgtttattcagggcatcactgttgggccactggtgaggtacctggatgttaagaagactaacaagaaagagtccatcaacgaggaactccacatacgcctgatggatcacctcaaggcggggatcgaggacgtgtgcggccactggtctcactaccaggtccgcgacaagttcaaaaagtttgaccacagatacctgcgaaagattctgattcgcaaaaatctgccaaagagctccatcgtgtctctttacaagaagttggagatgaaacaagctattgaaatggtcgagactggcatcttgtcttccaccgcgtttagtatcccacaccaggcccagagaatccaaggcatcaagcggctctctcccgaggatgtcgagtctatacgggatatcctgacgagtaacatgtatcaggtgcgccagcggactctctcttataataaatataacttgaaaccacaaactagcgaaaaacaggcaaaggaaattctaatcaggcgccagaacactctcagagaaagcatgaggaaaggccatagcctaccctggggaaaacctgcaggcaccaagaatattaggtacctgagttatccctacggtaatccacagtcagccggcagggacactcgagccgcggggttctccgatgatgactcaagcgatccagggagcccttctatcacgttttctgcctgctctcgcattggctccctgcagaaacaggaggcccaggagatcatccccatgaagtcgttgcaccgcggcaggaaagcatttagtttcggttaccagcggaatacttcacaagaagagtacctagggggggtccggcgggtcgcattacggccaaagcccctgtttcacgccgttgacgaggagggagagtccgggggcgagtcggagggcaaagccagtctcgtggaggtgagatcccggtggactgctgatcatgggcatgggcgggaccaccacaggagtcattctcccctcttgcagaagaagtag

SEQ ID NO: 206466 - DNA, 2691 bp, Artificial Sequence
  Description of Artificial Sequence: Synthetic coding sequence
atgctgcgggccgccctgagcctgctggccctgcccctggccggcgcggctgaggaacccacacagaaacctgaatctcctggagagcctccaccggggctggagctctttcggtggcagtggcacgaagttgaggccccctatctggtggcgttgtggattctggtcgcgtctcttgcaaaaatcgtgtttcatctgtctcgcaaggtgacttcactggtccccgagagctgcctgctcattctgttgggcctggtacttggaggcatcgtgctcgccgttgcaaaaaaggctgaatatcaactggaacctgggacctttttcctctttctgctgcctcctatcgtgctggatagtggctactttatgcctagcaggctgtttttcgataacctaggcgctattctcacgtatgcggttgtgggcaccctctggaacgctttcaccaccggagccgcgctgtggggcctgcagcaggccggcctagtcgcgccaagggtccaagccgggctgctggatttcttactgtttggaagcctgatttctgcagttgatccggtggctgtcttggccgtgtttgaggaagtacatgttaatgagacgctcttcataattgtgtttggagagtccctgcttaatgatgccgtgaccgtggtgttatataaagtttgtaacagcttcgtggagatgggatccgcaaacgttcaggccacagactacctgaaaggtgtggcctctctgttcgtcgtcagtctgggaggcgccgcagttggactagtgttcgccttcctgctcgccctaactacacgtttcaccaaaagagtacgcattatcgagccgctgctggtctttttgctagcatacgctgcttatctcactgccgagatggcttccttaagcgctattcttgccgtgaccatgtgtgggcttggctgtaagaaatatgtcgaagccaacatttcacataagtctcgaacaactgttaagtatacaatgaagaccctcgccagctgtgcagaaacagtgatctttatgcttctcgggatcagtgccgtagactcgagcaagtgggcgtgggatagcgggttggtactaggcactcttatttttattctgtttttccgcgcactaggggtcgttttacagacatgggtccttaatcaattcagactggtgccattggataaaattgaccaggtcgtgatgtcctatggagggctgcgcggcgcagtggctttcgctctcgtaatcctgcttgatcgcactaaggtccctgcaaaagactactttgtcgcaactaccatagtcgtcgtattcttcacagtcattgttcaaggacttacaatcaaaccactggtgaagtggctcaaagttaagaggtcagagcaccataagcctacgctgaaccaggagttgcacgaacatacctttgatcatattctggccgccgtggaggacgtagttggccatcatgggtaccattattggagagaccggtgggagcagttcgataaaaagtacctgtcccagctcttgatgaggaggtccgcatacaggatcagggaccagatctgggacgtgtattacaggttaaacattagggacgcaatctctttcgtcgaccagggaggtcatgttttatcttccaccgggttaactctgccatcaatgccttctaggaactcagtcgccgaaacctcagtgactaatctgcttagagaatctggctctggggcctgccttgaccttcaagtgattgacactgttcgctcgggcagggacagagaagacgctgtaatgcaccatctgttatgtggaggcctgtataagccacgtcgtcggtacaaagcctcatgttcacggcacttcatttccgaggacgctcaagagcgccaggataaggaggtgtttcagcaaaacatgaagagacggcttgaatcttttaagtcaactaaacataacatatgttttaccaagtccaagccgaggccccggaagactggtcgcaggaaaaaggacggcgtggccaacgcggaggcgacaaacggcaagcaccgaggtctgggcttccaagacacagccgccgtcatcctaaccgtggagtccgaggaggaagaggaggaaagtgacagcagtgagacagagaaggaggatgatgagggtatcattttcgtcgcccgcgccacctcggaggtgcttcaggaaggaaaagtgagcggctctctagaggtgtgcccaagccctcgcatcattccgccctcccccacctgtgctgagaaggagctgccatggaagtcaggccagggggacttagctgtgtatgtatctagcgagaccaccaagatcgtaccagtggatatgcagactggctggaaccagagcatctctagcttggaaagcctggcaagcccgccctgcaatcaggcccccattctgacctgtttgcctccccatccgcggggcacagaggaaccccaagtcccactgcatctcccctcagaccccagatctagctttgcctttcccccttccctggcaaaagcagggaggagtaggtccgagagctccgccgatctaccccaacaacaggagctccagccccttatggggcacaaggaccatacacatttatcgccaggtacagcaacatctcactggtgtattcagtttaaccgggggtctaggctatag

SEQ ID NO: 206467 - DNA, 1308 bp, Artificial Sequence
  Description of Artificial Sequence: Synthetic coding sequence
atgcggcggagcgcctaccggatccgggaccagatctgggacgtgtattatcgtttgaacattcgcgatgccatcagctttgtggaccagggtggccatgtgctgagtagtacaggacttacccttccatccatgccgtccagaaatagcgtggccgaaacaagtgtcacaaacctgttacgagaaagcggatccggggcttgcctggacctgcaagttatcgataccgttcgatcgggaagagatagagaggacgctgtgatgcatcacctgctctgcggcggcttgtacaaacctcgccgtcgcatagagctgaggaccgagccttgcggcatgttattgaaaacctttctgcagacagacatggaccaggctttcctgggcaccaagccagctgccgttgccacaagcagccagaggatgcggagatctggtaggacaaggcgcagttcctcccgcatgaaaagaagacttgagagcttcaaatcaactaaacacaatatttgctttaccaagagtaagcccaggcctaggaagactggacgcaggaaaaaggacggcgtggctaatgccgaagcgactaacggaaaacatcgcggtctcggatttcaggacaccgctgcagtcattctaactgttgagagcgaggaggaagaagaggagtctgacagcagtgaaacggaaaaggaagacgatgaaggcataatctttgtagctcgtgctacatctgaagtgctgcaagagggaaaggttagcggtagtctcgaagtctgtcctagccctcgcattatccctccaagccctacctgtgccgagaaagagctaccctggaagtcggggcaaggcgatttggcagtgtatgttagtagtgagactacgaagattgtgccagtggacatgcaaacgggctggaatcagtcaatatcttcattggagtccctcgctagccctccctgcaaccaggccccaattttgacctgcctgcctcctcatccaagaggcactgaagagccccaggtacctctgcatcttccaagtgaccctcgctccagcttcgcatttccccccagcctcgccaaggctgggctcgccgtccgtgccgctctaacgtcccctagcagtcgaagttgtagccccagctgggctacccgaaccacacccattagtgcccaggcccctctgcctcccacgggagcctcctcgtccaccgaagcagctgggtgttcctctcgccccagagggggggcaggaggtggtattcctgttggatccgcaccctgggtaatgggtagggccctagaaacatag

SEQ ID NO: 206468 - DNA, 2106 bp, Artificial Sequence
  Description of Artificial Sequence: Synthetic coding sequence
atggcccggcggggctggcggcgggcccccctgcggcggggcgtgggttccagtccacgggcaagacgactcatgcgcccactgtggttgctcctggccgttggagtctttgactgggccggcgccagcgacgggggcggaggggaggcccgagctatggacgaagagattgtgagtgaaaagcaggctgaggagagtcaccgtcaggatagtgccaacttgctgatcttcatcttgttgctgaccctgactatcttgactatttggttgtttaaacaccgcagagcccgctttttgcacgagaccggacttgccatgatctacggcttactggtgggccttgtgctaaggtacggaattcacgttccctcggatgtgaataatgtgactctatcctgcgaggtacagtctagcccaacaacgttattagttaacgtgtcaggaaaattttatgaatatatgctgaaaggggagattagcagccacgagcttaacaacgtccaagataatgaaatgctgaggaaggtgacctttgaccctgaggtttttttcaacatcctcctgccaccaatcatcttctatgccggatattctcttaagcgtagacacttcttcagaaatcttggctcaatacttgcctatgcgttcctgggcaccgccatttcctgcttcgttatagggagcattatgtacgggtgcgtgactttgatgaaggtcactgggcagcttgcaggggatttctatttcactgactgcctcctgttcggggctatcgtcagtgccacggaccccgtcacagttttagcaatctttcacgagctccaggtcgatgttgagctttacgccctcctgttcggcgagagtgtactgaatgacgctgtcgccatcgtcttaagctctagcattgtcgcctaccaaccggcgggagataattctcatacattcgatgtcacagcaatgttcaagtctataggcatcttcttaggtatctttagtgggagtttcgccatgggcgctgccacaggtgtcgtaaccgccttggtgacaaagtttactaagctacgcgagtttcagcttctggagactggcctgttcttcctcatgagctggtctaccttcttgctggccgaggcttgggggttcacaggagtggtcgcagtgctgttctgtggtatcactcaggcccactacacctataacaacctctctaccgagtcacagcaccggaccaaacaactgttcgagctgctgaacttccttgccgagaattttattttctcatacatgggattgaccctgttcaccttccagaaccacgtctttaaccccacttttgtggtgggggcctttgtagccatctttctgggccgggccgctaacatctaccccctgtcactgttgttgaatctggggcggcgttctaagattgggtccaattttcagcatatgatgatgttcgccggtctccggggcgccatggcgtttgcactcgccatccgcgacacggctacgtatgctcgccaaatgatgttttccacgaccttgcttatcgtgttcttcacagtttgggtattcggtggagggaccacggcaatgctgtcttgtctgcacatcagggtgggggtggactccgatcaggagcatttaggagtacctgagaacgagcgcaggacaaccaaggccgagagcgcctggctgtttagaatgtggtacaattttgatcacaattatctgaaacctcttctaacacactccggacccccactgacaacaacccttcctgcctgttgcgggcctatcgcccggtgtctaaccagtccccaagcttacgaaaatcaggagcagttgaaggacgacgactcagacctgatcctgaatgacggcgatataagtctcacttacggtgattcgacggtgaatactgaacctgcaaccagctcagccccaagaaggttcatgggaaattcatctgaagacgcacttgatcgggagttggcttttggggaccatgagctcgtgattcggggaacgaggttggttctgcccatggacgatagcgagccaccactgaatctgctagacaacacgcggcatggacccgcatag

SEQ ID NO: 206469 - DNA, 2010 bp, Artificial Sequence
  Description of Artificial Sequence: Synthetic coding sequence
atggcccggcggggctggcggcgggcccccctgcggcggggcgtgggttcctccccccgggctcgaagactgatgaggccattgtggctgctgctcgcagttggagtgtttgattgggcaggtgcatctgacggagggggcggcgaggcgcgagccatggatgaggagatagtatcagagaaacaagccgaggagagtcaccgccaggactctgccaatctattgatctttatcctcctccttacgctgacaattctgaccatttggctgttcaaacatcgaagggcccgctttttgcacgagacaggtcttgccatgatttacggcctgctggtaggcctagttctacgatatggcatacacgttccaagtgatgtgaacaacgtgaccctctcctgtgaagttcagtcttccccgacaacattactggtaacctttgaccctgaagtctttttcaacattttgctccctcccataatattctatgcagggtattcattgaaacgacggcactttttcagaaatctaggctctatcctggcatacgcctttctcgggacagctattagctgcttcgtcataggtagtattatgtatgggtgcgtgacactcatgaaggtaaccgggcagttggccggcgatttttattttacggactgtctcctcttcggtgcaatcgtttcagctaccgatcccgtgaccgttctcgccatttttcacgagttacaagttgacgttgaactgtacgccttactgttcggggagagcgtcctgaatgatgccgttgccatcgttcttagcagttcaatcgtcgcctaccaacctgctggagacaacagccatacctttgatgtgaccgccatgtttaaatccatcgggatctttctgggcattttcagcggatcattcgcaatgggggcagccactggcgtggtgactgccttggtaacaaagttcaccaagttaagagagttccaactgcttgagacagggctgtttttcctgatgtcctggtcaacgttcctactggctgaagcgtggggcttcaccggggtcgtggctgtgttgttctgtggcatcacacaggcacactacacctataataacctctctaccgagagccagcacagaactaagcaactgtttgagctgctgaattttctggccgaaaacttcatttttagctacatgggtttaaccctctttaccttccagaaccacgtcttcaaccctacttttgtggtgggcgcctttgttgccatcttcctcggtcgggctgctaacatttatcctctgtccttgctgctcaacctcggacgaaggtctaagatcggttccaatttccagcatatgatgatgttcgcaggattgagaggagccatggcctttgctctcgcaattagagacaccgccacctatgctaggcagatgatgttcagcacaaccctgctgatcgtgtttttcactgtgtgggtgttcggcggtggaactacagctatgttaagttgtctgcacatcagggttggagtggacagtgatcaggagcacttgggtgtgcctgaaaatgaacggcggacaactaaagcagagtcagcatggctattccgtatgtggtataactttgaccataactatctgaagccgttattaacacatagcgggcccccactgacaacaaccctaccggcctgttgtggacctatcgcgcggtgccttacttcaccacaggcatacgagaatcaagagcagcttaaggatgacgacagcgacctaattctgaacgacggcgacataagcctgacgtatggcgactcaaccgtgaacaccgagccagcaacttcgtcagcacctcgcaggttcatgggaaatagctccgaggacgccctggatcgggagctggctttcggtgatcatgaattagtcatccgaggcactcgccttgttctgcccatggatgacagtgagccaccacttaatcttcttgacaacacgcggcacggtcctgcttag

SEQ ID NO: 206470 - DNA, 1950 bp, Artificial Sequence
  Description of Artificial Sequence: Synthetic coding sequence
atggacgaggagatcgtgagcgagaagcaggccgaggagagccaccgtcaggactccgccaatcttctcattttcattctgctgctgactctgaccatcttgacgatttggctgttcaagcacaggcgggcaagatttttgcatgagactggtctcgcaatgatatatggattgttggttggcctcgtactccggtatggcatccacgttccctcagatgtgaataatgtaacactgagctgtgaggtgcagtcaagtccaacaaccctgctagttaacgtctccgggaagttttatgagtacatgctcaagggggaaataagctctcatgaacttaacaacgtgcaagacaatgaaatgctccggaaggtgacctttgatcctgaggtgttctttaacatactgctgcccccaatcatcttctacgcgggttattctctgaaacggcgacatttcttccgcaacctaggttccatccttgcttatgcctttctcggcacggccatttcttgcttcgtaatcggctcaatcatgtacggctgtgtcaccctaatgaaggtcacagggcagctggcgggcgacttctacttcacggactgtctgctgtttggcgccattgtgtctgccacggacccagtgacagttctcgccatttttcacgaacttcaggtcgacgtggaactgtacgctctgctcttcggagagagcgttcttaacgacgccgtggccatagtgttatcaagcagcattgtagcctaccagcctgccggagataactcccacacctttgatgtcaccgctatgttcaaatctatcggcatctttttgggcattttttccggttctttcgcaatgggcgcggcaacaggcgtggtgaccgccctggtgacaaagttcactaagttgagggagttccagctgcttgagacagggctcttcttcctgatgagttggagtacgttcctcctggccgaagcctggggtttcaccggcgtggtcgcagtcctattctgtggcattacccaagcacactacacttataacaatctgtcgaccgagagccagcatcgcaccaaacagctcttcgagctgctaaactttctcgcagagaacttcatattctcatacatgggtttaactctcttcaccttccagaaccacgtgtttaaccccacctttgtggtcggggcctttgtcgccatcttcctgggacgggccgccaatatttatccgctctccctgcttctaaatctgggacgacggagcaagatcggctccaacttccagcacatgatgatgtttgcaggactgaggggggctatggctttcgcgctggcgatcagggacactgctacttacgcccgacagatgatgtttagcacaacccttctgatcgtctttttcaccgtgtgggtgtttgggggtggcacaacagctatgctaagctgcctacatattcgagtcggggttgattccgatcaggaacacctgggagtgcccgaaaacgaacgacggaccaccaaagctgaatctgcctggctgttccgcatgtggtacaatttcgatcataattatcttaaacctttgctgacccactctggcccacctcttaccaccacgctcccagcttgttgtgggcccatcgctaggtgcttaacctctccacaagcatatgaaaaccaagagcaactcaaggacgacgattccgatctgattctgaacgatggggatataagtctgacctacggtgactctacagtgaacaccgagcccgcaacaagttccgcgccacggagatttatgggaaatagctctgaggatgccctggatagggagttagcctttggagatcatgaactcgtgatccgaggcacacgtctggtcctgccgatggatgactccgagcccccactgaacttactggataatacgaggcacggtcccgcctag

SEQ ID NO: 206471 - DNA, 2178 bp, Artificial Sequence
  Description of Artificial Sequence: Synthetic coding sequence
atggagcccggcgacgccgcccggcccggcagcggccgggccaccggcgcccccccgcctcgactgctcctgcttcccttactgctcggttgggggctgagagtcgcagcagcagcttccgcatcctcaagtggagctgctgcagaagatagtagcgccatggaggagctggcaaccgagaaggaagctgaagaatcacaccgccaggacagcgtctccctcctgacattcatccttttattaactttgacaatactgacaatttggctcttcaaacatcggcgtgtgcgatttctccacgagaccggcctagccatgatttacggcctcattgtgggggtgattttgaggtatggaacccctgctacctccgggagagacaagagccttagctgcacgcaagaggatcgcgccttctctacactgttagtgaacgtctccggtaagttctttgaatataccctcaagggagagataagtcctggcaagataaattctgtcgagcagaacgatatgctgcggaaagtgacattcgaccccgaggtgttttttaacattctgcttcctcccatcatctttcacgccggctatagccttaaaaagagacattttttccgaaacctggggagtatcctggcctacgcatttttgggcacagctgtctcctgctttattataggaaatcttatgtacggagtagtcaagctgatgaagattatggggcaactgtccgacaaattctactacacagactgtcttttttttggggctatcattagcgcgacggatccagtgaccgtgctcgccattttcaatgagctacacgctgacgtggatctgtacgccctgctgtttggagaaagcgttctaaacgatgcagtagctatagtcctctccagctctatagtggcctatcagccagccggactgaatacgcatgccttcgacgccgcggcattttttaaatctgtaggaatattcctgggaatcttcagcggaagctttacaatgggcgccgtgacaggtgtgaatgccaatgtcaccaaattcaccaagctacattgcttccctctcctggagacggcgttatttttcctgatgtcatggtccacatttttactggcggaggcctgcggattcaccggcgtggtggccgtgcttttttgtgggatcacccaggctcactacacatataataatctcagtgtggaaagtcgctcacggacaaagcagttgttcgaggtactgcatttccttgctgaaaatttcatcttttcttatatgggactggcactttttacttttcagaagcacgtttttagtcccatcttcattataggggcattcgttgccatctttctgggacgtgcggcgcatatttacccactctctttttttctgaaccttggccgtcgccataaaattggttggaacttccagcacatgatgatgttcagtggtttacgcggggcaatggcattcgccctagccattagggatacagctagctacgcaagacagatgatgttcaccaccacattgctgatagtctttttcactgtgtggatcatcggtggcggcaccaccccgatgttgtcctggttgaatattcgcgtgggagtggaggagccatctgaggaggatcagaatgaacaccactggcagtatttccgcgtgggagtcgaccctgaccaggacccgcccccgaataatgatagttttcaggtgttgcagggcgacggaccagactctgctcgcgggaacaggactaagcaggagagtgcatggatattccggctgtggtacagcttcgatcacaattatcttaaaccgatccttacacacagcggcccccctctgacaactacgcttcctgcatggtgtgggctcctcgcccgatgtctgacatcacctcaggtctacgataaccaggagcccttgagggaggaagactctgatttcatcctgactgaaggcgacctgacactcacatatggagacagcaccgtgacagcaaatgggagcagttctagccataccgcctcaaccagcctggagggttctcgccgtactaaatcctcaagtgaggaggtgctggaaagagatctaggcatgggcgaccagaaggtctcctctcgcggaacccgtctggtctttcctctggaagataacgcctag

SEQ ID NO: 206472 - DNA, 1746 bp, Artificial Sequence
  Description of Artificial Sequence: Synthetic coding sequence
atgggcgagaagatggccgaggaggagcggttccccaacaccacccatgagggattcaatgtgactctgcacactactctggtcgtgacaactaagctggtgctccccaccccaggcaagccaatcctgcctgtgcagactggcgaacaggctcaacaggaggagcagtctagcggcatgaccatcttcttctccctactagtgctggccatctgcatcatccttgtccatctgttaattcggtaccgactgcactttcttcctgagtccgtcgctgtggtgagtctgggaattctcatgggcgcggtgatcaagatcattgaattcaaaaagctggctaattggaaagaggaggagatgttccgcccaaatatgttctttctactgctgctgcccccgatcattttcgaatccggttactcattacataagggcaatttcttccagaatatcgggtctataacactttttgcagtcttcggtacagcaataagcgcttttgttgtcggcgggggaatttattttttaggacaggctgacgtcatttctaagctcaacatgacggattcgtttgcatttggcagcctgatctccgctgtcgatcctgtcgccacgatagccattttcaacgccttacatgtagaccccgtgctgaatatgttggtgttcggtgagtccatcctgaatgacgctgtgagcatcgtactgaccaacaccgccgagggcttgacaagaaagaatatgtcagatgtgtctggatggcagacctttctgcaagccttagattattttttaaagatgttcttcggctctgctgctctgggcaccctcacaggacttatatctgcactggtgctcaaacatatcgatctgcggaaaacccctagcctcgagtttgggatgatgattatcttcgcgtacctcccctacggcctggcagaggggattagtctgagcggaattatggcaatcctgttttccggaattgtgatgagccactatactcaccacaacctgtcacctgttacccaaatattgatgcagcaaaccctacggaccgtcgcctttctctgtgaaacgtgtgtattcgcatttctcggcctatccatcttttctttcccccacaagttcgaaattagctttgtgatctggtgtattgttctggtactcttcggccgcgctgtaaatattttccccttgagctacctgcttaatttcttcagggatcacaaaatcacccctaaaatgatgtttattatgtggttctcaggcctgaggggagccattccctatgccctgtccctccatctcgacttagagccgatggagaagcgacagttgataggtaccacaaccatcgtgatcgtgctgttcacaatcctcttgctgggcggatctaccatgcctctgattcgcctgatggacattgaggacgcgaaggctcacagacggaataagaaggacgtgaatctgtcaaagaccgagaagatgggaaacaccgtggagagcgaacacctctccgagctgacagaagaagaatacgaagcacactacatcaggcggcaggatctaaaaggattcgtgtggcttgacgccaagtatctgaatccttttttcacccgacggttgacccaggaggacctgcaccatgggagaatccagatgaaaacacttactaataaatggtacgaggaagtgcggcagggtccatccggtagtgaggacgacgagcaggaactcctgtag

SEQ ID NO: 206473 - DNA, 1794 bp, Artificial Sequence
  Description of Artificial Sequence: Synthetic coding sequence
atgggcgagaagatggccgaggaggagcggttccccaacaccacccatgagggctttaatgtgactctccatacaacactcgtcgtgacaaccaaactcgtgctgcccactccaggtaagccaatccttcccgtgcagacaggtgaacaggcgcaacaggaggaacagtcaagtggaatgactatattcttctccttgttggtccttgctatctgtattatcctcgtacacttgctgattagataccgtcttcattttttaccagaatccgtagctgttgtatctctgggcatcctgatgggcgctgtaatcaagattatcgagttcaagaaactggcgaactggaaagaagaggaaatgtttcggcccaatatgttcttcctacttctgctccctccaatcatattcgagagcgggtacagcctccataaaggaaacttctttcaaaacattggatcaattaccctcttcgctgtcttcgggacagctatcagcgccttcgtggttggcggaggtatttactttctaggccagggattttttttcgtgtgcgtgtgtgtgttcgtgtgttttatcctgcaagccgacgtgatcagcaagctcaatatgacagacagcttcgcatttgggagcttaatctcagctgtagatccggttgccactatcgcaatcttcaacgcactccacgtggatccagtgctgaatatgttggtattcggcgaaagcatcctcaacgatgccgtgtctatcgttctgacgaacaccgccgagggcctgaccaggaaaaacatgtcagatgtgtccggctggcagaccttcctccaggccttagactatttcttaaagatgttctttggctcagccgcattagggactctgaccgggctgataagcgctttggttctgaagcacatcgacttgcggaagacaccttccttggagtttggtatgatgatcatctttgcctaccttccttatggcctcgccgaaggtatctcattgtcaggaattatggctatcttattcagtgggattgtcatgtcccattacacccaccacaatctgagccctgtcacccagattctcatgcagcagaccctgaggaccgtcgccttcttatgcgaaacctgcgtgtttgcttttctaggcttgagtattttttcctttcctcacaaattcgaaatatcatttgtcatctggtgcatcgtgttggtgctgttcggtagagctgtaaacatattccccctgtcttatctgttgaacttttttagggaccataagattacccccaaaatgatgtttataatgtggttctccggactgcgaggtgcgattccgtacgcgctgtcgctgcacctggacctagaacctatggaaaaacgccagctgatcggcactacaaccattgtgatcgtgctgttcacaatactactgttgggtgggtcaaccatgcccctaatcaggctgatggacattgaagatgcaaaagcccaccgcaggaataaaaaggacgtgaacctaagcaaaactgagaagatggggaacacggtcgaatctgaacatctcagcgagctaaccgaagaggagtacgaagctcattatatccggcggcaagatctgaagggattcgtgtggttggatgccaagtatctcaaccccttcttcacccggaggctgacacaggaggacctgcatcacggcaggattcaaatgaagactctgactaataaatggtacgaagaggtgcgccagggtccctcagggtccgaggatgatgaacaggaacttttatag

SEQ ID NO: 206474 - DNA, 1089 bp, Artificial Sequence
  Description of Artificial Sequence: Synthetic coding sequence
atgctggtgttcggcgagagcatcctgaacgacgccgtgagcatcgtcctcacaaatactgcagagggcctgacacgtaaaaatatgagcgatgttagtggctggcaaacctttttgcaggccctggactatttcctgaagatgttctttgggagcgctgccctgggaacgctaacggggctgattagcgcccttgtactaaagcatattgatctgaggaagacccccagtctggagttcggcatgatgatcatcttcgcataccttccctacggtctggccgaagggatcagtctttcaggaatcatggcgatcctcttttccggtatcgtgatgagccattacacgcatcataatctttctcctgtgacccagatcctgatgcagcagacactgcggacagtggcctttctgtgcgagacctgtgtgttcgccttccttgggctgtcaattttcagctttccccacaagttcgaaatttctttcgttatttggtgcattgttctggtcctatttggacgcgcggtgaatatctttcctctgagttacttgctgaatttcttccgagaccataaaatcacacccaagatgatgttcatcatgtggtttagcggccttcggggagcgattccatatgctctttccctccacctggacctggaaccaatggagaaaagacaactgatcgggacaacaactattgttattgtgttatttacgattcttcttctcggcggctctaccatgcctctcatccggttaatggatatcgaggacgcaaaggcacacagaagaaataagaaagacgttaatctgtcaaaaacagaaaaaatgggaaacacggtcgagagtgaacacttatctgagctgaccgaggaggagtatgaagcccattatatacggagacaggatctcaaaggcttcgtatggctggatgcaaagtatcttaatccgttcttcactagaagactcacccaggaagatttgcaccacggacgcatccagatgaagaccttaacaaataagtggtatgaggaggtgcggcagggtcctagcggctccgaggacgatgagcaggagttactgtag

SEQ ID NO: 206475 - DNA, 846 bp, Artificial Sequence
  Description of Artificial Sequence: Synthetic coding sequence
atgatgatcatcttcgcctacctgccctacggcctggccgagggcatctccctgagcggaatcatggccatccttttcagtggcattgttatgtcacactacactcatcacaacctctcacccgtgacccagattctaatgcagcagactcttcgtacagtagcatttctctgtgagacctgcgtgttcgctttcctcggattgagtatattctcatttcctcacaagttcgaaatcagctttgtgatctggtgcatcgttctcgtgttattcgggagggctgtgaacatctttcctctcagctatttgctgaatttttttagagaccacaaaattactcccaaaatgatgttcattatgtggtttagtggactccgcggggctatcccttacgcattgtcactccatttggatctcgaacccatggagaaacgtcagctgattggtactaccaccatcgtcattgttctgtttaccatcttgctgctaggtgggtctactatgcctttgatccggctgatggacatagaggacgcaaaggcccaccgcaggaataagaaagatgtgaaccttagtaagacagagaagatggggaatacggtggaatcagagcacctttccgagctgacagaagaggaatacgaagcccactatattaggcgacaggacttgaaaggttttgtctggctggacgccaagtatctgaatccgttcttcactcgcagattgacacaggaggacctgcatcacgggcggattcagatgaaaactctgaccaacaaatggtatgaggaggtgcgccagggccccagcggcagtgaggatgatgaacaggaattgctgtag

SEQ ID NO: 206476 - DNA, 1938 bp, Artificial Sequence
  Description of Artificial Sequence: Synthetic coding sequence
atggagcggcagagccgggtgatgagcgagaaggacgagtaccagttccagcatcagggtgcggtggagcttctggtgtttaacttcctgctaattttaaccatcctgaccatatggctgtttaagaaccatagatttcggttccttcacgagaccgggggggcaatggtttacggcctgatcatggggctcattttgcggtacgcaaccgcacctactgacatcgaaagcggtactgtgtacgattgcgtgaagctaaccttttcacccagcaccctgctggtcaatatcactgaccaggtatacgaatataaatataaaagggagatctcacagcacaatatcaacccacatcagggaaacgcaattcttgagaaaatgaccttcgaccccgagatcttctttaacgtcctgttgccccccattatctttcacgcagggtactcactgaagaaacgccacttttttcagaacctggggtctatccttacttatgcttttctcggaacagccataagctgtatcgtcatcggcctcataatgtatggattcgtaaaagcaatgattcacgcggggcagcttaagaacggcgatttccatttcactgactgtctctttttcgggagcttaatgagcgccactgatcccgttaccgtcttagccatcttccatgagctgcatgtcgacccagatctgtatacgctgctttttggcgaatccgtccttaacgacgcagtggcaatcgtactgacatatagcatcagcatctacagcccaaaagagaatccaaacgcatttgacgcagcggccttctttcagtctgtcggaaattttctagggatattcgctgggtcttttgcgatgggatcggcgtatgctatcattacagctttgttgacaaagttcacaaagctgtgtgaatttcctatgttagagacgggtctgttcttcctgctgtcgtggagtgcctttctttctgcagaggccgctgggctcacagggattgtggctgtcctgttttgtggtgttactcaggctcactacacctataataacctttcttcagacagcaagatacgaacaaagcaactcttcgagttcatgaacttcctggccgagaatgtgatattctgttacatgggactagcactattcacatttcagaatcatatcttcaacgctctgttcattctgggtgcgtttttagctatttttgtcgccagggcgtgcaacatctaccctctgagttttctcctgaatctgggcagaaagcaaaagataccatggaatttccagcacatgatgatgttctcaggcctacgcggggcaattgcatttgcacttgccatcagaaacacagagagccagccgaaacagatgatgtttaccacaactctcctgcttgtgttcttcaccgtgtgggtgtttgggggaggcacgacaccaatgttgacttggctgcagatcagagtgggggtggaccttgacgagaaccttaaggaagacccgtcatctcaacaccaggaggccaataaccttgacaagaacatgacgaaagccgagtcagctcgactgtttcgcatgtggtacagcttcgaccacaaatacctgaagcccatcctcactcatagcggtccaccacttaccaccacactcccagaatggtgcggaccgatatctcgcctccttacttcaccccaggcctatggagagcagctgaaggaagatgatgttgaatgcattgtgaaccaggacgagctcgcaattaattatcaggagcaggcctccagcccctgttctccacctgcccggctcggcttagatcaaaaggcctcaccacaaacccccggcaaagagaatatctacgaaggagatcttggcttggggggctacgaactgaagctcgagcagaccttgggacagtcccagctgaattag

SEQ ID NO: 206477 - DNA, 978 bp, Artificial Sequence
  Description of Artificial Sequence: Synthetic coding sequence
ctgcggctgcagagcagctgggagcagatgaccttcgaccccgagatcttctttaacgtgctgctaccacccatcatcttccatgcaggttactcccttaaaaaaagacatttttttcagaatttgggtagcatcctcacttacgcgtttcttggtacagcaatcagttgcatcgtgattggacttattatgtatgggtttgtcaaggcgatgatccacgccgggcaactgaagaatggcgattttcacttcaccgattgtctcttcttcggaagcttgatgtccgcaaccgatcccgttactgtactagccattttccacgagttgcacgttgatccggacctctatacactgcttttcggcgaaagcgttctgaatgatgctgttgccattgtactgacgtacagcatctcaatctattctcctaaagagaatcccaacgcctttgacgcagcagctttctttcagagtgtgggcaatttcttaggtatcttcgccggttctttcgcgatggggagcgcctatgccattattaccgcactgctgacgaagtttactaaactgtgcgaattccccatgctggaaacaggactgttcttcctgctgtcttggtctgcgttcctcagcgcggaggctgctggcctcacaggaatcgtggcagtgctgttttgcggcgttactcaggctcactatacctacaacaacctttcatctgatagcaagattcgaactaaacagctttttgagttcatgaactttctggctgaaaacgtcattttttgttacatgggactcgctctgttcacttttcagaaccacatttttaacgcgctgtttattcttggagccttcgtgtcaattttccttgctagagcccacactgaactaaagaacctactgttctttttggcttctttcctgtgttacttctctcatcggtcaaaaggattgccaatggcgggttgtgcgctgccgtag

SEQ ID NO: 206478 - DNA, 3534 bp, Artificial Sequence
  Description of Artificial Sequence: Synthetic coding sequence
atggccggcatcttcaaggagttcttcttcagcaccgaggacctgccagaggttattctgaccttgagccttatatctagcatcggggccttccttaacaggcatctcgaagactttcctatcccggtccccgttattctgtttctgctagggtgctcattcgaggtgctctcctttacttcatcccaggttcagaggtatgccaacgctatacagtggatgtctcccgaccttttcttccggatatttactcccgttgtgttcttcaccaccgcctttgatatggatacctacatgttgcagaagctgttctggcaaatacttctcatatccatcccaggctttttagtgaattacatcctggtgctctggcacctcgcctccgtgaatcagctactcctgaagccaactcagtggctcttgtttagtgcgattctcgtgagctccgatcctatgctgactgcagccgccatccgcgacttagggttgtcccgcagcctaatctcactcattaatggagaatctttaatgacctcagttatttccctgatcactttcactagcatcatggacttcgatcagcggctccaaagcaaaagaaaccacaccctcgccgaggagattgtgggggggatatgctcatacataatagcaagtttcctttttggtattctgtctagcaaactgatccagttctggatgtcaactgtgtttggagacgacgtcaaccacatttcgttaatatttagtatactttacttaatcttctatatctgcgagctcgtgggtatgtccggtatttttaccctggccattgtaggccttctgctgaattctaccagttttaaggccgcgatagaagagacactgctgctggagttctggacattcctgtcccggattgcgttcctcatggtgtttaccttcttcggcctgctgatccctgcgcatacctacctctatatagaatttgtggacatttactactccctgaacatttacctgactcttatcgtacttcgctttctgacactattgctgatctctccagttctcagcagagtggggcacgagttctcctggcggtggatttttatcatggtatgcagcgaaatgaaagggatgcctaacatcaacatggctctgctcctcgcctatagcgatctctacttcgggagcgacaaggaaaagtcacagatcctgtttcatggtgttctggtgtgcctaatcactctggtggttaacagatttatccttcctgttgcagtaacaattctgggactaagggacgctacaagtacaaagtacaagtcagtgtgctgtacattccagcactttcaagagctcaccaaaagcgcagcgagcgctttaaaattcgataaggaccttgccaatgcagattggaacatgatcgagaaggctattaccttggagaacccttatatgctgaacgaagaggagacgactgagcaccagaaagtgaagtgccctcattgtaataaagagattgacgaaatcttcaacactgaggcaatggaactggccaataggaggcttttgtctgctcagattgcatcctatcagcgccaatacaggaacgagatcctgagccaatccgctgtgcaagtcctggtgggggctgctgagtcctttggcgagaaaaaaggcaagtgtatgagtctggataccatcaaaaattattctgagtcccaaaagaccgttacatttgcaaggaaactgctgctgaattgggtctataatacaagaaaggagaaggaaggccctagcaagtacttcttcttccgtatctgccatacaatagtcttcaccgaggagttcgagcacgtcggctacctcgtaattcttatgaacatctttccttttataatcagttggatatcacagttgaatgtcatctaccacagcgaactcaagcatactaactattgtttccttactctatacatcctggaggcacttctgaagatcgccgccatgcgcaaggacttttttagccacgcttggaacattttcgaactggccatcactctgatcggcatcctccacgtcatcctgatcgagatcgacacgatcaaatacattttcaatgaaacagaagtaattgtatttattaaagtggtgcagttttttcggatattgcgcattttcaagttaatcgcgcctaagctccttcaaatcatagataagaggatgtctcatcagaagacattctggtatggcatcctgaagggatatgtacagggcgaggctgatattatgacgattatagaccagataacatctagcaaacagataaaacaaatgcttcttaaacaggtgatcagaaacatggagcatgccatcaaggagctgggttacctcgagtatgatcaccccgagatcgccgttaccgtcaaaactaaggaagagattaacgtcatgttgaacatggctaccgaaatccttaaagcttttgggttgaaaggaattatctctaagactgaaggcgccggaataaacaagctcatcatggcaaaaaaaaaagaggtactagactctcagtccatcatacgccctctgactgtggaggaggtcctttatcacattccgtggctggataaaaataaggactatataaatttcatccaggaaaaggcaaaggttgtcactttcgactgcgggaatgacatcttcgaagaaggcgacgaacctaaggggatctacattattatctcggggatggtaaagctggaaaagtctaagccaggactgggcatagatcaaatggtcgagtctaaggaaaaggatttccccatcatcgacacagactatatgttgtcaggggagattattggtgaaatcaactgcttgaccaatgagccaatgaagtactccgctacctgtaagacggtcgtggagacctgtttcattcctaagactcatctgtacgacgccttcgagcagtgcagcccactgattaagcagaagatgtggctaaaactaggtctcgccattactgccagaaaaatcagagagcacctgagctacgaggactggaattataacatgcaactgaagttatccaacatctatgttgttgacattcctatgagcactaagaccgacatctatgacgaaaatctcatatacgtgatcctgatccatggggcagtggaagattgtttgttaaggaaaacatacagggctccctttctcattcctatcacctgccaccagatccagtcgatagaggatttcacaaaggtagttataatccaaacacctattaacatgaagacttttagacgcaatatacggaagttcgtgccaaagcataaatcatacctgacacccggcttgatagggtccgtgggaacattagaggaggggatacaggaggagcgcaacgtaaaggaggacggcgcccacagcgcagccacagctcggagccctcagccttgctccctgttgggaacaaagttcaactgcaaagaaagccccagaatcaatcttaggaaggtccggaaagaatag

SEQ ID NO: 206479 - DNA, 3390 bp, Artificial Sequence
  Description of Artificial Sequence: Synthetic coding sequence
atggccggcatcttcaaggagttcttcttcagcaccgaggacctgccagaggtgatcctgacactgtcgctcatctcctctattggcgcctttctcaatcgccatctcgaggattttcccatccccgtacccgtgattctgttccttctgggttgcagctttgaagtgctttcttttacctcaagccaggtacagcggtatgcaaacgctatccagtggatgagtccggaccttttctttagaattttcacaccagtggtgttcttcacaacagctttcgatatggatacatacatgttgcagaagttattctggcaaatcctgctgataagtattcctggctttctcgttaattatatcttagtcctgtggcacctggcctcagtaaatcagttgctgctgaaaccaacccagtggttactgttttcagcaatcctcgtgagctctgatcctatgttgacagcggccgcaattcgggacttaggactcagcagatccctgataagtctgattaacggagaaagtctcatgactagcgtgatcagcctcataacgttcacaagtatcatggacttcgaccagcggttgcaaagcaagcgaaaccatacactggccgaggaaattgttggcggcatctgtagttacattattgcgtcatttctatttggcatcctcagttcgaagctgattcagttctggatgtccactgtgttcggcgatgatgtaaatcatattagcctgatttttagtatcctttacctgattttctacatttgcgagctcgtggggatgagcggcatattcacccttgcaattgtgggtctgctgctgaattccacctcctttaaagcagctattgaggagacccttctcctggaattcctgaccctgttgctcatttcgccagtgctatctagggtcggacatgagtttagttggcgctggatcttcattatggtttgctctgagatgaaagggatgcctaacattaatatggccttgctgctggcatacagtgatctttattttgggagcgataaggagaagtcccagattctctttcatggagtactagtatgcctaatcacacttgtcgtgaaccgctttatcttgcctgttgcggttaccatccttggcctgcgagacgccaccagcactaaatataagagcgtatgttgtacgttccaacactttcaagaactcactaaaagtgcagctagcgctctcaaattcgacaaggatctggcgaatgccgactggaatatgattgagaaggctattactcttgagaatccttatatgttaaatgaagaagagacaactgaacaccagaaagtgaaatgccctcattgtaacaaggaaattgatgagatattcaacacagaagcaatggaattggccaaccgcagactgctgagtgcacagatcgccagctatcaacgtcaatatagaaatgagatcctgagtcagagcgccgtgcaagtactggtcggagccgccgagagtttcggcgaaaaaaaaggaaagtgcatgtccctcgatacaatcaagaattatagtgaaagccagaagactgttacctttgcgaggaaattactgctaaactgggtgtataacaccagaaaggaaaaagaaggcccatctaaatattttttcttccgcatctgccacacaatcgtatttaccgaggaatttgagcatgtggggtatctggtcatccttatgaatatttttccatttattattagctggattagtcagctgaatgtgatataccactctgagttaaaacataccaattattgctttctgaccctgtatatactcgaagccttgcttaagattgctgcaatgaggaaagactttttttcccatgcctggaacattttcgaacttgccattacactcatcggtatcctccatgtaattctgatcgagattgacactattaagtacattttcaacgagactgaagtgatagtgtttatcaaggtagtccaattctttcggatcctgcgcatctttaagctgattgctcctaagttgctgcagattattgacaagcggatgtcacaccagaagacattttggtatggtatcctgaagggatatgtgcagggcgaagctgacatcatgactatcattgatcagataacaagctcaaagcagatcaaacagatgttactgaaacaggtcatccgaaatatggaacatgctatcaaagagctgggctacctagaatatgaccaccccgagatcgcggtgaccgttaaaaccaaggaagaaatcaacgtgatgttaaatatggccaccgagatccttaaagcttttggcctcaaaggcattatcagtaaaaccgagggagctggcattaataaactcataatggctaaaaagaaggaggtgttggactcacaatctatcatccggccactcaccgtcgaagaggtgctctatcacatcccatggctggataagaacaaggactatattaactttatccaggaaaaggccaaagttgtgacatttgactgtggcaatgatatctttgaagagggcgatgagcccaagggcatctacattatcatctcagggatggtcaagctggagaagagtaagccgggcctcggtattgatcaaatggtggagtccaaagagaaagattttccgattatcgataccgactatatgctatctggggaaatcatcggcgagatcaactgcttgaccaacgaaccaatgaaatactcagctacatgcaagacagttgttgagacgtgctttattccaaagacccacctatacgacgcattcgaacagtgcagtcccctgatcaaacagaaaatgtggttgaaactgggactggctatcaccgcccgaaaaattagggaacatctctcttacgaagactggaactacaatatgcaattaaagctgagtaatatctatgtagtggatattccaatgtccactaaaaccgacatttacgatgaaaacctcatatacgtgattcttatacacggcgctgtggaagactgcctgctccggaagacttatagagccccattcttgattcctatcacttgtcaccagatccagtctatcgaggactttaccaaggtagttatcattcaaaccccaatcaatatgaagactttcagacgaaacatccgaaagtttgtccccaaacataagtcctacctgactcccgggctgattgggagcgtgggaactctagaagaaggtatccaagaggaacggaatgtcaaagaggacggagcgcacagcgcagcaacagccaggtctccccagccctgctctctcttaggtaccaaattcaattgtaaggaatccccacgcatcaacctccgaaaggtgaggaaagagtag

SEQ ID NO: 206480 - DNA, 2079 bp, Artificial Sequence
  Description of Artificial Sequence: Synthetic coding sequence
atgcagggcaagaagcccggcggcagcagcggcggcggccggagcggggagcttcagggggatgaggctcagcgaaacaaaaagaaaaaaaagaaggtttcctgtttttccaatatcaagatattcttggtgtcagagtgcgcgctgatgctcgcccaaggtactgtcggcgcctacttggtctctgttctcactactctggaacgccggtttaatttgcagtccgccgacgtaggggtcatagcgtccagcttcgagattggcaatctcgcacttattcttttcgtctcctatttcggtgcccgcggccacagacctcgtctgatcgggtgcggcggaattgtgatggctctgggcgcactactcagcgcactcccggagttcctcacacatcagtacaagtatgaagccggggagatccgctggggcgctgaaggcagagacgtttgcgcggcaaacgggagtggaggagatgagggtccagatcccgacctaatttgcaggaacagaaccgcgacgaatatgatgtatttgttgctgattggcgcccaagtccttcttggaattggagccactcccgtccagccactgggggtctcctacattgacgaccatgtacggcggaaggattcctctctgtacatcggaatcctctttactatgcttgtgttcggcccagcctgcggattcatcctcggatctttctgtacaaaaatctacgtcgatgccgtctttattgacacctctaacctggacatcacaccagacgaccctcggtggatcggggcgtggtggggcgggtttctcctttgcggcgccttgctgttcttctcctcacttctcatgtttgggtttccgcagtcactaccaccccactctgagccagctatggaaagcgagcaggccatgctctctgaacgggagtacgaaaggccaaagccgtcaaacggagtcctgaggcatccccttgaacccgacagcagcgcttcttgctttcagcagctgcgggtgatcccaaaggtgactaaacatctcctgagcaaccccgttttcacttgcatcattctggcagcctgcatggagatagctgttgtggctgggttcgctgctttccttggaaaatatctggaacagcagtttaacttgaccacatcctcggcaaatcagttgctagggatgactgctattccgtgcgcctgtctcggcatatttctggggggcttattagtgaagaaactgtctctgtccgccttaggggcaatccgaatggcaatgttggttaatctggtgagcaccgcatgctacgttagctttctgtttctggggtgtgatactggccccgtcgcgggggtgaccgtaccatacggcaattcaaccgcccccggctctgccttggacccatatagtccatgcaataacaattgtgagtgccaaaccgattctttcactccggtctgtggagctgacggcattacatacctgagcgcgtgcttcgccggttgtaactctactaacctgaccgggtgcgcctgcctaactaccgtgcctgccgagaacgccaccgttgtgcccgggaagtgcccatctcctggatgccaagaggcttttctgacattcctctgtgttatgtgtatctgttcgttgatcggggcaatggcacaaacaccatccgtcatcatactgattcgcactgtcagccccgaactgaagtcctacgcattaggggtattattcctcctcctgcggctgttaggttttatcccgccacccctcatttttggcgcaggaattgattctacttgcctcttctggtcaacattttgtggcgagcagggagcttgtgtgctgtacgataatgtggtgtaccgctacctttacgttagcatcgctatcgcacttaaatctttcgcattcatcctgtacacgactacctggcagtgcctgagaaagaactataaaagatacattaagaaccacgagggcgggctgtcaactagcaccgagtatcaagatatcgaaacagaaaagacatgcccagaaagtcactctccctctgaagactcattcgtgaggtcctag

SEQ ID NO: 206481 - DNA, 2076 bp, Artificial Sequence
  Description of Artificial Sequence: Synthetic coding sequence
atggaccagaaccagcacctgaacaagaccgccgaggcccagcccagtgagaataagaaaactcgctactgcaatggcctgaaaatgttcctcgcagctctgagcttgtcattcatcgctaagaccctgggcgcaattataatgaagtcctctattatacacattgaacggcgttttgagatcagctcctccctcgttggcttcattgatggcagcttcgaaatagggaacctcctggttatcgttttcgtgagctacttcggaagcaagctgcacagaccaaagctgattggaatagggtgttttatcatggggatcggaggagtcctaactgctctaccgcactttttcatgggatattatcgctacagtaaggagactaacattaatagctctgagaacagtacctcaacactctccacatgcctgatcaatcaaatactatcactgaaccgggcgagcccggagatagtggggaaggggtgtctcaaggaatctggctcctatatgtggatctacgttttcatgggcaacatgctccggggtataggggagaccccaatagtgcctctggggctcagttatattgatgattttgccaaggagggacacagcagcctctaccttgggattcttaacgcgatcgcaatgattggccctatcattgggtttacgctgggcagtctcttttcgaagatgtacgtggatatagggtatgttgacctgtcaacaattcgtatcaccccaactgattctcggtgggtgggagcatggtggctcaacttcttggtgagcgggctgttcagcatcatcagctcgattcccttcttcttcctcccgcagacccctaataaaccccagaaagagcggaaggcttccctgtccctgcacgtacttgaaacaaatgatgaaaaagatcagacagcgaacctgaccaaccagggtaaaaatatcacaaagaacgtcaccggcttctttcaaagttttaagtctattctgaccaaccccctgtacgtgatgttcgttctgctgacactcctccaggtgtcttcatatatcggcgcgtttacgtacgtctttaagtatgttgagcagcaatatggccagccaagctctaaggccaacattctactgggcgtaataacgatccctatctttgctagtgggatgttcctgggggggtatattataaaaaaattcaagctaaataccgtggggatcgctaagttcagctgcttcaccgctgtaatgagcctctccttctatcttctgtacttctttatcctgtgcgagaataagtccgtggccggtttgacaatgacatacgacggaaataaccctgtgacttcacatcgtgatgtgccactgagttactgcaactctgactgtaactgtgatgaaagccaatgggaacctgtctgtggcaataatgggatcacctacatctcgccctgtttggccggctgtaaatccagctcaggaaataaaaagcccatcgtgttctataactgtagttgccttgaggtgacaggtttacagaaccgcaattacagtgctcaccttggagagtgtcctcgggatgacgcctgcacaaggaaattctattttttcgtagcgatccaggtgctgaatctcttcttttcagccctggggggcacctctcacgtgatgctcatcgtcaagattgtccagccggagcttaaatccctggcacttgggttccactccatggttatcagagctctgggagggatacttgctccaatctatttcggagccttgatcgataccacctgcatcaagtggtccactaacaattgcggcactcggggcagttgcagaacctataactctacctccttctcacgtgtctatttggggctgtcgagcatgctgagagtctccagcctggtgctttacataatcctgatctacgccatgaagaagaagtaccaggagaaggacatcaacgctagtgagaacggttcggtaatggatgaggccaacttggagtccctgaataaaaacaagcactttgtgcccagtgccggtgcagacagtgagacacactgctag

SEQ ID NO: 206482 - DNA, 2109 bp, Artificial Sequence
  Description of Artificial Sequence: Synthetic coding sequence
atggaccagcaccagcacctgaacaagaccgccgagagcgccagctcggagaagaaaaaaactagaagatgcaatggctttaagatgttcctggcagccttgtcattttcatatatcgccaaagcactgggagggattatcatgaagatttcaatcacacagattgaaaggagattcgacatcagcagcagtctggccggcctaattgatgggagctttgagatagggaacctgctggtaattgtgtttgttagttactttggcagtaagctccaccgtcccaagctgataggtattggatgcctgttgatgggcacaggttctattttaacctcactcccccacttcttcatggggtactaccgatatagtaaagagactcacataaacccatccgagaactctactagctcactgtctacatgtctgatcaaccagaccctgtcctttaatggtactagtccagaaatcgttgagaaggattgcgtgaaagaaagcgggagccacatgtggatttatgtgtttatgggcaatatgttgcgcggtataggtgaaacccctatcgtgccattgggcattagctacattgatgatttcgccaaggagggacactccagcctctacctgggtagtcttaatgctatcggcatgataggcccagtgataggatttgccttgggtagtctcttcgccaagatgtacgtggatatcggctatgtcgacctctctaccattagaattactccgaaggattcccgatgggtcggggcctggtggctgggcttcctggtgtctgggctgttttccattatcagctccattccctttttcttcttacccaaaaatcctaataagccccagaaggagcgaaaaatcagcctgtctctgcatgtgcttaagaccaacgacgatcggaaccagacggctaatctcacaaaccagggcaagaacgtgaccaaaaacgttacagggttttttcagagcctgaagagtatcctaaccaaccccttatatgttattttcctgctgctcacattactgcaggtgagctctttcatcgggagctttacgtatgtattcaaatacatggagcagcagtacggccagtcagcctctcacgcaaattttctgctgggcatcatcactatacctactgtggccacaggcatgttcctaggggggttcatcattaagaaattcaaactctctttagtgggaattgccaagttttcttttctgacttctatgatttcatttcttttccaacttctctactttccacttatctgcgagtctaagagcgtcgctggcctcacactgacttacgacggaaataactccgtggccagccatgtcgacgtccctctctcttattgcaacagcgagtgtaattgtgacgagtcccagtgggagccggtatgcggcaataatgggattacctatcttagcccatgcctggcagggtgtaagagcagttctggcataaaaaaacacacggtcttttacaattgctcgtgcgtagaggtcaccggactacagaaccggaactattctgctcatttaggagagtgcccacgcgataatacttgtaccagaaaattcttcatctacgtcgccatccaagtgatcaatagtttgttttccgcaaccgggggaaccacatttattcttctcaccgttaagatcgtacagccagagctaaaagccctcgcgatgggtttccaaagtatggtgataagaacactgggtgggatcctggcgccgatatactttggggccctgatagacaagacctgtatgaaatggtcaaccaacagttgtggagcacagggcgcttgccgcatctacaatagtgtgttctttgggagggtgtatttaggactgagcatcgcgctcaggtttcccgcattggtcctgtatatcgtctttattttcgccatgaagaagaagttccaaggcaaggacacaaaagcaagtgacaatgagcggaaggtgatggatgaggcgaacttggaattcctgaacaatggcgagcactttgtcccctctgcaggcactgatagcaaaacttgtaaccttgatatgcaagacaacgctgcagccaattag

SEQ ID NO: 206483 - DNA, 2109 bp, Artificial Sequence
  Description of Artificial Sequence: Synthetic coding sequence
atggaccagcaccagcacctgaacaagaccgccgagagcgccagctccgagaagaagaaaactcggcgctgcaatggatttaaaatgttcctggcagccctgagcttttcctacattgctaaagccctcgggggcattatcatgaagatttctattacacagatagagaggcgcttcgatatttcctcctcactggccggcctgattgatgggagtttcgagattggcaacctcttagtaattgttttcgtctcatattttgggagtaagctccacaggccgaagttgattggaatcggctgtctgttgatgggaacgggatccattctgacctctctgcctcatttttttatgggctattatcgatattccaaagaaacacatattaatccttccgagaactcaacctccagcctctcaacttgcctgattaatcaaacgttgtctttcaatggaacgagtcccgaaatcgtggagaaagactgcgtgaaagaaagtggatcacatatgtggatatacgtttttatgggaaatatgttgaggggtatcggggagacgcccatcgtccctcttggtatttcctacatagatgatttcgccaaagaggggcatagtagtttatatctggggtcactcaacgctatcggcatgatcggaccggtaatcggctttgccctcggaagcttgttcgccaaaatgtatgtagacattggatacgtggatctttccactatcagaattactccaaaggatagtagatgggtgggtgcttggtggctgggatttttggtgtctgggctttttagcatcatatcatccatcccattcttttttctgcctaaaaaccctaacaaaccccagaaggaacggaaaatttccctcagcttgcacgtgttgaagacaaacgatgaccggaatcagacagctaatctgacgaatcagggcaaaaatgtgacaaagaacgttacaggtttttttcagagtctcaagagtatcctcaccaacccactctatgtgattttcctcctcctgacattgcttcaagtttccagcttcattggaagctttacatacgtgtttaaatacatggagcagcaatatggacagagcgcatctcacgcaaactttctgctgggcattatcacgatcccaacagttgctaccggcatgtttttgggcggattcataattaaaaagttcaagctttccctggtgggtatcgcgaagttctccttcttgacaagtatgatctccttcctcttccagcttttgtacttccctctgatctgcgagtccaagtcagtggctgggctgacactgacgtatgacggcaataacagcgtggcctcccacgtcgacgtccctttgagttactgtaattcagaatgtaactgcgatgagtcgcagtgggagcccgtatgcggaaacaacggcattacatatctaagtccctgccttgcaggttgcaaaagtagctccggcatcaaaaagcataccgtgttctacaactgcagttgtgtggaggtgaccggcctccagaatagaaattatagcgcccacctgggcgaatgccctagggacaatacgtgtaccaggaagttttttatctacgtggccattcaggtgatcaacagtcttttcagcgccacagggggtaccacattcatattgttgactgtaaagattgtgcaacccgagctgaaggcactggccatgggctttcagtctatggtcataaggacactcggtggcatcctcgcacccatatacttcggcgctctgatcgataagacatgcatgaaatggtccactaacagttgcggcgcgcagggagcctgcagaatttataacagtgtttttttcggtagagtatacttgggccttagcatcgcccttcgctttccagcattggtactgtacatcgttttcatcttcgccatgaaaaaaaaatttcaggggaaagatacaaaggcaagcgacaacgagcgaaaggttatggacgaagctaacctggagttccttaacaacggagagcactttgttccctctgccggcacggacagcaaaacctgtaatctggatatgcaagataacgccgctgccaattag

SEQ ID NO: 206484 - DNA, 2247 bp, Artificial Sequence
  Description of Artificial Sequence: Synthetic coding sequence
atggaccagcaccagcacctgaacaagaccgccgagagcgccagctccgagaaaaaaaagaccaggagatgtaatggcttcaagatgttccttgctgctctaagtttctcatatattgccaaagcacttggagggattatcatgaaaatctcaatcactcagattgaaaggcgattcgatattagctcctcactggcaggcctcattgacggctcatttgaaattgggaatctactcgtgatcgtttttgttagttacttcgggtcgaaacttcatcgcccaaagctgatagggatcgggtgtctgctgatggggaccggaagcattctgacaagcctgccccactttttcatggggtactaccgctactcgaaggagacgcacataaatcccagcgaaaactccactagctcactaagcacttgtctcattaatcaaacactgtctttcaacggcacctctcctgagatcgtggagaaagattgcgtgaaggagtccggcagtcatatgtggatatacgtcttcatgggtaatatgctaagaggcattggggaaacacctatcgttcccttgggcatcagttacattgacgactttgctaaggaggggcactcgagcctgtatctggggagtctgaacgccattggaatgattggcccggtaatcgggttcgcacttggctccttgtttgccaaaatgtatgttgacattggctatgtagatctgtccaccatcaggattactccaaaagactcaagatgggtaggtgcctggtggttgggattccttgtgtctggcctcttcagtattatttcttctatccctttcttctttcttcccaagaatcccaataaacctcagaaggaacgcaagatctctctctctctccatgtgctgaaaacgaacgacgaccgtaatcaaaccgccaatcttacaaaccaggggaagaatgtgaccaaaaatgtgaccggatttttccagtctctgaaaagtattctgacaaaccccctgtatgtgatttttctattgcttactctgctacaagtttccagtttcataggtagctttacatacgtatttaaatacatggagcagcagtatggtcagagcgctagtcatgccaacttcctgctgggtattatcacaatcccaacagtggcaaccggaatgttcctaggcggtttcattatcaaaaaatttaaactctctttagtgggtattgcgaaattcagctttcttacaagcatgatcagctttctttttcagctgctctactttccattaatttgcgaaagtaagagtgtcgctggcctgacattgacatacgatgggaacaacagtgtcgcaagccatgttgatgtgccattgtcttactgcaattctgaatgcaattgcgatgaatcacaatgggaaccagtgtgtggaaacaatggaatcacttacctctccccatgtcttgcgggctgcaaatcatcctctggcatcaagaagcatacagtgttctataactgttcctgtgtggaagtgactgggttacagaacagaaattactctgcacatttaggagagtgccccagggataacacttgtacaagaaagttcttcatctacgttgctattcaagtcatcaactccctcttcagtgcaacaggaggaaccacttttattttgttaactgttaagattgtgcaacccgagctgaaagcacttgctatgggcttccagtccatggtgatacgtactctgggagggattttggccccaatctattttggcgctttgatcgataaaacctgcatgaagtggtctacaaacagctgtggtgctcaaggcgcctgccgaatctacaattcagtttttttcggcattgtccaacccgagctgaaggccctggccatcgggttccacagcatgatcatgagatctctgggcggtatcctcgtccctatttacttcggggcactgattgataccacctgcatgaagtggagtactaacagctgtggagcacggggcgcgtgtaggatttacaacagcacctacctcggccgcgcttttttcggactcaaagtcgccttgatatttcctgtgttggtcctgcttacagtctttatcttcgttgtccgaaagaagtctcatggcaaagacaccaaagttctagaaaatgagcggcaggtcatggatgaggctaatctggagtttctgaacgacagtgagcactttgtgcccagtgcagaagagcagtag

SEQ ID NO: 206485 - DNA, 2139 bp, Artificial Sequence
  Description of Artificial Sequence: Synthetic coding sequence
atggacaccagcagcaaggagaacatccagctgttctgcaagaccagtgttcagcccgtgggaagaccatcttttaaaactgagtatcctagcagtgaggagaagcagccatgttgtggcgagctgaaagtattcttgtgcgcactgagctttgtttattttgcgaaagccctggccgagggctatttgaaatcaacgattacacagattgagcggcggtttgacatcccgtcatcactggtgggtgtgattgatgggtcattcgaaatcggcaaccttctggtgatcacttttgtgtcctatttcggagcaaaactccaccgccctaagattatcggcgcgggatgtgtgattatgggtgtggggaccttgctcatcgccatgccccagttttttatggagcagtacaaatacgagagatattccccatcctcaaattccacgttgtcaatcagcccctgtttattggagtcatccagccagttaccagtgtcggttatggaaaagtcaaaaagcaagatatcaaacgaatgcgaggtggacactagctcctccatgtggatctatgtgttcctggggaacctcctgcggggcatcggggaaacacctatccagcccctaggaatagcttacctggacgacttcgcctctgaggacaacgctgccttctacattggctgcgtgcaaactgtggctattatcggtcctatatttggattcctcctgggttcactctgtgctaagctctacgtggatataggattcgttaacttggaccatatcacaattaccccaaaagaccctcagtgggtcggcgcatggtggctcggatatcttatcgcagggataatatccctcctggcagccgttccattctggtacctgcctaagtctttgccaagaagtcagtcccgcgaggattctaactcgagttctgagaaatccaagttcatcatcgacgatcataccgactatcaaacgccacagggggagaatgctaagattatggaaatggcacgggactttttgcccagcctaaagaatttattcgggaaccctgtgtacttcttgtacctgtgcacctccactgtgcagtttaactcacttttcggaatggtgacatataagccgaagtacatagagcaacaatacggtcagagtagctcacgcgccaacttcgtgattggtctgattaacattcccgccgtcgccttggggattttctctggcggaatcgtgatgaagaaattccgaatatccgtgtgtggggcggccaagctgtatcttggttcctcagtcttcggttatctccttttcttatccctctttgcacttggctgcgaaaattcagacgtggcaggcttgacagtgagctaccagggcaccaagccggttagctaccatgaaagggccctgtttagcgactgtaactccagatgtaagtgcagtgaaacgaagtgggagcctatgtgtggcgaaaacggcatcacgtacgtgagtgcctgtcttgccggctgccagaccagcaatcgttcgggtaaaaacattatattttataattgtacatgcgttggaatcgccgcctctaagtccggcaactcgtccggtatagttggcagatgtcagaaggacaacgggtgccctcagatgtttctgtacttcctggttatttccgtgataacctcctacaccctatccctcgggggtatcccagggtatatcctgctcctacgatgtattaaaccacagctgaaatcgttcgcattgggtatctacaccctggccatccgagtgttagccggcattccggcacccgtttattttggcgtgctcatcgatacctcctgtcttaagtggggtttcaagcggtgcggaagtcggggctcttgtaggttatacgactccaacgttttccgacacatatacttgggactcacagtgattcttggaacagtgagcatcttgctgtctatcgccgtcctctttatcctgaaaaaaaattacgtaagtaaacaccggtccttcattacaaagcgtgagcggaccatggtatcaacccgtttccagaaggaaaactacaccacttctgatcatctccttcagccaaactactggcccggaaaggaaactcagctgtag

SEQ ID NO: 206486 - DNA, 2193 bp, Artificial Sequence
  Description of Artificial Sequence: Synthetic coding sequence
atggacaccagcagcaaggagaacatccagctgttctgcaagaccagcgtgcaacccgtaggccggccctctttcaaaacggagtatccatccagtgaggaaaagcagccttgctgtggagagctcaaggtgttcctgtgcgcactgtccttcgtatacttcgcaaaggccctcgccgagggctatctgaaaagcaccattacgcagattgagcgtcgctttgacatacctagtagtctggtgggggtgatcgacggctcattcgaaattgggaacttgctggtcataacatttgtgtcttatttcggagctaaactccatagacccaaaatcataggagctggctgcgtgatcatgggggtgggcactctattgattgctatgccacagttttttatggaacaatataaatatgaaaggtattcgcctagttcaaattcaacgctgagcatttccccctgtttgctcgaaagtagcagtcagctgcccgtctctgttatggagaaaagtaaatctaaaatttcaaatgagtgcgaggtcgacacctcaagtagtatgtggatctacgtatttctgggtaacttattaaggggaataggagaaaccccaatccaacccctgggcatcgcatacctagacgactttgccagtgaagataatgctgccttttacataggatgtgtgcagaccgtcgcaatcatagggccaatctttgggtttttgctgggatccttgtgtgctaaactgtacgttgacattgggtttgttaatctggatcacatcacgatcaccccgaaggaccctcagtgggttggcgcctggtggctggggtacttaattgccgggatcatcagtttgctggccgcagtgcctttttggtatctccctaagagtctgcccagatcacaatcaagagaggactcaaactcttcaagtgagaagtcaaaatttattatcgacgaccatacagactaccaaacccctcaaggagagaatgccaaaattatggagatggctcgtgattttctcccatctcttaagaacctatttggtaatccggtgtacttcctttacctctgtacttcaacagtccagttcaactcactcttcggcatggtgacctacaaacccaaatatatcgagcagcagtatggccagagcagttctcgcgctaattttgttattggactgatcaatatccctgccgtagccctgggaatcttcagtggcggaatcgtcatgaagaagtttcgcatctcggtgtgcggcgctgctaagctttatctgggtagcagtgtgttcggctacctcctatttctgtctctctttgcactggggtgcgaaaattccgacgttgcagggctgacagtctcctaccagggcacaaagcccgtctcttatcatgaacgggccctcttctcggattgtaactcaagatgcaaatgtagtgaaacaaagtgggaaccaatgtgtggcgaaaatggtatcacgtacgtgtcggcctgtctggcgggctgccaaacctcaaaccgcagtggtaaaaacatcattttctacaattgtacctgtgtcggaatcgcagcaagcaaatctggcaacagtagcggcatcgtgggccgctgtcaaaaagacaatggatgccctcagatgtttttatattttcttgtgatttctgtgataacctcatacaccctaagcttaggaggcatccccgggtatattctcctgcttcggtgcataaagccccagctcaaatctttcgcactgggcatctacacactggctattcgggttcttgcgggtatcccagccccggtgtactttggcgtgctcattgataccagctgcctaaaatgggggtttaagcgatgcgggtctcggggctcatgccgactatacgatagcaatgtcttcaggtatcagatcaaaagcatcccagcttcccactgttactctatccctgatctgcacaacgcgactgatactaataagttctcatgccacttcacagcctgcaagacgtacatttccggcaccaactgtgacacgggacactctgtaaatagtcctaagcactgcagcactttccacttcaaggagaaattatgcttcaaaactcagaagttttacaatcaggagaggaagaacaacggagtctacaaaattccaaaaggaaagctccattataagtag

SEQ ID NO: 206487 - DNA, 1992 bp, Artificial Sequence
  Description of Artificial Sequence: Synthetic coding sequence
atggacaccagcagcaaggagaacatccagctgttctgcaagaccagcgttcagccggtagggaggccttcatttaaaaccgagtacccctcttcagaggaaaaacagccttgctgtggcgagctgaaggtgtttctttgtgctctgtctttcgtttacttcgctaaagctttggccgaagggtatttgaagtctaccattacgcagatcgagcgccggtttgatattccaagctcccttgtgggtgttattgacggatctttcgagattggaaatctactggtaatcacattcgtgtcgtatttcggtgctaaactacaccggccgaaaattattggcgcggggtgcgtgattatgggggtcggtactctcctgatcgctatgccccagttctttatggagcaatataagtacgagagatactcgccgtccagtaacagcacactctcaattagtccgtgcctgctggaaagttcttctcagctccccgtgagcgtgatggaaaagagcaagagcaaaattagcaacgggtgtgttcagactgtggccatcatcgggcccatattcggctttctactcggttccctgtgcgctaaactgtacgtggacatcggcttcgttaacctggaccacatcacaattactccaaaggaccctcagtgggtgggcgcttggtggctcggatacttgatagccggtattattagcctgttggcagccgtgcctttctggtatctgcccaaaagcctgcctaggtcccagtcccgcgaggacagtaatagttctagcgaaaagtctaagttcatcattgatgatcacaccgactatcaaacgccacagggggagaatgccaagatcatggagatggctcgggacttcttaccaagccttaagaacctcttcggcaaccccgtctactttctctatctgtgcacttctaccgtccaatttaatagcctgttcggcatggtcacctataagccaaagtatatcgagcagcagtacggtcagagctcgagtagggcgaatttcgtcattgggctgatcaatatacctgcggtcgcacttggaattttttcaggaggaattgtcatgaaaaagtttaggatcagtgtatgcggagccgccaaactgtacctgggatcaagcgtgtttggatatttgctgtttctttccctgttcgcacttggatgtgagaatagtgacgtcgcaggtctgactgtatcttaccaggggacaaaaccagttagctaccacgagagagcgctgttctctgattgcaactcccgttgtaagtgttccgaaactaaatgggagcctatgtgcggcgaaaacggaattacatatgtgagcgcttgcttggccggttgtcaaacctcaaacagaagcggaaagaatattattttctataattgcacctgcgtaggcatagcggccagcaagagcgggaacagttcaggcattgtgggtcgctgccagaaagataacgggtgtcctcagatgtttctgtattttctggtaatttccgtcatcactagctatacgctgtccctggggggcatccctgggtatatcttattgttgcgttgtattaagccgcagctcaaatcatttgccttgggtatctatacactggctataagggtgctggcaggcatccccgctcctgtgtacttcggtgtgcttatcgacactagctgtctcaagtgggggttcaaaagatgcggctctcgtggaagctgccgcctctacgattcaaacgtgttcagacatatctatctcggcctcacagtaattttaggaacagtaagtatcctgttgtcaattgccgtcctttttatcctcaagaagaattatgtttctaagcacagatcctttatcactaagcgcgagcggactatggtgtcgaccaggtttcagaaggaaaattataccacatcggatcatctgttgcagccgaactactggcctgggaaagaaacccagctctag

SEQ ID NO: 206488 - DNA, 1839 bp, Artificial Sequence
  Description of Artificial Sequence: Synthetic coding sequence
atgggcgtgggcaccctgctgatcgccatgccccagttcttcatggagcagtataaatatgagcggtacagccccagctcgaattcaactttgagcatttctccctgcttgctggagagtagctcacaacttcctgtttccgtcatggagaagtcaaagagcaagatcagcaacgagtgcgaggtcgacacttctagctccatgtggatatacgtcttcctgggcaatctgcttcgtgggataggcgagaccccaatacagccccttggaattgcttacctcgacgatttcgctagcgaggacaatgccgcattctatattggctgcgtacagacagtggccattatcgggccgatttttgggttccttctggggtccctgtgtgcgaagttgtacgtcgacatcggtttcgttaatctcgaccacatcaccatcactcctaaagacccccaatgggtcggcgcctggtggcttgggtacctgatcgcgggcattataagcctcctggctgcagttccattttggtacttaccaaagtctctcccaaggtcacagtcccgggaagatagtaactccagctcagagaagagcaagttcatcattgatgaccacaccgattatcagacacctcaaggtgaaaatgccaaaataatggagatggcacgagacttcctgcctagcctcaagaatctattcggcaacccggtgtactttttatacttatgtacatcgacagtgcagttcaactccctctttggtatggtcacatataagcccaagtacatagagcagcagtacggccagtcctcatcccgggcaaactttgttatcggccttatcaatattcctgctgtagcattaggcattttttcagggggcattgtcatgaaaaagttccgaatcagcgtgtgcggggcggccaaactataccttggctctagcgttttcggctacctgctgttcctgagcctttttgccttaggatgtgagaattccgatgtggccgggttaacagtcagttaccaaggaactaagccagtttcttatcacgaacgggctcttttttctgattgtaattcacgctgcaaatgcagtgaaaccaagtgggagcccatgtgcggtgagaatgggatcacctacgtgtccgcctgtctggccgggtgtcagacctctaacaggtccggcaagaacatcattttttataattgcacctgtgttgggattgccgcaagtaagtccggaaacagctccggtatcgtcgggagatgccagaaggacaacggctgtcctcagatgttcctatatttcctggttatctccgtgataacttcttacacactctctctgggcggaatccccggctacattctgctgttgcgctgtattaagccacagcttaagtctttcgccctgggtatttacactctggccatccgggtgttagccggaatccctgctcctgtgtactttggggtcttgatcgacacatcatgccttaagtggggattcaagaggtgtggcagccggggctcatgcaggctgtacgacagtaacgtttttcgatatcagattaaaagtattcccgcctcacattgctattctatccccgacctgcacaacgctacagacacgaacaaattctcttgtcacttcaccgcctgcaagacatacatctcaggaacaaactgtgataccggacacagtgtcaattctcccaaacattgcagcacatttcatttcaaagaaaagctctgttttaagacacaaaagttctataaccaagagaggaaaaacaatggagtgtataagatcccgaagggcaaactccattacaagtag

SEQ ID NO: 206489 - DNA, 2193 bp, Artificial Sequence
  Description of Artificial Sequence: Synthetic coding sequence
atggacaccagcagcaaggagaacatccagctgttctgcaagacctccgtccagccagtcggaagaccctcttttaaaactgaatatccatcatccgaagagaaacagccatgctgcggagagctgaaggtctttctgtgtgccctgagcttcgtttacttcgccaaggcattggctgaaggctatctgaaaagtacaatcacccagatcgaaaggaggtttgatattccatccagtttagtgggtgtcatcgacggatcattcgaaattgggaacctacttgtgattacatttgtgtcttactttggcgcaaagctccaccgacccaagatcattggcgccggttgtgttattatgggggtcggcacattgcttattgcaatgccacaattctttatggagcagtacaaatatgagcggtacagtcccagttctaactcaactctgtccatcagcccatgtctcttggagtcatcgagccagctgccagtgtctgtgatggagaaaagtaaatctaaaatatctaacgagtgcgaggttgacacctcctcaagtatgtggatctatgtgtttctaggcaatctgctgagggggataggtgaaacaccgattcaaccacttggcatcgcctatctggacgacttcgctagcgaagataacgctgcgttctacattggctgcgttcagaccgtcgccattattgggccaatcttcggatttctcttgggtagtctttgcgccaaactgtatgtcgatatcgggttcgtcaacctcgatcatataacgatcactccgaaggatcctcagtgggtgggtgcttggtggctgggttacttgattgctggtatcattagcttgcttgcagctgtgcctttttggtacttaccaaaatcgctgcccaggagccaatcccgtgaggactctaattcctcaagcgaaaaatcaaagttcataatagacgatcacacagactaccagacaccacagggggagaacgccaagattatggagatggcacgcgactttcttccttctcttaagaatctgttcggaaaccccgtctatttcctttacttgtgcaccagcacagtccagttcaactctttattcggcatggtgacctacaaaccaaaatacatcgagcagcagtatggccagtcctcatctagagccaattttgtgataggtctgattaacatcccagctgtggctctcggcatcttcagcggaggcatcgtcatgaagaagttcaggatctctgtgtgtggagccgcaaaactctacttgggcagctcggtgttcgggtaccttcttttcctatcgctctttgcacttggatgcgagaatagcgacgtcgccggactgaccgtttcataccagggcacgaaacccgtatcctaccacgaacgggctttattttccgattgcaattcccggtgtaagtgctctgaaacaaaatgggagcctatgtgcggcgagaacggaattacgtacgtgagcgcgtgcctcgcaggctgccagaccagcaacagatccggcaagaatatcatcttttacaactgtacctgcgttggcattgccgcatccaaatctggcaattcgagtggaattgtcgggcgatgtcagaaggataacggatgcccccagatgtttttgtactttctggttattagcgtgattacatcttacacactgagtcttggtggcatcccaggctacatcttactgttacggtgtatcaaaccacaactcaagtccttcgctctgggaatctacactttggccataagggttctcgccggtatcccagcacccgtgtacttcggcgttttaatagatacctcctgcctgaaatgggggtttaagcggtgcgggtctcgagggtcatgccggctgtacgacagcaacgtgtttagataccagataaaaagtattcccgcgagccattgttatagcatccctgatctgcacaatgctacagacaccaataagtttagttgtcacttcacagcctgtaagacctacatctccggaacaaattgcgacacaggacattccgtgaactcaccgaagcattgttccaccttccattttaaagaaaagctctgttttaaaacgcagaaattctataaccaggaacgaaagaataacggcgtgtacaaaattcctaaggggaagttacactataagtag

SEQ ID NO: 206490 - DNA, 1932 bp, Artificial Sequence
  Description of Artificial Sequence: Synthetic coding sequence
atgggcctgctgcccaagctgggcgccagccagggcagcgacacctccactagccgggccggtcggtgtgcccgcagcgtgtttgggaacatcaaagtgtttgtgctgtgccagggtctgctgcagctgtgtcagttactttatagcgcctattttaagtcctctctgacaaccatagaaaaaaggtttggcctcagcagtagttccagtggcttaatctcctcactgaacgaaatttctaacgcaatactcatcatctttgtttcttacttcggctcgagagtgcatcgaccgagattgattggaatcggagggttgttcctggcagctggtgcattcattctgacgctgccacatttcctcagtgaaccgtatcagtacaccttagcttctacggggaataactccaggttgcaggccgagctgtgtcaaaaacattggcaggacttaccccctagcaagtgccattctacaacccagaatccacaaaaggaaacctcgagcatgtgggggttgatggtagtggcgcaactcctcgccgggattggtaccgtgcctatacaaccgtttggcatttcctatgtcgatgacttttctgaaccatccaattcacccctctacatctctatcttattcgcaatcagtgtctttgggccagccttcggttacctcctagggtctgtgatgctgcagatctttgtggactacggacgagttaacacagctgcggtcaacctcgtcccaggcgatccaagatggattggcgcctggtggctgggccttctgatatcctctgccctcctggtcttgacttccttccccttttttttcttcccccgcgctatgcctatcggggcaaaacgagcccctgcaaccgccgatgaggccaggaaactggaggaggctaagagccgcgggtcccttgtggattttattaagcgctttccttgcatctttctacgccttctaatgaattcactattcgtcctcgtggtccttgctcaatgcacgttttcatctgtgatagcgggattgtcgacctttcttaacaaatttctggagaagcagtacggtaccagcgcagcatacgcaaactttctgattggcgctgttaatctgcctgctgcagccctgggcatgctgttcggcggaattctgatgaaaagatttgtcttctccttgcaggcaattccacgaatagccaccaccattataacgatctcgatgattctttgcgtgccactgttttttatgggctgctctactcctacagtggcagaagtctacccgccgtccacctcctcatctatacatcctcagtctccggcttgtcggcgggactgctcctgccccgatagtatcttccaccctgtgtgtggggataacgggatcgagtatctcagtccatgtcacgccggttgctccaatatcaatatgagttccgccacttctaagcagctgatctacctcaattgtagttgcgttaccggaggcagcgccagcgccaagaccggctcttgcccagtcccatgcgcccatttcctgctgcctgccatcttcttaatctccttcgtaagcctgattgcatgcatcagccataacccgctgtatatgatggtccttagagtggttaaccaagaagagaaaagcttcgcaataggagtgcaattccttctcatgcgactgctggcctggttgcccagtcctgcactatacggactgactatcgaccactcctgcatcaggtggaactctctatgcctggggagaaggggcgcgtgtgcttattacgataacgacgcgctgcgcgaccgttatctgggcctccagatggggtataaggcgctgggcatgctcttgctgtgctttatatcttggcgagtgaagaaaaacaaagaatataacgtccagaaggccgccggcctgatttag

SEQ ID NO: 206491 - DNA, 1248 bp, Artificial Sequence
  Description of Artificial Sequence: Synthetic coding sequence
atgggcctgctgcccaagctgggcgccagccagggcagcgacaccagcacaagcagagccggcaggtgtgctagaagtgtcttcggcaacattaaggtgttcgtactgtgtcaaggactgttgcagctctgccagctgctctactctgcgtatttcaagagctcccttacaacaatcgagaagagattcgggcttagctcaagctcctccggcctgatcagtagcttaaacgagatatccaatgccatccttatcatattcgtgtcatactttggcagcagggttcatcgaccccggctcataggaattggcggcctctttcttgccgctggtgcctttatcctaacactgccacacttcctcagtgaaccctaccaatatactctcgcctctaccggcaataactctcgcctgcaagccgagctgtgtcagaaacattggcaagacctcccaccttccaaatgccactccaccactcagaacccccagaaagagacaagtagcatgtgggggctgatggtggtggcccagctcctggcgggaataggaactgtccctatccagccctttgggatcagctacgtagatgacttctcagagccaagcaactcaccactgtacatctccatactctttgccatctctgtgtttggccctgccttcggctatttgcttggctcagttatgctacagatattcgtagattacggccgcgtgaacaccgctgcagttaacttagtgccgggggatccccggtggataggggcctggtggctagggctactgatcagctcagccctgctggtgctcaccagcttcccttttttcttctttccgagagcaatgcctatcggggctaagagggcaccggcgacagccgatgaggcaaggaagctggaagaagccaaaagtcggggcagcctcgttgactttattaagaggttcccgtgtatctttttaagattactcatgaattctttgtttgtcctggtggtcctggctcagtgcacgtttagtagtgtgattgcagggctgtccactttcctgaataagtttctcgagaagcagtatgggacctctgccgcatacgcaaattttctgatcgcccaccaggtgctgtacattcgaagcctcctgcccgcagctggaacagccagggcacagattctctcgagcactcgtagcgtggagactatggaatcaagcacttctcctttggcgatgccggctgcagctacgtctacctag

SEQ ID NO: 206492 - DNA, 2133 bp, Artificial Sequence
  Description of Artificial Sequence: Synthetic coding sequence
atgcagggcaagaagcccggcggcagcagcggcggcggccggagcggggagctccaaggcgacgaggctcaaaggaataagaagaagaaaaaaaaagtgagctgtttttcgaatatcaaaatttttttggtgtctgagtgcgcacttatgctggctcaggggaccgtcggcgcttacttagtgagcgttttgacaacactcgagagacggttcaacttgcaatctgccgacgttggggtcattgcttcttcatttgaaatcgggaatttagcgttgatcctgttcgtttcctatttcggagcccgaggacaccgcccacggctgattggctgcggaggaattgtgatggccctgggggcactgctgtcagccctgcccgaattcctgacacaccagtacaaatatgaagctggggagattcgatggggggctgagggacgggacgtgtgcgcagctaatggtagtggcggcgacgagggtcccgatccagacctgatttgcaggaaccgcaccgctactaatatgatgtatctcctgttgatcggcgcccaagtgctccttggcattggggcaactccagtacagcctctgggcgtgtcttatatcgacgatcacgtccggcgtaaggactctagtctgtacatcggaatcctgtttaccatgttagtgttcggaccagcttgtgggttcattctgggtagcttttgcaccaagatttatgtggatgctgtctttatcgacacctcaaacctggacataactccagatgaccccagatggatcggcgcgtggtggggtggtttcctcctgtgcggggccctcctcttcttttccagtttgctgatgtttggatttccccagtccttgccaccccattcagaaccggcaatggagtctgagcaggcgatgctgagcgaaagagagtacgaacgtccaaagccttccaatggcgtcctccgccaccctttggagcccgacagttcagcctcatgcttccagcagctccgggtgatccccaaggtgacaaaacatttactgtctaaccctgtctttacatgcatcatattagcagcgtgtatggagattgccgtcgtggccggcttcgccgctttcctgggcaagtatttggagcagcaatttaacctaactacatcaagcgccaatcagctcctgggcatgaccgcaattccctgtgcctgcctagggatattcctggggggtttactggtcaagaagctgtcactcagtgccctgggcgccattcggatggccatgctggttaaccttgtttctacagcttgctatgtgagtttcctgttcctgggctgcgataccggaccagtcgccggtgtcactgtgccgtacggcaatagcacggcgcccggtagtgcactcgacccgtactccccatgcaataacaattgtgaatgtcagaccgattcctttacgccagtttgtggcgctgacggtattacatatcttagcgcctgtttcgcagggtgcaatagcacaaacctcacagggtgcgcgtgcctgacaacagtgccagctgagaacgcaactgttgtccccggcaaatgccctagccctggctgccaggaggcctttctgacatttctttgcgtgatgtgcatttgttccttaataggggcaatggcccaaaccccttcggtcataattttgattcgcacagtgtcgcccgaattgaaatcctatgcgttgggagtcctcttcctgctcctgaggctgctgggatttatcccaccccctctgatcttcggtgctggtatcgacagcacatgcttgttttggtctacattttgcggggaacagggcgcctgcgtcttatacgataacgtggtgtaccggtacttgtatgtctcaatcgctatagcgttgaagagcttcgccttcatcttgtatacgacaacatggcagtgtctgagaaaaaattataaacgctacatcaagaatcacgaggggggactttccactagcgagtttttcgcgagtactctaaccctggacaatctgggaagggatcccgtgccagccaatcagacccatagaacaaaatttatatataatttggaggaccatgagtggtgcgagaacatggagtcggtgctgtag

SEQ ID NO: 206493 - DNA, 1356 bp, Artificial Sequence
  Description of Artificial Sequence: Synthetic coding sequence
atgcgggagatcgtgcacatccagatcggccagtgcggcaaccagattggagccaagttttgggaaatgattggcgaggaacatggtatcgacttggccggttctgaccggggcgcctccgctctacagctggagcgtatctcagtctattataatgaggcctacggccgcaaatatgttccccgcgcggtcctggttgacctggagcccggaaccatggattcgatccggagctcaaagttaggggctctgtttcagcctgacagttttgtgcacggtaattccggcgctggcaataattgggccaaaggtcattatactgagggtgctgagctgatagagaacgttttggaggtcgtgcgacacgagtccgagagctgcgactgtcttcaagggtttcaaatcgttcattccctcggcggcggcactggctcagggatgggaacactccttatgaacaaaattcgcgaggagtacccagatagaattatgaactccttctctgtcatgccctctccaaaggtgtctgacacagtggtggagccttacaacgccgtgctcagcatccaccagctgatagagaacgccgatgcttgcttttgcatcgataacgaggccctctacgacatctgttttaggacgcttaagctcaccacccctacttatggagatctcaatcatcttgttagtttgaccatgtctggcatcaccacttctctccgcttccccgggcagctgaacgctgacctcaggaagttggctgtaaatatggtgccatttccgaggctgcacttcttcatgccaggattcgcccccctcactgcccaaggctcccagcagtacagagctttgtccgtcgcagaactgacccaacaaatgttcgacgctcgaaatacaatggccgcctgcgacctgcgccgcggtagatatctgacagtggcatgtatcttcagaggtaagatgagcactaaggaagtggaccagcagctcctctccgtccagactagaaactcatcttgtttcgtcgagtggatccccaacaacgtcaaggtggccgtctgtgatattcccccacggggcctcagcatggcggcaacattcatagggaacaatacagctatccaggaaatttttaaccgggttagcgagcacttcagcgccatgttcaaacgaaaagcttttgtgcattggtatacctccgaaggcatggatattaatgaatttggcgaggccgagaacaacattcatgaccttgtctccgagtaccagcagttccaggatgctaaggcggtgctggaagaggatgaggaggtgacggaggaggccgaaatggagcccgaggacaaaggccattag

SEQ ID NO: 206494 - DNA, 1749 bp, Artificial Sequence
  Description of Artificial Sequence: Synthetic coding sequence
atgcccctgcaccagctgggcgacaagcccctgaccttccccagcccaaactctgcgatggagaatggtctggaccacactcccccttcacgtagggcgtcgcccggaacccctctttctccaggtagcctgcgcagcgccgctcactctcctttagatacatcgaagcaaccactctgccaactgtgggcagagaagcatggagcgaggggaacacatgaagtacgctacgtgtcagccggacagtctgtggcctgcggctggtgggcattcgccccgccttgtctccaagttttgaatacaccaaaaggcatcttgttctttctgtgcgcggctgcgttcctgcagggaatgaccgtgaatggtttcattaacacagttatcacatccctggagagacgatacgacctccactcttaccagagcgggcttatcgcctccagctatgatattgccgcttgcttgtgtctcacctttgtttcctatttcggaggcagcggacacaaacctcggtggctggggtggggggtgttattaatgggaacaggatctttggtcttcgcactacctcattttacagctggacgttacgaggtcgaattggatgccggggtcagaacatgtcccgctaaccctggtgccgtgtgcgccgacagcactagcgggcttagtcggtatcagcttgtctttatgctcggtcaattcttgcacggggtaggtgctacccctctttatacactgggtgtcacatatctgggaatgagcacctttagccctaagttcttggagagccaattttctttatccgccagcgaggccgcaacactctttggctatcttgttgtgccggcaggcggcggaggaactttcttgggaggattctttgttaataagttacgactgagggggtccgctgtgatcaagttttgcctcttctgtaccgttgtgagtttattgggcatcctggtcttttctcttcattgcccctcggtgcccatggccggcgtgacagcctcctatggaggctccctgttgcccgagggccacttgaacctgactgccccatgtaatgcagcatgttcctgtcagcctgaacactattcacctgtctgcgggtctgatggcttaatgtatttcagtctgtgccacgcaggctgtcctgccgctaccgaaactaatgttgacggacagaaagtgtacagggactgtagttgcatcccacagaatctatccagtggctttggacacgccaccgccgggaaatgtaccagtacatgtcagcggaagcccctgcttttagtcttcatcttcgtagtgatctttttcacatttctctcctccattcctgctctgacagctacgctgaggtgcgtgagggatccccagcgctccttcgcactcgggattcagtggatagtcgtgcgtatactcggcggtattccaggccccatagcttttggctgggtcatcgacaaagcttgtttactatggcaggaccaatgcgggcagcaaggctcatgcctagtttatcagaactctgctatgtcccgatatatcctgatcatggggctgctttacaaggtactcggagtgcttttctttgctatcgcctcaagccgggcggcctccgatcacagacctcgcccccctggccacggaggtcactccgcatttcccgacgaccgaactgtgccgctgggagacgccattacaagagagctgctcttcgatttgcagccttctacatag

SEQ ID NO: 206495 - DNA, 2169 bp, Artificial Sequence
  Description of Artificial Sequence: Synthetic coding sequence
atgcccctgcaccagctgggcgacaagcccctgaccttccccagccccaacagcgcaatggaaaatgggcttgatcatacccctccatctaggagggcatctcctgggaccccgctgtcacccggaagtctgcggagcgctgctcattcacctcttgatacaagcaagcagccgctctgtcagctttgggccgaaaaacatggcgcaagaggaacccacgaggtcaggtacgtgagcgcaggtcagtccgtggcatgcggttggtgggcctttgcccctccttgcctgcaagtgcttaacacccccaaggggatcctgttttttttgtgcgcagctgcatttctccaaggaatgaccgttaatggtttcatcaacacagtgataacaagcctggaacgaaggtatgatctgcacagctatcaaagcggcctgattgcaagcagttacgatattgccgcttgcctttgcctcaccttcgtgtcctacttcggtggatctgggcataaaccacggtggctgggatggggcgttctcctcatgggtaccggctctttggtgttcgccctgccacactttactgccgggagatatgaagtcgagctggatgctggggtcagaacatgcccagcaaacccaggtgctgtgtgcgccgattcaaccagcgggctcagtaggtatcaactggtctttatgctaggccaattcctgcatggcgttggagctacccctctgtacacgctgggcgtgacgtatctggatgaaaacgttaaaagttcctgctcgcctgtatatatagcaatcttctatacagcagctatcttaggcccagctgcagggtacttgatcggtggcgcactactaaacatttacaccgagatgggccgcaggacagagctcactaccgagtccccattgtgggtgggcgcctggtgggttggctttctgggctctggggcagccgcttttttcactgctgtccccatcctaggctaccccagacagctgcccgggtcacagaggtatgcagtgatgcgggcagcagagatgcatcagcttaaagattcgtcacgcggcgaggccagcaatcctgactttggcaagactatcagggatctgccgctgtccatttggctgctgctaaagaaccctaccttcatcctcctgtgccttgccggcgcgacagaagccaccctgatcactgggatgtccacattttctcctaaattcctggaaagccagttctcactgagcgcgtccgaggccgcaactctttttggctacttggtggtgcccgctggaggcgggggcacatttctgggcggatttttcgtaaataaactgcgactaagaggatcagctgtcataaagttctgcctgttttgcaccgtcgttagtctgctcggaattctcgtgtttagtctccattgcccatccgttcccatggccggggtcaccgctagctacggaggttcactgctcccagagggacacctcaacttgacggcaccttgtaatgctgcatgttcttgtcagccagaacactattcgcccgtctgtggctcagacggactgatgtacttcagcctctgccacgctggctgccccgctgctacagagacgaacgtagatggacagaaggtgtacagagactgttcttgcatcccacaaaacctcagctcgggattcgggcatgcaacagccggtaagtgtacttccacgtgtcagcgcaagcctctgttgctggtctttattttcgttgttatatttttcacatttttgtcgagtatacccgccctgaccgccactctccgctgtgtgagggacccccagcgctcctttgcccttggtattcagtggatcgttgtgcgcattctcggcggcattcctggtcctatcgcgttcgggtgggtaatcgacaaggcatgcttattgtggcaggatcaatgcgggcagcagggctcctgcctcgtgtatcagaactctgcaatgagccgatacatccttatcatgggactgctttataaggtgttgggagtgctgttcttcgcaatcgcatgtttcttgtacaaaccgttatctgagagctcagatggacttgagacctgccttccctcccaaagctcagctccagatagcgccactgactcccagctgcagtccagtgtctag

SEQ ID NO: 206496 - DNA, 2169 bp, Artificial Sequence
  Description of Artificial Sequence: Synthetic coding sequence
atgcccctgcaccagctgggcgacaagcccctgaccttccccagcccaaattccgccatggagaacgggctcgatcacacccccccctctcgtcgtgcgagccctgggactcctcttagcccgggatccttgagaagcgccgcccattcaccgctggacacgtcaaaacagccgctttgtcaattgtgggctgagaagcatggggcccgcggcacacatgaagtacgatacgtgtctgccgggcagtcagtggcgtgcggttggtgggcttttgcccctccatgtctccaggttctgaataccccaaaggggatactcttcttcctctgtgccgctgcattccttcaggggatgacagttaatggctttatcaatactgtcatcacttctctggaaagaagatacgatctccattcttatcagtctggactgatcgcttcgtcgtatgatatcgcagcctgcttatgcctcactttcgtgtcatactttggcgggtctggccacaagcccaggtggctggggtggggcgtgcttctgatgggaaccggcagtctcgtcttcgctctgccacacttcacagcaggtaggtacgaagtcgagctggacgctggagtccgtacatgcccagccaatccaggcgctgtttgtgccgactctactagcgggctctccagatatcagttggtgttcatgctcggacagttcctgcatggagtgggtgccactcccctgtataccctgggtgtgacatatctcgatgaaaacgtgaagtcgagctgtagtccagtctacattgcaattttctacaccgcagcgatattgggacctgcagccgggtacctgatcgggggcgctctcctaaatatctatactgaaatgggacgaagaacagaactaaccacagaatcacctctctgggtgggagcgtggtgggttggcttcctcgggagtggtgcagccgccttttttactgcagtccccattctgggttatccccggcagttgccagggtcacaaagatatgccgtcatgagggctgccgagatgcaccagttaaaagactctagtcggggagaggccagtaaccctgactttggaaagaccattagagatctcccactgtcaatatggcttttgctgaagaatcccactttcatcctcctgtgcctggccggcgcaactgaagcgacgcttatcaccggcatgtcaaccttcagccccaaattcctcgaatcacaattcagcctgagcgctagcgaggccgccacactatttggctacctggtggtgccggcaggcgggggcgggacatttctcggtggttttttcgttaataagctaaggttgcgtggctcagccgttatcaaattctgtcttttctgcacagtcgtgtctctgctgggcatactggtgtttagtctacattgccccagcgtccctatggcaggcgtgactgcatcctacggcggctcccttttaccagagggtcacctgaatttgacagcgccctgtaatgccgcctgtagttgtcagcctgaacactatagtcccgtttgcggcagtgatggacttatgtatttcagtctgtgccatgcaggctgccccgccgctaccgagactaacgtggatgggcaaaaggtgtatagagactgtagctgtataccccaaaacctctccagtggattcggacacgccaccgctggcaagtgcacatctacctttctgtatatccctcagcagcacagctgcacgaacggcaattccaccaccggggctctgcaggagactcctcggtcaaaacgcgcatgtagatgcgtccgtgatccgcaacgctcttttgcacttggcatacagtggattgtggtaaggattctgggtggaatcccgggccccatcgcttttggctgggttattgataaggcctgtttgttgtggcaggatcagtgtggccaacagggctcttgcctggtctaccagaactcagcaatgtcaaggtatatcctgataatggggttgttgtataaggttctgggagtgctgtttttcgccatagcctgcttcctctacaaaccactgagcgaatcttccgacggccttgagacatgcttgccttcacagtcttctgcccctgactccgcaacagactcacaactccagtcatcggtctag

SEQ ID NO: 206497 - DNA, 456 bp, Artificial Sequence
  Description of Artificial Sequence: Synthetic coding sequence
accaccgccctgtgcgccgcccggaccgccagctgcaccagccactgtgccacccagggggccctacaaccccgcagacggatgtggactgcaaggagatgcgtacgcgatccgcaacggtcttttgccctgggcatccaatggattgtggtcagaattttaggggggatccccggacctattgccttcgggtgggtgatcgataaggcgtgcctgttgtggcaggatcagtgtgggcagcagggttcttgcctcgtctaccagaattctgccatgtcgcggtacatcctcattatgggactcctgtataaagtactgggcgtgttattcttcgcaattgcatgctttctctacaaaccactatcagagagcagtgatgggctcgagacttgcctcccgagccagtcctctgctccagatagcgccactgattcccagcttcagagctccgtctag

SEQ ID NO: 206498 - DNA, 1863 bp, Artificial Sequence
  Description of Artificial Sequence: Synthetic coding sequence
atgcccctgcaccagctgggcgacaagcccctgaccttccccagcccaaacagcgccatggaaaacggattagaccacacacctccctcaaggcgcgccagcccagggactcccttgtccccagggtccctgagatcagccgcacatagcccccttgatacgagcaaacagcccctctgccagctgtgggccgagaagcacggtgcaaggggtacccacgaggtgcgctatgtgagcgccggacaaagcgtggcctgtgggtggtgggccttcgctcctccctgcctgcaagttctgaacactcccaagggtatcctgtttttcctctgcgctgctgcgtttttacagggaatgactgtaaatggttttattaatactgtcatcactagcttggagagaaggtatgatctgcactcttaccagtcgggcttgattgcctcatcgtacgatatcgcagcgtgtctttgcctgacatttgtgagttactttggaggctccgggcataagcctaggtggttagggtggggggtactcttaatgggcacagggtccctcgtctttgccctgcctcactttacagccgggcggtatgaggtagagctggacgctggggtgagaacatgccctgccaatcctggcgcggtatgtgcggatagcacctccgggttatccagataccagctcgtgtttatgctcggccagttcctacacggggtgggggcaacacccctctacacactgggggtgacctatttggacgaaaatgtaaagtctagctgcagccctgtctacattgcaatcttttacactgccgcgattttaggcccagctgctgggtacctgattggcggtgcactactcaatatttacaccgagatgggacggcgcacggagctaacaactgagtcccctctctgggtgggtgcctggtgggtagggtttttgggctcaggagcagctgctttttttactgccgtgccaatccttggttacccccgccagctccctggcagccaacgctatgccgtaatgcgggctgctgagatgcaccaattgaaggattcgagccggggggaggcttccaatcctgattttggcaagacgattagagatttaccactttctatctggctgttgctcaagaaccctacttttatcctcttgtgtcttgccggtgccacagaggccaccctcataactgggatgtctactttcagccctaaattcctggaatcccagttcagcttgagtgccagtgaagcagcaaccctctttggttatctagtggtgcccgcgggcggtggcggcaccttcctgggcggtttctttgttaataaactaaggctgcggggtagcgccgtcattaaattttgtttgttctgcacagttgtctcactcttggggatactggtcttcagtctgcactgtccttccgtgcctatggcaggcgtgacggctagctacggaggatccctgttgccagaaggccacttgaatctgaccgccccttgcaacgcagcttgctcctgccagcctgaacactacagtcccgtctgtggctctgacgggctgatgtactttagtctgtgccacgcaggatgcccagccgccaccgaaaccaacgtagacggacagaaggtgtcaggcgccgcggcatatcggccatgccctcccctagacccaggaaagggacctccctgcctcccactagttatcggggccatagtgggcctccctcgttgtaccgagacagtagcagtgtcactgcgaatctttccgctggtgctcgctatgccccttcaggggaacgccctgcagctggttcgggagtccccctccttttggttttcttactccctctag

SEQ ID NO: 206499 - DNA, 2160 bp, Artificial Sequence
  Description of Artificial Sequence: Synthetic coding sequence
atgttcgtgggcgtggcccggcacagcggcagccaggacgaggtgtcccgcggggtggagccactggaagcggcgagggctcagccagcgaaggacaggagagctaagggcaccccaaagtccagtaagcctggtaagaagcatcgttacctgagactcttgcctgaggctctgattcggttcggtgggttccgcaagaggaagaaagcaaagtccagcgtctcaaagaaacccggcgaagtggacgactctttggagcaaccgtgtggcttaggctgcttagtgtccacctgctgtgagtgttgcaacaatattcgctgctttatgattttctactgtattctgcttatttgccaaggtgtagtcttcggcctgattgatgtgtctatcggcgatttccaaaaagagtatcagcttaagacaattgaaaagttggccttggaaaagagctatgatattagttccggcctggtggccattttcatagcattttatggagatcggaagaaagtaatttggtttgtggcatcttcttttttaataggactcggaagtctcctgtgcgctttcccgagtatcaacgaggaaaataaacagtcaaaagttggtatcgaagacatctgcgaagagataaaagtagtttcaggctgccagagtagtggaattagcttccagtcaaaatacctgagtttctttatcctgggccagaccgttcaaggcatagcaggaatgcccctgtatatcttgggtatcactttcatcgatgaaaacgtagccactcattccgccggcatttacttaggtatcgccgagtgcacatcaatgatcgggtatgccctgggatacgtgcttggggcccccctagttaaggtccctgagaatacgacttcggccacgaataccacggtgaataatgggtcccccgagtggctttggacatggtggataaatttcctgttcgctgccgtcgtcgcttggtgtacactcatccccctgtcgtgctttccaaacaacatgcccggctccacaagaataaaagcacggaagcgcaaacaactccacttcttcgatagtcggctcaaggacttaaagctcggtacaaatattaaagatctttgcgccgccctctggattctgatgaaaaacccagtgttgatttgtctggcactgagcaaagcaactgaatacctggtgattatcggagcatccgagttccttcctatctatcttgagaaccagttcatcctcaccccaacagtggccacaacgcttgcaggcttagtgctgatcccaggcggggcactgggtcagctgcttgggggagttatcgtgagtacgctggaaatgtcgtgtaaggcacttatgcgatttataatggtaacatcggttatctcactcatccttcttgttttcatcatcttcgtccgctgcaacccagttcaatttgccgggataaatgaggactacgacggcactggaaaactgggcaatttgactgcgccttgcaacgagaaatgcagatgcagttcttccatctattcttctatatgtggtcgtgacgacatcgagtattttagcccatgctttgcgggatgcacctactcaaaagcccaaaatcagaaaaagatgtattacaactgctcatgtataaaggaaggcctaatcaccgccgatgcagagggagactttatcgatgcccggcccggtaagtgtgatgctaagtgttataagctccccctcttcattgctttcattttcagcactctcattttttcaggctttagcggggtcccgatcgtccttgcgatgacccgcgtggtccctgacaaactgcgctccctggccctcggagtcagttacgtgattttgcggatattcggaacgattccaggcccttcaatctttaaaatgagcggtgagacctcttgtattttgagggatgtgaacaaatgtggccacaccgggaggtgctggatctacaacaaaactaagatggcgttcctgctagtcggcatttgctttttatgtaaattgtgcacaattatctttaccaccatagcctttttcatttataagcggaggctcaatgagaacactgactttccagacgtcaccgtcaaaaatccaaaggtcaaaaagaaagaggaaaccgacctatag

SEQ ID NO: 206500 - DNA, 1401 bp, Artificial Sequence
  Description of Artificial Sequence: Synthetic coding sequence
atgttcgtgggcgtggcccggcacagcggcagccaggacgaggtgagccgaggggtggaacctctggaagcggccagagcacagccggctaaggatagacgggccaaggggacaccaaaaagcagcaaaccaggcaagaaacatcgctacctccggctgctacctgaggctttgatccgctttggaggctttagaaagcgcaaaaaggctaaatcttccgtgagcaagaagcctggtgaggtggatgatagcttggagcaaccatgcggtcttggatgtctggtctctacatgttgtgaatgctgcaacaacatccgctgcttcatgattttttactgtatcctgctgatttgccaaggcgtggtgtttggactgatcgatgtgtccattggagattttcaaaaggagtaccagcttaaaaccattgagaaactcgctctcgagaagagctacgacatctcttctgggctcgtggctatctttatcgccttctacggggatcgcaagaaggtgatctggttcgtcgcttcctcattcctgattggcctaggaagtctactgtgtgcatttcctagcatcaacgaggagaacaaacagtccaaggtgggcattgaggggatcgccgagtgtacttccatgattggctacgctctggggtacgtcctgggagcaccgctggtgaaagtgcccgagaataccacgagcgcgacgaaaacaggaaagctgggaaatctcactgccccatgtaatgagaaatgtcgttgttcgtcctctatctactcaagtatctgcggtcgggacgacatagaatatttcagtccatgtttcgctgggtgtacttacagcaaagcacagaatcagaagaagatgtactacaattgctcatgtattaaagagggccttatcacggccgatgccgaaggggatttcattgatgctcgtcctggaaaatgcgacgcaaaatgctataagctacccctttttattgcctttatattcagtacgttgattttcagcgggttttcaggagtcccaatagtgctggcaatgacccgtgtggtgcccgataaattaagatccttggctctgggcgtgagttatgtgatcctccgaattttcgggaccatccccggcccaagtatctttaagatgtccggcgagaccagctgtatcctgcgggacgtcaacaaatgcgggcatactggcaggtgctggatctacaataagactaagatggccttcctgttagttggcatctgttttctgtgtaagctctgcacaatcatttttacaacgatcgcattcttcatatataagcgccgcctgaatgagaacacagattttcccgatgtgacggttaaaaatcccaaagtcaagaaaaaggaagagaccgacctgtag

SEQ ID NO: 206501 - DNA, 1974 bp, Artificial Sequence
  Description of Artificial Sequence: Synthetic coding sequence
atgttcgtgggcgtggcccggcacagcggcagccaggacgaggtgtctagaggtgttgagccattggaggctgctagagcccagccggccaaggataggagagcaaaaggcactccaaaatcctccaagcccggtaagaaacatagatacctacgccttctccccgaggcattaatccggtttggcggatttcgtaaaagaaagaaggccaagtcatccgtctccaaaaagcccggggaggtagatgactccctcgaacagccttgcggcctcggatgcctggtctcaacctgctgcgagtgctgtaataacataagatgtttcatgatattttactgcatactcttaatttgtcagggcgtggtttttggacttatcgacgtttcaattggcgacttccagaaagagtaccagctcaagaccatcgaaaaactggccctggaaaagtcttatgatattagcagcggattggtcgcaattttcatagccttttatggcgacagaaagaaggttatctggtttgttgcatcctcatttttgatcggcctcgggtctctgttgtgcgccttcccttccattaatgaggaaaataaacagagcaaggtgggaatagagggaatagcggagtgcacctcaatgattgggtatgctctaggatacgtccttggcgctccccttgtgaaggttcctgagaacactacctctgctaccaacacaacagtcaataacggctcgcctgagtggctgtggacctggtggatcaatttcctttttgctgccgtggtggcatggtgcaccctcattcctctgagctgtttccctaataatatgcctggtagcaccagaatcaaagctagaaaacgtaagcagcttcactttttcgacagcagactcaaagatttaaaactcggaaccaacatcaaggatctttgcgcagcactgtggatcctaatgaaaaatcccgttctcatttgcctggcactctcaaaggcaacagaatacttggtcatcatcggggcttcagagttccttcccatatatctcgagaatcagttcattttgactcccaccgtggcaacgactctggccgggctcgttcttatacctggaggcgctttgggacagctcttgggtggcgtcatcgtctccactttggagatgagctgcaaggcccttatgcgctttatcatggtgacatctgtcatcagcctaattctattggttttcatcattttcgtccggtgcaatcctgtgcagtttgctggaatcaatgaagattatgacggcactggtaagctgggcaatctgacggctccttgcaatgaaaaatgtcgatgctcctctagcatttattcaagtatctgcggaagggatgacatcgagtatttcagcccctgcttcgctggctgtacatattccaaggctcagaatcagaagaaaatgtactacaactgtagttgtatcaaagagggcctcattacagctgacgcggagggcgattttattgatgcaagacctggaaaatgcgatgcaaaatgctataagctgccactctttattgccttcatcttcagtacgctcatatttagcggcttctccggcgtaccaatcgtcctcgcgatgacccgagtggtgccagataaactgagaagcctggccttgggggtaagctacgtcatcctcagaatattcggtactattcctgggccgagtatctttaagatgtccggagagacaagctgtattctgagggatgtcaacaagtgcgggcataccggccgttgctggatctataataaaactaaaatggctttcctgctcgttggcatttgctttctatgcaagctctgcactatcatctttaccaccatcgcgttcttcatctataagagaagacttaatgaaaacacagatttccctgatgtgacagtgaagaaccccaaggtgaagaaaaaagaggagaccgacctctag

SEQ ID NO: 206502 - DNA, 2160 bp, Artificial Sequence
  Description of Artificial Sequence: Synthetic coding sequence
atgttcgtgggcgtggcccggcacagcggcagccaggacgaggtgtctcgtggagtggagcctttggaagctgccagggcccaacctgcaaaggaccgacgtgccaaaggcaccccgaaatccagcaaacctgggaaaaagcatagatacctcaggcttttgcctgaagcccttattcgttttggcgggttccggaagaggaagaaagccaaaagcagcgtgagcaaaaagcccggtgaagtcgatgactcccttgagcagccctgtggccttggttgcctggtttccacatgctgcgaatgttgcaacaacatccgctgctttatgatattctattgcatcctactgatctgccaaggagtggtttttggactgatcgacgtctctatcggtgacttccagaaggagtatcagttgaagactatcgagaagctcgccctcgaaaagtcgtatgacattagtagcggacttgtggcaattttcatcgccttttacggcgatcgcaaaaaggttatctggttcgtggccagttcttttttaatcggtcttggcagtttactgtgtgcgtttcctagtatcaatgaggaaaataagcagagcaaagttggaattgaagatatctgtgaggagattaaggtcgtctccggatgccagtcctccggtatcagcttccagtctaaatatttatcgttctttatactggggcagacagtgcagggcattgccgggatgcccttgtatatcctgggcattacttttatcgacgagaacgttgccactcactccgcgggtatctatcttggaatagctgagtgcacgagcatgatcggctacgctcttggctatgtgctgggggcacccctggtcaaggtccccgagaacacaaccagtgcaaccaacaccaccgtgaacaatggatctcctgagtggttgtggacatggtggatcaattttctgtttgcagccgttgtggcgtggtgcacactgattcccttgtcttgctttccaaataacatgcccggctccactcggattaaggctcgcaaaagaaaacagcttcatttttttgattcccgcctcaaggacctgaagctaggcaccaatatcaaagatttatgcgcggccctgtggatcctgatgaagaatccagtgctgatctgcttggctctgagtaaagccaccgagtatttagtgatcatcggagcaagcgagtttctgcctatatatctggagaaccagtttattttgactccaaccgtcgccaccacacttgctggactagtgcttattcccgggggagcactgggtcagctgctgggcggggtcatcgtgtcaacactggaaatgtcatgcaaagccctgatgagattcatcatggtgacctcagtcatttcacttattctactggtattcatcattttcgtgcgatgtaaccccgttcagttcgcaggaattaacgaggactatgacgggacgggcaagctcgggaacctgaccgcaccatgcaatgagaagtgtcgttgctcaagctctatctatagcagcatctgtggaagggatgacattgagtacttctccccatgtttcgccggctgtacttattccaaggcccagaaccagaagaagatgtattacaactgctcctgcattaaagaggggttgattacagcagacgcagaaggagacttcattgacgcgagacctggtaagtgcgacgctaaatgctacaagctacctcttttcatcgcctttatcttctccacccttatcttctccggcttttccggcgttccaattgtgctggccatgactcgagtggtcccggacaagcttcgcagtctggcccttggagtgagttatgttatccttcgcattttcggcactattcccggacccagcatcttcaagatgtctggcgagacttcatgtatcctgcgcgatgtgaacaaatgtggccacaccggacggtgctggatatacaataagactaaaatggcgttcctcctggttggcatttgtttcctgtgtaaactgtgcaccattatattcaccacaatcgctttttttatttacaagcgacggttgaatgagaatactgactttccagacgtcactgtcaagaatccgaaggtaaagaaaaaggaggagacagacctgtag

SEQ ID NO: 206503 - DNA, 78 bp, Artificial Sequence
  Description of Artificial Sequence: Synthetic coding sequence
ctgaacgagaacaccgacttccccgacgtgaccgtgaagaaccccaaggtcaagaagaaagaggagacagacctgtag

SEQ ID NO: 206504 - DNA, 1401 bp, Artificial Sequence
  Description of Artificial Sequence: Synthetic coding sequence
atgttcgtgggcgtggcccggcacagcggcagccaggacgaggtgtccaggggcgtagagcctcttgaagccgcacgagctcagcccgccaaagatcggcgagcaaaaggtactccaaagagtagcaaacccggcaagaagcaccggtacttacgcctgttacccgaggccctgattcgattcgggggttttcgcaaacgaaagaaagctaagagctctgtttctaagaaacctggcgaggttgatgactccctggaacaaccctgtggcctgggttgtctggtgtctacttgttgtgaatgttgtaacaacattcgatgtttcatgattttctactgcattctactgatttgccaaggggtggtgttcggcctaattgacgtcagcattggggattttcagaaggagtatcaacttaagaccatcgaaaaattggctttggaaaaaagctatgatattagttccggcctggtcgcgatctttattgctttctatggtgaccgaaaaaaagtaatttggtttgtagccagttccttcctcatcggcctcggttctcttctctgcgcgttcccttcgatcaatgaagaaaacaaacagtctaaagtcggtattgaggggattgccgagtgtacctcgatgattgggtacgctcttggttacgtgcttggcgctcccctcgttaaagtgccagagaataccacgtcggccaccaagaccgggaagctgggaaacttgaccgccccatgcaatgaaaagtgcagatgtagctccagcatttacagcagcatatgcgggagggacgacatcgagtatttctcaccttgttttgccggatgcacatatagtaaggcacagaaccagaaaaaaatgtactacaactgttcgtgtatcaaagaaggactcattactgccgacgccgagggggattttatcgacgctaggcccggcaagtgtgatgccaagtgttacaagctgcccctcttcattgcctttattttctctaccctgattttctctggcttctccggcgtgcccatagtgcttgccatgacccgggttgtgccagacaaattgaggtctctggccctcggcgtctcttatgtgattttgcgcatcttcgggacaatcccaggacccagtattttcaagatgagcggggagaccagctgtatcctcagagatgtgaacaagtgtggtcacacagggaggtgttggatttacaataagactaaaatggcattcttgctggtcgggatctgcttcttgtgtaaactttgtacgattatttttaccactatagctttctttatttataaaaggcgactgaatgagaacacagattttcccgatgtaaccgtgaagaacccaaaggtgaagaagaaggaagagacagatctctag

SEQ ID NO: 206505 - DNA, 351 bp, Artificial Sequence
  Description of Artificial Sequence: Synthetic coding sequence
atgctgagctgccggctgcagtgcgccctggccgccctgagcatcgtgcttgctttagggtgcgttactggcgctccctcagaccccagattgaggcaattcctccaaaaatcattagcagcagcagctggtaaacaggaacttgccaagtacttccttgctgagttgctttcagaacctaatcagaccgagaacgatgccctggaaccggaggatctgtcacaggccgcggagcaggatgagatgagactggagttgcagcggtctgcaaattctaatccagccatggccccccgagagaggaaggccggctgcaagaattttttctggaaaaccttcacaagttgctag

SEQ ID NO: 206506 - DNA, 1176 bp, Artificial Sequence
  Description of Artificial Sequence: Synthetic coding sequence
atgttccccaacggcaccgccagcagccccagcagcagccccagccccagccctggaagctgcggggaggggggtggaagtcggggccccggcgcaggagcagctgatgggatggaggagccaggcaggaacgcatcgcagaatggcactctctcagaaggccaggggagtgcaatcctgatctcttttatatatagcgttgtgtgtctcgtaggtctgtgcggaaactccatggtgatttatgtgattctgaggtatgccaagatgaagacagccacgaatatatacatcctaaatttagctatcgccgacgaactcctaatgctcagcgtccctttcttggtcacttccacactgctccgccattggccattcggagccctgctttgcagactcgtcctctcggttgatgccgttaacatgttcacctctatttattgcttgaccgtgctcagcgttgacagatacgttgccgtggtccaccctattaaggcggctagataccgacgacctactgtggctaaggtcgttaatttgggcgtgtgggtgctgtctttactggtgattttgccgatcgtggtcttcagccgtactgctgctaacagcgatggcactgtagcgtgtaacatgctgatgccggaacccgcacagcggtggctggtgggctttgtgctttacactttcctgatgggatttctcttgcctgtgggtgcaatctgtctatgttatgtcctgattattgccaaaatgcggatggtggctctgaaagctggttggcagcagcggaaaagatctgaaaggaagattaccctgatggtaatgatggtcgtgatggtttttgtcatttgctggatgcccttctacgtggtgcagttggtgaatgtgtttgcggaacaggacgatgccaccgtatcacagttgtctgttattctggggtacgccaattcatgtgccaacccaattttgtacggatttctgagcgataacttcaagagatcttttcagcggattctgtgtctctcttggatggataatgctgccgaggagccagtcgattattacgccacagctctgaagtctcgagcttactccgtggaagacttccagccagagaacctagaaagtgggggcgtcttccgaaatggaacctgtacgtcacggatcaccacgctctag

SEQ ID NO: 206507 - DNA, 1257 bp, Artificial Sequence
  Description of Artificial Sequence: Synthetic coding sequence
atggacatgctgcaccccagcagcgtgagcaccaccagcgagcccgaaaatgccagcagcgcttggccgcccgatgccacactggggaacgtttcagctggtccttctcccgccggcctggctgtctccggtgtactcattcccctggtgtacttggtcgtgtgcgtggtcggtctcctgggtaacagtctggtgatctatgttgtattgcgccataccgccagtccctctgttactaatgtttatatcctgaacctcgccttagctgatgaactcttcatgctgggtctcccatttctggccgctcagaatgcattatcgtactggcctttcggctccctgatgtgtcgcctcgttatggccgttgacggcattaatcagttcacaagcattttttgtttaaccgtgatgagcgtggatcgctacctggcggtggtccaccccaccagaagtgcgcggtggcgaacagctccggtggctagaactgtgtccgctgcagtctgggtagcgtccgcagtggttgtcctgcccgtcgttgtctttagcggagtccctcgcggtatgagtacttgtcacatgcagtggcccgagcctgcagccgcatggcgggccggattcattatctacacagccgccctggggttttttgggccacttctggttatatgcctgtgttatttgctgattgtggtgaaagtgaggtccgctggtcggagggtttgggccccgagctgtcagaggcgcaggcgtagcgaacgaagagtcaccagaatggtggtggctgtggtagccctgtttgtcctgtgttggatgccgttctatgtgctgaacatcgtgaatgtcgtctgccctctccccgaagagccagcctttttcggcctctactttcttgtagtggctctgccctacgccaacagctgtgccaatcccatactctacggctttctaagctacagatttaagcaaggattcagacgcgtgcttctgcggccatccaggagagtgcgttcacaggaaccaacggtaggcccccccgaaaagaccgaggaagaggacgaggaggaagaagacggggaagagagtcgcgaggggggcaagggtaaggagatgaacggcagagtgagccagatcacccagccaggcaccagcggtcaggagcgcccaccgtccagggtggcctcaaaagaacaacagctgcttccacaggaggccagcaccggagagaagtcatccaccatgaggataagttatctgtag

SEQ ID NO: 206508 - DNA, 1257 bp, Artificial Sequence
  Description of Artificial Sequence: Synthetic coding sequence
atggacatgctgcaccccagcagcgtgagcaccaccagcgagcccgaaaatgcctcatccgcctggcctcccgacgcaaccctggggaatgtgagtgccggccctagccccgctggacttgccgtgagcggagtgctcatcccgctagtctacctggtggtgtgtgtggtcggactgctgggcaacagcctggtaatttatgttgttcttaggcatactgccagcccctccgtcacaaacgtgtatatcttgaacctggctctcgcagacgagctattcatgctgggcttacctttcctcgcagctcaaaatgccctttcctactggccatttggttcccttatgtgccggctggttatggccgtcgatggtataaatcagtttacgtccatcttctgtctcacagtgatgtccgtagacagataccttgccgtagtgcatccaacgcggtccgcaaggtggaggaccgcgccggtggcccggacagtatctgctgctgtttgggttgcctcggcggtggtggtactccccgtggtcgtgttctccggagtgcccaggggcatgagcacttgtcacatgcagtggccagagcccgcagccgcctggagagccgggtttattatttataccgcagctctgggcttcttcggacccttactggttatatgtctgtgctatcttctgatcgtggtgaaggtacgttctgccgggagacgtgtctgggcaccatcttgtcagaggagaaggcgatcagaaagaagagtgaccagaatggtggtggccgtggttgcactcttcgtgctttgttggatgccattttacgtactgaatatcgttaatgtggtttgtccactccctgaggagcctgctttcttcggtctgtatttcttggtcgtggccctcccctacgctaattcctgcgccaatcctatactttacggtttcctatcatatcgatttaagcagggttttcgcagagtattgcttcggccttcccgtagggttcgcagccaagagccgacggtaggtccccccgaaaaaacagaggaagaagacgaggaggaagaggatggcgaggaatcacgggaaggtgggaagggcaaggagatgaatggtcgcgtgtcacagattactcaaccgggcacctcagggcaagaaaggcctccaagccgcgtggcaagcaaggagcagcaattactcccccaagaggctagcactggtgaaaagagttccaccatgcgtatctcatatctgtag

SEQ ID NO: 206509 - DNA, 1167 bp, Artificial Sequence
  Description of Artificial Sequence: Synthetic coding sequence
atgagcgcccccagcaccctgccccccggcggcgaggagggcctggggactgcctggcccagcgctgctaacgcgagcagtgctccagcagaggctgaggaagccgttgcaggcccgggggatgcgagggcagccggaatggtggctatccagtgcatctatgccctcgtgtgtctcgtgggtctcgttggtaacgctctggtcattttcgtcattctgcgctatgcaaagatgaagacagctactaatatttatctccttaacctggctgtggccgatgaactgtttatgcttagcgtacccttcgtcgccagctcagcagcactgaggcattggccgttcggaagcgtgctctgtcgggcagtcttgagcgtggatggactcaacatgttcacctctgtgttttgccttactgtcttatccgttgatcgatacgttgctgtggtgcaccccctgagagccgcgacctatcgtagaccatcagtagctaaactcatcaaccttggggtgtggctggcctcactcctggtgacattacccatcgcgatctttgctgacactcggccagcacgtggcggtcaggctgtggcttgcaatctgcagtggcctcatccagcgtggagcgccgtgtttgtggtgtacactttcctcttaggcttcttgcttcccgtgctagccatcggactgtgctacctattaattgtgggcaagatgcgtgcagtcgctcttagagccggctggcagcagcggaggcggtctgagaaaaaaatcacgcgactggtcttaatggtagtcgtagttttcgtactttgttggatgcctttctatgtggtgcagctgttaaacttgttcgtcacgtccctcgatgccacagtgaatcacgtgagcctgattttatcctacgcgaacagctgtgccaatccaattttgtatgggttccttagtgataactttcgcaggttcttccagcgggtactctgcctgaggtgctgtctgctggaaggtgcaggtggcgctgaagaggagcccttagattattacgccactgctctgaagtctaaggggggcgcaggttgcatgtgtccgccccttccttgtcagcaggaggccctacaaccagagccaggtcggaagagaatcccattgacgcgcactaccactttctag

SEQ ID NO: 206510 - DNA, 1095 bp, Artificial Sequence
  Description of Artificial Sequence: Synthetic coding sequence
atggagcccctgttccccgccagcacccccagctggaacgccagcagtcccggcgccgccagcggaggaggagacaatcggaccttagtgggcccagcaccctctgcgggcgccagggctgttttggtgcctgttctctatctgcttgtctgcgccgcaggactgggcgggaatactctggtcatctacgtggttttaagatttgctaagatgaaaaccgtcacgaacatctatattctcaatctggccgtagccgatgtattgtacatgttgggtctgccattcctagcaacacaaaacgcggctagcttctggccttttggccctgtcctctgcagacttgtcatgaccctcgacggagttaaccagtttaccagcgtgttctgtttgactgtgatgagtgtggaccggtatctcgctgtggtgcaccctcttagtagtgctcgctggcggaggcccagagtggccaagctggcgagcgctgctgcgtgggtcctgtctctgtgcatgtccctaccactactcgtgttcgcagacgtgcaggaaggagggacttgtaatgctagctggcccgagccagttgggctctggggagccgtcttcatcatctacacagccgtgctcggcttcttcgcgcctctgctagttatctgtctgtgctacctgctcattgttgttaaagtgagagcagctggagtccgcgtagggtgcgtgagacggagaagcgagcgaaaggtgactcggatggttttagttgtggttctcgtgttcgcaggatgctggctgcccttctttacagtgaacatcgttaacctggccgttgccctccctcaagagcctgcctcagccggcctttatttttttgtggtgatcctgagttatgccaatagctgcgcaaatcccgtgctgtatggtttcctatccgacaattttcgccaatctttccagaaggtattatgtctgcgaaagggctccggggcaaaagacgcagacgcaactgagcccagacccgaccggatacgacagcagcaggaagcaacgccacctgcacatcgggcggccgccaatggcttaatgcagaccagcaaactgtag

SEQ ID NO: 206511 - DNA, 1095 bp, Artificial Sequence
  Description of Artificial Sequence: Synthetic coding sequence
atggagcccctgttccccgccagcacccccagctggaacgccagctcacccggcgcagctagcggcgggggtgataaccgcaccctggtcgggcctgcacccagtgcgggggcacgcgctgtgctggttccagtgctgtatcttttagtgtgcgccgcaggtctaggagggaacaccctggtgatttacgtggttcttcggttcgccaagatgaagactgtgaccaatatctatatcttgaacctggctgtggcagacgttctgtacatgttgggcctgccatttttggctactcagaatgccgcctctttctggccatttgggccagtgctgtgtagactggttatgacactggacggagtgaaccaattcactagtgtgttttgtctcacggtcatgtcagtggacagatacctcgccgtggtgcacccattatcttcagcccgctggcgaagacctagggtcgcaaagctcgcatctgctgctgcttgggtcttgtcattatgtatgagcctgccacttttggtatttgctgatgtccaagagggcggcacttgcaatgcatcatggcccgagcccgtgggcctgtggggcgcagtatttatcatatataccgccgtactgggatttttcgcccctcttcttgtgatttgtttatgctacctgctcatcgtggtaaaggtgcgggccgctggggtccgagtcggctgtgtgagaaggagatcagaacggaaagttactcgtatggtgctggtggtcgttctagtgtttgctgggtgttggctgccgttctttactgtcaacattgttaatctcgccgtggctctccctcaggaacctgcgagtgccggcctgtacttcttcgttgtgattctgagctacgccaattcctgcgccaaccccgtgctgtatggcttcctcagcgataattttagacagagtttccagaaggttttgtgtctgcgcaaaggctccggagccaaagatgcagacgcgacggagccacgcccagacagaattcgacagcagcaagaggccactccaccagcccatcgcgccgcagccaacggcttgatgcagacttctaaactgtag

SEQ ID NO: 206512 - DNA, 822 bp, Artificial Sequence
  Description of Artificial Sequence: Synthetic coding sequence
atggagcccctgttccccgccagcacccccagctggaacgccagctcaccaggggcggccagtggcggcggagataacagaactttggtcggccccgccccatctgctggcgctcgggctgtgctggtgcccgtcttatacttactggtgtgcgctgccggcttgggaggaaacacgctcgtgatttacgtggtcctacgcttcgctaagatgaaaacagttacaaatatatatatcctcaatctggctgtggcagacgttctctatatgctgggcctgcctttccttgccacacagaacgccgcctctttctggccattcggccccgttctctgtcgtcttgtgatgacgttggacggtgtgaatcagtttacaagcgtgttttgccttacagttatgtctgtagaccggtacttagcagtggtgcaccctctcagcagcgcccgatggcggcggccacgcgtggccaagttggcttcagcggccgcttgggtcctgagcctttgcatgtctctgcctctgcttgtcttcgccgatgtccaggagggaggtacgtgcaatgcttcgtggccagagccggtgggactgtggggcgcagtctttatcatatacacggcggtgttagggttctttgcacccctcctcagggggtctggcagggccggagacgctaacggacggccttgggaatctaggagactcccccccaggatcgtcctgcctcctccgccccagacccccgccttcccgggtgcaccaggcccagaaagaggtccccgcgaaccttgctgggggctttgggggactctggctttgctctag

SEQ ID NO: 206513 - DNA, 6978 bp, Artificial Sequence
  Description of Artificial Sequence: Synthetic coding sequence
atggccaccaacatcgagcagatcttccggagcttcgtggtgagcaaattccgcgagatacagcaggaactgagctccggaagaaacgaagggcaactgaacggagagacaaacactcccatagaaggcaaccaggccggtgatgccgcagcgtctgctaggagcctgcccaacgaggaaattgttcagaagatcgaagaagttctgtcaggagtgctcgatacagaactccgctacaagccggatctgaaagagggctcccgcaagtctagatgtgtcagtgtgcagactgatccgactgacgaaatcccaacaaagaagtccaagaaacataaaaagcacaagaacaaaaaaaagaaaaagaagaaggaaaaggagaagaaatacaaaagacagccagaggaatccgaaagcaaaaccaaatcccatgacgacgggaacatagatttagagtcagactcattcttaaaattcgactcagagccatcagctgtcgccctggaactaccaacccgagcttttggccctagcgagaccaacgagagcccagccgtcgtgctagagccaccagtcgttagcatggaggtgtccgaaccacacattctggagaccctcaaacctgcgactaaaacagcagaattgtccgtcgtgtctacgtccgtgatctccgagcaaagcgagcagagcgtggccgtgatgcctgaaccgtctatgacgaagattctggactcttttgctgcagccccagttcccacaacaacgcttgtgctgaagagttcagaacccgtagtcactatgtctgtggagtatcagatgaagtctgttctgaaatccgtggagtcgacctccccggagccaagcaagattatgcttgttgaaccgcctgtggccaaggtcctcgagccaagcgaaactcttgttgtgtctagtgagacaccaaccgaggtgtacccagaaccaagtacatcaaccactatggacttcccagagagttcagccatagaggccttacggctgccagaacagccagtcgacgtcccttccgaaatagcagattcctccatgacaaggccccaggaactgccagaacttccaaaaaccaccgccctggaactccaggagtcatcagtggccagcgcaatggaactgccgggcccccctgcaacctctatgcctgagctgcagggtccacctgtgaccccagtactggagctgcctggaccatcagccacacccgtacccgagctccctggcccattgagcacccctgtgcctgagcttcctgggcctccagccacagcagttcccgagttacccgggcctagcgtgactccagtgccccagctgagtcaggagctaccgggactgcctgccccgagcatgggtctggagcccccgcaggaagttccggagccacccgttatggctcaagagcttccggggctgcctttggtcacagctgccgtcgagctgcctgagcaacctgccgtcactgtggctatggaactgacggagcagcccgtgacgacgacagagctggaacagccggttggcatgacaaccgtcgaacaccctggtcatccagaagtgactaccgccaccggcttactggggcaacccgaagccacgatggtactggagctcccaggacagccagtggcaacgactgccttagagctgccaggccagccttctgtgacaggcgtccctgagctgccaggcctgccttcagcaacgagggccctcgagctgagtggacagccggttgctactggcgcccttgagctcccagggcctctgatggcagcaggagcgctagaatttagtgggcagtccggcgctgccggcgctctggaactcttagggcagcctcttgcaacgggagtgctggagctgcctgggcagcccggggcccccgagctgccgggacagccagtggctacagtggcactcgagattagtgttcagtcggtcgttaccaccagcgagctgagcaccatgacagttagccaatcacttgaagtccctagcactaccgcactggaaagttacaacacagtggctcaggagttgcccaccacactggtgggcgagacctctgtgaccgtcggggtggatccactgatggcgcccgagagtcacatcctggcttctaatacaatggagacccacattttagccagtaacaccatggacagtcagatgctggcgtcaaacactatggactctcagatgctggcctctaataccatggactcccagatgctggcaagttcaactatggattcccaaatgctcgctacatcctcaatggattcccagatgttagccacatcctctatggattctcagatgctagctacatctacaatggactcacagatgctcgctacctccagcatggacagtcagatgttggctacatccagcatggatagtcagatgcttgccactagcagtatggattctcaaatgctggccacgtcaagtatggactcacagatgcttgctacatccactatggactcgcagatgctcgcaacttctaccatggactcacagatgctggccacctctagcatggactctcagatgcttgcttctggcaccatggacagccagatgctggccagcggaaccatggacgcacagatgctggcctcgggaaccatggatgcgcagatgttggcttcctctacccaggatagcgctatgctggggagtaagagtcccgacccgtacaggctggcccaggacccatatcggctggcccaagacccctacagacttggccatgatccgtaccgcctggggcacgacgcataccggttgggccaggacccatacagacttggacatgatccctaccggctgacccctgacccataccgcatgtcacccaggccatatcggattgcaccgaggtcctaccggatagccccccggccttaccgcttagcaccccgcccgttgatgctggccagcagaagaagtatgatgatgagctacgcagcggagcgctctatgatgtcctcttatgaaaggagcatgatgtcctacgaaagaagtatgatgagcccaatggctgaacgttccatgatgtccgcttacgagcgtagtatgatgtctgcgtacgagaggtctatgatgtcccccatggccgagcgatccatgatgagtgcctacgaacggagtatgatgagtgcctatgagcggtcaatgatgtcccctatggccgatagaagcatgatgtctatgggagctgacagaagtatgatgtcgtcatactctgctgccgataggtcaatgatgtctagctactcagccgccgacaggagcatgatgtccagctacaccgccgatcggtccatgatgtctatggcggcagacagctatacagacagttataccgatacctataccgaggcctatatggtaccaccactcccacccgaggagccacctactatgccacctctccctccagaggaaccgccaatgacgcccccactacccccagaagagcctcctgagggtccagctctccctactgagcaatcggcacttactgctgagaacacttggccgaccgaggttcccagctctccatcagaggaatctgtctctcaacccgagcccccagttagccagtcggagattagtgagccaagcgctgtgccaactgactacagcgtatctgcaagcgatccctccgtgctggtgtccgaagcagctgttacagtccctgaaccccccccagagccagagtcctctataacactgacgccagtggagtccgccgtagtagcagaggagcatgaggtagtacccgagagacctgtgacttgtatggtttccgagaccccggccatgagcgcggagcccaccgtgttagcgtctgaaccccccgttatgtcagaaacagctgagactttcgattccatgagggcttctggccacgtggcatcagaggtgtcaactagtctcctggtgccagccgtcactactcccgtactggcagaaagtattctagaacccccagccatggcggcccccgagagttccgccatggctgtactggagtcttctgctgtgactgtgcttgaatccagcaccgtgactgtgctcgagtcgagcaccgttaccgtacttgagccctcagtggtaaccgttcccgagccaccagtggtggcagaaccagactatgttacaatcccagttccggtagtgagtgcactagaacccagtgtcccagtgttagaaccggcggttagcgtattacaaccttctatgatcgtgtcagagccttctgtaagcgttcaggaaagcacagttacagtgagcgagccagctgttacggtttctgagcaaacccaggtgatcccaacagaagtcgctatcgaatcgactccaatgatccttgagtcttctatcatgtcgtctcacgtgatgaaagggataaatctgagcagtggggaccagaatctggcaccggagatcggcatgcaggaaatagctcttcattccggggaagaaccccacgctgaagagcacctgaaaggcgacttctatgagtctgagcacggcatcaacatagacctgaacatcaacaaccacttaatcgctaaggagatggaacacaacactgtctgtgccgccggaacatcgcccgtcggagaaatcggagaggaaaaaatcctgccaacgagcgagacaaagcagcgtaccgtgctggatacctatccaggggttagcgaagcagacgcaggcgagactctttcatccaccggcccgtttgcccttgaaccagacgccactggaacttctaaagggatcgaattcacaacagcctctacactgagcctcgtgaataaatacgacgtagatctgtctctaacaacccaagacactgaacacgatatggtcatctcgaccagcccctccggcggctcggaggcagacatcgaaggccctctcccggctaaggacatacatttagatctgccgtctaataacaatctggtcagcaaagacactgaggaaccgcttcctgtcaaagagtctgatcaaaccttggctgcactgctgtccccaaaggaaagctcagggggcgagaaggaggtccccccacctcctaaagagaccctaccagatagcggtttttccgccaatatcgaggatataaacgaggctgatctggtcaggcccctcctccccaaggatatggaaagattgacatccctccgcgccggaattgagggccctttgcttgcatccgacgtgggacgggaccgatcggccgcaagccccgtggtgagctccatgccggagagggccagcgaatcatcctctgaagagaaggacgattatgaaatcttcgtcaaagtaaaggacacgcatgaaaagtcaaaaaagaataaaaacagagataagggcgagaaagagaagaaacgagactccagtctgcgttctagatcgaagagaagtaagtcttctgagcacaaatccagaaagaggacgtcggaaagcagaagtcgcgcacgcaaaagaagctccaagagcaaaagtcatcggtctcagacccgtagtagaagcaggagccggagacgtaggcgctccagcaggtcacggtccaagtctcgcggccggagatcagtgtcgaaggaaaagagaaaacggagtcccaagcatcgttcaaaaagccgcgagagaaagcggaagcggtcttcatcgagggataatcgaaaaaccgtcagagcgcggtcccgcactccatcacgcagatcacggagccataccccctccagaagaagacgttcacgatctgttgggaggcgccgatccttcagcatctcacctagccgaaggtcccgcacacctagtcggcgctcccgtactccttctcgtaggtctcgcacaccctctcgccggagtaggactccctcccggcgctctagaacacctagcagacgtagcaggacaccatccagacgccgacgctcgagaagcgtggttcggagacgatcattctccatttcccccgttaggttacgtcgcagccgcactcccttgcgccgcagattctcaaggtcgcctatacggagaaagagatcgaggagcagcgaacgggggagatccccaaaacgtcttactgacctggacaaggctcagcttctggaaatcgcgaaggctaacgctgctgccatgtgcgctaaggctggtgtccctcttccccctaacctcaagccagctccaccacctactatcgaagaaaaagtcgctaagaagtcagggggagccacaatcgaggaattaactgagaagtgtaagcaaatagctcaatccaaggaagacgacgatgtaatcgtgaataaacctcatgtttccgatgaggaagaggaagagccccctttttaccaccatcccttcaaactcagcgagcccaagcccatatttttcaatctgaatattgccgccgccaagccaactcccccaaaaagccaggttaccctgaccaaggagttcccggtgagctccggcagtcaacaccgcaaaaaggaagccgactctgtgtacggggaatgggtcccggtagagaagaacggggaagaaaataaagacgacgacaatgttttcagtagcaacctgccatctgaacctgtcgatatttcgacagcaatgagcgagcgtgcactcgcccagaaaaggcttagcgagaacgcctttgacctggaggctatgtctatgctgaatcgcgcccaggaacgcatcgatgcatgggctcagttaaatagtatccctggccagttcactggcagtacaggcgtgcaagtgcttactcaggaacagctcgcaaacacaggggctcaagcctggattaagaaagggcagatattggtggccgtgttcctgcctcggtccgtgcccgctgtgctgtttacaaccctgttactccctcggcccaggatatcctcatag

SEQ ID NO: 206514 - DNA, 6912 bp, Artificial Sequence
  Description of Artificial Sequence: Synthetic coding sequence
atggccaccaacatcgagcagatcttccggagcttcgtggtgagcaagtttcgggaaattcagcaggagctctccagcggaaggaacgagggacagctaaacggcgaaactaatacccctatcgagggcaaccaggctggtgacgcagcagcaagtgcaagatcacttccgaatgaggaaatcgtgcagaagatcgaagaggtattgtctggggttcttgacaccgaactgcgctataaacccgacttgaaagaaggcagccgcaagtcccgctgtgtgtccgtgcaaacagaccccactgatgaaatccccaccaagaaatctaagaagcacaagaagcataaaaacaagaagaaaaagaagaagaaggagaaagagaagaaatataagcgacaacccgaggagtcagagtctaagacaaagtctcacgacgatggtaacatcgatttggagagtgactcatttttaaagtttgactccgaacccagcgccgtggcactcgaacttccgactagggcctttggcccttcagaaaccaatgaaagccctgccgtggtgctggagccccctgtcgtcagtatggaggtgtccgagcctcatatcctagagaccctgaagcccgcgacaaagacagccgagctctctgtcgtcagcaccagcgtgatatctgagcagagtgagcagtctgttgccgtgatgccggaaccatcaatgaccaagatactggactcgtttgccgccgcgccagtgcccaccactaccttggtccttaaatcgagcgagcctgtggtaactatgtcggtggagtatcagatgaaatctgtgctgaaatccgtagaatctacttctccagagcctagcaagataatgttggtggaaccccccgtcgccaaagttttggaaccctccgaaactctggtggtgtcaagtgagactcctacagaggtttatcctgagccatctacatccaccaccatggacttcccagaatcaagtgctatcgaagctctgaggttgccagagcagccagtggacgtgccttctgagatcgcggacagtagcatgaccaggcctcaagagctgccagaacttcccaagaccactgcgcttgagttgcaggagtccagtgtggctagtgctatggagcttcctggccctccagctacttcaatgccggaactgcagggaccacctgtgaccccggtgcttgagttgcctgggccctcggctactccagtgcctgagttgccgggccccctgtcaacccccgtgcccgaactgccggggcccccagccaccgcagtcccagaactgcccgggcccagcgtaacccccgtgccgcaactgtcccaagagttgcccggcctccccgcaccatcaatgggactggaaccaccacaggaagtgccagaaccaccagttatggcacaggagttgccggggctgcctctcgtcacagcagccgtggagctgccagagcagcccgccgttacagttgcaatggagctgaccgaacaacctgtcaccacgaccgaactagaacagccagtaggaatgacaaccgttgaacatcccggccaccccgaagtcaccaccgccacgggcctgttgggccagccagaggccaccatggtgctggagctccctggccagccagttgcaactaccgcccttgaactacccggacagccgagcgtgacaggagtgccagagcttcccggcttgccgtcagcgacccgcgccttagagctgtcagggcagcccgtagccacaggcgctctcgaactgcccggccctctgatggccgcgggggccctcgaatttagcgggcagtccggggccgccggcgccctcgaactgttgggacaaccacttgctaccggcgtcctagaactcccaggacagcctggagccccagagctgcctgggcagccagtggcaactgtggctctggagatttccgtgcagtccgtggtgacaacatccgaactctcgacaatgacagtgtctcaatctctggaggtgccatccacaactgctctggaatcttacaacactgtggcacaggagctgcctaccactctggtgggagagaccagcgtcacagttggcgtcgatcctctaatggcccccgaaagccacattctggccagcaataccatggaaacccacatccttgcttccaacacgatggacagtcagatgcttgcttctaataccatggatagccagatgctcgccagcaataccatggattcacaaatgctcgcctctagtaccatggattcgcagatgctggcgacgagttctatggattcccagatgctcgccacctcatcaatggattcacagatgctggccaccagcaccatggatagtcagatgcttgcaacctcttccatggatagccagatgctggcgacctcatcgatggattcacagatgctagctacttcttccatggacagtcaaatgctggcaacatcttccatggacagccagatgctggccacatccaccatggactctcagatgctggccacatccactatggattcacaaatgcttgcaacatcgtctatggacagtcaaatgctcgcctctgggaccatggactcacagatgctggcttcagggacgatggatgcacagatgctggcctcagggactatggatgctcagatgttggcctcctccacacaagactcagctatgcttggatctaagtctccggatccttaccgacttgcacaagacccctaccgcttggcccaggacccttatcgcctaggacacgatccctaccgccttggccatgatgcctacaggctggggcaggatccttatcggctgggtcatgatccataccggttaacgcccgatccatacagaatgagccctagaccctatcggatcgctccacgatcttaccggatcgctcctagaccttaccggcttgctccgcgcccacttatgctggcctctaggcgttctatgatgatgtcctacgctgcagaaaggagtatgatgagcagctacgaacggagcatgatgtcttatgagcggagtatgatgagcccaatggccgaaagaagtatgatgtctgcatacgaaaggtcaatgatgtccgcttatgaacgatctatgatgtctccaatggcggaacgctcaatgatgtctgcttacgagaggagcatgatgtccgcatacgagcgctcaatgatgtcccccatggcagacaggtcgatgatgagcatgggagctgatcgcagtatgatgagttcatattcagctgccgataggtctatgatgagcagctacagcgccgccgaccgttcaatgatgagctcatatactgctgatcgtagtatgatgagcatggccgccgattcatacaccgacagctacacggacacctacactgaggcgtatatggtgcccccattgccaccagaagagcctcccaccatgcccccgctgcctccggaagagccccccatgactcctcccctgccgcccgaagagccccccgaggggccagcgctccctacagaacaatcagctctaaccgctgaaaatacttggcctacagaagttccttcatcccccagtgaggagagtgtctctcagccggagcctccagtcagccagtctgaaatctctgagcctagcgccgtgccgacagattactcagtcagtgcctcagatccctccgtgctcgtgagcgaggccgccgtgaccgtaccggaacccccacctgagccagaatcttctatcacactcacccctgtggagagcgccgtcgtggctgaagagcacgaagttgttcctgagcggcctgtgacttgtatggtatcagagacaccagccatgagcgccgagccaaccgtgctggcctccgagcctcccgtgatgtccgagacagccgaaaccttcgactccatgcgcgccagcggccacgttgcttccgaggtatccaccagcttactggtccccgcagtgacaaccccggtcttggcggagagtatccttgaaccgcctgctatggccgcccccgagtcctctgccatggcagtgttggagagctctgctgttacagtacttgaaagcagtacagttacagttctggagagttcgaccgtcaccgtgctggaaccaagcgtggttactgtgcccgagcctcctgtggtcgcagaacccgattacgtcaccattcccgtccccgtggtttctgctctggagccctctgtaccggttttagaaccagctgtgagcgtgctgcagccctctatgatcgtgagcgaaccaagcgtttctgtgcaggaaagcacagtgaccgtttcagagcccgccgtgaccgtaagtgaacagacccaggttatccccactgaagttgcaattgagtccactcctatgattctggagtcctctatcatgagctcccatgtcatgaagggcataaatctgagttcaggggatcagaatctagctcctgaaatcggtatgcaggagattgctttgcactccggtgaggagccacacgccgaggagcacctaaagggagacttctacgagagcgagcatggcattaatatcgacttgaacattaacaaccacctgatcgctaaagagatggaacataatacggtttgtgctgcgggcacttcaccagttggggagatcggtgaagagaagatattgcctacctccgagacaaagcagagaacagtgctagacacttaccccggggtgtccgaagctgacgccggcgagacccttagtagtaccggtccatttgctcttgagcccgatgccaccggcacatctaaaggtatagagtttaccacggcttctaccctgtccctcgtcaacaaatatgacgtggacctctcactcaccacccaagatacggagcatgatatggtcatctccacctctccctccggcggcagcgaggccgatatcgagggacccctccccgccaaggacatccacctcgacctcccatctaataataacctggtgagtaaggataccgaagaaccactcccagtgaaggaaagcgaccagaccctcgccgcactgctgagtcctaaggagagtagtgggggtgaaaaagaagtccctcccccaccgaaagaaacactgccagactctggtttttctgccaatatcgaggatataaatgaggccgacctggtgagaccattactacccaaggacatggagcgcctgacaagcttgcgagcagggatcgagggaccactgctagcctctgacgtgggccgcgatcgctcagctgccagtcctgttgtcagttcaatgccagaacgggctagcgagtcatccagcgaagagaaggacgattacgaaatctttgtcaaggtgaaggatacacacgaaaagtctaaaaaaaacaaaaatcgggacaagggtgagaaggagaaaaagagggatagcagtctgaggagccgttctaaaagaagtaaatccagtgaacacaaaagccgtaagaggaccagcgaatcacgaagccgtgcccgcaagagatcctctaaaagtaagagtcatagaagccagacacgtagcaggtccagaagtaggcgacgcagacgctcatcacgttcacgatccaagagtagaggacggaggagtgtatccaaggaaaaacggaagcgtagtccaaagcaccgaagtaaaagccgcgaacgcaagagaaagcggtcatcgagtcgcgataacagaaagactgtgagagctcgctctagaaccccctcacggagaagcaggtcacacaccccctcacgccgtagacgaagccgctctgtgggacgaagacgtagcttctctatcagccccagcaggcgttcgcgcacccccagccggaggagccgcacaccctcccggcggtctagaacaccctcgaggagaagtaggaccccatcccgccgctcacgaacgccatctcgacggtctaggacgcccagtaggaggcggaggagcagatctgtcgtgagacggcggtcgttttccatttctcccgttaggttgaggaggagccgcactcctttacgtcggaggttttcccgctctccaattcggcggaaacgaagccggagcagcgagcggggaaggtcccctaaacggctgacagacctcgacaaggcccagctgctggagattgcaaaagccaacgccgctgccatgtgcgctaaggccggcgtgccactgcccccgaacctgaagcctgctccgccccccaccattgaggaaaaggtagccaagaaatccggcggcgccaccatcgaggaattaactgagaaatgtaaacagatcgcccagtcaaaggaggatgacgacgtcattgtgaataagccacacgtgtcagatgaagaggaagaggagccgcccttctatcaccatcctttcaaactaagcgagccgaaaccaatcttcttcaacctgaacattgctgctgccaaaccaacccctcccaagtcccaggtcacactcacaaaggagttccccgtgtcttcgggctcacagcaccgcaagaaggaggcggattctgtgtatggtgaatgggtgcctgtcgagaaaaacggggaggagaataaggatgacgacaacgttttcagttcaaacctgcctagcgaggggcgcgtcaaaagacaggggagggtgagacgccagatgaagcagcccgcagcgtctcatttgaccgtaacccgatgcaattccctgtgcggcacaaagccacagagcgagaaacaccgcatagccgagaacagtgtcataacatccctcccaaatattggaccgagtctgcatttatgggaagggagtcccaggtacaattatctcgcttccagatttgcctccagactgtactcatctaggttctggtggtag

SEQ ID NO: 206515 - DNA, 7281 bp, Artificial Sequence
  Description of Artificial Sequence: Synthetic coding sequence
atggccaccaacatcgagcagatcttccggagcttcgtggtgagcaaattccgggagattcagcaggaactcagcagcggacgaaatgaaggccaactgaatggagaaaccaatactcctatcgaggggaaccaagcaggggatgccgccgcttccgctagatctctgcctaacgaggaaatcgtacaaaagatcgaagaagtactatctggtgtgttagacacagagctaaggtataaacctgacctcaaagagggtagcaggaaaagcagatgtgtttccgtacaaactgaccctaccgacgagatacccactaagaaatccaaaaagcacaaaaagcataagaataaaaaaaaaaagaaaaaaaaagagaaagagaaaaagtataaaaggcagccggaagaaagcgagtccaagacgaaaagccacgatgacgggaacatcgatctcgaatctgattcctttctgaagtttgactcagaaccttccgcagttgccctggaattacccactagagcttttggcccatcggagacaaatgagagcccagctgttgtgctggaaccaccagtcgtgagcatggaggtgtcggagcctcacatccttgagaccctgaagcctgccaccaaaaccgctgaactctcagtcgtctctacttcggtgattagtgagcagtcagaacagtccgtggcagtcatgccagaaccttctatgactaaaatactggatagttttgccgccgctccagtccctacgacgaccctcgttctcaagagctccgagcccgtggtgaccatgagcgttgagtaccagatgaagtcagtgcttaagtctgtcgagagcacctcgcctgagccaagtaagattatgctagtcgagcccccggtggccaaggtattagagccttctgaaaccctcgtcgtgtctagtgagactccgaccgaggtgtatcctgagccttcgacctcgaccactatggattttcctgagagttccgccatcgaagcactgagactgcccgaacaacccgtggacgttccctccgaaattgctgactcaagcatgactcgtcctcaagagctcccagagctaccgaagacaaccgcccttgagctgcaggaatcatccgttgcttctgctatggaattaccgggcccaccggcgacctccatgcccgaacttcaggggccgcctgttacgcccgtgctcgaactccccgggccgtcagcgacaccagtaccggagctgccaggcccgctgtctactccggtgcccgagctccctggccccccagccactgcagttcccgagttaccgggtccgtcagtaacaccagtgccccaactctcacaggaacttcccgggcttcccgcccctagtatgggcttggagcctcctcaggaggtgcctgaaccccccgttatggcccaggaattgcccgggctgcccttggtaacagcggcagtggaactacccgaacagccagctgtaacggtagccatggagttgacagaacagccagtgacaactaccgaactggaacagcccgtgggaatgactacagtggagcatcctggccatcctgaggttactaccgcaaccggtctgctaggacagccagaggccaccatggtgctggagctccccggacagcccgtcgctacgactgcactggagcttcccgggcagccttcggtgaccggagttcctgagctaccaggcctgcccagcgcaacacgagccttagagctgtcagggcaacccgtcgcaacaggcgcactcgaactgcctggcccccttatggccgccggcgctctggaattctccggccagagtggggccgccggagcccttgagctgctcggccagcccctcgcaaccggcgtccttgagctgccaggtcagcctggcgcaccagaactgcctggtcaacccgtggctacagtggctctggagatctccgtgcagagtgtcgttactacctcagagctgtctacaatgaccgtttctcaatccctggaagtgcctagtaccactgccctggaatcttataacaccgtcgcacaggaactccccactacactggtgggggaaacttcagtcaccgtaggagttgacccacttatggcccccgagtcccacattctcgcaagcaatacgatggagactcacatcctggcctccaatactatggatagccaaatgctcgcatccaataccatggactctcaaatgctggcctccaataccatggactcacagatgctagcaagcagtacaatggactcccagatgctggctacttccagtatggacagccagatgttggcaacctccagcatggactcccagatgttggcgacatctacaatggacagccagatgctagccacatccagcatggactcgcagatgcttgccacttcttccatggattcccagatgctcgccaccagtagtatggattctcagatgcttgccacttcgtcaatggacagccagatgctcgccacgtccaccatggacagtcagatgcttgccacctccactatggacagccagatgcttgccacaagtagtatggatagccaaatgctagcatccgggacaatggattcccagatgctggcctcagggacaatggatgcccaaatgttggcatccggcaccatggacgcccagatgttggcctcaagcacccaggatagtgctatgctggggtctaagtcccctgatccatacaggctggcacaagacccttatcggctggcccaagacccctataggcttggacatgacccgtatcgtctcggccacgatgcgtaccgcctaggccaggacccctaccgattagggcacgatccatacagactgacccccgacccctacagaatgagcccaaggccctaccggatcgctccacggtcatacaggatagcccctaggccctacagactggccccacgacccctgatgttagcatcacgcagatctatgatgatgtcctatgccgcagagagaagcatgatgagttcctacgagagatctatgatgagttatgagcgatctatgatgtctcccatggcagaaaggtcaatgatgtcagcctatgagcgctccatgatgtcggcctatgaaagatccatgatgagcccaatggccgagcggtcaatgatgagcgcctacgagagaagcatgatgagcgcctacgagaggagtatgatgagcccaatggcagatcgcagtatgatgtcgatgggagccgaccggtcaatgatgtcttcctactctgcggccgacagatccatgatgtcttcatactcagctgccgatcggtccatgatgagctcctacactgctgaccggagtatgatgtccatggcagcagattcgtatacggactcttataccgatacctatacggaagcatatatggttcccccacttccacctgaggaacctccgaccatgcccccattgcccccagaggagccaccaatgactccacccctgccacctgaagagccacctgagggcccagccctcccaaccgagcagagcgcgctgaccgctgaaaatacttggcccaccgaagtaccatcctctccatctgaggaatccgtgtcccagccagagcctcccgtgtcacaatcagaaatcagcgagccttcagccgtccccaccgattacagtgtgtcagcttcagacccctctgtcctggtgtcagaagcagctgtaacggtgccagagcccccacctgaacccgagagtagcattactctcactccagtggaatcagccgtcgtagccgaggagcacgaggtcgtgcctgagcggcccgtcacatgtatggtgagtgagacccccgcgatgagcgccgagcctacagtgctggccagcgagcctccagttatgtcagagacagcagaaaccttcgactctatgagggcttcaggccatgtggcgtcagaggtgtccacctcccttctggtaccagccgtcacaaccccagtgctagcagagagcattctagagccccccgccatggcggcacccgaaagcagtgcgatggctgtgttggagtcctccgcagttactgttctagagtcctctaccgtcaccgtgctggagagctcaactgtcaccgttctggagccctcagtggtgaccgttcctgaacctccggtggttgccgagcctgactacgtgacgatccccgtgcctgtggtgtccgcccttgagcctagcgttcctgtcctagagcctgccgtaagcgtgctgcagccttccatgatcgtatctgagccctcggtttccgttcaggaatccacagtgacggtttcagaaccggcagtcacagtgtccgaacagacacaggtaattcctaccgaggtcgccattgagagtacaccaatgattctggaatcgagtatcatgtcttcacacgtaatgaagggcatcaacctgtcatctggtgatcaaaatttagccccagaaattgggatgcaggagattgctctgcattcaggagaggagccacatgctgaagagcatctaaaaggcgacttttacgaaagtgaacatggcatcaacattgacctaaacataaacaaccatctgattgcgaaggagatggagcacaatacagtatgtgcagcagggacaagcccggttggtgagataggcgaagagaaaatcctgccaacatccgagaccaagcagaggaccgtgttggacacgtaccccggggtatcagaggctgacgcgggggagaccctgtcctccactggccccttcgcgctcgagcccgatgctactggaacatcaaagggcatcgaatttactacagccagtactctctcgctcgtgaataaatatgatgtggatctgtccttaaccacccaggatactgaacacgatatggtgatttccacatcgccttctggcgggagcgaagctgatatagaaggccctcttcctgccaaagatattcacttggacttgccgtccaataataatctggtcagcaaggacaccgaggagcctctcccagtcaaggagagtgatcagacactggcggccctgttgagtcctaaagagtcatccggcggggagaaggaagttcctccccccccaaaggaaacgttgcctgatagcggattctccgccaacatcgaagacattaatgaagcagatcttgttcgtcccttgttgccaaaagatatggagagactgacatcactacgcgccggaattgagggcccattgttggcctccgacgtcggccgcgataggtctgcagcatcgccagtggtcagctccatgccagaacgggccagcgagagttcctcagaagagaaagatgactacgagatctttgtgaaggtcaaagacacacacgagaagagcaagaaaaataagaatagggacaagggtgaaaaggaaaagaagagagattcttctttgcgatctcggagcaaaagaagcaaatcctcagagcataagagccgcaagcgaacttccgagtcaagaagtcgagcgcggaaaagaagctctaaatcaaagtcccatcgctcgcaaacacggagccgctcccgatccaggcggaggcgccgctctagccgcagcaggtcaaaaagtagaggtaggcgatccgtcagtaaggaaaaacggaagaggtcacccaagcatcgctctaaatccagagagaggaagcgcaaaagatcaagctcacgcgataacagaaagacagtgcgggctaggtccagaacacccagtcggcgctcccgtagccacacccccagccgcagacggcggtcacgatctgtgggcaggaggcggtccttttccatttcaccttcacgaaggtcaagaactccatcccggaggagccgcaccccgtccagacggagtagaaccccatcgcggcgtagtcgcaccccctcccgccggtcccgtaccccgagcagaaggtctagaaccccttctcggaggagaagatcacgttcagtcgtgcgacggcggtcattcagcatctcacctgtgaggctcaggagaagtcgaacccccctcaggcgtagattctctcggtcaccgattcggagaaagaggagtcgttcttcagaaagaggaagatctccaaagagattgacggacttagacaaagcacagctgctcgagatcgccaaagcgaacgcggctgctatgtgtgccaaggccggggtaccactccctccgaatctaaagcccgcaccgccaccgacaattgaggaaaaggtggctaaaaaatccggcggcgctacaattgaagaacttaccgagaagtgcaaacaaatcgctcaaagtaaggaggacgacgatgttattgtgaataaaccccacgtcagcgacgaggaggaagaggagccacccttttatcaccacccatttaaactcagtgagcctaaacccatctttttcaacctgaatatagcggctgcaaagcccacaccccctaaatcacaagtcactctgaccaaagagtttcccgtcagtagtggctcacagcaccgtaaaaaggaggcggactcagtatacggggaatgggtccccgtggagaagaacggcgaggaaaacaaagacgatgacaacgtgttttcttcgaatttgccaagcgaacccgtggacattagcacagccatgtccgagcgggctctggcccagaagagattgagcgagaatgccttcgatttggaggctatgtcaatgctgaacagagcacaagaaaggattgacgcttgggcgcagttgaacagcattcccggccaattcactgggtcaacaggcgtccaggtgttaacccaggaacagttggcgaataccggggcgcaggcatggatcaagaaggatcagttcttacgtgcagcccccgtgaccggcggcatgggcgccgtcctgatgcggaagatggggtggagggagggcgagggcctgggaaaaaacaaggaagggaacaaggaaccaattctcgttgacttcaaaacagaccgtaagggcctcgttgctgtgggagaacgagcacagaagagaagcggcaatttttcagctgctatgaaggaccttagtgggaagcatcctgtgagcgcattgatggagatctgcaataaaagacgctggcaacctcctgaatttcttctcgtgcacgacagcggtcccgatcatcggaaacattttctgttcagagtcctgagaaacggggccctgacacggcccaattgtatgttctttctgaaccggtattag

SEQ ID NO: 206516 - DNA, 1584 bp, Artificial Sequence
  Description of Artificial Sequence: Synthetic coding sequence
atggcccccgagcggctgcggagccgggccctgagcgccttcaagcttcggggcctgctgctgagaggcgaggctataaaatacttgacagaagctttgcagtctattagtgagctggaattagaggacaagttagagaagatcattaacgcagtggagaaacagcctctgagtagtaatatgattgagcgatctgtcgtagaagccgccgttcaagagtgttctcagagtgttgacgagaccattgagcatgtctttaacatcatcggggcctttgacattccccggttcgtttataattcagaacggaagaagttcttacccctgctcatgacaaaccatccagcccccaatttgttcggaaccccaagagataaggcagagatgtttcgggagcgatataccatcttgcatcagaggacccacaggcatgagctcttcacccctccggtgattgggtctcacccggatgaatccgggagcaagttccaactgaagactatagagactcttctgggatcaaccactaagatcggtgatgcgatcgttctgggaatgatcactcagctgaaggagggaaaattcttcctggaggacccgaccggcacagtccagcttgatctgtctaaggctcaattccacagcggactctataccgaggcttgctttgttcttgctgaaggttggttcgaagaccaggtctttcacgtgaacgcattcgggttcccaccaaccgaaccctcctctaccacgcgagcttactatggaaacatcaatttttttggtggcccttccaataccagcgtcaaaactagtgctaagttaaagcagttggaggaggagaacaaagacgccatgtttgtgttcttgagcgatgtgtggctggatcaggtggaggttctggagaagttacgaataatgttcgctggctactcacccgcgccccctacctgctttatcctttgtgggaatttctcttctgcgccatacggcaaaaaccaggtgcaggctctgaaagattctctgaagacactggcggacattatatgtgagtaccctgacattcaccagagctcgcggttcgtgtttgtccccggccctgaggatccaggtttcggctcaattcttccacggcctcctttggcagaatcaatcaccaacgagtttagacagcgcgtgccattctcagtgtttaccactaacccctgtagaatccaatattgtacacaggagattacagtgttcagagaggatcttgtcaacaagatgtgccgcaactgcgtgcgctttccttcgtctaatctcgctattccaaaccatttcgttaagaccattttgagccagggccacctcactcccttgcccctctatgtgtgccccgtctattgggcctatgactatgcattgagggtttatccagtgccagatctactggtgattgcagataagtacgacccgtttactacgacaaacacagagtgtttatgcatcaacccaggctccttccccagatcaggattttccttcaaggtgttttacccaagcaacaagacagtggaggactctaagctccagggcttctag

SEQ ID NO: 206517 - DNA, 3900 bp, Artificial Sequence
  Description of Artificial Sequence: Synthetic coding sequence
atgcagcaggccccccagccctacgagttcttcagcgaggagaactcacctaagtggcggggtttgctggtgtctgctttgcgtaaagtacaagaacaggtgcatcccacactatctgcaaacgaagagtccctgtactacatcgaggagctgatcttccagctactcaacaagctatgcatggctcagcctcgaacagtccaggacgtggaggagagggttcaaaaaactttcccgcacccgatagacaagtgggccatagctgacgcccagtcagctattgaaaaacgtaagcggaggaacccccttctgctgcccgtcgacaagattcatccatcactaaaggaggtgctaggctacaaagtggattaccatgtgtccttgtacattgttgccgtacttgaatacattagcgctgacattctcaaactcgctggtaattacgtctttaatataagacattacgagatctcgcagcaagatattaaggtgtcgatgtgcgcagacaaagtgttaatggatatgtttgaccaggacgacattggactcgtgagtttgtgtgaagatgagccttcgagctccggtgagctcaactattatgaccttgtcaggactgagatagcagaagagagacaatatttgcgggaactgaatatgatcattaaggtgttcagagaggcattcctcagtgatcgaaagcttttcaaacctagcgatatcgagaagatcttttctaatattagtgacatccatgagctcactgtcaagctactaggcctgattgaagatacggtagagatgactgacgaatcctcaccccatccacttgccggaagctgcttcgaagatctggccgaagagcaagcgttcgacccgtacgaaactttgtcacaggacatactctcacccgagtttcatgagcacttcaacaagctgatggccaggccagctgtggcgctgcacttccagcaattgaaggcttgttcagaggaacaggaagaccgtgaatgcctgaaccaagcgattaccgctctaatgaacctgcaggggagtatggatcgcatatacaaacaatattctcccagacggcggcccggggacccggtctgtcccttttacagtcatcagctccgtagcaagcacctcgccataaaaaagatgaatgaaatccagaagaatattgatggctgggaaggcaaggatatcgggcagtgttgcaatgagttcattatggaaggccccctgacccgtatcggagcaaaacatgaaagacatattttcctgttcgacggacttatgatttcatgtaaacctaaccatgggcagacccgtctgcctgggtattctagtgcagagtatagactaaaagagaaattcgtgatgaggaagattcagatttgcgataaggaggacacatgcgaacataagcatgcattcgagttagtgtctaaggatgagaactcgattatttttgcggcaaaatccgcggaggagaaaaacaactggatggccgcactgatttctttacattacagatctaccttggatcgtatgctcgattccgtcctcctgaaggaagagaacgagcagcctttgcggttgcctagccctgaagtctacaggtttgtggtgaaggattctgaagaaaatatagttttcgaggataatctgcagtctcgatctggcattccaatcattaagggcggcacagtggtcaagctgatcgagagactgacttaccatatgtatgctgaccccaacttcgttcgcacgttcttgactacataccgatctttctgcaagcctcaggagctgttgagtttgttaatcgagcgctttgaaatacccgagcccgaacccacggatgcagacaagctcgccatcgagaaaggggagcagccaatcagtgcggatctaaaacggttccggaaagagtacgtccagccggtgcagcttagaattttaaatgttttccgacactgggtcgagcaccacttttatgatttcgagcgggacttggaattacttgagaggcttgagagctttatctcgtccgtacgtggaaaggccatgaaaaaatgggtggaatcaattgccaaaattatccggcggaagaagcaggctcaagccaacggagtcagccacaacataacattcgagagccctccccctcccattgagtggcatatctcaaagcctggccaatttgaaacgttcgatttgatgactctgcacccaatcgaaattgctcggcagcttaccctgctagagtctgacctctatcgcaaagtacagccctctgagcttgtcggatccgtgtggacaaaggaggataaggaaattaactcacccaatctgctcaagatgattcgacacaccacaaatctgacactttggttcgagaaatgtattgtcgaggctgaaaattttgaggagagggtcgccgttctctccaggatcattgaaatacttcaggtgttccaggacctgaacaactttaacggcgtgctcgagatcgtctctgccgtaaattccgtgtccgtgtacaggctggatcatacattcgaagccctgcaggaacgaaagcgaaaaatcctggatgaagcagttgaactgtcacaggatcatttcaagaagtacctggtcaagctaaaatctataaatccaccgtgcgttccttttttcgggatctacctcacaaatattctcaagaccgaggaagggaacaacgacttcctgaaaaagaagggcaaggatcttatcaatttctccaagagaaggaaagtggccgaaatcactggcgagattcaacaataccagaatcagccatattgcttgcggattgagcccgatatgcgacgatttttcgagaacctcaatcccatggggtccgctagtgagaaagagttcacagattatctttttaataagtctctggaaatcgaaccccggaattgcaaacaacctccaagattcccccggaagtcaaccttctcactcaagtcccccgggattaggccaaacaccgggcgtcatggctccacaagcggcacgttgagaggtcaccctacgccacttgaaagagaaccctgtaaaatctccttctctcgcattgccgaaacagagttggaaagtacggtgtccgcccccactagtccaaacaccccgtcaacacccccagtgagcgcgtctagtgatctttccgtcttcttggatgttgacctgaacagctcttgtggtagcaattctatcttcgcaccggtcttactgcctcacagtaaatcttttttttctagctgtgggagccttcacaagctatccgaagaaccacttattccccccccccttcctccacggaagaagttcgatcatgatgccagcaattcgaaaggcaatatgaaaagcgacgatgatccgcctgctatccccccacgtcagcctcctcctcctaaggttaaacccagggtccctgttccaacaggcgcgttcgatggacccctccacagcccgccaccacctccaccacgcgacccacttccggatactccaccccctgttccacttagaccccctgagcactttatcaattgtccttttaatcttcagcccccgcctcttggtcacctgcacagggactcagactggttaagggatatctcgacctgcccgaattcaccctctacccctcctagcactccatcccctcgtgtgcctcgcaggtgctacgtgctttcaagtagccaaaacaacctcgcgcatcctcctgcccctccggtgccgccgcgacaaaattctagtcctcatctccccaagcttccaccaaaaacgtacaaaagggagcttagccaccctcccttgtataggctccccctgctggaaaatgctgaaacaccccaatag

SEQ ID NO: 206518 - DNA, 1389 bp, Artificial Sequence
  Description of Artificial Sequence: Synthetic coding sequence
atgctgctgctggcccggtgcctgctgctggtgctggtgagcagcctgctggtgtgctctgggttggcttgcggtccaggcaggggtttcggcaagcgaaggcacccaaagaaactcacccctctggcttacaaacagttcatccctaacgtggccgagaaaacccttggtgcctctggcagatatgagggcaagatttccagaaattcagaaagattcaaggagttgaccccaaactacaacccagacataatattcaaggatgaggagaacactggcgcagatcgactgatgacccagcgatgtaaggacaaattgaacgcattagcaattagcgtgatgaatcagtggcccggtgtgaaattacgcgtcacggagggctgggacgaggacggccatcactcagaagaaagtttgcactacgaagggcgggccgtggacattactacgtctgatcgcgaccgctccaagtacggcatgcttgcgcggcttgcagtggaggccgggttcgactgggtctattacgaaagcaaagctcacatccactgctccgttaaagccgagaactcggtagccgctaaatccggcgggtgtttccccggcagtgctaccgtccacctggagcagggcggtaccaagctggtgaaggacctgtcccccggagacagggtgctggccgccgacgatcagggacggctgttatactcggactttcttactttcctcgaccgggatgatggcgctaaaaaagtgttttatgtgattgagaccagggaacctagggagcggttgttgctgaccgcggcccatctccttttcgtggcgccccacaacgacagtgcaactggcgaacccgaagcctcctcagggagcggacctccttctggcggcgctctgggacctagggccttattcgcttctagagtcaggcccggacagcgcgtctatgtggttgccgaacgggatggcgatagaagattgctacctgctgccgtccactctgtgactctgagcgaagaagctgctggtgcgtatgccccccttacagcacaagggactatcctaattaatcgggttttagccagttgttacgctgtcattgaagaacactcctgggctcatagagcgttcgcgcccttcaggttagcccatgccctgctggccgccttggcccccgcccgcaccgaccgcggaggcgacagcggaggaggcgatcgtggaggggggggagggagggtggcgctcactgcaccaggcgctgcggatgctccgggcgccggagcaactgcaggcattcactggtattcccagctgctgtatcagattggtacttggcttttggatagcgaggcactccacccgcttggaatggcagtaaagtctagctag

SEQ ID NO: 206519 - DNA, 3456 bp, Artificial Sequence
  Description of Artificial Sequence: Synthetic coding sequence
atgagcagcgagtgcgacggcggcagcaaggccgtgatgaacggcttggcacccgggtccaatggacaggacaaagctaccgccgacccgctgcgagctcggtctatcagtgccgtcaagataatacccgtgaagacagtgaaaaatgcttctggcctcgtgctgccgacagatatggacctcaccaagatctgtacagggaagggcgccgttaccctgcgggcctcgagctcgtacagggaaaccccatcatcatcccctgccagtcctcaggagacccgtcaacatgagagcaaacccggcctggagcctgagccaagctccgctgatgaatggagactctcaagctcagcagacgccaacggaaacgcacaaccttcttccttagctgccaaggggtatcgttcagtacaccctaacttgcctagtgacaaatcacaggacgcgaccagcagcagcgccgcgcagcctgaggttattgtggtccctctttatctggtcaataccgacaggggacaggaaggtaccgctagaccacccaccccgttgggaccactaggttgtgtacctactattcccgctactgcttcagcggcatcccctctcactttcccgacactagacgactttattcccccccatttgcaacgatggccccaccatagtcagcccgcgcgtgcctctgggtcttttgcccccatcagccagacaccaccatcctttagtcctccgcctcctctcgtgccacccgcgccagaagacttaagaagggtgagcgagccggacttaacaggggccgtgtcgtccaccgatagttcacctcttcttaatgaagttagcagtagcttgattgggaccgactcacaggctttccctagtgtatccaagccctcctctgcctatccctccacaacgatcgtcaaccctacaatcgtgcttctgcaacacaaccgggagcaacagaaaaggctcagttctcttagcgacccagtatctgaaaggcgcgtgggcgaacaagactccgccccgacacaggagaagccaacttcccccggcaaagccatcgaaaaacgggccaaggatgatagccggcgggtggtgaagtccacgcaggatctctctgacgtctccatggacgaagttggaattcctctccgcaatacagaaaggagcaaagactggtacaagactatgttcaaacagatccacaaactgaatcgcgatacaccagaggagaatccctattttccgacctataagttccccgaactacccgaaattcagcagacctccgaggagacaaagagctgtagtgttatgtccccccgcctggaatgtagcggaaccgtgatagcacactgtagcctcaagcttctggactcaagcaacccccctactagtgcctcgcaggtggctggcacagccgacgacgactcagacctctattcacctcgttatagcttttcagaggacaccaagtctcccctgagtgtgcctagatcaaagtctgagatgagctacatagatggagaaaaggtggtaaagcgatccgccacgttacccctgccggctcgctcaagttccttaaaatcaagtagtgaaagaaatgactgggagccccccgacaagaaagtggacactcgcaaatatagggcagagccaaaaagcatctacgagtatcaacccggaaaatctagtgtgctgacaaacgagaagatgagccgcgatatatccccggaagagattgatcttaaaaatgagccttggtacaaatttttctctgaactcgaatttggcaagcccccacccaagaaaatttgggactacacccccggggactgtagtatactcccccgggaggatcgcaaaaccaacctggataaagaccttagtttatgtcaaaccgagttggaggcagatttagaaaagatggagacccttaataaagcgccctctgcgaacgtcccacagagctccgccattagcccgacaccggagatttccagcgagacaccagggtacatctatagttcaaattttcacgcagttaaacgggagtcggatggggctcccggggacctaacatctttagaaaatgagcggcagatatataagagcgttctagagggtggcgatattcctctccagggcctgtccgggctgaagagaccaagctcctctgccagcaccaaggattcggagtctcccaggcacttcattccagccgactatctcgagagtaccgaggaattcatcaggagaagacacgatgataaggagaagctcctggctgaccagcgtcggctgaaacgagagcaagaagaggcagatatcgccgccaggaggcatacaggggtcattccaacacaccatcaattcatcactaacgaacgattcggcgatctgttaaacatagatgataccgctaaacgaaaatcaggatccgaaatgaggccagctagggccaagtttgatttcaaagcgcaaacattaaaagagcttcccctgcagaagggagatatcgtctatatttacaaacagattgaccagaactggtacgaaggagagcaccatggcagggtcgggatatttcctcgcacatacattgaattgcttccgcctgctgagaaagcccagccaaagaaacttactccagtgcaggtattagagtacggggaggctatcgctaagtttaattttaacggcgacactcaagttgagatgtcatttcggaagggggagagaattaccctgctgcgacaggtggatgaaaattggtatgaaggccgaatccctggcacatcccgccagggtatttttccaattacgtacgtcgacgtgatcaagcgcccactggtcaaaaatcccgtggactacatggacctcccattctcttcctcccctagccgttctgccacggcctctccacaaccctggcgcgaggagagcggtcagtacgagcgcaaagctgagcgcggagccggcgaaagaggacctgggggtcctaagatctcaaagaaatcatgcctgaagccttctgacgtggttagatgcctctccactgagcagcgcttgtccgatctgaataccccagaggagagccgacccggtaaaccactcggtagcgcattcccaggcagtgaagcagagcaaacggagaggcaccgcggcggagagcaagcagggcgcaaggcagctaggaggggaggatcccagcaaccccaggcgcagcaacggcgagtgacccctgaccgttcccagacttcgcaggacctgttctcataccaagctttgtactcttacataccacaaaatgatgatgaactggagctgcgcgatggggatattgtggacgtgatggaaaagtgtgatgatgggtggtttgtgggaacttcccgcagaacaaagcagtttggcactttccccggtaactacgtaaaacccctgtacctttag

SEQ ID NO: 206520 - DNA, 2346 bp, Artificial Sequence
  Description of Artificial Sequence: Synthetic coding sequence
atgagcagcgagtgcgacggcggcagcaaggccgtgatgaacggcctcgcgccaggcagtaatgggcaagacaaggcgacggcagatccactgcgggctcgttccatcagcgctgtgaagattatcccagtgaagacagttaagaacgcatcaggcctagtgctgccgaccgatatggatctgactaagatctgtactggaaagggagccgtcacactgcgcgcctctagctcttaccgtgagaccccttccagctcccccgcgagccctcaagagactcgtcagcatgagtctaagccaggcctagagcccgaaccatccagcgcggacgagtggaggctctccagttccgccgacgctaacgggaacgcccagcctagttccctggctgccaagggctaccgatcggtccaccccaatttaccatccgataaatcacaggacagttctcccctgttgaacgaggtaagcagctccctgataggcactgattcccaggcttttccatcagtcagcaaaccttcctctgcatatccatctactactatcgtgaatccaacaatagtgctgctgcaacacaacagagagcagcagaaacggctttcctcactgagtgacccggtttctgagaggcgcgtgggtgaacaagacagtgcacccacacaggagaaacccacttctcccggaaaagctattgagaagagagcaaaggacgacagtaggagagtggtaaaatctacccaggacctcagcgacgtgtctatggacgaggtaggcattccattgcggaatacggagagaagcaaggactggtacaagactatgttcaagcaaattcacaagcttaatcgggatgatgacagcgatctgtacagccccaggtatagtttctcagaagatactaaatctccactgtctgtgccccgtagcaaatctgagatgagctacattgacggagaaaaggtggtcaagcgtagtgctacactaccactgccagccagaagcagctctttaaaaagtagcagcgagcgaaacgactgggaaccacctgacaagaaagtggatacaagaaagtaccgcgcagaacccaaatcaatctacgaataccagcccggcaagtcaagtgttctcactaatgaaaagatgagcagcgctatttctcccactccagaaatttcctcagagaccccgggatatatttattcctcaaatttccacgctgtcaagcgcgaatcagacggcgctccaggtgacctcacttctctggagaacgaacgtcaaatctacaagtctgtactagagggcggcgatattcccctccaggggttgtctggactgaagcggcccagcagcagtgccagcactaaagactccgaatcaccgagacacttcatccctgccgactacctcgaaagtactgaagagtttattagacggcggcacgatgataaggagaaattgctagccgatcaacgccgcctgaaaagagaacaagaggaagctgacatcgcagctcgtaggcacacgggagtgatccctacacaccaccagttcataacaaatgaaaggtttggtgatttgctcaatattgacgatactgctaaaagaaaatctggcagtgaaatgaggccagcaagagccaaattcgacttcaaggcccaaaccctgaaagagctgccgctacaaaaaggcgatatagtatatatctataaacaaatcgaccagaactggtacgagggcgaacaccatggaagagtgggcatattcccccgcacttacatcgagcttctgccacctgcggagaaggctcaaccaaagaagctcactcccgtgcaggtgctcgaatacggggaagctatagccaaattcaatttcaatggggacacacaggtggaaatgtctttcagaaagggagagcggatcacactcctgcgccaggtggacgagaactggtatgagggacgcatccccggcactagcagacagggcatcttcccaattacgtacgtggatgtgatcaagcgacctcttgtgaagaatcctgtcgactatatggacctgcccttttcctcatccccctcaaggagcgctaccgcctccccgcaacagcctcaagcacaacagaggcgagtgacgcccgatcggtcacaaacaagccaggatctgttttcctaccaggctctatacagttacatcccacagaatgatgatgagctcgagctgagggatggggacatagttgatgtgatggaaaaatgcgacgacggctggttcgtgggtacttccagaaggacaaagcagtttgggacttttccaggaaattatgttaagcctctgtacttatag

SEQ ID NO: 206521 - DNA, 2541 bp, Artificial Sequence
  Description of Artificial Sequence: Synthetic coding sequence
atgagcagcgagtgcgacggcggcagcaaggccgtgatgaacggcttggcgcccggcagtaacggacaggacaaggcaacggccgacccacttcgagcacggtccatctccgccgtgaagatcatcccagttaagactgtcaagaacgcctcaggcctggtgctgccgacggatatggatctgacaaagatctgcaccggaaaaggagcggtgactctgagggcctcgagcagttacagagaaacaccctctagctcacctgcttcgccccaggaaactagacagcatgaatctaaacctgatgaatggcgtctctcctcttcagccgatgctaacggtaatgcccaaccctcctcactggccgccaaaggctaccggtcagtgcatcccaatttgcctagcgataagtctcaggactctagtccactgttaaacgaagtttccagctccttaattgggactgattctcaggcttttcctagcgtcagcaaacccagcagcgcgtatcctagcacaacaattgtcaatccgaccattgtgctgttgcagcataatcgggagcagcaaaaaagactgagcagcctttcggatccagtctccgagcggcgagtcggggagcaggactccgctccgacacaggaaaagccaacctcccctgggaaagctatcgagaaacgcgccaaagatgacagtagaagggtcgtaaaaagtacccaagacctgtccgacgtgagcatggacgaagtgggtattccactgagaaatactgagaggtctaaggactggtataagaccatgttcaagcagattcacaagctcaatcgagatacgcccgaggaaaatccgtacttccccacttacaagttcccagaactccctgaaatccagcagacctcggaagaggacaacccatatactcctacttatcaatttccggcctctactccaagccctaaaagcgaggatgacgactccgacctgtacagtcctcgatacagcttctcagaggataccaaatcgccactttctgtgccccggagcaaatcggagatgtcatatatagacggggagaaggtggttaaacggagtgctacccttccacttccagcaaggagctcttctctgaaaagtagttccgagcggaatgattgggagccccctgataagaaagtagacactaggaaatacagggcggagcctaagtcgatatacgagtaccagcctgggaaaagctcggtactgaccaacgaaaagatgagtcgggacatcagccccgaggagatagacctcaaaaacgagccttggtacaaatttttcagcgagcttgaatttggaaaaccctcaagtgccatctctcccacaccagagattagctcagaaaccccaggctatatttattctagcaactttcatgcagttaaaagggagtccgacggtgcccccggggacctgacaagcctggagaacgaaagacagatctacaagtcagtgctggagggcggcgacatacctctgcagggcctgagcgggctgaaaagacctagcagcagcgcaagcaccaaggattcagagtctccacggcattttatccctgcagactacctcgagtcaacagaagaattcatacgccgtcgacatgatgacaaggaaaagctgctggctgaccaacgcaggctcaagagagaacaggaggaggccgacattgcagccagaaggcacaccggggtaatacctactcaccaccagttcattaccaatgaaagattcggcgacttgctcaatatcgacgacacggccaagcgaaaatccggatccgaaatgcggccggccagggcaaagttcgacttcaaggcacaaaccttgaaagaattaccccttcaaaagggcgatatcgtgtacatttacaagcagattgatcagaattggtatgaaggagaacaccatggcagggtgggcatcttccctcgcacctatatcgaacttctccctcctgctgaaaaggcccagcccaagaagcttacgccagtgcaggtgctagagtatggcgaagccattgcaaagtttaacttcaatggcgacacccaagtcgagatgagtttcaggaagggggagaggattacactactgaggcaggttgacgaaaactggtatgaggggcgcatcccgggcacctctcgccagggaatttttccgatcacctatgtagatgtgatcaaacgacctctagtcaaaaaccctgtggactatatggacctgcccttctctagctcaccttcaagaagcgccacagcaagtccccagcagccacaagcccaacagagacgggtcacacccgatcgcagccagacaagccaggacctgttctcatatcaggccctctactcttacattccgcagaatgacgacgaattagaattacgggacggagacatcgtggacgtgatggaaaagtgcgacgatgggtggttcgtggggacaagtagaaggacgaaacagtttggtacatttccaggcaattatgtgaaacctctttatctctag

SEQ ID NO: 206522 - DNA, 2718 bp, Artificial Sequence
  Description of Artificial Sequence: Synthetic coding sequence
atgagcagcgagtgcgacggcggcagcaaggccgtgatgaacggcttagcgcctggctcgaacggacaggacaaggctaccgctgatccgctcagagccagaagcatctcagccgtgaaaattattcctgtcaagaccgtcaaaaatgcatcaggactggttttgcctacagacatggacctcacaaagatctgtacaggcaagggcgcagttaccctgcgcgctagctcgtcttacagagagaccccctctagtagccctgcatctccccaagaaactaggcaacacgagtccaagccaggcctagagcccgagccctcaagcgccgatgagtggcgcctatctagttctgcagacgccaacggtaacgctcagccaagctcactggcagccaagggatatcgatccgtccaccccaacctgcccagcgacaagagtcaacgttggccacatcattcacaacccgccagagcttctggctcctttgcccccatctcccaaactccgccctcattcagtccccccccgcctcttgtgccccctgcccccgaagacctgagacgggtgagcgaacctgacttgaccggggccgtctctagtaccgactcttcgcctctgttaaacgaagtctcaagcagcctgattggtaccgactcccaggcttttccctcagtgtcaaaaccctcttccgcctacccttcaacgactatcgtcaaccctactatagtgctgctgcagcacaacagagaacagcagaagcggttgtcttctctgtccgacccagtgtctgagagaagggtgggtgaacaggattcagcgccgacacaagagaagcccacttcgcctgggaaagcaatcgagaaacgcgccaaagatgattccagacgcgtggttaagtcgactcaggatctttcggacgtgagcatggatgaagtgggaattcccctgagaaatacagagcgaagtaaagactggtataagacgatgtttaagcagattcacaaacttaatagggatgatgatagcgatctctatagcccccgttacagcttttcagaggacacaaaaagtccgctgtctgtgccccgtagcaaaagcgagatgagctacatcgacggcgagaaagtcgtgaaaaggtctgcaacattaccgctcccggcccggtccagctcactgaagtcatcctcggagaggaatgactgggagcccccagacaaaaaggtggatacgcggaaataccgagcggagccaaagagcatctacgagtaccagcccgggaaatccagcgttctgactaacgaaaaaatgtcaagggatatctcccctgaggaaattgacttaaagaatgagccatggtataaattcttcagtgagttagagttcggcaagcctccacccaaaaaaatttgggattacacccccggcgactgcagcatcctacctcgtgaagataggaaatccagcgcaatttcccccacaccggaaatctcttctgagaccccggggtatatttacagcagcaattttcatgctgtgaaaagggaaagcgatggcgcccccggggatctgacctccctggagaatgaaaggcagatatacaagagtgtcctggaggggggtgacatacccttgcagggactctcaggcctgaagaggcctagcagctcagcgtccaccaaggattccgaaagtccaagacatttcataccggctgattatctagagtcaacagaagagttcatccggcggcggcacgatgataaagaaaagttgctggccgaccagcgcagactcaagcgagaacaggaggaagcggatattgccgcgagaaggcacaccggagtgatcccaacgcatcaccaatttattacgaatgaacgctttggtgatttgttaaacatcgacgatacagccaagaggaaatcggggtctgagatgcggcctgccagagccaagtttgatttcaaggcgcagacactcaaggaactcccactgcagaagggggatattgtttacatttacaagcaaatagatcaaaattggtatgagggcgaacaccacgggcgcgttggcatttttccaagaacttatatcgagttgctaccacctgccgagaaagcgcagcctaaaaagctaactccagtgcaggtcctggaatatggggaggccatcgccaagttcaacttcaacggagacactcaggttgagatgtcatttcggaagggcgaacggatcaccctcctccgccaagtggacgagaattggtacgaaggaaggatccccggaacgtctcggcaggggatttttcccattacttatgtagatgttatcaagcgcccactggttaagaatccagtggactatatggacttacccttttcttcctcacctagcaggagcgccacggcttcacctcagctatctcaccattctcttagagccggacctgaccttaccgagagcgagaagagctacgtacagccccaggctcagcagagaagagtaacgccagatcggtcccagacgtctcaggatctgtttagctaccaagctctctatagctatatcccgcagaatgatgatgagctggaattaagggacggcgacatcgtggatgttatggagaagtgcgacgacggctggttcgtgggaacaagccggcggacgaaacagttcggtaccttcccaggtaactatgtgaagcccctctacctttag

SEQ ID NO: 206523 - DNA, 3015 bp, Artificial Sequence
  Description of Artificial Sequence: Synthetic coding sequence
atgagcagcgagtgcgacggcggcagcaaggccgtgatgaacggcctcgcacccggctccaacgggcaggacaaggccacagcagaccccctccgggccagatccatcagtgccgtgaaaatcatcccggtgaagacagtcaaaaatgccagtggattggttctccctacggatatggacctaacgaaaatctgtactggcaaaggagccgtcactttgagggcttcctctagctacagggaaacccctagtagctctcccgctagcccgcaggagacccgccagcacgagtcaaagccagacgaatggcggctgtccagctcagcagacgcaaatggcaacgctcagcccagtagtttggcagccaaagggtacaggtcagtccaccccaacctccctagcgacaaatcacaggacgccacctcctctagcgccgctcagcccgaggttatcgtggtacccctgtacctagtaaacaccgataggggacaggagggcactgcccgaccaccaacccccttagggccactaggttgcgtgcctactatcccagctaccgcaagcgctgcatccccacttacatttccaaccttggacgatttcatacctccgcacttgcagcggtggccccaccactcacaacccgcccgagcatccggtagcttcgcccccatatcacagactccaccttctttctcccccccgcctcccttggttcccccagcccctgaggacctgagacgagtcagcgagccagacctgacgggggccgtgtcatccaccgattcgtctccactactgaacgaggtgagtagtagcctcatcggaacagattcacaagccttccccagtgtgtcgaagccaagttccgcctacccatccacaacaattgtgaatcccaccattgttctcctccagcataatcgcgaacagcagaagcggttgagttctctttcagatccggtgtcagaacgacgcgtgggcgaacaggattctgcgccgacacaggagaagcccacttcacctggaaaggccatcgagaaaagagccaaagacgacagcaggcgcgttgtgaaatctacgcaggatttgtctgacgtgtccatggacgaagttggtatccctctgaggaacacagaacgtagcaaagactggtacaagacgatgtttaagcagatccacaaactgaacagggatacccctgaagaaaacccttacttccctacctacaagtttcccgagctgcctgagatccaacaaacctctgaggacgatgactcagacctgtattcgcccagatattctttcagcgaggacactaaaagcccattatccgtgcctcggtccaaatctgagatgtcctacatcgatggtgagaaagtggtgaaacggagcgccactctcccccttcctgcgcgaagctcctcccttaaatccagctccgagaggaatgattgggagcctccagacaagaaagtggacacacgcaagtatcgggctgaacccaaatccatttacgagtatcagccaggtaagagctccgtgctgactaatgaaaaaatgtcccgggacatctcccctgaggaaatcgacctcaaaaacgagccatggtacaaatttttttcagagctagaattcggaaagccgccccctaaaaaaatctgggattatacccctggagactgttcaatcctgccacgcgaggataggaagacaaacctggataaggatctgtccctctgtcagactgagctagaagccgatctggagaagatggaaaccctgaacaaagcccccagcgccaatgtcccacagtcctctgctattagtccaacacccgaaataagcagtgagacacccggatatatttatagtagcaacttccacgccgtcaagcgagaaagcgatggcgcccccggcgacctcacttcactggaaaatgagcgccagatctataaaagtgtccttgagggcggggacattcccctccagggcctcagtggactcaagaggcccagctcttctgcctcgacgaaagactctgagtccccccggcacttcatcccagctgattacctggaaagcacagaggagttcattcggaggcgacacgatgataaagaaaagctgctcgccgaccaacgcaggctcaagagggagcaggaggaggcagacattgccgcacgaaggcacacaggtgtgattccaactcaccaccagttcatcaccaacgaaagatttggagacctgctgaacatagacgatacagccaaacggaaatctggttctgaaatgcgcccagcaagagcaaagtttgacttcaaggcccaaaccctaaaggagttgccgctccaaaagggggacattgtctacatttataaacagatagaccagaactggtacgagggcgagcaccacggacgggtgggaatcttcccacggacctacattgagctgttgccacccgccgagaaagcacagcccaaaaagctaacacccgttcaagtcctggaatacggtgaggccatcgctaagttcaatttcaatggtgacactcaggtggagatgtccttccggaagggggagcgtattacactgctgaggcaggtagatgagaactggtacgagggaagaattccaggcacctctcgacaagggatcttcccgattacctatgttgacgtcattaaacgccccctggtgaaaaaccccgtggattatatggacctgcctttctctagcagcccatctagaagcgccactgcatcaccgcagcaacctcaggctcagcagcgtagagttactcccgaccggagccagacaagtcaggatctgttctcatatcaagctctgtactcttacatcccgcagaacgacgacgaactggaacttcgcgacggcgacatagtcgacgttatggaaaagtgcgatgacggctggttcgtgggaacttcccgccggaccaaacagttcggtacatttcctgggaactacgtgaagccattgtacttatag

SEQ ID NO: 206524 - DNA, 3879 bp, Artificial Sequence
  Description of Artificial Sequence: Synthetic coding sequence
atgagcagcgagtgcgacggcggcagcaaggccgtgatgaacggcctggcaccaggctccaacggccaggataaagccactgccgatccattgcgagcccgatcaatctcagccgtgaaaattatcccagtcaagaccgtgaaaaatgcatctggattagtgctacccaccgacatggacctcaccaagatctgtactgggaaaggagccgttaccctcagagccagcagtagctaccgcgaaaccccaagcagttccccagcctctccccaagagacccgccagcatgagagcaagcctgggttggaaccagagccaagtagtgcagacgaatggagactgagttccagcgccgacgcaaacggtaacgcccagccttccagtctggccgctaaaggttatcgatctgtccatccgaatctgccatcagataagagccaggatgccacaagttcttctgccgcccagcctgaggtaatcgtcgtccccctgtacttggtgaacacggacagaggacaggaagggaccgctcggcccccaacacccctgggccctttgggctgcgtgcctacgatccccgctacagcctccgctgcttcacccctcacatttcccaccctggacgacttcattccgccacacctacaacgttggccccaccacagccagccggccagggcctccggcagctttgcacccatctcgcaaaccccgccaagtttcagtccccccccccctctggtgccccctgcacccgaagatctgcgaagagtgagcgaaccggatctcaccggggccgtgagttctaccgacagctcccccctcctcaacgaagtgtctagctctttaattggtactgattcccaagcattcccatctgtttctaagccatcctccgcatacccttctaccactatagttaacccaaccatcgtactgctgcaacacaatcgagagcaacagaagcgtctgtcttcactgtctgatcccgtgtcagagaggcgagtaggtgaacaggatagcgccccaacccaagagaagcccacttctccaggcaaggcaattgagaagcgcgcgaaggacgactctcggcgggtggtcaagagtacacaagacctttccgacgtttccatggatgaagtcggcattccattgcgtaacaccgaacgttccaaggactggtacaaaaccatgttcaagcagatccataaacttaacagggatacacccgaagagaatccttattttccaacttacaagttcccagaactgccggaaattcaacagacatcggaagaggacaatccctacacccccacctaccagttcccagcgtccacccccagtcccaaatcagaagatgatgacagcgatctgtactctcctaggtacagtttctctgaggacactaaatctcccctgagcgtaccccgatctaaatcagagatgagttatatagatggtgagaaggttgtcaagaggtccgctaccttacccttgcccgcccgtagctcatccctaaagagttccagtgaacggaatgattgggaacctccagacaagaaagtcgacactcgaaagtatagggctgagccaaaaagcatttacgagtatcaaccggggaaatcatccgtgcttacgaatgaaaaaatgtcaagggatattagccctgaggagattgacttgaaaaacgagccctggtacaaatttttctctgaactggaattcgggaaaccacctccgaaaaagatttgggattatactccaggggactgcagcattcttccacgggaggatcgaaagaccaatttagataaggatctgagcctgtgccaaaccgaactggaggctgatctggagaagatggagactctgaataaggccccgtccgctaatgtaccccagagcagtgccatctcaccaacacccgaaataagttcagaaaccccagggtacatttatagctccaacttccacgcagtaaagcgggaaagtgatggagcccccggagatctcacctccctggaaaacgagcgccagatctataagtcagtgttggaggggggggacattccgttgcagggcctctctggactgaagcggccatcctcgtctgcctctaccaaggactcagagagccccaggcattttatcccagccgattatctggagtcaaccgaggaattcatcagacggcgtcacgacgataaggaaaaactcctggcagaccaaagacgcctcaaaagggagcaggaggaagccgacattgcagcgcgacgccacactggggtgattcccacccaccatcaattcatcaccaacgaaagattcggagatttactgaatatagacgataccgccaaacgtaaatccggatcagagatgaggccagctagagcaaagtttgactttaaggcacagacgctcaaggaactgcctctacagaaaggcgacatcgtctacatttataaacagatcgatcagaattggtatgagggggaacaccacggcagggtgggcatatttcctaggacctatattgaacttttgccccctgctgaaaaagcgcagcccaagaagttgacccctgtgcaggttctcgaatatggagaggctattgcgaagttcaattttaatggtgacacacaagtcgaaatgagcttccgcaaaggagagagaattactctactccgccaggtggacgagaactggtatgagggccgcatcccgggtacttctcggcaaggcatcttccctataacctacgtggacgttatcaaacggcctttggtcaagaaccctgtcgattatatggatttgccattctcgagctctccatcccggtccgccactgccagcccccagtttagctctcatagtaagctaatcactcccgcccccagctcactgcctcattccaggcgagctctcagccccgagatgcacgctgtgacttcggagtggatctctcttacggtcggcgtgccaggacgccgctccctcgcactgaccccaccattgccacccctgcctgaggcatcgatttataacacagatcacttggcactttctccccgggcctcaccttccctctctctctccctgccacatctctcctggtctgaccgaccaacaccacgctcagttgcctctccactcgccctgcccagtcctcataagacttactcattagcgcctaccagccaggcctccctgcacatgaacggcgacggaggggtgcatacacccagttctggcatccaccaggactccttcttacagctcccgctaggcagttcagacagtgtgatttctcagctgtctgatgctttctcaagccagtcaaaaaggcagccgtggcgggaagaaagcggccaatacgagcggaaggcagagcgcggcgctggagaacgcggccccggggggccgaagataagcaagaagagctgtctgaagcccagtgacgttgttagatgcctatccaccgaacagcgcctttccgacctcaacacgcccgaagaaagcagacccggaaagcctctggggagtgcatttccgggctccgaagccgaacagaccgagcggcatcgcggaggagaacaggccggccggaaggcggcacgtcggggcggttctcagcaaccacaggctcagcagcggcgggtgacgccagatcgtagccaaaccagtcaggacctcttttcttatcaagctctatactcttatatcccacagaatgatgacgagctcgagctgcgagacggtgatatcgtggacgtgatggagaagtgtgatgacgggtggtttgtggggacttctcggcggacaaaacaatttggcaccttccccgggaattacgtgaaacctctgtacctctag

SEQ ID NO: 206525 - DNA, 3801 bp, Artificial Sequence
  Description of Artificial Sequence: Synthetic coding sequence
atgagcagcgagtgcgacggcggcagcaaggccgtgatgaacggcttggcacctggttctaatgggcaggataaggccactgctgatcctctaagagcgcggtctatttcagccgtgaagattattcctgtgaagactgtgaagaacgcctctggattggtcctgcctacagatatggacctcaccaagatatgtactgggaaaggtgccgtaacgctaagagcctcatcctcttatcgggagacgccttcgagcagtccagcgagtccacaagagacccggcagcatgagtctaaacccggcttggaacctgagccatcatcagccgacgagtggcggctcagtagcagcgccgacgctaatggcaacgctcagccgtctagcctggcagcgaaaggctaccggtctgtacaccccaatctcccatcagataagagtcaggatgccaccagtagctctgctgctcaaccagaggtgatcgtggtccccctgtacctcgtcaatacagatcgagggcaagaagggaccgcacggcccccaacgcccttgggtccactcgggtgcgtgcctactatcccagctactgcatccgccgcctcgcccttaacattcccaaccctggatgacttcatcccaccccaccttcagaggtggcctcatcattctcagccagcgcgtgcgagtggtagttttgcaccaatatcgcagactcccccatcctttagtcctccgccgcctttagtgcctccagcgccagaagacctaagaagggtgtctgagcctgatcttaccggagcggtgagctcaacggacagttcacctttgttgaacgaagtcagcagttccctgattggaaccgacagccaggcatttcccagcgtttctaagcctagtagcgcgtacccctctacgacaattgttaatccaacaattgttctgctccaacataaccgagagcaacagaaacgattgagctccctgagcgatcccgtctccgagcgcagggtaggcgagcaggatagcgccccaacccaggagaagcccaccagcccgggcaaggcgatcgaaaaacgtgccaaagacgatagcaggcgtgtggtcaaaagtacccaagatctgtcagatgtctcaatggacgaggtgggtatccctctgagaaacacagagagaagcaaggactggtataagaccatgttcaagcaaatacacaagttaaaccgagatgatgattcagacctgtattccccccggtactcttttagtgaggatacgaaatcacccctttcagtgccgcgaagcaagagtgagatgtcctacatcgacggtgaaaaggtggtgaagcggtcagctactctcccgctgccagcacgcagctcctctttgaaatccagctcagaacggaacgattgggagccacccgacaaaaaggtggacacccgcaaataccgcgcagaacctaagagtatatacgaataccagccaggcaaatcaagcgtcctgaccaatgagaaaatgagtagggacatatctcccgaggaaattgacctgaagaatgagccctggtataaattcttctcggaactggagttcggtaagcccccaccaaagaaaatttgggattacacccctggagactgcagcatcctgcctcgagaggaccggaaaacgaacctggataaagatctctctttgtgtcagaccgaattagaggctgacctcgagaaaatggagacccttaacaaagctcctagcgccaacgtcccccagagttctgctatcagtcctaccccggagatatcgtcagaaaccccgggttatatttactctagcaactttcatgccgttaaacgtgaaagtgacggggctcccggtgatctgacaagcttagagaacgaaagacagatctataagtctgtgttagaaggaggcgatatcccactgcaaggtctaagcgggctgaaacgtcccagcagctcagcatcaactaaggattcggaatctccacggcacttcattccagcagattacctggagtcaaccgaggaattcattcggcggcggcacgacgataaagagaagctactggccgaccagagacgacttaagagggaacaggaggaagccgatattgcggctaggcgacataccggggtgattccgacacatcaccaattcataaccaacgagagattcggggacctcctcaatatcgacgacaccgcaaagcgaaagagcggaagcgagatgcgtcctgcacgggctaaattcgactttaaagctcagaccttaaaagaattgccgttacagaagggtgatatagtgtacatctataaacagatcgatcaaaattggtatgaaggggaacaccatggccgtgtcggaattttcccccgcacttatattgagcttttgccacctgccgagaaagctcaacctaaaaagctgactcccgtgcaagtgcttgagtacggagaggcaattgcaaaatttaatttcaatggtgacactcaggtggagatgagctttagaaaaggcgaaagaattaccctattgcggcaagtggatgagaattggtatgagggcaggattcctgggacaagtcgacaaggaatttttcctatcacgtatgtcgatgttattaagcgtcccttagttaagaacccagtggattatatggatcttccattcagcagtagcccatctcgaagtgcaaccgcatcacctcagttttctagccacagcaaacttattactcccgctccaagcagcctgccacactcacgcagagctttatcacccgagatgcatgccgtaacgagcgaatggataagcctgaccgtcggagtgccaggaaggcgctcactggctctgactcctcctctgcctccgctgccggaggctagtatatataacaccgaccaccttgccctgtcccctcgcgcttcaccctcactgagtttgagtctaccgcacctgtcctggtctgatcggcccacacccagaagtgtggccagccctctagccctgccttccccccacaagacctactctttagccccaaccagccaagcgagtcttcacatgaatggcgatgggggcgttcatacaccatcttcgggcatccaccaagattcattcctgcagttgcccttggggagctcagactcagtaatcagccagctcagtgatgcgttctctagccagtccaaacgccagccttggcgcgaagaatccgggcagtatgaacggaaagccgagcgcggtgccggcgagaggggtcctggcggcccgaaaatttcgaagaaaagttgtctgaaaccctccgatgtagttcggtgtctgtccactgaacagcggctaagtgacctcaatacccctgaggaatccaggccgggaaagcctcttggatccgcgtttcccgggtcagaggctgaacaaaccgagagacatagaggcggagagcaagctgggaggaaagccgcacggcgtggtgggtcccagttatcccatcacagccttagggctggtcctgatttaactgaaagtgagaagtcttacgttcaaccccaggcacagcagcggcgggtgactccagatcggtcacaaaccagccaagatctgttctcctaccaagcgctttactcatacattccgcaaaacgacgacgagctggaactgcgcgatggagatattgtggacgttatggaaaaatgtgacgatggatggtttgtgggaacaagcagaaggacgaaacagtttgggacattccccgggaactacgtcaagcccttgtatctatag

SEQ ID NO: 206526 - DNA, 2436 bp, Artificial Sequence
  Description of Artificial Sequence: Synthetic coding sequence
atgagcagcgagtgcgacggcggcagcaaggccgtgatgaacggcttagccccagggagcaatggccaggataaagatatggacttgacaaagatctgcactggaaaaggggcagtgaccctgcgagcctcctcgagttaccgcgagaccccaagtagctccccggccagtccgcaggagacacggcaacacgagagcaaacctgggctcgaaccagaaccttcttcagctgacgaatggcgcctatccagcagtgcagacgccaatggcaacgctcagccaagttccctggcagccaaaggataccggagtgtgcatcctaatttaccctctgataagtctcaggattctagcccccttcttaacgaagtatcctctagtttgattggcaccgacagccaagctttcccctccgtttcaaaaccctcgagcgcctaccccagtaccacaatcgtaaatcctacaatcgttctcctgcagcataatcgtgagcagcaaaagaggttgtcctctctttcggatccggtgtccgaacgcagagttggcgaacaggattctgcccctacccaagagaaacccaccagccctggaaaggcaattgagaagagggccaaggatgacagtcgtcgagtcgttaagagtacccaggatttgtctgacgtgtccatggacgaggtgggcatcccgctgcgcaatactgagcgctccaaggattggtacaagacaatgttcaaacagatccataaactcaacagagacgatgacagtgacctctactcgcccaggtactcgttcagcgaggacacgaagagtccactctcagtccccaggagcaagtcagagatgagttatattgatggcgagaaagtggttaagaggtccgcaactctgccgcttccggccaggtcaagttcccttaagtcttccagtgagcggaatgactgggaaccacctgacaagaaggtggacacaaggaagtaccgggccgagccaaaatccatttacgagtaccaaccaggcaagtcctcagtcctgactaacgagaagatgagccgcgatatctctccggaagaaattgacttgaagaatgagccatggtacaaatttttttctgaattggaattcggcaaaccaaccaatctagacaaggatcttagcctctgccagaccgagctggaggccgatctcgaaaagatggagaccctcaacaaagcaccaagcgcgaacgtgccccagtcaagcgccatcagcccaacaccagaaattagttctgagacaccaggctacatttatagcagcaacttccatgccgtgaagcgagagtcggacggcgcaccaggtgacctcaccagccttgagaatgaaagacagatatacaaatctgtgctggagggaggcgatattcccctccaggggttaagcggcctcaagcggccaagttctagcgccagcacaaaggacagcgagtcccctcggcacttcattcctgccgattatctggagtctactgaagaattcattagacggcggcacgacgacaaggagaagctcctagccgaccagagaaggctgaagcgtgagcaggaagaagcagatatcgcggcccgacggcacaccggagtcatccccacacaccatcaatttatcacgaacgagagatttggcgatctcctgaacattgacgacactgccaagagaaagagcgggtccgagatgcggccagcaagagccaagtttgatttcaaagcccagactctgaaagaactaccgcttcagaaaggcgacatcgtgtacatctacaagcagatagaccagaactggtatgaaggagaacaccatggccgggtgggcatctttccccgtacatacattgagctgctcccacccgccgagaaggcccagcccaaaaagctcacacctgtacaggtactggagtacggggaggcaatcgcgaagttcaattttaacggggacacccaggtcgagatgtcatttcgaaaaggcgagaggattaccctgctccgccaggttgacgagaactggtatgaaggaagaattcctggtacctcccgacaggggatattccctatcacttatgtggatgttatcaaacgtccccttgtgaaaaaccctgtcgactatatggatctgccattctcatccagtccatctcgttcagccaccgcatcccctcagcagccgcaagctcaacagcgccgcgtgacgccggatcggagtcagacctctcaagatctcttctcttatcaggcactctattcttacatccctcagaatgatgatgagctcgagctgagagatggggatattgttgacgtcatggaaaagtgcgatgacggctggttcgtggggacttcaaggaggactaaacagttcggtactttccctggaaattatgttaagcctctctacctatag

SEQ ID NO: 206527 - DNA, 2055 bp, Artificial Sequence
  Description of Artificial Sequence: Synthetic coding sequence
atgagcagcgagtgcgacggcggcagcaaggccgtgatgaacggcctcgcacctggatccaatggtcaagataaggatatggatctaactaagatttgtactgggaagggcgcagtgactctgagagcctcttctagctatcgagaaaccccttcctcaagccccgcctcaccccaggagacaaggcagcacgaaagcaaacctgacgaatggcgcctgagttctagcgcagacgctaacggcaatgcgcagccttcttctctagcggcaaaaggatatcggagcgtgcaccctaatctgcccagtgataagtcccaggacagttcccccctactgaacgaggtctcaagttccctgatcggcaccgactctcaggccttcccgagtgtatctaaacccagcagcgcgtatcctagcaccacgatagttaatcctaccatcgtcttgctgcagcacaaccgcgaacaacagaagagactgtcatcccttagcgatccggtgagcgaaagacgcgtgggcgagcaggattccgctccaacccaggagaagcctacgtcccctgggaaagctatagaaaaacgagcaaaggatgattctaggcgagtggttaaaagtacacaagatctttctgacgttagcatggatgaagtgggcattcccttacgcaacacagagaggtctaaggactggtataagactatgttcaaacagatccacaaactcaatcgggacgatgatagcgacctctattctccacggtactcattcagcgaagatacaaaatctccgctatccgttccaaggagcaagtctgagatgtcatacatcgacggggaaaaggtagtcaagcggagcgccaccttgccactgcctgcaagaagttcctcccttaaatccagcagcgaaagaaatgactgggagcctcccgataaaaaggtggatacccggaaatacagggccgagccaaaatcaatttacgagtatcaaccaggaaaatcttccgtgctgactaacgaaaaaatgagctctgccatctccccaacacctgagatttccagcgaaactccgggctatatctattcctccaactttcatgctgtcaaacgggagagcgatggcgcccccggcgacttgacttctctggagaatgaaagacaaatctacaaatctgttctggagggcggcgatatccccttacaggggctgtccggactgaagcggcctagcagctctgcatctaccaaggactcggagagtccccggcatttcattcccgccgactacctggagagtaccgaggaattcatcaggcggcgccatgatgacaaagagatgcggcctgctagagccaaattcgatttcaaggcccaaactctcaaagaactgccactgcagaagggggatattgtgtacatttataagcaaatagatcagaattggtatgagggtgaacatcatggacgtgtgggcatttttcctaggacatacattgagcttctgccccccgctgagaaggcacagccaaaaaaactgacaccagttcaggtcttggagtacggggaggctatagccaaatttaacttcaatggagatacacaagtggaaatgagctttaggaagggcgaacggatcacgcttctccgccaggttgacgagaattggtacgagggacgtatcccagggacatcacggcagggaatattccccatcacatatgtcgacgtcattaaaaggccactggttaaaaaccccgtggactacatggatctgccattctctagctccccaagccgaagcgccacagccagtccacaacagccgcaggctcagcagcgtcgcgtgactcccgatagatcccagaccagccaggatttattctcataccaggcgctgtattcttacatcccacagaacgatgacgagctagagttgcgtgatggggacattgtggatgtcatggaaaaatgcgacgatggttggtttgttggcacctctcgtagaaccaaacaattcggaacatttcccggaaactacgtgaaacctctatacttgtag

SEQ ID NO: 206528 - DNA, 2718 bp, Artificial Sequence
  Description of Artificial Sequence: Synthetic coding sequence
atgagcagcgagtgcgacggcggcagcaaggccgtgatgaacggcttagccccaggttcaaacggtcaagataaggccacagcagatcctctgagggctcgctccatctcagcagtcaagattatacctgtgaaaaccgttaagaatgcatccgggttagtgctccctacagatatggacctgaccaagatttgcactggcaagggggctgtcacgctccgagcttcaagttcctatcgggaaactccaagcagcagcccagcatcccctcaggaaacccgccagcatgaatcaaaaccgggtctcgaacccgaacctagtagcgccgacgagtggcggttaagcagtagcgcagatgcaaacggcaatgcacagccctcttccctggccgctaagggttatcgcagcgttcatccaaatctgccttcggacaagtcgcagcggtggccgcaccattcccagcctgcccgagcctcgggtagctttgcaccaatctcgcaaacgccaccaagtttctctcctcctccccctttagtgccgccggccccagaggatctgcgacgagtgtccgagcctgatctcactggtgcagtgtcatccacagactcctctccccttctcaatgaggtctcttccagtctgatcggcacagactcccaagccttcccctcggtgtcaaaaccatcgtctgcctatcccagcaccaccattgtcaatcctacgattgtgctcctgcaacataaccgtgagcagcagaaaaggctctcgtctctgagtgacccggtgagtgagaggcgcgtcggcgaacaggactcagccccaactcaggaaaagccaacttcgcctggaaaggctatcgagaagcgggcaaaggacgacagcaggagggtcgtaaaatctacgcaggatctcagcgacgtgagcatggacgaggtcgggattcctctgaggaacacagaaaggagtaaggactggtataagaccatgttcaagcagatccataagctaaaccgggacgacgactccgacctttattctcccagatactctttctcagaggatactaaaagcccactgtccgtgcctcgaagtaagtcagagatgtcttacattgacggtgaaaaagtggtgaaaagatccgccactcttcccctaccggcccgctcttctagtcttaagtcatcgagcgagaggaacgattgggagcccccggataagaaagtggatacacgcaagtatagggctgagcctaagtctatatacgagtaccagcctggcaagtcatccgtactgacaaacgagaaaatgtctagggacataagcccagaggaaattgacctgaaaaatgagccctggtacaagttctttagtgagttggagtttggaaagccccctccaaagaagatatgggattacacgcccggtgactgttctattctgcccagggaagatcgaaagtcatcggcgataagtccaactcccgaaatcagttcagagactccaggctatatctatagctcaaatttccacgccgtcaagcgggaaagcgatggggcacccggggatctcacctccctagaaaatgagcgtcagatatacaaatccgtgctggaggggggggatatccctctccaggggctgtcgggcctcaagaggcccagcagttctgcctcgacaaaagactcagagtcaccccggcatttcatccctgcagactacctagaatctaccgaggagtttatccgacggcggcatgacgataaagaaaaactgctggcggatcagagaaggctcaaaagggaacaggaggaggccgacatcgctgcaagaaggcatactggggtgattccgacgcatcatcagttcataacaaatgaacgctttggggatttgctgaacattgacgatactgccaagcggaagagcggctccgagatgagacctgcaagagccaaattcgatttcaaggctcagaccctcaaagaacttcctctgcagaagggggacatcgtgtacatctacaaacagattgaccaaaactggtacgaaggggagcaccacggaagagtgggtatttttccccgaacctatatcgagctactgccacccgccgaaaaggcccagccgaagaaactgactccagtgcaggttcttgaatatggcgaggcaattgcgaaatttaacttcaacggcgatacccaagttgagatgagcttcagaaaaggagagaggatcaccttacttcgccaagtggatgaaaattggtacgaaggaagaatcccaggaacctctaggcaaggtatctttcccattacatatgttgatgtaattaagcggccactcgttaagaaccccgtagactacatggatttgccattcagtagtagccccagcagaagcgcgaccgcttctccgcagttgagtcatcactcgttaagagcaggtcctgacctcaccgagtcagaaaaatcctacgtgcaacctcaggcgcagcagcgccgagtgactcccgataggtcccagacaagccaagacctgtttagctaccaggcactgtactcatacatcccgcagaatgatgatgaactggagctgcgggacggtgacatcgttgatgtgatggaaaaatgtgatgatggctggtttgtgggtaccagtcggaggacgaaacagttcgggaccttcccaggtaattacgtgaaaccgttgtacctctag

SEQ ID NO: 206529 - DNA, 3456 bp, Artificial Sequence
  Description of Artificial Sequence: Synthetic coding sequence
atgagcagcgagtgcgacggcggcagcaaggccgtgatgaacggcctggcccctgggtctaatgggcaagataaggcaactgctgacccactgcgggctcggtctatttcagctgtgaagataatccctgtcaagaccgtcaagaacgcgtctggcctggtcttgccaaccgacatggatttaaccaaaatttgcaccgggaagggagccgtgaccctgcgcgcctcttccagctacagagaaacccctagttctagtccagcatcacctcaggagacacgacagcatgagtccaagcccggactggagcccgagccatctagcgctgatgagtggcggctcagctcgtcagccgacgccaacggtaacgctcagccatcttctttggccgctaagggatatcgcagcgttcacccaaatctaccaagcgataagagtcaggacgccacaagttcatccgcggcccaacctgaagtgattgttgtgcctctgtatctggtgaacaccgatcgtggccaggagggaacagctcgccccccgacgcctttggggcctctgggctgtgtccccacgataccagccactgcctcggctgcctctcccctcactttcccgactctcgacgattttattccaccgcatctgcagagatggccccaccacagtcagccggcaagagcctccggctctttcgcccccatttcacagacaccgccctccttctcccccccccccccactagtccctcccgccccagaagatcttagacgtgtgagcgagccagacctgacaggagcagtctcaagtactgactcgagccccctgttgaatgaagtgagctcctccctgattggcaccgacagccaggcctttcccagcgtatccaaaccttcttccgcttacccatctacgaccatcgtgaatcctactatcgtcctgctccaacacaaccgggaacaacaaaagagactcagctccctgtccgaccccgtcagcgaaaggcgggttggagagcaggacagcgcccccactcaagaaaagcctacatctcctggaaaagctatagagaaaagggctaaagatgactcacgcagagtggtaaaaagtacccaagacctctctgatgtttccatggacgaggtgggtattcccctgcgtaacaccgagagaagcaaggactggtacaaaactatgttcaagcaaattcacaagctcaaccgggataccccagaggagaatccctatttccccacttacaaattcccagagctccctgagatccaacaaacatccgaagagactaagtcttgctccgtcatgtctcccagattggagtgttccggtacagttatcgcccattgcagcctcaaattattggactccagcaaccctcccacaagtgccagtcaggtcgctgggacggccgacgacgattccgacctgtattctcctcgttatagtttctcagaagatacaaagtcacccttgagtgttcctcgatctaagtcagagatgtcctatatcgatggcgagaaagtggtgaaaaggtcagcaacgctgccactgcccgccagaagcagcagtttgaaatctagcagcgagcgaaacgactgggaacctccggataagaaggttgatacgcggaagtatagggccgagcctaagtccatttatgagtatcagcccggcaagtccagtgtcttgactaatgagaaaatgtccagagatatctctcccgaggagatcgacttaaaaaacgaaccgtggtataagttttttagcgagctggaatttgggaagccaccccccaagaaaatttgggattatactcctggagactgcagcatcctcccacgggaggacaggaaaaccaacctggataaagacctttcactctgtcaaacagagctagaggctgatctcgaaaagatggaaaccctgaataaagccccctcagcgaatgtgccacagtcaagcgccatcagccctacccctgagatcagtagtgagacccccggttatatctacagctccaacttccatgccgtgaaacgagagagcgacggcgcacctggggacctgacttcactggagaacgagagacaaatctacaaaagtgtgcttgaaggcggcgatatacctctgcaggggcttagtggactgaaacgtccttctagctccgcatccaccaaggactctgagagccctaggcacttcatcccagccgattatttagagagcaccgaagaatttattaggcgccggcacgacgataaggaaaagttattggcagaccaacggcggttaaagcgggagcaggaagaagccgacatcgccgccaggcggcacaccggtgtaatcccaacccatcaccagtttataaccaacgagaggttcggtgacctgctgaacatcgacgatacagccaagcggaagagcggatctgaaatgaggcctgcgcgcgctaaattcgactttaaggcccaaacactgaaggaacttcccctgcaaaaaggggatatagtgtatatctataagcagatcgaccaaaactggtatgaaggcgaacatcacggcagagttggtattttcccccgtacctatattgaactgttacccccagcggaaaaggcccaacccaagaaactgactcctgtccaagttttagagtatggcgaagccatcgctaagtttaactttaacggagatacacaagtggagatgtccttccgcaagggggaaaggatcactctcctgcgacaggtcgacgaaaattggtacgagggccggatcccaggcacctctcggcaggggatctttcccattacctacgtggatgtcattaagcggccactggttaaaaaccctgttgactatatggatctgcccttttcgagttcgcctagtcggtccgctaccgcatcccctcagccatggcgtgaagagagcgggcagtacgagcgtaaagctgagagaggcgcgggtgagagagggcccggcggtccaaagattagtaaaaagagctgtctcaaaccatctgacgtggtccggtgtctcagtaccgagcaacggctgagcgatttaaacaccccagaagagagtagaccagggaaaccactgggatccgcgtttcctggttccgaagctgagcagacagaaagacacagggggggagagcaagctgggaggaaagccgccaggagggggggtagccagcagccacaggctcaacagcgcagagtaacccctgaccggtctcagacatcccaggacctgttttcgtatcaggccctttattcatacattcctcagaacgatgacgagctcgagctcagggacggtgatatcgtcgacgtcatggagaagtgcgatgatgggtggttcgtgggaacctctagacggactaagcagtttggtaccttccctggcaattacgtaaagccactctatttatag

SEQ ID NO: 206530 - DNA, 3879 bp, Artificial Sequence
  Description of Artificial Sequence: Synthetic coding sequence
atgagcagcgagtgcgacggcggcagcaaggccgtgatgaacggcctcgctcccggctccaatggtcaggacaaggccactgctgacccactaagagcccggtctatatccgctgtgaaaatcataccagtgaagacggtgaagaacgcttctggactggtgctgcccactgatatggacctgacgaagatttgtacagggaagggggccgttaccctaagggcttccagctcctacagagagacgccctcaagttcacctgcatcaccccaggagacgagacagcatgaaagtaaacctggactcgaaccagagccctcctccgccgatgagtggcgattgtcttcctctgccgacgcaaacgggaacgcccagcccagctccttggcagccaaaggctatcgctctgtccaccctaacctcccatccgacaagagtcaggatgcaacttccagctcggctgctcagcctgaagtcattgtggtccctctgtaccttgttaacacagaccgaggacaggagggcaccgcaaggccacccacgccactgggacccctcggttgtgtgcctacaatcccagctacagcttctgcagcctcaccgctgactttccccacattagatgacttcatccctcctcacctgcagagatggcctcatcattcccagcctgctagggcatcgggttcctttgcacccatttctcagactccacctagcttctctcccccaccccctctcgtgccaccggcccccgaggacctgcggagggtgtctgagcctgacctgaccggggccgtgtcatctacggatagtagccctctgctgaacgaagtctcttccagtttgatcggcactgactcacaggcatttccatcagtctccaaaccgagttctgcttacccgtctaccactattgttaaccctaccatcgttctgctccagcacaacagagaacagcagaaaaggctgtcctcactgagcgacccagtttcggaaaggagggtaggcgagcaggacagcgctccaacccaggagaagccgacaagcccgggaaaagcaatcgagaagagggcaaaagatgattctaggcgagtggtgaagtcgacacaggacctgagcgacgtatccatggacgaagtgggcatcccactgcggaatacagagaggtccaaagattggtataagaccatgtttaagcagattcataagctgaatagagacactccagaggaaaacccctatttccctacctacaaatttccggaactcccagagattcagcaaacgagtgaggaggacaatccttatactccaacatatcagttccccgcaagcacgccaagtccgaaaagcgaggatgacgacagtgacctgtactcacctcggtatagctttagcgaggacaccaaatcacctctgagcgtcccaaggagcaagagtgagatgagctacattgacggggagaaagtcgttaaacgatctgccacacttcctctgcccgctcgttcgtcctctctgaaaagctccagcgagcgcaacgattgggagccgcccgacaaaaaagtggacacaagaaaatacagagccgaacccaaatctatttacgagtaccagccaggcaaaagttctgtcctgactaacgagaagatgagcagggatatcagtcctgaggagatagacctgaaaaacgagccctggtacaaattcttcagtgaactcgagttcggtaagcctccgccaaagaagatttgggactacacacctggggactgctctattctgccccgagaggataggaagaccaatcttgataaagacctgtccctatgccagaccgagctggaggctgatctagagaagatggaaaccctaaataaagccccaagcgccaacgtaccccaatcaagtgccatctcacccacccccgagataagttcagagacccccggatacatatactcctcaaacttccacgctgtaaaaagggagtctgacggagctcccggcgatctgacatcactcgaaaacgagcgccagatttacaagagcgtacttgaaggaggagacatacctcttcagggactgtctgggttaaaaaggccaagctcaagtgcttcaactaaggatagtgaaagcccccgtcatttcatccccgctgactatctggagagtactgaggaatttatacgacggcggcatgatgataaggaaaagttgctggcggaccaacgtcgcctgaaacgtgagcaggaagaagccgacattgcagcaagaaggcataccggcgtaatccctacccaccaccagtttattaccaatgagcgatttggagacctgttgaacatcgatgacacagccaaacggaagagtgggtccgagatgagaccagctcgggcaaaattcgactttaaagctcagaccttaaaagaactgccactacagaaaggtgatattgtgtacatttataagcagatcgatcagaattggtacgaaggcgagcaccacggcagggtcggaatctttccccgcacgtacatagaactgttaccgccagccgaaaaggcccagcccaaaaagttgacccctgtccaagtgttggagtacggcgaagctatcgcgaaattcaattttaatggggacacccaggtggaaatgtcgtttaggaagggcgagaggatcactttactgcgccaagtggacgagaattggtatgaagggaggattcccggcacaagtcgccaaggcatcttcccgatcacctacgtggacgtgataaagcgccccctcgtcaaaaacccagtagactatatggatctaccattctctagtagtccgtcccgtagtgcgacggcctctccacaattttcgtcccactccaaactgataacacctgctcctagctcactcccccacagtaggagggcactatctccagagatgcacgccgtcacaagcgagtggatctcactcaccgtcggtgtacccgggagaagatcgctggcactgacaccccccctgccccctcttcctgaagctagcatctacaatactgatcatcttgctttatccccacgtgcctctccttccctgtccctgtccctgcctcacttgagctggtcagatcgccctactccgagaagcgtggcatcacctcttgcccttccctccccgcacaagacctattccctggcgcctacctcgcaagccagcttgcacatgaatggtgacgggggcgttcacactccatccagcggaatccatcaggactccttcctacagttgccgttagggagttcagacagcgttatctcccagctgtccgatgccttttccagccagtcaaagcggcagccgtggcgagaggaaagtggacagtatgaacgcaaagccgagagaggtgccggggagaggggaccgggggggcctaaaatttctaaaaaatcatgtctcaagccctccgacgtcgtgagatgcctctcaacagagcagcgcctatctgatctgaacacgcccgaagagtcgagacccggaaagcccctgggatctgcctttcccggtagcgaagcagaacagaccgaaagacatcgggggggcgagcaggccgggcgtaaggctgctcgaagaggcgggtcccagcagccccaggctcagcagcgcagggttaccccggacagaagccaaacgagccaggacctcttctcatatcaggctttgtactcatacatcccccagaacgatgatgaactggagttgagagacggggacatcgttgatgtcatggagaaatgtgacgacggatggttcgttggcacgtctcggcgtacaaaacagttcggcactttcccaggaaactatgtgaagccactatacctgtag

SEQ ID NO: 206531 - DNA, 2451 bp, Artificial Sequence
  Description of Artificial Sequence: Synthetic coding sequence
atgagcagcgagtgcgacggcggcagcaaggccgtgatgaacggcctagcccccggctcaaacggccaggataaggatatggacctgactaagatttgtacgggcaagggcgccgtgaccctaagggctagctcctcctaccgagaaaccccatcatcctcacctgctagccctcaggagacccggcagcacgagagcaaaccagggctggagcccgaaccttctagtgccgacgagtggcggctcagttctagtgctgatgccaacggaaacgcccagccttcctccctcgcggccaagggttatcggtccgtgcaccccaacctcccgagcgacaaaagtcaagacgcaaccagttcttcagccgctcagccggaagtgatcgtcgtgcctctctatctcgttaacaccgaccgaggacaagaaggtacagccaggccccctacccctcttggaccactgggatgcgtgcccacaatacctgccacagcgagcgctgcttctccccttacttttccaaccctggacgacttcattccaccccacctgcagcgttggccccaccattctcagcccgcccgtgcatctggtagctttgccccaatctcacaaactccccccagcttctctcccccccctcccctggtgcctccggcccctgaagaccttagacgcgtctccgagcccgatctcacgggtgctgtttcttctacggatagttctcctctgctcaacgaggtctcgtccagtttaattggaacagactcccaggctttcccatctgtgtccaagccctcgagcgcttatccatccactactattgtgaatcccacaatcgtgcttctccaacacaacagagaacagcagaaaagactgtcctctctctcggaccctgtctctgagaggagggtcggagaacaggacagtgcacctacacaggaaaagcctacttcgccgggcaaggccatcgagaaacgggcaaaggacgatagccgaagggtggtcaaatccactcaggacctcagcgatgtgtcaatggacgaggttggtattcctctgcgcaatacagagaggagtaaggactggtataagaccatgttcaagcagatccataagctgaatcgcgatgacgactccgacctgtactctccaaggtatagcttctcagaggatacaaaaagccctctttcagtgccacgctcaaagtctgaaatgagctacatcgatggcgagaaggtcgttaagcgctcggcaacgctccctctgcccgctcggtcatcatctctcaagtcgagtagtgaaagaaatgactgggagcctcctgataaaaaggtggacacccgaaaataccgggcagagccaaaatcgatatacgagtatcaaccaggaaagagtagtgtccttacaaacgagaagatgtcttctgccatctccccgactccagagatctcctccgaaacccctggatacatatattcttctaatttccatgctgtgaaaagagaaagtgacggagctcccggggacctcacatccctggagaacgaacgacagatttacaagagcgtgctagaagggggagacattccattacagggcttatccgggctgaaaagaccgtccagcagtgcaagtacgaaggattcagagtccccaaggcacttcatcccagccgattacctggaatccacggaggagttcatcagacgacgccatgacgacaaagaaatgagacccgccagggccaagtttgatttcaaagctcaaactttaaaagagcttcccctgcaaaaaggcgacatcgtgtacatttataagcagatagatcaaaattggtacgaaggcgagcatcacgggcgggtgggcatatttcctcggacctatatcgaactgctcccgccagctgagaaggcacaacccaagaaactcaccccagtgcaggtcctggaatatggcgaagcaattgccaagttcaacttcaatggggatacgcaggtggagatgagttttcgaaagggcgagcggataacgctgctccgtcaggtagatgaaaattggtacgaaggccgaatacccggtactagtagacaagggattttcccaatcacttacgtcgacgttattaaacgcccactcgtgaaaaacccagtggattacatggacctgcctttctcttccagtcccagcaggtcagctaccgcctctccgcagcagccccaggcacagcagcggcgggtcactcccgaccgctctcagacatctcaggacctgttctcctatcaggccctctacagctacattccacaaaacgatgacgaattggagttaagggacggggacattgtggacgttatggaaaagtgcgacgatggatggtttgtcgggaccagcagaagaaccaagcagtttggcaccttccctggaaactacgtcaaaccactttacctttag

SEQ ID NO: 206532 - DNA, 3015 bp, Artificial Sequence
  Description of Artificial Sequence: Synthetic coding sequence
atgagcagcgagtgcgacggcggcagcaaggccgtgatgaacggcttagcaccagggagtaacggacaggataaggcgacagccgacccgttgcgggcacgtagtatctctgccgtaaaaattatcccagtcaagactgtgaaaaacgcatcagggttggtgttgccgacggatatggatttgaccaagatttgcacggggaagggcgcggtgacgctcagagcaagctcatcatacagagagactccgagttcatcaccagcctccccccaagaaacccgtcagcatgagtcgaaaccggatgagtggcgactcagttcctccgccgatgccaacggaaacgcccaaccgtcatcactagctgccaagggctaccgatcagttcaccccaacctgccgtctgacaagagccaagacgccacaagctcatccgccgcgcagccagaagttattgtggttcctctgtacctggttaatacagatcgggggcaggaggggactgcccgcccacccacacctctggggccactcgggtgcgtgcccactatcccggcaaccgcatcagcagcatctcctttaactttcccaaccctcgatgattttattccgcctcacctgcagcggtggccacaccatagccaacccgcccgagcaagcgggagctttgcccctatttctcagactccaccatctttcagcccccccccaccgcttgtgccaccggctccagaagatctgcgccgtgtgtccgaaccagacctcaccggcgccgtcagtagcactgacagctccccattgctcaatgaggtatcttcctccctcatcggcacagatagccaggcatttcccagcgtgtctaagccttcctctgcctatccgagcacaacaattgtcaatccgaccatcgtgctgctgcagcataacagagaacagcagaaaaggctttcgagcctgagtgatcccgtttcagaacgcagggttggggagcaggactccgctccaacccaggaaaagcccaccagccctggaaaagcaattgaaaagagggcaaaggacgattcccgcagggtggtgaaatcaacacaggacctgtccgacgtgtctatggacgaggtcggaataccactgcggaacacagagagatccaaggactggtataaaaccatgtttaagcagatccataagctgaaccgagatactccagaggaaaacccttattttccaacctacaaatttccagaactcccagaaattcagcagacgagcgaagacgacgactcagatctttatagtccgcgatactcattcagtgaggataccaagtcacctctttccgtgcctcgaagtaagtcagagatgtcttatatagacggtgaaaaggttgtcaaacgcagcgcaacccttcccctcccagcccgctcctcctccctgaagtctagtagtgaaagaaatgattgggagccgcccgacaaaaaagtggatacaaggaagtatcgcgcagagcccaagtcaatttacgagtatcagcccggcaaatcgagcgtccttaccaatgagaagatgtccagggatatcagccctgaggagattgatctgaagaacgagccctggtataagtttttcagcgagctggagttcggtaaacctccacctaagaaaatttgggactacacacccggagattgttctatcttgccccgcgaggatcggaaaacaaacctggacaaagatttgtccctctgccagacagagctggaggccgacctcgagaagatggaaactctgaacaaagcacctagtgccaacgtccctcaatctagcgccatctcacctaccccggaaatttcttctgaaacaccgggctacatttattcctcaaattttcatgcagtgaagagagaatctgatggcgcgcctggggatctgacgtcactcgaaaatgaaaggcaaatctataaatcagtcctcgaaggcggtgatattcccctccagggactaagtgggctgaagcgcccaagctcaagtgcgtccactaaagactctgaatcaccacgccacttcataccagccgattatcttgagagtaccgaggagttcatccgtaggcggcacgatgacaaagagaagttactagcagatcagcggagactgaagcgggagcaggaggaggctgacattgcagctagaaggcataccggcgtcatccccacacatcaccagttcataacaaacgagagattcggcgatctgctgaacattgatgataccgcaaaacggaaatctggcagtgagatgagacccgcacgcgccaagttcgattttaaggcccagactcttaaagagctgccccttcagaaaggagacattgtgtatatatacaagcagattgaccaaaattggtacgaaggagaacatcatggccgagtgggcatttttccccggacttatattgaacttcttcctccagctgagaaagcccagccaaagaaactcacacctgtccaggtcctcgagtatggcgaggccatagcaaagttcaatttcaatggagatacccaagtcgaaatgagtttccggaaaggtgagcgaattactctgctccggcaggttgacgagaactggtatgaaggtcgcatccctgggacatctaggcaaggcatattcccgataacctatgtggatgttattaaaagacctcttgtcaagaatccagttgattatatggacctgcctttttcctcctctccgtcgagaagcgcgaccgcttctccccaacagcctcaagcccagcagcggcgagtgaccccagaccgatcacagacctctcaggacttgtttagctaccaggctctgtactcatacattcctcaaaatgacgacgaattagaactgcgcgatggggatattgtcgacgtcatggagaaatgcgacgatggatggtttgtgggcacatcacggcggaccaaacaatttggcacgtttcctggtaactacgtcaagccactgtatctttag

SEQ ID NO: 206533 - DNA, 2016 bp, Artificial Sequence
  Description of Artificial Sequence: Synthetic coding sequence
atgcagggccccccccggagcctgcgggccggcctgagcctggacgatttcatcccgggacacctgcagagtcacattgggagctcatcccgcggcactagggtccccgttatcagaaatggaggttctaacaccctcaacttccaatttcatgatcctgcaccaagaaccgtgtgtaatggaggttatacaccacgtagagatgcctctcaacatcccgatcctgcctggtaccagacatggcctggacctggttccaagcccagcgcctctacaaagatcccagcctcacagcacacgcaaaactggtcagcaacctggaccaaagatagcaagaggagagataagcgatgggttaagtacgaaggcatcggccctgtggacgaatccggtatgcccatcgccccacggtctagtgtagaccgcccaagggattggtatcgacggatgtttcagcagatccacagaaagatgcctgatctccagctcgactggaccttcgaggaacccccaagagatccccggcacctgggcgcacagcagcgacccgcccataggccgggccccgccacatcatccagtggacgcagctgggaccactccgaggagctcccgcggtccacattcaattaccgtccgggggctttctccaccgtgctacagccatccaatcaggtgctgcgaagacgcgaaaaagttgataatgtctggaccgaagaatcatggaatcagttcctgcaggaattggagaccggtcagcgcccaaaaaaaccgctggtggacgatcccggtgaaaagccatcccaacccatcgaggtgcttcttgagcgtgagttggctgagcttagcgctgagttagataaggatctgagggcaattgagacaaggctcccctctcctaagagtagccctgccccacgccgtgccccagagcagcggccacccgcgggccccgcttctgcctggtcttcttcctaccctcatgcaccatatctgggttctgccaggagcttatccccacataaaatggccgatggagggtctccctttcttggacgccgcgacttcgtctatccttcgtctacacgggacccctccgcctctaacggcggaggctcccccgcccgaagggaagaaaagaagcgcaaggcagcccgcctgaagtttgacttccaagctcagtccccgaaagaactcactctgcaaaagggcgatatcgtgtacatccacaaggaagtggataagaattggctggaaggcgaacaccacggcaggctgggcatattcccagctaactacgtggaagtcctgcccgcagacgagattcctaagcctatcaagccaccaacttaccaagttctcgagtatggggaggcagtcgcccaatacacctttaaaggggacctcgaggtagagttgagttttcggaaaggcgaacacatctgtttgattcgcaaggtcaatgaaaattggtacgagggacgcattacaggaaccggtagacaagggatctttcccgcatcttacgtacaggtgtctagagagcctcggttgcgactgtgtgacgacggcccacagctgccaacttcccctagactgacagccgctgctagaagtgctaggcacccgagtagcccttcggccctacgatctccggcagacccaattgatctcggcggccaaaccagcccccgacgaacaggcttcagcttccccacccaggaacctcgcccacaaacccaaaatctggggactccaggccctgccctatcgcatagccgagggcccagccaccctctcgaccttggaaccagcagccctaacacctcccagattcactggacaccttatagagcaatgtatcagtaccggcctcagaacgaagatgagcttgaactgagggaaggggaccgggtcgatgtcatgcagcagtgcgatgacgggtggtttgtgggagtgagccggcgaacacagaaattcggaacttttcctggcaattacgtggcaccagtatag

SEQ ID NO: 206534 - DNA, 990 bp, Artificial Sequence
  Description of Artificial Sequence: Synthetic coding sequence
atggccgacggcggcagccccttcctgggccggcgggacttcgtgtatccgtcatccacacgggatcccagcgctagcaatggtggaggaagtccagccaggcgggaggagaagaagcgtaaggcagctaggctcaagttcgacttccaagcccagagccccaaggagctgacactacagaagggggacatagtctacattcataaagaggtcgataaaaattggctcgagggagagcaccacggaaggttaggcatcttcccagctaattacgtggaagtgttgccagctgacgagatacctaagccgatcaagccccctacctaccaggtcctggagtatggtgaagccgtggcccagtacaccttcaaaggcgatctagaggtcgagctgtcttttcggaagggcgagcacatctgccttatccgtaaggttaacgaaaactggtacgagggccgcatcaccgggaccggacgccagggcatttttccggcctcctacgtgcaggtgtcgagagaaccccggttgaggctttgtgatgatgggcctcagctaccaaccagccccagattgactgccgctgctcggtccgcaaggcacccttcctcccccagcgcccttcgatcccccgccgatcctatcgacctaggagggcaaacttctccccgacggaccggcttttccttccccacccaggagccaaggccacagactcagaaccttggtacccccggcccggctctctctcactcacgggggccttctcaccccctggacctggggacatcatcacctaacacctcccaaatccattggactccatacagggcgatgtatcagtaccggccccagaatgaggacgagctggagctcagggagggagaccgtgtagatgttatgcagcaatgtgacgatggttggtttgtgggcgtatcacggcggacccagaaattcgggacattccctggcaactacgttgcacctgtgtag

SEQ ID NO: 206535 - DNA, 1074 bp, Artificial Sequence
  Description of Artificial Sequence: Synthetic coding sequence
atggccgccgccgccaagcccaacaacctgagcctggtggtgcacggaccgggggacctgcgacttgaaaactatcccatacccgaacctgggcccaatgaagtgctactgcggatgcacagcgtaggcatttgtggttctgacgtgcactactgggaatacggccgcatcgggaacttcatcgttaaaaaacccatggtgttgggccacgaagcctcagggactgttgaaaaagttggatcgtccgttaaacatctcaagcctggggatagggtggcaatcgagcccggtgctcctagagagaacgatgagttttgtaaaatggggcggtacaatctctcaccatcaatcttcttctgcgcaacaccacccgacgatggcaatctatgcagattttataaacataacgccgcgttttgctacaagttgcccgacaatgtgaccttcgaggaaggggctttgattgagccgctcagcgtagggatccatgcttgcagaagggggggagtgactttgggccacaaagtcctggtgtgtggcgctgggccaatcggaatggtgactcttctcgtggcaaaggccatgggggctgcccaggtcgttgtgactgatttgtctgcaacccgtctgagcaaggcaaaggaaattggggcagaccttgtgttgcaaatcagcaaagaatctcctcaggagatagcacggaaagtagaagggcaactggggtgcaagccagaggttacaatcgagtgtacaggggctgaagcatcaatccaggctggtatttatgctacccgctcggggggtaatctggtcctcgtcgggctgggatcagaaatgacaaccgtgccactgcttcacgccgcgatccgagaagttgatatcaaaggtgttttccgatactgcaacacctggccagtcgccatcagcatgcttgccagcaaatcggttaatgtcaaacctctggtgactcacaggtttcccctcgagaaagcgctcgaggcatttgagacctttaaaaaaggtctgggactcaagatcatgctcaaatgcgacccatctgatcaaaatccatag

SEQ ID NO: 206536 - DNA, 597 bp, Artificial Sequence
  Description of Artificial Sequence: Synthetic coding sequence
atggcctaccccggccaccccggcgccggcggcggctactaccccggtggctatggcggagcgccgggaggccccgcctttcccggtcaaacgcaggaccccctttacgggtacttcgctgccgttgcaggccaagacgggcagatcgacgccgatgagcttcaacgatgccttactcagtccggcatagcaggcggttataaaccattcaatcttgagacctgcagacttatggtgagtatgttagaccgggacatgtctggcacaatggggttcaatgaattcaaagagctttgggccgttctcaatggctggcgacagcacttcatcagctttgatactgataggtctggcacagtggacccccaggaactgcagaaggcacttaccactatgggttttagattatccccacaagctgtgaatagtatcgcgaagcgttactctacaaatggtaaaatcacctttgatgactatatcgcatgttgcgtaaaactgcgcgctctcaccgatagcttcaggcggcgggatacagcccagcagggggtagtgaactttccctatgacgacttcatacagtgcgtgatgtcggtctag

SEQ ID NO: 206537 - DNA, 552 bp, Artificial Sequence
  Description of Artificial Sequence: Synthetic coding sequence
atgcagtacggcggcgcccccggcggccccgccttccccggccagactcaggaccccttgtacggctatttcgctgccgttgcgggccaggatggtcagatcgacgccgatgagctccaacgctgcctgacccaatccggtattgccgggggctacaaacctttcaacctggagacatgcaggctgatggtcagcatgctagatcgtgatatgagtggaaccatgggctttaacgaatttaaagagctgtgggcagttctaaatggttggcgccaacatttcatttcctttgatacagaccggtcagggacagtcgaccctcaggaactgcaaaaggcactgaccacaatgggttttagactctccccacaagcagtgaacagcattgctaagagatacagcaccaatggaaaaattactttcgacgactacattgcgtgctgcgtcaagttgagggcactaacagacagctttcgacgccgggatacggcacagcagggcgtggtgaactttccttacgatgactttatccaatgcgtgatgagtgtctag

SEQ ID NO: 206538 - DNA, 543 bp, Artificial Sequence
  Description of Artificial Sequence: Synthetic coding sequence
atgcagtacggcggcgcccccggcggccccgccttccccggccagacgcaggatccgctgtacggttacttcgctgcggtcgcgggccaagatgggcagattgacgccgacgaactgcagagatgccttacgcagagcggcatcgccggtggctataagccattcaacctcgagacttgtagattgatggtttctatgctcgatagagacatgagcggaaccatggggtttaatgagtttaaagagctgtgggctgtattaaatggttggcgacaacatttcattagcttcgatacagaccgctccggaacagtggacccacaagaactccagaaggcattaacaaccatgggatttcgcctgagtcctcaggctgtaaatagtattgcaaagcggtacagtactaatggcaaaattaccttcgatgattatatcgcgtgttgcgtgaagttaagggcattgaccgactcatttcgaaggagagataccgctcagcagggggtggttaacttcccatatgacgatgtgtctcttaggaactag

SEQ ID NO: 206539 - DNA, 6645 bp, Artificial Sequence
  Description of Artificial Sequence: Synthetic coding sequence
atggccacccggagcagccggcgggagagccggctgcccttcctgttcaccctcgtggctctcctgccacctggcgccctttgtgaagtgtggacacagcgtctgcacgggggctcagcaccactgcctcaggacagaggattccttgttgttcagggcgaccctcgagagctgcgactctgggctaggggtgatgctagaggtgcctctagggcagatgaaaaaccactgcgtagaaagcgcagcgcagccttacagcccgagcccatcaaagtgtacggccaagtgagtctgaacgatagccacaatcaaatggtggtccattgggccggcgaaaaatcgaatgtgattgttgctttagcaagggactctctggccctggcgcggccaaagagttcagacgtgtatgtgtcgtacgattacggaaaaagctttaaaaagatctctgacaagcttaacttcgggcttggtaatagatcagaggccgttatcgcccagttctaccacagccccgcggataacaagaggtacatctttgctgacgcatatgcacagtacctatggataaccttcgatttctgtaacacacttcaggggttcagcatcccatttcgggccgcggacctgctgctccatagcaaagcgagtaatctgctgctcggattcgatcgaagccatccaaacaaacagctatggaagagcgacgacttcgggcagacatggattatgatccaggagcatgtaaagagctttagctggggcattgacccctacgacaaacctaataccatctatattgaacgccacgagccatcaggttactcaaccgttttcagaagtacggacttcttccaatccagggagaatcaggaggtcatcctcgaggaagtgcgcgatttccagctgcgggacaaatatatgttcgcgacaaaagtggtgcaccttcttggaagtgagcagcagtccagtgtccagttgtgggtaagttttggccggaagccgatgcgtgccgctcagttcgttacaaggcatcccatcaatgagtactacatcgccgatgcttccgaagaccaggttttcgtctgcgttagtcactccaataatcgtactaatctgtatatctcagaggctgaagggctgaagttttccctctccctggagaatgtcctgtactattcgcctggaggcgcagggtcggatacgcttgtccgctatttcgccaatgagccttttgctgacttccatagggtcgaagggctgcaaggcgtgtacatcgctacactgatcaacggatcgatgaacgaggagaacatgcggtctgttattacctttgacaagggtgggacttgggaattcttacaggccccagcgttcactggttatggggaaaaaataaattgtgaactgagccagggatgctcgctccatcttgcccaaaggctgagtcaacttcttaatctgcaattgaggcgtatgcccattctgtccaaagaatccgcccctgggctgatcattgctacagggtcagtcgggaagaatctggcatccaagaccaacgtttacatcagctcttcagccggggcacgctggcgggaagcccttcctggtccacattactatacctggggggatcatggaggaataattaccgcgatcgcccaaggcatggaaacgaacgagctcaagtattccactaatgaaggggagacttggaaaacatttattttcagcgaaaaacctgtatttgtatatggccttcttaccgagcccggagagaagtctaccgtgttcactattttcggaagtaataaggagaatgtgcactcttggttgattctccaggtaaatgcaacggacgctctaggagtcccctgcacggaaaatgactataagttgtggtcaccgtccgatgagcgcgggaatgagtgtctactcggccacaaaacagtattcaagaggagaacccctcatgccacgtgctttaatggggaggacttcgatagacccgtggttgtgagcaactgttcctgcaccagggaggactatgagtgcgacttcggtttcaagatgtctgaggatctcagcctggaagtgtgcgtaccggaccccgagtttagcggcaagtcctattcccctcccgtgccttgccctgttggatctacttatcggcggaccagaggttacaggaagatttccggcgatacatgttccggaggcgacgtggaagctagacttgagggtgagttggtcccttgccccttggccgaggaaaacgagttcatactgtatgctgtccgcaagagcatatatagatatgacctggcttcaggtgcgactgaacagctcccactgaccgggctccgcgccgccgtggctctggatttcgactatgaacataactgtctatattggagcgatcttgctcttgatgtcattcaaagattatgccttaatgggtccactggacaagaggtcattatcaactccgggcttgagacagtggaggcgttggcctttgagccgctgtctcaactattgtattgggtggatgctggcttcaagaagattgaagttgccaacccagatggggactttcgactgaccatcgtcaacagtagcgttctggataggccacgggcgctggttctggtacctcaagaaggagttatgttctggacggactggggcgatctcaagcccggcatttatagatccaacatggacggttccgcagcataccatctggtcagcgaggatgtgaaatggccaaacgggattagcgtggatgatcagtggatttactggaccgatgcgtatttggagtgtatcgagagaatcacgttctctggccagcagagatctgtgatcttggataaccttccccacccatatgctattgcagtatttaagaacgagatctattgggatgactggtctcagttgtccattttcagggcaagcaagtacagtggctcccagatggagatcctggcaaaccaacttaccggcctgatggatatgaagattttctataaaggcaaaaataccggtagcaatgcttgtgtgccgcgcccctgctctctgctgtgtttgcctaaggccaataactcacgtagctgccgttgtccagaggacgtgtcatcaagtgtacttcctagcggcgacctgatgtgcgactgccctcaaggatatcaactaaagaacaatacatgtgttaaacaagagaacacgtgtttgaggaaccagtatcgatgtagcaacggcaactgcatcaactctatctggtggtgtgacttcgacaatgattgtggggatatgtctgatgaacgtaactgtccaaccaccatctgcgatctcgacacccagttccggtgtcaggagagcggcacctgtataccactgtcttataagtgtgatctcgaggacgattgcggtgacaactccgacgagtctcactgtgaaatgcaccagtgtaggagcgacgagtataattgctcctcgggcatgtgtattagatcatcatgggtgtgcgatggggacaatgactgtcgagactggagcgatgaagcaaactgtacagccatataccatacctgtgaagcgtcgaactttcaatgtagaaacgggcactgcatcccccagcgctgggcctgcgacggggataccgattgccaggatggctcagatgaggaccccgtgaattgcgagaaaaagtgcaatggctttaggtgccctaatggcacatgtatcccatcatcaaagcactgtgatggccttcgagactgtagcgacggtagcgacgagcagcactgcgagcccctgtgcacccacttcatggacttcgtctgcaaaaatagacagcagtgcctgttccattctatggtttgtgacggcatcattcagtgcagggacgggagcgatgaggacgcagcattcgccgggtgttcacaagatcccgagttccataaggtttgtgacgaatttggattccagtgccagaacggggtctgtataagtctcatctggaagtgtgacggtatggacgactgtggcgattacagcgatgaggccaactgtgagaaccccacggaggcaccgaattgttccagatacttccagtttcgctgtgagaacggccattgcattccaaatagatggaagtgcgatcgtgaaaacgattgtggggactggtccgatgagaaggactgcggcgactcacatatccttcctttctcaaccccgggaccgagcacttgccttcccaactattatcggtgctcctctggcacctgcgttatggatacttgggtatgcgatggatatagggattgcgccgacggtagcgacgaggaagcatgccctctgctcgcgaacgttacggccgcctccactcctacccagttgggacgatgtgataggtttgagttcgagtgccaccagccaaagacctgtattccgaactggaagaggtgtgacgggcatcaagactgccaagacggaagggatgaggcaaattgtcccactcactctacactgacatgtatgtcgcgcgagttccagtgcgaggacggtgaagcctgcatagtcctaagcgagagatgtgatggcttcctggattgctctgacgagagcgacgaaaaggcttgcagcgatgagctgactgtgtataaggtacagaacctccagtggactgccgactttagcggggatgttactcttacctggatgcggccaaaaaagatgcccagtgcgtcctgtgtatataacgtttactatcgggtggtgggagaatctatatggaaaaccctcgagactcattccaataagaccaacacagtactgaaggtgctgaagcctgacactacataccaggtgaaagtccaggtccagtgtctgtccaaagctcacaataccaacgactttgttacactccggaccccggaaggcttgccagatgccccaaggaacctgcagttaagtctccctcgcgaagcagagggggtcattgttggccattgggcgcctcctatccatacccatggcctgatcagggagtatatagtcgaatatagtagatcgggttctaagatgtgggcatcacagagagccgcctctaacttcacagaaattaaaaacctcttagtaaacaccctttacacagttagagtcgcagccgtgacctcccgcggcatcgggaattggagtgatagcaaaagcattactactattaaaggaaaagtaatccccccgcccgatatccacatagatagttacggagagaattatttgagtttcactctcacaatggagagcgacatcaaggtaaacggctacgtggtcaatctattttgggccttcgacactcacaagcaagagagacgcacgctcaactttaggggttcgatcctgtctcataaggtaggaaatcttaccgcccacacctcatacgagatctccgcctgggctaagactgatctcggcgattcgccccttgctttcgagcatgtcatgacaaggggcgtgcggccacccgctccgagtctgaaggccaaggctatcaatcagaccgccgtggaatgtacctggacagggccaaggaatgtggtctatggaatcttttacgcgaccagctttctggacctgtacagaaatcccaagtccctgactacatcactgcacaacaaaaccgtcatcgtttcaaaggatgagcagtacctcttcctggtgagagtcgtggtcccctaccagggcccctcctcggactatgtagtggtcaagatgataccagatagtcgattaccgccaagacacttgcatgtggtgcatacaggcaagacaagtgtggtgatcaaatgggaatcaccttacgattccccagaccaggacttgctttacgcggtcgcagtaaaggatctcattaggaagacggatagatcttataaagtcaaatcaagaaatagcaccgtggagtacaccttaaacaagcttgaaccaggcggcaagtaccatattattgtgcagctgggtaacatgtcaaaagactcttccatcaaaataacaacggtgagtctgagtgccccagacgctctgaaaatcatcactgaaaacgatcacgtactgttgttttggaagagtctggcgcttaaggagaagcattttaacgaaagccgggggtacgaaatccatatgttcgactcagctatgaatataacagcgtacttggggaacactacagacaatttctttaagataagtaatttaaaaatggggcacaactatacgtttaccgtgcaggcacggtgcctgttcggcaaccaaatctgtggcgaaccagccatcctcctgtacgatgagctcggaagcggtgctgatgcgagtgctacacaggccgccagatcaaccgatgtcgccgccgtggtggtgccaatcctgttcctgatactgctaagtctgggggtgggctttgctatcctatacactaaacataggaggcttcagagctcatttacggcctttgctaattcccattactcctctcgtctaggcagcgccatttttagttcaggggacgatctgggtgaagacgatgaagacgcacctatgatcactggcttttcagatgacgtgcctatggttattgcttag

SEQ ID NO: 206540 - DNA, 3507 bp, Artificial Sequence
  Description of Artificial Sequence: Synthetic coding sequence
atgggcaaggtgggcgccggcggcggcagccaggcccggctgagcgcgctgttggcaggggctgggctgctgatcctgtgtgctccgggcgtgtgcggaggcggatcatgctgtccctctcctcacccttcttcagctcctaggtccgcctcaactccccgcggattcagtcatcagggcagacccggccgtgcacccgccacccctcttcctctggtggtgaggcctctgttttcagtcgctccaggtgaccgggccctgtccctggagagagcgcgggggacaggagcctcaatggctgtggccgcgagaagtggcagaaggcgtcgtagcggagctgatcaggagaaggctgaacggggggagggtgcttcacggagccccaggggcgtgctcagagatggtgggcagcaggagccaggaacgcgcgagcgggatcctgacaaagctacacggtttcgtatggaggagttacgactaacctctacgacgtttgctctgaccggagacagtgctcacaatcaagccatggttcattggtcgggacataactcttctgtgattctgatactcacaaagctgtatgactataacctggggagcatcaccgaaagcagtctctggcgaagtaccgattacggtaccacttatgaaaaactgaatgataaggtcggcttaaaaactattctgtcttacctttacgtgtgccctaccaacaagcgcaagatcatgctgctcaccgatcccgaaattgagagctcactattaatttcgagtgatgagggtgccacataccagaagtatcggctcaatttttatatacagtcactgctcttccatcctaaacaggaggattggattctggcctacagccaggatcagaagctgtattcttccgcagagtttggtcggcggtggcaactcatacaagagggggttgtgcctaatcgtttctattggagcgtgatggggagcaacaaggagccggatctggtccatctcgaagcaaggaccgtagatggccatagccattacttgacatgtaggatgcaaaattgtaccgaggcaaatcggaaccagccattcccgggctatattgatcctgatagtctcatcgtgcaggaccattacgtgtttgttcaacttacatccggagggagaccccactactatgtttcctacagacgaaacgcttttgcccagatgaagcttccaaagtacgccttgcctaaggatatgcacgtcataagtaccgatgagaatcaagtgtttgccgcagttcaagaatggaatcagaatgatacctacaacctctatatatcagacacacgaggcgtttactttacgctcgcactcgaaaacgttcagtcttctcgcggaccagaaggaaatattatgattgatctttatgaggttgctgggattaagggcatgtttctcgcaaacaagaaaattgataatcaggtcaaaacattcatcacttacaacaagggccgggactggcggttactgcaggccccggacacagacctgcgcggagatccagtgcactgtctgctcccttactgcagtttgcacttgcatcttaaagtctcggaaaatccctacacgtcaggtattattgcaagcaaggatactgccccttccatcatcgtagcctccgggaatatcggaagtgagctctccgataccgacatctcaatgtttgtcagtagtgacgctggaaatacctggaggcaaatatttgaggaggagcactccgtactgtatttggaccagggcggagtgcttgtggccatgaagcatacctcccttccgatcaggcatctctggctctctttcgatgagggcaggtcatggtcgaagtactcgttcacttccattccgctgtttgtggatggtgttttgggcgagccaggcgaggaaacactgataatgactgtgtttgggcacttttctcatcggagtgagtggcagttggtgaaagtggattataagtccatatttgaccgcagatgcgcagaggaggactaccgaccttggcagttgcactctcaaggtgaagcatgcattatgggcgcaaagcggatttataagaagagaaagtctgaaagaaagtgtatgcaaggaaaatatgccggtgctatggagtccgaaccgtgtgtgtgtacagaagccgacttcgattgtgactacggatatgagcgacacagtaacggccaatgtctgccggcgttctggttcaacccatcttccctatcgaaggactgctccctgggtcagtcatatctgaacagcactgggtatagaaaggttgtgtctaacaactgcaccgacggggtgagagagcagtacactgccaagccgcaaaaatgtcccggtaaagcgccccgagggttgcggatcgttacagccgacggcaaactgacagcggagcaaggccacaacgtcactctgatggtgcagttggaggaaggcgacgtccagagaacattaatccaggtggacttcggagatggcatcgccgtgtcttatgtcaacctgagtagtatggaggacggaattaaacatgtgtatcagaacgttggcattttccgagtgaccgtgcaagtagacaattccctgggaagcgacagcgccgtcctatatttgcacgtcacttgccccctagagcatgtacacctgagtctgccattcgtaaccactaagaataaagaagtgaatgcgactgccgtgctgtggccctctcaagtcggaactttgacttacgtctggtggtacggtaacaacaccgaacccttgatcaccctcgagggatccatcagcttcaggttcacatccgaaggtatgaacacaatcaccgtgcaggtgtcagccggtaacgctattttgcaggacacaaaaaccatcgccgtctatgaagagtttcgatcacttcgcctgagcttctcccccaatcttgatgactacaacccggatataccggaatggcgcagggacattgggcgtgttatcaagaaatctctcgtcgaggccaccggtgttcccggccagcacattctggtggccgtgctacccggactcccaaccacagcggaacttttcgtcctgccttaccaggaccccgctggagagaacaagcgaagcaccgatgacctggagcagatctccgaactccttattcatacgctgaaccagaattcagtccactttgagctcaaacctggggtacgggtccttgtgcacgctgctcacctcacagccgcccccttggtagacctgaccccaacacactccgggagcgctatgctaatgctcctgtctgttgtctttgtcgggctcgcagtgtttgtcatatataaatttaaacggagagtcgctctcccatcgccaccttccccctcaacacagccgggagatagtagtctgcggctccagcgggccaggcatgcaacccccccatccaccccaaagcgcggatcagctggggcacaatacgcaatctag

SEQ ID NO: 206541 - DNA, 3597 bp, Artificial Sequence
  Description of Artificial Sequence: Synthetic coding sequence
atgggcaaggtgggcgccggcggcggcagccaggcccggctgagcgccttactggccggagcgggcctgcttatattatgcgcccccggagtgtgcggcggggggagttgttgcccttctcctcaccctagctctgcccctcggagcgcctcaacaccgcgtgggttcagccatcagggacgaccaggaagagcacctgccactcccctccctttggttgttcggccactttttagcgtggccccaggggacagagcgctgtcgctagaacgggccaggggtacaggggcgtcaatggccgtggccgcccgcagcggcaggcgcaggcgcagcggggccgaccaggaaaaggcagaaagaggggagggcgcttcaagatcaccaagaggagtactccgggatggggggcagcaggagcccggcacccgggagagggatccagataaggccactcgcttcagaatggaggaactgcggctgacctcaacaacatttgcccttactggagactcggcccataatcaggccatggttcactggagtggccataatagctcagtaatcctgattttgaccaagctctatgattacaatcttggctcaatcaccgagagcagtctctggcgaagcaccgactatggcacaacttacgaaaagctcaatgacaaagtggggctgaaaactatcctgtcctacctctacgtgtgtcccactaataagagaaaaatcatgctgttgactgatcctgagatcgagagttctctgctaatttcaagcgatgagggagcgacctaccagaaataccgcttgaacttctacatccagtctttgctattccatcctaagcaggaagattggatcctagcttacagccaggatcagaaactctatagctcagctgagttcggccggcgctggcagctgatccaggagggcgttgtgccaaaccgattctactggagcgttatgggctcaaacaaagaacctgacctcgtccacctggaagccagaaccgtggacggtcacagccattacttaacatgccggatgcagaactgtactgaggctaaccgtaatcagccctttcctggatatatagacccggactcactgattgtgcaggatcattatgtgttcgtacaattgacgagcggcggccgcccacattactatgtctcttacaggcggaatgctttcgcccagatgaaattgcctaaatatgcacttcctaaggacatgcatgtcatttcaaccgacgagaaccaagtgtttgctgctgttcaagagtggaatcagaacgacacatacaacctttacatcagcgatacacggggagtgtatttcaccttggcactcgagaatgtccagagttctcgcggacctgaaggcaatatcatgatagatctatacgaagtagcaggcatcaaggggatgtttttagctaataaaaagatcgataaccaggtaaagacttttataacctataataaaggcagggattggaggctgctgcaggcccctgacactgacctgcgcggagaccccgtacattgtcttcttccctactgcagccttcacctgcatctgaaggtttccgagaacccctatacatctggaatcattgcatcgaaggacactgcaccatcgataatagtggcttcaggtaatatcggttctgagctgagcgacaccgatatttcaatgttcgtgtcatctgatgccgggaacacctggagacagattttcgaggaggaacactccgtcttgtacctggaccagggcggcgtccttgttgcaatgaagcatacatccttaccaattaggcatctgtggctctcgtttgatgagggacgaagctggagtaaatattctttcacaagtatccccctcttcgtggacggcgttctcggcgagccaggagaggagacccttattatgaccgtatttggtcatttcagtcaccgctctgaatggcaattggtaaaggtggactataaaagcatcttcgatcggcgctgcgctgaagaagactaccgaccatggcagttacacagtcagggagaagcctgcataatgggcgccaagaggatctataaaaaacggaagagcgaaaggaaatgtatgcagggcaaatacgccggagctatggaatctgagccatgtgtctgtacagaggctgactttgactgcgattacggctatgaaaggcactctaacgggcagtgcctccctgccttctggttcaatccttcttccctttccaaggattgcagcctgggccaatcttacctgaactcaacaggataccgcaaggtcgtgtccaataactgcacagatggggtcagagaacagtataccgctaagcctcagaagtgtccaggcaaggctcctcggggccttaggattgtgaccgctgacggtaaattaaccgctgaacagggccacaatgtcactctcatggtacagcttgaagaaggcgacgtgcagcgcacccttattcaggtggactttggcgatggcattgcggtttcctatgtgaacctgtctagcatggaggatggtatcaagcatgtctaccaaaacgtgggcatctttcgggtgactgtgcaggtagataattctctggggtcagacagtgccgtattgtacttgcacgtaacatgccctctcgaacacgtgcatctcagcctgccttttgtgaccacaaagaacaaagaagtgaacgctacggcagtactctggccaagccaggtaggcaccctcacatacgtctggtggtacggtaacaacaccgagcccttgatcactttagagggtagcattagctttcggtttacttctgagggcatgaacaccattacagtgcaggtatccgccggtaacgctattctgcaggacacaaaaaccattgcagtgtacgaggaatttagatctcttaggcttagtttttcgccaaatttagacgattataacccagacatcccagaatggcgacgcgatattggacgtgtaatcaaaaaaagcctcgttgaggcaactggcgtgccaggacagcacatcctggttgccgtgcttcccggcctgcctacgaccgcagagcttttcgtgctgccgtaccaagatcctgccggcgaaaacaagagaagtactgacgacctggaacagatcagtgagcttctaattcacaccttgaatcagaactccgttcactttgaactgaagccaggcgttagagttctggtgcacgcagcccacttgacggcagccccactcgtggacctcaccccaacacactcaggcagcgctatgctcatgctgctgtccgtggtctttgttggcctggctgtgttcgtgatctacaagttcaaaagaaagatcccagggatcaacgtgtacgctcaaatgcagaatgagaaggagcaagagatgattagcccagtaagccactccgaatcacgccccaacgtgcctcagacagaactccggcgaccaggacagctgatcgacgaaaaagttgagagtcagctgattggtagcatcagcattgtggccgaaaaccagtctacgaaggagatacctacatacgtcaacgtgtag

SEQ ID NO: 206542 - DNA, 2145 bp, Artificial Sequence
  Description of Artificial Sequence: Synthetic coding sequence
atgatcgacctgtacgaggtggccggcatcaagggcatgttcctggcaaacaaaaagattgataaccaggttaaaacatttatcacttacaacaagggaagggactggaggctgctccaggcgcctgatactgatttgaggggggatcccgtgcactgcctgctgccatactgctccctgcatctccatctgaaagtttcagagaacccttacacgtcaggaatcatagcgtccaaagatacagccccctctattatcgtggctagtggaaatatcggatctgaattgtcggacaccgacatcagcatgttcgtgtccagtgacgcgggcaacacatggcggcagatcttcgaggaagagcatagcgtgctgtacctggatcagggtggcgttcttgtggctatgaagcatactagtctacccatcagacacctatggctgagctttgatgagggtagaagctggtctaagtatagctttacaagcatacctttgtttgtggatggcgtgcttggcgagcctggggaggagacactgataatgactgtatttggtcatttcagtcatagaagcgagtggcaattggtaaaggtcgactacaagtccatttttgaccggagatgcgcagaagaggactataggccgtggcagctccatagtcaaggggaggcctgcattatgggggctaaaaggatctataaaaagagaaaaagcgaacggaaatgcatgcaagggaagtacgccggggccatggagtctgaaccttgtgtctgcactgaggctgactttgactgcgactatggttatgagcggcacagcaacggtcagtgcctgccagcattttggttcaatccatcctcactgagcaaggactgctccctcggacaatcatatctgaacagcacggggtaccgcaaggtggtctccaataactgcaccgacggcgttagggagcagtacactgctaaaccacagaagtgtccagggaaggcacctaggggactgcggatcgtgacagcagatgggaaactcacggccgagcaaggtcataacgtgactctaatggttcagttagaggagggagacgtgcagcgaacactaatacaggtggacttcggggatggtattgctgtgtcgtacgtgaacctcagctccatggaggacgggatcaagcacgtttaccagaatgtaggcatcttcagagttaccgttcaggtggacaacagtttgggtagtgactccgctgtgctgtatctccacgttacctgccctctagaacacgttcacctctccttgccatttgtgacaactaagaataaagaagttaacgcaaccgcagttttatggccgtctcaggtgggcactctcacctacgtgtggtggtatggcaataacacagagcccctgatcactcttgagggcagcatctcgttcagatttacatcggagggcatgaacactattacagtccaggtcagtgctggcaacgcaatcctgcaggatacgaaaaccattgctgtctatgaggaattcaggtcactgcggttatctttctcaccaaatctggacgactacaaccctgatatcccagagtggagacgcgatatcggcagagtcatcaagaagagtctcgttgaggccaccggggtcccaggtcagcacatcttggtggccgttctcccaggactcccaactacagctgaattgttcgtgctaccataccaagaccctgccggcgagaacaaacggtctaccgatgacctggaacagatatctgagctgctgatccacaccttgaatcagaacagtgtgcacttcgagctgaaacccggcgtgcgagtgctggtgcacgccgcccatctaacagctgctccacttgttgatcttacaccaactcattccggctcagctatgttaatgcttctaagcgtggtttttgtcggtttagccgttttcgtgatttacaagttcaaacgcaaaattcctggtatcaatgtgtacgctcagatgcagaatgagaaggaacaggagatgatctctcccgtatcccactctgagtcccggcccaacgtgccacaaactgaactgcgccgccctggccaactgatagatgagaaggtggagtcacagctcatcggcgagtag

SEQ ID NO: 206543 - DNA, 642 bp, Artificial Sequence
  Description of Artificial Sequence: Synthetic coding sequence
tgactggacgactacaaccccgacatccccgagtggcggcgggacattggccgcgtcatcaagaagtccttagtggaggcaaccggagtgcctggacaacatatcctagtcgccgtgcttcctgggctgcccactacagcggagctgttcgtcctaccataccaggacccagccggtgagaacaaaagatctaccgacgatcttgagcaaatctctgagctgctaattcatacattaaatcagaatagcgtccatttcgagttgaaacccggcgtgcgagtgctagtgcatgcggctcacctaacagctgctcccttggtggatttgacaccaacacactccggatcagctatgttaatgctgctctccgtcgtgtttgtgggactggccgtatttgtgatatataagttcaagaggaaaatccccgggatcaatgtgtacgcacagatgcagaatgaaaaggaacaggagatgatttcacctgtgagccactccgaatccaggccaaacgtgccacagacagaattacgtcgccctggccagctgatcgacgagaaggttgagtcacagctcattggcagcatctccattgtggccgagaatcagagcactaaggaaatccctacttatgtcaatgtgtag

SEQ ID NO: 206544 - DNA, 3009 bp, Artificial Sequence
  Description of Artificial Sequence: Synthetic coding sequence
atgggcaaggtgctggagagcagcctgtggcggagcagcgacttcggaacaagctatacaaaacttacactccagcccggcgtgaccacggtcattgataatttctacatctgcccaacgaacaaaagaaaagtaattctggtcagctcatccctgagcgatcgcgatcagtcactgttcctgtccgcagacgagggggctacctttcaaaagcaaccaattccattcttcgtcgagacattaattttccatcccaaggaagaggacaaggtgctcgcatacacgaaagaaagtaagctgtacgtttcgagcgatttgggaaagaaatggacattgctccaggagcgcgtgacgaaagatcatgtgttttggtccgtctccggcgtggatgcagaccctgatttggtccacgtcgaagcccaggatcttgggggtgatttccgatatgtgacttgcgcaatacataattgctcagagaaaatgttaacagccccattcgccggtcccattgaccacgggtccctcacagtgcaggatgactatatattcttcaaggccacttccgcaaatcaaaccaaatattacgtttcataccggcgtaatgaattcgtgctgatgaaactccctaagtacgccttacccaaggacctgcagatcatcagtaccgacgagtctcaggtgttcgtggcagtacaggaatggtatcagatggacacctataatttgtaccaatctgatccaaggggcgtgcgatatgcacttgtcctgcaggatgtgagaagctcccgccaggcggaagagagtgttctgatagatatactggaggtccgcggcgtgaagggtgtgtttctcgctaaccagaaaatcgatggtaaagtaatgactttgataacttataataaagggcgagactgggactatctacgtcccccttcgatggatatgaacgggaaaccgactaattgtaagccacccgactgccatttacacctgcatttacgctgggccgataatccctacgtgtccgggacggtgcacaccaaggataccgcacccggcctgatcatgggtgctgggaacttaggcagccaactggttgagtacaaagaagagatgtatattacaagtgattgtggacacacctggagacaagttttcgaagaggaacatcacatcctctacttggatcacggtggcgtcatcgttgccattaaggacacatcaataccactcaaaatcctgaagtttagcgtcgacgaaggcttgacctggtctacgcataacttcacttcaacgtctgtgtttgtagatggtctgttatccgaacctggcgacgaaactctggttatgacagtgttcggccacatcagctttagaagtgattgggaattagtgaaagtggactttagaccaagcttttctcggcaatgcggtgaggaagactactcttcatgggagctatctaacttgcaaggagaccgctgcataatggggcaacaacggtccttccgcaaacgcaagtccacgagctggtgtattaaaggtaggtccttcacatccgctctaaccagtcgggtttgtgaatgcagggatagcgatttcttgtgcgactacggcttcgagcgctctagctcgagcgagtcttccacaaacaaatgcagtgcaaacttctggttcaatcctctgtctccgcctgacgattgcgcccttggccagacctatacgagcagcctggggtatcgaaaagtggtatccaatgtgtgtgagggcggcgtcgacatgcagcaatctcaggtgcagctccagtgccccctgaccccacctcgtggactgcaagtgtccattcagggcgaggccgtggctgtgcgtcctggggaggacgtactgtttgtggtcaggcaagagcaaggagacgtgcttaccaccaagtaccaagttgatctgggtgacgggttcaaagccatgtacgttaacttgacattgaccggcgagccaatacggcatcgatacgagtcacccggcatttatagggtgtcagtacgagcagaaaatactgctggccatgatgaggccgtcctctttgtgcaggtcaactcacccctacaggctctctaccttgaagtggtgccagtaattggcttgaaccaggaggtgaacttgacagccgtgcttctgccgctaaatccaaatctaaccgtgttttactggtggataggccactcactgcagccactccttagcttggacaacagcgtcacaacccgcttcagcgataccggtgatgtgagggtgactgtccaggcggcgtgcgggaactcagtcttgcaggattcacgggtgctacgggtactggaccagtttcaggtgatgcctctgcagttctcaaaggagctggatgcttacaatcccaataccccagagtggcgcgaggatgtcggcctcgtcgtcacaaggttgctttctaaggagacctcagtcccgcaggagctcttggtcacagtggtgaagcccgggcttccaactctggcagacctctatgtcctcttgccacccccccgcccaacgcgaaagcggagcctgtcgagcgacaaaagattggccgcgattcagcaggtcttgaacgcccaaaagattagtttcttactccgcggcggcgtgagagtactggtcgccctgcgagatactggcaccggggcagagcagctgggggggggtggcggctactgggcagtcgtggtgttattcgtcatcgggctcttcgccgcaggtgccttcattctctacaaattcaagtcccggaagcgcccaggccgcacagtgtatgctcagatgcacaatgagaaggagcaggagatgacgagccccgtgtcccactccgaagacgtccagggcgccgttcagggagaagagtttattgatgatgacctggactctcagaccctggggaaccactccggggtggtgctcagtatcaacagcagagaaatgcactcatacctcgtatcgtag

SEQ ID NO: 206545 - DNA, 3480 bp, Artificial Sequence
  Description of Artificial Sequence: Synthetic coding sequence
atggcccaccggggccccagccgggccagcaagggccccggccccaccgctcgggctccgagtcctggagcccctccaccccctcggagtcccaggtcacggccgctgctcctgctgctgctcttgctgggggcttgtggagccgctggtaggtcccctgagcccggacggttagggcctcacgcccagttgactagagtccctagaagtcctcccgccggcagggccgagcctggaggcggggaggaccgccaagcccgaggtacagagcccggtgctccaggccccagtcctggacccgcgccaggaccaggagaggacggcgcccccgccgccggttacaggaggtgggaacgagccgcccccttggccggtgtggcctccagagcccaggttagtcttatctcaacaagctttgtgcttaagggcgacgccactcacaatcaagccatggtgcactggactggcgaaaacagctctgtgatccttatcctgactaaatattaccatgccgacatgggcaaggtgctcgaatcttccttgtggagatctagcgatttcggcactagctacacaaagcttaccctgcagcccggcgtgacaacagtcatagacaatttttacatttgtccgacaaataagagaaaggtgattctcgtctcaagctcgctctctgatagagatcagtcgctgttcctcagtgccgacgagggcgcaacttttcagaaacagccaatcccgttctttgtggagactctcatattccatccgaaggaggaagacaaggtattagcctataccaaggaatctaagctgtatgtgtcgtcggacctggggaagaagtggacgctgctgcaagagcgtgtaacaaaagaccacgtcttctggagtgtctccggcgttgacgcagatcccgatctggtccatgtggaagctcaagatctggggggcgattttagatacgtgacctgcgcgattcacaattgttcagagaaaatgctgaccgcccctttcgctgggcctatcgaccatggtagcctgacggtccaggacgactatatcttctttaaggcaacatctgccaatcagactaagtattatgttagttatcgcaggaatgaattcgttttaatgaagctaccaaagtatgcccttcctaaggacctgcaaatcataagtaccgacgagtctcaggtgttcgttgccgtgcaagagtggtaccagatggatacatacaatctgtatcagagcgatcctagaggggtgaggtatgcgctggtgctccaggacgtccggagcagcaggcaggccgaggaatctgtgctgattgacatcttagaggtccgtggagtgaagggagtctttctcgcaaatcagaagattgacggtaaagtgatgacattgataacctataacaaagggagagactgggattacctgcgcccgcctagcatggacatgaacggtaaaccaactaattgtaaaccacccgattgccatttgcacctgcatcttagatgggcagataacccctacgtgtctgggaccgtccacacaaaagataccgccccaggcctcatcatgggggccggaaatttaggcagccagttggtggagtataaggaggagatgtacataacttctgactgtgggcacacctggcggcaggtgtttgaggaggagcaccacatcctttatctggatcacggcggcgtcattgtggccattaaggatacctctatcccgctgaagatcttgaagttttctgtcgatgagggattaacgtggtccacgcacaactttactagcacaagcgttttcgtggacgggctgctgagcgagcccggcgacgagacgctggtgatgacagtgttcgggcacatctctttccgttcagattgggagttggttaaggtggatttccggccttcgttctcccgacagtgtggcgaggaagactattcgtcttgggagctcagcaatctccagggggaccgctgcatcatgggccagcagagatctttcagaaagcgcaagtcaacttcatggtgcatcaagggccgctcattcacatctgcactgacctctcgagtgtgcgagtgccgcgattccgacttcctatgtgattatggcttcgaaagatcctcctctagcgaatcctctacgaataaatgctctgcaaacttctggttcaacccactgagcccccccgatgattgcgctctcggacagacatacacatccagcttgggctaccggaaggtcgtgtcaaatgtgtgcgagggcggcgtggacatgcagcaatcccaggtgcagctacagtgccctctcaccccacctcgcggcctgcaggtgagtattcagggcgaagcagtggctgtacgaccaggggaggatgtcctcttcgttgtgcgacaagaacagggcgacgtcctaaccacaaagtaccaggttgacctgggagacgggtttaaggcaatgtatgtaaaccttaccctgaccggcgaacccattcgtcaccgatatgagagtcctggcatttatagagtcagcgtgcgggccgagaacactgccggccacgacgaggccgtgctgttcgtgcaggtgaactccccgctccaggcattgtatctcgaggttgtcccagtgattggacttaatcaggaggttaaccttactgcggtgctgctccctttaaacccaaatctgacagtcttctattggtggattggccactctctgcagccattgctctccctggataattccgtgacaacaagatttagcgatacaggtgatgttagggtcaccgtccaggcagcctgtggaaattccgttctgcaggactcgagagtgctgagggtgctcgaccagtttcaggtaatgccactccagttcagtaaggaacttgatgcatacaacccgaacactcccgaatggagggaagacgtgggcctggtggtcacccggcttctaagtaaggaaacaagtgttccacaagagctgctcgtcaccgtcgtcaaacctggtctgcctacattggccgacctgtacgtgctcctgccacccccgaggccaacgcggaaacgcagcctgtcatcagataagagactggctgccatccaacaggtgctgaacgcccaaaaaatctcctttttactgaggggcggcgtaagggttttggtggccctgcgtgatactggcactggagcagagcagttagggggaggcggaggttactgggctgtcgtggttctgttcgtaattggattattcgcggcgggcgcattcattctgtacaagtttaaaagaaaaagaccaggacggaccgtgtacgcccagatgcacaacgaaaaagagcaggaaatgacatctcctgtgtctcattcagaggacgtccagggcgcggtgcagggaaaccattcaggagtggtgctgtcaatcaatagccgggagatgcactcctatcttgtctcgtag

SEQ ID NO: 206546 - DNA, 594 bp, Artificial Sequence
  Description of Artificial Sequence: Synthetic coding sequence
atgggcgagcggaagatcttcaagaagcggaagcccggcgcccagtgcgctctcgggagggaccatagcggaagtgtggtttcagagccatgcgtgtgcgctaattgggactttgaatgcgactacggctatgaacggcacggagaaagtcagtgtgtgcctgccttctggtacaaccccgcgtcgcctagtaaggactgtagcctcgggcagtcatacttaaattccacgggctatcgcagaatcgtgagcaataattgcaccgacggcctcagagaaaagtacactgccaaagcccaaatgtgccccgggaaggcacctcggggtcttcacgtggtaacaacagatgggagactggtggcagagcagggacataacgcaacatttattatcttgatggaggagggtgacctgcaacggactaacatacagctcgatttcggcgacggaattgccgttagctatgctaacttttcacccatcgaggacggaatcaagcatgtctacaagagtgccgggatttttcaggtcactgcctatgccgaaaacaatttaggaagcgacactgccgttttattcttgcacgttgtttag

SEQ ID NO: 206547 - DNA, 3669 bp, Artificial Sequence
  Description of Artificial Sequence: Synthetic coding sequence
atggaggccgcccggaccgagcggcccgccggccggcccggcgcccccctagtccggactggactactgctcctttcaacgtgggttctggctggagccgagatcacttgggatgcgacaggcggaccgggcagacccgctgccccagcttcccgacctcccgcactgtccccactgtcaccgcgcgccgtcgcctcgcaatggcctgaggaattagcgtctgcacgtcgcgctgccgtgctggggcgcagggcaggacccgaactgctgccccaacaaggaggtggcagggggggtgaaatgcaggtcgaagctggcggcactagcccagctggcgaacgacgaggaaggggcatcccggcacccgcaaagctcgggggcgccaggcggtcccggagagcccagccgcctattacccaggaaaggggggacgcgtgggccaccgcacccgcagatgggtcccgtggctcccgcccactagccaagggaagcagagaagaggtgaaggctcccagggcggggggctcagccgcagaagatttaaggctgccctccacctcttttgccttgacaggggattcggcgcataaccaagccatggtccattggagtggacacaattcttctgttatactgattcttactaaactatatgattttaatctaggatccgtaacagaatcctcgctgtggcggtcaactgattatggaaccacttatgagaagctaaacgacaaagtgggcctgaaaacggtgctgagttacctgtatgtgaacccaacaaacaaaaggaagatcatgctgctgtccgatccggaaatggagtcttctattttgatttccagcgacgaaggagccacgtaccagaaataccgtctcacattctacattcagtcactcctgttccatcccaaacaggaggattgggtgctggcctactccctggatcagaagttgtactcttcaatggatttcggcagacgctggcagttgatgcacgagcggatcacccctaacaggttttactggtccgtcgcaggtctggataaagaggctgatcttgtacatatggaagtgagaaccactgacggatacgcacactacctgacgtgccgcatccaggaatgcgccgagactacgcgctcagggccattcgcgcgctcgatcgacatctcttcgctcgttgtgcaggatgaatacatcttcatccaggtcacaacatccggtcgcgcgagttactatgtcagttacagacgagaggcttttgcacagatcaaattgcccaagtactcgctgcctaaagacatgcacatcatatccaccgacgaaaaccaggtgttcgccgccgtgcaggaatggaaccagaatgatacatacaatctttacattagcgacacgcgcggaatttattttacactggcaatggaaaatataaagtccagccgcggcctcatggggaatataatcatcgagctgtacgaagtcgctggtatcaaggggatattcctggctaacaagaaggtggacgaccaggtgaaaacatatatcacttacaacaaaggacgcgattggcgcctcctgcaagcgcccgacgtagacctgcggggttcacccgtacactgccttttgccattctgtagcctccacctgcacctgcagctgtccgagaacccgtattcgagtggaaggattagcagtaaggagactgcccctgggctggtggtagctacgggtaatatcggcccagaactgtcatacacagacataggagtgttcatttcctcagacgggggtaacacttggcgccaaatctttgacgaagaatataatgtttggtttctggactggggaggcgctctcgttgccatgaaacacactcctcttcccgttcgacacttgtgggtctcttttgacgagggacatagctgggataaatatggtttcacttctgtgcctctttttgtagatggcgccctagtagaagcaggcatggagacacacattatgacagtttttggccatttctccctacgctccgaatggcagctcgtcaaagtggactacaagtccatcttctccagacactgcacaaaagaggattaccaaacgtggcacttgctcaaccagggggaaccctgcgtcatgggggagcgcaaaatctttaaaaaaaggaaacccggcgcccagtgtgcattgggccgggaccattctggctcagtcgtcagcgagccgtgcgtctgtgcgaactgggatttcgaatgcgactacggctatgagcggcacggggagtctcagtgcgtgcccgccttctggtacaacccagccagccccagcaaggattgcagcttggggcaaagctatctgaatagcaccggatatagacggatcgtctcgaacaattgtaccgacggcctcagggaaaagtataccgccaaggcacagatgtgcccaggtaaggctccccggggcctgcacgtcgtgacgactgacgggcgcctggtagccgagcaggggcataacgccacctttataattctgatggaagagggcgatctacagcggaccaatattcagctggattttggggatgggatcgccgtctcatacgctaatttctctccaattgaggacgggatcaaacacgtctacaagtctgccggcatcttccaggtgactgcctacgcggaaaataatctgggctccgacactgcagtactcttccttcacgtggtgtgtcctgtcgagcatgtacacttacgggtcccttttgtggccataagaaacaaggaggtcaacatttccgctgtggtctggcccagccagttggggacacttacatacttctggtggttcggcaacagcaccaagcccttgattaccctagattcctctatctcctttactttcttggcggaaggcaccgacactatcacagttcaggtcgctgctggaaacgccctgatccaggataccaaggaaatcgcagtgcatgagtattttcagagccagctgttaagtttctcacctaatttggactaccacaacccggatattcctgaatggagaaaagacattgggaatgtcataaaacgcgcgcttgtgaaggtgacatcagtgccggaggaccagatcttgatagccgtgtttcccggactcccaacttccgcagaactgttcatcctgcctcccaagaatcttactgaacgccggaaaggaaatgagggcgacctggagcagattgtggaaaccctgtttaatgccttgaatcagaacctggttcagttcgagctcaagccaggcgtgcaagttatcgtgtatgtcacccagctaactctggcacctctcgtggatagtagcgccgggcattcttcatctgccatgctgatgctcctaagcgtggtgttcgtggggctcgcagtctttctaatctacaagtttaaacgaaagatcccgtggatcaacatttacgcgcaagtccagcatgataaggaacaggaaatgattgggagtgtgagccaaagcgaaaacgccccaaagattacactttccgatttcaccgagcctgaagagctgctggacaaggaacttgacaccagggtgatcggtgggattgccacaatcgccaattcggagagcacaaaagagatccctaattgcacctctgtttag

SEQ ID NO: 206548 - DNA, 462 bp, Artificial Sequence
  Description of Artificial Sequence: Synthetic coding sequence
gagaacccctacagcagcggccggatcagcagcaaggagaccgcccctggactcgtggttgcaacagggaacatcgggcccgagttgagctacacagacataggtgtattcattagcagtgacggaggaaacacgtggcgacagatattcgatgaagagtataatgtgtggtttctcgattggggcggcgccttggtggctatgaagcatacaccgctgcccgtgcggcacctgtgggtgtctttcgacgagggccattcttgggataaatacggcttcaccagcgtgcctttgtttgtggacggagcactggtggaagccggaatggagacacatattatgactgactatggttacgaacggcacggggaaagtcagtgcgtgcctgcattctggtataatccagcttcaccaagcaaggactgcagcctgggacaaagctacctgaactcaaccggttag

SEQ ID NO: 206549 - DNA, 1410 bp, Artificial Sequence
  Description of Artificial Sequence: Synthetic coding sequence
atgggcaccgtgcacgcccggagcctggagcccctgcccagcagcggaccggactttggaggcctgggagaggaggccgagttcgtcgaagtcgaaccagaagccaagcaggagatacttgagaacaaagatgtggtcgtccagcatgtgcactttgacggcctgggtcgcacgaaggatgacatcatcatttgtgagatcggcgacgtctttaaagccaagaatctgattgaggtgatgaggaagagccacgaggcaagagagaagttgctgcggctggggattttccggcaggttgacgtcctgatcgatacctgccaaggcgatgacgccctgcctaatggactggacgtcacctttgaggttaccgagctccggaggctgacaggttcatataatactatggttggcaacaacgagggttccatggtgttaggcctcaaactgcctaatctgctgggaagagctgagaaggtcactttccaattctcatatggcaccaaggagactagctacggtctctcttttttcaagcctcggccaggcaattttgagcgaaacttttcggtcaacctttacaaagttaccggacagtttccatggagctcgctgagggaaactgatcgaggaatgtcagccgaatatagttttcccatctggaaaacatctcacaccgttaagtgggaaggagtatggagggaactcgggtgtcttagccggactgcgtcatttgccgttcggaaggagagcggacacagcctgaaatctagcttgtcacacgcaatggtgattgactcccggaactcctccattctgccgcgacggggagctctcttgaaagttaaccaggagcttgcagggtacaccgggggagacgtctcatttatcaaagaggattttgagctgcagttaaacaagcagctgatatttgatagcgtgtttagcgcatctttttggggcggtatgctcgtgccgatcggtgataagcctagcagtattgcagacaggttttacctcggcggcccaacaagcattcggggattcagcatgcattcaattggtccacagtctgagggtgactacctgggcggggaggcctattgggccggcggcctgcacctatacacccccctacccttccgtcccgggcagggcggattcggggaactcttccgaactcacttttttttgaacgcagggaatctttgcaaccttaattacggcgaaggaccaaaagcacatatacgtaaacttgctgagtgcattaggtggagctacggggcagggatcgttcttaggttagggaatattgctcgcttggagttgaactattgtgtccctatgggtgtgcagactggtgacagaatttgcgatggggtgcagttcggtgccggaatacggttcttgtag

SEQ ID NO: 206550 - DNA, 780 bp, Artificial Sequence
  Description of Artificial Sequence: Synthetic coding sequence
atgagcgccgagtacagcttccccatctggaagaccagccacaccgtgaaatgggaaggggtgtggagagaactcggatgtctgagtcgcacagccagcttcgctgtacggaaggaatccggtcacagtttaaaatcatccttgtcccacgctatggtgattgatagtaggaattctagcattctgccccgcaggggagcacttctgaaggtcaatcaggagttggcaggttacacggggggtgacgtgtcttttattaaggaggacttcgaactgcagctcaataagcaattaattttcgatagcgtgttttcagctagtttttgggggggcatgctcgtccctattggagataaacccagcagcatagcagatcgcttctatctgggcggaccaacctccattaggggcttcagcatgcattccatcggcccacagagtgaaggagactatcttggaggagaagcttattgggcgggggggctccatctgtataccccactaccgtttcgaccaggccagggaggctttggggaattgtttagaacacacttctttctcaatgccgggaatctttgtaatctgaattacggggaaggcccgaaggcccacattcggaaactggctgagtgcattcgctggagctacggtgctggtattgttctgcggctcggcaatatcgccagactggagttgaattactgtgtgcccatgggtgtacaaaccggcgaccgaatctgcgatggggttcaatttggtgcgggaattaggttcctatag

SEQ ID NO: 206551 - DNA, 1425 bp, Artificial Sequence
  Description of Artificial Sequence: Synthetic coding sequence
atggccagcggcggcggcggctgcagcgccagcgagcggctgccccccccctttccgggtctggagccagaatcagaaggcgctgctgggggcagtgaacccgaggcaggggatagcgacaccgaaggtgaggacattttcactggagctgcagtcgttagcaagcatcagtcccccaagatcacaacgtctttattacctatcaacaatggcagtaaggagaacggaatacacgaggagcaagatcaggagcctcaggatcttttcgctgacgcgaccgtggaactgagtctggacagtacccagaacaaccaaaaaaaagtcctggcaaaaacccttatcagcctcccaccacaagaagcgaccaactcttcaaagccacagcctacctacgaagagctggaagaagaggaacaggaagatcagtttgacctgactgtggggatcaccgatcctgagaagatcggggacggaatgaatgcctacgtggcctacaaagtgaccacacagacttctctgcccttattccggtcgaaacagtttgccgttaaacggcggttttccgacttcctgggcctgtatgagaaactctctgagaaacattctcagaatgggtttatcgtccctcccccgcccgagaagagcttgatcggaatgaccaaagtgaaggtcgggaaggaagatagtagctcagccgaattcctagaaaagcgaagggcagctctagaaagatacctccagcgcattgttaaccatcctaccatgctgcaggaccccgacgtgcgcgagttcctggaaaaggaagagctcccccgcgccgtgggtacccagactctgtcgggagctggcttgctgaagatgttcaacaaggcaactgatgctgtctccaagatgaccattaaaatgaatgagtcggatatatggtttgaggagaagctgcaggaggtcgaatgtgaagagcagcgcctgagaaagcttcacgccgtggtggaaacgctggtgaatcatcgcaaagaattggctctgaataccgctcagttcgctaaatcactggccatgcttggaagtagcgaagacaatacagcactttcacgtgccctcagccaactggccgaagtcgaggaaaaaatcgaacagctgcatcaggaacaggcaaacaatgacttcttccttctcgctgagctgttgtcagactacatccgtctccttgccattgtgaggtgggagagtagagtgacacagtatgagagagactttgaaaggatttcaaccgtggttcgcaaagaagtaatccgattcgagaaggagaagagcaaggacttcaagaatcacgtgatcaaatacctggagacactcctctattcacaacagcagttggctaaatattgggaggctttccttcccgaagcaaaagccatttcctag

SEQ ID NO: 206552 - DNA, 1569 bp, Artificial Sequence
  Description of Artificial Sequence: Synthetic coding sequence
atggccagcggcggcggcggctgcagcgccagcgagcggctgccccccccctttcctggcctggaacccgagtccgaaggagccgcaggcgggagcgagccagaggcgggggatagcgacacagaaggcgaggacattttcacgggggcagcggtcgtgtctaagcaccagagccccaaaataacaacatccctgctcccaatcaataacggttcaaaggaaaacggcatccatgaggagcaggatcaggaaccacaagatttatttgcggacgccaccgtagaactctctctggacagcacacagaacaaccagaagaaagttctcgcaaaaacccttatcagtctccccccgcaggaagccactaattcttcaaaaccccagcccacgtacgaggaacttgaagaagaagagcaggaggatcagttcgatcttacagtgggaattacggatcctgaaaagattggtgatgggatgaatgcatacgtggcatacaaggttaccactcagacctcattgcccctattccgatctaaacagttcgctgtcaagcgcagattctctgattttttgggcctgtacgagaaactttcggagaagcactcccagaatggctttattgtccccccccctccagaaaaatccttgatcgggatgaccaaggttaaggttgggaaagaggactctagttcagcggagtttttggagaagagacgcgctgcactagagaggtacctgcagcgcatagtcaatcatcctactatgctgcaggaccctgacgtccgcgagtttctggagaaggaggaactacccagagccgtaggaacccaaaccctttcaggagccggtttgctgaagatgttcaacaaggcaacagacgccgtttccaaaatgactattaaaatgaatgagtccgacatctggtttgaggaaaagctccaggaggtagagtgcgaggagcagagactgcgaaaacttcatgcagttgtggaaaccctggttaatcatcggaaagaactcgccctgaacacggctcagtttgcaaaaagcctggcgatgctggggtcatcagaagacaataccgcactcagccgcgccctgtcccaactcgccgaggttgaggagaagatcgagcaacttcatcaggaacaagccaacaacgacttcttcctgttagcagagctgttgtctgattacatccgcctgctggcaattgtgcgagcagcttttgaccagcggatgaagacctggcagcgctggcaggacgcccaggccacactgcagaaaaaaagggaagcggaggctcgcctcttgtgggccaataaaccagataaattgcagcaggctaaggatgagatcctcgaatgggaatctcgcgtaacacaatacgagcgcgactttgagagaattagcaccgtggttcgtaaggaggttatacggttcgagaaagaaaagtccaaggatttcaagaaccacgtcatcaaatatctggagacattactctactcacaacagcagctggctaagtattgggaagcatttctgcctgaggcaaaggccatttcctag

SEQ ID NO: 206553 - DNA, 1374 bp, Artificial Sequence
  Description of Artificial Sequence: Synthetic coding sequence
atggccagcggcggcggcggctgcagcgccagcgagcggctgccccctccattccctggtctggaaccagagtcagagggcgctgctggtggctccgagccagaggccggagacagcgataccgagggggaggatattttcaccggggctgcggtggtatccaagcaccagtcgcccaagattaccacttcactgttgcccattaacaacggctctaaagagaacggcattcacgaggagcaggatcaagaacctcaagatctgttcgcgggtgatgggatgaacgcttatgtggcttataaggtaaccactcagacctcactgccactgtttcgcagcaagcagtttgcggtgaaaagaaggttctctgatttcctgggactgtacgagaaactgagtgagaagcattcgcagaatgggtttatcgtgccaccaccccctgagaaatctctgatagggatgacaaaagtcaaagtcggcaaggaagacagcagtagcgccgagttcctcgagaagagacgggccgccctcgaacgctacctgcagaggatcgtaaaccaccccacaatgctgcaagatccagatgtgagagagttcttagagaaagaagagctccctcgcgcagtagggactcagactctctcaggggcaggactgcttaagatgttcaacaaagccacagatgcggtctcaaagatgacgatcaagatgaacgaatcggatatatggttcgaagaaaagctgcaagaggttgagtgcgaggagcagagacttcgtaagctacatgccgtggtggaaacactggtcaatcacaggaaggagctggccctgaacaccgcacaatttgcaaaatccctggcgatgctggggtcctccgaggataataccgcactatctcgagccttgagccagcttgctgaggtggaggaaaaaattgagcaactgcaccaggagcaggccaataatgacttctttcttctggctgagctgttaagcgactatatcaggttgctcgccatcgtcagggccgctttcgatcagcgaatgaaaacatggcaacgatggcaggacgcccaggctaccctgcagaagaaacgagaagctgaggcccgactcctgtgggctaacaaacccgataaactgcagcaggcaaaagacgagatcctggagtgggagagccgagtcacacagtacgagagggacttcgagcggattagcacggttgttcggaaagaggtcatcaggtttgagaaagaaaaaagcaaggatttcaagaatcacgtcatcaagtaccttgagaccctgctctactcacagcagcagctggcaaaatactgggaggcgttcctcccggaggcaaaagcaatctcctag

SEQ ID NO: 206554 - DNA, 1374 bp, Artificial Sequence
  Description of Artificial Sequence: Synthetic coding sequence
atggccagcggcggcggcggctgcagcgccagcgagcggctgccccccccttttcccggactggaaccagaatccgagggggctgccggcggctcagaaccggaggccggagactccgacacagaaggcgaggatatctttaccggtgccgccgtggttagcaagcaccagtctcctaagatcacgacctcacttctgcctataaataatggcagtaaggaaaacgggatacatgaagagcaagatcaggaaccccaggacctgttcgcaggggacggtatgaatgcctatgttgcctataaagttacaacacagacctccctgccactgttcagatctaaacagttcgccgtgaagcggcgtttttctgacttcctggggttatacgagaagttatccgaaaagcacagccagaatgggtttatagtgccccctcctccggaaaaatccctcataggcatgacaaaggtgaaagtcggaaaggaggattcctctagcgccgagtttctggaaaagaggagggccgcattggagcggtacctgcagcgtatcgtgaaccatcctaccatgctccaggaccccgacgtgagagagttcctggagaaagaagagttgccccgcgctgtaggtacacagaccctgagcggagccggcctgctgaaaatgttcaacaaagccactgacgcggtgagtaaaatgactattaaaatgaatgagtccgacatatggttcgaggaaaagctccaagaggtagaatgcgaagagcagcgcctcagaaagctgcacgctgtggtcgagaccctcgtgaatcaccgaaaggaactggcactgaacacagcccagtttgctaagagcttggctatgttgggaagctcggaggacaataccgccctgagtcgggcccttagtcagctcgccgaagtcgaggaaaagattgagcagctgcatcaggaacaagccaataacgatttctttctactggctgagctgctgtccgattacatcaggctgctggccattgttagggctgcgtttgaccaaagaatgaagacctggcagaggtggcaagacgcgcaagcgactctgcagaaaaaacgggaggccgaggcccggctcttatgggccaataaacccgataagctacagcaggcaaaagacgaaattttggagtgggagagtagggtgactcagtatgagcgcgattttgagcggataagcaccgtagtgaggaaggaagtcatccgatttgaaaaagagaaaagtaaggattttaagaaccacgtcataaagtacttggagacactactatattctcagcagcagctggcaaaatactgggaagccttcctcccagaagctaaagccatttcttag

SEQ ID NO: 206555 - DNA, 3018 bp, Artificial Sequence
  Description of Artificial Sequence: Synthetic coding sequence
atggccgcccggcccagccgggccaccggcccccggggcggccagcgttctagagttaaaccccctccaggccggcggcttaaggaacagcttccacccttggccgctgctagggccgtctttgcagctgctactgcagttatcatgctgacagaggccagtctgagtatttggggctgggggagtctgggcatagttttgtttctaatcactttcggccctttcgtgatcttttacttgacattttatatactatgttttgtcggcggagggctggtggtcactttgctcttcggcaaaactaattccgagaaatacctggagcagtgcgagcactccttcctgccacctacctccccaggcgtgccgaagtgcctcgaagaaatgaagagagaagcgaggaccatcaaaatcgaccgccgcttgacaggtgctaatatcatcgatgagccactgcaacaggtgatccagttcagcttgagggattatgttcagtactggtactacacattgagtgacgatgagtcctttctcttggaaataaggcagactctgcaaaacgcgctgatacagtttgccacgcgcagcaaggagatcgattggcagccctatttcactacaagaatagtagacgactttggaacacacttgagagtgttccgcaaagctcagcagaagattacggagaaggatgaccaggtgaaagggaccgcagaagacctggtcgatacgttctttgaggtggaggtggagatggaaaaagaggtgtgtagagacctcgtatgtacctctccaaaagacgaagagggattcctaagggatttatgcgaggtcctcttatacttgctcctgcctccaggcgactttcagaacaagattatgaggtacttcgtgcgtgagatcctggccaggggtatcctgctccctctgattaaccagctgtcggaccctgactatattaaccagtacgtgatctggatgatacgtgattcaaactgtaactatgaggcattcatgaacataatcaaactgtctgataatattggggaactggaagctgtgcgggacaaggccgcagaagaactgcaatacttgaggtctctggatacagccggcgacgatattaatacaattaagaatcagattaattctctgctttttgttaagaaagtatgcgattctcggatccagcgtctgcagtcaggcaaagagattaataccgttaagctggctgcgaattttgggaagctctgcaccgtgcccttggacagcatcctcgtggacaatgtggcactgcagttttttatggactatatgcaacagactggaggccaggcccacctttttttttggatgaccgtggaggggtaccgcgtcacagctcagcaacagctcgaagttctcttgagccgtcagagggatggaaagcaccagacaaaccagacgaaaggtctgttgagagccgcagctgtaggtatttacgaacagtacctgagtgagaaggcaagtccaagggtgacagtggacgattaccttgtcgcgaagttggccgacactctaaatcacgaagacccaacgcccgagatcttcgacgacattcagcgcaaggtgtacgagctcatgctccgtgatgagcgtttctatccctcttttcgccagaacgctctatacgtccgcatgctggccgaactggacatgctgaaagatccttcatttagggggtccgacgacggggatggagaatcattcaatggttcaccaaccggaagcattaacctcagcttggatgatctctctaatgtgtcttccgacgacagtgtgcaactacacgcctacattagtgataccggcgtctgtaacgaccacggcaagacctacgccctgtatgcaatcaccgtgcaccgccgtaacctgaatagtgaagaaatgtggaagacttatcggcgatatagcgacttccatgactttcatatgcgtatcacagagcagttcgagagtctttcctctatcctcaagttgccaggtaaaaagacgttcaacaatatggaccgcgatttcttggagaaacgcaaaaaagatcttaatgcctatctacagctactgctggcgccagagatgatgaaggcaagtcctgccctggcacactacgtatatgatttccttgagaataaagcgtattctaaggggaaaggcgatttcgcccgaaaaatggatactttcgttaatcccttacgcaattccatgagaaatgtgagtaatgccgtaaagtccttgcccgactctctagctgagggaatgaccaaaatgtcagacaacatgggaaaaatgtccgaacgacttggccaggacattaaacaatctttttttaaagtgcccccgctgataccgaaaaccgattccgaccccgagcaccgtagagtcagcgctcaactggatgataacgtcgacgacaatatacctttgcgcgtgatgctgttacttatggatgaggtttttgatctcaaggaacgcaatcagtggctgaggcgaaatataaaaaatctgctccagcaactcatccgagccacgtacggcgatacaattaaccggaaaatcgtcgatcacgtggactggatgacaagcccggaacaggtggcagattccgtgaagcggttccgggacgcattctggccaaatggcatcctcgcagaagccgtgccgtgcagagataagagtattaggatgcgtacgcgcgtagctggcaaaaccaagcttctggccatcatgcctgatgagttaaagcatattatcggcgccgagaccaccagaaaagggattcttcgggtgttcgagatgttccagcacaatcagctgaaccgcagaatggtctacgtattcctcgaaggcttcctggaaacactgtttccacagtataaattccgtgagctcttcaataaattgcactccaggagcaaacagatgcagaagtacaagcagaagctgcagaccacccaggcgccgagcctgcagaagcgatag

SEQ ID NO: 206556 - DNA, 2874 bp, Artificial Sequence
  Description of Artificial Sequence: Synthetic coding sequence
atgctgaccgaggccagcctgagcatctggggctggggcagcctgggtatcgttctgtttctaattacattcgggccattcgtgattttttatctgactttttatatcctgtgtttcgttggcggagggcttgtggtgaccctgctgttcggaaagaccaactccgaaaaatatctcgagcagtgcgagcactcctttctgccacctacctcacccggggtaccaaaatgtctggaagaaatgaaaagagaagctcgcacaataaaaatagacaggcgcttgaccggagccaatatcatcgatgaaccattgcagcaggttatacaattcagtctgagggattacgtccagtactggtactacacattaagcgacgacgaatctttccttctggagattcgacagacattgcagaatgcattgatacagtttgccactcgtagcaaggagattgactggcaaccatactttactactcggatcgtggatgatttcggaacacacttgcgggttttccgcaaggcccagcagaagatcaccgagaaagacgaccaggttaaaggaacagccgaggatctcgtggacacctttttcgaggtggaggtagagatggaaaaggaggtatgtcgcgatctggtgtgcacctcccccaaggatgaggaaggcttccttagagatctgtgcgaagtcctcctgtatctgctgttgccccctggggactttcaaaacaaaataatgagatacttcgtgcgggaaatacttgcccgaggtattctcctcccactgatcaatcagttgtcggatcctgattatatcaaccagtacgtgatatggatgatccgggactctaactgtaactatgaagcgttcatgaatattattaaacttagcgacaatatcggcgagctggaggcagtgcgggacaaggccgcggaagagttgcagtatttgcggagcctggacaccgcaggtgatgacatcaatactatcaaaaatcagattaactcattactgttcgtcaaaaaagtttgtgatagtaggattcaaagactgcagagtggcaaagagatcaacaccgtgaaactggcagcaaactttggcaagctgtgtactgtgcctttagattccatcctggtggataatgttgccttgcagttcttcatggactacatgcagcagactggtggacaggcccatctctttttttggatgaccgtggaggggtacagagtgactgctcagcaacagcttgaggtcttgctgagtagacagcgggacggaaagcaccagacgaaccagactaagggcctgctcagagctgcggcggtggggatctatgagcagtacctcagtgaaaaggccagtccacgtgtgaccgtggacgattatctcgtcgctaagttagcggacactctcaatcatgaggatccaactcctgaaatcttcgatgatattcaaaggaaggtgtacgagctgatgctcagagatgagcgtttctatccctcctttcgccagaatgcgttgtacgtcagaatgctagctgaactcgatatgttgaaagatcctagtttccgcggctccgacgacggagacggtgagtcattcaacggatcccctaccgggtcaatcaatctgtccctggacgatctaagcaatgtgtctagcgacgactctgtgcagctgcatgcctatattagtgacacgggcgtgtgcaatgaccacggcaagacatatgcactgtacgcaatcacagtgcataggcgcaatctgaacagtgaggaaatgtggaagacttacaggcgttacagcgacttccacgattttcacatgagaattaccgagcagttcgaatccttgtcttctattttgaaactcccaggaaaaaaaacattcaacaacatggatcgcgacttcctagaaaagaggaaaaaggatttgaatgcctacctgcagcttctgctggccccagaaatgatgaaggcctcaccagcactggctcattacgtatacgactttctggaaaacaaggcctattcaaagggaaagggagactttgcacggaaaatggacacttttgttaatcctcttcggaactcaatgagaaacgtgtctaatgccgtcaagtctctacccgacagcctggccgaaggcatgacgaagatgagcgacaatatgggcaaaatgtccgagaggctggggcaggacattaagcagagctttttcaaggtcccgccactgattccgaaaaccgatagtgaccctgagcatagacgcgtctcagctcaactggacgacaacgtggacgacaatatacctttgagagttatgttgcttctgatggatgaggtgttcgacctcaaagagcgtaatcagtggctccggcggaatataaagaacctgctgcagcagctgattcgggccacatacggcgacacaattaatagaaaaatcgtcgaccacgttgattggatgacctcccccgagcaggtggcagattccgtaaagaggtttagggacgctttctggccaaacggaatacttgcagaggctgtcccctgcagagacaagtccataagaatgcgcacacgcgtagccggaaaaacaaagctcctcgccattatgccagatgaactgaaacacataatcggcgcggaaaccacacgcaaagggatccttcgggtctttgagatgtttcagcacaaccaactaaataggcgaatggtttacgtgttcctggaaggatttttggagacactgtttccccagtataaattccgagagctcttcaataagttgcactctaggagcaaacagatgcagaaatacaaacagaaactccaaaccacccaggcaccttccttgcagaagaggtag

SEQ ID NO: 206557 - DNA, 771 bp, Artificial Sequence
  Description of Artificial Sequence: Synthetic coding sequence
atgagccggcaggccaaggacgacttcctgcggcactacaccgtgtcagatccacgaacacaccccaaaggctacacagaatacaaggttaccgctcagttcatatccaagaaagatcccgaggacgttaaggaggttgtcgtctggaagaggtatagcgattttaggaagctccatggggaccttgcttacacgcacagaaatctgtttcgaaggctggaagagttcccagccttccctagagcccaggtattcggcagattcgaagccagcgttatcgaagaaaggaggaagggggctgaagatctcctgagattcactgtccacattcccgcactaaacaacagcccacaactcaaagagttttttcgaggcggtgaggtcaccaggcccctggaggtgtctcgcgatctgcacatccttccgccgcctctgatacctacacctccaccagacgacccgcggctcagtcagctgctgcccgcagagcgcagaggactggaggagctggaagtgccagtcgaccccccaccttcctcccccgcacaggaagccctcgaccttctgtttaactgcgaatccaccgaagaagcctccggcagcccggcccggggtcctctgactgaggctgagttagcactcttcgatcccttttcaaaggaaggtgatccgcttccagctcgccaggagggcgtgaaaaaaaaagccgctgagtatcttaaaagagccgaggaaatcctcaggctgcacctgtcacagttacctccttag

SEQ ID NO: 206558 - DNA, 1029 bp, Artificial Sequence
  Description of Artificial Sequence: Synthetic coding sequence
atgagccggcaggccaaggacgacttcctgcggcactacaccgtgtcggatcctcggacccatccaaagggctacaccgagtacaaagtcacagctcagtttatcagcaaaaaagaccctgaagatgtgaaggaggtcgtcgtgtggaaacgctattccgatttccgcaagctacatggtgatttggcttatacccaccgcaatctgttcaggcggctggaggagtttccggcttttcctcgcgcacaggtatttgggcgattcgaagcctccgtgattgaggagcgcagaaagggcgcagaagatctcctgcgctttacggttcacattcctgctctgaacaattctccccaattgaaggaattctttcgaggcggggaagtgacacggcctctagaggtgtcccgcgatctgcacattttgccgcccccccttatccctacccctccccccgatgatccccggctgtctcagctgttacctgccgagcgccgtggactggaggagctagaagtcccagtggacccaccaccatcgtctcctgctcaagaggcattggacctgcttttcaactgtgaatcaactgaagaggctagcggttcccccgccagaggccctctcaccgaagccgagctggccctgttcgacccattttccaaggaagagggcgccgctccgtctcccacccacgtcgcggaactggcgacaatggaggtcgaaagcgcgcgtttggatcaggagccttgggaacctggcggtcaagaagaggaggaagatggcgaaggaggtccgacacctgcttacctgagtcaggccaccgagcttatcacacaggcactgcgtgatgagaaggctggcgcctacgctgctgcactgcaggggtacagagatggtgtgcatgttttattgcaaggcgttcctagcgatcctctgcccgctcggcaggagggcgtgaagaagaaggctgccgaatacctgaaacgggcagaagaaattttgcggctgcatctttcccagttaccaccctag

SEQ ID NO: 206559 - DNA, 1608 bp, Artificial Sequence
  Description of Artificial Sequence: Synthetic coding sequence
atgagcgagggcgagagccagaccgtgctgagcagcggcagcgaccctaaggtggaatcctctagcagtgccccagggctgacatccgttagccctcctgtgacgtccaccacaagtgcagcttccccggaagaagaggaggagtctgaagacgagagcgagattctcgaagaatcgccatgtgggagatggcagaagcggcgcgaagaagtgaaccagcggaatgttcctggcattgactctgcgtatttagctatggatactgaagagggggtcgaagtggtgtggaacgaagtccagttctcagaacgcaagaattacaaactccaagaagagaaggtgagagcagtgttcgacaacctgatccagctggaacatctcaacatcgtcaagttccacaagtactgggccgatattaaggagaacaaagcacgggtgatttttatcacagaatacatgagcagcggatccctcaagcagtttttaaaaaaaacaaaaaaaaatcacaagaccatgaacgaaaaggcctggaaacgctggtgcactcagatcctttccgcactatcttacttgcactcctgcgaccccccaatcatccatggtaacctcacctgtgacaccatttttatccagcacaatgggctgattaaaattggcagtgtcgcccctgacactattaacaaccacgtcaagacctgtcgcgaagagcagaaaaatctgcatttctttgcaccagaatatggcgaagtaactaatgtaactaccgcagtggatatttatagtttcggcatgtgcgctctcgaaatggcagtcctggaaatccaaggtaatggggagtcaagctatgttcctcaggaggccatttcatcggccattcagttgcttgaagacccattacagagggaattcatccaaaagtgtttgcaatcggagcctgcccggagaccaaccgctagggaacttctgtttcaccccgcacttttcgaagttccctcccttaagctgctcgccgctcattgtatcgtgggacatcaacacatgatccctgagaacgccttggaggagatcacaaaaaatatggatacttctgcggtgctggctgagatccctgctggtcccgggagagagcccgtgcaaacactttattcccaatctcccgcgcttgagttggacaagttcctcgaagatgtacggaatgggatctaccctttgactgcgtttggtctcccaagaccccagcagcctcaacaggaggaagtaacttccccggtggtccctccttctgtcaagacacccaccccagaacccgccgaggttgaaactagaaaggtcgtcctgatgcagtgcaacatcgagtccgtggaagagggcgtgaaacatcacctgacactcctcctgaagctggaggacaagttgaaccggcacttgtcgtgcgacctcatgcccaatgagaatatccctgaactcgctgctgaattggtccaattggggtttatcagcgaggccgaccagtctagacttacctcattgctggaagaaactttaaacaaattcaattttgcccgcaatagcaccttaaattccgctgccgttacagtcagtagctag

SEQ ID NO: 206560 - DNA, 1338 bp, Artificial Sequence
  Description of Artificial Sequence: Synthetic coding sequence
atgcacttcagcatccccgagaccgagagccggagcggcgacagcggaggaagtgcttatgttctccgcaaagaatacggagccaacgtgttacccgcgttcccgccaaaaaaattattctccctgactcccgccgaagttgagcagcgaagggagcagctcgagaaatacatgcaggccgtcagacaggatccactacttggatctagcgaaacatttaacagcttcctccgtcgcgcccagcaggagacccaacaagttcccaccgaggaggttagtctggaagtgcttcttagtaacggtcaaaaagtcctcgtcaatgttctgacgagcgatcagacagaggatgtgttggaggccgtcgccgccaagctggacctgccggatgatttgatcggatacttcagcctctttctggtcagagaaaaagaggacggcgcattctctttcgtcagaaagctgcaggagtttgaattaccatacgtgtctgtgacgtctttacggtctcaggagtataagatcgtacttcgcaaatcttactgggacagcgcctacgatgacgacgtgatggaaaacagagtgggactgaacctgttatatgcccagaccgtgtccgacatagaaaggggctggattctagtaacaaaagaacagcacagacagcttaagtcactgcaggagaaggtgtctaagaaagagtttttgcggttggcgcagacattacggcattacgggtacctacggttcgatgcctgtgtggctgactttccagaaaaagactgcccagtggtcgtaagcgccggcaattcggagttgagcttgcagctgagattacccggccagcaactccgtgagggttcattcagggtgacccggatgaggtgctggcgcgtcacatctagtgtccccctgccttcaggtagcacatcctcccctgggcgaggccgcggcgaggtgcggctcgaactggcattcgagtatctaatgtccaaggatagactgcagtgggtcacaattacctctccccaggcaatcatgatgtctatatgcctccagtccatggtggacgagctaatggtgaaaaagagcggagggtctatccgtaaaatgctcaggcgccgggttggcgggactctacggaggagcgactcccagcaggcagtgaagagtccgccacttctggaaagtccggatgctaccagagaatccatggtgaaactctcgtccaaactgagtgctgtttctttacgaggaataggcagtccgtcgacagatgcctctgctagcgacgttcatggaaacttcgctttcgagggtataggggacgaagacctgtag

SEQ ID NO: 206561 - DNA, 771 bp, Artificial Sequence
  Description of Artificial Sequence: Synthetic coding sequence
atggagaaccgggtgggcctgaacctgctgtacgcccagaccgtgagtgacatcgagcgggggtggatactggtgacaaaagagcagcatcggcagttgaaatcactgcaagagaaggtcagcaaaaaggagtttctccgcctcgcgcagactctgcggcactatggataccttaggttcgacgcgtgcgtggccgacttcccagaaaaagactgcccagtggtggtgagcgccggaaatagcgaactgtctttgcagctacgactacccggccaacagcttagagaggggtcatttagggtgaccagaatgaggtgctggcgggtgaccagttcagttcctctgccatcaggttcaacatcttcacctggccgagggcgcggggaggttcggttggaactggccttcgagtacctgatgagcaaagacagattacagtgggtaacaattacatctccacaggcgataatgatgagtatctgtctgcagtctatggtggacgagctgatggtgaagaaatctggcggatcaattaggaagatgttaaggagacgagtcggggggactcttaggagatccgacagccaacaggcggtgaaaagtcctccacttcttgaatctcccgacgccacacgagaatccatggtcaagctctccagcaaattatcagcagtcagtctgagaggtattgggagcccctccacagatgcaagtgctagtgatgttcacggaaattttgcatttgaggggatcggggacgaggacttgtag

SEQ ID NO: 206562 - DNA, 771 bp, Artificial Sequence
  Description of Artificial Sequence: Synthetic coding sequence
atggagaaccgggtgggcctgaacctgctgtacgcccagaccgtgagtgacattgaaaggggctggatccttgtcacaaaggaacagcaccgacagttgaagtccttgcaagagaaagtttccaagaaggagttccttcgattagcacagaccctgagacactatggctacttacgcttcgacgcctgtgtggccgatttcccagagaaagactgccctgtcgtagtgtctgctggcaatagcgagctcagtctccaattaagactgcccgggcaacaactgcgcgagggtagtttcagggtgacaaggatgcggtgctggagggtgacatcctccgtgccgctacctagcggatcgacatcctcccctggcagaggacggggcgaagttagattggagttggctttcgaatacttgatgtccaaggatcggctgcagtgggttactatcactagcccgcaagctatcatgatgagcatatgcctccagagcatggtcgatgaactaatggtcaagaaaagcggcggcagcattcgtaaaatgctgagacggcgggtgggcggcacactaagaagaagcgactcgcaacaggcggttaagtctccaccgttgctcgaaagccccgacgcaacccgcgaatctatggtgaaactcagttcaaaactgtccgcggtgagcctgcgggggatagggagcccctcaactgacgcaagcgcttcggacgtccatggaaattttgctttcgagggaattggcgatgaggacctttag

SEQ ID NO: 206563 - DNA, 1560 bp, Artificial Sequence
  Description of Artificial Sequence: Synthetic coding sequence
atggccgccgagcgggagcccccccccctgggcgacggcaagcccaccgacttcgaggatctggaagacggagaagacctgtttacgagcacggtttcaactctggagagctctccctcatcccctgaacccgcctctctgccagccgaagatatttcagccaactctaatgggccaaaacccaccgaggtggttctcgacgacgatagagaggacctgttcgcagaggctaccgaggaagtgagtctggacagccctgagcgcgaacccatcctgagctccgaaccctctcccgcggtcacacccgtcacaccaacaacactgatcgcgcccagaattgaatcgaaaagcatgtcagcacctgtcatttttgacagatcccgggaagagatagaagaggaagcgaatggagatatttttgatatagaaatcggggtgtcagaccccgagaaagtcggagacggtatgaacgcctatatggcttatcgggttactaccaagacaagcttgtctatgttctcaaaatctgagtttagcgtgaaacgacggttttcagactttctgggtttacactctaaattggcctctaagtaccttcacgttggctatatagttccccctgctcctgagaagagtatcgtgggaatgacgaaggtgaaagtcggaaaggaagacagcagttccactgagtttgtagagaaacggcgggctgcactggaacggtacctgcagagaaccgtgaagcatcctacacttcttcaggacccagacctccgtcagtttttggaatcttctgagctccccagggctgtgaatactcaggccctctcaggcgcgggtattctccgcatggtgaataaggcagctgatgcagtgaacaaaatgaccataaaaatgaatgaaagcgacgcttggttcgaagaaaagcaacagcagttcgagaacctagatcagcagctcaggaagctgcatgtgagcgtggaagccctggtatgccacagaaaagagctgtctgccaacaccgctgctttcgccaaatcagccgctatgttaggcaattcagaggatcataccgcattatctcgagctctaagtcagcttgccgaggttgaagagaaaattgatcaactgcatcaggaacaggctttcgccgacttctatatgttctctgaactgctcagcgactacatcagactgatcgcggccgtgaaaggggtttttgatcacaggatgaagtgctggcagaaatgggaggatgcccaaattactcttctgaagaagcgagaggctgaggctaaaatgatggttgccaacaaacccgacaagattcagcaggcaaagaatgagattcgcgagtgggaggcgaaagtgcaacagggagaaagggactttgaacagatttcaaaaacgatcagaaaggaagtcgggcggttcgaaaaggaaagagtgaaggactttaaaactgttatcatcaagtacttggagtctctggtacagacacagcagcagcttatcaaatactgggaggcttttttgcccgaggccaaagctatcgcctag

SEQ ID NO: 206564 - DNA, 390 bp, Artificial Sequence
  Description of Artificial Sequence: Synthetic coding sequence
atggccagccccgagcaccccggcagccccggctgcatgggccccataacacagtgcaccgcccgaacccaacaagaggcacccgccacgggtcctgatttacctcacccaggcccagacgggcacttggatacccatagcggcctcagctcaaattcatcaatgactactcgggaattgcagcagtactggcagaaccagaagtgccggtggaaacacgtcaagttactgttcgaaattgcatcggctaggatagaggagaggaaagtgtcaaagttcgtcatgggcaaatcccgacctggggagatgacctacccaggctctcggggagagacaggtaccgcacccgagccggacccgagatgtcctcggcagtccgatatgctgtag

SEQ ID NO: 206565 - DNA, 951 bp, Artificial Sequence
  Description of Artificial Sequence: Synthetic coding sequence
atggccagccccgagcaccccggcagccccggctgcatgggccccatcacacagtgcaccgcacggacccaacaagaggctcccgccaccggtccagatctcccccatcccgggccagacggtcacctggatacccatagcggcctgtctagcaactcttctatgaccacgcgagagctgcagcaatattggcagaaccagaagtgcaggtggaaacacgtgaagttgctgtttgaaattgcgagcgcgagaatcgaggaaagaaaggtctcaaaattcgtggtctatcagataattgtaatacagacgggctcgttcgacaacaacaaggccgtgcttgagcggaggtacagcgacttcgccaagcttcagaaggcgctgttgaaaactttcagagaagaaattgaggatgtcgaattccccaggaagcatctcacggggaacttcgcagaagaaatgatatgtgaaagacgccgggccctacaagagtacctgggtctgttatacgcaatacggtgcgtcagaaggagtcgagagtttctggatttcctgacaaggcccgaactgagggaagcttttggctgcttgagggcaggccagtatccccgcgcactcgaacttttactgagagtactgcccctgcaggagaaactgacagctcactgccccgcagccgctgttccggcgctatgtgcagtcttgctgtgtcacagggacctggaccggccggctgaggcttttgcagctggtgaacgagccctgcagcgtctgcaggcccgagaagggcaccgctattacgctcctctgctggacgcaatggtacgcctggcatacgctttgggtaaggactttgtgacattgcaggaacgcctcgaggaaagtcagctgaggcggcctacgccccgtgggatcacgttgaaggaattaacagttagagagtatctacactag

SEQ ID NO: 206566 - DNA, 459 bp, Artificial Sequence
  Description of Artificial Sequence: Synthetic coding sequence
atggccagccccgagcaccccggcagccccggctgcatgggccccataactcagtgtaccgccagaacacagcaggaagcaccagccacaggacctgatctgcctcatccaggaccggatggacatctcgatacccacagtgggctgtctagtaatagctctatgactaccagggagttgcagcaatattggcaaaatcagaagtgccgctggaaacacgtcaagttgctgtttgagattgcaagtgcccgcatcgaagagaggaaagtttctaagttcgtcgtctaccagatcatagttatccaaacaggcagtttcgataacaacaaggcagttctggaacgacggtacagcgacttcgtgaccctgcaagagcgcctcgaggagagccagctgaggcgaccaacccccagaggtattacgctcaaagagctcacggtccgagagtatcttcattag

SEQ ID NO: 206567 - DNA, 309 bp, Artificial Sequence
  Description of Artificial Sequence: Synthetic coding sequence
atggccagccccgagcaccccggcagccccggctgcatgggccccatcacacagtgtactgcacggacacagcaggaggcgcctgctacaggcccggacctgccacatcctggcccggacggtcacctggacacccattccggcttgtcctctaattctagcatgactacccgagagctgcaacagtactggcaaaaccaaaagtgtcggtggaagcacgtgaagctgttgttcgagattgcttccgctcgaatcgaggagcgcaaggtgtccaagtttgtcgctcccgctcctgatgccactccatag

SEQ ID NO: 206568 - DNA, 807 bp, Artificial Sequence
  Description of Artificial Sequence: Synthetic coding sequence
atgcagcagatccggccccccttcatccggggccccccccaccacgcttctaaccctaactctccgctgtcaaatcccatgttacccgggatcgggccacccccaggaggaccccgtaacctaggccccaccagctctccgatgcaccggcccatgctcagtcctcacatccaccccccctctacacctacaatgcctgggaatcctcctggcctgctgccgccacctccccctggcgccccgctaccaagtctgcccttccctccagtgagcatgatgccgaacgggccaatgcccgtgcctcagatgatgaacttcggcctgccctcgctggcccctcttgtgcccccgcctacactgctggttccttatcctgtgatcgtcccacttcccgttcctatcccgattcccattcctatccctcacgtcagcgattctaagccacctaaaaagctgctaagtccagaagaaccggctgttagcgaactggagtccgttaaggaaaataattgtgcctcaaactgtcacctggatggtgaagcggcgaaaaagctcatgggggaggaagcccttgccgggggagataaaagcgatcccaatctcaataatcctgctgatgaagaccatgcgtacgccctgagaatgttacccaaaacaggatgtgttatccaaccagtgccaaagcctgcggagaaagcagcaatggccccatgcatcataagctctcccatgctatcagcgggacctgaggatctggaaccaccattaaaacgcagatgtctgaggatccggaaccaaaacaagtag

SEQ ID NO: 206569 - DNA, 423 bp, Artificial Sequence
  Description of Artificial Sequence: Synthetic coding sequence
atggccgagaccgtggccgacacccggcggctgatcaccaagccccagaacctaaacgatgcctacgggcctcctagtaacttcctcgaaatagataccaatctacctattttcaaactgaaggaatcgaccgtgaggagacggtactcagactttgaatggctgagaagcgagctcgaaagggagagtaaagttgtggtacctcctctcccgggaaaggctttcctcagacagctgcccttccggggggacgatggaatcttcgatgataatttcattgaggaacgaaagcagggattggagcagtttattaataaagtggcgggccaccccttggctcagaacgagcgatgcctgcatatgtttctgcaagatgagatcattgataagtcatatacccctagcaagatcaggcatgcctag

SEQ ID NO: 206570 - DNA, 342 bp, Artificial Sequence
  Description of Artificial Sequence: Synthetic coding sequence
atggccgagaccgtggccgacacccggcggctgatcaccaagccccaaaatcttaatgacgcctatggacccccctcgaatttcctcgagatagatgtctccaatcctcagacagtcggggtcgggcgcggcagatttacgacttatgagattagagtcaagacaaacttgcctatttttaagctgaaagaatccacagtcagacggcggtacagtgatttcgaatggttgaggtctgaactggagcgggaaagcaagccatgcctccggatgacctctgaggcacggtctcacggcaggacttggtgcgcgcagaacgacgaaaaattgttttgcgattag

SEQ ID NO: 206571 - DNA, 393 bp, Artificial Sequence
  Description of Artificial Sequence: Synthetic coding sequence
atggccgagaccgtggccgacacccggcggctgatcaccaagccccagaatcttaacgacgcctacgggcccccatccaacttcctggagattgatgtatccaatcctcagactgtgggcgtgggaagaggccggttcactacctacgaaattcgggtgaaagtggtggtcccccccctgcccggaaaggcattcctccgccagctaccctttagaggggacgatgggatttttgatgacaacttcatcgaggaaagaaagcagggtcttgagcaattcataaacaaagtcgccgggcatcctctcgcccaaaacgaacgttgtcttcacatgttcctgcaggatgagattattgataagtcatacacccctagcaaaattcgacatgcatag

SEQ ID NO: 206572 - DNA, 1353 bp, Artificial Sequence
  Description of Artificial Sequence: Synthetic coding sequence
atggagcaggccccccccgaccccgagcggcagctgcagcccgcccccctggagcccctgggttcaccagatgccggtctgggtgccgccgtcgggaaagaagcagaaggagcgggcgaggagagttccggcgtcgatactatgactcataacaatttctggctcaagaaaatcgagatttcagtgagtgaagctgagaagcgcacaggcagaaacgctatgaatatgcaggagacttacaccgcatacctcatcgaaactcgctctgtagagcacaccgacggccagtccgtgctgactgacagcctctggcggcgatatagtgagttcgagctgcttcgtagctacctgctggtatattatccacatatcgtggtaccacccttgccagagaagagagcagagtttgtgtggcacaagttgagtgctgacaatatggaccctgacttcgtcgaaagaaggcgaatcggactggagaacttcctgctaagaatcgcatcgcacccgatcttgtgccgggataagattttttatctatttctgacgcaggaaggcaattggaaagagaccgtgaatgaaaccggctttcagctgaaagcagatagccgccttaaggctttgaatgctaccttcagagttaagaaccccgataagaggtttaccgacttgaaacactactctgacgagttgcagtccgtgatctcccacctcctgagagttagagcccgtgtcgcggatcgactgtatggtgtatataaagtgcatggcaattatggaagagtgttttccgagtggtccgctatagaaaaggagatgggggacggactgcagtccgcggggcatcacatggacgtgtacgcctcgagtattgacgacattctcgaagacgaggagcactacgctgaccagctaaaagagtatctgttttacgccgaagctctgagggctgtgtgtcggaagcacgagctcatgcagtacgacttagaaatggccgctcaggacctggcttccaagaaacagcaatgcgaagagctggtgactggcaccgtgaggacgttctccctcaagggcatgacaacgaagctgttcggtcaggagacacccgaacagagggaagccagaattaaggtgctcgaagagcagattaatgaaggagagcagcaattgaaatcaaagaatctggaagggcgcgaattcgtcaagaacgcctgggccgatattgagagatttaaggagcaaaaaaaccgggatctcaaggaggccctgatctcctatgcggtcatgcagatctctatgtgcaagaaagggatccaggtatggaccaacgcgaaagagtgttttagcaaaatgtag

SEQ ID NO: 206573 - DNA, 918 bp, Artificial Sequence
  Description of Artificial Sequence: Synthetic coding sequence
atggaccccgacttcgtggagcggcggcggatcggcctggagaacttccttctgaggattgcaagtcaccctatcctgtgcagagacaagattttttatctatttctcacacaggagggaaattggaaggagaccgtcaacgaaacagggttccagttgaaggcagactctaggttgaaggccctcaatgctactttcagagtgaagaatcctgataagcgattcactgatctgaaacattactccgacgaactccaatccgttatttcccacctgctgcgcgttagggcccgggtagccgacaggctgtatggcgtctataaagttcatgggaattacggccgggtcttctccgaatggtcagcaatcgagaaggaaatgggcgatggcctgcagtccgcagggcatcatatggacgtatatgcgtccagcatagacgatatcctagaagatgaggagcactatgcggatcagcttaaggaatatttattctacgcggaagccctcagggctgtgtgtcgcaaacatgaactcatgcagtacgacctagagatggctgctcaggacttggccagcaagaaacagcagtgtgaggaattggtcactggaacagtgcgcactttctctctgaaggggatgacaaccaaattatttgggcaggagactcccgaacaaagggaggcccggattaaagtgctcgaagagcagataaacgagggcgaacaacagctcaaatccaaaaacctggaggggcgcgagttcgtgaagaatgcttgggcggacattgagcggttcaaggaacagaaaaaccgcgatctgaaggaagccctaattagctatgcggtgatgcaaatttccatgtgtaaaaaaggcatccaggtgtggacaaacgctaaggaatgcttctcaaaaatgtag

SEQ ID NO: 206574 - DNA, 1215 bp, Artificial Sequence
  Description of Artificial Sequence: Synthetic coding sequence
atggccgccgtgcccgagctgctgcagcagcaggaggaggaccggagtaagctgcgtagcgtaagcgtagatctgaacgtggatccatccttgcagatcgacataccagacgctctcagcgagcgcgacaaggtaaaatttacggtgcacaccaagaccacgctgccaaccttccagagcccagagttctctgtaacccgccaacatgaggacttcgtatggttacacgacactctcatagaaacgactgattacgctggcttgataataccacctgctcctaccaaacctgactttgacggcccgagagaaaagatgcagaaacttggcgaaggggagggcagtatgacaaaggaagaatttgccaagatgaaacaagagttggaagctgagtacctggctgtgttcaaaaaaaccgtgagctctcatgaagtgttccttcaacggctttcaagccatccggtattgagtaaagaccgcaatttccacgtgttcttggagtatgatcaagatctgtctgtccgcaggaaaaataccaaggaaatgttcggcggcttctttaagtctgtagtcaagtctgctgacgaggtgctttttactggagtaaaagaggtggacgatttctttgagcaggagaagaactttctcattaattattataatcgtataaaggacagttgtgtgaaagcagacaagatgactcgcagccataaaaacgtagcagatgattacatccacactgccgcctgtctacactcccttgctttggaggagcccaccgtgataaaaaaatacctcttgaaggtggccgaactctttgagaagctgaggaaagtagagggccgagtttcttccgatgaagacctcaaactaaccgaactgctgagatactatatgttaaatattgaggcagccaaggatctgctgtatagaaggactaaagccctcattgactacgagaatagcaataaagctttggataaagcacgactgaagagcaaagatgtgaaactggccgaggctcatcagcaggaatgctgtcagaaatttgagcagttgagtgaatcagctaaagaggaactgatcaatttcaagagaaaacgcgtggccgcatttagaaagaacctgatcgaaatgagcgaacttgagatcaagcacgcgcggaataacgtttcccttctacagagctgcatcgacctattcaagaacaactag

SEQ ID NO: 206575 - DNA, 1215 bp, Artificial Sequence
  Description of Artificial Sequence: Synthetic coding sequence
atggccgccgtgcccgagctgctgcagcagcaggaggaggaccggtccaaacttagatcggtgagtgttgatctcaacgtggacccttcgctccaaattgacattcctgacgctctgagtgagcgggacaaagttaagttcacagtgcacaccaaaacaaccttaccaaccttccagtcccccgagttctctgtcactagacagcacgaggatttcgtatggttacacgataccttgatcgaaactacagactatgccggacttataatcccccctgcccccactaaaccggacttcgacgggcctcgggagaaaatgcagaaactaggagaaggagaaggcagtatgactaaggaggagttcgcgaaaatgaagcaggagctcgaggcagagtatctcgctgtgtttaagaagacagtttcgagtcatgaggtgttccttcagcgcctgtcttcccaccctgtcctcagcaaggaccgcaactttcacgtgttcctggagtatgatcaagatctttcggttagacggaagaatacgaaagagatgtttggaggcttttttaaatcagtcgttaaatccgctgatgaagtgctcttcactggtgtcaaggaggtggacgacttctttgagcaggaaaaaaacttcctgatcaactattataacagaatcaaggacagctgcgtgaaggctgataagatgacgcgatcacacaagaatgtggccgacgactatattcacacggccgcctgccttcattctttggccttggaggaaccaactgttattaaaaagtacctgttgaaagttgctgagctgttcgagaagctgaggaaggtggagggccgcgtctcatccgatgaagacctgaaacttactgaactgctgcggtactatatgctaaatatcgaggccgctaaggacttgctctatcgcaggacgaaggcgttgattgactatgagaacagcaacaaagcccttgataaggcccggctgaagtctaaagacgtgaaactggcggaagcgcatcagcaggagtgttgccagaaattcgaacagctgagtgaaagtgccaaggaagagcttattaatttcaagagaaaacgggtggccgctttcagaaagaaccttattgagatgagtgaactcgagataaagcatgccaggaacaacgttagtttgctccagtcatgtattgatttgtttaaaaacaactag

SEQ ID NO: 206576 - DNA, 687 bp, Artificial Sequence
  Description of Artificial Sequence: Synthetic coding sequence
atggccgccgtgcccgagctgctgcagcagcaggaggaggaccggagcaagaccactctgcccaccttccagtcccccgagttcagcgtgacgcggcagcatgaggacttcgtgtggcttcacgacaccctcattgaaactactgattacgctggtctgattataccaccggcacctactaagccagactttgatggcccacgagaaaaaatgcaaaagcttggggagggggaggggtctatgaccaaggaggaattcgccaaaatgaagcaggagctcgaagcagagtacctagccgtttttaaaaagaccgtttcttctcatgaggttttcctccagaggttatcgtcccatcccgttttatcgaaggatcgcaatttccacgtctttctggaatatgaccaggatcttagtgtccgcaggaagaataccaaagagatgttcggaggattcttcaagtctgtggttaagtcggccgatgaggtccttttcacaggcgttaaggaggttgatgacttcttcgagcaggagaaaaacttcctgatcaattactataatcgaatcaaggactcctgcgtcaaggcagacaaaatgacccgctcccataagaatgtagctgatgattatatccacaccgcagcctgcctgcactctttagctctagaagagccaacagtgatcaagtag

SEQ ID NO: 206577 - DNA, 810 bp, Artificial Sequence
  Description of Artificial Sequence: Synthetic coding sequence
atggccgccgtgcccgagctgctgcagcagcaggaggaggaccggtctaaattacggtccgtgtccgtggatcttaacgttgacccatcactgcagattgacatccctgacgccctgagtgaaagagataaagttaagtttaccgtgcacactaagatcccccccgcccctacaaaaccagacttcgacggtcctagggagaagatgcagaagctgggcgagggggaggggtccatgacaaaggaggagtttgctaagatgaagcaggaactggaagctgagtacctggcggtgtttaagaagacagtcagctcacacgaggttttcctgcagcggctctcctcacatcctgtcctgagcaaggacagaaactttcacgtgttccttgaatacgatcaggacctttccgttaggcgcaagaatactaaggaaatgttcggcggtttcttcaagagcgtggtaaagagcgcagacgaggtgctatttacaggggtcaaagaagtggatgacttttttgagcaagagaaaaatttcctgattaattattacaaccggatcaaagatagttgtgtcaaggcagacaaaatgacgagatcacacaagaatgtcgccgacgactatatccatactgccgcttgccttcattctctggccttggaagaaccaactgtgatcaagaagtatctgctgaaagtagctgagttatttgaaaagttgaggaaagtggaggggcgcgtgagctccgacgaggatctgaagctcacagagctgctccggtattacatgttaaatatagaagcagctaagtag

SEQ ID NO: 206578 - DNA, 885 bp, Artificial Sequence
  Description of Artificial Sequence: Synthetic coding sequence
atgaccaccctgaccgagatcaagctgctgcccagcctggtgctgctggtatgctgcgagtatctcgcgatcttcaaaaagaccgtggccatgcacgaggtgtttctatgcagggtagcagctcaccccatactgagacgagatctgaatttccacgtattcctggaatacaatcaagacttgtccgtaaggggcaagaacaagaaagaaaaactggaagacttttttaagaatatggtgaagagcgcagatggggtcattgtgagtggcgttaaggatgtggatgatttttttgagcacgaaaggacctttctccttgaataccataacagagtgaaggacgcgagtgcaaagtcagacaggatgacacggtctcacaagtccgccgctgacgactacaaccggatcggcagttccctctacgccctcggtactcaggactccacagacatctgcaagttctttctgaaggtttctgaactgtttgacaaaacacgtaaaatcgaggctagggttagtgcagatgaagacctgaagctgtcagacctcctcaagtactatttgagggaatcacaggccgccaaggaccttctctaccgccggagccgctctctggtcgattatgagaacgcaaacaaggccctagataaggccagagcaaaaaataaggacgtgctgcaggccgagacttctcagcagctgtgctgtcagaagtttgaaaaaatttctgagtctgccaaacaggagctgatcgatttcaaaacacggcgggtggctgcctttcggaagaacctggttgaactggctgagttggagttgaaacatgccaaagggaatctgcagctgctgcaaaactgtttagctgtgcttaatggagatacctag

SEQ ID NO: 206579 - DNA, 1257 bp, Artificial Sequence
  Description of Artificial Sequence: Synthetic coding sequence
atgcgggcctgcgccggcccccggctgggcgccgccatgatggagggtctggacgacggcccagacttcctcagtgaagaagacaggggactgaaagcaattaatgttgacctgcagtcagacgcggccttacaggtggatatttcggacgccctcagcgagcgcgataaggtgaagttcacagtccacaccaagtcaagtcttcccaactttaagcagaacgagttttccgtcgttcggcaacacgaagaattcatctggctgcacgactcctttgtggagaatgaagattacgctggttatatcatccctccagctcctccacggcccgacttcgatgctagtcgggagaaactccagaagctgggggaaggggagggttcaatgaccaaagaggagtttactaaaatgaagcaggaactggaagctgagtatttggccatctttaagaaaaccgttgccatgcacgaggtttttttgtgcagggtcgctgcccacccaatcttaaggcgcgatctgaacttccacgtgtttcttgaatataaccaggatcttagcgtcagaggcaaaaataagaaagaaaagctggaggattttttcaaaaacatggtgaaaagcgctgacggggtgatcgttagtggcgtgaaagatgtggatgatttctttgagcatgaaaggaccttcttgcttgagtatcacaaccgcgtcaaggatgctagtgcaaagtctgatcgtatgacacgttcccacaagagcgccgccgatgactataataggattggctctagcttatatgcactcgggacccaggattccactgatatatgcaagttttttctcaaggtgtccgagctgtttgataagacccgtaaaatcgaagcccgcgtgtctgctgacgaagacctgaagctctccgacctgctgaagtattacctgcgggagtcccaggccgcgaaagatcttctttataggcgaagccggtctttagtcgattatgagaacgccaacaaggctcttgataaagcccgcgcaaaaaataaggatgttttgcaggcagagactagccagcaactgtgctgtcaaaagtttgagaagatcagtgagtctgccaaacaagagttaatcgatttcaaaacccgtcgcgtggcggcctttcggaaaaacctggtcgaacttgctgagctagaacttaagcatgccaaggggaaccttcagttgctgcagaactgtctggcagttctcaacggggacacttag

SEQ ID NO: 206580 - DNA, 873 bp, Artificial Sequence
  Description of Artificial Sequence: Synthetic coding sequence
atgaccaaggaggagttcaccaagatgaagcaggagctggaggccgaatatcttgcaatcttcaaaaagactgtcgccatgcatgaagttttcctatgtagagtcgccgctcaccccatcctcagacgtgacctcaacttccatgtattcttggaatacaatcaggacctgagcgtcaggggcaaaaacaaaaaagaaaagctggaagactttttcaaaaacatggtcaaatcagctgatggtgtgatagtaagcggagttaaagacgtagacgacttcttcgagcacgaacggacctttctcctagagtaccataatcgcgtgaaagacgcctccgccaagagcgatagaatgactcggagccataagtccgctgcagatgactataaccgaatagggagttcactctatgcgttaggcacccaggactctacagatatctgtaaattcttcctgaaggtcagtgagctgttcgacaaaaccaggaagattgaggcacgagtgagcgccgatgaagaccttaagttatcagacctccttaaatactacctccgggagtcacaggcggcaaaggacctcctgtataggcggtcccgcagtttggtggactatgaaaacgccaacaaagcactcgataaagctcgcgccaagaacaaggacgtgctgcaggccgagaccagccagcagctatgctgccaaaagtttgaaaagatttcagagtcagctaaacaggagttaattgacttcaagactcgcagggtcgctgcgttccgtaagaatctagtggaattggccgagctggagctgaagcacgccaagggaaatctgcagctgcttcagaattgtcttgccgtgctgaacggggacacgtag

SEQ ID NO: 206581 - DNA, 873 bp, Artificial Sequence
  Description of Artificial Sequence: Synthetic coding sequence
atgaccaaggaggagttcaccaagatgaagcaggagctggaggccgagtacttagccatcttcaagaagacagttgccatgcatgaggtgtttctctgccgggtggctgctcatcctatcttgaggcgtgacttgaattttcacgtattcctggagtataaccaggacctgagcgtcagggggaagaataaaaaggagaagttggaggacttctttaaaaatatggtgaaatctgctgacggggtgatcgtgtccggcgtgaaagacgtcgacgatttttttgagcacgagcgcaccttcctgttagagtaccataatagagtaaaggacgcgagcgcgaagagtgataggatgacccgctcacataagagcgccgccgacgactacaataggattggaagcagcctctatgccttaggtactcaggactccacggatatctgcaagttcttcctcaaagtttcggaactgttcgataagactcggaagatagaggcacgcgtttcggcggatgaagacctgaagttaagcgacctgcttaagtattatttgagggaaagccaggccgcaaaagatctcctctaccgacgcagccgcagtctcgtcgattacgagaatgccaacaaagccctggataaagcccgagcaaaaaataaggacgtcctgcaggctgaaacaagccaacagctctgctgtcagaaattcgagaagatatccgaaagtgcgaagcaggaactgattgattttaaaacacgccgggtggccgcttttcggaaaaatttagtggagctggctgaactcgaactgaagcatgcaaaggggaatctgcaactccttcagaactgcctcgccgtgctgaatggtgatacttag

SEQ ID NO: 206582 - DNA, 1188 bp, Artificial Sequence
  Description of Artificial Sequence: Synthetic coding sequence
atgaagatccccctgaacaagttccccggcttcgccaagcccggcactgaacagtacctgcttgcaaaacagttggctaagcctaaggagaagattccaattattgtaggggattatgggcccatgtgggtgtatccaacgtccacctttgattgcgtcgtggccgacccgagaaaagggagcaagatgtatggacttaaaagctacattgagtatcagctgaccccaacaaataccaatcggagcgtgaatcaccgctacaaacacttcgactggctgtacgagcgactcttggtaaaattcggaagtgcaatacctatcccgtcgctgcctgacaaacaggtcacaggtagattcgaggaagagttcatcaagatgaggatggagagactccaagcatggatgacccggatgtgccgacaccccgttattagcgaatccgaggtttttcagcagtttttgaactttcgggatgagaaggaatggaaaaccgggaaaagaaaagccgagcgcgacgaactggcaggagtgatgatcttctccacaatggagccagaggctccagacctggatctggtggaaatcgagcagaaatgcgaggccgttggaaagttcaccaaggctatggatgacggagtgaaggagctgctaaccgtgggtcaggagcactggaaacgatgcactggccctcttccaaaggagtaccagaaaattggtaaagcccttcagtccctcgccactgtgttcagcagttctgggtaccaaggagagaccgacctgaacgatgccataaccgaagctggaaagacctatgaggaaatcgctagtctggtggccgaacaaccgaagaaggacctccattttctcatggaatgcaatcatgaatacaagggcttcctggggtgctttccagacataataggtactcacaagggtgcaatcgagaaggttaaggaatctgataagctcgtggctactagtaaaattacactccaggataagcagaacatggtgaaacgggtctctatcatgtcatacgctttacaggccgagatgaatcacttccactccaatagaatatatgactacaattcagtgattaggctttatcttgagcagcaggtccagttctacgaaacaatcgccgagaaattgcggcaggctttatctagattcccagtgatgtag

SEQ ID NO: 206583 - DNA, 1788 bp, Artificial Sequence
  Description of Artificial Sequence: Synthetic coding sequence
atggccaccaaggcccgggtgatgtacgacttcgccgccgagcccggaaataatgaactcacagttaacgagggtgaaattatcaccatcacaaatcctgacgtgggcggtggttggttggagggccgcaacattaagggcgaacgcgggttagttcctacggactatgtcgaaatcttgccctctgacggaaaggatcagtttagctgcggaaattccgtggcggatcaagcctttctagattcactcagcgcctccaccgcccaagcttcatctagcgctgccagtaataatcaccaggtgggctctggcaatgacccatggtccgcctggtccgcctctaagtctggcaactgggagtcgagcgaaggctggggagcacaaccggagggcgcaggggcacagcgaaacacgaacactcccaataattgggacaccgcattcggacatccccaggcttaccagggccctgccactggagatgacgatgactgggacgaggattgggacgggccaaaaagcagttcctatttcaaagacagtgaatccgcagacgccggtggggcacagagggggaactcacgcgcctcctccagtagcatgaagatcccattgaacaagttcccaggatttgctaagcctgggactgagcagtatttgcttgccaagcaactcgccaaacccaaggaaaaaattccaattatagttggggattacggcccaatgtgggtataccctacttcaacatttgattgtgtcgtggcagacccacgtaaagggtctaaaatgtacggcctgaagagttatattgaataccaacttacaccaaccaacactaatagaagcgtcaatcataggtacaaacacttcgattggctgtacgagcgcctgctcgtcaagttcggctccgccataccgattccctccctgcctgacaagcaggtaaccggccgcttcgaggaggagttcattaaaatgcggatggagagactccaggcgtggatgacaaggatgtgcagacacccagttatttctgaatcggaggtcttccaacagttcctcaactttagagatgaaaaggaatggaaaacagggaaacggaaagctgaacgagatgagctagcaggcgtcatgatttttagcactatggaacccgaggctccagacctggacctggtggagattgaacagaagtgcgaagcagtgggcaaatttactaaggcaatggatgatggcgttaaagagctgcttaccgtgggtcaggagcattggaagcggtgtacaggccctctaccaaaggaatatcagaaaatcgggaaggccttgcagtctctcgcgaccgtgttcagcagttctggttaccaaggggagaccgacctaaatgacgctatcactgaagcaggcaagacatacgaagaaatcgcatcactggtggccgaacaacctaaaaaagacctccattttctgatggaatgtaaccatgaatacaagggatttctggggtgttttcctgacatcatcggaacccacaagggagctatcgaaaaagtaaaagagtccgacaaactggtcgccaccagtaaaattactctgcaagataagcagaacatggtgaagagagtgtccataatgagctacgcccttcaggcagaaatgaaccacttccattccaatcgcatctatgactacaattcggttattagactgtatctcgagcaacaggttcagttttacgagaccattgccgaaaagctgcggcaggccttgagtcggttccccgttatgtag

SEQ ID NO: 206584 - DNA, 1788 bp, Artificial Sequence
  Description of Artificial Sequence: Synthetic coding sequence
atggccaccaaggcccgggtgatgtacgacttcgccgccgagcccggaaacaatgaactgacagtgaatgagggcgaaatcatcactatcacaaaccccgatgtgggcggagggtggctcgaagggcgcaatatcaagggagagagagggctggtgcccaccgattacgtggaaatcctaccaagtgatggtaaggaccagttcagctgcggcaactctgtggcagaccaggctttccttgacagcctctctgccagtaccgcccaggcttccagctccgcggcctcaaataatcaccaggtgggctcagggaacgatccttggtctgcctggagtgcctctaagtccggaaattgggaaagtagtgaaggctggggagcacagcccgaaggcgctggtgcgcagcgaaacaccaacacacctaacaactgggacacggcatttggacatccgcaagcttaccagggaccagctacaggggatgacgatgactgggatgaagattgggacggcccaaagagctcaagctacttcaaggactccgagtctgctgacgccggtggtgcccagagaggaaatagccgcgcctcttcctcgtctatgaaaatccccctcaacaagttccccggtttcgccaagcctggtacagagcagtatctcctcgcgaagcagctcgccaaacctaaggaaaagatcccaattatcgtgggagactatggtcctatgtgggtgtaccccacaagcacctttgactgcgttgtcgctgatccaagaaagggctctaagatgtacggacttaaatcctacattgagtaccaattaacacctactaacaccaacaggagtgtcaatcaccgctacaagcatttcgactggctctacgagcgcttgctggtaaagttcggttctgcgattcccattccatcattgcccgataagcaggtgactgggcgtttcgaggaagaatttattaaaatgaggatggagcgccttcaggcttggatgacacgaatgtgtagacatcctgtcatttccgagtcagaagtattccagcagttcctgaacttccgcgacgaaaaggaatggaagactggaaaacggaaagccgagagagatgaactggcaggagtgatgatattttctacaatggaacctgaagcaccggatctcgacctcgtggagatcgagcaaaaatgtgaagccgtggggaaatttaccaaagcgatggatgatggagtgaaggagttgctgaccgtgggccaggaacactggaaaaggtgtactggtccgctacccaaggaataccagaaaatcgggaaggcgctccagtccctagcaacagtgttcagctcaagcgggtaccagggagagacagacctgaacgacgccataactgaagccgggaagacctatgaggagatcgccagcctggtggccgaacagccaaaaaaggacctgcactttttgatggagtgcaatcatgaatacaaggggttcctcggatgcttccccgacatcattgggacccataagggcgccattgaaaaggtgaaagagtccgacaagctcgtcgcgacctctaagatcaccttacaggacaagcagaatatggtcaagagggtgagtatcatgagttacgcgctgcaagccgagatgaaccattttcattctaaccgcatctatgactacaattcagtcatcaggctttaccttgaacagcaggttcagttctacgagaccatcgcggaaaaactgcgacaggccctcagccgctttccagtcatgtag

SEQ ID NO: 206585 - DNA, 1308 bp, Artificial Sequence
  Description of Artificial Sequence: Synthetic coding sequence
atgggcctgagcttcagcctgttccccctgcggaaccacgtgaacgtggagggagccacgcataagcaggtcgtggatctgatcagagcgggtgaaaaggaactgattttgacagtcctctcggtcccgccacatgaagccgataacctcgaccccagcgatgactcactaggtcagtccttctacgattataccgaaaagcaagcagttcctatttctgtgcctcgctacaagcatgtcgaacagaacggggaaaaatttgttgtttataatgtttacatggcaggcaggcagttgtgtagtaagcggtatcgcgagttcgccatactacaccaaaatctcaagcgggagtttgcaaatttcacttttcctcgccttcccgggaagtggcctttcagcctgagcgaacagcagctggacgcccgacggcggggccttgaggaatacctggaaaaggtgtgtagcatccgagtcattggcgagagcgatataatgcaggagttcctgtctgagagtgacgagaattacaacggcgttagtgacgtggaattgcgagtagcccttccggatggcactaccgtaacagtgcgggtaaaaaaaaatagcacgaccgatcaggtgtaccaggccattgccgcaaaggtgggcatggattccaccactgttaattactttgccctctttgaagtgatctcccactcctttgtgcggaaacttgcccccaacgaattccctcataagctctatatacagaactacacaagtgccgtgcctggaacatgccttaccatccggaaatggctgttcaccacggaagaagaaattttgttaaatgataacgatctggcggtcacttactttttccatcaggctgtcgacgacgtcaaaaagggttatataaaggccgaggagaaaagctatcagttgcagaaactgtacgaacagagaaaaatggtgatgtacctcaatatgctgcggacatgtgaaggctataacgaaatcattttcccccattgtgcatgcgactcaagaagaaagggtcacgtaataacagccatctcaataactcactttaagttgcatgcatgcactgaggaaggccaactcgagaatcaggtaatcgcctttgagtgggatgagatgcaaaggtgggacaccgacgaggaaggcatggccttctgctttgagtacgccaggggcgagaagaagcccagatgggtgaaaatcttcacgccatactttaattacatgcacgagtgtttcgagcgggttttttgcgagctaaagtggcggaaggaggagtactag

SEQ ID NO: 206586 - DNA, 1587 bp, Artificial Sequence
  Description of Artificial Sequence: Synthetic coding sequence
atggccgacgaggacggcgagggcatccaccccagcgccccccacaggaatggcgggggcgggggcggaggcggatccggacttcactgtgcaggaaatggtggcggaggaggcgggggtcctcgtgtcgtgcgtatcgttaagtctgagagtgggtatggtttcaatgtgaggggtcaagtgtccgagggtgggcagctgcgcagtatcaacggtgagctgtacgcccccctccagcatgtttcagccgtccttcccggaggtgcagcagaccgagccggcgtccggaagggcgacaggattctcgaagtgaatcatgtcaatgtggaaggagccacccataaacaagtggtggaccttatcagagccggagaaaaagaactaatcctgactgtcctgtccgtgccccctcacgaggcagataacctagacccgagcgacgatagcctgggccagagcttttacgactataccgaaaagcaggcagttcctatcagtgtgccacgctataagcacgtggagcagaatggagagaagttcgtcgtatataatgtgtatatggctggccggcagctttgctcaaaaaggtatcgagagttcgctatactccaccagaacttgaaaagagagtttgccaacttcacattcccgcgcctgcctgggaagtggcctttctctttatcggagcagcagttggatgcgcggaggaggggcttggaggagtacctggaaaaagtatgttcgatcagggtcatcggagagagcgacattatgcaggagttcttatctgaaagtgatgagaattataatggtgtgtcggacgtcgaactccgcgtagctctcccagacggaactactgtaactgtccgagttaaaaaaaactccactaccgatcaagtgtaccaggctatagccgccaaggttggaatggatagcaccacagttaattattttgcactgttcgaagtcatcagtcacagctttgtcagaaaactagccccaaatgagtttccccataaactctacatccagaattatactagtgctgtaccaggcacgtgccttacaatcagaaagtggctcttcaccaccgaagaagagatccttcttaacgataacgatcttgccgtgacctattttttccaccaggcagtagatgatgtaaagaagggctacatcaaagcagaggagaagtcttatcagctccagaaactatatgagcaacggaagatggtcatgtatctgaatatgttaaggacttgcgaaggctacaacgaaatcattttcccacattgtgcatgtgacagcaggcgcaaggggcatgtgattaccgccatatccattactcatttcaagcttcacgcctgtaccgaggaaggccagctggaaaaccaagtcattgcgtttgagtgggatgagatgcaacgatgggacactgacgaagagggaatggccttttgttttgagtatgccaggggagagaagaaaccccgatgggtgaagatcttcaccccatattttaactacatgcacgagtgcttcgaaagagtgttttgcgaattaaagtggagaaaggaggagtattag

SEQ ID NO: 206587 - DNA, 1626 bp, Artificial Sequence
  Description of Artificial Sequence: Synthetic coding sequence
atggccgacgaggacggcgagggcatccaccccagcgccccccacagaaacggcggaggcgggggtggcggtggcagcggcctgcactgcgcaggaaacgggggcggcggaggtgggggcccgagagttgttagaattgtgaaaagtgagagcgggtacgggttcaacgtgcgagggcaagtgagcgaaggagggcaactccgctccataaacggagagctctatgcccccctgcaacacgtctctgccgtgctgcctggcggcgccgctgaccgggctggcgtgcggaagggtgataggattctcgaggtcaatcatgtgaacgtggagggggctactcataagcaggtggtcgatttgatacgggcaggagaaaaggaattaattttaactgtgttgtccgtgccacctcatgaagctgataatctagacccctcagacgattcactgggccagtcgttttatgactatactgagaagcaggctgtcccaatctcagtgcctcgatacaagcatgtcgaacagaacggagagaagttcgtcgtatataacgtctacatggccggaagacagctctgctccaaacgctatagagagttcgcaattctccatcagaatctgaagcgcgaattcgcgaattttacatttcctcgtttgcctgggaaatggccgttctcgctgtctgagcagcagctggatgcccgcagaagagggttggaagagtaccttgagaaggtctgttccattagagtgatcggcgaaagcgacatcatgcaagagtttttgagcgaatccgacgagaattataacggagtcagcgacgtggagcttcgggtcgccctccccgatggaaccaccgtaactgtccgcgttaagaaaaactctaccacagatcaagtttaccaggccattgccgccaaagtaggtatggactctacgactgtcaattactttgccctctttgaggtgatctctcacagctttgttcggaagcttgcccccaatgaattccctcataagctgtacattcaaaattacacaagcgccgttcccggaacttgcctgaccataaggaagtggctttttactacagaagaggagattctcctgaatgacaatgatctggccgtgacctacttttttcatcaggccgtggacgacgttaagaaaggatacatcaaggcagaggagaaaagttatcagttacagaagctctacgaacaaagaaagatggtgatgtacttgaacatgctaaggacatgcgaaggctacaatgagatcatctttccacactgtgcttgcgattcccgcaggaagggccatgtcattaccgccatcagtatcacacactttaagctacatgcatgtactgaagagggacagctcgaaaaccaggtgatagcattcgagtgggatgaaatgcagaggtgggataccgacgaagagggcatggcgttttgctttgaatatgctcgcggcgaaaagaagccccggtgggtaaagatttttactccctatttcaattatatgcatgagtgttttgagagggtgttctgcgagctaaaatggcgcaaggagaacattttccagatggctagaagccagcagagagatgttgcaacctag

SEQ ID NO: 206588 - DNA, 2640 bp, Artificial Sequence
  Description of Artificial Sequence: Synthetic coding sequence
atggccggcggcggcggcgacctgagcacccggcggctgaacgagtgcatctctccagtagcaaatgagatgaaccacttgcccgcccattcgcatgacctgcaacgaatgtttacagaagatcaaggcgtagacgatcggcttttgtacgatattgtgtttaagcactttaagcgcaataaagtcgagattagcaatgccattaagaagacctttcctttcttggagggcctcagggaccgagatctcatcaccaataagatgttcgaagacagccaggatagctgccgtaacctcgtgccggtccagagagtcgtgtataatgtcctgagcgagctggagaagaccttcaaccttcccgtgcttgaagcgctctttagtgacgtcaacatgcaggagtatcccgatctgatccacatctacaagggcttcgagaacgtaatccacgacaagttgcccctacaagaaagtgaggaggaggagagggaagaacggagcggcctccagttatccttagaacaggggacgggtgaaaatagcttccggagcctcacatggcccccgagtgggtccccaagtcacgccggtacaaccccacccgagaacggcttgtctgaacacccgtgtgagacagagcagatcaacgccaaacgaaaggacaccacatccgacaaggacgatagccttggctcccaacaaaccaacgagcaatgtgcccagaaggcagaaccgaccgaaagctgcgaacagatagcggtgcaggtgaacaacggagacgccggacgtgaaatgccttgtccattgccttgtgacgaggaaagcccagaggcagagcttcataatcatggcatacaaattaatagctgctctgtgagactcgtggatataaagaaggaaaagcccttttcaaattcaaaggttgagtgtcaggcccaggccagaacacatcacaaccaagccagcgatattattgttatatccagtgaagactctgaggggagcactgatgtggacgagcctctggaggtgttcatcagcgccccgcgatcagagcctgtgattaacaacgacaaccccttagaatcgaatgacgagaaagagggacaggaggcgacgtgtagcagaccccagattgtcccggaacccatggactttcggaagctctctacgttcagagaaagttttaaaaagagagtgattggtcaggaccacgatttttccgaaagctctgaggaagaagctcccgccgaggcatcatccggcgccttgcgcagcaaacatggagagaaggctccaatgactagccgcagcacctcaacctggagaattccgtcacgaaaaagacgcttttctagttctgattttagcgacctctcaaatggagaagaattgcaggagacttgctctagcagcctaaggagaggttcaggaagccagcctcaggaacccgagaataagaaatgcagttgtgtaatgtgttttcctaaaggcgttccccgtagccaggaggcccgaacagaaagctctcaggcttcagatatgatggatactatggacgttgaaaataactcaactctggagaagcactccggcaaaagacgtaagaaacggcgacataggtcaaaggtcaacgggctgcagagaggtagaaagaaggaccgccccagaaagcaccttaccctgaataacaaagtgcagaagaagcgctggcagcagcgcggcaggaaggcaaacacgcgaccactgaagcgaaggagaaagaggggcccacgtattccaaaggatgagaacatcaactttaagcagagcgagctccctgttacctgcggtgaggtcaaagggacattgtacaaggaacgattcaagcagggtactagtaagaagtgtattcagtccgaggataagaagtggttcactccacgcgaattcgagatagagggggaccggggcgccagcaaaaactggaaattgtcaatccgctgtggaggctataccctgaaagttctgatggagaacaagttccttcccgagcctccatctactaggaaaaagcgcattctggagagtcacaacaacaccctggttgacccttgtgaggaacacaagaagaaaaatccagacgcctctgtgaaattctccgaatttctgaagaaatgcagtgaaacctggaagacgatatttgcaaaagaaaaaggcaaatttgaagatatggcaaaggccgataaagcgcactatgaaagagagatgaaaacttatatcccacctaagggcgagaagaaaaagaagttcaaagatccaaacgcccccaagcggccaccactggccttttttctgttctgtagtgagtacaggcctaagattaagggagaacatccgggtctgagtattgacgacgttgtgaaaaaacttgccggtatgtggaataacactgctgctgctgacaaacagttttatgaaaaaaaggcagcaaaactgaaggagaagtacaagaaggacatagccgcctaccgggccaagggaaagccgaactccgctaagaaaagagtggtcaaggccgaaaaatccaaaaaaaaaaaggaggaggaggaggacgaggaagatgaacaggaggaagaaaatgaagaagacgatgacaagtag

SEQ ID NO: 206589 - DNA, 2658 bp, Artificial Sequence
  Description of Artificial Sequence: Synthetic coding sequence
atggccggcggcggcggcgacctgagcacccggcggctgaacgagtgcataagtcccgtcgctaacgagatgaaccacctcccagcacattctcacgacctgcaaaggatgttcactgaggatcagggcgtggacgatcgtttgctttatgacattgtgttcaaacactttaaaaggaataaagttgaaatctcaaacgcgattaagaagaccttcccctttttagagggcttgcgcgatcgggatctaatcaccaacaagatgtttgaagatagtcaggactcttgccgcaaccttgtgcctgtgcagcgtgttgtgtataatgtgctgtcagagctggagaaaaccttcaatcttcctgtgctagaggctctcttttccgatgtcaatatgcaagagtatccggatctgatacacatttacaagggctttgaaaacgtcatacacgataaactgccgttgcaggagtccgaggaagaggaacgggaagagcggagcggtctccagctgtccttggaacagggaaccggagaaaactcgtttcggtctctgacctggcccccctcaggatccccctctcacgcaggaacgactcctcctgagaatgggctctcagaacacccatgcgaaacagagcagatcaatgccaagagaaaggacaccactagcgacaaagatgatagcctaggatcacagcagactaacgagcaatgcgcacaaaaggcagagccaaccgaatcatgcgaacagattgctgtccaggtgaataatggcgatgctgggcgcgaaatgccatgcccacttccttgtgacgaagagagcccagaagctgaactgcacaaccacggcatccagataaactcttgcagtgtccgactcgtggatatcaagaaggaaaaacccttcagcaacagtaaagtcgagtgccaggcccaggctcggactcatcacaatcaggcctcagacataatcgtgattagctctgaggatagcgaagggtcaactgacgttgatgaacctctcgaggtcttcatcagcgctccacgttccgaaccagtcattaataacgataaccccttggagtctaacgacgaaaaggaggggcaggaggcaacatgtagtcgcccccagatcgttcccgagcctatggatttccgcaagctgtctaccttcagagaatcattcaaaaaaagggtgatcgggcaggaccatgacttttcagagagcagcgaggaagaggccccagccgaggctagctctggagctctgcgcagtaagcacggagaaaaagccccaatgacttcccgatcaactagcacctggcggatcccctctagaaagagacggttttccagttcagacttctctgatctctctaacggagaagagttgcaggagacttgtagtagtagtctgcggcgcggctccggtagccaaccccaggagccggagaacaagaagtgctcctgtgtgatgtgctttcccaaaggggtgcctcgttctcaagaggctcggacagaatcctctcaagcctcagacatgatggacacaatggatgtggaaaacaacagcacactcgagaaacactcaggcaagagaaggaagaagaggcgtcacagaagtaaagtcaacggtctccagagggggcggaaaaaagatcgtccacgaaagcatctcacactgaataacaaggtgcaaaaaaaacgatggcagcagcgcgggcgtaaagcaaatactcgccctttgaagagacgcaggaagcgaggccctcgtattcccaaggacgagaatattaacttcaagcagagcgaattgcctgtcacctgtggtgaggttaaggggactctctacaaggaaagatttaagcagggaacgtctaagaagtgcatacagtccgaagataagaaatggtttaccccaagggaatttgagatcgaaggggaccgcggcgctagtaagaactggaagctgtccatccggtgcggaggctatacgctgaaggtccttatggaaaataaatttctgcctgagccgccctcgactagaaagaaacggattttagagagtcacaacaacacactggtagatccttgccctgagaattccaacatatgcgaagtttgtaacaaatggggacgcctcttctgttgcgatacctgccccagatccttccatgagcattgccatattccgtcagtggaagcaaacaagaatccctggagctgtatattctgccgcattaaaaccatacaagagagatgtcctgagtcccagtctgggcatcaggagagcgaagtcctcatgcgtcagatgctgccagaggaacagctaaagtgcgagtttctcctgttaaaagtgtactgcgattctaagtcctgtttcttcgccagtgagccatactataatagggagggatcccaaggtccccagaaacccatgtggctgaacaaggtgaagacctccctgaatgagcagatgtatacccgtgtcgagggtttcgttcaagacatgaggctcatatttcacaaccacaaagaattctacagggaagacaagtttacccgtttgggcattcaggttcaagacattttcgagaagaacttccgcaatatttttgccatccaagagacctcaaagaacatcatcatgttcatctag

SEQ ID NO: 206590 - DNA, 1422 bp, Artificial Sequence
  Description of Artificial Sequence: Synthetic coding sequence
atggccggcggcggcggcgacctgagcacccggcggctgaacgagtgcatcagcccggttgctaatgagatgaaccatttgcctgctcacagtcacgacctgcaaaggatgttcactgaggatcaaggggtggacgaccggctcctctacgacatcgtgtttaagcatttcaaaaggaataaagtcgagatctccaacgctataaaaaagaccttccccttcctggaggggcttcgagaccgcgacctgatcaccaacaagatgtttgaagacagccaggactcctgcaggaatcttgtcccagtgcaaagggtcgtctacaatgtgttgtccgagctggagaaaacctttaatcttcccgtgctggaggccctgttctccgacgtcaacatgcaggagtaccccgacctcattcacatttataagggattcgagaacgtcattcacgacaagctcccactgcaggaaagcgaagaagaagaaagggaggaaaggagcggactccagctctctttggaacagggcactggtgagaatagctttagatccctcacttggcccccatcgggctctccttcacatgcaggcaccactcctcctgagaatggcctcagcgagcatccttgtgagactgaacagatcaatgcgaaacgcaaagacacaacgtcggataaagacgacagcctgggatcccaacagaccaacgaacagtgcgcccagaaggcagagccgacagaatcctgtgaacaaatagcagttcaggtaaacaacggagacgctggcagggagatgccttgtcctctcccatgcgatgaagagagccctgaggctgagttgcataatcacgggatccagatcaattcgtgtagcgtccggctggtggacatcaagaaggagaaacccttttccaacagtaaggtggagtgtcaggcccaggcgcgtacgcaccacaaccaggccagcgacatcattgtgatttcaagcgaagatagcgagggctcaaccgacgtggacgagccattggaagtgttcatttccgcaccccgcagtgaaccggtaatcaacaacgataaccccttggagagcaacgatgaaaaggaaggacaggaagcaacctgtagcaggcctcaaattgtccctgaaccaatggactttaggaaacttagcacttttcgggagagcttcaagaaaagggtgatcggccaagaccacgactttagtgagtcctcagaagaagaggctccagccgaggctagcagcggagccctgcgtagcaaacacggtgagaaggcaccaatgacttcccggagtacatctacttggagaattccatcacggaagcgccagcttaaaaagaaaaagaaaaagaagcaatgtcaccctcagcctcaaccccagagaggcctcctcgaacaaagctag

SEQ ID NO: 206591 - DNA, 2067 bp, Artificial Sequence
  Description of Artificial Sequence: Synthetic coding sequence
atggccggcggcggcggcgacctgagcacccggcggctgaacgagtgcatctctcccgtggccaatgagatgaaccatttaccggcccactcacacgacctccagcgcatgttcacggaggaccagggcgtggatgacaggctgctctatgacatcgtcttcaaacactttaaaaggaacaaagtggagatcagtaatgcaataaaaaagacttttccattcttagaaggtctgcgtgaccgcgacttaatcaccaataagatgtttgaggactcacaggactcatgtcggaatttggtgcctgttcagagggtcgtgtataacgtactgagcgaattagaaaagaccttcaatctcccagtgctggaagcactcttctcggatgtcaatatgcaggagtatcctgatctgatccacatctataagggattcgaaaacgtcatccacgataagcttccactgcaggaatctgaggaggaggagagagaggaacgttctggtctccaactgtccctggagcagggcaccggcgaaaattccttccgaagcctgacgtggcctccatccggctcccctagtcacgccggcaccaccccccctgagaacggcctctctgagcatccttgcgaaacagaacaaataaatgccaaacgtaaggacaccacaagcgacaaagacgactccctcggtagtcagcagaccaacgagcagtgcgcacaaaaggctgagccaacagaaagctgcgagcaaatcgctgtgcaggtaaataatggcgacgccggacgggagatgccctgtccactgccttgtgacgaggagtcccccgaggctgagttgcacaaccatgggattcaaatcaattcctgttccgtgaggttagtggatattaagaaggaaaagccctttagcaatagtaaggtagagtgtcaggcacaggcgcggactcatcataaccaggctagtgacatcattgtgatctcctccgaggacagtgaaggctctactgacgtggacgaacccctggaggtgttcatcagcgccccacggtctgagccagtgataaataacgataatccactggagagcaatgacgagaaagaagggcaggaggcaacttgctcccggccccagattgtgcccgagcccatggacttccgtaagttgagcacgtttcgggaatcttttaaaaaaagagttataggccaggaccatgacttttccgaaagttctgaggaagaggcaccggccgaagcttccagcggagcccttcgtagcaagcacggcgaaaaagctccaatgacttctaggagcacatctacttggcggatcccctctagaaagcgacggttctcttctagtgacttttctgatctgagcaatggcgaggagctgcaggaaacatgctcttcatctcttagacggggatcaggttctcaaccacaggagcccgagaacaagaagtgtagctgcgtcatgtgttttccgaagggtgttcccagaagccaggaagccaggactgagagtagtcaggcgagtgatatgatggacacaatggacgtggaaaacaacagtaccttggagaagcacagtggcaaacgtcggaagaaacgcagacaccgtagcaaggtcaatgggctccagcgcggacgaaagaaggacagacccagaaaacacctcacactaaacaataaagttcagaaaaagcggtggcagcaacggggaaggaaggccaacacgagacctctgaagcgccgcaggaaaagggggccccgtatccccaaggacgaaaatatcaattttaaacaatctgagcttcctgtgacctgtggcgaggtgaaaggaacgctctacaaggaaagatttaagcaaggaacttccaagaagtgcattcagtccgaagataagaagtggttcacaccacgagagttcgagatagagggagaccgcggagcttctaaaaattggaaactctcaatccgatgtgggggctatacattaaaggttctgatggaaaacaaatttctgcccgagccgccctccacacgcaaaaaggtgatgatcaaatag

SEQ ID NO: 206592 - DNA, 1443 bp, Artificial Sequence
  Description of Artificial Sequence: Synthetic coding sequence
atggccggcggcggcggcgacctgagcacccggcggctgaacgagtgtatttccccggtcgctaatgaaatgaatcacctccccgcacattcccacgaccttcagcggatgtttaccgaggatcagggggtcgatgaccgtctgttgtacgatatagtctttaaacacttcaagaggaacaaagttgagatctccaacgcaattaaaaaaacattccctttcttggaaggtctgcgggatagagatctcattactaacaagatgttcgaagactctcaggacagctgtcgaaatcttgtgccagtgcagcgagtggtgtacaacgtgctgagcgaactggagaaaacgttcaatctaccagtgctcgaggctttattctcggatgtgaacatgcaggaatacccggaccttattcatatttataaggggttcgaaaacgtaatccacgataagctccccctgcaggaatccgaggaggaagagagggaggaaagaagcggactgcagctgtcccttgaacaaggaacgggcgagaactccttccgcagcctgacatggcccccctcgggcagcccttcgcatgcaggaacaaccccgcccgagaatggactgtctgagcatccatgcgaaaccgaacagattaatgctaagcggaaagacacaacaagtgacaaggatgacagcctagggtcgcagcagacaaacgagcagtgtgctcagaaggccgagcctacagagagttgcgaacagattgcagtacaggtaaacaatggcgatgctgggcgcgagatgccctgcccactgccttgcgacgaggagagccccgaagccgagttgcataatcacggcattcagattaattcatgttctgttcggctggtcgacatcaaaaaagagaaaccattttctaatagtaaagtggagtgccaagcacaggcgcggacccatcataaccaggcaagcgatatcatcgtgatctcttcagaggacagcgagggctctactgatgtggacgaaccgctggaggtgttcatttcagctccgaggtcagaacccgtgattaacaacgataatcctctggaaagcaatgatgagaaggaaggacaggaggcaacctgctcacggccccagattgtgccagagcctatggactttaggaagttgagcacatttcgagaaagcttcaaaaagagggtgattggacaggaccacgattttagcgagtctagcgaggaagaggcccccgccgaagcatcaagtggtgcgctccgctccaagcatggcgagaaggccccaatgaccagtaggtcaacatctacttggcgcataccttccagaaagcggcgctttagttccagcgacttttcagacctgtccaatggcgaagagctgcaagagacttgttcatccagtttgagacgcggctccgggaaagaggactag

SEQ ID NO: 206593 - DNA, 1068 bp, Artificial Sequence
  Description of Artificial Sequence: Synthetic coding sequence
atggacgtggagaacaacagcaccctggagaagcacagcggcaagagaagaaagaaacgacgacaccggtccaaagtcaacggccttcagcgcggccgtaagaaggaccgtcctaggaagcaccttacactaaataacaaagttcagaaaaagcgctggcagcagcgggggaggaaggcgaatacacgtccactgaagcggcggcgtaagagagggcctaggatacccaaagacgagaacatcaattttaaacagagcgagctccctgtcacctgtggtgaagtcaaaggcaccctatataaggaacggtttaaacagggtacctctaagaagtgcattcagagtgaagataagaaatggtttacaccaagggaatttgagatcgaaggggatcggggggcatctaaaaattggaaactcagtatccggtgtggaggctacactttgaaagtactgatggagcgcattcttgaatctcacaacaatacactcgtggatccgtgcccagaaaactctaacatatgtgaggtgtgcaacaaatgggggaggctcttctgctgcgacacctgcccaagatctttccatgagcactgccacatcccttctgtggaggccaacaaaaacccctggagctgtatcttctgccggatcaaaacaattcaggaacgttgtccagagtcccaatctggccaccaggagagcgaggttcttatgcgacagatgctgcctgaggagcaactcaaatgcgagttcctgctcctaaaagtttactgcgatagcaaatcctgtttcttcgccagcgagccttattataaccgggagggatctcagggcccccagaagccgatgtggctgaataaggtcaagacctcactcaatgaacagatgtacacccgggtggaaggcttcgtacaagacatgagattgatctttcacaaccacaaggagttctaccgggaggacaaatttacacggctgggaattcaggtccaggacatcttcgaaaagaattttcgcaacatcttcgcaatccaggaaacttccaaaaacattatcatgttcatctag

SEQ ID NO: 206594 - DNA, 1359 bp, Artificial Sequence
  Description of Artificial Sequence: Synthetic coding sequence
atggccggcggcggcggcgacctgagcacccggatgttcaccgaggatcagggagtggacgatcgattgctgtatgatatcgtttttaaacatttcaaacggaataaggtggagattagcaatgcaattaaaaaaacttttccattcctagaaggcctgcgcgaccgggacctgattacgaacaaaatgtttgaagatagtcaagattcctgtcgaaatttggtacccgtgcaaagagtggtatacaacgtcctctcggaattagaaaaaacatttaaccttcccgtgctagaggctctcttcagcgacgtcaacatgcaggaatacccggatttgattcacatctataaggggtttgagaacgtgattcacgataagctgccacttcaggagtctgaggaggaggagcgcgaagaaagaagcggcctgcagctgagcctggaacagggcaccggtgagaattcatttcgatcattgacctggcccccctccggcagtccaagccatgctgggaccactccacctgagaacggtctttcagagcatccctgtgagacagaacagatcaacgctaagaggaaggacaccacgagcgataaagatgactctctgggttcccagcagaccaatgagcaatgtgcgcaaaaagccgaacctaccgagagctgtgagcagatcgccgtgcaggtgaataatggtgacgccggcagagagatgccctgccccctgccttgcgacgaggaatcccccgaagccgaacttcacaatcacggcatacagatcaacagctgtagcgtgcgcttggtggatatcaagaaagaaaagccctttagcaattccaaggttgagtgccaggcacaggctagaacgcaccataaccaggcctctgacatcattgtgatatcgtcagaggatagcgaaggctccacagacgtggatgaacctctcgaagtctttattagcgcaccaagatcagaaccagtgattaacaacgataacccgctggagagcaacgatgagaaagaaggccaggaagccacatgttccaggccccagatagtccccgagccgatggattttcgcaaactctcgactttccgagagtcatttaaaaagagggtcatcggacaggatcatgacttttctgagagttccgaagaggaggctcccgctgaggcctccagtggagctctccgaagtaagcatgcccccatgactagtaggtctactagcacgtggcgtattccgtcccgcaaacgcagatttagttcaagcgatttctcagacctgtccaatggagaggaattacaggaaacctgtagtagctcacttcgccgaggctccggcaaggaggactag

SEQ ID NO: 206595 - DNA, 1338 bp, Artificial Sequence
  Description of Artificial Sequence: Synthetic coding sequence
atgatgttcaccgaggaccagggcgtggacgaccggctgctgtacgatatcgtgtttaagcactttaagcggaacaaggtggagatttcaaacgcgattaagaaaacgttcccttttctcgagggactgagggaccgagacctcatcacaaataagatgtttgaggatagtcaggacagttgtcggaaccttgttccagtccagcgggttgtatataacgtcctgtctgaactggagaagacttttaaccttccagtcctggaagcccttttcagtgatgtgaatatgcaggagtaccccgatctaatacacatttacaaggggtttgagaacgtaattcacgataaactgccacttcaggagagcgaagaggaagaaagagaggaacgttctgggctgcaattaagtctggaacagggcaccggagagaattcttttcggtcactgacttggcctcccagcgggtctccatcgcacgccggcacaacccctcccgagaatggcctttcagagcacccctgtgagacggagcaaatcaatgccaagaggaaagataccacaagcgataaggacgacagtcttggatctcagcagaccaacgagcagtgcgcgcagaaagctgaacccactgagagctgtgagcagatcgctgtacaggttaacaacggagacgctggccgcgagatgccgtgcccattaccttgtgacgaagaatcacccgaggcagagctgcacaaccacggcatccagatcaactcttgttccgtgcgcctggtggacatcaagaaagagaaacccttttctaactccaaggtggagtgtcaggcccaggccaggacacatcacaatcaggcatcagatataatcgttatctctagtgaagacagcgagggcagcactgatgtcgatgagcccctggaagtgtttatatccgcacccagaagcgagcctgtaattaataacgataaccccttggaatccaatgatgaaaaggaaggacaagaagctacttgtagtagaccacagatcgtgcccgaacccatggatttccgcaagctgtcgacctttcgcgagtccttcaaaaagcgggtgatcgggcaggatcacgatttcagcgagagcagcgaagaagaggcacctgcagaggcctcctcaggcgcgctcagaagcaaacatggtgaaaaggccccaatgacatcccgctcaacttccacttggcgcatcccctcgcggaagcggcgtttcagctccagtgacttttcagacctctcaaatggagaggaactgcaggaaacatgcagcagctctctccgacgcggcagtggaaaggaagattag

SEQ ID NO: 206596 - DNA, 2142 bp, Artificial Sequence
  Description of Artificial Sequence: Synthetic coding sequence
atgttcaccatgacccgggccatggaggaggccctgttccagcacttcatgcaccagaagttaggcattgcgtatgctatccacaagccctttccattctttgaggggttgctggacaattctattataacaaagcggatgtacatggagagcttggaggcatgcagaaacctgatcccagtatcacgagtagttcataacatacttacccagctggagcgcacctttaatctgtccctacttgtcacactgtttagtcaaatcaatctccgcgagtaccctaatctggtgaccatctaccgttcgttcaagagggtgggcgcaagttatgagtggcagtctagagatactcctattctgttggaagccccaacaggattggccgaggggagcagtctccatacacccctcgcacttccccccccacagcctccccaacctagctgttccccgtgtgctcctcgggttagtgaaccaggcactagctcgcagcaaagtgacgagatactgagcgagagccccagcccctccgatcctgtgctgcctctcccagccttaatccaggagggcagatccaccagcgtaactaatgataaactcacatcaaaaatgaacgctgaagaagatagcgaggaaatgccctcactcctgactagcacagtacaggtggccagcgacaatctgatcccccaaatccgggataaagaagacccacaggaaatgccacattctcccctgggaagcatgcccgaaatccgtgataattcccccgagcctaatgatcctgaggaacctcaggaggtaagttcaacgcccagcgacaaaaagggcaagaagaggaaacggtgtatctggagcactccgaagcggcggcataagaagaaatcactgcctggggggactgcctcgagtagacacgggatacagaagaagctgaagagagtagatcaggtgccgcagaaaaaagatgatagcacatgtaattcaaccgttgaaactcgggcgcagaaggcacgaaccgagtgcgctcgcaaatcgcgatccgaggaaattattgatggaacgtcagagatgaacgagggtaaacgctcacagaagaccccttccacgcctaggcgagtgactcagggcgcggcgagccctgggcacggcatccaagagaagttgcaggtcgttgataaggttacacagcgtaaggacgatagcacatggaactccgaggtgatgatgcgtgtccaaaaggcccgtacgaagtgtgccagaaagtctaggctgaaagaaaaaaagaaagaaaaggacatttgctcatcaagcaaacgacgctttcagaagaacatccaccgccgtggcaagcccaagtccgacactgtcgactttcactgctccaagctgcccgtcacctgtggggaggcaaaaggcattctatataagaaaaaaatgaagcatggctcttccgtcaagtgtattaggaatgaggatggaacttggctgactccgaatgagttcgaagttgagggtaaaggtcgtaacgccaagaattggaagcgtaatattaggtgtgaaggcatgacgcttggcgaactactgaagcggaaaaatagcgacgaatgcgaggtgtgttgtcagggaggacaattactttgctgcggcacatgtccccgcgtgtttcatgaagattgccacataccccctgtcgaagccaaacggatgttatggagctgcactttttgtagaatgaaacggagttctggatcacagcagtgtcaccacgtgagcaagacacttgaaagacaaatgcagccacaagaccaactgaagtgcgaatttctgctgctcaaagcttactgtcatcctcaatcttctttctttaccgggatcccgttcaacatacgagactacggggagccgttccaggaggctatgtggctagacttggtgaaggaacgactcatcactgaaatgtacaccgtagcttggtttgtgcgtgacatgcggctcatgtttaggaaccacaagacgttttacaaagcaagcgattttggtcaggtgggattagatctagaggcggaatttgagaaagaccttaaagacgtactaggttttcatgaggctaacgatggggggttttggactttgccttag

SEQ ID NO: 206597 - DNA, 1650 bp, Artificial Sequence
  Description of Artificial Sequence: Synthetic coding sequence
atgttcaccatgacccgggccatggaggaggccctgttccagcacttcatgcatcagaaactggggatcgcatatgcaattcacaagcccttcccttttttcgaaggcctcctggataattctataatcacaaaacggatgtatatggagtccctggaggcttgcagaaacctgattcctgtgagtcgcgtcgtgcacaacattctcactcagttggagcgcactttcaatcttagtttactggtcactctcttcagccagataaatctgcgtgagtatccgaatctggtgaccatttaccgcagctttaagcgggtgggcgcgtcctacgagtggcagtctcgagatactcccattctcctagaggctccgacaggcctagctgagggttcaagcttgcatacccccctggccctcccacccccgcagccgccacaacctagctgtagcccttgcgcgccacgggtgtccgagcctggaacatccagtcagcagtcggatgagatcctgtccgagtccccatcaccgagcgatccggtgctcccactgcctgctctgatacaagagggccggagcacaagtgtcactaatgacaaattgacttctaaaatgaatgccgaggaggactcagaggagatgccttccctgctaacttcaaccgtgcaggtagctagcgataacctgattccacaaatccgagacaaagaggatcctcaggaaatgccgcactcacctctcggctccatgcccgaaatccgggacaactcaccggaaccaaatgatccagaggaaccacaggaagttagctctacgcctagcgacaaaaagggcaaaaagagaaaaaggtgcatttggagtaccccaaagaggcgacacaagaagaaatcactacctggaggaaccgcctctagtagacacggcattcagaaaaagcttaagcgggtggatcaggtcccacagaaaaaagacgactccacatgcaactcaacggtcgagactagggcacaaaaggcacgcacagaatgtgcaagaaaatcacggtcggaagaaatcatcgatggaactagtgagatgaacgaaggtaaacggtcccagaagacaccctctaccccaagaagggtgactcaaggcgcagcctcaccaggacacggaatacaagagaagttgcaggtggtcgacaaagtgactcagaggaaggatgacagcacttggaacagcgaagtgatgatgcgtgtgcagaaagcgcggaccaagtgtgcaaggaagagtcggcttaaggagaaaaaaaaagaaaaagatatttgttccagctccaaaagaaggttccagaagaacatacaccgcagaggcaaaccaaaatccgatacggtggatttccactgctctaaattgccagtgacctgcggcgaggccaagggcatactttataagaaaaagatgaagcacggcagtagcgttaagtgtatcaggaatgaagatggaacgtggctgaccccaaacgaattcgaggttgagggaaaaggaaggaatgcaaaaaactggaagcgcaacatacggtgcgagggtatgaccctaggggaactgctaaagtccggccttctgctttgtccgccgcgaattaacctgaagcgggagctgaactcaaaatag

SEQ ID NO: 206598 - DNA, 756 bp, Artificial Sequence
  Description of Artificial Sequence: Synthetic coding sequence
atgcccgagatccgggacaacagccccgagcccaacgaccccgaggagccacaggaggtgtcctcaacgccaagtgataaaaaaggcaagaaaagaaaaaggtgcatatggtcgacgccgaagcggaggcacaagaaaaaatcgctgccaggcgaaattatcgatggtaccagtgagatgaacgaaggaaaaaggagtcagaaaacacccagcacaccaagaagagtaacgcagggcgctgcctcgccgggacatggcatccaggaaaagctgcaagtcgtggacaaagtgactcagcgaaaggacgacagcacttggaacagtgaagtaatgatgcgagtgcagaaagcacgcaccaaatgtgcacggaagagcagattgaaagagaagaaaaaggaaaaagatatttgctctagctccaaacggcggttccaaaaaaatatccatcggcgtggaaaaccaaaatctgacaccgttgattttcattgcagcaagctaccggtcacctgcggagaagcgaagggtattttatataagaagaagatgaaacatggctcctctgtgaagtgcatcaggaacgaagacggcacctggttaaccccaaacgagttcgaagtggaggggaaagggcgcaacgctaagaactggaaaaggaacatcagatgtgagggcatgacactgggagaactgctcaaaagtggcctgctgctctgtccacccagaatcaaccttaagagagagctgaactccaaatag

SEQ ID NO: 206599 - DNA, 2070 bp, Artificial Sequence
  Description of Artificial Sequence: Synthetic coding sequence
atgttcaccatgacccgggccatggaggaggccctgttccagcactttatgcaccagaagcttggcatcgcttacgccatacataagccgttccctttcttcgagggactgctagacaactccattattacaaagcgaatgtacatggagtcgctggaggcctgccgaaatttgatcccagtttcccgcgttgtgcacaacattttaacacagctagagaggacctttaacctcagcctgctggttaccctattctcccagattaacctccgcgaatatcctaatctggtgaccatctacagatctttcaagcgtgttggcgcttcttacgaatggcagtctagagatacgccgattttgcttgaggcccctaccggcttagcagagggtagcagcctgcacaccccattggccctgccccctccgcaaccaccgcaaccctcctgtagtccctgcgcgccccgggtatccgaaccagggacttcttcacagcagtctgatgaaatcctatccgagtctccaagcccatcagacccggttctgcccttgccagctttaatccaggagggaagatccactagcgtgaccaatgacaagctgacatccaagatgaatgcggaagaggattccgaagaaatgccaagcttacttacgagtacggtgcaggtggcttccgataacctgattccccaaatcagagataaggaagatccacaggagatgccacattctcccctgggcagcatgccagaaattcgggataattccccagaacctaacgatcccgaagagccccaggaggtctcttccaccccaagcgataaaaaagggaaaaagcgtaaaaggtgcatctggtcaacccctaaaaggcggcacaagaagaaatcgttgcccggcggaactgcatcttctcgtcacggaattcagaagaaactcaagcgagtggaccaagtgcctcagaagaaggacgattcaacatgtaattctaccgtcgaaactagagcccaaaaggcccggacagagtgcgcacgcaaatcacgaagcgaggagattatcgacggtacaagcgaaatgaatgaaggaaaacggtcccagaaaacaccatccacccctcgcagagttacccaaggagctgcgtcccctggccacgggatacaggaaaaacttcaggtagtcgacaaggtgactcagagaaaagatgatagcacatggaactctgaagttatgatgagggtgcaaaaggcacgtacaaaatgtgcgcggaagtcaaggctgaaggaaaagaagaaggagaaggacatctgctctagcagtaaacgccgtttccagaagaatattcaccgaaggggcaagcccaagagcgacactgtcgacttccattgttctaagctgcccgtgacttgcggggaggccaaggggatcttgtataaaaaaaagatgaaacacggaagcagcgtgaagtgtatccgtaatgaagatggaacgtggctgactcctaatgaattcgaagttgagggcaagggtcgcaatgctaagaactggaagcgcaacatccgatgcgagggtatgactctcggtgagctccttaagcgaaagaatagtgatgaatgcgaggtctgttgtcaggggggacagctgttgtgttgtggcacctgcccaagggtgtttcacgaagactgtcatataccgccggtcgaagcaaaaagaatgctgtggtcctgcaccttttgtaggatgaaacgtagctcagggagtcagcagtgtcatcatgtgagtaagactctcgagaggcagatgcagccgcaggaccagttgataagagactatggggagcctttccaagaggccatgtggctggaccttgtcaaagaaagactgattactgagatgtatactgtcgcctggtttgtccgggatatgcgcctgatgttccgcaatcataagacattttacaaggccagtgatttcggacaggtaggcctagaccttgaggcagagtttgagaaggaccttaaggacgtgctgggatttcatgaggctaatgacggtggtttctggacacttccatag

SEQ ID NO: 206600 - DNA, 1644 bp, Artificial Sequence
  Description of Artificial Sequence: Synthetic coding sequence
atgttcaccatgacccgggccatggaggaggccctgttccagcactttatgcaccagaaacttggcatagcgtacgctattcacaagccttttccattctttgaaggcctcctggataatagcatcatcactaagaggatgtatatggagagcctggaggcgtgccgaaacctgatccctgttagtcgagttgtgcacaatatcttgactcagttggaacgcactttcaacttgtcgctcctcgtcactctgttcagccagatcaacctgcgcgaatacccaaatttagttactatataccggagctttaaaagagtgggcgcatcctacgagtggcagtccagggatacaccgatcctcctggaagcgcctactgggctggccgaaggatcctctctgcacactcccctcgccctcccccctcctcaaccccctcaaccgtcatgctctccttgcgctcctcgggtgtccgaacctggcacctcatcacagcaatctgacgagattctctctgaatcgccgagcccatctgaccccgtgttaccccttcctgccctgatacaggagggacggagcaccagtgtgacaaatgacaaacttaccagcaagatgaacgccgaggaggacagcgaggagatgccatcattgctcacctcgactgtgcaggtggcatcagataatctgataccccagatcagggataaggaagacccgcaggaaatgcctcattctcccctcggatcgatgccagaaatcagagacaattctccagaacccaatgatcctgaggaaccccaggaggtctcatctactccctctgataagaaaggcaagaagcggaagcggtgcatttggtccacgccaaagaggagacacaagaagaaaagcctccctggggcaagttcccggcacggcatccagaaaaaattaaaacgtgttgaccaggtcccccagaaaaaggatgattccacatgtaattccacagttgaaacaagagcgcagaaagcccgaaccgaatgcgccagaaaaagcaggtctgaagagattatagatgggacgtccgagatgaacgaaggaaaacgctcgcaaaagaccccctcaacaccacggcgagtgacccagggcgctgcgtcccctggccacggtattcaagaaaaactgcaagtggtcgataaggtgactcagcggaaggatgactctacttggaactccgaggtcatgatgagagttcaaaaggcccggacaaagtgtgcccggaaatcccgtctgaaggaaaagaaaaaggagaaagatatctgtagctcgtcaaagcgccgctttcagaaaaacatccatagaagggggaaaccgaagagcgacacagtggacttccattgttcaaaattgcctgtgacatgcggggaggctaaggggatactttacaagaagaagatgaagcacggcagcagtgtgaagtgcatcagaaacgaggatggcacctggctgactcctaacgagttcgaggtagagggcaaaggtaggaacgccaagaactggaagaggaacatacgatgcgaagggatgactctcggcgagttactgaaaagcggcctgcttctttgtcctcccagaatcaatctcaagcgtgagctcaacagcaaatag

SEQ ID NO: 206601 - DNA, 666 bp, Artificial Sequence
  Description of Artificial Sequence: Synthetic coding sequence
atgttcaccatgacccgggccatggaggaggccctgttccagcacttcatgcatcagaagttaggaattgcctacgcaattcacaagcccttcccattcttcgagggactgctcgataacagtatcattacgaagagaatgtatatggaatctctggaggcctgtaggaatctgatcccagtcagcagggtcgtacacaatattctgacccaacttgagcgaacttttaacctttcacttctcgtgaccctgttcagccagattaacctaagagaatatcccaacttagttactatatacaggagctttaagagagttggagcttcgtacgaatggcaaagcagggatactccaatccttctggaagcccccacaggactggccgaggggtctagcttacacacacccctcgcactcccacctcctcagccgcctcagccctcttgtagcccgtgtgcaccccgcgtcagcgagccagggacatcgtctcagcagagcgacgagatcctcagcgaatccccctccccaagcgatccagtgctgccgctgcctgctctcatccaggagggcagatctaccagtgtaactaacgataagctgaccagtaaaatgaacgccgaagaagattcagaagagatgccatcactgctcacctccaccgtctag

SEQ ID NO: 206602 - DNA, 306 bp, Artificial Sequence
  Description of Artificial Sequence: Synthetic coding sequence
atgttcaccatgacccgggccatggaggaggccctgttccagcactttatgcaccaaaaactggggatcgcctacgccattcataaacccttcccttttttcgaggggctgctggacaactcaattattaccaagcgaatgtacatggaatctctggaggcttgccgcaatctcattcccgtttctcgtgtggtccataacattttgacccaactcgagaggacatttaatctgagtttactggtgactctattcagtcagatcaacctccgagaatatcccaatctcgtcactatatacagatag

SEQ ID NO: 206603 - DNA, 1668 bp, Artificial Sequence
  Description of Artificial Sequence: Synthetic coding sequence
atgggccggggcttccggatgttcaccatgacccgggccatggaggaagccctttttcagcactttatgcaccaaaagttagggatagcctacgcgatccataagccattccccttctttgaaggcttgctagacaacagcataatcacaaaacgcatgtacatggagtctttagaggcctgccgcaatttgatcccagtgagcagagtcgtgcacaatattctgactcagctggagcgaaccttcaacctgtccctcctcgttaccctcttctcacagatcaacctaagagaataccccaatctggtgaccatttacagatcttttaagcgggtcggggcaagctatgaatggcagagccgcgatacccctatacttttagaagcaccaaccgggctggctgagggatcatccctgcacacacccctggccctaccacccccgcagcctccccagcccagttgtagtccctgtgctccaagagtgagcgagccaggaaccagcagccaacagtctgatgaaatactctcagaaagtccgtccccaagtgacccagtgttaccactgccagcactcatccaggaagggcgttctacaagcgtgacgaacgacaaattgaccagcaaaatgaatgctgaggaggactccgaggagatgccctcactcctgacctcaactgtgcaggtggctagtgataatttaatcccacagattcgcgataaagaagacccgcaggaaatgccacactcccccctgggatcaatgcctgaaatccgcgacaacagtcccgaacccaacgaccccgaagagcctcaggaggtgtcctctaccccgagcgataagaaagggaaaaaaaggaaaaggtgcatttggtccactccaaagcgtcggcacaaaaagaagtcattacctggaggtacggcaagctcacggcatggaatccagaagaagctgaagagagtggaccaggtgccacagaaaaaggatgattctacgtgtaatagcacagtcgagacaagggcccagaaggccaggacagagtgtgcccgtaagtcaagatctgaggaaataatagacgggactagtgagatgaatgagggcaaacgaagccagaaaacccccagcacgccaaggcgcgtgacccaaggagccgcttcacctgggcatggcatccaagaaaagttgcaagtcgtggacaaggtaacacagcgcaaggatgactctacgtggaatagtgaagtcatgatgcgggtgcagaaggcccggacaaaatgcgcaagaaagtcaaggctcaaggaaaagaagaaagaaaaagacatttgcagctcttctaagaggcggtttcagaagaatattcaccgcagaggtaaacctaaaagcgataccgttgacttccactgcagcaagctccccgttacctgcggggaggcaaaggggatcctgtataagaagaagatgaagcatgggagctccgttaagtgcattcgtaatgaggacggtacctggttaacgcctaatgagttcgaggtagaaggaaaagggcgtaacgctaagaactggaagcggaatatcaggtgtgagggaatgacactgggagaactattaaagagcggactgctcctgtgcccgcctcgcattaatctgaagagagagctaaattccaagtag

SEQ ID NO: 206604 - DNA, 2346 bp, Artificial Sequence
  Description of Artificial Sequence: Synthetic coding sequence
atgaccgcccccgagaagcccgtgaagcaggaggagatggccgccctggacgtcgattctggcggagggggaggaggaggcggaggccacggagaatatctgcagcagcaacagcagcatggaaatggagcagtggcagccgccgctgcagctcaggacacgcagccttcacctctggcactcctggcggctacctgctctaagatcgggccgccttccccgggagatgatgaggaagaggctgccgccgctgcaggtgcaccagcggcagctggcgccacgggagatctggcatcagcacaactcggaggtgcccccaataggtgggaagtgctcagcgctacccccaccaccatcaaagacgaggccggaaatttagtgcaaatacccagtgctgctacgagttccggtcagtacgtcctgcctctccagaatctacagaatcagcagattttttccgttgctcccggctctgattcaagcaatggaacggttagcagtgtccagtaccaggtcattcctcagattcagtctgctgatggacagcaggttcagatcggattcaccggctcttcagataatggaggcatcaatcaggaatcctctcagatccaaataataccgggcagcaaccagaccctactggcatcagggacgccttccgcaaacatacagaatctcatcccacagacaggccaggtgcaagttcagggcgtcgctattggaggctcatcctttccaggacagacccaagtggtcgccaacgttccgttgggtcttcctggcaacatcacatttgtgcctattaatagtgtcgacctggatagtttgggattaagcggaagcagtcagacaatgactgcgggcatcaatgctgacggccacctcattaatactgggcaagccatggattcctcagacaattctgaacggactggcgagagggtatcccctgacattaacgaaaccaatactgacaccgatctttttgtgccaacatcaagtagcagtcagcttccagtcacgatagacagtaccggaatcctgcagcagaacactaattccttgaccacatcgagtggccaagtccactcctcagatcttcaggggaactacattcagtcccccgtatccgaggagacccaggcccagaacatccaagtttcgaccgctcagcctgtcgtgcagcacctccaactccaggagtcccaacaacctacctcgcaagcccagatcgtgcaagggataacacctcagaccatccatggtgtgcaagcttccggccagaatatcagtcagcaagctctccagaacctacaattacagctgaaccccggcaccttcctgatccaggctcagactgtgacaccaagcggacaggtgacgtggcagactttccaggttcagggcgtgcaaaatctgcagaacttgcaaattcagaacaccgcagcgcaacagattaccttaactccggttcagaccctgaccctgggccaggtggcggctgggggagccttcacgtcaactcccgtgagcctcagcacgggacagctccccaatctccagaccgtgactgtaaactcaattgacagtgccggcatccagcttcaccctggcgagaatgctgactcaccagcggacattagaatcaaagaggaagaacccgaccccgaggagtggcagctgagcggggacagcacactcaatactaatgatctgacacatttgagggtacaggtggtggacgaagaaggggatcagcaacaccaggagggaaaaagactgaggcgagtagcttgtacctgccccaactgcaaggaggggggaggacgagggacaaacctgggcaagaaaaagcagcacatctgccatattcccggatgcgggaaggtctacggcaagacgtcgcatcttcgtgctcacctccggtggcactctggcgagcggccttttgtctgcaactggatgtattgcgggaaacggttcactcggagtgacgaactgcagcgacacaggagaacacacactggggaaaagaaatttgtgtgtcctgagtgttctaagaggttcatgcgatccgaccacctggctaaacacatcaagactcatcagaataagaaaggaattcatagtagtagtacggttctcgcttctgttgaggccgcgcgcgacgatactctgattaccgccggcggaactacccttatcctggcgaacatacagcaaggcagcgtatcaggtattggcacagtgaacaccagcgccacttcgaaccaggatatcctcaccaatacagagattcccctccaactcgtgacagtctcgggcaacgaaactatggagtag

SEQ ID NO: 206605 - DNA, 2217 bp, Artificial Sequence
  Description of Artificial Sequence: Synthetic coding sequence
tgacccgagaagcccgtgaagcaggaggagatggccgccctggacgtggactccggtgggggaggcggggggggaggcggacatggcgagtacctgcaacagcaacagcaacacggtaatggtgccgttgccgcagcggctgctgctcagaccggtgacctggcaagcgctcagttagggggcgcccctaatagatgggaggtgctgagcgctacccctaccaccataaaggacgaggccgggaatttggtacagatcccaagtgctgccactagcagcggacagtacgttctgcctcttcaaaacctgcagaaccagcaaatcttcagtgtggcccccggcagcgactcctctaatggaacggtttcatccgtgcaataccaggttatcccccagatccagagcgccgacggacagcaggtgcagattggctttacggggtcctctgacaacggagggatcaaccaggaaagcagtcagatccagattatcccagggagcaaccagactctgctcgcctctggcacccccagcgccaacatccagaatctgattcctcagacaggccaggttcaggtgcaaggcgtagccattggggggtccagcttccccggacagacccaagtggtcgccaatgtgcctctcggcctgcccggtaacattactttcgttcccattaactcagtagatttggatagcctgggcttatccgggtcctcccagaccatgaccgcagggatcaatgccgatggccatttgattaatacaggtcaagcaatggattcctccgacaatagtgagcgcaccggagaaagggtcagccctgatattaacgagacaaatacagacaccgatctgttcgtcccaacttcctcgtcttctcaactccccgtgacaattgattccactgggatcctacaacagaatacgaactcgctgaccacttcatctggccaggtacactcaagcgacttacagggcaactacatacagagcccagtgtccgaggaaactcaggcccagaacatccaggtctctacggcccagccggtcgtgcagcatttacagctgcaggaaagccagcagcccacatcccaggctcaaatagtccaggggatcaccccccagacgattcacggcgtgcaggcctccggccagaacattagccagcaggctcttcaaaatctgcagctgcagttaaatccaggcacattcttgattcaagcacagactgtgactccgtccgggcaggtgacctggcagacttttcaggttcaaggcgtgcagaatcttcaaaatctgcagatacagaacactgcagcgcagcagatcacacttacccctgttcagacactgactctcgggcaggttgcagcagggggagcttttacctctacccctgttagtctcagtactggccagctgccaaatctccagactgttaccgtgaactcgatcgacagcgctgggatccagcttcacccaggcgaaaacgcagactctcccgcagacattcggataaaggaggaagaaccggaccccgaagagtggcagctgagtggcgattccaccctgaacacaaacgacctgacgcatcttcgcgttcaggtcgtcgatgaagagggcgaccagcagcatcaggagggaaaaaggctgcgccgcgtagcctgcacctgccctaattgtaaggaaggaggagggcgtggaactaatctgggaaagaagaagcagcatatctgccatatacccggttgtgggaaagtgtatggtaagactagccatttgcgggcgcacctgagatggcatagcggcgagcgacccttcgtgtgcaactggatgtactgtggtaagcgtttcacacgctctgatgagctccagagacaccggcgcactcacactggtgagaaaaaattcgtttgccctgagtgctccaagcggttcatgcgaagtgaccatctagcaaaacatattaagacacaccagaataagaagggcattcactccagcagtactgtgctcgcctccgtggaggcagccagggatgataccttgattacagcaggcgggaccacactgattctcgccaatatccaacaggggagcgtgtccggcattggtacggtgaacacgagtgccacaagcaatcaggatatcctgactaatactgaaattccgcttcagctggtaaccgtgtctggaaatgagacgatggagtag

SEQ ID NO: 206606 - DNA, 2142 bp, Artificial Sequence
  Description of Artificial Sequence: Synthetic coding sequence
atcggcccccccagccccggcgacgacgaggaggaggccgccgccgccgccggtgcccccgccgcggccggggcaacaggggatttagcttccgcacaattaggtggcgctcctaaccggtgggaggtgctaagtgccaccccaaccaccattaaggatgaggccggaaaccttgtgcaaatcccatctgcagccacttcctcaggccagtacgtgctcccactccagaacctgcagaaccagcagatattcagtgtagccccaggatcagattcaagtaatggcacagtctctagcgtccagtatcaggtcatccctcagattcagtcggccgatggccagcaagttcagataggattcaccgggtctagcgataacggagggattaatcaggagagctcacagatacagattataccaggttctaaccaaacgctcctggcctccgggactccctccgccaacatccagaacctgatcccccaaacgggccaggtgcaggtccagggcgtcgccattgggggaagttcattccccggccagacccaggtggtcgctaatgttcccctgggattgcctggaaacattactttcgtaccaataaattctgtcgacctagattctctgggcctgagcggaagcagccagaccatgacagctggtataaacgctgatggacaccttatcaatacagggcaagcaatggacagtagcgacaacagcgagcgcacaggagaaagggtgtctccagatatcaatgagacgaatactgacacggacttgtttgtaccaacatcaagtagctcgcagctacccgtcacaatcgactctacaggaattctgcagcaaaatactaactcacttactacctcttcaggccaggtccattcctccgatcttcagggaaattatatccagagccccgtaagcgaggaaacgcaggcgcagaacatacaagtgtctactgcccagcccgttgttcagcatctacagcttcaggagagccagcagccaacctcacaggcccagatagtccagggcattaccccacagaccattcatggagtgcaggcatccggacagaacataagccaacaggccttgcagaacttacaactgcagctgaatcccggaaccttcctgattcaggcacagacggtgacacctagcggccaagtcacctggcagacgttccaagtccagggggtccagaacctccagaatttacaaatccagaatactgccgctcagcagatcaccttgaccccagtacagaccctgacgctggggcaagtcgcggcaggaggtgctttcacgagcacacccgtgagtctctcaacgggacagttgccaaatctgcagacggtcactgtgaacagcattgactcggccggaatccagttacatccaggcgagaacgctgactctcccgctgatatccgtatcaaggaagaggaaccagatcctgaagagtggcagctgtccggtgatagcaccttgaacacgaatgatctaacccacctgcgagtgcaagtggtggatgaagagggagatcagcagcaccaggagggtaaacggttgcgccgcgtagcttgcacatgtcctaattgtaaggagggcggtgggcgcggaactaacttggggaagaagaaacaacatatctgccatatacctggctgtggtaaagtctacgggaagacatcgcaccttcgcgcccatctccggtggcactcgggtgaacgtcctttcgtttgtaattggatgtattgcggtaagcgcttcacccggagcgacgagctgcaaaggcacaggcgaacccatacaggcgagaaaaagtttgtttgtccggaatgctctaaaaggttcatgagaagcgaccacttggcaaagcatatcaagacccatcagaataagaagggaatacactcttcttcgactgtgcttgcgtcggtcgaagctgctagagacgacacccttatcacagctggcgggaccactcttatcttggccaatattcagcaaggcagcgtgagcggtattggaaccgtcaatacaagcgcgacatctaaccaggatattctcacgaacactgaaatcccccttcagttggtcaccgtgtcagggaatgaaacaatggagtag

SEQ ID NO: 206607 - DNA, 2187 bp, Artificial Sequence
  Description of Artificial Sequence: Synthetic coding sequence
atggccgccctggacgtggacagcggcggcggcggcggcggcggcggtggtcatggggaatacttacagcaacaacagcaacacgggaatggtgccgtagccgcagccgccgcggcccagaccggcgacctggcgtctgctcaactaggcggagcccctaatagatgggaggtgctgtctgccacgccaaccactatcaaagacgaggccgggaacctggtgcagattccaagcgccgcaactagctctggccagtacgtgctccctctgcaaaacctccagaaccaacagattttcagtgtcgcacccggatccgactcttccaacggaaccgtatcttcggtccagtaccaagttataccacagattcagagcgctgacggccaacaagtacaaatcgggttcacaggaagttctgataacggaggtattaaccaggaaagcagccagatccaaattattcccggcagcaatcagacactgctcgcatcaggaacaccctcagccaatatccagaacctaattcctcagaccggacaggtgcaggtgcaaggggttgccattggaggctccagctttcctgggcagactcaggtcgttgccaacgtcccactcggattgcctggtaatataaccttcgttcctatcaatagcgtcgacctggactccttggggttgtccggttcaagtcaaaccatgacagcaggcatcaacgctgacggtcacttaattaatactggccaggccatggactcatcagacaactccgaacggaccggcgagcgcgtgtcaccagatatcaatgaaacgaacaccgacaccgatctcttcgtgccaacaagttccagctcgcaactccccgtaacgatcgatagtacaggtatcttgcagcagaacaccaattcgctgactacttcatctgggcaggtgcacagttcagaccttcaaggtaactatatacagagtccagtttctgaggaaactcaggctcagaacattcaggtgtccactgctcaaccagtcgttcagcacctgcagcttcaggaatcccagcagccgacctcccaggcccagattgtgcaaggaataacaccacagacgatccacggggtccaggcctcaggtcagaacatctcccagcaggctctccaaaatttacagctgcaacttaacccaggcacattcctgatccaagcgcagacagtgaccccatctggacaggtcacctggcagaccttccaggtccaaggagtgcagaacctccagaacctccagatccagaacaccgccgctcagcagattaccctgacccccgtgcagactctgacactgggacaggtggctgccgggggagccttcacatctactccagtttctctctctaccgggcagttaccaaatctgcagactgtcactgttaactccatcgacagcgcaggaatccagttgcatccaggggaaaatgccgattctcccgccgacatacgaattaaggaagaagaacccgacccggaagaatggcagttgagtggggatagcacactgaataccaacgatctgacccacttgcgggttcaggtggtcgatgaagagggagaccagcaacaccaggagggaaaacggctccggcgcgtggcctgcacctgcccgaactgcaaggaggggggcggccggggcacgaacttaggcaagaaaaagcagcacatctgccacatccccggatgtgggaaagtttatgggaaaaccagccacctgcgagcacacctgcgctggcattccggcgagagaccgtttgtgtgcaactggatgtactgcggtaaacggttcacgagaagcgacgaactacagcggcaccggcggactcatactggggagaaaaagtttgtttgtccggagtgtagcaagagattcatgagatccgaccacttagcaaagcacatcaagacgcaccagaataagaaaggtatccactcctcttccacagtgttggcctccgtggaagctgcgcgcgacgacaccctcattacggccgggggaacaactctcatcctggccaacatccaacagggcagtgtgtctggtattggcacagtgaacacatctgctacttcaaatcaggacatactgacgaacaccgagatccccctgcaactggtgaccgtgtccgggaacgagactatggaatag

SEQ ID NO: 206608 - DNA, 1545 bp, Artificial Sequence
  Description of Artificial Sequence: Synthetic coding sequence
atggtgtgggaggtgaagaccaaccagatgcccaacgccgtgcagaaactgctccttgtcatggataaacgagctagcggtatgaatgattctctggaactgttacagtgtaacgagaatttgccttcaagccctgggtataatagttgcgatgaacatatggaactcgatgatttgccagagctccaagccgttcaatccgaccccactcagtctgggatgtaccagctgagctcggacgtaagccaccaggagtaccctcgatcgtcatggaaccagaacacttcagacatccccgagaccacctacagagagaacgaggtggattggctgacagaactggcgaatatcgccacgagtccccagtctcctctgatgcagtgctccttttacaatagatcttctcccgtgcatattatcgccaccagtaaatccctgcactcatacgctcgccctcctccggtctccagcagtagcaagtcggaacccgcattccctcatcaccactggaaagaagagacgcccgtgaggcacgagcgagcaaattccgagtccgagagcggaattttttgtatgagtagtctgtccgacgatgacgacctcgggtggtgtaattcatggccctccaccgtgtggcattgcttccttaagggcacaagactctgttttcacaaagggagcaacaaagaatggcaggacgtggaggatttcgctagagcggaggggtgcgataacgaggaagacctgcagatggggattcacaaaggctatggttcggatggcctgaaactgcttagccacgaagaaagtgtatcgttcggggagtcagtcctgaaactgaccttcgacccaggcacggtggaagacggcctgctgacagtcgagtgcaagcttgatcaccctttttatgtcaagaacaaagggtggtcgagtttttatccttctctcaccgtggtccagcacggcatcccatgttgtgaagtgcatatcggggacgtgtgcttgcccccaggccatcccgatgctataaacttcgacgattctggggtcttcgacacatttaagagttatgactttacacccatggattcctccgccgtgtatgtcctgtcatccatggccagacagagaagggcctccctgtcatgcgggggacccggcggacaagattttgcgcgtagtgggtttagcaagaactgcggttctcctggttctagtcagttgtcatctaactccctgtacgccaaggctgtcaaaaaccacagcagtggaaccgtcagtgctacctctcccaacaaatgtaagcggcctatgaatgccttcatgctcttcgctaaaaagtatcgagttgaatatacccagatgtacccaggtaaagacaatagggctatatcggtaatattgggtgataggtggaagaagatgaagaatgaagaacggaggatgtacaccctagaggcaaaagctctggccgaggaacaaaaaaggctaaatccagactgctggaagagaaaacggacaaacagcggatcacagcagcactag

SEQ ID NO: 206609 - DNA, 432 bp, Artificial Sequence
  Description of Artificial Sequence: Synthetic coding sequence
atgagcgaccagaagaaggaggaggaggaggaggccgccgccgccgccgcgatggctacagagggtggcaagacatctgagcctgaaaacaataacaagaaacctaagacaagcgggtctcaggattctcaaccatcaccgctggcattgcttgcggctacctgtagtaagataggcacccccggagaaaatcaggccacaggacagcagcagaggaacctgctcgaaacacttggtaacctgctcccgcccctactgcttctccaaaaacggatcacattccttaaccagcctctggtgcggttagtgctgccggccgtcatcaccggtgtgcacctgctccagaagttgaaccaagtgattcttcctcccctggtgaactttaagtcatacaaatacaagatccaggttgtggtctacagcactaagtag

SEQ ID NO: 206610 - DNA, 1296 bp, Artificial Sequence
  Description of Artificial Sequence: Synthetic coding sequence
atggccagcagcctgctggaggaggaggtgcactacggcagcagccccctcgcaatgttgaccgcggcttgttcaaagttcgggggttcatcgccactgagggattccacaacacttggcaaagcagggacaaagaagccatattctgtaggatctgatttgtctgctagtaagactatgggcgacgcctatcccgctccgtttacaagcacaaacggtttgctttcacccgccgggagccctcctgctcctacctccggatacgcgaatgattaccctcctttctcacacagcttccccggccccactggcacacaagatcctggtctgctggttcctaaaggccactccagctcggattgtctcccttcagtgtatacaagtctggacatgacacacccttacggaagctggtataaggccggtatccatgcaggaattagtccaggacctggcaacactccgactccatggtgggatatgcatcccggaggaaattggctcggcggggggcaggggcaaggggatggtttacagggcacacttccgaccggcccagcccagcccccattgaatccccagcttcctacttatccttctgacttcgctcccctaaaccctgccccttatcccgccccgcacttgttgcagcccgggccacaacacgtccttccccaggatgtgtacaagcctaaggctgttggaaatagtggtcagctggaggggagcggcggagcaaagccgccaagaggagccagtaccggagggtccggaggatacgggggcagcggagctgggaggtcctcctgtgactgcccaaattgccaggagctggaacggctgggcgctgcagctgccggactgcggaagaagccgattcacagctgtcatatcccaggctgcggaaaggtttacgggaaagcttcacacctgaaagctcatctgagatggcacaccggcgagcggcccttcgtttgcaattggctcttctgcggcaagagatttacccgaagtgacgagctggagcgacatgtgcgtacacacactcgggagaagaaattcacttgtcttctgtgtagcaaaagatttacacgtagtgatcacttatccaagcaccagaggacgcatggggagcctgggcccggccctcctccaagtggccccaaggaactaggagagggccggtccactggcgaggaggaggccagtcagactccccgcccatcagcttcaccagccacaccagagaaagctccaggcgggtcccccgagcagtcaaatctgctggaaatttag

SEQ ID NO: 206611 - DNA, 1296 bp, Artificial Sequence
  Description of Artificial Sequence: Synthetic coding sequence
atggccagcagcctgctggaggaggaggtgcactacggcagcagccccctggcaatgttgaccgccgcatgttccaagtttggggggtcttccccattgcgagattctacaacactggggaaagcaggaacaaagaagccgtattcggtgggctcggacctgagtgcctcaaaaaccatgggagacgcttaccctgctcctttcacatctaccaacggtctccttagccccgcaggctctcccccagctcctacatcaggttacgccaacgattaccccccattcagccattcctttcctggccctactgggacccaggaccccggactgttggttcccaaaggtcactccagtagtgactgcctgccatcggtctataccagcctggatatgactcatccatatggcagctggtataaagctggtattcacgccggaatatctcccggccctggaaacactcccaccccctggtgggatatgcaccctgggggcaattggctgggaggaggacaaggtcaaggcgacgggcttcagggcacgctgccgaccggtcccgctcagcctcccctgaatccgcagctccccacatatccctccgatttcgccccacttaaccccgcaccctatccagccccacatctcctgcagcccggacctcaacacgtgttaccacaggatgtttacaagcctaaagccgtcggtaacagtggacagctggagggatcaggcggcgccaagcctcctcggggcgcaagcacaggtgggtccggcggatacggcggatccggcgctggccgctccagttgcgattgccccaattgccaggagctcgagcgcctgggggcagccgccgcgggtctacggaaaaaaccaattcattcctgtcacattccaggttgcggaaaggtctacggcaaggctagccatctcaaggcgcatctgagatggcacaccggagagaggccatttgtttgcaattggcttttctgcggtaagcgttttactaggagcgatgagctagagcgccacgtccgcactcacacccgtgagaagaagttcacgtgcctgctgtgcagcaaacgctttaccagatccgatcacctttcgaaacatcagcggacacatggggagccaggccccggaccccctccctctggacccaaggagcttggggagggtaggtctacaggggaggaggaggcctcacagaccccccggcctagcgcctcaccagctactcctgaaaaggccccagggggctctccggagcaatcaaatctgctcgagatctag

SEQ ID NO: 206612 - DNA, 1242 bp, Artificial Sequence
  Description of Artificial Sequence: Synthetic coding sequence
atgctgaccgccgcctgcagcaagttcggcggcagcagccccctgcgagacagtactactctcggtaaggccggaacaaaaaaaccttactctgttggctccgatctttcagccagtaagacgatgggagacgcgtacccagccccctttacctccacaaacggcttgttgtcccctgccggctctccccctgctcccaccagcgggtatgccaacgattaccccccattctctcattcatttcccgggcctaccgggacccaggacccgggcctgctggttcccaagggccactcttcttctgactgcttgcctagtgtgtataccagtttggacatgacccacccatacgggtcttggtacaaagcaggaatccatgcaggcatctcccctgggcctggtaatactcccaccccttggtgggacatgcatcctggcggcaattggctgggcggtggtcagggtcaaggggacggcctgcaggggacactgcctactggaccagcacaacccccacttaacccccagcttcccacttaccccagcgactttgctcccctgaaccctgcaccttaccccgcgcctcatttgctgcagcccgggcctcagcacgtacttcctcaggacgtgtacaaacccaaagctgtaggcaacagcgggcagcttgagggttcggggggtgcaaagcctccacggggagcctcaaccggtggctcgggtggatacggaggctcaggggctggcaggtctagctgcgactgccccaactgtcaggagcttgagcgacttggcgccgccgctgcgggactgcgcaagaagcctattcacagctgtcatatcccaggatgcggcaaagtctatggtaaggcatcacacctgaaagcccatcttcggtggcacacaggggagaggcccttcgtatgtaattggctgttctgcgggaagcggtttactcggagcgacgagctcgagcgccacgtgcgcacgcatacgcgcgagaagaagtttacatgtctgctgtgttctaagcgcttcactagatctgaccacctgtccaagcaccaacgcacccatggggaacctgggcctggccctcccccatcaggccccaaggagttgggcgaaggacgatcgaccggcgaggaagaggcatcacagactcctaggccatccgcatcccctgctacgccagagaaggcaccaggcggatctcccgaacagtctaatttactcgagatttag

SEQ ID NO: 206613 - DNA, 1401 bp, Artificial Sequence
  Description of Artificial Sequence: Synthetic coding sequence
atggccaccagcctgctgggcgaggagccccggctgggcagcaccccgctggctatgcttgccgccacctgcaacaagatcggcagtccgtcaccttctccctcaagtttgagcgactccagctcgtccttcgggaaaggctttcatccctggaagaggtcctcttcttcatcgagcgcttcctgcaatgtcgtcggaagttcactgtcttcatttggagtgtctggcgccagtcgaaacgggggctccagctctgctgcggccgctgctgccgccgccgcagcagcagctgcagcactggtgtctgacagcttttcatgcggcggtagcccagggtcctctgctttcagcttgacctcatccggaggctcctcagctcatagccaggacggatcacaccagcctgtgttcatctctaaagtgcatacatccgtcgacgggctgcaaggcatctaccctcgcgtaggtatggctcacccttatgagtcttggtttaagccatcccatcccggtctgggggccgccggcgaggttggctccgccggggcctccagctggtgggacgtgggcgctgggtggatcgacgtgcagaatccaaacagcgctgccgctttgcccggtagcttacaccctgcagccggcggccttcagacctctctgcattcgcccctcgggggctataactcggattactcaggtctttcccactccgcgtttagcagtggtgcttcctcccacctactgagccctgccggtcagcacctcatggacgggtttaagccagtgctgcctggatcttatcccgactctgccccttcacctctggccggggccgggggatcaatgctgtccgccggtccatctgccccgctcggagggagcccacggtccagcgccaggcgttatagtggtagagccacgtgcgattgtcccaactgccaggaagctgaaaggctggggcctgccggcgcttcccttaggcgcaagggacttcactcctgccatattcccggctgcggcaaagtgtacggtaagacatcacacctaaaggcccacttacggtggcacactggcgaacgccccttcgtctgtaattggctcttctgcggaaagcggtttacccggtcagacgagcttcagaggcatctgagaacacatactggcgaaaagagatttgcatgccctgtgtgcaacaaaaggttcatgcggtcggaccaccttagcaaacatgtgaaaactcatagcggcggtggcgggggtgggggaagcgcaggcagcgggtcagggggcaagaaaggctctgatactgattccgaacattctgccgcggggtctccaccatgccactctcccgagctgttgcaaccaccagaacccgggcatagaaacggactcgaatag

SEQ ID NO: 206614 - DNA, 1473 bp, Artificial Sequence
  Description of Artificial Sequence: Synthetic coding sequence
atgctggccgccacctgcaacaagatcggcagccccagccccagcccttcatccctaagtgactcgagttccagctttggcaaagggtttcatccatggaagaggtcgagctctagcagtagcgcatcatgcaatgtggtgggcagctccttaagcagttttggcgtgagcggcgcctcccggaatggcggatcctccagcgctgcggctgctgccgcagccgccgcggcagctgccgccgccctggttagcgatagtttttcctgtggcggcagtccagggagctccgctttctcactgaccagttcatcagcagcagcggctgcggcagctgccgcggctgccgccagttcctcacccttcgctaacgattattcagtgtttcaagctcctggcgtttccggcggatccgggggcgggggaggcgggggagggggaggatcctccgcccactctcaggacgggtcacaccagccggtgttcatttctaaagtacacacatctgtagatgggcttcagggaatctacccacgcgtaggaatggcacacccctacgaatcctggtttaaaccctcgcacccgggtctcggcgccgccggagaggtgggaagcgctggcgcctcatcatggtgggacgtcggtgcgggctggatcgatgtccagaatccaaattccgccgcagccttgcctggaagtttgcaccctgcggcaggggggctgcagacgtcactgcatagccccctcgggggctataattcagattactctgggttgagtcattcagcttttagctcaggtgctagttcccacctgctgagtccggccggccagcacttgatggacggctttaaacccgttcttccaggctcctatcccgactctgctccctctccactggctggcgctgggggctccatgttgtcagctggtccatctgcccccttgggaggaagcccacggtcgagtgcacgtcgatactcgggccgggccacctgcgactgtccgaactgccaggaggcagagaggctggggccagcgggcgcttcactccgaaggaagggattgcattcctgtcatataccgggctgtggcaaagtgtacggaaaaacgtcacatctcaaggcccacctgcgctggcacaccggcgaaaggccctttgtctgtaactggctgttttgcggtaaaaggtttactcgctcagatgagctccagcgccaccttaggactcataccggcgaaaaacgttttgcatgtccagtctgcaacaaacggtttatgcgcagcgatcatctctcaaagcacgtcaaaacccactctggcggcggtggtggtggaggttccgctgggagtgggtctggtggcaaaaaaggtagcgacacagacagcgaacactcagccgccggaagccccccctgtcattcccctgagctcttgcagccgccggagccgggtcataggaacggcctggaatag

SEQ ID NO: 206615 - DNA, 1527 bp, Artificial Sequence
  Description of Artificial Sequence: Synthetic coding sequence
atggccaccagcctgctgggcgaggagccccggctgggcagcacccctctggccatgctggctgctacctgtaacaaaatcggctctccctcaccatctccctcttcactctcagattccagttcatccttcggcaagggcttccatccttggaagagatcctcatcaagctcgagtgcaagctgtaatgtagtgggaagcagcctttcgtccttcggagtgagcggggcctcgcgtaatggaggaagcagttccgctgcagcagcggcggctgctgcggccgcggccgcagccgcgctggtgagcgattctttcagctgcggtgggtctccggggagctcggcattctctctgacttcatcttccgcggctgctgcagccgcagctgcggcggcagctgcctcatcaagtccattcgctaatgactatagtgtgttccaagctcccggagtttcaggcggatcagggggcgggggcggaggtggcggaggaggatcctccgcacacagccaggacggctctcaccagccagtttttattagcaaagtccacaccagcgttgatggcctgcagggcatttatcccagagttggcatggcacatccgtatgagtcctggtttaagcctagccatccgggactgggagccgccggcgaagttggatcagccggagcaagcagctggtgggacgtgggcgcaggatggatagatgtgcagaaccccaatagcgccgcagccctcccgggatctctccatcctgctgcaggggggctgcagacaagcctgcattctccgctgggcggttataacagcgattatagcgggttgagtcattctgccttctcatccggagcctccagccacctgctgtcccccgccggccagcacctcatggatgggttcaagcctgtgcttccaggatcttaccctgacagcgccccatcccctctcgctggggccggcggctccatgttgtctgctggtccttctgcccccttgggcgggagtcccagatcctccgcaagacggtactccggcagagccacatgtgattgtcccaactgccaggaggccgaacggctcggtccagctggcgcaagcctgcgccggaagggcctccatagctgtcatattcccggctgcggcaaggtgtacgggaaaacatctcatctgaaagctcatctgcgatggcacactggcgaacgcccttttgtgtgcaactggttgttttgcggtaagagattcaccagaagcgatgagctccagcggcacctgcggacccacacgggtgaaaaacgtttcgcttgtcccgtttgcaacaagcgatttatgcggagtgaccatctcagtaagcacgtgaaaactcatagcgggggcggaggggggggaggaagcgctgggagcggtagcggcgggaaaaagggctcagacaccgacagcgagcatagcgcggctggctctccaccttgccacagcccagaattactgcagccacccgaacccggacatcgcaatggccttgaatag

SEQ ID NO: 206616 - DNA, 294 bp, Artificial Sequence
  Description of Artificial Sequence: Synthetic coding sequence
atggacaagcagagcagcgccggcggcgtgaagcggagcgtgccctgtgactctaacgaagccaacgaaatgatgccagagactccaaccggcgacagcgatccacagccagcgcctaaaaaaatgaaaacaagtgagtcgtcgacaatccttgtggtccgataccggcgaaactttaagcgtactagcccagaggaattactcaatgatcatgcccgggaaaatcgaatcaacccactccaaatggaagaagaggagttcatggagattatggtggaaattcctgccaagtag

SEQ ID NO: 206617 - DNA, 294 bp, Artificial Sequence
  Description of Artificial Sequence: Synthetic coding sequence
atggacaagcagagcagcgccggcggcgtgaagcggagcgtgccctgcgagagcaatgaggtaaacgagaccatgcctgaaaccccgaccggtgatagtgatccccagcctgcccccaagaaaatgaagacatcagagtccagcactattttggtagtgaggtaccgccggaacgttaaacggaccagccccgaggaactactgaacgaccatgctagggagaaccggatcaatccactccagatggaggaggaggaatttatggagatcatggtggaaattccggccaagtag

SEQ ID NO: 206618 - DNA, 1308 bp, Artificial Sequence
  Description of Artificial Sequence: Synthetic coding sequence
atgctgcccgcccggtgcgcccggctgctgaccccccacctgctgttggtgcttgtccagctctctccagctagaggccatcggacaactggcccaaggtttctcattagcgacagagatccccaatgtaatctgcactgctcccggactcagcccaaacccatttgcgccagcgacgggaggtcctacgaaagcatgtgcgagtaccagcgggctaaatgtcgggaccccaccttgggggtcgttcatagggggcggtgcaaagacgccggacagtcaaaatgtaggctcgagcgtgcacaggctctggagcaggccaagaagccacaggaggcagttttcgtgcccgagtgtggtgaggatggcagtttcacccaggtgcagtgtcatacctataccgggtattgctggtgcgtcactcctgacgggaagccgatatcagggagctctgtgcagaacaagacccctgtatgttcaggttcagtgactgataagccactgtcccaagggaactccggaaggaaggacgacggttcaaaacccacgcctacgatggaaacacagcctgtatttgacggtgatgaaatcaccgctcctactctctggattaaacatctcgttattaaggactcaaagctgaataataccaatatccgcaattcagagaaggtgtatagttgtgatcaagagaggcaaagcgcactggaagaggcacagcagaaccccagagaagggatagttattccggaatgcgctcctggcgggttatataagccagtgcagtgccaccagtcaacgggctactgttggtgtgtcctggtggataccggaaggcctctccctgggacctcgacacgctacgtgatgccctcatgtgaatctgatgcacgtgctaagaccaccgaagccgacgatcccttcaaagacagggagctgcctggctgccccgagggtaagaaaatggaatttatcaccagcctgctggatgccctcactacagatatggtgcaggctatcaattctgccgcacccaccgggggtgggaggttcagcgaacccgatccttcacatacactggaagagcgcgtggtgcactggtactttagccagctcgattctaacagctcaaacgacattaacaagcgggaaatgaagccttttaagcgttacgttaagaagaaagctaagcctaagaaatgcgcaaggcgcttcacggattactgtgacctgaacaaagataaagtcataagccttcccgaactgaagggatgcctcggagtatcgaaagaagtgggtcgccttgtttag

SEQ ID NO: 206619 - DNA, 1305 bp, Artificial Sequence
  Description of Artificial Sequence: Synthetic coding sequence
atgctgcccgcccggtgcgcccggctgctgaccccccacctgctgctcgtgctggttcagctatcacccgccagaggacaccggactacaggcccccgctttttaatctccgaccgggatccacagtgcaacctgcattgcagtcggacccagccaaagccaatctgtgcctccgacggaaggtcatatgaatcaatgtgtgagtatcagagggcaaagtgtcgcgacccaacgttgggtgtggttcacaggggaagatgtaaagatgcaggacaatcaaagtgccgactggaacgagcgcaggccttagaacaggctaagaaaccgcaggaggccgtgttcgtgcccgaatgtggagaagacggatcattcacacaggtgcagtgccatacctacaccgggtattgttggtgtgtcactcccgacggaaaaccaatttctggcagcagcgtccagaacaagacaccagtatgctctggatcagttactgataagcccctgtcccagggaaatagtggcaggaaagacgacgggtccaaacccaccccaaccatggagacacagcctgtcttcgacggagacgaaattacggctccaacattatggattaagcacctggtgatcaaagactctaagctaaacaacactaatattcggaactcagagaaagtttatagttgcgatcaagaacgccagtcggcactggaagaggctcagcagaacccacgtgagggcatagtgatcccagaatgcgcccccggcggcctgtataagccagtgcagtgccatcagagcactggctactgttggtgcgtgctggtggataccggaaggcccttgcccgggacctccacacggtatgtaatgccttcctgcgagagcgacgccagggcaaaaactacagaggccgatgatccgttcaaagatagagagctgcccgggtgtccggagggcaaaaaaatggaatttattactagccttctcgacgccttgacaacggatatggttcaagcaatcaattccgcagcacctaccggaggaggtaggttctcagaaccagatccgtcacacacgctagaagaaagggttgttcattggtacttcagtcaattggatagtaattcaagtaatgatattaacaaacgcgagatgaagccgtttaagagatacgtgaagaagaaggctaagcccaagaagtgtgctagacgtttcactgattattgcgacctcaataaagataaagtgatttcacttcccgagctaaaagggtgtctaggcgtcagtaaagagggtcgcctcgtgtag

SEQ ID NO: 206620 - DNA, 1374 bp, Artificial Sequence
  Description of Artificial Sequence: Synthetic coding sequence
atgctgctgccccagctgtgctggctgcccctgctggccggcctgctgccccccgttcctgcacagaagttctccgcacttaccttcctgagagtggaccaggacaaagataaagactgctctctggattgcgctggcagccctcagaaacctctgtgcgcgagcgatggaaggacctttctgtccaggtgtgagtttcagagggcgaaatgtaaggatccacaattggagatagcctacaggggtaattgtaaagatgtcagtcgctgcgtggccgagcgcaaatatactcaagagcaagccaggaaagagtttcagcaggtatttataccagaatgtaatgatgatgggacatatagtcaggtgcaatgccacagctacactggctactgttggtgtgtgacacccaacggccggcctatctccggaaccgcggtggctcataaaacacccaggtgtcctggctcggtgaacgagaaactaccccagagggaagggaccggaaagactgtgagcttacagatattctccgtcctcaattctgatgacgctgccgcgcctgctctggaaacccaacctcagggcgacgaggaggatattgcctcaaggtatcctaccctgtggacagagcaggtcaaatccaggcagaacaagactaataaaaatagcgttagcagctgtgaccaggaacatcagagtgcactggaggaagctaaacagcctaagaacgataatgtggtcatcccagagtgtgcccacggaggattatacaaaccagtccagtgtcacccctcaacgggctactgttggtgcgtactggtggacacagggaggcccatccccgggacttctactcggtatgaacagcccaagtgtgataataccgccagggctcacccagcaaaggccagggatctgtacaagggccggcagctacagggctgtcccggcgccaaaaaacacgaatttctcactagtgtgttagatgcactcagcacggatatggtgcatgccgcttcggacccatcctcaagctctgggaggctgtctgaacccgacccttctcacactctcgaggagagagtggtgcactggtattttaaactgctggataaaaattcttcgggcgatattgggaagaaagagattaagcccttcaagagatttcttcgaaagaagagtaaaccaaagaagtgtgtgaaaaagttcgtggaatactgcgatgttaacaatgacaaaagcatttctgtccaggagctgatgggctgcctgggagtcgccaaggaggatggcaaagctgacaccaagaaacggcacaccccaaggggacatgctgaaagcacttccaaccggcaaccccggaagcagggatag

SEQ ID NO: 206621 - DNA, 1341 bp, Artificial Sequence
  Description of Artificial Sequence: Synthetic coding sequence
atgctgctgccccagctgtgctggctgcccctgctggccggcctgctccccccagttcctgctcagaaattctccgccctgacatttcttcgcgtggaccaggataaagacaaggattgcagcctagattgtgccggcagcccccagaaaccactgtgtgccagcgatgggagaacttttctgtccaggtgcgaattccagagggcaaagtgtaaagatccacagctggaaattgcatatcggggcaactgtaaagacgtgtccaggtgtgtggccgagcgtaagtacacccaggagcaggcgcggaaggagtttcagcaagtgttcattcccgagtgtaacgacgatggaacctactcacaggttcagtgtcattcatatactggctattgctggtgcgtcacgccaaacggtcggcctattagcgggaccgcagttgctcataagacaccgaggtgccctggctctgtgaacgaaaagctgcctcagcgtgaagggaccggcaagaccgatgacgccgccgcccccgcccttgaaacgcagccccagggcgatgaagaggatattgcctctcggtacccaaccctgtggacagaacaggtcaagagtcggcagaacaagacaaataaaaattcagtgtccagctgcgaccaggagcatcagtcagccctggaggaggctaagcaaccaaagaacgataatgtcgtgattcccgagtgcgcccacggcggactctacaaaccggtccagtgtcacccttctactggctattgttggtgcgtcttggtcgatacaggccgacccattcccggtaccagcacaagatatgaacaaccgaagtgtgataacactgcccgggcccaccccgcaaaagcccgggatttgtacaagggacggcagctgcagggctgcccaggtgccaaaaagcacgaatttctgacatctgttctagacgccctctcaacagatatggtacacgccgcctccgacccgagcagtagctccggacgcctgagtgaaccagatccgagccataccctggaagagcgtgtagtacactggtacttcaagctattggacaaaaactcaagcggcgacatcggcaagaaggaaataaagccctttaaacgctttctgcgaaaaaagtctaagccaaagaaatgcgtaaagaaattcgttgagtactgcgacgtcaataatgataaatccatctccgtacaagagctcatggggtgcctgggagtggccaaggaggatggaaaagcggacacgaagaagagacatactcctaggggacacgcagagagtacttctaatcggcagcccaggaagcaggggtag

SEQ ID NO: 206622 - DNA, 1347 bp, Artificial Sequence
  Description of Artificial Sequence: Synthetic coding sequence
atgctgctgccccagctgtgctggctgcccctgctggccggcctgctgcctccggtccccgctcagaagttctctgcgctcacttttcttcgagtggatcaggataaggataaagactgcagcttagactgcgccggaagtccccagaagcccttgtgcgcgtcagacgggagaaccttcctgtcccgctgcgaatttcagcgagccaaatgtaaggaccctcaattagagattgcctatagaggaaactgtaaggatgtgtcccggtgcgtcgcggagcgcaagtacacacaagagcaggcgcgcaaggaattccagcaggtgttcatccctgaatgcaatgatgatggtacatatagccaggttcagtgtcacagttacacaggttactgctggtgtgttactcctaacggccgacctatttcaggcactgcagtggctcacaagaccccacggtgtcccggaagcgttaatgaaaagctgccacaaagggagggcactggcaagaccgacgatgccgccgctcccgcactcgagactcagcctcagggcgacgaagaggacattgcttcccggtatccaacgctttggaccgaacaggtgaaaagccgacagaacaaaaccaacaagaactctgtctctagctgcgaccaggaacaccaatctgccctagaggaggctaaacagccgaagaatgataatgtggtgattcccgagtgcgcgcacggcggcctttacaagccggttcaatgtcatccatctacagggtattgttggtgcgtcttggtggatactgggcggccaatcccaggtacaagcacacgctacgaacagccaaaatgtgacaacacggcgcgcgctcaccccgccaaagcacgggatctctacaagggcagacagctacaggggtgcccaggggccaaaaaacacgaatttcttactagcgtcctcgacgctttgtcgactgacatggttcatgccgcttctgatcctagctcctcctctggtcgactctccgaaccggacccgtctcatacactcgaagagagggtggtgcactggtacttcaagttgctggataagaattcttccggtgacatcggaaagaaagagattaaacccttcaaaagattcctgaggaagaaatccaagccaaagaaatgtgtgaagaaattcgtggaatattgtgacgtcaataacgacaagtctataagtgtacaggagctgatgggctgtctgggggtggctaaagaggacggaaaggcggataccaaaaaaagacacactcccagagggcatgcagagtcaacctctaaccgccaggagaacccccggaaggagggctag

SEQ ID NO: 206623 - DNA, 255 bp, Artificial Sequence
  Description of Artificial Sequence: Synthetic coding sequence
aagaagagcaagcccaagaagtgcgtgaagaagttcgtggagtactgcgacgtgaacaatgataagtccattagcgtgcaagagctaatgggctgtctgggtgtggccaaggaggatggtaaggccgatacaaaaaagagacacactccacgaggacacgccgaaagcacatcaaatcgtcaggacgccatggttgtttctagccggcccaaggctaccacgcaccggaaaagtaggaccctgagtcgccgttag

SEQ ID NO: 206624 - DNA, 1275 bp, Artificial Sequence
  Description of Artificial Sequence: Synthetic coding sequence
atgcgggcccccggctgcggccggctggtgctgcccctgctgctgctcgcggctgcagccctggccgagggcgatgccaagggcctgaaagagggtgaaacgcctggcaactttatggaggatgaacagtggctgtctagcataagccaatactctggtaagataaaacactggaatagattccgagatgaggtcgaagatgactatatcaaatcttgggaggacaatcagcagggagatgaggcactcgacacaacaaaagacccctgtcaaaaggtgaaatgctcacgacacaaagtctgtatagcacagggctatcagagggctatgtgcattagccgaaaaaagctggagcaccggattaaacagccaacagtgaagctacatgggaataaggacagcatctgtaagccatgccatatggctcaactcgccagcgtttgtggatctgacggccacacgtattcctccgtctgcaaactggagcagcaggcctgtttgagttccaagcagctggccgtgcgatgtgaaggaccgtgtccatgtcctaccgaacaggccgccacatcaactgctgatggaaagcccgagacttgcaccggacaagacttagcagatctgggggaccgtctacgagattggtttcagttgcttcacgaaaatagcaaacagaatggatcagcctcttccgttgcaggtcctgcttccgggttggataaatccctaggagcgtcatgtaaagacagcatcggctggatgtttagcaaacttgatacgtctgccgacctcttcctggatcagactgagctggcagcaataaaccttgataaatatgaggtatgtataaggccctttttcaatagctgcgacacatataaggatggcagagtgtccaccgctgagtggtgtttctgtttctggagggaaaaacctccctgccttgcagaactggagcgtattcagatccaggaggcggctaaaaaaaagccgggtatattcataccctcctgcgatgaggacggctactatcgtaagatgcagtgtgaccagagctccggggattgctggtgtgtagatcagttgggcctggagttaacaggcactcggacacacggctcccccgactgtgacgacatcgtggggttttccggggactttggtagcggcgtgggttgggaagacgaagaagaaaaagaaactgaagaagcaggggaagaagctgaggaggaagaaggtgaggcaggggaggccgacgacggaggttatatttggtag

SEQ ID NO: 206625 - DNA, 1266 bp, Artificial Sequence
  Description of Artificial Sequence: Synthetic coding sequence
atgcgggcccccggctgcggccggctggtgctgcccctgctgctgcttgccgccgctgcccttgctgaaggagacgcaaagggtctcaaggaaggagagacccccggtaatttcatggaggacgagcagtggctgtctagtatctcccagtattctggaaaaatcaagcattggaatcgctttagggatgatgactatatcaagtcttgggaggacaaccagcagggcgatgaagccttggataccaccaaggacccctgtcagaaggtgaaatgctctagacataaggtctgcatagctcagggatatcagagggcaatgtgtatctcccgtaaaaagttagaacacagaatcaaacagcccacagtgaaacttcatgggaataaagattctatctgcaagccttgccatatggcgcagctggcatctgtatgcggtagcgacggccatacatacagctctgtatgtaaacttgagcagcaagcttgcctgtcctccaaacagctggcagtccgatgtgaaggaccttgcccgtgtcccaccgagcaggctgcaacaagtactgctgacgggaagcctgagacatgcaccggccaagatttggcggacttgggggataggctgagggactggttccaattacttcatgagaactcaaagcagaatgggtctgcatcttccgtggcgggcccggcaagcgggctggataagtccctaggtgccagctgcaaggactctataggatggatgtttagtaaacttgacacgagtgccgatctctttctggaccagacagagttagcggccatcaatctggataagtacgaagtgtgcataaggcccttcttcaattcatgtgatacctacaaagacggtcgagttagtacagctgagtggtgtttttgcttctggcgcgagaaaccaccgtgtctggccgagttagaacgcattcaaatccaggaagctgcgaaaaagaagccaggtattttcattccgtcctgtgacgaagacggctactacaggaaaatgcaatgcgatcaatctagcggtgactgctggtgcgtggatcagcttggtctcgaactgacgggcactagaactcacggctctcctgattgcgatgatatagttggctttagtggggatttcggttctggggtggggtgggaggatgaggaggagaaagaaacagaggaggccggagaagaagccgaggaagaagagggagaagcaggagaagctgacgacggtggctatatttggtag

SEQ ID NO: 206626 - DNA, 234 bp, Artificial Sequence
  Description of Artificial Sequence: Synthetic coding sequence
atgcgggcccccggctgcggccggctggtgctgcccctgctgctgttagccgccgctgcgcttgcagaaggggacgccaagggcctgaaggagggagagacccccggtaatttcatggaggatgagcagtggttgagctccatttcgcaatatagtggtaagattaagcactggaatcggttccgcgacgtgccttcaagtgacccacctagcaccacccaagcaacaccatag

SEQ ID NO: 206627 - DNA, 1275 bp, Artificial Sequence
  Description of Artificial Sequence: Synthetic coding sequence
atgcgggcccccggctgcggccggctggtgctgcccctgctgctgcttgccgcagctgccctagccgaaggcgacgctaaaggcctgaaggagggtgagacaccaggaaactttatggaggatgagcagtggctttcatccattagtcagtatagtggcaagatcaagcactggaatcgctttagagatggcatagaagatgactacatcaagagctgggaggataaccaacagggggacgaggcgctcgacacaactaaagacccctgtcagaaagtaaaatgcagccggcataaagtgtgtattgcccagggttatcagagagccatgtgcatcagccgcaaaaagctagagcacaggatcaagcagcccactgtgaaactgcacggcaacaaggactcaatttgtaagccctgtcacatggcccagcttgcatctgtgtgtggctcagacgggcacacctactctagcgtgtgtaaactggagcaacaggcatgtttgagctccaagcaacttgctgtcaggtgcgaaggtccctgtccatgccctacggagcaagcagccacctcaacagccgatggaaaacctgagacctgcacagggcaggatttggccgatcttggtgaccgattgagggattggtttcagttactgcatgaaaactccaagcaaaatggctcagcttcaagcgtggccggccccgccagcggactggataagtcactgggcgcctcctgcaaagattcaattgggtggatgttttccaaactggatacaagcgcggaccttttcctggaccagaccgagcttgccgcaattaacctggataagtatgaggtgtgcatcagacctttctttaattcttgtgatacctacaaggatggtagagtctcaactgctgagtggtgcttctgcttttggagggagaagccaccatgcctggcggagctcgaaaggattcagatccaggaagctgcaaaaaagaagcccgggatttttatcccatcatgcgacgaggacggatattacaggaaaatgcagtgcgaccagtcttcgggggactgctggtgtgtcgaccagctcggtctggagctgactgggacacgtactcacggtagcccagactgcgacgatattgtcgggtttagtggggattttggctctggggtcggatgggaggacgaggaggaaaaggaaacagaagaagccggtgaggaagcggaagaagaagagggtgaagcaggagaagcagacgacggcgggtatatatggtag

SEQ ID NO: 206628 - DNA, 1311 bp, Artificial Sequence
  Description of Artificial Sequence: Synthetic coding sequence
atgctgaaggtgagcgccgtgctgtgcgtgtgcgccgccgcctggtgctcccagagcctcgccgctgctgccgctgtggctgccgccggaggcaggagcgacgggggcaattttttagatgacaagcagtggctgacaaccatcagccagtacgacaaagaagtgggccaatggaataagtttagggacgaggtggaggatgactacttccgtacatggtcccccggtaagccatttgatcaggctctggatcccgccaaggatccttgtctgaaaatgaagtgctcaagacataaggtatgcatcgcccaggactcacagaccgctgtgtgcatctcacaccgcagacttacacatcggatgaaagaggccggagtggaccatagacagtggagggggcctatattatcaacatgcaaacagtgccccgttgtgtacccctcccccgtctgcggttccgatggccatacttactctttccagtgcaagctggagtatcaggcctgtgtgctgggcaagcagatctctgtcaagtgcgaaggccattgtccttgcccatcagataaaccgacctcgacgagccgaaacgtaaagcgcgcctgtagtgacctggagtttcgagaggtcgcaaatagactgagagactggttcaaagcgttgcatgagagtggtagccaaaacaaaaagacaaaaactctcctgagacccgaacgcagcagatttgatacttctatccttccaatatgcaaagattctctgggctggatgtttaacaggttggataccaactacgacctgctgctggaccagtctgaattgcgcagtatctacttggataaaaatgaacagtgcacaaaagcttttttcaattcttgtgatacttacaaagacagcctgatcagtaacaacgagtggtgctactgttttcagaggcagcaggaccccccatgtcagaccgagctatcgaatattcaaaaacggcagggcgtcaagaagctgctgggccagtacattccactgtgtgatgaagatggatattacaagcccactcagtgtcacggttctgtcggccagtgttggtgcgtagaccgatacggaaacgaggtgatggggagtcggatcaatggggtggcagattgtgcaatcgactttgaaatctccggcgatttcgcttccggagatttccacgagtggactgacgatgaggacgacgaagatgatatcatgaacgacgaggatgaaatagaggacgatgacgaggatgagggggacgacgatgatggcggcgacgatcatgacgtgtacatctag

SEQ ID NO: 206629 - DNA, 1302 bp, Artificial Sequence
  Description of Artificial Sequence: Synthetic coding sequence
atgctgaaggtgagcgccgtgctgtgcgtgtgcgccgccgcctggtgcagtcagagcctcgctgctgccgcagcagttgctgccgccggtggccgaagtgatgggggcaatttcctggacgacaagcaatggcttactacgatcagccagtacgacaaggaagtgggccagtggaacaagtttagggacgacgactacttccggacttggtcccccggcaagccgttcgaccaggcacttgatcccgctaaggatccgtgccttaaaatgaagtgttcacgacacaaggtctgtatcgctcaggacagccaaactgccgtctgtatctcccacaggaggcttacacaccgcatgaaagaggcaggggtcgaccacaggcaatggaggggcccaattctgagcacttgcaaacagtgccctgttgtctacccgtcccccgtctgcggctccgacgggcatacgtattcctttcagtgcaaattagaatatcaggcgtgtgtgttgggcaaacagatttcggttaaatgcgaaggccactgcccttgcccatctgataaaccaacctctactagccgtaacgtgaaaagggcctgctcagacctggagttccgggaggtcgcaaacaggctgcgggattggttcaaggccttacatgaatctggatctcagaacaaaaaaaccaagaccctcttgcgcccagaacggtctcggtttgacacatcaatcctgcccatctgcaaggactctcttggttggatgttcaatcgtcttgacaccaactacgacttacttctggaccagagtgaactgcgaagtatctacctcgataaaaatgagcagtgcaccaaagccttcttcaactcttgtgacacatacaaggacagtcttatctccaacaacgagtggtgctactgtttccagaggcagcaggatccgccctgccagactgagctgtcaaacatccagaagcgacaaggggtcaagaaactgctgggccagtacatacccctctgtgacgaagatggttactataaaccaacacagtgccacggttctgtcggtcagtgttggtgtgtggaccgctatggcaatgaagtgatgggcagcagaatcaacggtgtcgccgactgcgcaattgattttgagatcagcggggattttgcttccggagattttcatgaatggacggacgacgaagatgatgaagatgacatcatgaacgatgaggacgagatcgaggacgatgacgaagatgaaggcgacgacgatgacggtggcgacgaccacgatgtgtacatctag

SEQ ID NO: 206630 - DNA, 1158 bp, Artificial Sequence
  Description of Artificial Sequence: Synthetic coding sequence
atgatcacccaggaccacatccacatgagcagcggcctgagccaggacgactatttcagaacctggtctccgggtaaaccattcgatcaggccctggaccccgcaaaggatccttgtctgaaaatgaagtgcagcaggcacaaagtgtgtatagcgcaggattctcagacggctgtgtgcatcagccaccgtcgtttaacacaccggatgaaggaggcgggcgtggaccatcgacagtggaggggaccaatcctaagcacgtgtaagcagtgtccagtagtgtacccttcgccagtttgtggctcagacggacacacgtatagtttccagtgcaagctcgagtatcaagcttgtgtgctgggcaagcaaatctccgtaaagtgtgaaggccattgtccctgtccctctgataagcctaccagtacctctaggaacgttaagcgagcatgcagtgacctcgagttcagggaagtagcaaacagactcagggactggtttaaggctctgcacgagtctggtagccagaacaagaagaccaaaactttgctgagacctgaaaggtctcgtttcgatacgtctatcctccctatttgcaaagatagcttgggatggatgttcaatcgccttgacactaattatgacctgctcctggaccaatccgaacttcgaagcatctatcttgataagaacgagcagtgcaccaaggcctttttcaactcctgtgacacatataaggactctctcatctcaaataacgagtggtgctattgtttccagaggcagcaggatccaccatgtcagacagaactcagcaacattcagaagagacagggcgtgaagaagctgctcggccagtatattcctttgtgtgacgaagatggatactacaagcctactcaatgtcatggctctgtcggacagtgctggtgtgtggaccgctatggtaatgaagtgatggggtccaggatcaatggggtggccgattgcgcaatagatttcgagattagcggcgatttcgcgagtggggacttccacgagtggacagacgacgaggatgatgaagacgacatcatgaacgatgaagatgagatcgaagacgatgacgaggacgagggagacgacgacgatggcggagatgaccacgatgtgtacatttag

SEQ ID NO: 206631 - DNA, 1311 bp, Artificial Sequence
  Description of Artificial Sequence: Synthetic coding sequence
atgctgaaggtgagcgccgtgctgtgcgtgtgcgccgccgcctggtgttcccagtccctcgcagcagcagcagctgtcgcggccgctggtggtcgaagtgacggggggaatttcctcgatgacaaacagtggctgactaccatctctcagtacgataaggaggtgggccagtggaacaaattcagggacgaggtggaggatgactatttccggacctggtccccaggcaagcctttcgatcaagctctcgacccagccaaagacccttgcctgaagatgaagtgctctcggcacaaggtgtgcattgcccaagacagccaaactgccgtgtgcatatcccatcgcagactgacacataggatgaaagaggccggggtcgaccaccggcagtggcgcggaccgatattgagtacctgcaagcagtgccccgtcgtgtatccaagccccgtgtgtggcagtgatgggcacacatactccttccagtgtaagcttgagtatcaagcctgtgtactggggaaacaaatttcagtcaaatgtgagggacactgcccatgccccagcgacaagcccacatccacctcgagaaatgtcaaaagggcatgcagcgacctcgagtttcgcgaggttgctaacaggttaagagactggtttaaagctctgcacgaaagtggttcacagaataaaaagaccaaaacacttcttcgcccagaaaggagccgcttcgacaccagtatactgccaatctgtaaagattcactgggatggatgttcaatcgcctggatacaaactacgatctgctgttagaccagagtgaactaagatcaatctatctcgacaaaaatgaacagtgtactaaggcgttcttcaacagctgtgatacttataaggattctcttatatccaataatgagtggtgttactgctttcagcggcaacaggatccaccatgccagacagaactgagcaacatccaaaagagacagggcgtaaagaaactccttgggcagtatatcccgctttgcgatgaagatggttactacaaacccacacagtgccacgggtccgtaggtcaatgttggtgcgttgaccggtacggcaacgaggttatgggtagccggataaacggagtggcagactgcgcaattgattttgaaattagtggagattttgcgagtggcgactttcacgaatggacagatgatgaagatgatgaggatgacatcatgaacgatgaagatgaaatcgaggatgatgatgaggacgagggcgacgacgacgatggcggggacgaccatgacgtctatatctag

SEQ ID NO: 206632 - DNA, 1302 bp, Artificial Sequence
  Description of Artificial Sequence: Synthetic coding sequence
atgctgaaggtgagcgccgtgctgtgcgtgtgcgccgccgcctggtgtagccaaagcctcgcggctgccgccgcagtagccgccgctgggggacgttccgatggtggcaactttctcgatgacaagcagtggcttactacaattagtcagtatgataaggaagtcgggcagtggaataagttccgtgatgacgactacttcaggacttggagcccagggaagcctttcgatcaagccctggatccggctaaggacccctgcctcaaaatgaagtgctctcgacataaggtgtgcatcgctcaagattcccagaccgcggtatgtatatcacaccgtcggctgacccacaggatgaaagaggccggtgtggatcacaggcagtggcgggggccgatcttatcaacctgcaaacagtgccctgtcgtgtatccttccccggtgtgtggatcagatggccatacttatagcttccagtgcaaactggaatatcaggcatgcgtactgggcaaacagatctccgtcaagtgcgagggacactgcccatgtcccagcgataagcccacaagtactagcaggaacgtaaagcgtgcgtgctctgatttggagttccgggaagtcgccaatagactgcgggactggttcaaagccttacacgaatccggctcccagaacaagaagaccaagaccctattgaggcccgagagatcccgtttcgacactagtattctgccgatttgtaaagatagcctagggtggatgttcaaccggctggatacgaattatgatctgctgctcgaccagagcgaacttcgatcgatctacctggataaaaatgaacagtgcaccaaggcattctttaactcgtgtgatacctacaaggattctctcatcagcaacaatgaatggtgctattgtttccagaggcaacaggatcctccttgccaaaccgagctctctaatatacagaaacgacagggtgtgaagaagctgttgggtcaatatattcccctctgcgatgaggacggctattacaaaccgacacagtgtcacggctccgtcggccagtgttggtgcgtcgaccgctacgggaatgaggtcatgggcagcagaattaatggcgtggccgactgtgccattgacttcgaaattagcggggactttgccagcggcgattttcacgagtggacagatgatgaggatgacgaagatgacattatgaacgatgaggatgaaatcgaggacgatgacgaagacgagggtgacgacgatgacggcggggatgatcatgatgtttacatttag

SEQ ID NO: 206633 - DNA, 348 bp, Artificial Sequence
  Description of Artificial Sequence: Synthetic coding sequence
atgctgaaggtgagcgccgtgctgtgcgtgtgcgccgccgcctggtgtagccaatctctggcagccgccgcagccgtagcggcagccggcgggagaagtgatggggggaacttccttgatgataaacagtggctgacaacgatctctcagtacgataaggaggtgggacagtggaacaagtttcgagatgaggtcgaggacgactactttcggacttggtccccagggaagccgtttgatcaagccctcgaccccgcaaaggatccatgcctgaaaatgaaatgcagccgccacaaggtctgcatcgcccaggacagccagaccgcagtgtgcatctctcaccgttag

SEQ ID NO: 206634 - DNA, 1311 bp, Artificial Sequence
  Description of Artificial Sequence: Synthetic coding sequence
atgctgaaggtgagcgccgtgctgtgcgtgtgcgccgccgcctggtgctcacaatctctggctgccgccgcagctgtcgcagccgccggaggccggtctgatggcggaaattttcttgacgacaagcagtggctgacaactatcagtcagtacgacaaggaggttggacaatggaataagttcagagatgaggtggaagacgactactttcgaacctggagtccagggaagcccttcgaccaggcgcttgatcctgcaaaagacccctgcctcaaaatgaagtgctctcgccataaggtttgcattgctcaggatagtcagaccgcagtatgcatttcacaccgccgcctgacccataggatgaaggaagcaggcgtggaccaccggcaatggcgcgggcccattctatcaacctgtaagcagtgtcccgtggtctacccaagtccggtatgtggatcagatggacacacctattcgttccagtgtaaactcgaataccaggcttgtgtcttggggaagcaaatttccgtgaagtgcgaaggacactgtccttgccccagcgacaaacctacctctacaagccgaaatgtgaagagggcctgttccgacttggagtttcgggaggtggctaataggttaagggactggtttaaagcactgcacgaatccgggagtcagaacaagaagaccaagacgctcctacgcccagagcgcagccgcttcgataccagcatactgccgatttgcaaagatagcctgggctggatgtttaaccgcctcgacactaattacgacctcctactggatcagagtgaactgaggtccatctatctggacaagaatgaacagtgcaccaaggctttttttaacagctgtgacacttacaaggattcactgatcagtaacaacgagtggtgctactgttttcagaggcaacaggatcccccgtgccagactgaattgtctaacattcaaaagcggcagggcgtgaaaaagcttctgggccagtacatcccactatgtgatgaagatggatattacaagcccacacaatgccatggatccgtcggccagtgttggtgcgtggaccggtacggcaatgaggtcatgggatcacgcattaatggggtggccgactgtgccatagacttcgaaatctcaggggacttcgcctctggagatttccacgagtggactgacgacgaagacgacgaagacgatatcatgaatgacgaggacgagattgaggacgacgacgaggatgaaggagatgatgacgatggtggggatgaccatgacgtgtatatttag

SEQ ID NO: 206635 - DNA, 486 bp, Artificial Sequence
  Description of Artificial Sequence: Synthetic coding sequence
atgctgaaggtgagcgccgtgctgtgcgtgtgcgccgccgcctggtgctctcagagtcttgctgctgccgccgctgtagcggctgctggcgggcgtagcgatggaggaaatttccttgacgacaagcaatggcttacaacgatctcacagtacgacaaggaggtggggcagtggaataaatttagagacgacgactactttcggacctggtccccaggaaaaccattcgatcaggccctcgatccagcaaaggatccatgcttaaaaatgaagtgtagccgacacaaagtgtgtatcgctcaggacagccagactgctgtgtgcatctcccataggagattgacacaccgtatgaaggaggccggagtagaccatcgccagtggcgaggtcccattctgtctacgtgcaaacagtgccctgtggtgtatccttctcccgtgtgcggctcggacggccatacttacagcttccagtgtaagctatag

SEQ ID NO: 206636 - DNA, 522 bp, Artificial Sequence
  Description of Artificial Sequence: Synthetic coding sequence
atgctgaaggtgagcgccgtgctgtgcgtgtgcgccgccgcctggtgctcccaaagcctggccgctgccgccgccgtggcggccgccggagggcggtctgacggtggcaatttcctcgacgacaaacaatggttaaccacaatctcacagtacgataaggaggttggccaatggaacaagttccgcgatgatgactacttcaggacttggagccctgggaagccgtttgaccaggcttgttccgatctggaattccgcgaagtcgccaaccgtttaagagattggttcaaggccctccatgagtccggatcccagaataagaagactaaaaccctactgagacctgaacggtcgcgctttgatacaagcatccttccaatttgcaaggacagcctgggatggatgtttaacaggttggacaccaattatgacctcctactcgaccagagtgagctccgttccatctatctggataagaacgaacagtgtactaaagctttttttaattcttgcgatacatag

SEQ ID NO: 206637 - DNA, 1182 bp, Artificial Sequence
  Description of Artificial Sequence: Synthetic coding sequence
atgctgaaggtgagcgccgtgctgtgcgtgtgcgccgccgcctggtgctcccaaagcctcgctgccgcagcggcggtagctgcagctgggggtcggtcggatggcgggaattttctcgacgacaagcagtggctgacaaccatcagccaatatgacaaagaagtgggacaatggaataagtttcgggacgatgattactttcgaacgtggagccctggtaagccttttgatcaggcactggatcccgcaaaagacccatgtctgaagatgaaatgcagtcgccacaaggtgtgtatagcgcaagacagccagacagcagtttgcattagccatcgtaggcttacccaccggatgaaggaggccggtgtggaccaccgccaatggaggggtcctattctctccacctgtaagcagtgtcctgtggtttacccgtcacccgtatgcggaagtgatggacacacctactccttccagtgtaagctggagtaccaggcctgcgtcctcggcaaacaaataagcgtgaagtgcgaggggcattgtccttgccctagcgataagcctacaagcacgagtcgcaacgtcaagcgggggttcgacaccagtatcctgcccatctgtaaggatagcctggggtggatgttcaaccgtctggacaccaattatgatctcctcttggatcagagcgaactccgatcgatttatctcgacaaaaacgaacagtgcacaaaagcgttcttcaattcttgtgatacctacaaagacagccttattagcaataatgagtggtgctattgcttccagagacagcaggaccctccgtgccagacagaactgagcaatattcagaagagacagggcgtgaagaaattgctcggccagtacatccctttatgtgatgaggacggatactataaaccgacacagtgtcacggcagtgtcggccagtgctggtgcgtcgacagatatggaaatgaagttatggggtctcggatcaacggtgtcgctgattgcgcgattgactttgagattagcggggattttgcgtctggagacttccacgagtggacggatgacgaagacgatgaagatgacattatgaatgatgaagatgagatcgaggacgacgatgaagatgaaggggatgacgacgacggaggggatgatcatgacgtttatatttag

SEQ ID NO: 206638 - DNA, 1302 bp, Artificial Sequence
  Description of Artificial Sequence: Synthetic coding sequence
atgctgaaggtgagcgccgtgctgtgcgtgtgcgccgccgcctggtgttcccagtccctcgcagcagccgctgcagtcgccgcggccgggggtagaagtgacggtggaaattttcttgacgacaaacagtggctgacgacaatcagccagtacgataaggaggtgggacagtggaacaaatttcgcgacgatgattactttaggacgtggagtcctggcaagcctttcgaccaggccttagatcccgccaaggacccctgcctcaagatgaagtgttccagacacaaggtatgcatagcccaagacagccagaccgccgtttgtatctcccacagacgcctaacccatcgcatgaaggaggccggcgtggaccaccggcagtggagaggcccgattttatccacctgtaagcagtgtcccgtggtatatccatcccctgtctgcgggagcgacggccacacctattcctttcagtgcaagttggaataccaggcttgcgtcttaggaaaacagatcagcgtgaagtgtgaaggtcactgtccctgtcccagtgataaacctacgtcaacaagcaggaacgtaaaacgagcttgttctgatttagaatttcgagaggttgccaaccggcttagggattggtttaaggcgctgcacgaatccggtagtcagaacaagaaaactaaaacactgctgagacctgaacgttctaggttcgatacatctattctgccaatctgcaaggattccttaggctggatgtttaaccgcctggatacaaattatgatttgctcctcgaccagtcagagttaagatctatctacctagataagaacgagcagtgtaccaaagcgttttttaattcttgcgacacatacaaagacagccttatctccaacaacgagtggtgctattgtttccagcggcaacaagaccccccttgtcaaactgaactctctaacatccaaaagcgccagggggtgaaaaaacttctgggacagtacatcccactgtgtgacgaggatggctattataaacccacccagtgtcacggttctgttgggcagtgttggtgtgtcgatcgatacgggaatgaggtgatgggcagtcgcattaacggcgtggctgactgcgccatcgattttgagatctctggcgatttcgcttcaggcgactttcacgagtggactgatgacgaggacgacgaggacgatatcatgaatgacgaggatgagattgaggacgacgatgaggatgaaggcgatgacgatgatggtggcgacgatcacgatgtatatatatag

SEQ ID NO: 206639 - DNA, 1311 bp, Artificial Sequence
  Description of Artificial Sequence: Synthetic coding sequence
atgctgaaggtgagcgccgtgctgtgcgtgtgcgccgccgcctggtgcagccagtctctggctgctgccgcggcggtggcagccgccggtggaagaagtgacggaggaaatttcttagacgataagcagtggctcacaacaatttcccagtacgacaaggaggtggggcagtggaataagttcagagacgaagtggaagatgattatttccgcacttggtctcccggaaagcccttcgatcaggccttggacccagcgaaagatccgtgcctgaagatgaaatgctcccgacacaaggtttgcattgcccaggacagtcaaactgcagtgtgcatttcccatagaagactgactcacaggatgaaagaggctggggtggaccacaggcagtggcggggcccgattttgtcaacatgcaagcaatgccctgtggtgtaccccagtcccgtgtgtggcagcgacggacacacatattcgtttcagtgtaagctggagtatcaagcctgcgtgctggggaaacagattagtgtcaagtgcgaaggccattgtccctgtccaagcgataagcccacaagcacatctagaaacgtcaagagagcctgctcagatcttgagttcagagaagttgcaaaccgacttcgtgattggttcaaagcacttcatgagtcaggaagccaaaacaaaaagaccaaaactttgttacggcccgagcgtagcagattcgatacctcgattttgcctatctgcaaggattcactgggctggatgttcaatcgattggataccaattatgacctgcttctggatcagagcgaactgcgatcaatatacctggacaaaaatgaacagtgcactaaggcattctttaatagctgtgacacgtataaggacagtctgatttcaaataacgagtggtgctactgtttccagagacagcaggaccccccttgccagacggaattgtcaaatattcagaagaggcaaggcgtcaaaaagctcctcggccaatacatcccactctgcgacgaggacgggtactacaagccaacacagtgccatgggtccgtggggcagtgctggtgcgttgacagatatggaaatgaagtaatgggaagtcggatcaacggagtcgctgactgtgccatcgattttgagatcagcggagattttgccagcggcgattttcacgaatggaccgacgatgaagatgatgaagacgacattatgaacgatgaagacgagattgaggacgacgatgaagacgaaggtgatgatgatgatggaggcgatgaccatgatgtctacatttag

SEQ ID NO: 206640 - DNA, 348 bp, Artificial Sequence
  Description of Artificial Sequence: Synthetic coding sequence
atgctgaaggtgagcgccgtgctgtgcgtgtgcgccgccgcctggtgctctcagtccctcgctgccgccgcggcagtggcagctgctggcggacggagcgatggcggaaactttcttgacgataaacagtggctgaccactatcagtcaatatgataaggaggtgggtcagtggaataaattcagagacgaggtcgaagatgattatttcaggacctggtccccaggaaaacctttcgatcaagctctcgacccggccaaggacccttgcttgaagatgaagtgttccagacacaaggtgtgtattgcccaagacagccagactgccgtgtgtataagtcacaggtag

SEQ ID NO: 206641 - DNA, 942 bp, Artificial Sequence
  Description of Artificial Sequence: Synthetic coding sequence
atgctgaaggtgagcgccgtgctgtgcgtgtgcgccgccgcctggtgctcccaatcgctggctgccgctgcagccgtggcagctgcaggcggtcgctccgacggggggaatttcctggatgataaacagtggttgacgactatctctcagtatgacaaggaagtggggcagtggaataagtttcgcgacgacgattactttagaacttggtctcctgggaaaccttttgaccaggctttggacccagcaaaggatccctgccttaagatgaaatgtagtaggcataaagtgtgcatagcccaagatagccagaccgctgtgtgcataagtcatagacgactgactcatcgcatgaaggaagcaggcgtggaccacagacaatggcgcggccctatcctgagtacctgcaaacagtgtcccgtagtctatccgtcccccgtgtgcggttccgatgggcatacttatagcttccagtgcaagctggaataccaggcttgcgtccttggaaagcagattagcgtgaagtgtgagggacattgcccctgcccgtcggacaagccgacaagtacttctaggaatgtgaaaagagcttgttcagacttagagtttcgtgaggttgcaaatagactaagggactggtttaaagctttgcacgaaagtggtagccagaacaaaaagacaaagaccctgctacggcccgagaggagtaggtttgatacgtccatcctgccgatctgtaaagatagcctggggtggatgttcaataggctggacacaaactatgaccttctcctggaccagtctgagttacggagcatctacctggacaagaacgaacaatgtaccaaagccttttttaactcatgcgacacctacaaggactccctgatttcaaacaatgaatggtgctactgcttccaacgccagcagggtaaacgatag

SEQ ID NO: 206642 - DNA, 1017 bp, Artificial Sequence
  Description of Artificial Sequence: Synthetic coding sequence
atgctgaaggtgagcgccgtgctgtgcgtgtgcgccgccgcctggtgttcacaatctctggccgcggctgctgccgtcgctgccgccggcgggcgcagcgatggaggaaacttcctcgatgataagcagtggctcaccaccattagccaatatgataaggaagtgggacagtggaataagttcagagactgcaaacttgaatatcaggcctgtgtgctaggtaagcagatttcagtgaaatgtgaggggcattgcccatgtcctagcgacaaacctaccagcacatctagaaacgtgaagcgggcatgttcagacttggagtttagagaggttgccaatagacttagggattggtttaaagccctccatgaatcagggtcccaaaataaaaagacgaagacattactgcgaccggagcggtcaagatttgataccagtattctgcctatatgcaaagatagtctgggctggatgttcaatagactggacacgaattatgacctgctcctggatcagagcgagctgcggtccatctatctggataaaaacgagcagtgcaccaaggcctttttcaacagttgtgatacctataaggactctttaatctccaacaacgagtggtgttattgctttcagcgccagcaggatcccccctgtcagaccgagctgagtaacattcaaaaaagacagggggtgaaaaagcttttgggccagtacatcccgttgtgcgatgaggatggctattacaagcccactcagtgccatggcagcgtcgggcagtgttggtgcgtcgaccgctacggcaacgaagtcatgggaagccggataaacggggtggcagattgtgccatcgatttcgagatttcaggggatttcgcgagcggggacttccatgagtggacagacgatgaagatgacgaagatgacataatgaacgatgaagatgaaatcgaggatgacgacgaggacgagggcgatgacgatgatggaggggacgaccatgatgtctacatctag

SEQ ID NO: 206643 - DNA, 1023 bp, Artificial Sequence
  Description of Artificial Sequence: Synthetic coding sequence
atgatcaacaacggcagcccccagagcctgagcatgacccggaagtccgactctggcactaattctgagactatgaaagaagccggggtggaccacaggcagtggaggggacccatcctgtctacatgcaaacagtgtcccgttgtctacccctcgcccgtttgcgggagcgacggccacacctattccttccagtgtaaactcgagtaccaggcgtgcgtgctaggcaaacagatcagcgtgaaatgcgagggtcactgtccttgcccttcagataagccaacttccacgtcaaggaatgtgaaaagggcctgctccgacctggaatttcgtgaagtggccaatagactgcgtgactggtttaaagctttacacgagtcggggtcccagaacaaaaaaactaaaaccctcctaagacccgagcggtctcgctttgacacctctatcttgccaatttgtaaggatagtcttgggtggatgttcaaccgcttggacaccaattatgacctgctgctggatcagagcgagctgcggtctatctacctggataagaatgaacagtgtactaaagctttcttcaactcatgcgacacttacaaggatagtcttatcagtaataatgagtggtgttattgcttccagcggcagcaagaccccccctgtcaaaccgaactttctaacattcagaagcgccaaggagtgaagaagctgctcggtcaatatatccccctgtgtgacgaagacggatattataagcctacccagtgccatggatcagtcggacagtgttggtgcgtggacaggtacgggaatgaggttatgggcagcagaatcaatggggtggccgattgtgctatagatttcgagatcagcggggattttgctagcggcgactttcacgaatggactgatgacgaggatgatgaggatgatatcatgaacgacgaggacgagattgaagacgatgatgaggacgagggtgatgacgacgacggcggagatgaccacgatgtctacatatag

SEQ ID NO: 206644 - DNA, 915 bp, Artificial Sequence
  Description of Artificial Sequence: Synthetic coding sequence
atgaagtgcagccggcacaaggtgtgcatcgcccaggacagccagacagcagtgtgcatcagtcacagacgcctgacgcaccggatgaaagaagcaggggttgaccaccggcagtggagaggaccaattctgagcacatgcaagcagtgccctgttgtgtaccctagccctgtctgtggctcagatgggcatacttactcgtttcagtgcaagctagaatatcaggcgtgtgtgctcgggaaacagatttcagtgaagtgtgagggtcattgtccctgcccctcggataagccaacttctacaagcagaaatgtgaagcgcggattcgataccagtatcctgccaatctgtaaggatagtctgggctggatgttcaaccgcctggacaccaactatgatctcctgctggatcagtcggagctgcgtagcatttatctagacaagaacgagcagtgcacaaaggcctttttcaacagctgcgacacctacaaagactctctgatctccaataacgagtggtgttactgctttcagcggcagcaggatcctccttgccagacagagttatcaaacatccaaaagagacagggagttaagaagctcctgggccaatacattcccctttgtgatgaggatggatattacaagccaacacaatgccacggctctgtgggccaatgctggtgtgtcgataggtacggtaacgaagtgatgggaagtagaatcaacggcgtggctgattgtgccatagactttgagataagtggcgatttcgcgagcggggacttccatgagtggacagacgatgaagacgacgaggatgatattatgaacgatgaagacgaaatagaagacgacgatgaggacgagggagatgacgacgatggcggggatgatcatgatgtctatatttag

SEQ ID NO: 206645 - DNA, 951 bp, Artificial Sequence
  Description of Artificial Sequence: Synthetic coding sequence
atgaaggaggccggcgtggaccaccggcagtggcggggccccatcctttcaacctgtaagcagtgtccagtggtgtatccctcaccagtgtgtgggtccgatggacacacctatagctttcaatgcaaactggaataccaggcctgcgtgctgggcaaacagatcagcgtcaagtgcgagggtcactgtccctgtccttctgataagcctaccagcacttcgaggaacgtgaagcgagcctgttccgacctagagtttcgggaagtggcaaacaggctgagagattggttcaaagccttgcacgaatcaggatcccaaaataaaaaaaccaagaccctgttgaggcccgagcggtcgcggttcgatacgtcgattctgcctatctgtaaggactccctagggtggatgttcaatcggcttgataccaattacgaccttctgttggatcaaagcgaactcaggtctatctatttggacaaaaatgaacagtgtaccaaagccttttttaatagttgcgacacatataaggactcactgatttccaataacgagtggtgttactgctttcagaggcaacaggaccctccctgtcagacggaacttagcaacattcagaaaaggcagggcgtgaaaaagctgctcgggcaatatatccccctgtgcgatgaagacggatattataaaccaacgcagtgtcacggcagcgtaggtcagtgttggtgcgtggaccgctatggtaatgaagtgatgggcagtagaatcaacggggtagccgactgtgcgatcgatttcgagatcagtggggactttgctagcggtgattttcatgaatggaccgacgatgaggacgatgaggacgacattatgaacgatgaggatgaaatcgaagatgacgatgaggatgaaggggacgatgacgatggcggcgatgaccatgacgtctacatatag

SEQ ID NO: 206646 - DNA, 1017 bp, Artificial Sequence
  Description of Artificial Sequence: Synthetic coding sequence
atgctgaaggtgagcgccgtgctgtgcgtgtgcgccgccgcctggtgctcacagtctcttgcggccgctgccgcagtcgccgcagccggtggccgaagcgatggcgggaatttcctcgacgataagcagtggctcactacaattagccagtacgataaagaggtcggtcaatggaacaagtttcgggattgtaaactcgagtaccaggcctgcgtcctcggcaagcagatttccgtcaagtgcgaggggcattgcccgtgcccatctgataagcctacttctactagcagaaacgttaagagggcttgttctgacctagagttcagggaggtagccaataggttaagagattggttcaaggcgctgcatgaaagcggtagccagaataagaaaaccaagactctgctgaggcctgagaggtcccgattcgacacaagcatcttgccaatttgcaaagacagcctaggttggatgtttaatcggctggatacaaactatgacttgctactggatcagtccgaactacgcagtatttacctggataagaatgagcaatgcacgaaagcattcttcaactcatgcgacacctacaaagacagtctgataagcaacaacgaatggtgctattgctttcagagacagcaggatcccccatgccaaactgaattgtccaatatacagaagcgccagggtgtcaaaaagctattgggccagtacattccactgtgcgacgaggacggatactacaagcctacccagtgccacggttctgtcggccagtgctggtgtgtggaccggtacgggaatgaggtcatggggagccggattaacggagtggcagactgcgccattgactttgagatttctggtgactttgccagcggggacttccatgagtggaccgatgatgaggatgatgaggatgacataatgaacgacgaagacgagatcgaagacgacgatgaggacgaaggggatgatgacgatgggggtgatgatcacgacgtctacatttag

SEQ ID NO: 206647 - DNA, 13740 bp, Artificial Sequence
  Description of Artificial Sequence: Synthetic coding sequence
atggagaccaaggagaaccggtgggtgcccgtgaccgtgctgcccggctgtgtgggatgtagaaccgtggccgctctggcctcatggacagtccgggatgtcaaggaaagaatcttcgccgaaacagggttccccgtgagtgaacagcggctgtggagaggtggaagagaactgtccgactggatcaagatcggggacctgacaagcaagaactgccaccttttcgtcaatctccagtctaaagggctcaagggcggtggaaggtttgggcagacgactcctcctctggtcgatttcttgaaggatattctccggcggtatccggaaggcggccaaatcttgaaagagcttatccagaacgcagaggacgcaggcgcaaccgaggtgaagttcctctatgatgaaacacagtacggaacagagactctgtggtctaaggacatggcaccctatcaggggcctgccctgtacgtatataacaacgccgtcttcactcctgaggactggcacggcatacaggagattgcccgctcccgcaagaaagatgatcccctgaaggttggcaggttcggcatcgggtttaactcagtgtatcacattacagacgtaccttgtatcttcagcggggaccagatcggcatgttggatccgcaccagacgctgtttggaccccatgagagcggacagtgctggaacctgaaggacgacagtaaagaaatctcagaactctcagaccagttcgcgccattcgtggggatcttcggctcgacgaaggaaactttcattaacggtaattttcccggtacattctttagatttccattgcggcttcagcctagccaactgagttcaaacttgtataacaagcagaaggttttggaactattcgagagctttcgagccgatgcagacactgtattactcttcctcaaatccgtccaggacgtttcactgtacgtgcgggaggcagacggcacagagaaattggttttccgggtaactagctctgagtctaaggccttgaaacatgagagaccgaatagtatcaaaattttgggcacagcaatctctaactactgcaagaagacaccaagtaacaacatcacctgtgtgacctaccacgtaaatatcgtgctagaggaagagtcaaccaaggacgcccagaagacctcatggctggtttgcaatagcgtcggggggagagggatatcgtctaagcttgacagcctcgccgacgaactcaagttcgtgcccattatcggtatcgcaatgccattaagctcaagagatgacgaggccaaaggagcaacaagcgacttttcaggcaaggccttctgcttcctgccacttccccctggggaggaaagctccacgggccttccagtgcatattagcggattcttcgggctaactgacaacaggcggtccatcaaatggcgagagctggaccagtggcgcgaccccgcagccctgtggaacgaatttcttgttatgaacgtcgtgcccaaggcctatgccactctgattttagactccattaagcgattagagatggaaaaaagctctgatttccccctgtctgttgacgtcatttataaattgtggcccgaagcttccaaggtgaaagttcattggcagccggtactcgaacctttatttagcgagttactccagaacgccgtcatctattctatttcctgcgactgggtccggctggaacaggtttacttctcagagctggacgaaaacctggagtacactaagactgttctgaactacctccagagttctgggaaacagatagcaaaagtacccgggaatgtcgatgccgccgttcagttgacagccgctagcggaactacccctgtgaggaaggttacacccgcatgggtacgtcaggttctccggaagtgcgcccacctgggttgtgctgaagaaaagcttcatctcctggagtttgttctctcagatcaggcctatagcgagttgttgggcttggagctgttgccactgcagaacgggaatttcgttcccttttctagtagcgttagtgatcaggatgtgatctatatcacatcagccgagtatccacggagcctttttccaagcttagaaggtagattcatacttgataacctgaaacctcatcttgtcgccgctcttaaggaggctgctcaaacaaggggcagaccctgtacgcaactgcaactactgaatcccgaacgctttgccaggctgatcaaagaggtgatgaatacgttctggccaggacgagagttaatagtgcaatggtatccatttgacgagaacagaaaccatccctccgtttcctggctgaagatggtttggaagaatctgtacatccatttttctgaggacctaacacttttcgatgaaatgccactcatcccgcgaacgatcctggaagagggccagacatgtgtggaactcataagactccgcatcccttctttggtcatactggacgatgagagcgaagcccaactcccagagtttttggctgatatcgtccagaagctgggggggtttgtccttaagaagcttgatgccagtattcagcatccgctgataaagaaatatatccacagccccctgcccagcgccgtcttgcagatcatggagaagatgccccttcagaaattgtgtaaccaaattacttcgctgctgccgacgcacaaagacgcgctgcgaaagtttctggccagcctaacggattcaagcgaaaaagagaaaaggattattcaggagctcgcgatcttcaagcggattaaccactcctctgatcaaggcattagcagctataccaaactcaaggggtgcaaggtgctgcaccacacagctaagctgcccgccgatctgcggttgtcaatatccgttatcgactcgtctgacgaggctacgataagattagcgaacatgcttaagattgagcaactcaaaactacttcatgcttaaagctagtgctcaaagacatcgaaaatgcattctacagtcatgaggaggtcacccagttaatgctttgggttctggagaacctgtcatctttaaagaacgaaaatcctaacgtcttggagtggctcactccactcaagtttatccagattagccaggagcagatggtgagtgctggggagctctttgaccctgacatcgaggtactgaaggatctgttctgtaatgaagagggaacatacttcccacctagtgtgttcaccagtcccgatattctgcacagtcttcggcagattggactgaagaatgaagcatctctgaaggagaaggatgttgtccaggtcgcgaaaaaaatcgaggcgcttcaggtgggcgcatgccccgatcaggacgttttgctgaagaaagccaaaactctgctcctggtgctaaataagaatcatactcttcttcaaagctctgagggcaagatgactctaaagaagatcaagtgggtgccagcgtgcaaagaacgtcctcctaattacccggggtctttggtgtggaagggcgacctctgtaacttgtgcgcccccccagatatgtgtgacgtcgggcacgcaatcctcattggttcatctctgcccctagtcgaaagtattcacgtaaatttggagaaagctctggggattttcacaaaaccttcccttagtgcggtgctgaaacacttcaaaattgtagtggactggtattcatccaagactttttcagacgaagactattaccagtttcagcacattctgcttgaaatatacggctttatgcacgaccacctcaacgagggtaaagactccttcagggccttgaagtttccctgggtgtggacgggaaaaaaattctgcccactggctcaagcagtaatcaaacccattcacgatcttgacctccagccatatttgcacaacgtgccaaagacaatggcgaagtttcaccagctttttaaggtgtgcggatctatagaggagttgacaagcgaccacatctctatggtgattcagaaaatttacttaaagagtgatcaagacctctctgagcaggaaagcaaacaaaatctccacctgatgcttaacatcatacgatggttgtacagcaatcaaatacctgcatctccgaacacccccgtgcccatccatcattcaaagaatcccagtaagctaatcatgaagccgattcacgaatgctgttattgtgacataaaggtggatgacttaaacgatctcctggaggacagcgtggaacctatcattctggtgcacgaggacatccctatgaaaactgccgaatggctcaaagtaccatgtctcagcacaagattgataaatccagaaaatatgggatttgaacagtcaggccagcgagagcctctcaccgtgcgaataaagaatattctggaggaatacccatccgtgagcgacatcttcaaggaactgctgcaaaacgctgacgacgccaacgcgacagaatgctctttcttgattgatatgcgccggaacatggatattagggagaatttacttgacccagggatggcagcctgtcacggcccggcgctgtggtcttttaacaattctcagttctccgattccgactttgtgaatatcactcgccttggagaatcactaaaacgtggagaagtagacaaggttggcaagtttggtctgggattcaactccgtttatcatatcacagacatccctatcatcatgtctagggaatttatgatcatgttcgatccaaacattaaccatattagtaaacacattaaagataagagcaatcctggaataaagattaattggtctaaacaacagaaacgtctgagaaaatttccaaaccagttcaagccctttatcgatgtgtttggatgtcagctgcctctcactgtcgaggctccttatagttacaatggcaccctcttccgactttctttccggacacaacaggaggccaaggtctccgaggtttctagtacttgttacaacacagccgacatctactctctcgtggatgaattctccttatgcggacacaggctcattatattcacgcagtccgtgaagtctatgtacttgaagtacctgaaaattgaagagaccaacccctcactcgctcaggataccgtgatcattaagaagaagtcctgctctagcaaggcactgaacactcccgttctgtccgtgcttaaggaagcagccaaactgatgaagacatgtagcagctccaacaagaagctgccatctgatgagcctaagagtagttgcatactgcaaatcacggtggaggaatttcaccacgtcttcagacgcatcgccgatctgcagtcccccctgttccgcggtccggatgacgatccagcagccctttttgagatggccaaatcaggccagtccaaaaaacccagcgacgagttatcacagaaaacagtggagtgcactacatggctgctctgcacatgcatggacaccggagaagcactgaaattctctctgtcagagagtggacggagactaggactggtgccctgtggggcggttggagtacaactgtcagagatccaggaccaaaaatggacagtaaagcctcatatcggagaggttttttgctacctgcccctcagaatcaaaacaggcctgcctgtccatattaacggatgcttcgccgttacttccaaccggaaagaaatctggaaaaccgataccaagggtcgctggaacaccacctttatgcggcatgtcattgtgaaggcctaccttcaagttctttcagtgcttcgcgacttggcaaccagcggcgagctcatggactacacgtattatgcagtgtggcccgaccccgatctggtgcacgatgacttcagcgtaatttgccagggattttacgaggacattgcacatggaaaggggaaagaactgacaaaggtgtttagcgatggcagtacatgggtatctatgaagaacgtcaggttcctggacgactctatcttgaagcgacgggacgtggggagcgcagcattcaagatttttctaaagtacctcaagaaaaccggctcaaaaaacctctgcgctgtcgaactgccatcatcagtgaagctggggtttgaggaggcaggctgcaagcagatcttgctggaaaacacgttcagtgagaagcagtttttttctgaggtgttttttcccaacattcaagaaattgaagcagagcttagggatccgctcatgatatttgtgctgaacgagaaagtggatgagtttagcggagtcctgagagttacaccctgtattccatgcagcctggaggggcaccccctagtgctaccctctaggttgatacatcctgaaggcagagtcgccaaactgttcgatatcaaggatgggaggtttccctacggatctacacaggactacctgaaccctattatcctcattaagctggtgcaactgggaatggcgaaggatgacattctgtgggacgacatgctcgaacgggccgtgagcgttgccgaaatcaacaaaagcgatcatgtagcggcttgtcttcgatccagcatactgcttagcctgattgacgagaagctgaaaatacgagatcctcgggctaaagactttgccgccaaataccagacgattcgcttcctgcccttcctcactaagccagccggattttccctggactggaaggggaattcattcaagcccgaaacaatgttcgctgcgaccgatctttataccgccgagcaccaggatatcgtgtgtcttctccagcctattttgaacgaaaacagccattcattcagaggatgtgggagcgtgtccctggccgtgaaggagtttctgggcctactaaagaagcccacagtcgacctagtgatcaaccagctaaaagaggtcgccaagtcagttgacgacggaatcacactgtatcaggagaatattactaatgcctgttataaataccttcacgaggcacttatgcaaaatgagataaccaaaatgtctatcatcgataagctcaagccctttagcttcattcttgtcgagaatgcttacgtggactccgaaaaggtttcctttcacttaaatttcgaagccgcaccttacctttatcagcttcctaacaaatacaagaataactttagagaactctttgagaccgtgggtgtaaggcagtcctgtacagtggaagacttcgcgctcgtgctggagtctatcgatcaggagcggggaactaagcagataaccgaagaaaatttccaattatgcagacgaattatctcagagggaatttggtcactcataagggagaagaagcaagagttttgcgagaagaattatggcaaaattctccttcctgatactaatctcatgcttttgcctgctaagagtctctgctacaacgattgtccctggataaaagtgaaagatactactgtcaagtattgccacgccgacatccctagggaagtggcagttaagctaggggcagtgcctaaacgccataaagctttggaacgctacgcaagcaacgtttgcttcaccactctcggcaccgaatttggtcagaaggagaaactgactagtcgcatcaaatctatcctaaatgcctacccaagtgaaaaagagatgctgaaagagctcctgcaaaacgcagatgatgccaaagccacagagatttgttttgtgttcgatccaagacaacaccctgtcgacaggatttttgatgacaagtgggctcccctccaaggccctgctctgtgtgtatataacaatcaacccttcactgaggacgacgtgaggggaatccagaatcttggcaaggggacaaaggaaggtaacccgtacaagacaggacagtatggcataggctttaattccgtatatcacattacggactgcccatctttcattagcggcaatgacatcctctgtatctttgacccgcatgcacggtatgcccccggcgccacaagcatcagtcctggtcgcatgttccgcgatttggacgcagactttcgaacccagtttagcgacgttcttgatttgtatttaggaacacactttaagcttgataattgcaccatgttccgattcccgctgcggaacgccgaaatggccaaggtatctgagatcagctcagtgcctgcctcagatagaatggtgcaaaatctcctcgacaagctgagatccgatggggcggaattactcatgttcctgaaccacatggagaaaatcagtatttgtgagatcgataagagtacaggcgccctgaacgtactgtactctgtgaagggaaaaataactgatggcgatcgccttaaaaggaagcaatttcacgcatctgtgatcgatagtgtgactaaaaaaaggcagcttaaggacatccctgtacaacagattacttacactatggacaccgaagacagcgaagggaacctgaccacttggctgatttgcaatcggagtggcttttcttcaatggaaaaggtcagtaaaagtgtcatctcagcccacaagaatcaggacatcactttgttccctagaggaggagttgctgcctgtatcacgcacaactacaaaaaaccgcatagggcattctgtttcttgccgttatcactggagacaggcctgccatttcacgtcaacgggcatttcgccttggatagcgcccgtcgaaacctgtggcgcgacgacaacggcgttggagtgcgaagcgactggaataacagcttgatgaccgctctgatagctcccgcttacgtggaactcttgattcagctgaagaaacgttatttccccggatccgatccaacgctctcagtactgcaaaatacacccatccacgttgtgaaggataccttgaagaagtttctgagcttttttccagtgaacaggctggacctacagcccgacctgtactgcctcgtcaaagccttatataattgcatccatgaggacatgaagagattactacccgttgtccgggcacccaatatagatgggtctgatctgcatagtgcagtaatcattacatggataaacatgtccacatccaataaaacccgaccttttttcgacaacctgcttcaggatgaactgcagcacttgaagaacgccgactataatatcaccacaaggaagacggtagccgagaacgtgtataggttaaagcatctgctcttagagatcgggttcaatctcgtgtataactgtgatgagaccgctaacctttatcactgcctgatagacgcagacattcctgtgagttatgtcacgcctgctgacataagaagttttctgatgacatttagctccccagatacaaactgccacatagggaagcttccctgccgactccagcagacgaacctgaaactgtttcattctctcaaactcttggtcgactactgttttaaggacgcagaggagaacgagatcgaagtggaaggacttcccctcttaataacactggattctgtcctgcagaccttcgacgccaagcgacctaaattcctgacgacctaccacgagctcatcccctctcggaaggatctattcatgaatacgttgtacctgaagtactcaaatatcttgctcaactgcaaggtggccaaggtttttgacatctccagcttcgcagacctgctgtcctctgtgctgccccgggagtataaaacaaagtcctgtaccaagtggaaggacaattttgccagcgagagctggctgaaaaacgcctggcactttatctctgagtcagtcagtgttaaggaggatcaggaagagactaaacctaccttcgacattgtggtcgacaccctcaaagattgggccctgcttcccggcactaaatttacggtttctgcaaaccaattggtggtgcctgagggtgatgttcttcttcccctgagcctcatgcatatcgctgttttccccaatgctcagagtgataaagtgttccatgctcttatgaaggccggatgtattcaattagccctcaataagatttgcagcaaggattccgcattcgtgccactgctcagctgtcacaccgctaatattgagagtcccacaagcatactgaaagccctgcactatatggtacagacatcgaccttccgcgccgaaaaattggtcgaaaatgactttgaggctttgctgatgtactttaactgcaatctgaatcatctgatgtcccaggacgacatcaagatactgaagtccctgccgtgctacaagtccatcagcggccggtatgtctccattggtaagttcggcacatgctacgtcctgacaaagtccatcccctcggcagaagtggagaagtggactcaaagttcctcaagcgctttcctggaggaaaagatccacctgaaagaattatacgaggttattggctgtgtgccagtggatgatcttgaagtgtatcttaaacatctgctgccgaagatagaaaacttgagttatgatgccaagctcgagcatctcatttatctgaaaaacaggttgtcatccgcggaagaattatccgaaataaaggagcaactgtttgagaagctcgagagtctgctgatcattcacgatgctaacagccgtctcaaacaggcgaaacatttctacgaccgcaccgtgagagttttcgaggtgatgctgccagaaaaactgtttattcctaatgatttttttaaaaagctggagcaactgattaagcccaagaaccatgtgacctttatgacctcttgggtcgagtttctgcgcaatattggcctgaagtatatccttagccagcagcagctgctgcaatttgccaaagaaatatctgtgagggccaatactgagaattggagcaaagagactctccagaacactgtggacatactactgcatcacatttttcaggagagaatggatctactctcaggcaactttctcaaagagttgagtctgatacccttcctgtgtcccgagcgggctccggccgagttcatcaggttccaccctcagtaccaggaagtgaatggcacactgcctctcatcaaatttaacggcgctcaggtcaaccctaaattcaagcagtgtgacgtgttacagcttctgtggacctcctgtcctattctgcctgaaaaagccactcccctgtctattaaagagcaagagggaagtgatcttggaccgcaggaacagctcgaacaggttctaaacatgctaaacgtgaacctcgaccctccgctcgataaagtaataaataactgtcggaacatttgtaatatcacaactctcgatgaagagatggttaagacccgggctaaagtcctgcggtctatttatgagttcttatccgcggaaaaacgcgagtttaggttccagcttcgcggagtagcctttgtgatggtggaggacgggtggaaattgcttaagccagaggaggtggttatcaatctagagtacgagagtgatttcaaaccatacctatacaaactgcctctcgagttaggtacttttcaccagctgtttaagcatctgggtaccgaggacataatttctacaaagcagtatgtggaagttctgtcccggatctttaagaactctgaaggtaagcagctggaccccaatgagatgagaactgtcaagagagtcgtgagtggactgttcaggagtctgcagaacgatagtgtcaaggtgcgaagtgatttggaaaacgtacgcgacctggctctctaccttcccagccaggacggacgcctggtgaagagctccatcctggtgtttgatgatgcccctcattacaaaagcagaatccagggcaatattggggtccagatgcttgttgatctgtcacaatgctatctggggaaggaccatggcttccacaccaagttgatcatgctctttccccagaagctgcggccccgattgttgtctagcattctggaagagcagctggacgaggaaacccctaaggtgtgccagtttggagccctctgctccctgcagggtaggctgcaacttctgctcagtagtgaacagttcattaccgggttaatcaggatcatgaagcatgagaacgacaatgcttttctcgccaatgaggaaaaagcaattagattatgcaaggccttgcgagaaggtttaaaggtttcttgcttcgagaaactgcaaaccacactgagagttaagggctttaatccaatcccacattctcgatctgagacctttgctttcctgaagagatttggtaatgcggtgatcctactttatattcaacatagcgactcaaaggatatcaactttctcctggctctggccatgacactcaagagcgccaccgataatctcatctcggacacctcttacctaattgctatgttgggatgcaacgatatttaccgcattggggaaaagctggattcacttggtgtaaaatatgactcctccgagccctccaagcttgaattacctatgcctggaactccaattcctgccgaaatacactacacattactcatggatcccatgaacgtcttttacccgggagagtatgttggatacttggtggatgctgagggcggagatatatacgggtcttaccaaccgacttacacttatgctatcattgtacaggaagtggaaagagaggacgccgataatagtagcttcttgggaaagatataccagattgacattggttatagcgagtacaaaattgtttcctcactggatctctacaagttcagccggccagaagaaagtagtcagtccagggactcagcgcctagtacaccaacctcacctacagaatttctaacaccgggactcaggagcatcccccccctcttcagcggcagggagtcccacaagaccagcagcaaacaccagtcacctaaaaagctgaaagtcaactctttgcccgagattctgaaggaggtgacatctgtcgtggagcaagcttggaaactgcctgagtccgaaagaaagaagatcattaggcggctctatctgaaatggcacccagataaaaatcctgagaaccatgatatagccaacgaggtttttaagcatttacagaacgaaattaatagactggagaagcaggcgtttttagatcagaatgccgaccgcgcaagccggcggaccttcagcacttcagcatcccgctttcagtcggacaaatattcattccaaaggttctatacttcttggaatcaggaggcaacaagtcacaaaagcgaacgtcaacagcaaaataaggaaaagtgcccaccaagcgccggccagacatactcacagcgtttcttcgttcccccgacatttaaaagcgtcggcaacccagtggaagcccgccggtggctgcgccaggcgcgagctaatttttccgccgccagaaacgatctgcataagaacgcaaatgaatgggtgtgcttcaaatgttacctgtccacgaagctcgctctgatcgcagcagactacgccgtcagaggcaagagtgataaggatgtgaaaccaaccgctctagcccagaaaattgaggaatatagccagcagctagaggggctcaccaacgacgtgcataccctcgaggcctatggggtagattccctgaaaacccgatatcccgatttgctgccgttcccccagatccctaacgatagatttactagcgaagtcgccatgcgcgtaatggagtgcactgcctgcatcataattaaactggagaactttatgcagcagaaagtatag

SEQ ID NO: 206648 - DNA, 13740 bp, Artificial Sequence
  Description of Artificial Sequence: Synthetic coding sequence
atggagaccaaggagaaccggtgggtgcccgtgaccgtgctgcccgggtgtgtggggtgccgcactgttgcagcactggcgtcctggactgttcgtgacgtgaaggagagaatcttcgctgaaacaggctttccagttagcgaacagcgcctctggcggggtggaagagagctgtccgattggatcaagatcggcgacttgacctctaaaaactgtcatctgttcgtcaacctccagtctaagggacttaaaggaggaggtcggtttggccaaaccactccacccctggtggacttccttaaggacattttaaggagatacccagagggaggccaaattttgaaggagttgatccagaatgctgaagacgctggcgcaaccgaagtgaagttcctttatgatgaaactcaatatggaacagagactctgtggtctaaggatatggctccataccagggaccagccctgtacgtttataataatgcagtgtttaccccagaagattggcatggcatacaagaaattgcgcggagtcgaaaaaaggacgaccccctcaaagtcgggaggtttggaataggttttaacagtgtttaccacatcaccgacgtgccatgcattttcagcggcgatcaaattggcatgctggacccccaccagacactcttcggtcctcatgaatctggacagtgctggaacctgaaagatgactctaaggagataagtgaattaagtgatcagttcgctccctttgtcggaatattcggatctacaaaagagacctttattaacgggaattttcctgggaccttctttagatttccccttagacttcagcctagtcagctcagcagcaatctgtacaataagcaaaaggtgttggaactcttcgaatctttcagggctgacgcggataccgtgcttctgttcctcaaaagcgtacaagacgtaagcctctatgttagagaggctgacgggaccgaaaaactcgtgttcagagttacttccagcgaatccaaagccctcaagcatgaaagaccgaacagcattaaaatcctcggtactgccattagcaactattgcaaaaagaccccttccaataacataacatgtgtgacttaccatgtgaatattgtgcttgaagaggaatctaccaaagatgctcagaaaacgagttggctggtgtgtaatagtgtgggggggcgggggatatcatccaaattggattctttggccgatgaactgaagttcgtcccaatcatcggtatcgctatgcccctatcaagccgcgatgatgaggcaaagggtgctacctccgatttttcggggaaagccttttgcttcctccctttacctccaggcgaagagtcatctacaggcttgccagttcatatcagcgggtttttcggtttgactgacaatcgccgcagcattaagtggcgagagctggaccaatggcgggaccccgctgcactgtggaacgaattcttagtgatgaacgtggtccccaaggcttatgccacactcattctggatagtataaaaaggctggaaatggagaaatcttctgactttcccctgtctgtggatgtgatatataagctgtggcccgaggccagtaaagtgaaggtgcactggcagcctgtgctcgagcccttgttctccgagctgctacaaaacgccgttatatattctatttcctgtgattgggtaagactggagcaggtctatttctctgagttggatgaaaatctggaatacacaaaaacagtgctgaactatctccaatcctcaggcaaacagattgcgaaggtgcccggcaacgtcgatgccgctgtacaactgactgcggcgagtggcaccactccggtgagaaaggtgacccctgcatgggttcggcaggtactccgcaagtgcgctcatctaggatgcgctgaggagaaactgcacctcttggagtttgttctgtctgatcaagcatactccgagctcttgggcctggagctgctgccactccagaacgggaactttgtcccattctcatcatctgtatccgaccaggacgtcatctatatcacatccgcggagtatcctcgtagcctgtttcccagcctggagggcaggttcattctcgacaacctcaagccacatttagtagccgccttaaaggaggcggcacagacacggggacggccttgtacacagctacagttgctcaatccagaacgctttgcaagactgatcaaagaagttatgaacaccttttggcccgggagagaactgattgtacagtggtaccccttcgacgagaatagaaaccatccatcagtgagctggctgaagatggtgtggaagaacctgtacattcatttctcggaggacctgaccctatttgacgaaatgcccctgatcccgaggaccatactcgaagaggggcagacttgcgtcgagttaatccggctgcgaattcctagtctcgttattctggacgatgagagcgaagcccaactgcccgagtttctcgccgatatagtgcagaagctgggcgggtttgtactcaagaagcttgacgcctctatacagcacccccttatcaaaaaatacatccattcccctctgcccagcgctgtgctacagataatggaaaaaatgccattgcagaaactctgcaaccagatcacctcactgctgccgacacacaaagacgccctccgcaaattcctcgcctccttgacagacagctctgaaaaggaaaaaaggattatacaggagctcgctatcttcaagcgcattaatcacagttctgaccagggtatctccagctatactaaattaaaggggtgcaaagtgttgcaccacaccgcaaaattacctgcagatctgcggctctctatcagcgtgatcgatagctcagatgaagcgacaattagactcgcaaacatgcttaagatcgagcaactgaagaccacatcatgcctcaaacttgttctgaaagatattgaaaacgctttctacagccacgaagaggtcacacaactgatgctttgggttctggaaaatctcagcagtctaaagaatgagaaccctaatgtcctggaatggttgacgcctctgaagttcattcagattagtcaggaacagatggtgtcagctggagaactgttcgatccagacatcgaggtcctaaaagatctcttttgtaatgaggaggggacgtactttccaccatccgtatttacatcccccgacatcctgcactccctaagacaaatcggactcaaaaatgaggccagtctgaaggaaaaagatgtggttcaggtggcaaagaaaatcgaggctctgcaggtaggagcatgtcccgatcaagacgtgctactgaagaaggccaaaacactgctcctggtattgaataagaatcataccctgctccagtcaagcgaaggtaagatgaccctgaagaaaattaaatgggtgccagcctgcaaagaacgccctcctaattaccctgggtctctggtgtggaaaggcgatctttgcaacctctgcgcacctccagacatgtgcgacgtgggtcacgcgattctgattggaagttcactgcctctggtcgagagtatccatgtgaatctcgagaaggcgctgggtatttttacgaagcccagtttgagcgcggttctgaaacactttaaaatcgtggttgattggtacagctcgaagaccttttccgatgaggactactatcaatttcagcacattctgctcgaaatctatggatttatgcatgatcacctcaatgaaggaaaagattccttcagggccctgaagttcccatgggtgtggaccggcaaaaagttctgtcctctggcccaagcggttattaaacctattcacgatctggacttgcaaccctaccttcacaacgttcctaagactatggccaagttccatcagttgttcaaggtttgcggctctattgaagaactgacgagcgaccatattagtatggtaattcagaaaatctatctcaagtctgatcaagatctgtcagagcaggaatcaaaacaaaatctgcatttgatgttaaacataatccgatggctgtactccaatcaaattccagcctcccccaatacaccggtgccaattcatcatagtaagaacccatcaaaactgattatgaagcctatccatgaatgttgttattgtgacataaaggtggatgacttgaatgacctcctagaagactcagttgagcctatcatactggtgcacgaagatatcccaatgaagacagctgagtggttgaaagtcccctgcctcagcacgagactgattaaccccgagaatatggggttcgaacaatccggacagagggagcccttgaccgtaagaattaaaaatattctggaagaataccccagtgtcagtgatatctttaaagaactcctgcagaacgccgatgacgctaatgcgacggaatgctctttccttatcgacatgcgtcggaacatggacattcgagaaaatctgttggaccctggcatggccgcctgtcatggtccggcactctggtcatttaataatagccaattcagcgacagcgatttcgtcaacatcacaaggctaggtgaatcgttgaagagaggtgaagtcgataaagtgggcaagtttgggctgggatttaactctgtctatcacatcactgatatacccattataatgtctagggagtttatgatcatgttcgacccgaatatcaaccacatctccaagcacattaaggacaagtcaaatcccgggattaaaatcaattggtccaaacagcagaagaggctgagaaaatttcccaaccaattcaagccgttcatcgatgtctttgggtgtcagctgcctctaactgtggaagcaccttacagctataatgggaccctcttcaggctctctttcaggactcagcaggaggcaaaggtgagtgaggtgagcagtacgtgttataataccgctgatatatattctctggtggacgagttcagtctgtgtggacatcgccttataatctttacacagagcgttaagagcatgtatctgaagtaccttaaaattgaagaaaccaaccccagtctagcccaggataccgtcattattaagaagaagtcctgtagttctaaggcccttaacacaccagtgctctccgtgctcaaggaggcggcaaagttgatgaagacatgcagctcttccaataagaaactccccagtgatgaaccaaagtcatcttgcatactgcaaataaccgtcgaggaattccaccacgtattcaggcgtatcgctgacctccaaagtcctctattccgcggccctgacgacgaccctgcggctctctttgagatggcaaaatccggtcaatcgaaaaaacctagtgatgaattatctcagaaaaccgttgaatgcacaacctggctgctgtgtacatgtatggacacgggggaggctttaaagttctcactatccgagtcaggaaggcggttgggactcgtcccctgtggagctgttggcgtccagctgagcgagatccaggaccagaagtggactgtgaaaccacatatcggcgaggtgttttgttacctaccactgagaatcaagacgggactccctgtccacatcaacggatgttttgcagtaacgtccaatagaaaagaaatttggaaaaccgacacaaaaggccgatggaacactacatttatgaggcacgtcatcgttaaggcatacctccaggtgctgtcagtgcttagggatctggcaacctccggcgagctgatggattacacatactacgctgtgtggcccgatcccgatttagtgcacgatgattttagcgtgatttgccagggcttctacgaggacatcgctcacggaaaggggaaagagctcacgaaggtgttttccgatggtagcacctgggttagtatgaaaaatgttagattcctggacgatagcatccttaagaggagagatgtgggctctgcagccttcaagatctttttgaagtatttaaagaaaaccggtagcaagaatctatgcgccgtagagttaccatcaagtgtgaaactcgggttcgaggaggccggttgcaagcagatactattagaaaatacatttagtgagaagcagttcttctccgaggtcttttttccgaatatccaggagattgaagcagagctgagagatccactgatgatcttcgttcttaatgagaaggtcgacgagtttagcggagtgcttcgggtcaccccgtgcattccttgcagcttggaggggcacccgctggtcctgccgtcacgattaattcatccagaggggcgggtggctaagttgttcgacattaaagatggccgctttccttatggctcaacccaggactatctgaacccaattatccttatcaagctggtgcagttaggcatggcaaaggacgatattctctgggacgacatgttggagagagccgtaagcgtcgctgagattaataaatcagaccacgttgctgcctgcttgaggtcctctattttgctgtctcttatcgatgagaagctaaaaatccgagaccctcgtgcaaaggacttcgctgcaaagtaccaaaccattcgttttcttccattcctgacaaaaccggcaggcttttcactggactggaagggcaattcttttaagccggagacgatgttcgcggcgaccgacttgtatactgccgagcaccaagatattgtgtgcctcctgcagcctatccttaatgagaattcacactcttttcgcgggtgtgggtccgtaagcttggctgtcaaagagtttctggggctcctgaaaaagccaacagtggacttagtgatcaaccagctgaaagaagtagcaaagtctgttgatgacggtatcacactgtatcaagagaatatcactaatgcctgctataaatacctgcatgaggctctcatgcaaaacgaaatcacaaagatgtccattatcgataagttaaaacctttttctttcatactggtggaaaatgcgtacgtcgattcggaaaaggtttcatttcatctcaattttgaggctgccccctatctgtatcagttgccgaacaagtacaagaataattttagggagctgtttgaaaccgtgggggtccgccaatcgtgtactgtggaagacttcgcgttagtgctcgagtcaattgaccaggagcgggggacaaaacaaattacagaggaaaactttcagctgtgccggagaataattagtgagggcatttggtcactgatccgcgaaaagaaacaagagttctgcgagaagaactatggcaaaattctactgcctgacacgaacctcatgctgttgcccgctaagtcattgtgttacaacgattgtccttggattaaagtgaaagacaccaccgttaaatactgccacgcagatatacctcgcgaggttgctgtgaagctgggggccgttccaaagagacataaggcgttggaaagatacgcgtccaacgtgtgctttacaacactcgggacggagttcggccaaaaggagaagctaacttccaggataaagagcatactgaacgcttatccatccgagaaagagatgttaaaggaactcttgcagaatgctgatgacgccaaagccacagagatctgttttgtttttgaccctaggcagcacccagtcgaccggattttcgatgataaatgggcccctctgcaggggcctgccctatgtgtgtataataatcagccattcacagaggacgacgtcaggggtatccagaacctagggaagggtaccaaagagggcaacccatacaagactggacagtatgggattggatttaacagcgtgtatcatataacagactgtccttctttcatctccgggaatgacatcctgtgcatttttgatcctcacgctcgctacgctcctggtgccacttctataagcccaggccgcatgttccgcgacctggatgcggacttcaggacacagtttagtgacgtcctggatctctacttgggaacacattttaaattagataactgcacaatgtttcggtttccactgaggaacgctgagatggccaaggtgagcgaaatctcatcagtgccagcctctgatcgtatggttcagaacctgctcgacaagctgaggtccgacggggccgaactgctgatgttcttaaatcatatggagaagatttcaatctgcgagatcgataaaagtacaggagctctaaacgtcctgtattcagtcaaagggaagattacagatggagataggctgaagaggaagcagttccacgccagcgttattgactccgttaccaagaagcgacagctgaaagacattcccgttcaacaaataacttacacaatggataccgaggacagtgaaggcaacctgacgacttggctcatttgcaacaggtccgggttcagttccatggaaaaggtatctaaatccgtcatctccgcccataaaaatcaggatattacattattccctcgaggcggcgtggcagcatgcatcacccataattataagaaaccccacagagccttttgttttctgcctctgagcctggagacaggactgcccttccacgtaaacggacacttcgccctcgattctgcgaggcgcaacctgtggagggacgacaatggtgtcggcgtacggtccgactggaacaatagcctgatgaccgctctcatcgctccagcctacgtggagcttctgatacagttgaagaagcgctattttccgggatctgatcccactctgtctgtgttacagaatacccccatccacgttgtcaaagatacactcaaaaagttcctgtccttctttccagtaaatcgactcgatttacagccggacctttactgcttggtgaaggctctttacaactgtattcacgaagacatgaagcgactcctgcctgttgtgagagctcccaacatcgatgggtccgacctccatagcgccgtcatcattacatggatcaatatgagcacctcaaataagacccgtccattctttgacaacttgctgcaggacgagctccagcacttgaaaaatgccgattataacattaccacccgcaagaccgtagctgagaacgtgtaccggctgaaacacttgcttcttgagatcggctttaatttggtgtacaactgcgatgagacagctaacctgtaccattgcctcattgatgcggacatacctgtcagttacgtcactcccgctgacatcagatctttcttaatgaccttctctagtcccgatactaactgccatatcggtaaactgccttgccgcttgcaacagactaacttaaaactgtttcacagcctcaagttgctggtcgattattgtttcaaggacgcagaagagaacgagattgaggtagaaggtctgcctttgttgattacactggattccgtcttgcagacattcgacgcgaaaagaccaaagttcctcaccacataccacgaactgattccatctcgtaaggatctctttatgaacacactctacttaaaatactctaatattctccttaactgcaaggttgccaaagttttcgacatctcatcctttgctgatttgctttcttccgtgctgcctcgcgagtataaaaccaaaagctgtacaaagtggaaagataactttgccagcgaatcttggcttaaaaacgcatggcacttcataagtgaaagcgtctccgtcaaagaggaccaggaggaaacaaaacccaccttcgacatcgtggtggataccctgaaggattgggccttgcttccagggactaaattcaccgtttcagctaatcagctggttgtgcctgagggagacgtgctcttgcctcttagtctcatgcatattgccgtttttccgaacgcccagtcagataaagttttccacgcgctgatgaaagccggttgtattcagcttgcgctcaacaaaatttgttctaaagactccgctttcgttcccctgctgtcatgccacactgccaatatcgagtcacctacttccatcctgaaagcacttcattacatggtacagacaagtactttccgcgctgaaaagctggtagaaaacgatttcgaggcgctgttgatgtattttaattgcaacctgaaccatttgatgtcgcaagacgacatcaagatcttgaaatctctgccatgttataaatctatctctgggcgttacgtctctattgggaagttcggcacatgttatgtgctaactaaatctatcccgagcgccgaagtcgagaagtggactcaaagcagctcttctgctttcctcgaagaaaagatccacctcaaggaactgtacgaggtaatcgggtgcgtgcctgttgatgacctcgaggtctatctcaagcaccttttacccaaaatcgagaacctgagttacgatgctaaacttgagcacctgatctatttgaagaatcgcctctcgagtgcagaggaactgagcgaaatcaaagagcagctattcgaaaagttggagagcttgctcattatccatgatgcgaactcaaggctgaagcaggccaagcacttttatgacagaactgttcgcgtgttcgaggtgatgttaccggagaagctattcattcccaacgatttctttaagaaactggagcagctcatcaagcctaaaaaccacgtgacctttatgacctcctgggtggagttccttaggaatatagggctgaagtatattctaagtcagcagcagctcctccagttcgccaaggagatctcagtgagagccaacaccgagaactggtcaaaagaaacattacaaaacacggttgacatactgctgcaccatattttccaggagcgaatggatctactttcaggtaatttcctgaaggaactgtctcttatcccatttctgtgcccagagagagcacccgcagagttcatcaggttccatcctcagtaccaggaagtgaatggaacactgccactcattaaattcaacggagcccaggttaaccctaagttcaaacaatgcgatgtcctccagctactatggacttcttgtccaattctgcccgagaaggcaacgcccctgtcaataaaagaacaggaaggttctgacttgggcccccaggagcagctggagcaggtgcttaatatgctcaatgtaaacctggaccccccgctagacaaggtcataaacaactgtcggaatatttgcaacattactactcttgacgaggaaatggtcaaaacaagagctaaggtccttcgttcaatttatgaatttcttagcgcagagaaacgcgaatttcgcttccaactccgtggggtcgcctttgtgatggttgaagatggttggaagctcctgaaacctgaggaggtggttatcaatcttgaatatgagtccgattttaaaccatacctgtacaaattgccactggagttgggaacttttcatcagttatttaagcacctggggactgaggatataatttctaccaaacagtacgtagaagtgctgtccaggatttttaagaatagcgagggcaagcagctagacccgaatgaaatgcgtactgtaaagagggtggtgtctggcctgttcagatccttgcagaatgatagtgtcaaggttcggagtgacctcgagaacgtaagagatttggccctttatctcccctcacaagatgggagactggtgaagtccagtatcctcgtctttgacgacgcccctcattacaaaagtcggatccagggaaacattggcgtgcagatgctagtcgacctgtctcagtgttatctcggtaaagaccatggtttccataccaaactcattatgctattccctcagaagctgcgtcccagactactgtcctcgattctggaagaacagctcgacgaggaaacacccaaggtgtgccaatttggagctctctgtagcttacagggcagactccagctgctgttgtcaagcgagcaattcattaccggtctgatcaggataatgaagcatgagaatgacaatgcctttctggcgaacgaggagaaggctattcggctctgcaaagctttgcgcgagggcttgaaagtatcctgcttcgaaaaactgcagacgacactgcgcgtgaagggatttaaccctattcctcactcccgctctgagacatttgctttcctgaagagatttgggaacgctgtgatcctcctgtatattcagcactcagatagcaaagacattaatttcctgctggcactcgctatgaccctgaagagcgccaccgataatctcataagcgacacaagttatttgattgcgatgttaggctgtaacgatatctatcgaattggggaaaaacttgacagcctgggtgtcaaatacgattcgtccgaaccttccaaactggaactaccaatgccagggacccccatccccgccgaaattcactatacgctcttgatggaccctatgaacgtattttatcccggagaatatgttgggtacctggtggacgcggagggcggcgatatatacggaagctatcagccaacctatacctatgctataattgttcaggaggtggagcgggaagatgctgataactcctcgtttctggggaagatctaccagatcgacatcggatattcagagtataagatcgtgtcatccttagacctctataagttctctcggcccgaggagagttcacaatcccgggacagtgcaccatccacacctacctctcctacggaatttcttacccccggacttaggagcatccctcccctcttctcaggccgagaaagtcataaaacttcaagtaagcaccagagcccaaagaagctcaaagtgaatagtctccccgaaattctgaaagaggtcactagcgtggtggaacaagcctggaaactgccagaatctgagagaaaaaagattatcagaagactatatttgaaatggcaccccgataagaacccagagaaccacgatatcgccaatgaagttttcaagcacttgcagaacgagatcaatcgcctggaaaaacaggcctttcttgatcagaatgccgatcgagcgagtcgcaggaccttcagtacttccgccagccggtttcaatctgataagtatagcttccaacggttttacacgtcatggaaccaggaggcgacctcccataagtcggagagacagcaacagaataaagagaaatgtcctcccagtgccgggcagacatatagccagagattcttcgtaccaccaacctttaaatcagtcggtaatcccgtggaagcaaggcggtggctccggcaggcccgtgccaatttcagcgccgcgcgcaatgaccttcataagaatgccaacgaatgggtgtgttttaagtgttatctgtccactaaactggctctgatcgccgcggactatgctgtaagggggaagtccgacaaggacgtcaaaccgacggccctcgcccaaaagattgaggagtatagccagcagctggaggggttaacaaacgatgtgcatacgctcgaggcctatggagttgattcgctcaagacacggtacccggatctactgccgttcccccagatacctaatgaccgctttacctctgaggtcgccatgcgggtaatggagtgcacagcctgtatcattataaaactggagaactttatgcagcagaaagtctag

SEQ ID NO: 206649 - DNA, 11490 bp, Artificial Sequence
  Description of Artificial Sequence: Synthetic coding sequence
atgaacaccttctggcccggccgggagctgatcgtgcagtggtacccatttgatgaaaaccgcaaccatccttccgtttcttggctcaagatggtgtggaagaacctttatatccacttttccgaggatctcacacttttcgatgagatgcccttgattcctcgtaccattctggaggagggacaaacttgcgttgagttaattcgtctgcgcatcccatcactagtcatcctggacgatgaaagcgaagctcaacttccagaatttctggcagacattgttcaaaagttgggcgggttcgtcctgaagaagttggacgcctcaattcagcaccctctgattaaaaaatatatacactctccactcccatcagcagtcctccaaatcatggagaagatgcccctgcagaaactgtgtaaccaaattacttccctcctccctactcataaggacgccctgaggaagtttctcgcctccctcacagattctagcgaaaaagaaaagcggataattcaggaactggccatttttaaacggattaatcactctagtgaccaaggcatcagctcttatactaaactgaagggatgcaaggtcctgcaccacaccgctaagttgccagcagacctgcgattgtcgataagcgtaattgactccagcgacgaagccactatccggttagcaaatatgctgaagattgaacagctgaaaactacaagttgcctaaaactcgtactgaaggacattgaaaacgccttttatagccacgaagaagtgacccagctcatgctgtgggttttagaaaatttgtcttccctgaagaacgagaaccccaatgtattggaatggctgaccccgctgaagttcatccaaatctcgcaggagcagatggtctctgcgggggagttattcgatccagatattgaggtcctgaaagatttgttctgcaatgaagagggaacttatttccctccaagcgttttcacctcccccgacatcctacacagtttgaggcagattggtctcaagaatgaggcgagtctgaaggagaaggacgttgtccaggtcgccaaaaagattgaggcgctccaggttggagcgtgccctgatcaggacgtcctcctgaagaaggcaaagacgctcttgttggtcctgaacaaaaatcacaccctgcttcaatcttctgaaggtaaaatgacgctgaagaaaatcaagtgggtgccagcatgcaaggaacgaccaccaaattaccctggctctctggtgtggaagggcgatctatgtaacctgtgtgcccctcctgatatgtgcgatgtgggacacgccattctcataggcagcagcctacctctggtggagtctattcatgtgaacctcgagaaagcactcgggattttcactaagccatcactgtctgccgtgctgaagcacttcaaaattgtcgtcgactggtatagttcgaaaactttctcggacgaggactattaccaattccagcacatcctgttggaaatctatgggttcatgcatgatcaccttaacgaaggaaaggactcatttagagcgcttaaattcccttgggtctggacaggcaaaaaattttgtccgcttgcacaggccgtaattaagccaatacacgatcttgacctacagccatacctccacaacgtccccaagactatggctaaattccatcagctgttcaaagtctgcggctctatcgaagaattaaccagtgatcatatttccatggtgatacagaagatctatctgaaatcggatcaggacctatcagagcaggaatccaagcagaatctccacctgatgctgaatattatccgatggctttatagcaaccagattccagcaagcccaaacacgcccgtgccaatccaccacagcaagaacccttcaaagctcataatgaagcccatccacgagtgctgctattgcgatattaaggttgatgacctcaatgatcttctcgaggattccgtagaaccgatcatactcgtgcacgaggacatacctatgaaaactgcggaatggcttaaggtgccttgccttagtacgagactgatcaatccagagaacatgggatttgaacagagcggccaacgagaaccacttacagtgcgcattaaaaacatactggaggagtacccctctgtcagcgatatcttcaaagagcttctgcagaatgcggatgacgccaacgccactgagtgctcgttcctcatcgatatgaggcggaacatggacattagagagaaccttctggaccctggcatggctgcctgccatggtccagctctgtggtccttcaataattcacagtttagcgactccgacttcgtcaacatcaccaggctgggggaaagtctgaagaggggagaggtggataaagttgggaaattcgggctgggattcaatagcgtgtatcatattaccgatatcccaatcatcatgtcaagagagttcatgatcatgttcgacccaaatataaatcacattagcaagcatatcaaagacaaatccaacccagggatcaagataaattggtcaaaacaacagaaacgcctgcgaaagtttccaaatcagttcaagccctttattgacgtcttcggctgtcaactgccactcaccgtggaggctccatatagctacaacggcacgctcttcagattgagtttcagaactcagcaagaggctaaggttagcgaggtgagcagtacctgttataacacagcagatatctatagtctggtggatgaattttctctgtgcggtcaccgactgattatcttcacacaatccgtgaagtcaatgtacctcaaatacctcaagatcgaggagactaacccaagcctcgcacaagacacagttattatcaaaaaaaaatcatgtagcagtaaagcattgaacacaccagtcctgagcgtgctcaaggaggctgccaagctgatgaaaacttgcagtagcagtaataagaagttgccaagcgatgagccaaagagcagttgtatactgcagattaccgtggaggagttccaccatgtttttaggagaattgccgacctccagagtcccttgtttagaggcccagacgacgaccctgcagcactattcgagatggcaaaatctgggcagtctaagaagcctagcgacgagctctcacaaaagactgttgagtgtacaacgtggctgttgtgcacttgtatggacacaggagaggcgctgaagttttctctgtcggaaagtggaaggcgcttagggctggtgccgtgtggtgcagtgggtgttcaattgagcgagattcaggaccagaagtggactgtgaagccccacataggcgaggtgttctgttaccttcccctccggattaagaccggactgcccgtccacattaatggatgcttcgctgttacctcaaaccggaaggagatttggaaaaccgataccaagggccgatggaataccacgttcatgagacacgttatcgtcaaagcatacctgcaggtcctttccgtgcttcgtgacctcgctaccagcggcgagctgatggactacacatactacgcagtgtggcccgaccccgatcttgttcatgacgatttctccgtgatctgccagggattctacgaagatatcgctcatggcaaagggaaagagttaacaaaggtcttctcggatggaagtacgtgggtgtcaatgaagaacgtcagattcctcgacgactccattctcaagcggagagacgttggcagcgccgcgtttaagatctttctcaagtacctgaagaaaaccggatctaaaaatttgtgcgccgtcgagcttcctagttccgtaaagttaggcttcgaggaagcaggatgcaagcagatactgcttgaaaacactttttcagagaagcaatttttttccgaagtgtttttcccaaacattcaggagattgaggcagaattaagggatcctttgatgatttttgtgctgaacgagaaggtggacgagttttccggcgttttaagggtgactccatgtattccctgctctctggaggggcatccgttggtgctgccgagccgactcatccaccccgagggccgcgtggccaaattgtttgatatcaaagatgggagatttccttacggtagtacacaggactatttaaaccccataatactgatcaagttggtgcagctgggaatggctaaagatgacattctgtgggatgatatgttagagagggcggtctccgtggccgagatcaataagtcggaccatgtggcagcctgcctgaggagctctatcctgttatctctaatcgatgagaagctaaagatcagagatcctagggcgaaagatttcgcagccaagtatcaaactataaggtttctgccatttctgaccaaaccagctggcttcagtctggactggaagggcaattctttcaaaccagagacaatgttcgccgcaactgatctctacaccgccgagcaccaggacatcgtttgtctgttgcagccgatcctgaacgaaaattcccatagctttcgtgggtgcggaagcgtctccctggccgtcaaagagtttctgggtctgctcaagaagcctacggtggatctggtgatcaaccagttgaaagaagtggccaagtctgtggacgacggtattactctttaccaggagaacatcaccaatgcctgctataagtatctgcatgaagctctgatgcagaatgaaatcactaaaatgtctatcatcgacaaactgaagcccttttccttcattctggtggaaaatgcttatgtcgattctgagaaggtttcttttcacctgaatttcgaggcagccccttacctttaccagcttccaaacaaatacaagaataacttccgagaattgtttgagacggtgggagtgaggcaaagctgtacggtcgaggacttcgccctggtgctggagtctatcgatcaggagcgtgggacgaaacaaatcacagaggagaactttcagttgtgtcggcggataatcagcgaaggcatttggtctctgattcgtgagaagaaacaagagttctgtgaaaagaactatggaaaaatcttgctccccgacactaaccttatgcttctgccagccaagtccttgtgttacaacgactgcccctggattaaagtgaaagatactactgttaagtactgccatgccgacatcccaagggaggtggccgtgaagctgggcgccgtgccaaagcgccataaggccctggaaaggtatgcttctaatgtttgcttcacaaccctcgggaccgagtttgggcagaaagagaagctcaccagccggattaagtcaattctgaatgcgtacccttctgaaaaggagatgctgaaagagttgctgcagaacgccgatgatgctaaggcaacagaaatttgcttcgtgtttgacccacgtcagcacccagtggaccgcattttcgatgacaagtgggcaccactccaggggccggccctgtgcgtgtataataaccagccctttaccgaggacgatgtaaggggcattcagaatttgggtaaagggaccaaggaaggaaatccttacaaaacgggccaatatgggatcggcttcaattctgtgtatcatattacggactgcccctcttttatcagtggtaacgacatcttatgcatcttcgatcctcacgcccggtacgcacccggagccacatcaatctctcccgggaggatgttcagggatttggatgctgatttccgcacacagttttcagatgtgctggacctgtatttggggactcatttcaagctagataactgtacgatgtttagattccctctacgcaacgccgaaatggcgaaagtgtcagagatcagcagtgtgcccgcctccgaccgtatggtgcaaaatttgctggacaagctcaggagtgacggggcagagctcctcatgtttttgaatcacatggaaaagatcagcatttgtgagatcgataaaagtactggcgctctgaacgtcctgtactcagtcaaggggaagatcactgatggcgatcgtctcaagagaaaacaattccatgcttccgtaattgattcggtcacaaaaaagagacagctgaaggatatcccagtgcaacaaatcacgtacacaatggacacggaagatagtgagggaaacttaaccacctggctgatatgtaaccgttccggcttctcctcgatggagaaggtgagtaagagcgtgatttccgcacacaagaaccaggatattaccctctttccacgtggtggtgttgctgcctgcatcacacacaactacaagaagccacacagagcattttgtttccttcctctcagtttagagacaggactgcctttccacgtcaatgggcattttgcattggacagcgcgcggaggaatctgtggcgtgacgataacggtgtgggggtgagatccgactggaataattctctgatgactgccctgatcgcccctgcctacgtagaattactcatccagctcaaaaagcgttacttccctggtagcgatcccactttatctgtattacagaacacacccattcacgtggtgaaagacactctgaaaaaattcctgtcttttttccctgtcaaccgcttggatctgcagcctgacctgtattgcttagtaaaggcactgtataactgtatccatgaagatatgaagagacttctgcctgtggtcagagcgcccaatatagatgggtcagacctgcactccgccgtgatcatcacatggatcaacatgagcacgtccaacaagacacgtccgttcttcgacaacctgttacaagacgagctgcagcacctcaaaaatgctgactacaacatcaccactcggaagacagttgctgagaacgtgtatcgacttaagcacctgctgctggaaattggcttcaatctggtttataattgcgacgaaaccgccaatctttaccactgtctgatcgatgccgacatccctgtgtcttacgtgaccccagctgatatacgctctttcctcatgacattcagctcgcccgacactaactgccatattggcaagttgccatgccggctgcaacagaccaatcttaagctcttccattcccttaagctgttggtcgactattgtttcaaagatgccgaagaaaacgaaattgaagtcgaagggctgccattactcattactttggacagcgtactgcagacttttgacgccaaaaggcctaaatttttaaccacataccatgagctaatcccctcaagaaaggatctcttcatgaataccctatacctcaagtattccaacattctgctaaactgtaaagtcgcgaaggtgttcgatatctcttcctttgccgatctcttgtctagcgttttacctagggagtataaaactaaatcatgcaccaagtggaaagacaattttgcatctgaaagctggctgaagaacgcatggcacttcatatcagaaagtgtgtcagtcaaagaggatcaggaagagactaagcctacatttgatattgtggttgatacattaaaagattgggctcttctgcccggcaccaagttcactgtcagcgctaatcagttggtggtgccagagggcgacgttctcttgcccctgagcctgatgcatattgctgtctttccaaatgcccagtctgataaggtgttccacgcactgatgaaggccggatgtatccagttggctcttaacaagatctgcagtaaggactctgccttcgtgccgctgttgtcctgtcatacagccaacatcgagagccccacctccattctcaaggccctccactatatggttcagacttcaacctttcgggccgagaagcttgtcgagaacgacttcgaagccctcttgatgtacttcaattgtaacttgaatcacctcatgagccaggacgatatcaagatcctaaaatcacttccctgctacaagtcaatttccggcaggtacgtgtccatcggcaaatttggaacctgttacgtgctcacaaaatcgatcccctcagctgaggtggagaaatggactcaaagttcttcaagtgctttcttggaagaaaaaattcacctgaaggagctctacgaggtgatcggctgtgtaccagttgacgacctagaagtttatctcaagcatcttctgcctaagattgagaacctgagctacgacgcaaaactcgaacaccttatttatctcaagaaccggctgtcatcggcagaagagctgagtgagatcaaagagcagctattcgaaaagctggagtccctgctgattatccacgacgccaacagccgcttaaagcaggccaaacacttctacgaccgtactgtgagagtctttgaagtgatgctccccgaaaagctgttcatcccgaatgacttttttaaaaaactggaacagctgattaaacccaagaatcatgtgacgttcatgaccagttgggtggagttcctgcggaatatcggtctgaaatatatcctgagccaacagcagttgcttcagttcgccaaagaaatctccgttcgggccaatacagaaaactggtccaaggaaacactgcagaacactgtcgatatactgctacaccacatctttcaggaaaggatggaccttttatcaggcaattttttaaaagagttgagtttaattcctttcctctgtcccgaaagggccccagctgagtttatcaggtttcatcctcagtatcaagaggttaacggtacccttccactcataaaattcaatggagcacaggttaatccaaagttcaaacagtgtgatgtgctgcagctgctttggacatcttgcccaattctgccagagaaggctaccccgctgagtataaaggagcaagaaggctctgacttaggaccccaggaacagctggaacaagtgctcaacatgctcaacgtcaatctcgatcctccgctcgacaaggtgatcaacaattgtaggaacatctgtaacatcaccactctggatgaggagatggtcaagacgcgggccaaggtgctccggagcatttatgaatttctgtccgctgaaaagcgggagtttagatttcagctccgaggggtcgcattcgtgatggttgaggatggctggaagctgttaaaacccgaagaggttgtgattaatctggaatatgaaagcgatttcaagccatacctatataagcttccattagagcttggcacctttcaccaactgttcaagcacctgggcacagaggatataatctccactaagcaatatgtcgaagtactgtcaagaatcttcaaaaattcagagggcaagcagttggatcctaacgagatgcgaacagtgaaacgtgtcgtgtccggcctgttccgctcactgcagaatgactctgtgaaggtgcggtcggacttagagaacgtgcgcgacctggccctctatttaccctctcaggacggcagactcgttaaaagctctattctggtattcgacgacgccccccattataaaagccgtatccagggcaatatcggggtccagatgttggtggatttaagtcagtgctatcttgggaaggatcacggcttccataccaagcttatcatgctgtttcctcaaaagctgcgcccacgtctcctgtcttcaattcttgaggagcagcttgatgaggaaacccccaaagtatgccagtttggtgctctctgctccctacagggccggctgcagcttctactcagcagtgagcagtttattaccggactcatcagaatcatgaaacacgagaacgataatgccttcctggccaacgaggaaaaagcaatacgtttatgtaaggcccttagagaggggctaaaagtgagttgttttgagaagcttcagaccacactgagggtcaagggctttaaccccataccacactctcggtcggagacattcgcgttcctaaaacggtttggtaatgcggtgatactcctgtatattcagcattcagatagtaaagacattaacttcctcttagctctggccatgacactcaagtctgccaccgacaatctaatctctgatacaagctatttgattgcaatgcttggttgcaacgatatttatcgaataggagaaaaacttgattccctcggcgtgaagtacgactcttcagagccttctaagctcgaattgcctatgcctggaacacccatcccagctgaaatccactacaccctgctcatggaccctatgaatgtgttttatcctggggagtatgtgggctacctggtggatgctgagggaggggatatatacggttcctaccagcctacatacacatatgccataatagtgcaggaagtggaacgggaagacgctgacaactcatcttttctgggtaagatctaccagattgacattgggtacagtgagtataaaatcgtgtcttctctggacttgtataagtttagccggcctgaagaaagcagtcagtcacgagacagtgcgccctccactcccacatcacctactgaatttctcacacctggtctgaggtctatcccgcctctctttagtgggcgtgagtctcacaagacttcctccaagcaccaatcacccaagaaattgaaagtgaattccctgcccgagatcctcaaggaggtgacatccgtggtggagcaggcttggaaactgcccgaaagtgagcggaagaagatcatacgccgactgtacctgaagtggcaccccgataaaaatccagagaaccacgatatagctaacgaggtgttcaagcatctgcagaacgagataaaccggttggagaagcaggccttcttggatcagaacgctgaccgagccagcaggcggaccttcagtacttcagcctcacgattccaatcagacaagtacagctttcagcggttttatacttcctggaaccaagaggccacatcgcataaaagcgaacgccaacagcagaacaaagagaagtgtcctccaagcgccggtcagacctattcacagagatttttcgtaccacccacctttaaatcggtgggaaatcccgtggaagcccgcaggtggctgagacaggcgcgcgcaaatttttctgccgcaagaaacgacctgcacaagaacgcaaacgagtgggtctgctttaagtgctacctgagcactaagctggccttgatcgccgccgactacgcagtaaggggtaaatccgacaaggatgtcaagcccaccgcactggctcagaagatcgaggagtactctcagcagctggaggggctgaccaacgatgtgcacacactggaggcgtacggggtggacagcttgaagacccggtatcccgacttactgccctttccccagattccaaatgatcgatttacctctgaagtagccatgcgcgtgatggagtgcaccgcttgtattattatcaagctggagaatttcatgcaacagaaggtctag

SEQ ID NO: 206650 - DNA, 7332 bp, Artificial Sequence
  Description of Artificial Sequence: Synthetic coding sequence
atggccgccgaggagggcgtggccagcgccgccagcgccggcggctcctggggcactgcagcaatggggcgagtgctcccgatgcttttagtgcctgtgcccgcagaagccatgggccagttgggatcacgagctcagttacggactcaaccggaagccttgggaagtctcaccgccgctggctcactccaggtgctgagcctgacaccagggagtcgcggcggcgggcggtgttgtctcgagggaccattctggcacttcctgtgggaggatagccggaattcatcaacacctacagagaagcccaaactacttgctcttggggaaaactatgaattgttgatttacgagttcaacctgaaagacggacgatgcgacgccactattttatactcctgttcacgcgaagccctccagaaactgatcgatgaccaggacataagcatctcactgctcagtctgcgaatccttagtttccataataacacttcattgttatttatcaataaatgcgtgatactgcatattattttccctgagcgcgacgctgcaattcgggtgttaaactgctttaccctgcccctgccagcccaggcggttgacatgatcatcgacacccagttgtgtcgggggatattgttcgtgttgtcatccctcgggtggatctatattttcgatgtcgttgatggtacgtacgtggctcacgtggatctggccctccacaaggaggacatgtgcaatgagcagcagcaagaacccgccaaaatctcctcttttaccagcctgaaggtgagccaggatctagacgtcgccgtaatcgtgagttcatcaaatagcgcagttgccttgaacctgaacctttatttcaggcagcatcctgggcacctgctctgcgaacggatcctggaggaccttcccatacaggggccgaagggggtcgacgaggacgacccggtgaacagcgcatataatatgaagctcgctaaattctcatttcaaatcgatcgttcatggaaagctcagttaagctcccttaacgaaaccattaaaaattctaagctggaagtcagctgttgtgccccctggtttcaggatattctgcacctggaatcaccagagtcagggaatcactccaccagcgtccagtcctgggcctttattcctcaggacattatgcacggtcaatacaacgtgcttcagaaagaccatgccaagacctccgatccaggccgctcatggaagataatgcacataagcgaacaagaggaaccaattgaacttaagtgtgtctccgtgaccggatttacggctctattcacctgggaggtcgagaggatgggctacacaatcaccctgtgggaccttgaaacccagggtatgcagtgttttagcctgggtaccaaatgcattccggtcgactcctctggagaccaacagctgtgcttcgtcttgacggaaaatggactgagtctgattctcttcgggctaactcaagaggaatttttaaaccgtctgatgatccatggcagcgcctcgactgtggacaccctatgccacctgaatggctgggggagatgcagtatccctatacacgccctggaggctggaattgaaaatcgccagctggacacagtgaactttttcttgaagtcaaaagagaacctgtttaatccctctagcaaatcgagcgtgtcagatcagttcgaccacctcagctctcacctttacctccgcaatgtagaagagctcatcccagccctggatctgctgtgtagtgcaataagggagtcctactcagagcctcagtctaagcacttttcagagcagttattgaacctcactctgtcatttctgaataatcaaatcaaggaactgttcatccatacagaagaattggatgagcatctccagaagggagtaaatattcttacttcttacattaatgagctgcgcacctttatgattaaattcccctggaagctcacagatgctatagatgagtacgacgtgcacgagaatgttcccaaggtaaaggagagtaatatttggaaaaagctgtctttcgaagaggtcatagccagcgcaatcttaaacaataaaatccctgaagcccaaacgttttttcgcattgattcacattctgctcagaagctggaagaactgattggaatcggcttaaatcttgtgttcgacaatctgaaaaagaacaatatcaaggaagctagtgagttgctcaagaacatggggttcgacgtgaaaggccagttactgaagatatgcttctacacaaccaataaaaacatcagagactttctggtggaaattctgaaggagaagaactacttttctgaaaaggagaaaagaacaattgactttgtgcatcaagtggagaaattatatctgggtcactttcaggagaacatgcagattcagagtttcccaagatattggattaaagagcaggacttcttcaagcataagtctgtgctcgactccttcctgaaatatgactgcaaagacgaattcaataagcaggaccaccgaattgtgttgaattgggcactgtggtgggatcagcttactcaagaaagcattctgctgcctcgaatttcaccggaggaatataagtcatacagcccggaggctctttggagatatctaaccgcacgccacgactggctcaacattatcttgtggattggagagttccagacccagcacagctacgcttcattacagcagaataagtggcctcttctgaccgtggatgtgatcaaccaaaatacttcctgtaataattatatgcgaaacgagattctcgacaagctcgcccggaacggagtcttcctggcttctgaactggaagactttgagtgttttcttttgcgactgtccagaataggtggcgtgattcaggatacattgccagtccagaattacaaaaccaaggaagggtgggacttccacagtcagttcattctctattgcctggaacactcgctgcagcacctgctctatgtgtacctggactgttataagttgtccccagaaaattgtccatttctggagaagaaggagctgcacgaggctcacccctggttcgaatttttggttcaatgccggcaggttgccagcaacctaaccgacccaaagctgatttttcaggcaagtctggctaacgcacagatcctcatcccgacaaatcaagcatccgtttcgagcatgttgttggagggacacactcttctggctctggccacaaccatgtattccccggggggagtaagccaggtagtacagaacgaggagaatgaaaattgcctaaagaaggtggaccctcagttattaaaaatggctctgaccccatatcctaaactgaagaccgccctgttccctcagtgcaccccccccagtgtgctgccgtccgacattaccatttaccacctgatccagagcctctcaccatttgacccttcaaggttatttggatggcagagtgcaaacacattggcaattggggacgcttggagtcaccttcctcacttctcgtcacccgatctggtaaataaatacgccatcgttgagaggctgaactttgcatattatctgcataatggaaggcctagttttgcctttggtacgtttctggttcaggaactgataaaaagtaagacccccaaacaattgatccaacaggtgggtaacgaagcgtatgtgatcggcctgtcctctttccacataccttccattggtgccgcctgcgtatgcttccttgaacttcttggtctggacagtctgaaactgcgggtggacatgaaggtcgcaaacattatcttgagctacaagtgcaggaacgaggacgcacaatacagttttatcagagagtctgttgctgagaaactgagcaagctggccgatggcgaaaagactacaaccgaagaactgcttgtgctgcttgaggaaggaacctggaatagcatccaacaacaggaaatcaaacggctgtctagcgagagcagttctcagtgggcgttggtagtccagttctgcagacttcacaacatgaaattgagtatatcatatctgagagaatgcgccaaagccaatgactggttgcaattcatcattcactcgcagctgcacaactaccacccggccgaggttaaatcactaatccagtacttctctccagtcatccaagatcacctgcggctggctttcgaaaacctccccagtgtgccaacctctaaaatggactcagaccaggtttgtaacaagtgcccacaggaactgcaaggaagcaagcaggagatgactgacctttttgaaatcttgttacaatgttccgaggagcctgattcatggcactggcttttggtggaagcggtgaagcagcaggctcccatcctgagcgtcctcgcatcctgcctccagggagctagtgcaatctcttgcttatgcgtttggatcattacttctgtcgaggacaacgtagccaccgaagctatgggacacatacaggattctacagaggaccacacgtggaaccttgaagatctgtcggtcatatggagaaccctactgactcgacagaaaagcaaaactctgatccgcggctttcagctgttctttaaggacagtcccttgctgctggtgatggaaatgtatgaactgtgtatgttttttcggaattacaaggaagcagaagcgaaactcttggagtttcagaaatccctcgagacactgaacaccgcggccaccaaggtacatccagtcataccagccatgtggcttgaggatcaggtgtgcttcctactcaaattaatgctgcagcaatgtaagacacaatacgagttgggaaaactgctgcaactgttcgtggaaagagaacacctgttctctgatggcccagatgtcaagaaactatgtattctatgccagatcctgaaggatacatctattgccatcaatcataccatcattacctcatattctatcgaaaatctgcagcacgaatgtcggtctatccttgaacggcttcaaacggatggacaattcgcccttgcccggcgagtggccgagctggctgagctgccagtggacaacttggttatcaaagagatcactcaggaaatgcagacactgaagcatattgagcagtggagtctgaaacaggcaaggatcgacttctggaaaaagtgccatgagaacttcaaaaagaattctatctcttcaaaggctgccagttccttctttagcacccaagcccacgtggcgtgcgaacaccctacaggctggtcttctatggaagagcgacacctcctcctaacattggccggccactggctggcacaggaggatgtcgttcccctggataagttagaggagctcgagaaacagatctggctgtgcagaattacccagcacactttaggtcgcaaccaagaagagaccgagcccagattcagccggcagatcagtaccagcggagaactttctttcgactccctggcatctgagttctcctttagcaagctggcggcccttaatacttccaagtatctggaactcaactcactgccatctaaagagacatgcgagaacagactcgattggaaggaacaggagtctctgaacttcctgattggcagactgttagacgacgggtgcgtgcacgaggccagtcgtgtatgtcgctatttccatttttacaacccagatgtggccttggtgcttcattgtcgtgcactggccagtggtgaggccagtatggaagatcttcacccagagatccacgccctgctgcagtcggctgaacttctggaggaagaggctcccgatatccctctcagaagagttcactccaccagcagcctggactcccaaaagttcgtgacggtcccatctagtaacgaggtcgttactaacttagaagtcctcactagcaagtgtctccatggcaaaaactactgccgacaagttctctgcctctacgatttagccaaggagttgggctgctcatacactgatgttgccgctcaggatggggaggcaatgctacgtaagatcttagcctcacagcagccggatagatgcaagagagcacaggcatttatctctacacaggggctgaagcctgacacagtggctgagctcgttgctgaggaagtaacccgggaactattgacaagctcacagggaaccggccacaagcagatgttcaatcccaccgaggaatcacagacattccttcagctcaccaccctatgccaagataggactttagtgggcatgaaactcctggacaagatttcgtccgtgccgcacggtgagctgagctgtactacggagctgctgatcttggctcaccattgttttacattgacttgccacatggaaggaatcattagggtgttgcaggccgcccatatgttgaccgacaatcatctcgctccgtccgaagagtatgggctagtagtgcgtcttctcacaggcatcggcagatacaatgagatgacttatatcttcgacttactgcacaagaaacactacttcgaggtcctgatgaggaaaaaactggatccatctggcacccttaaaactgcactactagactacatcaaaagatgcagacctggtgattccgaaaagcataacatgattgctctgtgcttctctatgtgcagagagattggcgagaatcatgaggccgcagcccgcatccagctgaagctgatcgaaagccagccttgggaggattcactgaaggacggccatcagttgaagcagctgcttctgaaggctctgactctcatgttggacgccgcagagagctacgctaaggattcctgcgtgaggcaggcccagcactgccagcgcctgaccaaattaatcaccctgcaaatccatttcctgaacaccggccagaatacgatgttgattaacctcggaagacacaagctgatggattgtattctcgctcttccacgattctaccaagcctcaatcgttgctgaggcctatgatttcgtgcctgactgggcggagatcctttatcagcaggtgatcctcaaaggtgacttcaactatttagaggagtttaagcagcagcggttactgaaaagctctatttttgaggagatttctaagaagtacaaacaacatcagccgacagatatggtgatggagaatctaaagaagctgcttacctattgcgaggacgtgtatctctattataaactggcatacgaacacaagttctatgagattgtgaatgttctgctgaaagaccctcaaacgggctgttgtctcaaggacatgcttgccggctag

SEQ ID NO: 206651 - DNA, 6993 bp, Artificial Sequence
  Description of Artificial Sequence: Synthetic coding sequence
atggccgccgaggagggcgtggccagcgccgccagcgccggcggctcctggggaaccgcggcaatgggtcgcgtgcttcctatgctgctcgtgcctgtccccgccgaggcgatgggccaactgggaagtcgggctcagctccgtactcagcccgaggctctggggagtctcacagccgcagggtcgctccaagtgctctccctgacacccggtagtcgggggggagggcggtgttgtctcgaaggacccttctggcactttctgtgggaagatagccgcaattccagcactcctacagaaaagcccaagctactcgcgctgggagagaactatgaactcctgatctacgaattcaacctgaaggacgggcggtgcgatgcaaccatcttatattcttgtagccgggaggcgcttcagaaactgatcgacgaccaggacatcagcatctcgctcctgagccttcgaatattatcttttcacaacaataccagtctcctcttcattaacaagtgtgtgatcctccacattatttttcccgaacgtgatgcggccatcagggttctaaactgctttactctcccactcccggctcaagccgtggatatgatcattgacacgcagctgtgcagaggcattcttttcgtactcagtagcctcgggtggatttatatatttgatgtggtggacggcacatacgtcgcacacgttgacctggcactccacaaggaggacatgtgcaatgagcagcagcaagagcctgctaagatctcctccttcacaagccttaaggtctcccaggacctggatgtggccgtcatcgtaagtagtagcaatagcgctgtcgctctgaaccttaatctctatttccgacagcatcctggacacttactctgtgagcgtattctggaggacctgccaatacagggccccaaaggagtagacgaagacgatcctgtgaatagtgcgtataacatgaagctggccaagttctcttttcaaatcgatcgctcttggaaggcccagctctcgtctctgaacgagaccattaaaaattccaaactggaggtgtcctgttgtgctccttggtttcaggatatcctacacttggagtcacctgagtccgggaatcatagtacaagtgtccagtcttgggcttttattccccaagatattatgcatgggcagtataatgtcctacagaaggaccacgccaagacatctgatccaggaaggtcttggaagattatgcacatcagtgagcaggaggaaccgattgaactcaagtgtgtcagtgtcactgggtttaccgctttattcacctgggaagtcgaacgaatgggttataccattacattgtgggatcttgaaacacaaggaatgcagtgcttctctctcgggactaaatgcatacctgtggactcttcaggcgatcagcagttatgctttgtcctaactgaaaacggtttgagcctcattctgttcggcctcacacaggaggagtttctcaatcgactgatgattcatggatctgccagcactgtggatacattgtgccacctcaacggatggggacggtgcagtatacctatacatgctctcgaagccggcattgaaaaccgccagcttgacacagttaattttttcctaaaaagtaaggagaatctgtttaatccctctagtaagagctcagtcagtgatcagttcgaccatctctcgtctcacttatacctgaggaacgtcgaggagcttatacctgctctcgaccttctctgctctgctatcagagagtcctattctgaacctcagagcaagcactttagtgaacagctcctgaacttgacacttagctttctcaacaatcagattaaggagctttttatccacaccgaagaactcgatgaacatctccaaaagggagttaacattttgacctcctatattaacgagcttcgcacgtttatgataaagtttccctggaagctcacagacgcaatcgatgaatatgatgttcacgagaacgttcctaaagtcaaggaaagcaacatctggaagaaactgagttttgaggaagtgatcgcctcagcaattttaaacaacaaaatacccgaggcacagacatttttccgaattgactctcatagtgcccaaaaactcgaggaacttatcggcattggactgaacctcgtgtttgacaacctaaagaaaaacaatatcaaggaggcctcggagctgctcaagaacatgggattcgatgtgaaaggccaattgctgaaaatttgtttctatacaaccaacaaaaacatccgcgactttttggtggaaattcttaaagagaagaactattttagcgagaaagagaaacggaccattgactttgttcaccaggtggaaaaactctatcttggtcattttcaggaaaacatgcagatccagtctttccctagatactggattaaagagcaggactttttcaagcataagtccgtgcttgattcgtttctgaagtatgattgtaaggatgagtttaataagcaggatcatcgcatagtcctgaactgggcactttggtgggatcagcttacacaagagagcattctgctgcctcgtatatcccccgaagagtataagtcctattcccccgaggcattgtggaggtacttgaccgccaggcatgattggttgaatatcatcctgtggataggcgagttccagacgcaacactcatacgccagcctgcagcaaaataaatggccgctgctcaccgtcgacgttatcaaccagaatacctcatgcaacaattacatgcgcaacgagatactggataagctcgcccggaacggcgtcttcctggcctcagagcttgaagactttgagtgtttcctgctccgtttatccaggataggtggtgtcattcaggacaccctgcccgtgcagaactacaaaaccaaagaagggtgggatttccatagccagtttatattgtattgtctggaacacagcctgcaacatctgctgtatgtatatctggattgctacaagttgagcccagagaactgtcctttcctggaaaaaaaagagcttcatgaagcacacccatggttcgaatttctggtgcaatgtcgccaagtagcctcaaatttgacagaccccaagttgatcttccaagccagtctcgctaatgcacaaattttgatcccaacaaaccaggcttccgtgtctagtatgctattagaaggccacaccctgttagccctggccaccacgatgtatagccctggtggagttagccaagtcgtgcaaaatgaagagaacgaaaactgccttaagaaagtggatccacagctgctcaaaatggcactaactccctatccaaaactgaagacagctctctttcctcaatgcaccccgccttctgtgctgccatcggatataaccatttaccatttgatccagagcctctccccattcgatccaagcagacttttcggctggcaaagcgccaacactttggccatcggagacgcttggagtcatctcccgcattttagtagccccgatctggttaataagtacgccattgtcgaaagacttaacttcgcttactacttacataatggtagacctagcttcgctttcgggacttttctggtgcaggaactgattaagtctaaaacacctaagcagttaattcaacaggtcggaaacgaggcttatgtgatcggtttgagcagttttcatatcccgagtatcggagctgcctgtgtttgttttctcgaattgctcggactggactccctgaagctgcgggtcgacatgaaagttgccaatattatcttgtcgtacaagtgcagaaacgaagacgcacagtactcatttatccgagagtctgtcgccgaaaaactgtccaagctggccgatggggagaaaactacaactgaggagttgctggtcctgctggaagagggaacgtggaattcaatccagcagcaggaaatcaaacgtcttagcagcgaatcgtcaagtcaatgggcccttgttgtgcaattttgccgtctccataatatgaaactctccatctcttacctccgagagtgcgccaaggccaatgattggttgcaatttataatccacagtcagcttcacaattatcacccagccgaggtcaaaagcttgatacagtatttttccccagtgatccaggaccacctccgcctcgcctttgagaacttgccctctgtgccgacctcaaagatggactctgaccaggtgtgcaacaagtgcccgcaggagctgcagggatcaaagcaggagatgactgacctctttgagattctcctccaatgtagcgaagagcccgattcttggcactggctgttagtagaggcagtgaagcaacaggccccaattctctccgttctggcatcgtgtctgcaaggagcttcggcaatcagttgcctatgcgtgtggattatcacctctgtcgaagacaacgtcgctaccgaagcaatgggacatattcaagactctactgaagatcatacctggaacttagaggatctcagcgtgatctggcgaacactgcttactcgccagaagagtaagaccctcattcgcggctttcagctatttttcaaggactcacctctcttgctagtgatggagatgtacgaactgtgcatgtttttccgcaactataaggaagccgaggcaaagttgctggagttccagaagtcgttggaaacacttaacacagctgccaccaaggtgcacccagttatcccggccatgtggctggaggaccaggtgtgctttctcttaaagctgatgctacaacagtgcaagacgcaatatgaattgggcaaactgcttcaactcttcgtggaacgggagcaccttttttccgatggaccagatgtgaaaaaattgtgcatcctctgccagatactgaaagacaccagcatcgccataaatcacaccattatcacttcatatagcatcgaaaacctacagcatgagtgccgctctatcctagaaagactgcaaacagatggccagtttgcgctggcaaggcgcgtggccgagctcgctgaactgccagtggataacctcgtgataaaagagatcacacaggagatgcaaacactgaaacacatcgagcagtggtccctcaagcaggcacggatagacttttggaaaaaatgtcacgagaactttaagaaaaacagcatcagtagtaaagcagctagtagtttctttagtactcaggcacacgtggcttgtgagcatcctaccgggtggtcaagcatggaagaaagacatttgctcctcacattagccggacactggctggcgcaagaagacgtcgtgcccctagataaactggaagaactggagaaacagatctggctctgccggataactcagcacaccctgggtcgcaaccaagaggagacagagccccgtttttctcgccaaatatcaacctcaggggagttgagcttcgactcgctcgcctccgaattttctttttccaaattagccgcacttaacacctccaaatatctggagttaaattctttaccgtccaaggagacttgcgagaatcgtctggattggaaggagcaggagagtctgaattttttgattggaaggctcctggatgacggttgtgtgcacgaggctagtagagtttgtagatattttcacttttacaacccggacgttgctctcgtgctgcactgccgagcgttagcctccggcgaggcaagcatggaggatctgcatcccgagattcatgctctcctgcagagtgcggaactgctagaagaagaagcgcccgacatccccctcagacgcgttcactctagacataagcaaatgttcaacccaactgaagagagccagacatttctgcaactgacaaccctctgccaagataggacactggtggggatgaagttattagataagattagttctgtccctcacggagagttgtcgtgtaccacagagttgctgattcttgcgcatcattgctttactctgacctgtcacatggaggggattattagggtcctccaggccgcccatatgttgacagataaccacctagctcccagtgaggagtatgggctggtggtgcgccttctaaccgggattgggcggtacaacgagatgacgtacatattcgaccttctgcataagaaacattactttgaggtgttgatgcgtaaaaagctcgacccctcaggcactctaaagaccgccttactcgattacatcaaacgatgtcggccaggtgattccgagaagcataacatgatcgctttgtgcttctccatgtgcagagagattggggaaaaccacgaggccgccgcaagaattcagcttaaactgatagagtcacaaccgtgggaggatagtcttaaagacggccatcagctcaagcagttgttactgaaggccctgacactcatgcttgacgctgcggaatcgtacgcgaaagactcttgcgtccgccaagcccagcattgccagagactcacgaaactcattacattgcagatccacttcctcaacaccgggcagaatacgatgctgattaaccttgggaggcacaagctgatggactgtatactggccctgcctcgcttctaccaagcatccatagtagccgaggcgtatgatttcgtgcccgactgggcagagatcctgtatcagcaggtaattctgaagggagacttcaattatctggaggagtttaagcagcaacggctgctgaaaagtagcatctttgaagaaatctcgaaaaagtacaaacagcaccagccaaccgacatggtgatggaaaatttgaagaagcttttgacttattgcgaagatgtatacctatactacaagctggcctacgagcacaagttctatgaaatagtcaatgtcttactgaaggatccacagaccgggtgttgtctgaaagatatgctagctgggtag

SEQ ID NO: 206652 - DNA, 6240 bp, Artificial Sequence
  Description of Artificial Sequence: Synthetic coding sequence
atggccgccgaggagggcgtggccagcgccgccagcgccggcggcagctggggtaccgccgccatgggacgagtgctgccaatgctgctggtgcccgtacccgccgaggctatgggccaactgggctctcgggctcagctgcggacgcaacctgaggccttaggctcgttaacagccgcgggatcgctccaggtgttgtcactcacacctggctccaggggcggcggccggtgttgtctggagggtcctttctggcattttctgtgggaggatagtcggaactcatcgacgccgactgagaaaccaaaacttttagcactcggtgaaaactatgaattgctgatttacgaattcaacctcaaggatggccgatgtgatgctacaatcctgtatagttgcagccgggaagctttacagaaactgatcgacgatcaggacatttcaatttcccttcttagtctgcggatcttaagttttcacaataacaccagtctgctgtttattaacaagtgcgtgatcctacacattatttttcctgagcgagatgcagcgatcagagtcctcaactgctttaccttacccttaccagcccaggcagtcgacatgatcatcgacactcagctctgcaggggaattctattcgtgctctcatctctcggttggatatacatcttcgacgtcgttgacggaacatatgttgcccacgtcgacctggctctgcataaagaagacatgtgtaatgagcaacagcaggagcctgccaaaatctcctcttttaccagcttaaaagtctctcaagatttagatgtggctgttatcgtgtcctctagcaacagcgcagttgctttaaaccttaacctctactttcgacagcaccctggtcatcttttgtgtgagaggatcctcgaagatttgccgattcaggggccaaagggggtggacgaagacgatccagttaattcagcatataacatgaagctcgccaagtttagtttccaaattgacagaagctggaaagcacagcttagctcgttaaacgagactatcaagaactctaaattggaggttagttgctgcgctccctggtttcaagatattctgcacttggagtctcccgagagcgggaaccacagcactagcgtgcaatcctgggcctttatcccccaggacattatgcacggacaatacaatgttctgcagaaagaccacgccaaaacatccgatccgggacgtagctggaaaattatgcacatctccgagcaggaagaaccgattgaactgaagtgcgtctcagtgactgggttcactgcccttttcacatgggaagtggagagaatgggttatacaatcaccctctgggacctggaaacccagggtatgcagtgcttcagcctaggcaccaagtgtatccccgtggacagcagcggagaccagcagctctgcttcgtgctgaccgagaatggcctgtcattaattctgtttgggcttacacaggaggaatttttgaatcggctcatgattcatggaagtgcttccacagtggacaccctatgccatctcaacgggtggggccgttgctccatccctattcatgcattagaagccggtatcgagaacagacagctggatacagtgaatttttttttgaagtctaaggagaatctcttcaaccccagctcaaagagctctgtcagtgatcagttcgaccatctcagctcccatctctacctccgcaacgtcgaagaactcattccagctctggatctgctctgttccgctatcagagaaagttattccgagccccagagtaaacactttagtgagcagttactcaacctaacgctctctttcctgaacaatcagatcaaagagctgtttatccacacagaggagttggacgagcatctgcaaaaaggggtaaacattctcacgagctatatcaacgagctaagaacgttcatgatcaaattcccttggaaactcaccgacgccatcgatgagtatgacgtgcacgaaaatgtgcccaaagttaaggagtctaacatttggaagaagctctcatttgaagaggtgattgcaagtgctatcttaaataataagattccagaggcccagacattttttaggatagactcacacagtgcacagaagctggaggaactgattggaattggtctcaatctggtgtttgataacctcaagaagaataatataaaagaggcaagtgagctgctcaaaaatatggggttcgacgtcaaaggccagctcctaaagatttgtttctacacgaccaacaaaaatatcagggacttcctcgtggagattctgaaggagaagaactacttttctgagaaggaaaagagaacaatagatttcgtgcaccaggtcgagaagctttatttggggcatttccaagagaacatgcagatccagagtttcccgcgctactggataaaggagcaggacttttttaaacataagtcagtgttagatagcttccttaaatacgactgtaaagatgaatttaataagcaggaccaccggattgtgcttaattgggcactgtggtgggaccagttaacgcaggagagcattctgctgccaagaatcagtccagaggaatacaagtcatactcacccgaggctctgtggagatacctgactgccaggcacgactggctgaacatcattctctggataggcgaattccagacacagcattcctatgcctctttgcagcagaataaatggccattactgacagttgacgtgattaaccagaataccagttgtaataactacatgaggaacgagatcttggacaagctggcccgaaatggagtgttcttggcatctgaactggaggattttgaatgtttcctgcttagattgtccagaatcggaggcgtgatccaggataccctccccgtacagaattataaaacaaaggagggctgggacttccacagccagttcattctgtactgtctcgagcactctttgcagcacttactgtacgtgtaccttgattgctataagctgtcccctgagaactgccccttcctagaaaagaaggaactgcacgaggcacacccatggttcgagttcctggttcagtgccggcaggttgcttctaatctgacagatccgaaactcattttccaggcttcgctcgcaaacgctcagattctgattcccacaaatcaggcgtccgtgtcctccatgttactagagggacacacattgctggccctggccaccaccatgtacagcccgggaggcgtctcacaggtggtgcagaacgaagagaacgaaaactgcttgaaaaaggtggacccccagctcctgaaaatggcattgacgccctatccgaaactgaagaccgcactcttcccacagtgcaccccgcctagcgtgctgccctccgacatcactatctatcatctcatccagtccctttctccatttgaccccagccgcctgtttgggtggcagtcagccaatacactggcgatcggggacgcttggagccatctccctcacttcagctcacctgatctcgtcaacaaatacgccatcgttgagcggcttaactttgcatattacttacataacggccgcccgtcttttgcctttgggacctttctggttcaagagttgatcaaatccaagacgcccaagcagctaatacagcaggttggcaatgaagcatacgtcattggactgagtagttttcacataccatcaattggggcagcatgtgtgtgcttcctcgaacttctgggtctcgactccctgaagctgcgggtggatatgaaagtcgccaatattatcttgtcctacaaatgtcgaaacgaagatgcgcagtactcttttatcagagagagtgtggccgagaaattgtctaaattagccgatggcgagaaaacaactacagaagaattgcttgtgttgctggaggagggtacctggaattcaatccagcagcaggaaatcaaacgcctgagctctgagagctcatcacaatgggcccttgtcgtgcagttttgccgcctgcacaatatgaagttgtctataagctatctacgggagtgtgccaaagctaacgactggctccagttcatcatccatagccagttacataactatcatcccgccgaggttaagtctttaattcagtacttcagtccggtgatccaggatcatctgagattggccttcgaaaatttgccttccgtccctactagtaaaatggactccgaccaggtttgcaacaaatgtcctcaggagctgcagggaagtaagcaggagatgacagacctatttgagattttgctacagtgttccgaggagcccgattcctggcactggttgctcgtggaagcggtgaaacagcaggctcccattttgtctgtgctagcctcctgcctccagggggccagtgcaatttcttgcctgtgtgtttggataatcacctctgtggaggataacgtggccaccgaggcaatggggcatattcaggattccaccgaagaccacacttggaatctcgaggatctgtctgtgatctggcgcactttgctcactcgacagaaatctaaaacgctcatcagggggtttcagctttttttcaaggatagcccactcctccttgtaatggaaatgtacgagctttgcatgtttttcaggaactataaagaggctgaagccaagttactggagttccagaaatccctcgaaaccctcaataccgccgctaccaaggtgcacccggtcatcccagctatgtggctcgaagaccaagtctgcttcctgctcaagcttatgctacagcaatgtaagacacagtacgagctcgggaaactcctgcagctgttcgtggaacgcgaacacctcttcagtgacggacctgatgtgaaaaagctgtgtatattatgccagatcctgaaagatacatctatcgcaataaaccacaccattattacttcttactccattgaaaatctgcagcatgagtgcagatccattctcgagcggcttcaaacagatggacaattcgccctggcccggcgggtggccgagttggccgaattgcccgtggacaaccttgtgataaaagaaatcacgcaagagatgcagacgctcaaacacatcgaacagtggagcctgaaacaggctcgcatagacttctggaaaaaatgccacgagaatttcaaaaagaactccatttcctccaaggccgcctcctcctttttctccacccaggcccatgtggcatgcgaacacccaacagggtggtcctccatggaggagaggcacctgctcttgacattggccggccactggctcgctcaggaagacgtggtgcccctcgataaacttgaagagttagagaagcaaatttggctctgtagaattacacagcacacacttggaagaaaccaggaggaaaccgaaccccgctttagtagacagattagcacttctggggagctttcctttgactctttggccagcgagttttccttctcgaagcttgctgccctgaacactagcaagtatctggaactcaatagtctgcctagtaaggagacctgtgaaaacaggttggactggaaagagcaggaaagtctgaattttcttattggccggctgcttgacgacggctgcgtgcacgaggcaagtcgagtctgtcggtattttcacttttacaacccggacgtggctctcgtgttacattgccgggcactcgcatcgggtgaggcttcgatggaggatctgcatcccgaaatccacgcccttctgcagtcggctgagctcctcgaggaggaggcccccgatatccctctaaggcgtgtgcattcgacatctagcctcgactctcagaaatttgtgactgtcccgagcagtaatgaagtggtgacaaacttggaggtcctcactagtaagtgtttgcacgggaaaaattactgccggcaggtcttgtgcctgtacgatctagctaaggaactggggtgcagctacacagacgttgctgcccaggatggcgaggctatgctgcggaagatcctcgcctcccagcagccagatcggtgtaagagggctcaagcctttattagtactcagggccttaaaccagataccgtcgctgagctcgtggccgaggaggtgaccagggagctcctgacctcctctcagggcaccggcgccttaccgccaggagattcccagccgctctag

SEQ ID NO: 206653 - DNA, 2001 bp, Artificial Sequence
  Description of Artificial Sequence: Synthetic coding sequence
atggagcaggagccccagaacggcgagcccgccgagatcaagatcatccgagaagcatacaagaaagcgttcctttttgtgaacaaaggcctgaatacggacgaactcgggcaaaaggaagaggctaagaattattacaagcagggtatcggccatcttctgagaggtatcagcatcagttctaaagaatccgagcacaccggcccggggtgggagtcagcccggcaaatgcagcagaagatgaaggagactctgcaaaatgtaaggactagactggagattttagagaaggggctagcaaccagtctgcagaatgacttacaggaggtgcccaaactgtaccccgagttccctcccaaggacatgtgcgagaagttgcccgaacctcagtccttttctagcgctcctcagcacgcggaggtcaatggaaacaccagcacgccctccgctggtgctgtggctgcccctgcttctttatctttgcccagtcagtcatgccctgccgaggccccaccagcttacactcctcaggcagccgaaggccattacacagtatcatatggaaccgactccggtgaatttagctctgtaggcgaggaattctatcggaaccatagtcagcccccacctctagagacgctcggactggacgccgacgagctgatccttataccaaatggcgttcaaatcttctttgtgaacccggcgggagaggtgagcgctccctcctacccaggttatctcaggatcgtgagattcctggataatagtctggatacggtcctgaacagaccgccggggttccttcaggtttgcgactggctgtatccattagtgcccgataggagcccggtgttgaagtgtaccgctggagcttacatgttccctgacactatgctccaggctgccggctgttttgtcggcgtggtgctcagcagcgagcttcctgaggatgacagagaactgttcgaggatttgctgcgacagatgtccgacttgaggctgcaagccaattggaaccgcgccgaagaagaaaatgagtttcagataccaggaaggacccggcctagttctgaccagctgaaggaagccagtggtactgacgtaaagcagctggaccagggcaacaaagacgttcggcacaaaggtaagcgtggcaaacgcgctaaagatacgtcctcagaagaagttaacctttcacacatcgtgccatgcgagccagtcccagaggaaaagccaaaagaactcccagagtggtccgagaaggtggctcacaacatcctgagtggcgcctcttgggtatcgtggggactggtaaagggcgctgagataaccggcaaagcaatccaaaaaggtgcctcaaagctgcgtgaacggatccagcccgaagagaagcccgttgaggttagtccagcggtaaccaagggtctgtacatcgcgaagcaggccacaggaggagcagcaaaagttagccagttccttgtagacggtgtctgtaccgtggctaattgcgttggaaaagagctagctcctcatgtgaaaaaacatgggagtaagctggtgcccgagtctttgaaaaaggacaaggatggtaaaagccccctcgatggtgctatggtggttgccgcatcttctgtacagggcttctctactgtttggcagggactagaatgtgccgccaaatgcatcgtgaacaatgtcagtgcggagacagtgcaaaccgtgagatataagtatggatacaacgccggagaggctacccaccacgccgtagactccgccgttaatgtgggtgtgaccgcctacaacatcaacaatatcggtattaaggccatggtgaagaaaacagcaacacagacaggccatactttgctggaggattaccagatcgtagataactcccagagggagaatcaagagggcgctgccaacgtgaacgtgcgcggtgagaaagacgagcagactaaggaggtcaaggaagccaagaaaaaagacaaatag

SEQ ID NO: 206654 - DNA, 2001 bp, Artificial Sequence
  Description of Artificial Sequence: Synthetic coding sequence
atggagcaggagccccagaacggcgagcccgccgagatcaagatcatccgagaggcgtataagaaagcgttcctgtttgtcaataaaggcttaaacacagacgagctgggccagaaggaggaggctaaaaactactataagcaggggattggccatctcctaagggggatcagtataagtagtaaggagagcgaacacactgggcctgggtgggaaagcgcaaggcagatgcagcaaaagatgaaggaaacgctgcagaacgtcagaaccagattggagattttagaaaaagggctagctactagcctgcagaacgatctgcaggaagtgcccaagttgtatcccgagtttccgccaaaagacatgtgcgaaaaactacctgagccccagagctttagcagcgcaccccaacacgccgaggtgaacggtaacacttctaccccgtccgcgggcgccgtcgcagctcctgcgagcctcagcctgccatcccagtcatgtccagctgaagccccccccgcttacactcctcaagcggccgagggacactacaccgtgagctatggcacagatagcggggaattctcaagcgtgggcgaagagttttacagaaatcactcccagcccccccctctggagaccctcggactggacgccgatgaactgatcctgatcccgaatggcgtgcagattttcttcgtcaacccagccggagaggtgagcgcacccagttatccggggtacctccggatagtacggtttctcgacaactctctcgataccgtgctgaatagaccaccaggcttccttcaggtgtgtgactggctgtaccctttggtccccgacaggtcccctgtgctgaagtgtacggcaggggcatacatgttccccgataccatgctgcaagctgccggttgttttgttggtgtggtgctgtcctcagagcttccggaggatgaccgcgaactgtttgaggatctactgcgacagatgtcagatctccgccttcaagcaaattggaacagggctgaggaggagaacgagttccagatccccggtcgcacaagacctagctcggatcagctgaaggaggccagcggaacagatgtaaaacagctggatcaggggaacaaggacgtccgccacaaggggaaaaggggcaagcgggcaaaggacacgagctccgaggaggtgaacctgtcccatatcgtcccatgtgagcccgttcccgaagaaaaaccaaaagagctccctgaatggtcagagaaggtggctcacaatatcctctccggcgcatcttgggtcagctgggggcttgtgaagggcgcagagattaccggtaaagctattcagaagggcgcctcgaagctgagagagaggattcagcctgaggagaagccggtggaggtctctccagcagtgacaaagggcctgtacattgccaaacaggctaccggtggtgctgcaaaagtatcccaatttttagtggacggcgtgtgcaccgtggctaactgtgtagggaaagagctcgctcctcacgttaaaaaacacggatctaagctcgttcctgaaagtctaaagaaggacaaagacggtaagtcccctctggacggggctatggtggtggcggcctccagtgttcaaggattttctaccgtgtggcaggggctcgaatgcgccgctaaatgtatcgtcaacaacgtctcggctgaaactgtccagactgttcggtataaatatggatataatgcaggcgaggccactcaccatgcagtcgactcagccgtgaatgtcggggtcactgcatacaatatcaacaacatcgggatcaaggccatggtcaaaaaaactgcaactcagactgggcatacactgcttgaggattatcagatcgtggataacagccagagggagaaccaagagggggcagctaatgtgaacgtgagaggtgaaaaagatgagcagactaaggaggtcaaagaggccaaaaagaaagacaagtag

SEQ ID NO: 206655 - DNA, 2001 bp, Artificial Sequence
  Description of Artificial Sequence: Synthetic coding sequence
atggagcaggagccccagaacggcgagcccgccgagatcaagatcatccgtgaggcatataagaaggcattcctctttgttaataagggtctgaatactgatgagctgggccagaaggaagaggctaaaaattactacaaacaggggattggccacctgctccgcggaatttctatatccagcaaggagtctgagcatacaggccctggttgggaaagcgccaggcagatgcaacaaaagatgaaagagacgctccaaaacgtgcggacccggctggaaattctcgaaaagggtctcgcaacctctttgcagaacgacctgcaggaggtgccgaagctgtatcccgagtttccacccaaggatatgtgcgagaaattaccagagccccaatctttctcctctgcacctcagcatgccgaggttaacggaaacactagcaccccttctgctggagcagttgcggcacccgcaagcctatctctgccttctcagtcgtgccctgccgaagcgcctcctgcgtatacccctcaggctgccgaaggtcattacaccgtgagttatggaaccgacagcggcgaattttcaagcgtgggcgaagaattttatcgtaatcactcccagccacctcccttggagaccttagggctagatgctgacgagttgatcctcattccaaacggagtgcagatcttttttgtcaaccccgctggggaggtgagcgctccctcctaccctggatatttaaggattgtccgattcttggataactcgctggataccgtcctcaataggccgcccggctttctacaggtctgtgactggctgtacccactggtaccggatcggagcccagttttgaaatgcacagccggtgcctatatgttccctgatacgatgctacaggccgcgggatgcttcgtgggtgtggtgctctcatcagagctcccagaggatgatcgagagctgtttgaggacctgctccgccagatgtcagacctaaggctacaggccaattggaacagagccgaggaagaaaatgagttccaaatccccggtagaacgaggccctcctctgatcagttgaaagaggcctctggtacggacgtgaagcagttagatcagggcaataaggacgtgcgacacaaaggcaagaggggcaaacgagccaaagacacctcatctgaggaggttaacttgtctcatatcgtgccttgcgaacccgttccagaagaaaaacccaaggaactaccagaatggagcgagaaagtggcacacaacatcctgtcaggagcaagctgggtcagttggggtttggtcaagggagccgagattacaggaaaggccatacagaagggcgctagcaaactgagggagaggatccagcccgaggaaaagcctgtagaggtgtcacccgcagtcaccaaaggcctgtacatcgctaaacaggccaccggaggagccgctaaggtgagtcagtttttagtggatggagtttgtacagtcgccaactgcgttggcaaggagttggcaccacacgttaagaaacatggttctaaactggtacccgagtctctaaaaaaagataaagacgggaagagccccctggacggcgctatggtcgtcgctgcttcttcagtgcagggtttctccacagtttggcagggcctggaatgtgccgccaaatgcattgtgaacaacgtgtccgctgagacagttcagacagttcgatacaaatacggctacaatgccggcgaagcaacccatcatgccgtagactctgcagtaaacgttggagtaacagcttataatatcaacaatattgggattaaggcaatggtcaaaaaaacagcaacacaaactgggcatacgctgttggaagattaccagatcgttgataactcccagcgagagaaccaggagggggctgctaatgtgaatgtacgaggggagaaggacgagcagacaaaagaagtgaaagaggctaagaagaaagataagtag

SEQ ID NO: 206656 - DNA, 2001 bp, Artificial Sequence
  Description of Artificial Sequence: Synthetic coding sequence
atggagcaggagccccagaacggcgagcccgccgagatcaagatcatccgggaggcatacaagaaggcgtttctcttcgtcaataaggggctcaatactgatgagctggggcagaaagaagaggccaagaactattacaagcagggcatagggcacctgctgaggggtattagcatctccagcaaggagagcgaacatactggacctggctgggagtctgcccgtcagatgcagcagaagatgaaggagacccttcagaatgttcgcacccgtctcgaaattctcgagaagggcctcgctacgtctttacagaacgatttgcaggaggtcccgaagctttacccggagttccccccgaaggacatgtgtgaaaaactgcctgaaccgcaaagcttcagctcagctccccagcacgccgaagtgaatggtaacacatcgaccccaagtgctggcgcggttgctgcccccgcctccttatccctgccaagccagagctgtccggcggaggcccccccggcctatacaccccaggctgccgagggccactataccgtttcctatggaaccgactcaggggagtttagctcagttggagaggagttttatagaaaccactcccagcctccgcctctcgaaactttaggccttgacgcagacgaactaatactaatcccgaatggggtgcagatctttttcgttaatccagctggggaggtgagcgctcctagttatcccggttaccttagaatagtgaggttccttgataactccctcgacacggtgctcaaccgccctcccggcttcctgcaggtgtgcgactggttataccccctcgtccctgaccggtccccagttctgaaatgcacggcaggcgcctacatgttccctgatactatgctacaggcagcaggctgcttcgtaggagtcgttttaagttccgagttgcctgaagacgatagagagttgtttgaagacctgcttcggcagatgagcgatctgaggttacaagccaactggaatagagctgaggaagagaacgagttccagatcccaggccggacgaggccatcaagcgatcagcttaaggaagcaagcgggactgatgtgaagcaattagatcaagggaacaaggatgtgcgtcacaaaggaaagcgggggaagagagctaaggacacgagctctgaggaggtcaacctgagccacattgttccgtgcgagcccgtgccggaggagaaacctaaggaacttcccgagtggtccgagaaggtggcacataatatcctgtccggggcttcatgggttagctggggcctggttaagggggctgagatcacgggaaaagctatccaaaaaggcgcctccaagttgagagaacgcatccagccggaggagaagcctgtagaggtgtcacctgccgttacaaagggactgtacattgccaagcaagccacaggcggagccgctaaagttagccagttcctagtcgacggagtgtgtacggtcgccaactgtgttggcaaggaactcgcaccacacgtcaagaaacacggcagtaaactcgtccctgaaagcttgaaaaaagacaaggatgggaagagcccactggatggcgcaatggttgtggccgcgtcatcagttcagggtttctccaccgtatggcagggattggagtgtgccgccaagtgcatagtcaataacgtttccgccgaaactgtgcagacagtcagatacaagtacggctataacgcaggagaagccacccatcacgccgtcgattcagccgtaaatgtcggtgttactgcctataatattaataacatcggtatcaaagccatggtgaaaaagacagccacacagactggccacacattactggaggactaccagatcgtggacaacagccagcgggaaaatcaagagggcgcagcaaacgtcaatgtcaggggtgaaaaggacgagcagaccaaagaggtgaaagaggcaaagaagaaggacaaatag

SEQ ID NO: 206657 - DNA, 846 bp, Artificial Sequence
  Description of Artificial Sequence: Synthetic coding sequence
atgggcgagatcaaggtgagccccgactacaactggttccggggcactgtgccccttaaaaagataatagttgacgatgatgactctaaaatctggtccctatatgacgccgggcccaggagcatcaggtgcccacttatttttctgccccccgtctctggtaccgctgacgtgtttttcaggcagatcttagcactcacaggctggggataccgcgtgattgcagtccatctgtttggagcctctttgggcggattcctggctcagaagttcgctgagtacacccacaagtctccgagagtgcactcgctgatattatgtaacagtttctcagacacctccatatttaaccagacgtggaccgctaacagcttttggctcatgcctgcattcatgttgaagaagatagtgctaggaaactttagcagtggtccagtcgaccccatgatggctgacgctattgactttatggtggataggttggagtctcttggccagtccgaactcgcttctaggctgactctgaactgtcagaatagctatgttgagccccacaagatcagggatataccagtgactatcatggacgtcttcgaccagtcagccctgtctactgaggccaaggaggaaatgtataaactctacccaaacgcacgcagagcccacttgaagacgggagggaattttccctatctgtgtcggagcgccgaggtgaacctgtatgtccagattcatctgctgcagtttcacggcacaaagtatgcagctatagatcccagcatggtatccgccgaggagctggaggtccagaaagggagtctgggcatatcccaggaggaacagtag

SEQ ID NO: 206658 - DNA, 927 bp, Artificial Sequence
  Description of Artificial Sequence: Synthetic coding sequence
atgggcgagatcaaggtgagccccgactacaactggttccggggcaccgtgccgcttaagaagatcattgtcgacgatgacgactctaagatctggagcctgtatgatgccggcccaagaagcattagatgccctctgatctttctgcctccagtgtccggtactgccgacgtgttctttcggcagatcctggcgctaacagggtggggataccgtgtaatcgctttgcaataccccgtgtactgggatcatctggaattttgcgatggctttcgaaaactactggaccacttacagctcgataaagttcacctctttggggcctccctgggaggctttctggcgcaaaagtttgcagaatacacccacaagagcccaagagtgcacagcctgatactgtgcaatagtttctcagatacatcaattttcaaccaaacatggactgcgaattctttctggttgatgccagcattcatgttaaagaagatagtgctgggtaattttagttctggtcccgtggaccctatgatggcggatgctatcgacttcatggtcgatcggctggaatcactgggccagtctgagctcgctagccggctcacgctaaactgccagaactcttacgtcgaaccccacaaaattcgggacataccggtgaccattatggacgtatttgatcagagcgccctgagcacagaagctaaggaggaaatgtacaaactttaccccaatgcgcggcgtgcacacttgaagactggaggcaattttccttacctgtgcagatccgccgaagtgaatctttacgtgcagatccatctgttacaattccatggcaccaagtacgcagccattgacccttcaatggtgtcagcagaagaacttgaagtgcagaaaggcagcctgggcatcagccaggaagaacagtag

SEQ ID NO: 206659 - DNA, 927 bp, Artificial Sequence
  Description of Artificial Sequence: Synthetic coding sequence
atgggcgagatcaaggtgagccccgactacaactggttccggggcaccgtgcccttgaaaaaaattatagttgacgatgacgatagtaagatctggtcgctttacgatgccggtccccgaagcatccgatgcccacttatctttctgcccccagtcagtgggacggccgatgtcttctttcgacagatccttgctctcaccgggtggggataccgcgttatagccctgcagtaccccgtgtactgggatcatctcgagttctgtgatggttttcgtaagttgctagaccacctgcagttggacaaagtgcacctttttggcgcctctctgggggggttccttgcccagaagtttgcggagtacacccataaaagtccccgagtgcacagcttaatcttatgcaatagctttagtgatacctcgatctttaaccagacttggaccgcgaactccttctggctgatgccggctttcatgctgaagaaaatcgttctcggcaactttagctcgggccccgtggatcccatgatggcagacgccattgactttatggtggaccgactggagtccttgggacagtcggagctggcctcaaggctaacactgaactgtcaaaactcatacgtggaacctcataaaatccgggatatcccagtcacaataatggacgtgttcgaccaaagcgctctgagcacagaggcgaaggaagaaatgtacaagttgtatccgaacgcccgaagggcccacttaaaaaccgggggcaacttcccctatctgtgccgatctgcagaggtgaacctgtatgttcagatccacttactgcagtttcacggaaccaaatacgctgcgattgatccaagcatggtgtccgcagaggaattagaggttcaaaagggatctctgggtatctctcaggaggagcagtag

SEQ ID NO: 206660 - DNA, 2388 bp, Artificial Sequence
  Description of Artificial Sequence: Synthetic coding sequence
atggccgtgctgctgctgctgctgcgggccctgcggcggggccccggacccggcccccgacccctgtggggaccaggccccgcgtggagtcctgggtttccagcccggcccgggcgggggaggccctacatggcgagccggccgcccggtgacctggccgaggccggcggccgggcactccaaagtctgcagctcaggctgttaaccccaacatttgagggcattaacggcctcttattaaagcagcatttggtccagaaccccgtgagactatggcagttactgggtggcaccttctacttcaataccagccgactgaaacaaaagaataaagagaaggataaatccaaaggaaaagccccagaagaagatgaagaggagagacggcgacgagaacgagatgaccagatgtaccgtgaacggctgaggaccctccttgtcatagccgtcgtcatgagcctcttgaacgcactgagcaccagcgggggatccatttcctggaatgattttgtacatgagatgttagcgaagggcgaggtgcagcgagtgcaggtggtgcctgaatctgacgtggtggaggtctatctgcatccgggcgccgtggtgtttggacggccccgcttggccctgatgtatcgcatgcaggttgcaaatatagataagtttgaggagaaattgcgggcagcggaagacgagcttaacattgaagccaaggatcgaattcccgttagctataagaggacaggcttcttcgggaatgcgctttactctgtcgggatgacagctgtgggcttagctatcttatggtacgtcttccgactggccggtatgacgggacgcgagggtggattctctgcttttaaccagctgaagatggctagattcacgatcgtggacggtaaaatgggaaagggagttagctttaaagatgtggcaggaatgcatgaggccaagctggaggtgagggaatttgtcgattatctaaagtcaccagaacgctttttgcagctcggggccaaagtcccaaagggtgctctacttctagggccgcctgggtgcggtaagaccctgctcgcaaaggcggtggcaactgaggcccaggttcccttcctggctatggctggccccgagttcgttgaggtcataggtggcttaggcgccgccagagtcagaagcctgttcaaggaagcacgggctcgcgccccgtgtatcgtttatatcgatgagattgacgccgtcggcaagaaaagatccacaaccatgtcaggcttctccaatacagaagaagaacaaactcttaaccagcttctcgtggagatggacggtatgggcacaacagatcacgtaatcgttctcgcaagcacaaatagagccgatattttagacggtgcattgatgaggcctgggcggctagataggcacgttttcattgacctcccgacccttcaggagcgtcgcgagattttcgagcaacacctcaaatctttgaagctgactcaaagctcaaccttttacagccagaggctggctgagttaactcccggcttttcaggcgctgatatcgccaacatatgcaacgaggccgcactacacgccgcgcgcgaagggcatacatcggtgcacactctgaattttgagtacgctgtggaacgcgttctggccgggactgccaaaaaaagcaagatcctgagtaaagaagaacagaaagtggttgccttccatgagagcggccacgctctggttggctggatgctggaacacacagaagctgtcatgaaagtttctatcacccctcgcacaaatgctgctcttggtttcgcacagatgctccctcgtgaccagcatctctttacaaaagaacagctatttgagcgcatgtgcatggcccttggggggcgggctagcgaggcgttgtcttttaatgaggtgacctctggtgcccaagatgacctccgtaaggtgacgagaatcgcgtactccatggtgaaacagtttggaatggctcctggaatcggcccaattagttttcccgaggctcaggaaggacttatgggaattgggcgtcgcccctttagccagggacttcagcagatgatggaccacgaagcgcgtctccttgtggcaaaggcctatcgtcatacggagaaagtgctgcaagataacctggacaagctgcaagctctcgccaatgccctattagagaaggaagtaatcaattacgaagacatagaagccctgatcggccctccgcctcatgggccaaaaaaaatgatcgccccccagcgttggattgacgctcagcgagagaagcaagatcttggagaggaagagactgaagagacccagcaaccaccattagggggcgaggagcctacttggcccaaatag

SEQ ID NO: 206661 - DNA, 672 bp, Artificial Sequence
  Description of Artificial Sequence: Synthetic coding sequence
atgcggctgcggtgcacccggcggggccgggacaccctgccctgcacactcagcactagcagcacaccttggagcgccagctcccaggttccacgagctcaactgggaaaggctgtaggctcatgccgcggcgtggggtcctgttgcgctagacactgcaaaacacacctcgcttctttaaggcagccgtgtggggagagaaccggagccgcttgcgtgctcttgatctattttagggtgacaatttatttctacgtcgagatcgagaagttactcatcatcgtcgccaaacaggagggcttaagcggcaatcataagcccgtggagaggaaatacatgacatacctgtcagcccaagatcatgagttgatccaagtggtgcagaatggccacctgcagatgtgcggcaagtcagaaacgggcaatgaagccagtcccgggttgccgaaaagggctaggtcgtgccctcggaaaaaccgtaagtggcttaggttcatgtcgcgggcaactccttggtgggcaggctgttggtctacccgccgggatgagggactccataacccatcaacaaatgccgcgttgggctttgcacaagcaccacagaggccagccccactccatgaacaactatttgaacgcatgtgtatggctctgggcggccgggcgtcgtag

SEQ ID NO: 206662 - DNA, 618 bp, Artificial Sequence
  Description of Artificial Sequence: Synthetic coding sequence
ctgggcccccaggcctgcaccgtggtgccccggagcaagtgcttcgatctcgagatggtaagctctcgctgggagccactgctgctgctgacggaagtcacaagcgcaaacgaagtgtgggtgacctccaattcaaccgcactcgtgtttgtttcagacaacgtgcgggaggaattagaagaggtgcaggatctgctctgccgcaccctccctttgcccgtgcagctcagtttccctgaggaagctctggacgtggcaagggtggctcacgtgttcgtctcgccattttgctttagcgctggcagcgaagaacggcgtagacgggagagggatgaccaaatgtatcgagagcgcttacgcacgctactggtcatagctgtcgtgatgagtctgctgaatgccctgagcactagcggcggctcgatctcctggaatgacttcgtccacgagatgctggcaaaaggggaggtccagagggtacaggttgtacccgaaagcgatgtcgtggaagtgtaccttcacccaggtgccgttgtgtttggaagacctcgcctggccctgatgtatcgaatgcaagtagccaacatcgataaattcgaggagaagctcagagcttag

SEQ ID NO: 206663 - DNA, 1470 bp, Artificial Sequence
  Description of Artificial Sequence: Synthetic coding sequence
atggccgtgctgctgctgctgctgcgggccctgcggcggggccccggacctgggccgcgacccttatggggtccgggaccggcgtggtctcccggttttcccgcaaggcccggtcgcggacggccgtacatggccagtaggccccccggcgacctggcggaggccggcggacgcgccttacagagccttcaactgcggttgctgaccccgacttttgaaggcatcaatgggctgctgctgaagcagcatttggtgcagaacccggtccgcctttggcaattgctgggcggcaccttctactttaacacctccagactgaagcagaagaataaggaaaaagacaagagcaagggtaaagcacctgaggaggacgaagaagagcggcgccgaagggaaagggacgatcagatgtatagagagcgcctacggaccttactcgttatagctgtagttatgtctctgctgaacgcattaagcactagcggcgggagcatttcctggaatgacttcgttcatgagatgcttgctaagggagaagtccagcgcgtccaagtggtgcccgagtctgacgtcgttgaagtatatttacacccaggagctgtggtatttggcagacccaggttagccctgatgtacaggatgcaggtggcaaatattgataagtttgaggagaaactcagggccgccgaggatgaactgaatatagaagccaaggataggatccctgtgtcttataaacgaactgggttttttgggaacgccctgtactccgttggtatgaccgcagtagggctggccatcctgtggtatgtttttcggttggcgggcatgactggaagagagggtggttttagcgcattcaaccagctcaaaatggcaaggtttactattgtggacggcaagatgggcaaaggggtctcattcaaagatgtggctggaatgcatgaggctaaattggaggtgagggagttcgttgattatttaaagtctccggagaggtttttgcaactgggcgctaaggtgcctaaaggggcactgctcttgggcccgcctggttgcggaaagaccctgctagccaaagctgtggccaccgaggctcaggttcccttcttggccatggccgggcctgaatttgtcgaggtgattggtggcctgggagcagccagagttcgttcgctgttcaaagaggcccgcgctagagctccgtgtatcgtgtacatcgacgaaatagatgcagtgggtaaaaagaggagcaccacaatgtccggtttctccaatacagaggaagaacagacactgaatcagctgctggtggaaatggacggtgctagcctggatcagctgccttctcagggaactatgagaaaactccggggcaaaactccggcgtgcagttgtttaaccgaacctaccgggtcgaggagggcgatggaggggcactcactctgctggggctgcctgcttcactag

SEQ ID NO: 206664 - DNA, 1851 bp, Artificial Sequence
  Description of Artificial Sequence: Synthetic coding sequence
atgaacagccccggcggccggggcaagaagaagggcagcggcggcgcctcaaatcctgtgccacctcgaccgcctccaccatgtctggctcctgcaccgcccgctgcagggcctgcccctcccccggaaagcccacataaacgtaacctgtactactttagttatcccctgttcgtgggtttcgcccttcttcggctggtggctttccacctgggtctgctgttcgtatggctatgccagcgctttagtagagcactgatggccgccaagcggtcttccggagccgctcctgccccggcgtccgctagcgctcctgcaccagttcctgggggagaagctgaaagagtgagggtatttcacaagcaggcttttgagtacatctcaattgctctgcgtattgacgaagacgaaaaagccggtcagaaagagcaggctgtcgagtggtacaagaagggcattgaggaactggagaaggggatagccgtgatagttaccggccagggggaacaatgtgaacgagctcgcaggctgcaggccaagatgatgacgaatctggttatggcaaaggacagactccagcttcttgaaaaaatgcagcccgtcctgccattcagtaagagccagacagacgtatataacgacagcaccaatctggcctgcaggaatggacatctgcagtctgaatcaggcgcagttccaaaacggaaggatccactgacccatacaagcaactctctccctcgttcgaagactgtgatgaagactgggtctgctggcctgtctggacatcacagggctccgtcatacagtgggttgtctatggtgagcggagttaagcagggaagcggtccagcacccaccactcataagggcacacccaagactaatagaacaaacaaacctagcacccccacaaccgctacccgcaaaaaaaaagatctgaagaatttccgaaacgtggactcaaatctggccaatctaattatgaatgagatcgtagataatggcactgcagtgaagtttgacgatattgccggccaggacttggccaagcaggcactgcaggaaatcgtcatcctgccgtccctgcggccggaattgttcactggtctccgggcccccgcacgcggcctgctgctatttggtccaccgggcaatggcaagaccatgctcgccaaggcagtggccgcagaaagtaatgccaccttcttcaacatttccgctgctagcctcacatcaaagtacgttggcgagggggaaaaattggtgcgtgctctgttcgctgttgcaagagagctgcagccttcaattatctttattgatgaagtcgattcactgctgtgtgaaaggcgcgagggcgagcacgatgcttcccgacggctaaagaccgagtttctgatcgaatttgatggtgttcagtccgcaggcgatgacagagtactcgttatgggcgcaacaaatcgaccacaagagctcgacgaagcagtgctaaggaggtttatcaagcgcgtctatgtgtccctcccgaacgaggagactcgcctgctgctcctcaagaatttgctgtgcaagcaggggagtcccctgactcagaaggaactggcccagctggccaggatgaccgacggctatagtggatccgacctgactgccttggcgaaggatgccgcgttgggtcccatccgggaattgaagcctgaacaggtgaaaaatatgagtgccagcgaaatgcggaacatcagactgtccgactttaccgagtcattaaagaaaatcaaaagatcagtctcccctcagaccctggaagcttacatccggtggaataaggacttcggtgacacaacggtgtag

SEQ ID NO: 206665 - DNA, 1755 bp, Artificial Sequence
  Description of Artificial Sequence: Synthetic coding sequence
atgaacagccccggcggccggggcaagaagaagggcagcggcggcgccagcaatcctgtgccaccacggcctccccccccctgtttagccccagccccgcctgctgccggccctgcacccccgccagagtctccccacaagaggaatctgtattatttttcataccctctgttcgtcggttttgccctattgcgactggtagcttttcacctgggcctgttgtttgtgtggctttgccaacggttctcccgggccctgatggctgccaagcgcagttctggggcggcgcccgccccagcctccgcaagcgcacccgcaccagtgccgggcggggaagctgagcgagtgagagtgtttcataagcaggcctttgagtacatcagtatcgctctgcgcattgacgaggatgaaaaggctggacagaaggagcaggcggtggagtggtacaaaaaaggcattgaggagctcgaaaagggcattgcagtgatcgtaaccgggcagggtgagcagtgtgaaagagccaggaggcttcaggccaagatgatgaccaatctggtgatggctaaggataggctgcagctcctagagtccggcgcggtgcctaaaagaaaagaccccttaacgcatacaagcaatagcttaccacgttcaaagacggttatgaagactggatcagctgggctctcaggccaccatagggcccccagctactctggtttgtctatggtgagcggggtcaaacagggttctggccccgctccaacaacacacaagggaactcccaaaacaaatcgaaccaacaaacccagtactcccactacagccacgagaaagaaaaaagatttgaagaacttccgaaatgtggattccaacttagccaacttgatcatgaatgaaattgtggataacggcactgcggtgaaatttgacgatatagcaggtcaggatctggcgaagcaggcactacaggagatagttattctgccgtctctacggccggaattattcaccggcttgcgggctccggcgcgcggcctgttactgttcggcccccccggaaatggtaaaaccatgctggccaaggctgtggccgcagagtccaacgccaccttcttcaacattagcgcagccagtctaacctcgaagtacgtgggagagggggagaagttagtgagagcactgtttgcggttgcacgtgaactccagccatccattatctttatcgatgaggtagatagcctgctctgtgaaagacgcgaaggcgagcacgatgcatctcgacggctgaagaccgagtttctgatcgaattcgacggggttcaaagtgcaggcgacgacagagtacttgtgatgggagcgactaatcgcccacaagagctggatgaggccgtgctgcggcgattcattaagagagtatacgtgtctctgcctaacgaagagactcgcctgcttttgctgaaaaacctgctttgcaaacaagggtcccccttaacccagaaggaacttgcacaactggcccggatgaccgacggatactccggctccgatttaactgccctcgcaaaggacgccgccctgggaccgatacgcgagctgaaacccgaacaggttaaaaatatgtctgcttccgaaatgcgaaacatcaggctgtctgatttcactgagtctcttaaaaaaattaaacgtagtgtgtcccctcagaccttagaggcttatatccggtggaataaagattttggcgacaccacagtgtag

SEQ ID NO: 206666 - DNA, 26394 bp, Artificial Sequence
  Description of Artificial Sequence: Synthetic coding sequence
atggccaccagccggggcgccagccggtgcccccgggacatcgccaatgtaatgcagcgtctccaggacgaacaggaaatagtccaaaaaaggaccttcacgaagtggatcaattcccatctggccaagcggaaaccccccatggtggtcgacgacttattcgaagacatgaaagatggcgtcaagctccttgctttactggaggtcctgtccggccagaaacttccatgtgagcagggacgaagaatgaagagaatccatgccgtggccaacatcggaaccgccctgaaattcctggagggacgaaaaataaaactggtaaatatcaattccacagacattgctgatggcaggcctagcatcgttctaggcctcatgtggacaattattctctacttccaaatagaggagttaacctctaacctgccacagttacaatctctgtcctcatccgcatccagcgtcgatagcatagtgagctcagaaaccccttctccacctagtaaaaggaaggttacaacaaagatacagggcaacgccaaaaaagctctcctcaagtgggtccagtacacagcaggcaaacagaccggtatagaggtaaaggactttggtaagtcatggcggtcgggggtagcctttcactccgtgattcacgccattcgtccagagcttgtagatctggagacagtgaaggggaggtccaacagagagaacctagaagacgccttcacaatcgcggaaaccgaactcgggatccccagactgttggatcctgaggatgttgacgtcgataagcctgatgagaaatctattatgacctatgtcgctcagtttctcaagcactatccagacattcataacgcctcgaccgacggccaggaagacgacgagatattgccgggattccctagctttgctaacagcgtccaaaatttcaaaagagaagatcgggttattttcaaggagatgaaggtgtggattgaacagttcgaacgggatctcacacgcgcacagatggtggagtcaaacttgcaagacaagtaccagtcctttaagcacttccgcgtgcaatatgagatgaagagaaaacagatagagcacctgatccagccacttcatagggacggtaagctgtctttagaccaggcgctcgtgaaacagtcatgggaccgcgtaacctctcggttattcgattggcatattcaacttgataaatcactgcccgcaccattagggaccatcggggcctggctgtacagggcggaggtggctctgcgcgaggagattacggtacagcaagtccacgaggaaaccgctaacaccatccagagaaaattagaacaacacaaggatctgctgcaaaataccgacgcgcacaagcgcgcatttcacgagatttataggacgaggagtgtgaatgggatccctgtgccacctgaccagttagaggatatggccgagcgcttccacttcgttagttccacaagcgaattacatctgatgaagatggagttcctggagctgaagtaccggctgttgagcctcctcgtgctcgccgagagtaaattgaaatcgtggattataaagtatgggcgcagggagagtgtggaacaactgttacaaaactacgtgagcttcatcgaaaattcaaagtttttcgagcagtatgaagtcacataccaaatcctgaagcagactgccgaaatgtatgtgaaagctgacggctctgtcgaagaggctgagaatgtgatgaaattcatgaatgaaactacagcccagtggcgaaatctctcagtggaggtgagatctgtaagaagtatgttggaagaagtgattagcaactgggataggtacgggaataccgtcgctagtctccaggcctggctcgaggatgctgagaagatgctgaatcagtcggaaaatgctaagaaggatttctttagaaacctgccccactggatccagcaacatacagccatgaacgatgcgggcaattttcttatcgagacgtgcgacgagatggtgtcgcgggatctgaaacagcaactgctcctgctaaacggccggtggagggaactgttcatggaggtcaagcaatacgcgcaggctgatgagatggaccggatgaaaaaggagtacacagattgtgtggtgaccctgagcgcatttgcaaccgaggctcacaaaaaactttccgagcctctggaggtgagcttcatgaacgtaaaactgttaattcaggacctcgaagacattgaacagcgcgtgcctgtgatggatgcccaatataagatcatcaccaagacagctcacctgatcactaaggagtcacctcaggaggaaggcaaagaaatgttcgccaccatgtctaagttgaaggagcagcttaccaaggtgaaggagtgctactcccccctgctgtatgaatcccaacagctgctcatccctctcgaggagctggagaaacagatgacttcattctacgactctctggggaagattaatgaaattataaccgtgttagagagagaggcccagagcagtgcgctgttcaagcagaagcatcaggaacttcttgcctgccaggagaattgcaagaagacacttacgctaatagagaagggtagccagagcgtacagaagttcgtgaccttgagtaacgttctcaagcactttgaccaaactcggctgcagagacagatagccgatattcatgtggctttccagtccatggttaagaagacgggggattggaagaagcatgtggagacgaatagtcgtctgatgaagaagttcgaagaatcgcgcgccgagttagagaaagtcctgcggattgcacaagagggactggaggaaaaaggggaccctgaagagctgctgaggcggcataccgagtttttctctcaactcgatcaacgagtgcttaatgcattcctgaaggcctgcgacgaactcactgatatactcccggagcaagaacagcaggggcttcaggaagctgtgcgaaagcttcacaaacagtggaaggacctgcagggggaggcaccataccacctgctgcacttaaaaattgatgtggagaagaaccgtttcctggcatccgtagaagaatgccggacagagctggatcgtgagacaaaacttatgccgcaagaaggcagtgagaaaataattaaggaacaccgcgttttcttttctgacaagggacctcaccacctgtgtgaaaaacggctgcaacttattgaagagttatgtgtgaagctacctgtccgcgatcccgtgcgggacactccaggtacgtgtcatgtaacactcaaagagctgcgcgctgccattgatagcacttatcgtaaacttatggaggaccctgacaagtggaaggattatacctcacgtttttccgagttttctagctggatatcaaccaacgagacccagcttaagggtatcaaaggtgaggccatcgatacggcaaatcatggcgaagtgaagagagccgtagaggaaatccgaaacggagtcacaaagcgcggcgagaccctgtcttggctgaaatctcggttgaaggtgctcacggaagtgtcatccgagaatgaagcccagaagcaaggagacgagctggctaagttgagctcctctttcaaggctctagtgactttgctgtcagaggtggaaaagatgttgagtaactttggggattgcgtacagtacaaggaaatcgtcaaaaattctctggaggaactgatttctggctctaaggaagtccaagagcaagcggaaaaaatcctcgataccgagaatttattcgaagcccagcagctactcttgcatcaccagcaaaaaacaaaaagaattagcgccaagaagcgagacgtgcagcaacagatagcgcaagctcagcaaggggaaggaggcttacccgaccgggggcatgaagagctgcgaaagctggagtccactttggacgggttggaacggtcacgcgagcggcaggaaaggcgcattcaggtgactctgcggaagtgggagagatttgagacgaacaaagaaaccgtggtgcgatatctgtttcaaactggctcctcgcacgagaggttcctgtccttttcatctctggagtctctgtcctcagaactggaacaaactaaagaattcagcaagcgtactgaatctattgctgtgcaggcagagaatctcgtgaaggaagcaagcgagatcccccttggaccccaaaacaagcagctgctccagcagcaagctaaatcaattaaagagcaggttaagaaattggaagacaccctggaggaggatatcaagaccatggagatggtgaagacaaagtgggatcatttcggttccaattttgagacacttagcgtgtggatcacagaaaaagaaaaggaacttaatgcgcttgaaacatcatcgagcgcaatggatatgcaaatttcccaaatcaaggttacaatacaggaaatagagagcaagctgtcttctatagtgggcttagaggaggaagctcagtcgtttgcacaatttgtcactaccggtgaatcagctagaattaaagccaaattgacacaaatcaggagatacggcgaagaactgagagagcacgcgcagtgtcttgaagggacaatcttaggtcacctgagtcagcagcagaagttcgaagaaaacttgagaaagatccaacagtccgtctctgagttcgaagacaaattggccgttccgataaagatttgttcgtccgcaaccgagacctacaaggtgcttcaagagcacatggacctgtgccaagccttggagtcgttgagctccgcgatcactgctttttctgccagtgcccgtaaagtcgtaaatagagacagttgtgttcaggaagctgccgccctccagcaacagtacgaggatattctgcggcgtgcaaaagagagacagacggctcttgagaatctactggcccattggcagagactggagaaggagttgtcgagctttctaacttggctagaacgtggcgaggcaaaggcctcttcccccgagatggatataagcgccgatcgggtgaaagttgagggcgaactccagctgatacaagctctgcaaaatgaagtcgtatcacaggctagcttctacagtaaactcctacagctgaaagaaagcctgtttagcgtggcgtccaaggatgatgtgaagatgatgaagctgcatctggagcagttggacgaacgctggagggaccttccacagatcatcaataaacgtataaacttcctgcaatcagtggttgccgagcatcagcagtttgatgaactgcttctgtctttttctgtgtggattaaactgttcttaagcgaattgcaaacaacatctgagattagcatcatggatcatcaggttgctctgacccgccataaagaccacgccgccgaggtcgagagtaagaaaggggagcttcagagcttgcagggtcacctcgctaaactgggttctctggggcgagccgaagatcttcatttgttacaggggaaggcagaagattgcttccagctgttcgaggaggcctcacaggtcgttgaacgccggcagctggccctatcgcaccttgcggagttccttcagagtcacgctagcttatccggtatcctgcgtcaactgcggcaaacagtggaggccaccaattcaatgaataagaacgagagcgatttaattgaaaaagaccttaacgatgctctgcagaatgctaaggccttggaaagcgcagctgtgtcgttggacggcattctgtctaaagcgcagtaccacctgaagataggttcctcagagcagagaaccagctgtagggccactgccgaccagttatgcggcgaggtggagcgcattcagaatttgctgggtacaaagcaatctgaggccgacgccctagccgtcttaaagaaagccttccaggaccagaaggaggagctcctcaaatcgatcgaggacattgaagaaaggaccgataaggagcgattgaaggaacccactcgacaggccctccaacaaagactgcgggtctttaatcaactagaagatgaactcaactctcacgaacatgaactttgctggcttaaggataaggctaaacagatcgctcagaaagacgtcgcttttgcccctgaggtcgatcgcgagatcaataggcttgaggttacttgggacgacacgaagagactgatccacgaaaatcagggccagtgctgcgggttaatcgatttgatgagagagtatcagaacttgaaatcagcagtgtctaaggtgctagagaacgcttcttcagtgatcgttactcggactacaattaaggaccaagaagacctcaagtgggctttttccaaacatgagaccgctaaaaataaaatgaactacaaacaaaaggacctcgataactttacatctaagggaaaacacctactttccgaactgaagaaaatccacagcagtgatttttcgcttgtgaagactgacatggaatccacagtggacaagtggcttgacgtgtctgaaaagctggaggaaaacatggatcggctacgagtcagtctttcgatctgggacgacgtgcttagtactcgcgacgaaattgaaggctggtctaacaattgcgtgcctcagatggccgagaatatttctaacctggataaccacctcagagctgaggagcttctgaaggaattcgaatcggaggtgaaaaacaaggccctgcgcctggaagagttacacagtaaggtgaacgacttaaaggaactcacaaagaacctggagactccccctgacctacagttcatcgaggccgatcttatgcagaaactggaacatgcaaaggaaatcacagaggtggcaaagggaactctgaaagattttactgcccagtcaacccaggtggaaaaatttatcaatgacattaccacctggttcacgaaggtcgaggaatctctcatgaactgtgctcaaaacgagacctgcgaagcgctgaaaaaagtcaaggacattcaaaaggaactgcagtcccaacagagtaacatttcctctacgcaggaaaatcttaacagcctctgccgtaaatatcacagtgccgagctagaatctctgggcagggccatgaccggcctcattaagaagcacgaggctgtgtctcagctgtgcagcaaaacacaggcatctctgcaggagagtttggagaagcacttctcagaatccatgcaagaatttcaggagtggtttcttggagctaaggccgccgcgaaggagagctccgaccggactggcgatagcaaggtactggaggccaaattgcacgatctgcagaacatcctggattcagtatcagacggacagagtaaattggatgctgtgacccaagaaggtcaaactctctacgcccacttatccaagcaaatcgtaagtagtatacaggaacagataacaaaagccaacgaagaatttcaggccttcttgaagcagtgtctgaaagataaacaagctctgcaggattgtgcctcagaactcggctcattcgaagatcagcataggaagttgaacctatggattcacgaaatggaagagcgcttcaatactgaaaacctgggggaaagcaaacaacacataccggagaaaaagaacgaagtacacaaagttgagatgttcttgggagagctgctggctgcccgggaatctcttgacaagctgagccaacgcggacagcttctttccgaggagggtcacggagccggccaagagggccgactgtgttctcagctgctgacatcccatcagaaccttcttcgcatgactaaggagaagttgcggtcttgtcaggtggcactccaagaacatgaggccttggaagaggcactgcagagcatgtggttctgggtgaaagccatacaggaccgacttgcctgtgccgagagcaccctcggctcaaaagatactttagagaagagactgtcacagatacaagatattcttcttatgaaaggggagggagaagtgaaacttaacatggccatcgggaagggagaacaagcattgaggtcctccaataaggagggacagcgggtgattcagacgcagctggagacacttaaggaagtctgggccgacattatgtctagtagtgtgcacgcccagagcaccctagagtctgtgatcagccagtggaacgactacgtcgagaggaaaaaccaactcgagcagtggatggagtctgtggatcagaagatagaacacccccttcagcctcagcctggcctcaaagaaaagttcgtcctgctcgaccatcttcagagcattctctcagaggccgaagatcacactagagcattgcatagactgattgccaaaagcagggaactgtatgagaaaacagaagatgagtcttttaaagacactgcccaggaggagctgaagacccagtttaatgacatcatgacagtggccaaagaaaaaatgcggaaagtggaggagattgtcaaggaccacctgatgtaccttgacgctgtccacgagtttaccgactggttgcacagcgctaaagaggaattacaccgctggtccgatatgtctggggactcatcagctacgcagaagaagttgagcaagattaaggagctaatagactcacgggaaattggcgcatctaggctgagccgcgtggaatctctggcccccgaagtgaaacagaataccacagcatctggctgtgagttgatgcacacggagatgcaggccttgagagcagactggaaacagtgggaagactctgttttccaaactcaatcttgccttgaaaatctggtttctcagatggcactgtctgagcaggagttttcagggcaggttgcccaactcgagcaggccctggaacagttctcggcactactaaagacttgggcacaacagctcaccctgctcgaaggtaaaaatactgacgaagagatcgtcgaatgctggcacaaaggacaggaaatcttggacgcactgcagaaggctgagccccggacagaagacctcaagtcccagcttaatgaactctgccggtttagcagagatctttccacctactctggaaaggtgagcggcctcattaaggaatacaactgtttgtgtctacaggcatccaagggctgtcaaaacaaagaacagattctgcagcagcggttccgcaaagcctttcgggattttcagcagtggcttgtaaatgccaagataaccacagcaaaatgtttcgatatcccgcagaacatttctgaggttagtacctcccttcaaaaaattcaagagttcctgtctgagtcagagaacggacagcacaaactcaatatgatgctgagtaaaggtgagctcctgagcactctgctcactaaagagaaagccaaaggcatccaggctaaggttaccgctgcgaaggaggactggaagaacttccatagtaacctacaccaaaaagaaagtgccttggagaacctgaagattcagatgaaggatttcgaagtttcagctgagccgatccaggactggctgtcaaagacagagaaaatggtgcacgaaagtagtaatagactgtacgacctgccagccaaacggcgggagcagcagaagctccagtctgtgttggaagagattcattgttacgagccgcaacttaaccgcttaaaggagaaagcccagcaattatgggagggacaagccgcttctaaatcattccggcaccgagtttcacaactatcctctcaatacctcgccctttctaacctgactaaagagaaggtcagcaggctggatcggatcgtggctgaacacaatcaattctcccttggaatcaaggagttacaagattggatgacagatgcaatccacatgctggacagttactgccacccaacttctgataagtctgtactggattctcggacattgaagcttgaggcactgctgtccgtgaaacaggagaaagagatacagatgaagatgattgtcacacggggagaatcagttttacagaacacctctccagaaggcatccccaccattcaacagcaactacagagcgtcaaggacatgtgggcctcgctgctgtcagcaggaatccggtgtaaatcgcagctagaaggggccctgagcaagtggacctcctatcaggatggcgtgagacaattttccgggtggatggacagcatggaagctaacctgaatgagtccgaacgccaacatgcagagttgcgggacaagacaactatgctgggcaaagccaagcttctcaatgaggaagtacttagctacagctctctccttgaaactattgaagtcaaaggagcggggatgaccgaacattatgtcactcagctggagttgcaggatctgcaggagcgttacagggcaatacaggaacgggccaaggaagccgtgactaagagtgagaagctagtgcgcctgcaccaggagtatcaacgagatcttaaggcctttgaagtgtggctgggtcaagagcaggagaaactggatcagtattcggtactggaaggtgatgcacatacccacgagaccacactccgagatctgcaggagctgcaagtgcattgtgcagaaggtcaggccctcctgaactccgtcctccatacccgtgaagatgttatcccttcaggcatcccgcaggcggaggacagggcccttgagagtctccgccaggactggcaggcctatcagcatagattgtctgaaacacggactcagttcaacaacgtggttaataagctgcgcctaatggaacaaaagtttcagcaggtcgacgagtggctgaaaaccgcggaagagaaagttagtccaagaacgcggcgccaaagcaacagggctaccaaggagatccaactgcatcagatgaagaagtggcacgaagaagtgacagcctacagggacgaagtcgaggaagttggagctcgcgctcaggaaattctggacgagtcccacgttaactctcggatggggtgtcaggccactcagctcactagcagatatcaagctttactcttacaggtgctcgagcagataaagttcctggaggaggaaatacagagccttgaggagtctgagagctcgctttcttcgtacagtgattggtacgggagtacccataagaatttcaagaacgtcgccaccaaaattgacaaggtcgataccgtgatgatgggtaagaaactcaaaaccttggaggtgttgctcaaagacatggaaaaggggcacagtttgttaaaatcagctagggaaaagggggagcgggccgtcaagtacctggaggaaggtgaggcagagagactgcggaaggaaatacatgatcacatggagcagctgaaggaacttaccagcacagttcgaaaagaacatatgaccttggaaaaaggactacaccttgccaaggagttctctgataaatgcaaagccttaactcaatggatagctgaataccaggagatacttcatgtccccgaagagcctaagatggagctgtacgagaagaaagcccagctctctaagtacaagagcctgcagcagaccgtgctgagccacgaaccaagtgtgaagtcagtgcgagaaaagggagaggctcttctcgaattggtgcaggacgtgacgctgaaagataagatcgaccaactgcagtcagattaccaggatctctgttccattgggaaagaacatgtgttttcacttgaggctaaagtcaaggatcacgaggactataactcggagttacaggaggttgagaagtggctgcttcagatgtccgggcgcctcgtcgcacccgatttgcttgaaactagcagccttgagaccatcacccagcagcttgcccaccacaaagcgatgatggaagaaatcgcaggctttgaggaccggttaaacaatctgcagatgaagggcgacactctcattggacaatgtgctgaccacctccaggcgaagctcaaacagaatgtgcacgcacacctgcagggaaccaaggattcttattcagcaatctgcagcaccgctcagcggatgtatcagagtttggaacacgagctgcagaaacatgtatcaaggcaggacacactacaacagtgccaggcctggcttagcgccgttcagccggatctggaacctagtcctcagcctcccctgagtcgtgctgaagctatcaaacaagtgaaacattttcgcgcactccaagagcaggcccggacgtacttggacctgctgtgttccatgtgtgacctcagcaacgccagtgtcaagaccactgccaaggatatccagcagacggaacaaacaatcgagcaaaagctcgtgcaggcccaaaaccttactcagggatgggaagagattaagcacctaaagagtgagctctggatttatcttcaggacgctgaccagcagctccagaatatgaagcggcggcactctgaactggaactgaacatcgcgcaaaacatggtgagccaggtcaaggattttgtgaaaaaactccaaagcaagcaggcctcagtcaatacaattattgaaaaggtgaataaattgactaaaaaagaagaatcacctgaacacaaggaaatcaatcatctgaacgatcaatggctcgacctgtgtcgacagagtaataacctatgcttgcagagggaggaagacctccagcggaccagagattaccatgattgtatgaatgtcgtcgaggtcttcctggagaaatttacgacagaatgggacaacctggcaaggagtgacgccgaaagtacagctgtacatctcgaagccctcaagaagttggcgctggccctccaagaaagaaagtatgcgattgaggacctgaaagatcagaaacaaaagatgatcgagcacttaaatttggacgataaggagttggtgaaagagcagaccagccatctggagcaacgctggtttcaattagaagatctaatcaagaggaagatacaggtctctgttactaatctggaagagctcaatgttgtccagagccgatttcaggaattgatggagtgggcggaggagcagcagccaaatatcgcggaagctctcaaacagtcacccccgccggacatggcacaaaatctgttgatggaccatctcgctatttgctccgagctggaggcaaagcagatgctcctgaaatccctcattaaggacgccgacagagtaatggccgatctcgggctgaatgagagacaggtgattcagaaggcgttaagcgatgcgcagagtcatgtcaattgcctgtccgatctggtaggacagaggcgcaaatacctgaataaggccttaagtgaaaaaactcagttcctgatggccgttttccaggcaaccagtcaaatacaacagcatgagcgcaagatcatgtttcgagagcacatctgtctcctgcccgatgatgtttccaaacaagtgaagacatgcaaatcagcccaagcatctctgaaaacataccaaaacgaggtgacgggactatgggctcagggacgagagctgatgaaggaggtgaccgagcaagaaaagtccgaggtcctgggaaagcttcaagagctgcagtcagtgtatgactccgttctgcaaaagtgttcgcataggctgcaggaactggaaaagaacctcgtcagcagaaaacatttcaaggaggatttcgacaaggcgtgccactggcttaagcaggctgacattgtgactttccccgaaattaacctgatgaatgaaagcagtgagttacacacgcagctcgcaaaataccagaacattctggaacagtcacccgaatacgagaacctgcttctgaccctccagagaactggtcagaccatcctgccctcattaaatgaggttgatcacagttatctctctgaaaaactgaacgccctcccgcgccaatttaacgtgatcgtcgcactggccaaggacaaattctataaagtgcaggaagcaatccttgctaggaaggaatacgctagcctcatcgagctgaccacgcagagtttaagcgaactagaagcccagttcctacggatgtccaaggtcccgaccgacctggccgttgaagaagcactgagcctgcaggacggatgtagggccattctggacgaggtagctgggttaggcgaggcagtggacgagcttaaccagaaaaaggagggttttcgatccactggtcagccctggcagccggacaaaatgctgcacctcgtgacgctgtaccatcgtctcaaaaggcagacagagcagagagtaagcctgctcgaagacaccacctccgcgtatcaggaacacgagaaaatgtgtcagcagctggagagacagctgaagtcagtaaaggaggagcaatccaaggtcaacgaggagacacttcccgccgaggagaagttgaagatgtatcacagccttgctggatccttacaagactcaggtatcgtgctgaagcgcgtgacaatccatctggaggatctggcaccgcacctggatcccttagcttacgaaaaagctcgacaccagatacagagttggcagggtgagctgaaattgctcacctctgcaatcggcgaaacggtgacggagtgtgagtcgcggatggtgcagagcattgacttccagacagaaatgtcacgaagcctggactggctgaggcgggttaaggccgaactgtctgggcctgtctacctcgatctcaatttacaggacattcaggaagaaatccgaaaaatccagatccaccaggaagaagtccagagctccctgagaatcatgaatgccctgagccacaaggaaaaagagaaattcaccaaggctaaggaactgatctcagctgacctggagcactctctggctgagctatcagagctagacggcgacattcaggaggccctgcgaacaaggcaggccaccctcacggaaatctactctcaatgtcagaggtattaccaagtatttcaggccgcaaacgactggcttgaggatgcacaggaactcttgcagctggctgggaatggactggatgtggaatcggctgaggaaaacctcaagtcacatatggagttcttcagcactgaagatcagttccacagtaatttggaagagctgcacagcctagtcgctactttggacccgctcatcaagcctactggcaaggaagatctggagcagaaggtcgcgagtcttgaactgcggtctcagcgcatgtcccgcgactctggcgcacaggtagatttgctgcaaagatgcaccgctcagtggcacgactatcaaaaagcccgtgaagaagttatagaattaatgaacgacactgagaagaaattatctgagttctcgctcctgaaaaccagcagctctcatgaggccgaggagaagctctcagagcataaggcactagtgtcagtggtgaactcgtttcatgaaaaaatcgtagcactcgaggagaaagctagccagctggaaaagacaggcaatgacgcttccaaagctaccctgtcccgcagtatgaccacggtgtggcagagatggacacggctcagagctgtggctcaagaccaggaaaaaatactggaggatgccgtggacgaatggacaggctttaataataaagtcaaaaaggccacagaaatgattgaccagctgcaggacaagctaccgggaagctccgcagagaaagcaagcaaggccgaacttctgactcttctggagtatcatgacacatttgtgttggagcttgaacagcagcaaagcgctctaggcatgctccgccagcagacactctccatgttgcaagacggcgccgctcctaccccgggggaagagccaccactgatgcaggaaattaccgcgatgcaggaccggtgtctcaacatgcaggagaaggtgaagacaaacggaaaactagtgaaacaagagttgaaggatagagaaatggtggaaacccaaattaactctgtcaagtgctgggttcaagaaacaaaagagtatttggggaaccctacgattgagatcgacgcgcaattagaggagctgcaaattctgctgacagaggctaccaatcatcgacaaaatattgagaaaatggccgaagagcagaaggaaaagtatcttgggctctatacaatcctgcctagtgaactctctcttcagttggcagaggtggccctagacctgaagatccgggaccagatacaggacaaaataaaggaggttgaacaaagtaaggctacttcacaggagctcagccgccagatacagaagctggccaaggatctgaccacgatactgactaagctaaaggcaaagacagataatgttgttcaggccaaaaccgatcagaaagtgctgggggaggagctggacgggtgcaactcaaaactgatggagctggacgccgctgtccaaaaattcctcgagcagaatggtcagctaggaaaaccgctggctaagaagatcgggaagctaaccgagctacaccagcagactattcgtcaggcagagaatcgcctgtccaaattgaatcaggcagcatcccatctagaggagtataacgagatgttggaactgatcctcaaatggattgaaaaggctaaggtccttgcccacgggactattgcctggaacagcgcatcacagttgagggagcagtatattctgcatcagacactgctggaagagagcaaggagatcgatagcgaacttgaagcgatgaccgagaaactgcagtacctgaccagtgtttactgcaccgaaaagatgtctcagcaggtggcagagctagggagagagaccgaagaactgagacaaatgataaaaatccgactgcagaatcttcaggacgctgcaaaggacatgaagaagttcgaagccgaactcaagaaactgcaggccgcactcgagcaggcccaggctactctcacctcccccgaggtaggacgcctcagtctgaaggagcaactgagccacagacaacacctgttatccgagatggagtctttgaagccaaaagtgcaggccgtgcagctgtgtcaatccgcactaaggatccccgaagacgtcgtggcgtcgttgccattgtgtcatgctgccctgcgtctccaggaggaggcctcaaggttacagcacactgcaatacagcaatgcaacatcatgcaggctgccgtggtccagtacgagcagtatgagcaggagatgaaacacctccaacagctgatcgaaggtgcgcaccgggagatagaagataagccagttgctacaagcaacattcaagagttacaagcccaaattagtcgacatgaagaacttgctcagaagataaaggggtatcaggaacaaatcgccagcctgaacagcaaatgtaaaatgttgactatgaaggccaaacacgctactatgctgcttacagtcactgaagttgaaggcctggccgaagggacagaggacctagacggggagctcttacctactccaagcgcacatccttctgtggtgatgatgactgccgggcgatgtcacacccttctttctcccgtcaccgaggagagcggcgaagaaggtactaactctgaaatctcaagcccacccgcctgtaggtctcccagccccgtggccaacacagatgcgtctgttaaccaggatatcgcatactatcaggcgctctctgccgaacggctccagacggatgcagccaagattcaccccagtacatctgcttcccaggagttctatgaacctggacttgaaccttcagccacagcgaagcttggcgacctgcagcgaagctgggagaccctcaaaaatgtgattagtgagaagcagcgcactttgtacgaggccctggagaggcaacaaaagtatcaagattccctccagagcatcagcaccaaaatggaggccatcgagttgaagttatctgaaagccccgaaccaggacgatcccccgagagccagatggcagaacaccaggccctgatggatgagattttaatgctgcaagatgagattaacgaactccaaagttctctggccgaagagcttgtgtctgagagctgtgaggcggacccagcggagcagcttgccttacagagtactctaactgtgctggccgaacgtatgagtacgattcgaatgaaagcctccggaaagaggcaattgttagaagagaagctcaatgaccaactcgaggagcaacggcaagagcaggcgctgcagaggtacaggtgtgaggccgatgaactggacagttggctactcagtacgaaagctaccttggacacggcactctcccccccaaaggagccgatggatatggaggcccagctgatggattgccagaatatgttggtggagattgagcagaaggtcgtggcactgtcagaactttctgttcacaacgaaaatctactgctagagggtaaggcccataccaaggatgaggccgagcaactggctggcaagttgcggcgtctgaaagggtcgctacttgaacttcagcgcgcattacatgataagcagctcaatatgcagggaaccgcccaggaaaaggaagaatcagatgtcgacctcacagcaactcagagtcctggcgtgcaggaatggctggcccaagcaaggactacgtggacgcaacaacgccaatcctcgttacagcagcaaaaggagctcgagcaagagctggccgaacagaaatcccttctgagaagtgtggccagcagaggtgaggagatcctgattcagcacagcgcggccgagacctctggggacgcaggtgagaaacccgacgtcttatcacaagagttaggaatggaaggtgagaaatcttcagccgaagaccaaatgcgaatgaagtgggagtccttgcaccaggaattcagcaccaaacagaagttactccaaaatgttctggagcaggagcaggagcaagttttgtattcaaggcccaatcgccttttatccggagttccgctctacaaaggcgatgtacccacccaggataaatcagccgtgacttcattgctagatggccttaatcaggctttcgaggaagtctctagccaatctggcggggccaaacgccagtccatccacctcgagcaaaaactatacgacggggtatccgcgacttcaacatggctcgacgacgtagaagagaggcttttcgtcgcaaccgcattgctacctgaagagactgagacctgcctgtttaaccaggaaattctggccaaggatattaaagaaatgagtgaggaaatggataaaaataagaacctcttcagccaggcttttccggaaaacggtgacaacagagacgtgatcgaagacacacttggttgtctgctgggccggctgagcctactggattcagttgtaaatcagcgctgccaccagatgaaagaacggttacagcagatcctgaatttccagaatgacctgaaggtgctttttacctctctcgcagataacaaatacatcattcttcaaaagttagccaatgtattcgagcagcctgttgcggagcaaatagaggcaatccaacaggccgaggatggcctcaaggagtttgatgctggcatcatcgagctgaaacgcagaggcgacaagctgcaagtggagcagccttcaatgcaggagctctccaaactgcaggacatgtacgacgagctgatgatgatcatcggcagtcgcagaagtggactgaaccagaatcttactctgaaatcacaatacgaaagggccctgcaggatctcgccgatctattagaaacagggcaagagaagatggcaggagaccagaagattatcgtcagtagtaaggaggaaattcagcaactgctggataagcataaagaatattttcagggccttgaatcgcacatgattttgactgaaacactgttcagaaagatcatcagctttgcagtgcagaaggagacccagtttcacaccgaacttatggcacaggcttcagctgtgcttaaaagagcacataagagaggtgtggagctggaatacattctggaaacttggagccacctagacgaggatcagcaggaactgagccgtcagctggaggtcgtggaatcatccataccgtccgtgggcctggtggaggaaaacgaagaccggctgatcgatagaattactctatatcagcacctgaagtcatcgttaaacgagtatcagcctaaactgtaccaggtgctcgacgatggtaaacggctgcttatttctatctcttgctcagatctggagtctcagctgaatcagctaggggagtgttggctgtcaaatactaacaagatgtccaaagaactccaccggcttgaaaccattctgaagcattggacacgctaccaatcagagtccgccgacctgatacactggctccaatcagccaaggacagactcgagttttggacccagcagtcggtgactgtgccccaggagctggaaatggtgcgcgatcacttgaatgcttttcttgagttttctaaggaagtggacgcccaatcttctctgaagagcagtgtcctaagtactggaaatcagttgcttcgcctgaagaaggttgatacggccacattgcgaagcgagctctctcgcatagatagtcagtggacagatctcctgactaatattcccgcagtccaggaaaagctccaccagctgcaaatggacaagctcccaagccgacatgccatctctgaagtcatgtcgtggatctccttaatggagaatgtgatacagaaggatgaggataatataaaaaacagtatcgggtacaaggctatccacgaatacctacagaaatataaaggttttaaaatagatataaattgcaaacaacttactgtcgatttcgtgaaccagagtgtcctgcagatctccagccaggatgtcgagtctaaaaggagtgacaaaaccgactttgcagagcagctgggcgcgatgaataagagctggcagattttacaaggcctggtgaccgagaaaattcagttgctggaaggactgttggagagctggagcgaatacgagaacaacgtacagtgtctgaaaacttggttcgaaacacaggagaaacgcttgaaacagcagcaccgaattggggatcaggccagcgtgcagaacgctctcaaagactgccaagatttggaggacctgatcaaagcgaaagagaaagaagtggagaaaattgagcagaacggcctggctctaatccagaacaaaaaggaagacgttagctctattgtcatgagcactctcagagagctgggacagacgtgggcaaacttggaccacatggtcgggcagctaaagatcctgcttaagtctgttttggatcaatggtcatcacacaaggttgcgtttgacaagataaactcttatctcatggaggctcggtattccttaagtcgcttccggttgcttaccggctccctcgaggcggtccaagtacaggtagacaacttacagaacctccaggatgacctggagaagcaggagcgatcactacagaagtttggatctattacaaatcaacttttaaaggaatgccacccacctgtgactgagactttaaccaatacactgaaggaagtcaacatgcgatggaataatctgctggaggagattgctgagcagctgcagagcagcaaagccttgctgcagctgtggcagaggtataaggactacagtaaacagtgtgccagtaccgtgcagcagcaagaggatcgtactaatgaactgctgaaggctgcaaccaataaagacatcgcagatgacgaggtcgcaacgtggattcaagattgcaacgacttgctgaaggggctcggtaccgtcaaggacagtctcttttttctgcacgaactgggggaacagctgaagcaacaggttgatgccagcgccgcctcagccatccagagcgaccagttatccctttctcaacacctgtgcgcactggaacaagcactctgcaagcagcaaacgtctctgcaggccggggtgctcgactatgagactttcgctaaaagtctggaggctcttgaggcatggatcgtggaggccgaggagattctgcaaggccaggacccaagtcactcctcggatctttctacgattcaggagcgcatggaagagctgaaaggccagatgctcaaattcagtagcatggctcccgacctagatcgcctcaacgaacttggctatcggctccctctaaacgacaaggaaattaagaggatgcagaacctgaacagacattggagcctcatcagctctcaaacaacagagagattcagcaagctccagtcctttttgctgcagcaccaaactttcttagaaaaatgcgagacgtggatggagtttctggtccagacagaacaaaaactggctgtcgagatctccggcaattatcagcacttgctggaacagcaacgcgctcatgagttattccaagcagagatgttcagtcggcagcaaatactgcactcaatcatcatagacgggcagaggctcctggaacaggggcaggtggacgatcgcgatgagttcaacctgaaactgactctgctgagtaatcagtggcaaggcgtgatccgcagggcacagcaacgcagggggataatcgatagccagatcagacaatggcagcggtacagagaaatggcggaaaagctgagaaaatggctggtggaagtgagctacctgcccatgtccggcctggggtccgtgcctattccgttgcagcaggcccggaccttatttgacgaggtacaattcaaggaaaaagtctttcttaggcagcaaggcagttatatccttaccgtggaggccggtaaacaacttctgctgagtgccgacagtggggcggaagcagcgttgcaagccgagctagccgagattcaggaaaaatggaagtctgcctccatgcgcttggaggaacaaaaaaaaaagttagcattcttgctgaaggattgggaaaagtgtgaaaaaggtatcgccgacagcctggagaagttgcgtaccttcaaaaaaaagctctcacagtctttgcccgatcatcacgaagagctacacgccgagcagatgagatgtaaagagctggagaatgctgttgggagctggacagatgatttaactcagctctctctgcttaaagataccctttctgcttacatcagcgctgatgacatcagtatcctgaatgaaagggtagaactgcttcagcgtcagtgggaagagctctgccatcaattatctttaagacgtcaacaaatcggagagagactgaacgagtgggcggtgttttcggaaaagaataaagagctgtgtgagtggctgacacagatggagtccaaggtgagccagaatggcgacatcctgatcgaagaaatgatcgagaagttgaaaaaagactaccaagaagagatcgctatcgctcaggaaaacaaaatccaattgcagcagatgggggaacgacttgccaaggcatcccacgaatcaaaggcatccgagattgagtacaaactgggtaaggtgaatgatcgttggcagcatttgcttgatctcattgcggcgagagtgaaaaaacttaaagagactttggtagcagtccaacagctcgacaagaatatgtctagccttagaacttggctagcgcatatcgagtcagaactggccaagcctatcgtttatgattcttgcaattctgaagagattcagcgtaagctgaatgagcagcaggaactacagcgagatattgagaagcactccacaggggtcgcatccgtactaaacctctgcgaagtcctgctgcatgattgcgacgcctgtgcaaccgacgcagagtgcgacagtattcagcaggctacacggaatctcgaccgacgttggcgtaatatctgtgcaatgtcgatggagcgccgtctaaagattgaagagacctggaggctttggcagaagtttctggatgattactcccggtttgaggattggctgaaatcatctgagcgcacagccgcctttccctctagctcaggcgtcatttacacggtggctaaggaagaactgaaaaagtttgaagcctttcagcgccaggttcacgaatgcctgacccagcttgagcttattaataagcaataccggaggctggcccgggagaatcgaactgacagcgcctgcagtctcaagcaaatggtgcacgagggcaaccagagatgggataacctgcagaagagagtcacctccattctcaggcgtctaaagcatttcatcgggcagcgggaggaattcgagacagcacgggacagtattcttgtgtggctgactgaaatggatttgcagttaaccaacatagagcactttagcgagtgcgatgtgcaggcgaagataaagcagctgaaggccttccagcaggagatctcgctgaaccacaataagatcgaacagatcatcgctcagggggagcagctgatcgaaaaaagcgagcctcttgacgctgctataattgaagaggaactcgacgagttgagaagatattgccaggaggtcttcggtcgggtcgagaggtatcacaagaagcttattcggctccccctacccgatgacgagcacgacctctccgatcgggagctcgaattagaggattccgccgcactctccgatctgcattggcacgacaggagcgccgatagcttgctgagccctcagccctcaagcaaccttagtctgagtcttgcccagcccctgcggagcgaaaggtccggacgagacacccctgccagcgtggattcgattccactcgaatgggatcacgattacgacctatccagagacctggaatccgccatgtcccgggctctgccatccgaggatgaagaagggcaggacgacaaggacttctatctgcggggcgccgtcgggctgagcggagaccacagcgccctggagagccagattcgacagctgggtaaggctctcgatgacagtaggtttcagatacagcagaccgagaacattataaggtcaaaaacccctacaggaccagagcttgataccagttacaagggatacatgaaactgctgggggagtgcagctccagtattgacagtgttaagcgactcgagcataagctgaaagaggaagaggaaagcctgcctggcttcgtgaacttacactctactgagacccagacggctggcgtcatcgataggtgggaactcctccaagcacaggcgctctcaaaggaattaaggatgaaacagaacctgcagaagtggcagcagtttaacagcgacctcaactctatctgggcctggctgggcgacactgaggaagagctggagcagcttcaaaggctggaattatcaactgatatccagactattgagttgcagatcaaaaagctcaaagaattgcagaaagccgtggaccaccgaaaggcaataatattaagcatcaacctgtgttccccagagttcacccaagccgactctaaagagagtcgcgatttacaagacagattgagccagatgaatggaagatgggaccgcgtctgctccctactggaagagtggcgaggactcttgcaagacgccctgatgcagtgtcagggattccatgagatgagtcacggtttactcctcatgctagaaaatattgaccgcaggaagaacgaaatcgtgcctattgatagcaatttagatgcggagattttgcaagaccaccataagcagctgatgcagattaaacacgagcttctggagtcacaattgcgcgtcgccagcttgcaggatatgtcctgccagcttctggtgaatgccgaggggaccgactgcctggaggcaaaggaaaaagtacacgtcattgggaaccgactcaagctgctgctgaaagaagtatccagacatatcaaggagcttgagaagttgctggacgtctcctcatctcagcaggatttgagcagttggtcgagtgctgacgaattagatacttccggctccgtgtcccctacttccggtagaagtaccccgaatcgccagaagacgccacgaggcaaatgctccttaagccagcctggtcccagcgtgtcctcccctcactcgcgcagcaccaagggagggtcagattcttctctcagcgagccaggacctggcagatcaggacgaggcttcctttttcgcgtgctgcgcgccgccctccctctacaacttcttctgttgttgctgataggattagcgtgccttgtgccaatgtctgaggaggactacagctgtgcactaagtaacaatttcgcaaggtcatttcacccaatgctcaggtacactaacggccctccacctctctag

SEQ ID NO: 206667 - DNA, 25230 bp, Artificial Sequence
  Description of Artificial Sequence: Synthetic coding sequence
atggccaccagccggggcgccagccggtgcccccgggacatcgccaacgtcatgcaacgcttgcaggacgagcaagaaatagtccagaaacggacattcacaaaatggatcaattcacatctggcgaaaagaaagccgccgatggtcgtcgatgacctttttgaggatatgaaagatggcgtgaagttactcgcccttctcgaggtgctatctggacagaagctgccgtgcgaacagggccgacgaatgaagcgcattcacgcggttgcaaatattggcactgctctgaagtttctggagggaaggaagatcaagctggtgaacatcaactcaacggatattgcagacgggagaccctccatcgtccttggcctgatgtggactatcatcttatactttcagattgaggagctcacctccaatttgccacagttgcagtcactgagttcaagcgcctcctctgtcgatagtatcgtgtcatctgaaactccttcccctccttctaagcgtaaggtcactactaagattcagggcaacgctaagaaagccctgctaaaatgggtccagtacacagcaggaaaacaaactggtatcgaggtgaaggattttggaaagtcatggagaagtggagttgcctttcactccgttatacatgccatccgccctgaacttgtggatctggaaactgtcaagggccgaagcaaccgcgaaaatctcgaggatgctttcactattgcagaaaccgaactgggtatccctagactcttagatcctgaggacgtcgacgtggacaagcccgatgagaagtccattatgacttacgtagctcaatttttaaagcattaccccgatatccacaacgcttcaaccgacggtcaagaagatgatgaaattctccccggcttccccagtttcgccaacagcgttcagaacttcaagagggaagaccgtgtgatctttaaggagatgaaggtctggatcgagcagttcgagagggatctcactagggctcagatggtggaatcaaacttacaggacaaataccagagctttaagcactttcgggtgcaatatgagatgaagcggaagcagatagaacacctaatccaaccgctccaccgggacggcaagctgagtttggaccaggcccttgtgaagcagtcgtgggaccgtgtcaccagccgtttattcgactggcacattcaacttgacaaaagtcttcccgcccctctgggaactataggcgcctggctttatcgtgcagaagtagcactgcgtgaagagatcaccgttcagcaggtgcacgaggagacagctaataccatccagcggaaattagaacagcacaaacggaaattgcggaatgtcatcgatttactccagaacaccgacgcccacaagagagcttttcacgaaatatatagaacccgcagcgtgaatgggatcccagtgccacccgaccagctcgaggacatggctgagagattccactttgtcagtagcacatccgagctccatttgatgaagatggaatttctggagcttaagtacagactgctctcactgctcgtgctcgcggaaagcaaattaaagagctggattatcaagtatggacggagggagtctgttgaacagctcctacagaactatgtgtcctttattgaaaactctaagttcttcgaacaatatgaagtgacctaccagattctgaaacagaccgccgagatgtatgtgaaagccgacggttccgtcgaggaagccgaaaacgttatgaaattcatgaacgagactaccgcccagtggaggaacctgagtgtcgaagtaagaagcgttagatcaatgctcgaggaagtaatatccaattgggacaggtacggaaacacagtggcgtccctgcaggcctggcttgaggacgctgagaaaatgctgaatcagagcgagaacgcaaagaaggacttctttagaaatcttccccattggatacagcagcacactgccatgaacgatgccggaaatttcctcatcgaaacatgcgacgaaatggtctcaagggatttgaaacagcaactgttgctcctcaatggacgttggcgcgaactgtttatggaagttaagcagtatgcacaggctgacgagatggacagaatgaaaaaggaatatactgattgcgtggtaacgctgagcgccttcgccacagaagcgcacaagaagctctccgagcccctggaggtgtcttttatgaatgtgaagctgttaatacaggatctggaagatatcgagcaaagggtcccagtgatggacgcccagtataagataatcacaaaaactgcacatctgatcactaaagagtcgcctcaggaagaagggaaggagatgttcgcgaccatgagcaagctcaaggagcagctaacaaaagtgaaggaatgctactcacccctcctctatgagtctcagcaactgctgattcccttggaggaactcgaaaagcagatgacgtcattttacgattctctgggcaagatcaatgagatcattactgtcctcgaaagagaagcgcagtcttctgcactcttcaagcagaagcaccagctccgtattcttaagtgcaagtggtgtaatagttctcagaagatgactctctgtttagtgctaggatctatgatcagcatgctgagcaccgcaaagatcaccattgcaggatataagtccgaggtagaagtgtcggagctgctcgcttgtcaggaaaactgcaagaaaaccctaacactcatcgaaaaaggctctcaatccgtccagaaatttgtaaccttgagtaacgtgctgaaacactttgaccaaacccggctgcagactgattgcaggtactcttgctgtttttctgttatgcgaaagcagcaccacatcatgattgtttttcacattaagagtatggtgaaaaaaacgggggactggaaaaagcatgtggaaaccaactcccgcctgatgaagaaattcgaggaatccagagcagaattggagaaggtgctgcgtatcgctcaagaagggctagaggaaaagggggatcccgaagagctcctgcggcggcacacagagttcttcagccagcttgaccagagggtgctgaacgcctttttgaaagcgtgcgatgaactgacagacatcctgcccgagcaggaacagcagggcttgcaagaggccgtccgtaaactgcacaagcagtggaaagatctgcagggggaagcaccctatcatctcctccatttgaaaattgacgtcgagaagaacaggtttcttgcctcggtagaagaatgcaggaccgagttggatagggagacaaaactcatgccccaggaggggtctgagaaaatcattaaggagcaccgagtgtttttcagtgacaaggggccacatcatctgtgcgagaagagacttcagctcattgaggagctgtgtgtaaagctgcccgtgcgtgaccctgtacgcgatactccagggacatgtcacgtgactctgaaagagttgcgcgccgcaatcgactcaacctataggaagctgatggaggatcccgacaaatggaaggattacacgtcacggttctccgaattttcctcttggattagcactaacgaaactcagctcaaaggaatcaagggcgaagccattgacaccgccaatcatggtgaggtgaaaagggcagtggaggagatcaggaacggcgtgactaagcgaggtgaaactctgagctggctcaagtcccgcctgaaagtgttgacggaggtgagctctgagaacgaggctcaaaagcagggcgacgagttagcgaagctctcctcaagtttcaaggctcttgtgaccctcctgagcgaggtggaaaagatgttgtctaactttggcgattgtgttcagtacaaggagatagtgaagaactctttggaagagctgatcagcggctctaaagaggtccaggaacaggccgagaaaattctagatactgagaacttgttcgaagctcaacaactgctcctgcatcaccaacaaaagactaagagaattagcgccaaaaagagggatgttcagcaacagatcgcacaggcacagcagggtgagggtgggctccccgaccgcggacatgaagagcttagaaagctcgaaagtaccctagacggattagaaagaagtagggagaggcaggaaagacgtattcaagtgactctgagaaaatgggagaggttcgagacaaataaggaaaccgtcgtcagatacctattccagacagggtctagccacgaaagatttctgtcattctcctccctcgaatcactgagctcggagctcgaacagactaaagaatttagcaaaagaaccgagagcatcgctgtacaggcagagaatctggtcaaagaggcctcagaaataccactcgggccccaaaacaagcagctgctgcagcagcaggccaaatctataaaggaacaggttaagaagctggaagacactttagaggaggagtatgtaatcgataacaaaacaatggaaatggtcaagacaaagtgggatcacttcggttcaaacttcgaaaccctgtctgtctggattaccgagaaagagaaagagctcaacgccctcgaaaccagcagttcggcgatggatatgcaaatcagtcagatcaaggtaaccatccaagagattgaatctaagttgagctctatcgtcggcctggaggaggaggctcagtcctttgctcagttcgtgaccactggcgagagcgcccgcatcaaagccaagctgacacagataaggcgttacggcgaggagcttcgagagcatgcacaatgtctcgagggaaccatactgggacatctgtcacagcagcagaagttcgaggagaatcttcgcaagatacaacagagcgtgagcgagtttgaggacaagcttgccgtccctattaagatctgctcaagcgcaacggagacctataaggtccttcaagagcacatggatctgtgtcaggcccttgagtcactgagttcagcgatcactgcatttagcgcgtccgctagaaaagtcgtcaatagagacagctgtgtgcaagaagccgccgcccttcagcagcagtatgaggatattctccgtagagcaaaggagaggcagacagccttggagaacctcttggcccattggcagcgcctggagaaagaactctcatcctttctaacctggcttgagagaggcgaggccaaagcttccagtccagagatggatatctcagcggacagagtcaaggtagaggcttccaaagatgacgtgaagatgatgaagctgcacctcgaacagcttgacgaacgctggcgggatttaccgcagataatcaataagagaatcaacttcttgcaaagtgtcgtggctgagcaccagcagttcgatgagctgctgctatcctttagtgtgtggatcaagttgtttttatccgaacttcagacaacatccgaaattagtattatggatcatcaggttgcactgacacggcacaaggaccacgctgcagaagtagagagtaaaaagggcgagctccagtccctccagggtcacctcgcaaagttggggtccttgggccgcgcagaggacttgcacttgctgcaggggaaggctgaggactgcttccagctgtttgaggaagccagtcaagtcgtggagaggcggcaactcgctttgtcacacctggcagaattcctccaatctcacgctagcttaagtggcatcctccggcaactgagacagaccgttgaagcgactaattccatgaataagaacgaatctgatctcattgagaaggatctgaatgatgcacttcagaatgctaaggctctggaatctgctgccgtgagcctcgacggcattctatcgaaggcgcaatatcacctgaagattgggtccagcgaacaacgtacttcttgcagggccaccgcagatcagctttgcggcgaggtggagagaatccagaatttgttaggtaccaaacagagtgaggctgatgctttggccgtgctcaaaaaagcatttcaggatcagaaagaggaactactgaagtccattgaggatattgaggaacgcaccgataaggagcgcctgaaggagccaacccggcaagcacttcagcagcgattgcgggtgttcaaccagttagaagacgagctaaatagtcacgaacatgaactgtgttggctcaaagataaggccaaacagatcgcacagaaggacgttgcatttgcgccagaggtcgatcgtgagatcaataggcttgaggttacatgggacgacactaagagattgatacatgagaaccaaggacagtgttgtggactcatagatctaatgcgtgaatatcagaatctaaaatctgccgtatcgaaggtgcttgaaaatgcaagctccgtgattgttactagaaccaccattaaagatcaggaagatctgaagtgggccttctctaagcatgaaactgccaagaataagatgaactacaaacagaaggacctggataacttcaccagcaaggggaaacacttgctttctgaactgaaaaagattcacagcagcgacttttctttggtgaagaccgatatggaatccaccgtagacaaatggttggatgtgtccgagaagcttgaggagaatatggaccgccttcgggtttcgctgtctatctgggacgatgtactctctaccagggacgaaatagagggatggtccaacaactgtgtgcctcaaatggccgaaaacattagcaatctagataaccatctgcgagcggaggagctgctcaaggaatttgaatcagaggtgaagaacaaagctttgagattggaggaattgcattccaaggtaaatgacctgaaggagttgacaaagaaccttgagactccgcctgacctgcagtttatcgaagcagaccttatgcaaaaattagaacacgccaaagagatcaccgaagtagccaaaggcactctgaaggacttcaccgcacaatccacccaggtagagaaatttattaatgatattacaacttggttcacgaaggtcgaagagtcgcttatgaactgtgcccagaacgaaacgtgtgaggctctcaaaaaggtgaaggatattcagaaagaactccagtcccagcagtccaatatttcgtccacacaggagaatctgaacagcctgtgtagaaaataccattcggccgagttggaaagcctcggtcgcgccatgactgggctcatcaaaaaacatgaagccgtgtcacagctctgttcaaaaacgcaggcttcattgcaggaatcactggaaaagcatttctcagaggagtctatgcaggaatttcaagagtggttcctgggcgcaaaagcagccgccaaagaatcatcggaccggaccggcgattcaaaggtattagaagccaaactacatgatttgcagcagaatattctggattccgttagcgatggtcaatcaaaacttgatgctgtcacccaggagggtcagacactgtacgctcacctatcgaaacagatcgtttccagcatccaggaacaaatcacaaaggctaacgaggagtttcaggcgtttctgaaacagtgtttaaaggataagcaggccctccaggattgtgcatccgagctgggaagtttcgaggatcagcataggaagcttaacctgtggattcatgaaatggaggagcgctttaacaccgaaaacctcggggagagcaagcagcatatccccgagaaaaagaatgaagttcataaagtagaaatgtttctcggagagctactagccgccagagagagccttgataagctgtcacaacggggacagttacttagtgaagaaggacacggcgcaggacaggagggccgcttatgctctcaattactcacaagtcaccagaatttgctgagaatgacaaaggaaaagcttcggtcttgtcaggtggccctgcaggaacacgaagcgctcgaggaggctcttcagtcgatgtggttctgggttaaggctatacaggatcgcctagcttgtgccgaaagtaccttgggttcgaaagacacgctggagaaacgcctatcccaaatccaggatatactgctgatgaagggcgagggcgaagtgaaattaaatatggctatcggcaagggcgagcaggcccttcgaagcagtaacaaagaaggacaacgggttatccaaactcaacttgagacactgaaagaggtgtgggcagacattatgagttcctccgtccacgctcagtccaccctggaatctgtgatctcccaatggaacgactacgtggaaaggaaaaatcagctcgagcagtggatggaatctgtcgatcaaaagatcgagcaccctctgcagcctcagcccggcttaaaggagaagttcgttctgctggatcatctgcagtcaatcttgtcagaggcagaagatcacacccgcgctctgcatcggctcatcgcaaaaagcagagagctgtacgagaagacagaagatgagagtttcaaggacacggcgcaggaagaactgaagactcagttcaatgacatcatgactgtcgccaaggagaaaatgaggaaagtcgaggaaatcgtaaaggatcaccttatgtacctcgacgcagtgcacgaattcaccgactggctgcatagcgctaaggaagagctgcaccgttggtctgatatgtctggggactctagcgccacgcagaaaaaactctccaagatcaaggaactgattgattctagagagatcggagcatcgcgcttatctcgcgttgagagcctggcaccagaagttaagcagaataccaccgcgagcggttgcgagctgatgcacaccgagatgcaggcattgcgcgcagactggaagcagtgggaagattccgtgttccagacccagtcatgccttgaaaatctcgtgtctcagatggcgctcagcgagcaagaatttagtggccaggtggcccaattggaacaggcactggaacagttcagcgccctgctaaagacctgggcccagcagctcaccttgctagaaggcaaaaacaccgacgaagagatcgtggaatgctggcacaaagggcaggaaatactcgatgccctgcagaaggctgaaccaagaacagaggacctcaaaagccaacttaacgaattatgccgcttcagtcgcgatttgtctacctattccggcaaggtgtcgggactgataaaagagtataattgcctctgcctgcaggcgtctaagggctgccaaaataaggaacaaatactccagcaacggttcagaaaagcgttcagagactttcagcaatggttggtgaatgccaagattacgacagccaagtgttttgacatcccccagaacatctctgaagtcagcactagcctgcagaagatccaagagtttttatccgaaagtgagaatgggcagcacaaacttaacatgatgctgagtaaaggtgagctactctctaccttgctgacaaaggagaaagcaaaggggatacaggccaaggtgacggctgccaaagaggattggaaaaattttcactccaacctgcaccagaaagaaagtgcccttgaaaatttgaaaatccagatgaaagatttcgaagtgagcgcagaacccatccaggattggttatcaaagacagaaaagatggtgcacgagtctagcaaccggttatatgatttgccagctaaaaggcgggagcagcagaagctccagtccgttcttgaagagatccactgctatgagccacagcttaaccggttaaaggagaaggcccagcaattgtgggaaggacaagctgcctctaaaagttttagacatagagtgagtcaactttcctctcagtatctggccttgtctaatcttacaaaggagaaggtgtcgcgcttggatcggattgtggctgaacataatcagttttccctgggcattaaggaactgcaagactggatgacagacgctatccatatgctggactcctattgtcaccctacttctgataagtccgtcttagattcccggactcttaaactcgaggctcttctgtctgtgaagcaggaaaaggaaattcagatgaaaatgatagtgactcgcggagaaagtgtgctccaaaacacaagtcctgaggggatcccaacgatccagcaacagctccagtcagtgaaggacatgtgggcttcgttgctcagcgcaggtatccgatgcaaacgtgttagactcccatgcgcctatattgcccttaaactgcgggtgcatcagcatgcagaactccgagataaaactacaatgctcggaaaggcaaaagaagcagtgacaaagtctgagaaactcgtgaggcttcaccaggagtatcagagggatctgaaggccttcgaagtctggctggggcaggagcaggagaaactagatcagtattccgtgctggagggcgatgcacacacgcacgagaccacactgcgcgaccttcaggagttacaggtccactgtgccgagggtcaagcacttcttaacagcgtgctccatactagggaagatgtgatacctagcggcatacctcaagcagaagatcgcgcgcttgaaagtctccggcaggattggcaggcctaccaacatcggctttccgagacccggacacagttcaataacgttgtgaacaagctgagactaatggaacagaagttccagcaagttgacgagtggctcaaaactgctgaagagaaggtatcaccacgcacccggcgccaatccaaccgggcgacaaaggagatccagctgcatcaaatgaagaagtggcatgaagaagtgaccgcttatcgcgacgaagtggaggaagttggtgcgcgcgcacaggaaatattagacgagtcacacgttaatagccggatgggttgtcaagctactcagctgacgagtcgataccaggcactgctccttcaggtgctcgagcagattaaattcttggaggaggagattcaatccctagaggaatccgagagcagcctttcgtcatatagtgactggtatggttctacacacaagaacttcaaaaatgttgctaccaagattgacaaggttgataccgtgatgatgggcaagaagctcaagacactggaggtgctgctgaaggatatggaaaagggccatagtctgcttaagtccgctagagagaaaggggagcgggctgtgaaatatctggaagaaggcgaagctgagagacttcggaaggaaatacatgaccatatggaacagttgaaagaactcacctccacggttaggaaggagcatatgaccttggagaaatcactccagcagaccgtgctttcccacgagccctctgtgaagagcgttagggaaaaaggggaggcattgctggaactcgttcaggatgtaaccttgaaagacaagatagatcagcttcagtctgattaccaagacctctgtagtattggaaaagaacatgtgttcagtcttgaggccaaggtgaaagaccacgaagactacaactcagaactccaagaagtggaaaagtggctgctgcaaatgagcggcagattggtcgctccagacttactcgagacatctagcttggagaccataacacagcagttagctcatcacaagatgtaccagagcctcgagcatgagctacaaaaacacgtgtctaggcaagacacactccagcagtgtcaggcatggttgtctgccgtacagccagatctagagccttctccgcaaccccctctctctcgcgccgaagccatcaagcaggttaagcatttccgagctctccaagaacaggcgcggacatatctggacttactctgctctatgtgcgatctgagcaatgcctctgtgaagacgactgccaaagatattcagcagaccgaacaaactatcgaacagaaattggttcaggcgcagaatctcacccagggatgggaggagatcaagcatctgaagagcgagttgtggatttatctgcaggatgcagatcagcaactccagaatatgaaacggcgccactccgagttagaactgaatatcgcgcaaaacatggtcagtcaagtcaaagacttcgtcaaaaagctccagagtaagcaggcaagcgttaacacaattattgagaaagtcaacaaactgacaaaaaaggaggagtctcccgaacataaagaaattaaccatctcaatgatcagtggttagatctctgccggcagtcaaataatctttgcctgcagagggaggaagaccttcagagaactagagactaccacgattgcatgaacgtggtggaggtgtttctggagaagtttacaaccgaatgggacaatctggcccgctcagacgctgaatctaccgcggtgcacttggaagctctcaagaagcttgcacttgcgctgcaggaaaggaaatacgctattgaagatttgaaggatcagaagcagaaaatgatcgaacacctcaatctcgacgacaaggagctcgtgaaggagcagacctcccacctggaacagagatggtttcagctggaagatctgatcaagagaaaaatccaggtgtcagtgaccaaccttgaggagcttaatgtggttcagagccggtttcaagagctcatggagtgggctgaagaacagcagcctaacatcgccgaggcactcaagcagtctccaccgcctgacatggcccagaatctgctcatggaccatctggcaatttgttccgagttggaagcaaagcagatgttgctgaaatctctgattaaggatgcggacagagtaatggccgatctgggcctgaatgagaggcaggtaatccagaaagctctgagcgacgcacagagccatgtcaattgcctgagcgacttggtgggccagagaagaaagaagcattttaaggaggattttgacaaagcttgtcactggctgaaacaggctgatatcgtgacatttccggagatcaacttgatgaacgagagctccgaacttcacacccagctagccaaataccagaacattctagagcagagtccagagtacgaaaacttactgctgacacttcagcggacgggccagacaattctgccaagcctaaatgaagtggaccatagttacctgtccgagaaactgaacgccctgcctagacaattcaatgttattgtggcactggccaaggacaagttttacaaggtccaggaggccatactggcacggaaagagtacgcttcactaatcgaactcaccacccagagcctcagcgagctggaagctcaattcctacgtatgtcaaaagttcccaccgaccttgctgtggaagaagcactgtccttgcaggacggatgccgcgcgatattggatgaggtggccggccttggcgaggctgtcgacgagctcaaccaaaagaaggaaggattcagaagtactggccaaccgtggcagccagataagatgctgcatctggtgacactgtatcatagattgaaaaggcagactgagcagcgcgtctcattattggaagatactacttctgcttatcaggaacacgagaaaatgtgccagcagcttgagcgtcagctcaaatccgtcaaggaggaacaatctaaggtgaacgaggaaaccttacccgcagaagagaaacttaaaatgtaccatagccttgccgggtcattacaggatagcggtattgttttgaaacgcgtaacaattcatctggaggatctcgccccccaccttgaccccttggcttacgaaaaagctcgccatcagatccagtcctggcagggcgaattgaagctgttgaccagcgccattggagagactgtaaccgagtgcgaaagccgcatggtacagtcgatagactttcaaaccgaaatgagccgaagtctggactggctgcgtagagtgaaagccgagctgtccggaccggtgtacctggatctgaacctacaggacattcaggaagagatcagaaagattcagatacatcaggaggaggtccagagctcccttagaattatgaacgctctctctcataaagaaaaagagaagttcaccaaagccaaggagctgattagcgccgacctcgaacatagtctcgcagagctgtctgaactggacggcgatattcaggaggccctacgtactaggcaggctactttaacagaaatctacagccagtgtcagcggtactatcaagtatttcaggcggccaatgattggctggaagacgcacaagaactcttgcagctggccggcaacggactcgatgttgaaagtgccgaggagaacctgaagtcccacatggaattcttcagcaccgaggatcaatttcacagtaatctggaagagctgcattccttggttgcaacccttgatcccctcattaagccgaccgggaaggaagatctggagcagaaagtggctagcctggagctacgctcccagcgcatgagtcgggactccggggctcaggcgttggtgtccgtcgtgaatagtttccacgaaaagatagtagctctggaggaaaaggcatctcaattagagaagactggcaacgatgcgagtaaggctactctgagtaggagtatgactactgtatggcagcgatggactcgactgagggcagttgcccaggatcaggaaaaaattctggaagacgccgtggacgaatggaccggtttcaataacaaagttaagaaggcaactgagatgatcgaccaactgcaggataagctgccgggctcatccgcagaaaaagcaagtaaggccgagctgctaacgctcctggaataccacgatacattcgtccttgagttggagcaacagcagtcggcgctggggatgctccggcaacagacactgagtatgcttcaagacggcgccgccccgacacccggcgaggagcccccactgatgcaggagatcaccgcgatgcaggaccgctgtctgaaaatggtcgaaacccagatcaattctgttaagtgctgggtgcaagagaccaaagagtacttgggtaatcctacaattgaaattgacgcccagttggaagagctgcagatactgctgactgaggccacaaaccatcgccagaatatcgaaaagatggctgaagaacagaaggagaagtacctgggcctgtacacaatactcccgtcagaactgagcctgcagctcgccgaggtggccttggatctcaagatccgggaccagatccaggacaaaatcaaggaggtcgaacaatccaaagcaacatcccaggagctgagtagacagatccagaagctggcgaaagacctgacgactatcctcactaagcttaaggctaaaaccgataacgttgtgcaggctaaaacagaccagaaagccgcctcacacctggaggaatacaacgaaatgcttgagctcatcctgaagtggatcgagaaggcaaaggtgctggcccacgggacaattgcctggaacagcgctagccagctgagagagcaatatattcttcaccaaacactcctagaggaatcaaaagaaattgactccgaactcgaggccatgactgagaaactgcaatacttaacaagtgtgtactgtacagaaaagatgtctcagcaggtagcggagttgggccgcgagaccgaggagctcaggcagatgataaagataaggctccaaaatctacaggacgccgcgaaggatatgaaaaagttcgaggctgagctgaagaaactgcaagccgctctcgagcaggctcaagcaaccctgacctcacctgaggtcgggcgattgagcttaaaagaacagctctcccatcgccaacatctcctctccgagatggaatccttgaaacccaaagtgcaggctgtgcaactctgtcagtccgctttaaggataccggaagacgttgtcgctagccttcccctgtgccacgccgccctgaggttgcaagaggaggcctcacggttgcaacataccgccatccagcagtgtaacatcatgcaagaagccgtggtgcagtatgagcagtatgagcaggaaatgaagcatctgcaacagttgattgagggggcccaccgtgaaattgaggataagcctgttgccacgtccaacatccaggaactccaggcgcagatctcaaggcacgaagagttggcacagaaaattaagggataccaggagcagattgcttccctgaacagcaagtgtaagatgctgacgatgaaggcaaagcatgccacaatgcttctcacagtcaccgaagtcgaaggtctggcagaaggcacggaagatcttgacggggagctcctaccaacccccagtgcccacccgtccgtggttatgatgaccgccggtaggtgtcacactttgctgtctccagtcactgaagagagtggtgaagaagggactaattctgagattagttctcctccagcttgtcgtagtccctcccccgtcgccaacaccgatgcatcagtgaatcaagacatcgcctattaccaagccctcagcgctgaacggctgcagaccgatgccgccaagattcacccgtctacttctgccagtcaggaattctatgaacctggactagagccaagcgccactgctaaactaggcgatttgcagcgcagctgggagaccttgaagaacgtgatctcggagaaacagagaacattgtatgaagccttggagaggcagcaaaagtatcaggatagtctgcagtccatctccactaagatggaggccatcgagctgaagctttccgaatcccctgagccagggcggtcgccagagagtcagatggccgaacaccaggctctgatggatgagatcctgatgctgcaggatgagattaatgaacttcagtcatcgctcgcagaagagctggtctcggagtcttgtgaagcagatcccgctgagcaactcgccctgcagagtaccttaaccgtgctggctgagaggatgagtacaatcagaatgaaggcaagtggtaagcgtcagctgctcgaggagaaattaaacgaccaactggaagaacagaggcaggagcaggccctccaacgataccggtgtgaagcagatgagttggatagttggctgttgtcaacgaaggccactctggatactgcgctaagtcccccaaaagagcccatggacatggaggcacagctgatggattgtcagaacatgttggtggagatagagcaaaaagtggtcgctctatcagagctcagtgtgcacaatgagaatctcctgttggaaggtaaggctcacacaaaggacgaagccgagcagctagcaggaaagcttcgacgactgaaagggtctttactcgagctgcagcgggcgctgcacgataagcagctgaacatgcagggcacagcccaggagaaggaggagagtgatgtcgaccttactgcgacacaatcacccggagtccaggagtggctggcacaggctcggactacttggacccagcagagacagagttcgctgcagcagcagaaggaattggagcaggaattggccgagcagaaatcgctgctgcgctctgtcgcaagccgtggcgaggagatcttaatccaacatagtgctgccgagacctctggcgatgccggcgagaaacctgatgtgctgagccaggagctgggtatggaaggcgagaagtccagcgccgaagaccagatgcgcatgaaatgggagtcattgcatcaggaattcagtaccaaacagaagttgttgcaaaatgtgttagagcaggagcaggaacaggtgttgtactctcgcccaaaccgcctgctcagcggtgtacctctctataaaggcgacgtacccacacaagacaagtcagcagttactagtctccttgatggccttaaccaagccttcgaggaggtgtctagccagagcggcggcgcgaaacgacaatctattcacctcgaacagaaactctatgatggagtcagcgcaaccagcacctggctcgacgatgtagaggaacgccttttcgttgcgaccgccctgcttcccgaagaaacagagacctgtcttttcaatcaggagatcttggcaaaggacattaaggagatgtcggaggagatggataagaataaaaaccttttctcacaggccttcccagagaatggagacaatcgcgacgtgatcgaggacacactgggctgcctgttaggccgcctgtctctgctggactccgtcgttaaccagagatgccatcagatgaaagaaagactccagcagattcttaatttccaaaatgacttaaaagtgctgtttactagtctggcagacaataagtatattatcctccaaaaactcgctaatgtcttcgagcaacccgtggctgaacagatagaagcgattcagcaagcggaggatggcttgaaagaatttgatgctggaataattgagctgaaacgtcgtggggacaagcttcaggtggaacagccttccatgcaagaactgagcaaattacaggatatgtatgacgagctgatgatgatcattgggagcaggcggtcaggtcttaatcagaacctgacccttaagtcgcagtatgaacgcgcactgcaagacttggcagacctattggaaaccggacaggagaaaatggcgggcgatcagaaaattattgtgagttcaaaggaggagattcaacagttgttggataaacacaaggaatactttcaaggactagagagtcatatgatccttaccgagaccctctttcgcaaaattatctcctttgccgttcaaaaggagacacaatttcacacggagctcatggcacaagcctctgctgtgttgaagagagcacataaacgaggggtggagcttgagtacatcctggaaacctggtcacacctcgacgaggatcagcaggagctttcccgccagcttgaggttgtcgaatctagcattccgtcggtgggtttggtggaagaaaatgaggacaggctgattgaccgcattacgctctaccagcacctgaaaagttccttgaacgaataccaacctaaactgtaccaggtactggacgacggaaaaagactccttatttcaatttcctgttccgatctggaaagtcaactgaatcagctcggcgaatgctggctttctaatactaataagatgtctaaagaactgcaccgtttagagacgatcttgaagcactggaccaggtaccaatcggagtctgctgatctgatccattggttacagagcgccaaggatcgcttagagttctggacacagcagtccgtcacggttccgcaagaattggagatggtgcgcgaccatcttaacgcctttttagaatttagcaaagaagttgatgcccagtcatccttaaaaagcagcgtgttaagtacgggaaatcaactattacggcttaaaaaggttgataccgcaactctgagaagcgagttgtctcggattgattcccagtggactgacctcctcactaacatccctgctgtacaggagaaactccaccagctgcagatggataaactgcctagtagacatgctatctccgaggttatgagctggatatctttgatggaaaacgtgattcagaaagatgaagataacatcaaaaacagcattgggtataaggctattcacgagtatctccaaaaatacaagggttttaagatcgatatcaactgtaagcaattaacagtggactttgtgaaccagagcgttctgcagatctctagtcaagacgttgaaagtaagcggtcagacaaaaccgactttgccgaacagctcggtgccatgaataagtcgtggcagattttacaggggctggtgactgaaaagattcagctgctggaaggacttttagagagttggagcgagtatgaaaacaatgtgcagtgcctgaaaacctggtttgagacacaggaaaagagactcaagcagcaacatagaataggcgaccaggcttcggtgcaaaatgccttgaaggattgtcaagacttggaggatctgatcaaagccaaggaaaaggaggtcgagaaaattgagcaaaacgggctggccctcattcagaataagaaggaggacgtgtcatccatagtgatgtcaacactccgagagctcggacagacctgggcaaacctggaccacatggttggccagcttaagatcttactcaagtctgtcttggatcagtggtcttctcacaaggtggcgttcgacaaaattaactcatatcttatggaggctcggtattccctgtcaagattccgactcctgacgggcagcctggaagccgtgcaagtccaggttgataacctccagaacctacaggatgatcttgaaaagcaagagcggagcctccagaaatttggaagcataacaaaccagctcctgaaagaatgccacccaccggttaccgagactctgacaaataccctcaaggaggtgaacatgcgatggaataacctgcttgaggagattgctgagcagctgcagtctagcaaggctctgttgcagctatggcagcgttataaggattattccaaacagtgcgccagcactgtgcagcagcaggaagatagaactaatgaactccttaaggccgctaccaacaaggacattgctgacgatgaggtcgccacatggatccaggattgcaatgacctcctcaaaggcctcggtacagtcaaggatagtctattctttttgcatgaactcggggagcagttgaaacagcaggttgacgcgagcgctgcttctgctatacagtcagaccaactgtccctctcacagcatctgtgtgcacttgagcaagcactgtgcaaacagcagactagcctgcaggccggagtcctggactatgaaacattcgctaagtccctagaggctctggaagcctggatcgtcgaggcggaagagatcctccaggggcaggatcccagccatagcagtgacctcagtaccatccaagaacgcatggaggagctgaaagggcaaatgctgaagttctcatcaatggcccccgatcttgataggttgaatgaactgggatataggctgcctctgaatgacaaggagattaagaggatgcaaaacctgaaccggcattggtctctgatctctagtcaaactacagagcggttcagcaagctacagtctttcctcctgcagcatcagacgtttcttgagaaatgtgagacatggatggagtttttggtacaaactgagcagaaacttgcagtggagataagcggtaattatcagcatttactggagcaacaaagggctcatgagctgttccaagcagagatgttttcccgccagcagatcctccactcaatcattatcgatggacagcgtctgctcgagcagggccaggtggatgaccgtgacgagttcaacctcaaattgactcttctttccaatcaatggcagggggtcattaggcgtgcacagcagcggagaggaatcattgactcacagatccgacaatggcagcgatatcgcgaaatggccgagaaactgagaaaatggctcgtcgaagtgagctatcttcccatgagcggcctcgggagcgtgccaatcccactgcagcaggccagaactctcttcgacgaggtacagttcaaagaaaaggtcttccttcgccagcaagggagctacattctgaccgtggaagccgggaagcaactcctcctgtccgctgactcgggcgcagaggctgctttacaggcggagctggcagaaattcaggaaaaatggaagtcagccagtatgcgccttgaagagcagaagaagaaactcgcttttctgctgaaggattgggagaagtgtgagaagggcattgccgactctctggagaagttgaggacctttaagaagaaactgtcccagtctctgccagatcatcacgaagagctgcatgcggaacaaatgcggtgcaaggagctggagaacgcggtgggctcttggactgacgacctcacgcagttatcactgcttaaagacactctgtctgcctacatttcggcagatgacatctccattctaaatgagcgcgtggagcttctgcagcgtcagtgggaggaactctgccaccagctgagcctcaggcgccagcagattggcgaaagactgaatgagtgggcggtgttctccgagaaaaacaaggagctgtgcgagtggctgacacaaatggaatctaaagtgagtcaaaacggagacattctgatcgaggaaatgatcgaaaagcttaagaaggactaccaggaggagattgccattgcccaggaaaataaaattcagcttcaacagatgggggagcgactggctaaggcctcacacgaaagtaaggcgtcagaaatcgagtataagttaggaaaggttaacgaccggtggcagcacctccttgatttaattgccgcacgggttaaaaagcttaaggagacccttgtcgcggtgcagcagttagacaagaacatgagcagcctgcgaacttggttggcgcatattgaaagcgaattggcgaagccaattgtctatgactcttgcaattctgaggagatccagcgcaaactgaatgaacagcaggagttgcagagggatatcgaaaagcactccacgggcgtggcttccgttctcaacctctgcgaagtgttactccacgattgtgacgcttgtgccaccgatgctgagtgtgatagcattcaacaagccacccgcaacctagacagaaggtggagaaatatatgcgccatgagtatggagcgtcgtcttaaaatcgaggagacctggaggttatggcagaaatttctggatgactattcaagattcgaggactggcttaaatcttccgaacgcacggctgcctttcctagtagcagtggggtgatttataccgtcgcaaaggaggagctgaagaagtttgaggccttccagcgccaggtccatgaatgcctcactcaattggagctgatcaacaaacagtaccgtaggctcgctcgcgaaaacaggactgacagcgcttgcagccttaagcagatggtgcacgagggcaaccagcgttgggataacctccagaagcgcgtgacgtctatattgagacgcctgaagcactttattgggcagcgggaagaattcgaaacagccagagattctattttagtgtggctcacagagatggacctgcagcttacaaacattgagcatttttcagagtgcgacgttcaggctaaaatcaaacaactgaaagcattccaacaggagatcagtctgaatcataacaagatagaacaaatcatcgcccagggcgagcagctgatcgagaagtcagaacctttagatgccgcaatcatcgaggaggaactggacgagttgcggagatattgccaggaggtgttcggccgcgttgagaggtaccacaaaaagctaattaggctccccctgcccgatgatgagcatgacctgtcagatcgggaactggaacttgaggattcagccgctctaagcgatttgcactggcatgacagaagtgcagactcactgctctctcctcagccatcctcgaatctgtcattatcactggcgcagcccttgcggagcgagcgctcaggccgggacaccccagcctctgtcgatagcatccccctggagtgggatcacgattacgacctgtcgcgggatttggaatccgcaatgtcccgagccctgccatctgaggacgaagaagggcaggatgataaggacttctacctgcggggagcagtgggactgtccggcgaccacagtgccctcgaaagtcagatcagacagctgggtaaagccttggatgactcacggtttcagatccagcagactgaaaatattattagatccaaaacaccaacgggtccagaactcgacacgtcttacaagggatacatgaaactccttggtgaatgctcttctagtattgacagcgtgaaacggcttgaacacaagctcaaggaagaggaggagtcgctgccagggtttgtaaatctccattcaaccgagacgcagaccgctggggtgatcgataggtgggaattgctccaggcccaggccttgtctaaggaattgcgcatgaagcagaatctgcaaaagtggcaacagttcaattcagacctgaattctatttgggcttggctcggcgatacagaagaagaactagagcagctacaacgtttggaactgtccacagacatacagactatagaactccagataaagaagctgaaggagctccagaaggctgtggaccaccgtaaggcaattatactgtcgattaacctgtgttctcccgagttcactcaagcagactccaaagagtcccgggacctgcaggaccgtctaagccagatgaacggccgctgggatcgcgtctgctcgctcctggaggagtggaggggattgctgcaggatgctctgatgcagtgtcaagggttccacgagatgtctcacgggctgctgttaatgctagagaatatcgaccgacgcaagaacgaaatcgtgcctattgactccaatctggacgccgaaattctgcaagatcaccataagcaactgatgcagataaaacacgagttgctggaatcccagcttcgggtggcctcactgcaagacatgtcctgccagctgcttgtcaacgcagagggcaccgactgtttggaggccaaggaaaaggttcacgttatcggcaatcgcctgaaattactacttaaggaggtgtcccgccatatcaaagaacttgaaaagttgcttgatgtcagctccagccagcaggacctgtcatcttggagttccgcagatgaattggatacgagcggtagtgtttcaccgacatctggcaggtccaccccgaacaggcagaaaacgcccagggggaaatgtagtctgtctcagccaggacctagtgttagttccccgcactctaggagcacgaagggcgggagcgattcgagtctatcagagccaggcccaggtcgatctgggcgggggttcctgttcagagttctgagggcagctctccccctccaactcctgcttcttcttctcatagggttagcttgcctagtgcctatgtccgaggaggactactcttgtgccttatctaacaattttgccaggagcttccatcctatgctcaggtacaccaacggacctccgccactatag

SEQ ID NO: 206668 - DNA, 9966 bp, Artificial Sequence
  Description of Artificial Sequence: Synthetic coding sequence
atggagctggacgccgccgtgcagaagttcctggagcagaacggccaattaggcaagcctctagctaagaagatagggaagcttacagagttacatcaacagacaatccgacaggcagagaatcggctttctaagctgaaccaagccgcttcccacctggaggaatacaacgagatgctcgaactcatactgaagtggattgaaaaagctaaagtgctagcgcatggcacaatcgcttggaacagcgcctcccagctgagggaacagtatatcctccatcagacactacttgaagagtctaaggaaatagacagcgaactcgaagccatgactgagaagcttcagtaccttacctctgtgtactgcaccgagaagatgagtcagcaggtggccgagctgggtcgcgagaccgaggaactccgccagatgatcaaaatccggctgcagaatctccaggacgcagctaaggatatgaaaaaattcgaggccgaacttaagaagctgcaggccgccctcgaacaggcccaggcgactttgacatcccccgaggtagggcggctgtcgctgaaggaacagctatctcaccgccaacacctcctgtccgagatggagtccctgaagccaaaagtgcaggcagtgcagctctgccagtccgcactgcgtattcccgaagatgttgtagcttccctgccgctttgccatgccgcactcaggctccaggaggaggcgtctcggctacagcatactgccatccagcaatgtaacattatgcaagccgcggtcgtgcagtatgagcagtacgagcaggaaatgaaacatctgcaacaattaattgaaggagcccaccgggaaattgaggataaacccgtcgccactagtaatatacaggaactgcaggctcaaatctctcgccatgaggaattggcacagaagatcaagggctaccaagaacaaattgcttctctcaattctaagtgtaaaatgttaacaatgaaggcaaagcatgcgacgatgctgttgacagtgaccgaagtggagggtctggcggagggaaccgaagatctggatggagagctgcttcccacgccctccgcgcatccgtccgtggtgatgatgaccgccggtcgatgccacaccttgctgagccccgtgacagaagaaagcggggaggaggggaccaattccgagatctccagcccaccagcttgccggagcccctccccggtggcaaacacagatgccagtgtaaaccaggacatcgcatattaccaggctttatccgccgaaagattacaaacggatgccgccaagattcaccccagtacgagcgcatctcaggaattctacgaacccggactggaaccaagtgctacagccaagctgggagacctccagaggtcttgggagaccctgaagaacgtgatctctgagaaacagagaactctgtacgaagcccttgaacgacagcaaaagtaccaggatagtcttcagtccatcagcacaaaaatggaggctattgaactgaagctttcagagtccccagaacccggaaggtcacccgagtcacagatggctgaacatcaagccctgatggacgaaatccttatgctacaggacgaaatcaacgaacttcagtcctcactcgccgaggaacttgtgtcggagagctgcgaagctgaccccgcggaacagctcgccctccaatccacccttacagtgctcgccgagcgcatgtctacaatccggatgaaagctagcgggaaacgacaactgctcgaagagaagcttaatgaccagctcgaagagcaacgccaagagcaagctctgcagcggtatcgatgtgaggccgatgagctggatagttggctgctctcaacgaaggcgaccctggacacagcactgtctccccccaaggagccaatggatatggaggcccaattgatggattgccagaacatgctggtcgaaattgaacaaaaggtggtggctcttagcgagttatccgtgcacaatgagaatttgttgctggaggggaaagcccatacaaaagatgaggccgagcagttagctggcaagctgagacgattgaagggaagtctgctggagcttcagcgggctctacatgataagcagctaaacatgcagggtactgcccaggaaaaggaggaatctgatgtggatttgacagccacccaatcccctggcgtgcaggaatggctggcgcaggcacgcaccacttggacgcagcagagacagagcagcctccagcaacagaaggagctcgaacaggagctcgccgagcagaagagcctgctgcggagtgtggctagccggggagaagagatccttattcagcacagcgcagccgagaccagcggcgatgccggtgaaaagccggacgttctcagtcaggagctaggcatggagggtgagaaaagctcagccgaggatcaaatgcggatgaagtgggaatctttgcatcaggaattcagtactaagcaaaagctgctccagaatgtcttagagcaggagcaggaacaggtgctatacagcaggccaaacagattgctgagcggcgtgccactctataaaggtgacgtccccacacaagataaatcggccgtcactagccttctggatgggctgaatcaagcattcgaagaagtttcctcacagagcggaggggcaaaaaggcagtccatacatttggaacagaagctgtatgatggcgttagcgccaccagtacctggctggatgacgtggaagagcgattattcgtggcaacagccctcctgccagaggagaccgaaacttgtctcttcaaccaggagatcttggcgaaagacataaaggagatgtctgaggaaatggacaaaaacaaaaatctgttttcacaggctttcccagaaaatggggacaaccgagatgtgatcgaggacactttgggatgtctgctgggaaggctgagcttgctggacagcgtagtgaaccagagatgccaccaaatgaaagagaggcttcagcaaattttgaactttcaaaatgatcttaaagtcctcttcacatctcttgctgacaataaatacatcatcctgcagaagttggccaatgtgttcgagcaacccgtcgccgagcagatcgaagccatccagcaggcggaggatggactcaaggagtttgacgccgggatcatcgagctcaagcggcgaggagacaagctgcaggtggagcagccatccatgcaggagttaagcaaactgcaggacatgtatgacgagctgatgatgattataggctctcgcagaagtggattaaaccagaatctgacattgaaatcccagtatgaacgcgcactccaggaccttgctgacctactcgagaccgggcaggaaaagatggctggtgatcaaaagatcatcgtgagctccaaagaggagattcagcagctgttggacaaacacaaggaatatttccaaggactggagagccatatgatccttaccgaaaccctattccggaagattatctctttcgctgttcagaaagaaacgcagtttcacaccgaactgatggcccaggcctcggccgtactcaaaagagctcacaagcggggcgtggagctcgagtatatccttgaaacttggtcccacctggatgaggaccagcaggagctgtcgcgacagctagaggtggtggagtcatccataccctccgtgggcctggtggaagaaaacgaggatcgcttaatcgacagaatcacactgtatcagcatttgaagtcctcattaaacgagtaccagcccaagctgtaccaggtcctggatgacggcaagagattactgatttctatctcctgttctgatttggagtctcagttaaaccaactgggagagtgctggctctccaatactaataaaatgagcaaggaactgcataggttggagacaatcctgaagcactggacccgctaccaaagcgaaagcgccgacctcattcactggttgcagagtgcgaaggatcggctggagttctggacacagcaaagtgtaacagttccccaggaactggaaatggttcgcgaccatcttaacgcttttctcgaattctctaaggaggtggatgcacaatcttccctaaaatcttctgtcctcagcactggaaaccagctcctacgtctaaagaaagtggacaccgcgaccctacggtcagagctgagtagaattgattcgcagtggacagatctcctcacaaacattccagcagtccaagaaaaattgcaccagctccagatggacaaactgccgtcgagacacgcaatttcagaggtgatgtcctggatctctttgatggagaatgttattcagaaagacgaagacaatatcaagaatagcatcggctacaaggcgattcatgagtatctgcagaaatacaagggcttcaaaattgatatcaactgtaagcagctcactgtggactttgtcaaccagtccgtcctccagatttcctcccaagacgtggaaagcaagagaagcgataagaccgattttgccgagcagctgggcgcgatgaacaagagctggcaaatcctgcaaggtctggtcacagaaaagattcaactcctggagggactcctcgagagctggtccgagtacgaaaacaacgtacagtgcctgaagacttggtttgaaacacaagagaaaagactcaaacagcaacatcgaataggtgaccaggcctctgtgcagaatgctttgaaagactgtcaagatttggaggatctcatcaaagccaaagagaaagaagtggagaaaatagagcagaatggtttggccctgattcagaataagaaagaagacgtgtctagcatcgtaatgagtactctgagggagttgggccagacttgggcgaacctcgatcatatggtgggccaattaaaaattctgctaaaatctgttctggatcagtggtccagccacaaggtggcttttgataaaattaactcctacttgatggaggcccgatactcactcagccgctttcggttgctgactgggtccctggaggccgtccaggttcaggtcgataacctgcagaacctgcaggacgacctcgagaagcaagagcgcagccttcagaaattcggcagtataaccaatcagcttctgaaagagtgtcatccccctgtgactgagactctgacgaatacccttaaagaggtgaacatgcgctggaataacctgctggaagaaatcgccgaacagttgcagtcctctaaggctctgctccaattatggcagagatacaaggactattccaagcaatgcgcctcgacagtgcaacagcaggaagaccggaccaacgagctactcaaggccgctaccaacaaagatattgccgatgatgaggtggccacttggattcaggactgtaatgacttactcaaaggattgggcaccgttaaagatagtctatttttcctgcacgaactgggggaacagctaaagcaacaggtcgatgcatcggcagctagtgccatccagtccgaccagctctccctctctcagcacctatgcgctctggagcaggccctgtgcaaacagcaaactagcctgcaggccggagtccttgattacgagacttttgctaaatccttagaggccctggaggcgtggatcgtcgaagccgaagagattctacagggccaggacccatcccactccagcgacctctccactatccaagaacgtatggaggagttgaagggacagatgctaaagttttcaagcatggctccggatctcgaccgtctaaacgaattgggctaccgcttaccgctgaacgacaaagagatcaaacgcatgcagaatctgaacaggcattggtccctcatatctagccagacaaccgaacggttctccaagctgcagagctttctgctacagcatcagaccttcttagagaagtgtgaaacttggatggagttcctggtgcagaccgagcagaaactggctgtggagattagtgggaactatcagcacttgctggaacagcagagagcacacgaactgttccaggccgaaatgttttcgcggcaacagatcctgcactccatcatcattgacggccagcgactgctggagcaaggccaggtggacgaccgagatgagtttaaccttaagcttacactgctttcaaaccagtggcagggagtgatcaggagagcccaacagagaagaggtatcatcgatagccaaatacgacagtggcaacggtatagggaaatggctgagaaactgaggaagtggttggtggaggtgagctacctacccatgagcgggctgggcagcgttcccattccactacagcaggcaaggacactgtttgatgaagtgcagtttaaggaaaaggtgtttctgagacagcaggggtcatacatcctgactgttgaagcaggaaaacagctgctgctgtccgcagattccggcgcagaggctgcgcttcaggccgaactggccgagatccaggaaaagtggaaatctgcttcaatgagattggaggagcaaaagaaaaaactggcatttctcctgaaggactgggagaagtgtgaaaaaggcatagccgattccttggaaaaacttaggacctttaagaagaagcttagtcaaagtcttccagatcatcatgaggagctccacgctgaacaaatgaggtgcaaggagcttgaaaatgcagtgggctcatggaccgacgacttgacacaactgtctctgctaaaggacacgctatctgcatacatcagcgccgacgacatatccattctcaacgaacgggttgaattactacagagacagtgggaggaactgtgtcaccagctttcactgcgccgacagcagatcggagagcggctaaatgaatgggccgtctttagcgaaaagaacaaagaactttgcgagtggctgactcagatggaatctaaagtgtcccagaatggagacatcctaatagaagagatgatcgagaagttgaaaaaggattatcaggaggaaatcgcaattgcccaagaaaacaagatacagctccagcagatgggggagcgcctcgccaaggcttcccatgagagcaaggcctcagaaattgagtataaacttggcaaagtcaacgatcgttggcagcacctccttgatctgatcgccgcccgagttaagaaattgaaggagaccttggtggctgtgcagcagcttgataaaaatatgtcaagcttacgaacttggctggctcatatcgaatctgaactggccaagccaatagtgtacgactcatgtaatagtgaagaaattcagcgcaagttgaacgagcagcaggagctgcaacgggacattgaaaaacactctaccggcgtggcttcggtgttaaatttgtgtgaggtattactgcatgactgtgacgcctgcgcgaccgacgcggagtgtgattctattcagcaggcgactcgcaacctcgatcggagatggcggaatatttgcgccatgtccatggaacggagactgaagatcgaggaaacatggaggttgtggcaaaagttcctggatgattacagtagatttgaggactggctgaaatcctctgagcgcacggcggccttcccctctagctccggagttatctatactgtcgctaaagaagagttaaaaaaattcgaagcatttcagcgacaggttcacgaatgtcttacccagctcgagcttattaacaaacagtaccggaggctggctcgggagaaccgcaccgacagcgcctgcagtctgaaacagatggttcacgaaggcaaccaaagatgggacaatcttcagaagagagtgacatctatactacggagactgaaacactttatcggtcagcgggaggaatttgaaaccgctcgcgatagtattttggtgtggctaaccgagatggacctacagctgacgaacattgagcactttagcgaatgtgacgtgcaggccaagattaagcagctcaaggcgtttcagcaggagattagcttgaaccacaacaagatcgagcagatcatcgctcaaggagaacagctcatagagaagtcagagccgttggatgccgctatcatcgaggaggaactcgacgagcttagaaggtactgtcaggaggtgttcggacgggtcgagcggtaccataaaaagctaatcaggctgcccttgccagatgacgagcatgacctgagtgacagagaattggagctagaagattcagctgccctgtctgacctgcactggcatgaccgaagtgcagactcacttctgagccctcaaccttcctcaaacttgagcctttcattggcacaaccactccggtccgagcgctccggaagagacactcctgcgtccgttgactccatcccacttgagtgggaccatgactatgatctcagccgtgacctggagagcgccatgtccagagccctgccgtctgaagatgaagagggccaggatgacaaggacttctacctccggggcgccgttggactgagcggcgatcacagtgccctcgagagtcagatcaggcagctcggcaaggctctcgacgattcaaggtttcagatccaacaaacagaaaatatcatccggagcaaaaccccaaccggccccgagcttgacactagctataaaggctacatgaaactgttgggagaatgctcttcatcaattgattctgtgaaacgcctagagcataaactgaaagaagaggaagagtctctgccagggttcgtcaatctgcactctacggagacacagacagccggcgtaatagaccgctgggagctgctgcaagcccaagccctgtcaaaggagttacgaatgaagcagaacctgcagaaatggcagcaatttaactccgatcttaactctatttgggcctggcttggagataccgaggaagagctcgagcagctacagcggcttgagctgagcaccgacatccagacaatcgaactgcagatcaagaagctgaaagagctgcagaaggccgtggatcaccgcaaagcgataatcctgtccatcaacctttgtagccctgagttcacacaggctgatagtaaagaatcaagagatctgcaggaccggctgtctcagatgaatggccgttgggaccgggtctgcagtctgctggaggaatggagaggactcctgcaggatgcactcatgcagtgtcagggcttccatgagatgtctcatgggctgctgttgatgttggaaaacatcgacaggcggaagaacgagattgttcctattgatagtaatctggatgcagaaatacttcaggatcaccacaaacagctaatgcagataaaacacgagctactggagagtcagctgagggtcgcgagtctccaggacatgtcttgccaactgctggtcaatgcagagggaactgactgccttgaagcaaaagaaaaagtgcacgtaatcggcaatcgcctgaagctgctgctaaaggaggtttcgcggcatattaaagagcttgagaagctcctcgacgtctcgagcagccagcaggacttatccagttggagctccgccgacgaactcgatacctccgggtcggtgtcgccgacttctggcagatcaacccctaacagacaaaagaccccacgtgggaagtgctctttgagccaaccaggccccagtgtatcatcccctcacagccgatcaactaaaggcggctctgactcatccctgtctgagcccgggcccggcagaagcggccggggtttcctgtttagagtgttgagagcagccctgcccctacagcttctgctgctgctactcatcggactcgcttgtctagtaccgatgagtgaggaagattatagttgtgctctttctaacaacttcgcacgatctttccacccaatgttgaggtacactaacggccctcctccattatag

SEQ ID NO: 206669 - DNA, 2934 bp, Artificial Sequence
  Description of Artificial Sequence: Synthetic coding sequence
atggtggtggccgaggacctgagcgccctgcggatggccgaggactcctgcgtcgacgctgacctacccgactgcaactgtgatgtgacaaggcagcgggtcaaaaaactgaaagagactttggtcgctgtccaacagctagataagaacatgtcaagtcttagaacctggctcgcgcacatcgaaagcgagctggcaaaaccaatcgtatacgattcatgcaactctgaggagattcagcgcaaattaaacgaacagcaagaactgcagcgcgatatcgaaaagcattccacaggcgtggcgtcggtcctgaatctgtgcgaggtactcttacatgactgtgacgcctgcgccactgacgcagagtgcgacagcatccagcaggccaccagaaatctggacaggcgctggaggaacatttgcgctatgagtatggaacggcgattgaagatagaggagacttggcggttgtggcagaaatttctagacgactacagtcgtttcgaagattggctgaaaagctctgagaggaccgctgccttcccgtcgagctcaggcgtcatttacaccgttgcaaaagaggaactcaaaaagtttgaagcattccaaaggcaagtgcatgagtgtctgacacagttggagctcataaataagcagtatcggcgtctcgcaagagagaataggaccgatagcgcttgttcacttaaacaaatggtgcacgaaggaaaccaacgatgggataacttgcagaagagagtcacttccatactaagacggctcaaacattttattggccagagggaggagtttgaaactgcaagagattcaattctggtgtggctgacggaaatggacctgcaactgacaaatatagaacactttagcgagtgcgacgtacaagccaagatcaaacagctcaaggcgtttcagcaggaaatcagcctcaatcacaataaaatcgagcaaatcattgctcagggagagcagcttatagaaaagagcgagcctttggatgctgcaatcatcgaggaggagctggatgagcttcggcgctactgtcaagaagtgtttggcagagtggaaagataccataagaagctcattcgcctcccattgccggacgacgagcacgacctgagcgatagggaactcgaactcgaggattcagcagccttatctgatctacattggcacgaccggagcgccgactccctcctgtcacctcagccttcctctaacttgtccctctcattggcccagcccctccgctctgaacggtccggccgggacaccccagcttctgtagacagcatccctctagagtgggaccacgactatgatctttcacgggacctcgagtcagcgatgtcccgtgccttgccttctgaggacgaagagggtcaagacgacaaagacttttacctgaggggggcagtgggtttgtccgacgtgatgatcccggagtcaccagaagcctacgtgaaactgaccgaaaacgccatcaagaatacaagtggggatcattcagccctggaaagccagatccgacagcttggtaaagcgctcgatgactcgagatttcagatccagcagaccgagaacattattcgaagtaagacccctacaggccccgagctggacacatcctacaaaggatatatgaagctactcggagagtgcagtagtagtattgactccgtcaagcgtctcgaacacaaactcaaagaggaggaagaaagtctccctggcttcgtcaacctccattccacagagacccagacagccggggttatcgaccgatgggaactactgcaggcccaggccctatctaaggagcttcggatgaagcagaatctgcagaagtggcaacagtttaactcagatctgaacagcatttgggcatggttgggcgatactgaggaagaactggaacaactccagcggctggaattgtctaccgatattcagactatcgaactgcagatcaagaaactgaaagagctgcagaaggcagttgatcaccgcaaggccatcattctctccatcaatctctgttcccccgagtttacccaggccgactcgaaggagtctcgggacttacaggacagactatcccagatgaatgggaggtgggaccgggtgtgtagcctgctggaggagtggcggggcctcctgcaggatgccttgatgcagtgccaaggtttccacgaaatgtctcatggacttctgttgatgcttgagaacattgacagaaggaagaatgaaatcgtgcctatcgattccaacctggatgctgagatactccaagatcaccacaagcagttgatgcaaataaaacacgagttgctggagtctcagcttcgggtcgcatcactccaggacatgtcatgccagttattagtcaacgcggaaggaactgattgcctagaggcaaaggagaaagttcacgtgatcgggaacaggttaaagctcctgctgaaggaggtgtcaagacacattaaagaacttgaaaagctactagacgtaagtagctcacaacaggatctctccagttggtcgtcggcagacgaacttgatacgtcagggagcgtcagccccacaagcggacgctccactccaaaccggcagaaaacaccgagaggcaagtgttctctgtcccaacccggcccctcagtgtcatctcctcactcacgctctacgaagggaggctctgactcatcactctctgagcctggcccaggtagatctggtcgggggtttctttttcgggtgcttagggcagcgcttcccttgcagctactcctactgctgttaataggtctcgcctgtttggtgcccatgtccgaagaagactatagttgtgctctctctaacaacttcgccagaagcttccatcccatgctgaggtatacaaatggtcctccacccctctag

SEQ ID NO: 206670 - DNA, 26394 bp, Artificial Sequence
  Description of Artificial Sequence: Synthetic coding sequence
atggccaccagccggggcgccagccggtgcccccgggacatcgccaatgtcatgcagagactgcaggatgagcaggaaattgtccagaaaaggacatttacgaaatggatcaactcccacttagccaagcgaaaacctcctatggtagttgacgatttgtttgaggatatgaaggatggagtgaaactacttgccttactagaggtattgagcggccagaaactcccatgtgaacaaggccgccggatgaagaggatccacgcagtggcaaatattggtaccgcactgaaatttctggagggccggaaaattaagctcgtgaacattaattccacagacattgcggacggtcgtccttctatcgtgctgggccttatgtggactatcattttgtacttccagattgaggagctcacctccaacttgccccagctgcagtctctgtcatcttcagcatcctcggtggactctatagtgagctcggagacaccatcccctcctagcaagcgcaaggtgacaaccaaaattcagggaaatgcgaagaaagctttacttaagtgggttcagtacacggccggcaagcagaccggtattgaggttaaggatttcggtaagagctggaggtctggagttgcctttcattctgtcattcacgctatccgccccgaattggtggatctcgagactgtgaagggccgtagcaaccgggagaacctcgaggatgcatttacaatcgctgagacagaacttgggattccccggctgctcgacccagaggatgtcgacgtcgataagccggacgagaaaagcattatgacttatgtggcccagttcctcaagcactatccagatatccacaacgctagcacagatggccaggaagatgatgagatactcccaggctttccttctttcgccaacagtgtgcagaacttcaagcgagaagacagagtgatattcaaagagatgaaggtgtggatcgaacagtttgaacgagacctgacgcgggcccagatggtcgagtccaatctgcaagataagtatcagtctttcaaacactttcgcgttcagtacgaaatgaagaggaagcagatagaacatctgattcaacctctgcatcgggacggaaagctgagtcttgatcaggccctggtgaagcagtcctgggaccgggtgaccagtagattgttcgactggcatattcagctggacaaaagtctgcctgcaccgctgggcacaatcggagcctggctttatagagccgaggtggccctgcgagaagagatcacagttcagcaggtgcatgaggagactgccaatactattcagcgcaaactggagcaacacaaagacctgctgcagaacaccgatgcccacaagagggcattccacgaaatctacagaactagatctgtgaatggcatcccagtacctcctgaccaacttgaagacatggcagaacgatttcactttgtgagttctactagtgaactgcacttaatgaagatggaattcctggaacttaagtatcggcttttatccctactagtgctagccgaaagtaagctaaagtcatggatcattaaatacggccgaagggagagcgtcgaacagctgcttcaaaattatgtgtctttcatagaaaattcaaagtttttcgaacagtacgaagtgacctatcagatcctaaaacagaccgccgagatgtacgtgaaagctgacgggtccgtagaggaggccgaaaacgttatgaagtttatgaatgaaaccacggcccagtggcgtaacctctcagtggaagtgaggagcgtccgtagcatgctggaggaggtaattagcaactgggaccggtacggcaataccgtcgcgtctctgcaggcgtggctggaggatgcagagaagatgctcaatcaaagcgaaaacgcaaaaaaagatttttttcggaacttgcctcattggattcagcagcatacggccatgaatgacgctggcaatttcctgattgaaacatgcgatgagatggtcagcagagacttgaaacagcagctccttctgctgaatggacggtggagagagctgttcatggaggtaaagcagtatgcacaggctgacgaaatggacaggatgaaaaaagagtacacagactgtgtagtgactctgagtgccttcgctacggaagcgcataagaagctgtccgagccactggaggtctccttcatgaatgtgaaacttctgatacaggacttggaggatatcgagcagcgggtgccagtgatggatgcacagtacaagattattactaagactgcccatctgattacaaaagagtcacctcaagaggagggaaaagagatgtttgctaccatgtccaaattaaaagagcagcttactaaggtcaaagagtgctactcacccctgctctatgagtctcagcaactgttgatcccactcgaagaactggagaagcagatgacttctttctacgactctttgggaaagataaatgaaatcattactgtgctggagagggaggcacagtccagtgccctgtttaagcagaaacaccaagaactgctcgcgtgccaggagaactgcaagaaaacattaacactaatcgaaaaggggagccaaagcgtgcaaaaattcgtgaccctttccaacgttcttaaacactttgaccagactcgtctacagcgtcagatagctgacatccacgttgcattccagagtatggtaaaaaagaccggggattggaaaaaacacgtcgaaactaactcccgtctcatgaaaaagttcgaggagagtcgagccgaacttgaaaaggtgcttcggatcgcgcaggaggggttggaggagaagggagatcctgaggagctgcttcgacgccatactgagtttttttcccagctcgatcaacgagtccttaatgcatttctaaaggcttgtgatgagctcacagacatactgccagagcaagagcagcaaggcttacaagaggcagtaaggaaactgcataagcagtggaaggatctgcagggtgaggccccctaccacctcctgcatctaaagattgatgtcgaaaaaaaccgattcctagcttcagtcgaggagtgtcgtactgagctggaccgtgagaccaagctcatgcctcaggaaggcagcgagaaaatcatcaaagagcatcgagttttctttagcgataaaggaccacatcacttatgcgaaaagcgcctacagctgatcgaggagctctgtgtcaaattaccagtgagagatcctgtcagggacacgcccgggacctgtcacgtgaccctgaaagagctcagagccgcaatagattcaacctaccggaagctgatggaggacccagataagtggaaagattacacaagccggttttctgagttttcgtcttggattagtaccaacgaaacacaactgaagggaatcaagggcgaggcgatcgatacagcaaaccacggagaagtcaaacgggccgtggaagaaattaggaatggcgttaccaagaggggcgaaacattatcttggctgaagtccaggttgaaggtactgacagaagtgagctccgaaaatgaagcgcagaagcagggggatgaactggctaagctgtccagttcttttaaggccctcgtgaccttactcagcgaggtcgagaaaatgctctctaacttcggagattgtgtgcaatacaaggaaatagtaaagaatagcctcgaagagctgatctccgggtcaaaggaagttcaggagcaggccgagaagattctggacaccgagaatctgtttgaggcccaacagctgttgctccaccaccagcaaaagactaagcgcattagtgccaaaaagcgtgatgttcagcagcagatagcacaggcccaacaaggagaggggggattgccagacagagggcacgaagagctcagaaaactggaaagtactctcgatggactggagcgctccagggagcggcaagaaaggcggattcaggtaacactcagaaagtgggaaaggtttgaaacgaataaagaaacagtggtgagatatctctttcagaccgggtcctcccacgagcgctttctcagctttagttccctggaatccttgtctagtgaactcgaacagactaaagaattcagtaagagaactgagtcaattgctgtgcaggctgagaacctcgtgaaggaagcaagtgagattccattgggtccacagaataaacagctgctccagcagcaggctaaaagtattaaagagcaggtgaaaaaactggaggatactttggaagaggacattaagactatggaaatggttaaaaccaaatgggatcatttcggttcgaatttcgaaaccctcagtgtttggattacagaaaaggagaaggagctcaatgcactcgagacatctagtagcgctatggatatgcagatctcacagatcaaagtaactattcaggagatcgagtccaagctttctagcatcgtcggactggaggaggaagcccagtctttcgctcaattcgtgactacaggagagtccgctcgcattaaggcaaaactaacccagatccgcagatacggtgaggagctgagagaacatgcacagtgtctggaaggaactatcttggggcatctgtctcaacagcagaaattcgaagaaaatctgagaaagattcaacagtcagtgagtgaattcgaggataagttagctgtaccgattaagatctgcagcagtgctactgaaacgtacaaagtcctccaagaacacatggacctgtgccaggccttggagagcctgtcaagtgcaatcaccgcattctctgctagcgccagaaaggtcgtgaaccgcgactcttgtgtgcaggaggccgcagctctgcagcagcagtacgaggatatccttcgcagggcgaaagaacggcaaaccgctctcgagaatctgctggcccactggcagagactggagaaggagctgtcctcattcctgacctggctggaaaggggagaggctaaagcctcgagcccagaaatggacattagcgccgaccgggtgaaagtagagggtgagctgcagctgatccaagcccttcagaacgaggtggtcagtcaagcaagtttttatagcaaacttctgcagcttaaagagtccttattttcggtagcaagtaaagatgacgtcaaaatgatgaagttgcacctcgaacagctggacgaacggtggagagatctgccccaaattattaataaacggataaactttctccagtctgtcgttgccgagcatcagcagtttgatgagctcttgctttccttttctgtatggattaagttattcctgtccgaattacaaacaacaagcgaaattagtataatggaccatcaggtagcactgacccggcataaagaccacgctgctgaggtggagagtaaaaaaggagaactccaaagtctgcaagggcacttagccaaactgggaagtttggggcgggccgaagacttacacctgctgcaaggcaaggcggaagattgtttccaactgttcgaggaagcttctcaggtggtcgaaagacgacagcttgctctgtctcacctggccgagttcctgcaatcgcacgctagcctatctggaattctgagacagctaaggcagactgtggaagccactaattccatgaataagaacgagagtgacttgatcgaaaaagacttaaatgacgcgctacagaacgccaaggctctggaatcagccgccgttagtctggatggcatcttatccaaggcacagtaccaccttaaaatcgggtccagcgaacaaaggacatcctgtcgagcaaccgctgaccagctgtgtggcgaggttgaacgaattcagaacctgctcggcactaaacagtctgaggcggacgccctcgccgtcctgaaaaaagctttccaggatcagaaggaagagctcctgaagtcgattgaggacatagaggagcgaaccgacaaggaaaggctgaaagaacctacgcggcaggccctccagcagcggcttagagtcttcaatcagctcgaagacgaacttaacagtcacgagcacgagctgtgctggctcaaggacaaggccaaacagatagcccagaaagatgtggcatttgcccccgaggtggaccgcgaaatcaatcgcttagaagttacatgggatgatacaaagaggctcatccacgaaaaccagggtcaatgctgtggcctcatagacctgatgcgcgaataccaaaacctcaaatcggcagtctctaaggttctggagaatgcttcctccgtgattgttaccaggacaacaatcaaggatcaagaggacctgaaatgggcctttagtaaacacgagactgccaagaataaaatgaattacaaacaaaaggacttagacaacttcactagtaaaggcaaacatctgctttctgagctgaaaaagatccattcatcagatttctccctagtgaaaactgacatggaatcgaccgtcgataaatggctcgatgtttctgagaagctcgaagaaaacatggaccggcttcgcgtctctctatctatttgggacgatgtgttgagtacacgtgacgagatcgagggttggagcaacaattgcgtgcctcagatggcggagaacatatccaatctcgataaccacttgcgcgctgaggagctcctcaaggagttcgagtccgaagtgaaaaacaaggcactcagactagaggaactccactcaaaagtcaatgatttaaaagagctcaccaagaatttggagaccccccccgatcttcaatttatcgaagccgacctcatgcaaaagctcgagcacgctaaagagataaccgaggtcgcgaagggcacactaaaagatttcaccgcccaatcgactcaggttgagaagttcattaatgacatcacgacttggttcacgaaagtggaggaatccctcatgaactgcgcacaaaatgaaacttgtgaggcgttgaagaaagtgaaggatatacagaaagagttgcagagtcagcagagcaacatcagttccacccaggagaatctgaactcactgtgccgcaagtaccattcggccgagctggagtccctgggccgtgcaatgacaggactcatcaagaaacacgaggccgttagtcagctctgttccaagacccaagcgtctctccaggaatctctggagaagcacttttctgagtctatgcaagaattccaagagtggtttctcggagctaaggctgcggccaaagaaagctctgataggaccggcgactccaaggtgctcgaagccaagctccatgacctgcagaacattcttgactcagtttcagacggacagagtaagctggatgccgttactcaggagggacagacactgtacgcccacctgagtaaacagatagtgagtagcatccaggagcagatcactaaagccaatgaggaattccaggcatttcttaagcagtgtctgaaagataagcaggccttacaggactgtgccagcgagctgggcagcttcgaggatcagcataggaagctaaacctatggattcacgagatggaggagagatttaacaccgagaacctgggggaatcaaagcagcacatccccgagaagaaaaatgaggtgcacaaagttgagatgtttttgggggaattgttagccgcgcgagaatcattggataaactcagccagaggggtcagttgctatctgaggagggacatggcgccggccaggagggtcgcttatgctctcaactcctgacatctcaccagaatcttctgcgcatgacgaaggagaaactgagatcatgccaggttgcactacaggagcacgaggcattggaggaagccctccagagcatgtggttttgggtgaaagccatccaggatcgcttagcctgtgccgagtcaactctgggatctaaagacaccctggagaagagactttcacagattcaggatatcctgttgatgaaaggagaaggggaggtaaagctgaacatggctattggcaagggtgagcaggccctgcgaagctctaacaaagagggccagcgggtgatccagacacagctggagactctcaaagaggtttgggccgacataatgtcttcttccgtgcacgcccagtctacactggagagcgttatctctcagtggaacgactacgtggagcgaaaaaaccagctggagcagtggatggagagtgtggatcaaaagatagaacaccctttgcagccccaacctgggctaaaagagaagttcgtccttctggaccacttgcagtcgatcctgtcagaagccgaggaccatacccgggctctgcaccgccttatcgccaaatccagggagctttatgaaaagactgaggatgaatcgttcaaggataccgcccaagaggagttaaagacgcaattcaatgatataatgaccgtggccaaagagaaaatgagaaaggtggaggagatcgtcaaggaccacttgatgtatctggatgccgtgcatgagtttaccgactggttgcatagcgccaaagaggagcttcaccggtggtctgacatgagcggggacagttctgccacacagaagaaactgagcaagatcaaggagttaatagactctcgggagattggcgcgtccaggcttagcagagttgaatccctggcacctgaggtgaagcaaaatactaccgcatccggatgcgaactgatgcacacagagatgcaggcccttcgcgctgattggaagcagtgggaggacagtgtcttccaaacccagtcctgccttgaaaatctcgttagccaaatggcccttagcgaacaggaattcagcggacaggttgctcagctggaacaggccctggagcaattctccgcgttgctgaaaacatgggctcagcagctgacactgttggaaggcaaaaacactgacgaggagattgtggagtgctggcacaaaggccaggaaatactggatgctttgcaaaaggctgagccccgtactgaagatctcaagtctcagctaaatgagctgtgcagattctcacgggatctcagcacttatagcggtaaagttagtggactcattaaggagtataattgtctttgcctgcaagctagtaaggggtgccagaacaaggagcagattctacagcagagattcaggaaggcatttagagattttcagcagtggctcgtgaatgcaaagattaccacagctaaatgctttgatatcccacagaacatctctgaggtgagcacaagcctccagaagatccaggagtttctctctgaatctgagaatggtcaacataagcttaacatgatgctgagcaagggtgagctgctgtccactctcttaacgaaagagaaggctaaggggattcaggcaaaagtaactgccgcgaaggaggactggaaaaattttcatagcaaccttcaccagaaggaaagcgccttagagaacctgaaaattcagatgaaggatttcgaggtgagcgctgagcctattcaggattggctgtcaaagacagagaaaatggtgcacgagtcctcaaaccggctgtatgacctgcctgcaaaacgccgcgagcaacagaagctgcagagcgtcctggaagagatccactgttacgagccgcagctcaatagactgaaagagaaagcacagcaactgtgggaaggtcaggccgctagcaagtcatttcggcaccgtgtgagtcagctttcctctcaatatctcgcactgagcaatctgactaaagaaaaagttagccgtcttgatagaatcgtggctgagcataaccagttttcattgggcatcaaagagctgcaagactggatgactgacgcgattcatatgcttgacagctactgccacccgacatctgacaagtccgtgctggacagcaggaccctcaaactggaagcactcctgtcggtgaagcaggaaaaagagatccagatgaagatgattgtgacccggggcgaatctgttcttcaaaatacatcccccgaaggtatccccactatccagcagcagctgcagagcgtcaaagatatgtgggccagcctgttaagcgcggggatacgatgtaaaagccaacttgaaggagctttatcaaaatggacaagttatcaagacggcgtgcgtcaattttctgggtggatggactccatggaggctaatttgaatgagagtgagcgccagcatgctgagctgcgggataagacaaccatgcttgggaaggccaaactgctcaacgaggaggtgttgagctatagttctctgttggagactatcgaagtgaaaggcgccggcatgacggaacactacgtgactcagcttgaactgcaggacctccaggagcgataccgcgctattcaggaacgagctaaagaagctgtgacaaagtcagaaaagctcgttaggctccatcaagaataccaacgagatttgaaggcattcgaagtgtggctgggccaagaacaggaaaagctcgatcagtactctgtcctagaaggggatgcccacacacacgagacaacactgcgagatcttcaagagctacaagttcactgcgcggaaggtcaggctctgctgaactcagtattacacactcgtgaagatgttatacccagcggcattccacaggccgaggatcgtgccctggagagcctcagacaagactggcaggcttaccaacatcggctctccgagacaagaacacagttcaataacgtggtgaataaactgcggttgatggaacaaaagtttcagcaagtggatgagtggcttaagacggcagaggaaaaggtatccccgaggacacggcggcagtcaaatagagctacaaaggaaatccaactgcatcagatgaaaaagtggcatgaagaagtcactgcctatagggatgaagtcgaggaggtcggtgctagagctcaggagatccttgatgaaagccacgttaatagtcgaatgggatgccaggcgacacagctgacctcccgctaccaagccttgcttctccaggtgctagagcaaatcaagttcttggaggaggaaattcagtcactggaggagagcgagtcttccctgtctagttacagcgactggtacggctcaacccacaaaaacttcaagaacgtggcaacgaagatagacaaagtggataccgtgatgatgggaaagaaactgaagactcttgaagtgcttctgaaggacatggagaagggccactctctgctgaaatctgccagggagaagggcgaacgagctgtgaaatacttagaggagggcgaggccgagcggttgaggaaagagattcatgatcacatggaacagctaaaggagctcacatcaactgttcgaaaagaacacatgacattagaaaaggggctgcatcttgccaaggaattttccgataaatgcaaagcactgacccagtggattgctgaatatcaggaaatactgcatgtacccgaggaaccaaaaatggaactttatgagaaaaaagcacagctcagcaaatacaagtcgcttcagcaaacagttctgagccacgagcccagcgtgaaatccgttcgagaaaaaggagaggcattgctggagctcgttcaggatgtgacactgaaagacaaaatagaccagctgcagtccgattaccaggacttgtgcagtattgggaaggagcacgtgttctccctagaagccaaggtcaaagatcatgaagattacaatagtgagttgcaggaggttgagaaatggctattacagatgtcgggacgcctcgttgccccagacctcctggaaaccagtagtctagagacaattacgcagcagcttgcccatcataaggccatgatggaagaaattgccggcttcgaggaccggttaaataatcttcaaatgaagggcgacaccctcatcggacagtgtgccgaccacctgcaggccaagctgaagcagaatgtccatgctcatctccaggggacaaaggacagctacagcgctatttgcagcacggcacaacgaatgtaccaaagtctggaacacgaactgcagaagcacgtctcccggcaagatacactgcagcagtgtcaggcatggttgagcgcagtacaacctgacttggagcctagcccacagccacccctctcccgtgccgaggccatcaagcaagtcaaacactttcgggcgctgcaggagcaggcccgcacctatctggatcttctatgttcaatgtgcgatctgagcaacgcctccgtgaagaccaccgcaaaggacattcaacagacggagcagacaatagagcaaaaactcgtgcaagctcagaatctcactcagggttgggaagaaatcaagcacttgaagtctgaactttggatttatcttcaggacgccgaccaacagctgcagaacatgaagcgaagacactccgaactggagctgaacatcgctcagaacatggtctcacaggtaaaagacttcgtgaaaaagctgcagtctaagcaggcttctgtgaacaccattatcgaaaaggttaacaagctgaccaagaaagaagaatccccagagcacaaggagatcaatcatctgaacgatcaatggctggacttgtgtcgccagagcaacaatctctgcttgcagagggaggaggatctgcagcgcacacgagattaccacgactgtatgaacgtggtggaggtgtttctggagaagttcactaccgaatgggacaacttagcgcgttcagacgcagagagcaccgcagtccatctggaggccctgaaaaagcttgcactcgcattgcaggaaagaaaatacgctatagaggacctgaaggaccagaaacagaaaatgatcgaacacctgaatctggacgataaagagctggtcaaggagcagactagtcatctcgagcaaagatggttccagctagaggacctgattaagcggaagatccaggtgtcagtgacaaacctggaggagctaaacgttgtccagagccgctttcaagagctgatggaatgggccgaagaacagcagcccaatattgccgaagcattgaagcagtccccccctccagacatggcccagaatctcttaatggaccatctggccatttgttcggaacttgaggccaagcagatgctgctgaaatccctcattaaggatgcagatcgtgtgatggcagacctcgggcttaacgagagacaggttatccaaaaagctctctccgacgcgcagagtcacgtgaactgcttgtccgaccttgtcgggcagcggcgtaaatatctgaacaaggccctgtcagagaagacccagttcctgatggccgtctttcaggccactagtcagattcagcagcatgagcgtaaaattatgttcagagaacacatttgcctgttaccagacgatgtcagtaagcaggtgaagacctgtaagagcgctcaagcctctctgaaaacataccagaacgaggtcacagggttatgggcccagggacgagaacttatgaaggaggtgaccgagcaggaaaaatccgaagtactgggaaagctgcaggaactgcagtcagtttacgattccgtcctacagaagtgttcccataggctacaagagctggagaagaacctggtcagtcgaaagcactttaaagaggacttcgataaagcgtgtcattggttaaagcaggccgacattgtgacgtttcctgagattaatctcatgaacgagtcctccgaattgcatacccagttggccaaataccagaatattctggagcagagccctgagtatgagaatctgctgctcactttgcagcgtaccggccagacaatcttgccctctcttaacgaggttgaccatagttatctctcagagaaactgaacgccctgcctcgacagtttaacgtcattgtggccctggcgaaggacaaattttacaaagtccaggaagctattctggcacggaaggagtatgcctctctcatcgaactgacaactcagagcctgagcgagctagaagcccagtttctccggatgagtaaagtcccaacggatttagcggtggaggaagccctgtcactgcaagacggttgccgcgccatactggatgaagtcgccggtctgggggaagcagtcgatgagctgaaccagaaaaaagaagggtttcgttccaccggacagccctggcagcccgacaaaatgcttcacttggtcactctgtaccataggctgaaacgccaaactgagcagcgggtcagtctgctggaagatacaacttcagcctaccaagagcatgaaaagatgtgtcaacaactggagcgccagctaaaatctgtgaaagaagaacaatcaaaggtgaacgaggagacattgccagctgaggaaaagctaaagatgtaccattccctcgctgggagtttacaggacagcggtatagtcctgaagagggtgacaatccacctcgaggatcttgccccgcacttggatcccttagcctatgagaaggctcggcatcagattcagtcctggcagggtgagctgaaacttttgacgagcgctattggggagacagttacagagtgcgagtctcgaatggtgcagtcgattgatttccaaacggaaatgagccggtctctggattggttgagacgcgtcaaagcggagcttagtggtcctgtctacctggacttgaacctccaggacatccaggaggagatcaggaagatacagattcatcaggaagaggtgcagtccagtctgcgaatcatgaacgctcttagccataaagagaaggaaaagtttacgaaggctaaggaactcatctcggccgacctggaacacagccttgccgaactgtctgaactggatggcgatatccaggaagccctgagaactcgtcaggccaccctcaccgaaatttactcccaatgccagcgctactaccaagtattccaggccgctaatgattggctggaggacgctcaagagctgcttcagctagctgggaacggcttggatgtcgagagtgccgaagaaaacctgaaatcacacatggagtttttttcaacggaagatcagtttcattcaaacctggaagaactacattccctggtggccacgctggatcccctgataaaacccacgggaaaagaagacctggagcagaaggtggcgtccctggaactgaggagtcagcggatgtccagagactcgggggcccaggtggatctgctgcagcggtgcacagctcagtggcacgattatcaaaaggcccgggaggaagttatagaattaatgaacgacactgagaaaaagctgagcgagttttcactgctgaagacttcttcttcgcacgaggctgaggaaaaactgtcggagcataaagccctggtaagcgtggtgaactcatttcacgaaaaaattgtggcacttgaagagaaggctagtcagttggagaagaccgggaacgacgccagcaaggccacactgtcccggagtatgacaactgtctggcagcggtggactaggctaagagctgtggcccaagatcaggagaagatcctggaggatgccgtcgatgagtggacgggatttaataataaggtgaagaaggccacagagatgattgaccagctgcaagacaagcttcctggctcatcggccgagaaagccagcaaagccgaactactcaccttgctggagtaccacgacactttcgtcctagagctcgaacagcaacaaagcgcgctggggatgttgcgccagcagactctttctatgttgcaggatggggctgcacccaccccaggggaggagccccctctgatgcaggagataacagccatgcaggatcgctgtctcaacatgcaggaaaaagtgaaaactaacggaaagctcgtgaaacaagaactgaaagatagagagatggttgagacgcagatcaactcagtcaaatgttgggtccaggaaactaaagagtacctgggtaaccccactatcgagattgatgcccagttggaagaactgcagatcctcttgaccgaggctacaaaccatcgacagaatattgaaaagatggcagaagaacaaaaagagaaatacctgggcctgtacactatcttgccctctgaactgtctctgcagctcgccgaggttgcactcgacctcaagatccgggaccaaattcaggacaaaattaaggaggtggagcaatcaaaagcaacttctcaggagttaagcaggcaaattcagaagctagctaaagacctgacaacgatcctaaccaagctcaaagctaagactgataacgtggttcaggccaagaccgatcaaaaagtgctgggagaggaattggatggctgtaacagcaagcttatggagcttgacgcggccgttcagaagttccttgagcagaacggacaattgggcaaacccctggcaaagaaaattggcaagctcactgagctacaccaacagacaatcagacaggctgagaacagactgtccaagttgaatcaggccgcgtcccacttggaagagtacaatgaaatgttggaactaatcctaaagtggatcgaaaaagccaaagtgctggcgcacggcactattgcatggaacagtgcatcccagttgcgggagcaatatatcctgcatcagaccctgctggaggaaagcaaagagatcgacagcgaactcgaggccatgacagagaaactccagtacttgacctcagtgtattgcacggagaagatgtcacagcaagtagccgaactgggcagagagactgaggagctgcggcagatgataaagatccgcctacagaacctccaggacgctgccaaggatatgaaaaagtttgaggccgaactgaaaaagctgcaggccgcgttggagcaggcacaggctaccttgacatcgcctgaggtcggcaggttaagtttgaaagagcagctaagtcaccggcagcacttgctgagtgaaatggagtcattaaaaccgaaggtgcaggctgtccaactctgccaatccgctctgcggataccagaggacgtggtcgcttcactccccttatgtcacgccgccctccggctgcaggaggaggccagcagattgcaacacaccgctattcaacaatgtaatataatgcaggaggccgtggtacagtacgaacagtatgagcaggagatgaagcacttgcaacagctgatcgagggggctcaccgagagatcgaggacaaacccgtggcaacaagtaacatccaagagttgcaggcacagatctctagacatgaggagctggcacagaagatcaaggggtatcaggaacagatcgcttcgctgaatagcaaatgcaagatgctgacaatgaaagccaaacacgcaacaatgctgctcactgtgaccgaggtagagggcctggcagaaggcactgaggacttagatggcgagctgttaccgaccccttccgcccatccttctgttgtgatgatgacagctggacgttgtcatacacttttatcaccggtcacagaggaatctggagaagaggggaccaactctgagatttcttccccaccagcctgcaggtccccatctccagttgccaatacggatgccagtgttaaccaggatatcgcctactatcaggcactgtcagctgagcgactgcagaccgacgccgccaagatccacccatctacgagcgccagccaggagttctacgaacccggattagagccatccgcgacagctaaattgggtgacctccagcggagctgggagaccctcaaaaatgtcattagcgaaaaacagagaactctttatgaagcgctggaaaggcagcagaagtatcaggattccctccagtccatttctaccaaaatggaagccattgagttgaaactatccgaatctcctgagcctggccgatcgccagaaagtcagatggctgaacatcaggcactgatggacgagatactcatgctccaagatgagattaatgaactccagtcatcactcgcggaagaactggtttctgaaagttgcgaggcagaccccgcagagcagctggcgcttcagtcaacattgacggtcctggcagaacgaatgtcaaccatcagaatgaaagcttctgggaagcgccagctgcttgaggagaagctcaacgatcagcttgaggagcagcggcaggaacaggcccttcagagataccgctgcgaagcggacgaactcgacagttggctgctttccacaaaagccacccttgatactgccctgtctccgcccaaagagcccatggacatggaagcgcagttgatggattgccagaacatgcttgttgaaattgagcagaaggtggtggcactgagtgaactctccgtgcacaatgagaatttacttttggaaggaaaggcgcatactaaggatgaggccgaacagttagccggcaagctcagacgacttaagggatccttgctcgagttacagagggcactccacgacaaacagttgaatatgcaaggaaccgcccaggaaaaagaggagtccgacgtggatttgacagccacccagtctcccggtgtacaggaatggctggcccaggccaggaccacgtggacacagcagcggcagtcctcactccagcagcagaaagagctagagcaggaactggcagagcagaaatcacttctgaggtccgtcgcttctcgaggcgaagagatcctcattcagcatagcgctgccgagacctcgggcgacgcgggggagaagccagacgtactcagccaggagctggggatggagggagagaaaagcagcgccgaggaccagatgcggatgaaatgggagtctctgcaccaggagttctcaaccaagcagaaactgttacagaatgtgctggagcaggagcaagaacaggtgctttattcaagaccaaataggttattgtcaggagtcccgctgtataagggggacgtgccgacgcaggataagtccgccgtaacgtcactgttagacgggttgaatcaagcttttgaggaagtatctagtcaatctgggggcgctaagagacagtctatccacctagagcaaaagctatatgacggcgtcagcgccacaagtacctggctggatgatgtcgaggagagactgtttgtggctactgccttattaccggaggaaacagagacatgtctgttcaaccaggaaattctagcaaaggatatcaaagagatgagtgaagagatggacaagaataaaaacctcttcagtcaggcctttcctgagaatggggacaaccgggacgtcattgaagataccctcggatgtctcttgggcagattgtcactgctggatagtgtggtgaaccagaggtgccaccagatgaaagagcggctgcagcagatcctcaacttccagaacgacctgaaagtgctgttcacttccctcgctgacaacaagtatattatactgcagaagctggcgaacgtgtttgagcagccggtggccgaacaaatcgaggccattcaacaggcagaggatggccttaaagagtttgatgctgggattattgagctgaagaggagaggggacaaactgcaagtggaacaacccagtatgcaggagctcagtaagcttcaagatatgtatgatgagctcatgatgataatcggctctaggcgatccgggctgaaccagaacctgaccctgaagtcccagtacgagagggccctccaagacttggctgacctgctggaaacgggacaagagaagatggccggcgaccagaagattatcgtgtcttccaaggaagagatccagcagcttttggataagcataaggaatactttcaaggtctcgagtcccacatgatccttaccgagactctttttcgcaagatcatatccttcgccgtacagaaggagacccaattccataccgaattgatggcacaggcgtcggcagtgttgaagagagcacataagagaggcgtggagctcgagtatatcctcgagacgtggagccatctggatgaagaccaacaggagttgagtcgtcagttagaggttgtggagtctagcatcccatctgtcggcctcgtcgaagagaacgaagatcgacttatagatcggataactctgtaccagcacctgaagtccagtctgaatgaataccagcctaagttgtaccaagtgctcgatgacggtaagaggctgttgatttctatctcttgctcagaccttgagagccagctcaatcagctcggcgagtgctggctgagtaatacaaacaaaatgtctaaggagctacataggctcgagacgatattaaagcactggactcgctaccagagcgagtctgcagatttgatccattggctgcagtccgccaaagatcgcctagaattttggacccagcagtcagtcactgtcccccaggaactggagatggtgcgggaccacctcaatgcttttttggagtttagtaaagaggttgacgcccagagctccttgaaaagtagcgtactgtctacaggcaatcagctcctcagactgaagaaagtcgacacagccacccttcggtccgagctcagccggatcgactcccagtggacggatctcctgacgaatattccagctgtgcaggagaagctgcaccagctgcagatggacaagctgccctcacggcacgccatcagcgaggttatgtcctggataagtctcatggaaaatgtgattcagaaggacgaggacaatatcaaaaacagcatcggatacaaagccattcacgagtacctgcaaaagtacaagggattcaagattgatatcaactgtaagcagctcaccgtggacttcgtcaaccagtccgtgctgcaaatatcctcccaggatgtggagtctaagcggtccgataagaccgatttcgcagagcagttgggggccatgaacaagagttggcaaattctccaaggacttgtcaccgaaaagatccagttattagaaggcctcctcgagtcatggagcgagtacgagaataacgtgcaatgcctgaagacatggtttgagactcaggagaaaagactaaagcaacaacacaggatcggagaccaggctagcgtgcaaaatgcgctaaaggattgccaggacctcgaggatctgataaaagcaaaggagaaagaggttgagaaaatcgaacagaatggccttgctttgatccagaataagaaagaggacgtgtccagcattgtgatgagcacgctgcgcgagctgggtcagacatgggccaatctggaccacatggtggggcagctgaaaatcctgctgaaatctgttcttgaccagtggtccagccacaaagtcgcattcgataagatcaattcttacttgatggaagctaggtacagcctcagcagattccggctgctaacgggcagccttgaagccgtgcaagtccaagtggataacctgcagaatttgcaggacgatctcgagaagcaggagagaagccttcagaaatttggcagtatcaccaaccaactcctcaaagagtgccaccccccggtaaccgaaaccctgaccaatactctcaaggaagtaaatatgcgctggaataatttgctggaagagatcgctgaacagctccagtcctcaaaggccctgctgcagctgtggcaacgctataaagactattcaaagcagtgtgcttccacggtccaacagcaggaagatcgcacaaacgagctcttaaaagcggccacgaataaggatatcgctgatgacgaagtggcgacctggatccaagattgtaacgatctcctgaaaggcttgggaacggtgaaggattcactgttctttctgcacgaactcggggagcagctgaagcaacaggttgacgcatcagcagcgagcgcaatccagtccgatcaactcagcctatcacaacacttatgtgccctcgagcaagcattatgcaaacagcagacgagtctgcaggctggcgtccttgattacgaaaccttcgcaaaatcgctggaggccctagaggcttggatcgtcgaggctgaggaaatcctccagggacaggatccgtcacacagttccgatctaagcacgatacaagagcggatggaggagctcaaaggacagatgctcaagtttagtagcatggccccggatctggacaggttgaacgagctcggctatagactccccctaaacgacaaagagattaagcggatgcagaacctcaacaggcactggtccctgatctcctctcagacaacagagcgattttccaagctgcagtcctttttgctacaacatcaaactttcctcgagaaatgcgaaacctggatggagttcctggtgcagaccgaacaaaaactggccgtagaaatatccggaaactaccaacacctcctcgaacagcagcgagcccatgaactttttcaagcagagatgttctctcggcagcagattcttcactccatcattatcgacggtcagcgcctcttagagcaaggccaagtagacgacagagacgaattcaatctcaaactcactctgttgagcaaccagtggcagggcgtgatcaggcgcgcacaacagagaaggggtatcattgattctcagattaggcaatggcagaggtaccgggagatggccgagaagcttcgcaagtggctggtggaggtgagctacctcccaatgtctggccttgggtcagtacccattcctttacagcaggcgcgaaccttattcgatgaagttcaatttaaggagaaggtgttccttagacagcaagggtcctacatactgaccgtcgaggccgggaagcagctgctgctgtccgctgactccggggcggaggccgccttgcaggcagaactggcagaaatccaggaaaagtggaagagcgcatccatgcgactcgaggagcagaagaagaagctcgccttcctgctgaaggattgggagaagtgcgagaaggggatcgctgactctctcgagaaactgagaacattcaaaaaaaaactgagtcagtccttgccagaccaccatgaagaattgcacgccgaacagatgagatgtaaggaacttgaaaatgccgtggggtcttggacggacgacttaactcaactctctttgctcaaggataccttatctgcctacataagcgccgatgacatatcaattctcaatgaaagggtcgaactccttcagagacaatgggaggagttgtgtcaccagctatctttgcgccggcaacagatcggtgaacgactaaacgagtgggccgtgttcagtgaaaaaaataaagagttgtgtgagtggctgacccaaatggagagcaaagtgtctcagaacggcgacatcctgatcgaggagatgatcgaaaagctaaagaaagactatcaggaggaaatcgccatagctcaagagaataaaatacagctccagcagatgggtgagaggctggccaaagcaagccacgagtccaaggcatcagaaatcgaatataaactcgggaaggtcaacgaccggtggcagcatctattggatcttattgctgcacgggtgaagaagctgaaggagacgttggtagcggttcagcagctagacaagaacatgagctcactgaggacatggctagcgcacatagagtccgaactcgccaagccgattgtctacgacagttgcaatagtgaggaaattcagcgcaagctgaatgaacaacaggagttacagagggacattgagaaacactctactggcgttgcgtcagtgctgaatctgtgcgaagttctgctgcatgattgcgacgcatgcgccaccgacgctgagtgcgattccatccaacaggccacaagaaacttggacaggaggtggcggaatatctgtgctatgtccatggagaggaggctgaagatcgaggagacctggaggctctggcaaaaattcctcgatgactattctagattcgaagactggctaaagagctcagagcgcacggcagcctttccatcatcaagcggagtaatctatacagtggcgaaggaggagctgaagaaatttgaggcatttcagcggcaggttcatgaatgcttaacacaattggagctgatcaacaaacagtataggagactggcgagagagaataggacagattccgcgtgttcactgaaacaaatggtccatgaaggtaaccaacgatgggataatttacagaaaagggtgacaagcattctgcgtcgattgaaacatttcattgggcagcgcgaagaattcgaaactgctcgggactctattttagtgtggctgaccgaaatggacctgcagttaaccaacattgagcacttttcggaatgtgacgtacaagctaaaattaagcaactgaaagcattccagcaagagatatccttgaatcacaacaaaatcgagcagatcatcgcacagggagagcaactgatcgagaagtccgagccattggacgccgccattattgaggaagaactcgacgagctgcgtcgctattgtcaggaagtgtttggccgggtggaaagataccacaagaaattgatccgtctccctttgcctgatgacgagcacgatctgtcagatagggaactggaactggaagattctgctgccctctccgacttacattggcatgacagatcagcggatagcctactgtctccacagccttcatcaaacctgagtttgtcactagcgcagcccctgaggagcgaacgaagcggacgggatacaccagcgtcagtggattctataccactggaatgggaccacgattatgacctatcaagagatttggagtcggcaatgtcccgggccctcccatcagaggacgaagaagggcaggacgacaaggacttttatttgcgtggagcagtggggcttagtggtgaccatagcgctttagagagccagattagacagctcggaaaggcactggacgacagcagattccagatacaacagactgaaaacataattcgctcgaaaacacccactggtcccgaactcgacaccagctacaaaggctatatgaaattacttggggagtgtagcagctccattgactcggtgaagaggctcgaacacaagctgaaagaagaagaagaaagcctccctggtttcgtgaacttgcattctactgaaactcagacggccggagtaatcgaccggtgggagcttctccaggctcaggctctgtccaaggagctgaggatgaagcaaaacctccagaagtggcagcagtttaattccgacctgaattccatttgggcctggttgggggataccgaggaagaactagaacaactgcagaggttagagctcagcactgatatccagaccattgaactgcagatcaagaagttaaaagaattacagaaagcagtggaccacaggaaggctatcattctgtcgatcaacctgtgttcacccgaatttacccaggccgactcgaaggagtcacgggatctgcaggaccgattgtctcagatgaacggcaggtgggaccgcgtctgcagcctgttggaggaatggaggggcctacttcaagatgccttaatgcagtgtcaggggtttcatgagatgtctcacggactgctgctgatgctcgagaatattgaccgccgtaagaacgaaattgttccaatagactccaacctcgatgccgaaatactgcaggatcaccataagcagctgatgcagatcaaacacgagttgcttgaaagccagctgcgggtcgcatctctccaggacatgagctgtcagctcctggtgaacgccgaaggcactgattgtctagaggctaaggaaaaggtgcacgttattggtaatcgattgaagcttttacttaaggaggtctctcgacacataaaggagctcgagaagctgttggatgtcagctcaagccagcaggacctaagctcatggagtagcgcagacgagctcgacacgagcggaagcgtttcaccaacctctggccggtcaacgccaaatcgacagaagacaccccgcggtaaatgctctttatctcagccaggcccctcggtaagttccccccattcgcgtagtactaaagggggctctgacagctcgctgagcgaaccggggccgggccgctccggacgaggctttctgtttcgcgtgctcagggccgctttacctcttcaattgttgttacttttgttgataggattggcctgtctggttcccatgtctgaagaggattactcatgtgccctgagtaacaacttcgccaggtcgtttcaccccatgttgcggtatacaaatggaccccctcccttatag

SEQ ID NO: 206671 - DNA, 26250 bp, Artificial Sequence
  Description of Artificial Sequence: Synthetic coding sequence
atggccaccagccggggcgccagccggtgcccccgggacatcgccaacgtcatgcagagattgcaggatgagcaggagatcgtgcaaaaaagaacattcaccaaatggatcaattcacatctagcaaagaggaagcctcctatggtcgtggatgacctgtttgaagatatgaaggatggcgttaagcttctcgcccttttagaggtgctatctggtcaaaagctgccatgtgaacagggtcgacgaatgaagcggattcacgcagtggccaacatcggaaccgccctgaaatttttagagggaaggaagtcaatgcaccgaggttcacctatcaagctcgtgaacattaacagtacagatatcgctgatgggcgaccttctatcgttctggggttaatgtggactatcattctgtatttccagattgaagaattaacgagcaacctgccccagctgcaatcattgagctccagtgcctctagcgtcgacagtattgtatctagcgagaccccctccccaccttctaagcgtaaagttaccactaagatccagggcaacgccaagaaagccctacttaaatgggtgcagtacactgccggaaagcagaccggcattgaggtcaaggactttggaaaaagctggagatccggagtagcatttcactctgtgatacacgccatcagacccgaactcgtggacttggaaactgtgaaaggtaggtctaacagagaaaaccttgaggacgcctttaccattgccgagacggagctcggaatccctaggttgctcgaccctgaggacgtggacgtggacaaaccggacgagaagtcaatcatgacatatgtggctcagttcctgaaacattaccccgacatccacaacgcctccactgatggtcaggaagatgacgaaattctacctggctttccctccttcgccaatagcgttcaaaattttaagcgcgaggatagggttatattcaaggagatgaaagtctggatagagcaatttgaacgtgatctgaccagagctcagatggtcgagagtaatttacaggacaagtatcaatctttcaaacattttcgagtccagtatgagatgaagaggaagcaaatcgagcacctcattcagcccctccaccgggatggcaaactgagtctcgaccaggccctggtgaagcagtcttgggatcgggtgacatctagactgttcgactggcacatccaactcgataagtctctgcccgcaccactgggaaccatcggtgcctggctgtaccgtgccgaggtcgctctgcgcgaagagatcacagtgcagcaggtccacgaagagaccgccaataccatccaacgcaaactggaacagcataaagacctgctccagaacactgatgcccacaagcgggccttccatgagatctacagaacacggtcagtaaacggaatccccgtgccccccgatcagctcgaggacatggcagaaagatttcacttcgtttcctcaacgtctgaactgcatctgatgaaaatggaattcctcgaactcaagtataggctgctgtcgctgctggtattagcagagagtaaacttaaatcctggattatcaagtacggccgtcgagaaagcgtggagcagttgttgcagaattacgtctcatttatcgaaaattccaaatttttcgaacagtatgaggtgacctatcagatactgaaacagaccgccgagatgtatgtgaaggccgacggatcggtcgaggaggccgagaacgtaatgaaattcatgaatgagactacagcccagtggcgcaatttgtctgttgaagtcagatcggtgcgatccatgcttgaagaggtgatatctaattgggatagatacggcaacaccgtagctagtctgcaggcatggctcgaggatgctgagaaaatgcttaaccagagcgagaacgctaaaaaggattttttccgcaatctgccccactggatccaacagcatactgcgatgaacgatgcaggaaattttttgatcgagacctgcgatgagatggtgtcccgggatctcaaacagcaacttttgttgctgaacggacggtggagggaattatttatggaagtgaagcagtatgcacaagcagacgaaatggacaggatgaaaaaggagtacacagattgtgttgtgaccctgtcagcgttcgctaccgaggctcacaaaaaactgtctgaacctttggaagtgagctttatgaatgtgaaattgctcattcaggacctagaggacattgaacagcgggtacctgtcatggatgcgcaatacaagattattaccaagacagcacatcttattactaaggagtccccccaggaggagggcaaagaaatgttcgcaacaatgtccaaactcaaagaacagttgaccaaggtgaaagagtgttatagcccactgctgtatgagtcacaacaactgcttattccgctcgaagaacttgaaaagcaaatgacttccttctacgactcattaggcaagattaacgagataatcaccgtgctggagagggaagcccagtccagtgctctgttcaaacagaaacaccaggagttgcttgcttgtcaagagaactgtaagaagactttgacactcattgaaaaagggagccaaagtgtgcagaagttcgtcacattatccaacgtcttgaaacacttcgatcagactaggcttcaaagacagatcgctgacattcacgttgcctttcagagtatggtcaaaaagacaggcgattggaagaagcatgtcgaaactaattccagactaatgaaaaagttcgaggagagcagagcagagttggaaaaggtgttaagaatcgcacaggaaggtttggaagagaaaggggacccagaggagttgcttaggaggcacacagagttcttcagtcagctagaccaaagggtgctgaacgcttttctaaaagcctgcgatgagctaactgacattttgcctgaacaggaacaacagggactgcaggaagcagtgaggaagttacacaaacagtggaaagatctccagggcgaagccccttaccatctcctccacctgaagatcgatgtagaaaaaaacagattcctcgcttccgttgaggaatgtaggacagagttggatcgggagacaaagttaatgccacaggaaggctcggagaaaatcattaaggaacacagagtttttttctcagataaaggacctcaccacctgtgtgagaagcgattgcagttaattgaagaactgtgtgtgaagctccccgtccgcgaccccgtcagggacacgcccggtacctgtcatgtgacactgaaggagctgagagccgccattgattcaacttacagaaaactgatggaagatccggacaaatggaaggactatacgagcaggttttctgaattctcaagttggatctccaccaacgagacacagcttaaaggaataaaaggggaggccattgatacagccaatcatggcgaagtcaaacgagcagtagaagaaatacgcaatggggtgaccaaaaggggcgagacattatcatggctcaagtcaaggctgaaagtcttgaccgaggtttctagcgaaaatgaggctcagaaacaaggcgacgagctggccaagctgtcttcctccttcaaggcgttagtgacacttctctctgaggtcgagaagatgctatctaacttcggtgattgtgtccaatacaaagaaattgtcaagaacagtctggaagagctgatatccggttctaaggaagtgcaggaacaggccgaaaagatcctggacaccgagaatttgttcgaagcccagcagctgctgctgcaccatcaacaaaagactaagcgaatttcggcaaagaagagggatgtccagcaacagatcgcccaggctcagcagggcgaaggcggcctccctgataggggccatgaagagctgaggaagcttgaaagcactttagacggtctcgagcggagccgggaaaggcaggagaggcggatccaggttactctgaggaagtgggaaagattcgaaactaataaagagaccgttgtgaggtacttattccagactgggagcagccatgagagattcctcagcttctcttctctagagtctctcagctcagagttggaacaaacaaaggagttctctaaacgcaccgaatctattgccgttcaggctgaaaacctagtgaaagaggccagcgagattcctttgggccctcagaacaaacaactgctccagcaacaagccaaaagtattaaggagcaggtcaaaaagttggaagataccctggaggaagacatcaagacaatggagatggtgaaaacgaagtgggaccatttcgggagtaactttgagactctgtccgtgtggattacagaaaaggagaaggagctcaatgcactcgaaacatcgtcctctgcaatggatatgcaaataagtcaaataaaagtaaccattcaggaaatcgagtcaaagctgagtagcattgtggggcttgaggaggaagcgcagtccttcgcccagtttgtgactactggcgagagtgcgaggatcaaggcgaagctaacacaaatcaggagatatggggaggaactgcgcgagcatgctcagtgtctggagggcacaattttggggcatctgtcgcagcagcagaagttcgaggaaaacttaagaaaaatacagcagtctgtgagcgagttcgaagataagcttgccgtcccgattaagatatgttccagtgcaaccgaaacatataaggtgttgcaggagcacatggacctctgccaggctctcgagtctttaagctccgctattacagctttcagcgcgtctgccaggaaggtggttaatcgcgactcctgtgtacaggaagcggccgctctgcaacaacaatacgaggatatactgcgccgtgcaaaggagcgccagacggctctagagaacctcctggctcattggcaacgtctggagaaggagttaagtagttttttgacatggctggaaagaggggaggcaaaggcctcttctcccgaaatggatatttccgcagacagggttaaggtggagggggagttacagctgatacaggcgctgcaaaacgaagtggtcagccaagcctccttttacagcaagttactacagctgaaagagtctctgtttagtgtcgcaagtaaagacgatgttaaaatgatgaagctgcatctcgaacagctggatgagcgctggcgggaccttccacagattattaataagcgcatcaacttcctgcaatcagttgtggctgagcatcagcagttcgatgagctactgctcagtttcagtgtgtggatcaagctcttcctctcagaactgcagacaacttctgagatctcaatcatggaccatcaggtggctctcacgcgccacaaagatcatgcagctgaagtggagtccaagaagggcgagttgcaaagtttgcagggccacctggcgaagttgggcagcctaggccgggcagaggacctgcatcttttacagggtaaggctgaggactgcttccagctattcgaggaggccagtcaagtggtcgagcgccgccagttggccctgagtcacctagctgagttcctgcagagccatgccagtctttccgggattcttcgacagctgagacaaaccgttgaggccaccaattcaatgaataagaacgagtccgatcttattgagaaggacctgaatgatgcactgcagaacgccaaggcgctggaaagcgccgctgtcagccttgacggcattctgagtaaagcccagtatcatctaaaaataggtagcagtgagcaaaggacctcttgccgggctacagctgaccagctttgtggagaagtggaacgtatccagaatctgctggggacaaagcagagcgaggcagacgcccttgccgtgctgaaaaaagcttttcaggaccagaaggaggaactcctaaagtcaattgaagatatcgaggagcgtactgataaagagcgactaaaagagcccacacgtcaagcactgcaacagaggttgcgggtgtttaatcaactagaggacgaactgaactcacatgaacatgaactgtgctggctgaaggacaaagcgaaacagatagcacagaaggatgttgcctttgcaccagaagtcgatcgcgaaatcaatcgcctcgaagtaacgtgggacgatactaaaaggcttatccacgaaaaccaaggacaatgctgcggcctgattgacctgatgcgtgaatatcaaaatctgaagagtgctgtgagcaaggtactggaaaatgcttctagcgtcatcgtaactagaacaaccattaaggatcaagaggatctgaagtgggcgttcagcaaacatgagaccgcaaagaataaaatgaactacaagcaaaaggacctagataactttacttcgaaggggaaacaccttttgtctgagctgaagaagatccactcttccgattttagcctggtgaagactgatatggaaagcactgtcgacaagtggctggacgtgagcgaaaagctagaagaaaacatggataggctgcgggtctccttgtcgatttgggacgatgttctctcaacaagggatgaaatagagggctggtcgaataactgcgttccacagatggccgagaatatctccaatctggacaatcacctaagagcagaagaactgctaaaagagtttgagagcgaggttaaaaacaaggcgcttcgactggaggagcttcacagcaaggtgaatgaccttaaagagctgacaaaaaacttggagactcctccagacttacagttcatcgaggcagatctgatgcagaagttggagcacgccaaagagattaccgaagttgcaaaaggtactctgaaggattttacagcgcagtcaacccaggttgagaaatttatcaatgatattaccacttggttcacaaaagtggaggagtctctgatgaactgtgctcagaatgagacatgtgaggccctgaaaaaagtaaaagatatccagaaggaactgcagagccaacagtctaatatttcttcaacccaggagaacttgaacagcctgtgtcgtaagtaccactcagcagaattggagtcgctggggcgcgctatgactggtcttatcaagaagcatgaggccgtctcacagctgtgcagtaagacacaagcaagcctgcaggagagtctggagaagcatttctctgagtcgatgcaggagttccaggagtggttcctaggagcaaaggctgcggcgaaagagagctctgaccgcaccggagacagcaaggtcttagaagcgaagctccacgacctgcagaatatcctggattccgtgagcgatggccagagcaagttggatgctgttactcaggagggccagacactgtacgcccacctgtccaaacagatcgtctcttctattcaggagcagattacaaaagccaacgaagagttccaagctttcctgaagcagtgccttaaggacaaacaggctctgcaggactgcgcatcagagctggggagcttcgaggatcagcaccggaagctgaacctgtggattcatgagatggaagaacggttcaacaccgagaacctaggcgagagtaagcagcacatccctgagaaaaagaacgaggtgcataaggtggaaatgttcttaggcgagctcctggccgctcgagagtccctcgataaactgtcacagcgaggccagttactgtctgaggaggggcacggtgctggtcaggaggggcggctatgttcccagctgttgacctcccaccagaatcttctgcgaatgactaaggagaagctaaggtcatgccaagtcgcgctgcaagaacatgaagccctcgaagaggccctccagagcatgtggttctgggttaaggcaatccaggacaggcttgcttgtgcagagagcactcttggatctaaggataccctggagaaacgattgtcgcagattcaggatatcctgctgatgaaaggggagggggaggtgaaattaaacatggcaatcggcaaaggcgaacaagcactgcgctctagcaacaaggaggggcagcgggtgatacagacccaattggagacgctcaaggaggtgtgggctgatattatgagctccagtgtgcatgcgcagtccacattagagagcgttattagtcagtggaatgactacgtggaaagaaagaatcagttggaacaatggatggagtcagttgatcagaagatcgaacatcccctccaaccccagcccggacttaaggaaaagttcgtgcttttggaccacctgcagagcatcctcagcgaagcggaagaccatacacgcgctctgcaccggctgatcgcgaaatcaagggaactctatgaaaagacagaagacgaatcttttaaagacactgcccaggaggagttaaagacgcagtttaatgacatcatgactgtggccaaggagaagatgcgtaaagtcgaagagattgtaaaggatcacctgatgtacctcgatgctgtacacgagtttaccgactggctccactccgcaaaagaggagctccacagatggtctgacatgagcggtgatagtagcgccacccaaaaaaagctgagcaagatcaaagagctgatcgactcacgcgaaattggagcatcaaggctaagccgagtcgaatccctcgccccagaggtcaagcagaacaccactgcaagtgggtgcgagctgatgcatacagaaatgcaagccctgcgggcagactggaagcagtgggaggattccgtctttcagacccagtcttgcttggaaaacttagtgtctcagatggctttatccgagcaagaatttagcggccaggttgcccaactggaacaggctctggagcagttctcagcactgctgaagacatgggctcagcaattgactcttttagaaggcaagaacacagatgaagaaatagtagagtgctggcataaggggcaagagatcctggatgccctgcagaaggctgaaccgcgcaccgaagacttgaaaagtcagcttaatgaactgtgtcgcttctcacgagatctcagcacctactctggcaaggtgtcgggcttaatcaaagagtataattgcttgtgccttcaggcttccaaaggctgccagaacaaagaacaaattctgcagcaaaggtttcgtaaggcctttagggacttccagcagtggctagtgaatgcgaaaatcaccacagctaagtgctttgacatccctcaaaacatatctgaggtgtcaacgtcattgcagaagattcaggaattcctgtcggaaagcgaaaatggccagcataaattgaatatgatgttgagtaagggagaacttctgtctacgctgttaacgaaggagaaggccaaaggcatccaagccaaagttacagccgctaaagaggattggaagaacttccacagcaatctccatcagaaagaaagcgccttggagaatctcaagatccagatgaaggactttgaggtgagtgctgagcctattcaagactggctctccaagaccgagaagatggtgcacgaatcttccaaccggctttacgatttgcctgcgaagcgcagggagcagcagaaactgcagagcgtgctagaggaaattcactgctacgagcctcaattgaacaggcttaaggagaaagcccagcagctgtgggagggccaggctgcctcgaagagttttcgccaccgagtctcacagctgtccagccagtaccttgcccttagcaacctgacgaaagagaaggtatcccgcctggataggattgtggccgagcacaatcaattttccctcgggatcaaggagttgcaagattggatgaccgatgcgatacacatgctggatagctattgccaccctacaagcgataagtccgtgttggatagcaggacactgaaactggaggccttactctctgtgaaacaggaaaaagaaatccagatgaagatgatagtgaccaggggagaaagcgttctccagaacacgtcacccgagggaatcccgactatccagcagcagctgcagtctgttaaggatatgtgggcaagcctgctgagcgcggggattcgttgcaaatcccaactggaaggcgccttgtccaaatggacgtcttatcaggatggcgtgcgccagttttccggctggatggacagcatggaggctaacttaaacgagtctgaacggcagcacgccgagctgagagataagactactatgctgggcaaggcaaaacttttgaacgaggaagttctctcttactctagtttgctggaaactatcgaggtgaagggggcagggatgaccgaacattatgtaactcagctcgaactgcaggatttgcaggaacggtaccgcgccatccaggagcgggcaaaagaggctgtgacgaaatctgagaagctcgtgaggctgcatcaagaatatcagcgagatctcaaggctttcgaggtgtggctggggcaggaacaagagaagctggatcagtactcagtattggagggagacgcccatacacacgaaacaacgcttcgagatttgcaggaactccaggtacactgcgctgagggtcaggcgctgctgaactccgtattgcatacacgggaggatgtgatcccttccgggatacctcaggccgaggaccgagcgcttgaatctcttcggcaggattggcaggcgtatcagcatcgactgtctgaaacccgtactcagtttaacaacgtcgtcaacaagctgagattgatggagcaaaagtttcagcaggtagatgaatggttaaagacagccgaagaaaagaagtggcatgaagaggtcactgcgtaccgcgacgaagtcgaagaagtcggcgccagggctcaggagatacttgacgagtcccatgtgaacagccgaatgggctgtcaagctactcaactgactagtcgttaccaggctttgcttcttcaggtcctggagcaaatcaaatttctggaagaagagatacaaagccttgaggagtcggagagttccctctctagctactccgactggtatggcagcacccacaaaaatttcaaaaatgtcgccacaaagattgacaaagtagacaccgtcatgatgggcaagaaattgaagacactggaggtgctgctgaaggacatggaaaagggccacagcctcctaaaatctgcgcgggagaagggtgagcgggccgtgaaatacctcgaagagggggaggctgaaagactcagaaaggagattcatgatcatatggagcagctgaaggaattgacaagcaccgtgcgaaaagagcatatgacattggagaaaggcctccatctcgccaaagagttcagtgataagtgtaaggctctgacacagtggattgccgagtatcaggaaattctacatgtgcctgaggaacccaagatggaactctatgagaagaaggcgcagttgtctaagtacaagtctctccagcagacagtcctctcgcacgaaccctccgtaaaaagcgtccgggaaaagggggaagcccttttggagctggtgcaagacgtgaccctgaaggataaaatcgatcagctgcagtctgattatcaggacctgtgctctatcggcaaggcaatgatggaagaaattgcaggtttcgaggataggctcaacaacctgcagatgaagggcgataccctgataggacagtgcgctgaccatcttcaggctaagctgaagcaaaacgtacacgctcatttacagggaacgaaggactcttatagtgccatttgtagcacagcgcagagaatgtaccagagtctagagcatgaactgcagaaacacgtgtccagacaggacactctgcaacagtgccaagcgtggctgagcgccgtccaacccgacctggagcccagcccccagcctccactgagcagagctgaggccattaagcaggtgaagcatttccgggcattacaggagcaggcccgcacctacctggacctcttatgtagcatgtgcgacttgtccaatgcgtctgttaagacaaccgcaaaagacatccaacagacagaacagactatcgaacagaagttagttcaggctcagaacctcacacagggctgggaagaaattaagcacctgaagagcgaactgtggatttacttgcaggatgccgatcagcagctccaaaatatgaaacgcaggcacagtgagctggaattgaacattgcacagaatatggtgtcccaagttaaggacttcgttaagaagctgcaatccaaacaagcttcagtgaataccataattgagaaagtaaacaaactgactaaaaaggaggaaagccctgagcacaaggagattaaccatctgaacgatcagtggcttgacctgtgcaggcagtccaataatctgtgccttcaacgcgaggaggacctgcaaaggactagagactaccacgactgcatgaatgtcgtggaggtttttctcgagaaattcaccaccgagtgggacaatctcgctcgatcggatgcggagtccaccgccgttcacctggaggctcttaaaaagttagcccttgccctacaggagcgtaagtacgccatagaggacctgaaggaccaaaagcagaaaatgatagagcacttaaacctggacgacaaggagctggtaaaggaacagacatcacaccttgagcagaggtggtttcagctggaagacctcatcaagcgaaagattcaggtctctgtgactaatctggaggagctgaatgttgtccagtccaggtttcaggaactgatggagtgggcggaggagcagcagcctaatatagccgaagcgctcaaacagagtcccccacctgacatggcccaaaatctgttaatggatcacctggcgatctgcagcgagctggaggccaagcaaatgctgttgaagtctttgatcaaggatgctgaccgggtgatggccgacctaggtctcaatgagcgccaggtcatccaaaaagcattaagtgatgcccagagccacgtgaattgcctcagtgacctggtgggccaacgccgaaagtatctgaataaggcactaagcgagaagacacaattcttgatggcggtgttccaagccacgtcacagattcagcaacacgagcggaagatcatgttccgggagcatatctgtctcctgcccgacgacgtatccaaacaagtgaaaacatgtaagtccgcccaggcatctctgaaaacgtaccagaatgaggttaccggtctctgggcacagggtcgcgaactcatgaaggaagttacggagcaggagaaaagcgaagtactggggaaattgcaggaactgcagtcggtatatgactcagtcctgcagaagtgtagtcaccggttgcaggagctagagaagaacctcgtgtcgagaaagcactttaaagaggattttgataaagcttgccattggctgaagcaggccgacatcgttaccttccctgaaatcaatttaatgaacgaatccagcgaactgcacacgcagcttgccaaataccagaatattcttgaacaaagtcctgagtatgagaacctccttcttaccctgcagcgaaccggacagacaattctaccgtccctgaatgaggtggatcactcttaccttagcgaaaaattaaacgcactgcctaggcaatttaacgtgatcgtggcactggctaaggataaattttacaaagtgcaagaagcaattttagcaagaaaagagtatgcaagtctcatagagcttactacccagtccctgagcgaactggaagcgcagttcctgaggatgagtaaggttcccacggatcttgccgtagaggaagcccttagtcttcaggacggctgccgggctatactcgacgaggtcgctggcctcggcgaagctgtggacgaattgaaccagaagaaagagggctttcggagcactggccagccttggcagcccgacaaaatgctgcacttggtcacattatatcacaggctgaaacggcaaactgagcaacgtgtatcactgctcgaggatacaaccagtgcataccaggaacacgaaaaaatgtgtcaacagctcgaaaggcaactgaagtctgtgaaagaggagcaatccaaagttaacgaggagaccctgcctgccgaggagaagttgaaaatgtatcacagcctggccggatccttgcaggactccggcattgtgctaaagagagttacaatccatcttgaggacctcgctcctcaccttgaccccctcgcatacgaaaaggctcggcaccaaattcagtcttggcagggggagctaaagctgctgaccagcgccatcggggagacagtcaccgaatgcgaaagcaggatggttcaatcaatcgacttccaaacggaaatgtcccgctctcttgactggctgaggagggttaaggcggaactaagtggaccagtgtacctggatctgaacctccaggatatacaggaggagatcaggaagattcagatccatcaagaggaagtgcagtcctcactacgaattatgaatgcactgagccacaaggagaaagaaaaattcacaaaggcaaaggagttgatctccgctgacctggaacactcgctggcagagctcagtgagctcgatggcgacatccaagaagcattgaggacacggcaggccaccttgaccgagatttactctcaatgtcaacgctattatcaggtctttcaggcagcaaacgactggcttgaggatgcccaggagttattgcagttggccggcaacggattggacgtggagtctgcagaggagaacttaaagtcgcatatggagtttttttctacagaggatcaattccacagtaaccttgaagaactgcatagtttggttgccactctggatcctttaatcaagcccacgggaaaagaggacctggaacagaaagtggcctccctggagctgagatcccagaggatgtccagggatagcggggcccaggttgatttgctccagcgatgtacagcccagtggcatgattaccagaaagcacgggaagaagtgatcgaactgatgaacgatacagagaaaaaactcagtgaattctccctgctgaagaccagctcttcccacgaagctgaagagaaactctcggagcataaggccctcgtgagcgtcgtgaattccttccatgagaagattgtggccttagaggagaaggcaagtcagttagagaagaccgggaacgatgctagcaaggctaccctctcccgttctatgactaccgtatggcagcgctggacccgtttacgagcggttgcccaggaccaggaaaagatcttagaggacgctgtggacgagtggacagggtttaataacaaggtcaagaaagccacagaaatgatcgaccagctccaggataaattacccggatcttctgccgagaaggcatctaaggcagaattactgaccctgttagagtaccacgacacttttgtcctcgagctggaacagcagcaatctgcacttggcatgcttcggcagcagacactgtccatgctgcaagacggggctgcacccacacccggggaggagccaccactgatgcaggagattacagctatgcaggaccgctgcctcaatatgcaggagaaggtgaaaaccaacggaaagctcgttaagcaagaattgaaggatcgggaaatggtggaaactcaaatcaattctgtaaaatgttgggtgcaggaaacaaaagaatacctgggtaatccgacaatcgaaatcgacgcccaattagaggaactacaaattctcctcacggaagcgaccaaccatcggcaaaatattgaaaaaatggctgaagagcaaaaagaaaagtacctgggtctgtacactatattaccgagtgagctgtccttgcagctagctgaggtggctctggacttgaagatccgggaccagatccaagataagattaaggaggtcgaacagagcaaagctaccagccaagagctgtctcgacaaattcaaaagctggcgaaggatctcaccaccatcctgactaagctgaaggctaagacagataacgttgtacaggctaaaaccgatcagaaggtgctaggagaggaactggatggctgcaactcaaagctgatggagctggatgcagcagtgcagaagtttttggaacaaaacgggcaactgggtaaacctttagctaaaaagatcggcaaactcactgagctccaccagcagacgatcaggcaggcggagaaccgcctgagtaaactgaatcaggcagcatctcatctggaagaatacaatgagatgctcgagctaatactgaaatggattgaaaaagcgaaggttctcgcccatggtaccatagcctggaacagcgcttctcagcttcgagagcagtacatccttcaccagacactgctggaagagtcaaaagaaattgactctgagcttgaagcaatgactgaaaaactgcaatacctgacctcagtgtattgtacagaaaagatgagccagcaagtcgccgagctcgggagggagacggaggaattgcgtcaaatgattaaaattcggctgcagaaccttcaggatgccgctaaggatatgaagaagtttgaagccgagctcaagaaactgcaagcagctctggagcaagctcaagctacgttaacgtcgcccgaagtgggtagattatccttgaaggaacaattgagccacaggcagcaccttttaagtgaaatggagagtctcaagcctaaggtgcaggccgtgcagctgtgtcagtctgccttacgcattccagaagacgtcgtggcttccttacccctgtgccatgcagcccttcggttgcaggaggaggcctctcgactccagcacaccgcaatccaacagtgcaatatcatgcaagctgctgtcgtccagtacgaacaatatgagcaggagatgaagcacttacagcagctgatcgaaggcgcccacagagaaattgaggataagcctgtggctacttcaaacattcaggagttacaggcacaaatttctagacatgaggagttggcccagaagatcaaaggctaccaagaacagatcgcttctttgaatagcaagtgcaaaatgttgacaatgaaggccaagcatgccaccatgctactcacagtcacggaagttgaaggattggctgagggcacagaggacctggacggggaactgctgcccaccccatccgcccaccctagcgtggtgatgatgactgcagggcgttgccacaccctgctcagcccagtgaccgaggaatccggggaggaaggtacaaacagtgagataagcagtcctcctgcttgcagaagcccctcacccgtggcaaacactgacgcatctgtgaaccaggatattgcctactaccaggcccttagcgctgagcggctgcagacagacgcagccaagatccacccttcaacctccgcttcccaggagttctatgagcccggactggagccatcggctaccgctaagcttggcgacttgcagcgatcctgggagactctgaagaacgttatcagcgagaaacagcgcaccttgtacgaggcgttggaacgccaacagaagtatcaagactccctccagtcgatcagcaccaaaatggaagctatcgagctgaagctttcagaatcaccagaaccagggagatcccccgaatcacaaatggccgagcaccaggcactgatggacgaaattctgatgttgcaagatgaaattaatgagctacagagttcgctcgccgaagaattagtctccgagtcttgtgaggccgaccctgccgaacagctggccctacagtccaccctcacggtgctggcagagagaatgtccaccatcaggatgaaagcctccggaaagaggcaattactggaggaaaagctgaacgaccaactggaggagcagaggcaggagcaagccctacaacggtatagatgcgaggccgacgaactagatagctggcttctttctacaaaggccactttggacacagcccttagccctcctaaggaacccatggacatggaggcccagctaatggattgccaaaatatgttggtggagatagagcagaaggtggtggccctgagcgagctcagtgtgcacaacgaaaatctgctcctggaaggcaaggcccacacaaaagacgaggccgagcagctcgccggcaaactccgccgtctcaagggctcactgttggaactgcagcgtgctctccacgataaacagctcaacatgcagggaaccgctcaggagaaagaggagagcgatgttgacctgaccgcgacccagtcacccggagtacaggaatggctggcccaggcccgaactacctggacgcagcagaggcagtcttccctacagcagcagaaagaactcgagcaggagcttgcggagcagaaatcactgttgaggagtgtggcaagcagaggcgaagagattttaatccaacacagtgccgcagagacctctggggatgcgggcgaaaagccagacgtgttgtcccaagagctgggaatggaaggagaaaagagctcagccgaagatcagatgagaatgaagtgggaatctttgcatcaggagtttagtactaaacagaagctgctgcagaacgtgctcgagcaggaacaagagcaggtcctatacagtcgcccgaataggttgttgtccggcgtgcctctttacaagggcgatgtgcctactcaagataaatcagccgtcacctctcttctggacgggctcaaccaggcattcgaggaagtgagctctcaatcgggtggggccaagaggcagtccattcacctagagcaaaaactctatgacggggtttcggcaactagtacctggcttgatgacgtggaagagcgactgtttgtggccacggctctgcttcctgaggagaccgagacttgtctgtttaatcaagagatactggctaaggacatcaaagagatgtctgaggagatggacaagaacaagaatctgtttagtcaggccttcccagagaacggcgacaacagagatgtaattgaagatacattaggatgcctgctgggacgcctaagccttctcgactcagtggtaaaccagcgatgtcatcagatgaaagaacgcctccagcagatcctcaatttccaaaatgacctgaaggtgctgttcacatccctagccgacaacaaatatattatccttcagaaactggcaaacgtgttcgaacaacctgttgccgaacaaatcgaggctatccagcaagcagaggatgggctcaaggaatttgacgcagggatcatcgagttgaaaagacgcggggataagcttcaggtggagcaaccaagtatgcaagaactgtccaagctgcaagacatgtacgacgaactgatgatgataatcgggtccagaaggagtggactcaatcagaatttgactctcaaatcccagtatgagcgagctttgcaggacttggccgatcttctggaaaccggacaggagaagatggcgggcgatcagaaaattatcgttagtagcaaagaagaaatccaacagcttctggataaacacaaagaatattttcaggggttggaatcccacatgatcctgaccgagacattgttccgaaagatcatttcatttgcagtgcagaaagagacgcaattccacaccgagctaatggctcaagcgtctgccgtcttaaagcgcgcacacaagaggggggtggaactggaatacatcctggaaacatggtctcatcttgacgaggatcagcaggaattgtcaagacaactggaggtagtggagtctagcatcccatctgttggcctagtagaggaaaatgaagatagactcattgacaggatcacattataccagcacctcaaatcttctctgaacgaataccagcccaaattgtatcaggtccttgatgacggtaagagattgctgattagtatctcatgctcagatctggaatcccagttgaaccagttaggggaatgttggcttagcaatactaacaaaatgagtaaagaacttcacagacttgagaccattcttaaacactggaccagataccagtcagagagtgccgacctgatccattggttacaatccgcaaaggatagattggagttctggacccagcagtcggtgaccgtgccacaggaacttgagatggtgagagaccacctgaacgcttttctcgaattttccaaagaggtggacgcgcagtcatcattgaagagttccgtcctgtctaccggtaatcagctcctcaggttaaagaaggtagacacagccactctgaggagtgaactgtcccgaatcgattctcaatggacagaccttctgaccaacataccggcagtccaggaaaaactccatcagctgcagatggataaactgccctcacggcacgcaattagtgaagtgatgtcctggatttcattaatggaaaacgttattcagaaggacgaggacaatatcaagaacagcatcggttacaaagcaattcacgaatacctgcagaagtataagggattcaagatcgatataaactgtaaacagctgacggtcgacttcgttaaccagtctgtactgcagatctcttctcaggacgtggagagtaaacgctcagacaaaaccgattttgccgaacaactcggagccatgaataagagttggcaaatcctgcaggggctagtcactgaaaaaatacagctccttgagggcctgcttgagagttggtctgagtacgaaaacaacgtgcaatgtctgaagacatggtttgaaactcaagagaaacgcttgaagcagcagcacaggatcggggatcaggctagtgtgcaaaacgccctgaaagactgccaggatctcgaggacctcattaaagccaaggagaaagaggtggagaagatcgaacagaacgggctggctttaatccagaacaaaaaggaagatgtgagttcaatcgtaatgagtactttgcgggagttaggccaaacttgggctaatcttgaccacatggtggggcaactcaaaatcctgctcaagtccgttcttgaccaatggtccagccacaaggtggcatttgacaagattaactcttatctgatggaggcccggtactctctgagcagatttcgcctgctcacaggtagtcttgaagccgtacaggtccaggtggataatctacagaatctccaagacgacctcgagaagcaggaaaggtccttacagaaattcggcagcattacgaaccagctgctaaaagagtgtcacccacctgtaacagagaccctgactaacactttgaaggaagtaaacatgcgctggaataacctactagaggagatcgctgaacagcttcaatcttcaaaggccctgctgcagctctggcagcggtataaagattatagcaaacagtgtgcatccaccgtgcagcaacaggaggacaggactaatgagcttcttaaggcagccacaaacaaggacatcgctgacgatgaagtcgctacctggatccaggattgcaacgacctcctcaaagggcttggcacagtgaaagactccctcttcttcttgcatgagctaggcgaacagcttaagcagcaggtcgacgcttccgccgccagcgcaatccaatctgaccagctatccctgtcccagcatctctgtgcccttgaacaggccctgtgcaaacaacagacaagcctgcaggccggagttctcgattatgagacatttgccaaatcgctggaggcactggaagcgtggattgtggaagccgaagaaatactccaaggccaggacccatcccactcttccgaccttagcacgatccaagagcgcatggaagagctaaaggggcagatgttgaagttcagtagtatggctccagatctcgatagattgaatgagctcggctaccgcctgccattaaatgacaaggaaatcaaacgaatgcagaacttaaaccgccattggagcctcatctccagccagactaccgagaggttttccaaattgcagagctttttacttcagcatcaaacattccttgaaaagtgcgagacctggatggaatttcttgttcagactgagcaaaagcttgcggtggagatctctggaaactaccagcatttgctcgagcagcagagagcccatgagttgtttcaggccgagatgttctcccgtcagcagattctacactctatcatcatcgatggccagagacttttggaacagggccaggtcgacgaccgagacgagttcaatttgaagctgacgttactttccaaccagtggcagggggtcattcgaagggcgcagcagcgccggggcattattgactcccagatcaggcagtggcagcgctatagggaaatggccgagaaactgcgtaagtggcttgtagaggtttcatatctccctatgtctggtctcggaagtgtgcctatcccattgcagcaggcacggaccctattcgatgaagtccagtttaaggagaaggtcttcctcaggcaacagggatcctatatcctcacggtcgaggccggcaaacagctgttgttatcagccgattcaggagcagaggcagcccttcaggccgagttagcggagatccaagagaagtggaagagcgcatcaatgaggcttgaagagcagaagaaaaaacttgcctttctcttgaaagactgggagaaatgcgagaaagggatcgcagacagcctggagaagctgcgtacattcaaaaaaaagctgagccagtcacttccggatcatcacgaggagctgcacgctgagcagatgcggtgcaaagaacttgagaacgcagtggggtcttggacggacgacctcacccagctgagtctccttaaggatactctctcagcctacatatccgctgacgatatcagtatacttaacgaaagagtggagctgttacaaagacagtgggaggagttatgccatcagctttcattgaggcgacagcagatcggagaaagactcaacgaatgggctgtgttttctgagaagaacaaagagctgtgtgaatggctgactcagatggaatccaaagtgtcacagaatggagatatacttatcgaggaaatgattgaaaaactcaagaaagattatcaagaagagatcgcaatagcccaggagaacaagattcagctccaacagatgggggaacgactggcgaaagcctctcatgagagcaaagcctcagaaatcgagtataaactgggcaaggttaatgacaggtggcaacacctactggatcttatcgctgcacgggttaaaaaactgaaggaaaccctcgtcgctgttcaacagcttgataagaatatgagcagtctgcggacctggcttgctcatattgagagcgaattggccaaaccaatagtgtacgacagctgtaattctgaggaaatacagcgcaagctcaacgagcaacaggagttacaaagggatatcgaaaaacatagcactggcgtggcgagcgtgctgaacctgtgcgaagtcctcctgcatgactgtgacgcttgtgctacggatgctgaatgcgattccatccagcaggctactagaaacttagacaggagatggcgaaacatttgtgctatgtcaatggaacgcaggttaaagatcgaggaaacatggagactgtggcagaaatttcttgacgactacagccgtttcgaggattggttgaaatctagcgagaggactgccgcttttcccagcagttctggggtgatctataccgttgcaaaagaagagctgaagaagttcgaggcattccagaggcaggtgcatgagtgtctgacccagctagaactgatcaataagcagtacagacgcctcgcacgcgagaatcggacggactccgcttgctccttgaagcagatggtgcatgaaggcaaccagagatgggataaccttcaaaagcgagtgacaagtattctgcgcagactgaaacacttcatcgggcagagggaagagttcgagacagcccgcgatagcatcttggtgtggttgactgagatggaccttcagttgactaatatcgaacatttctcggagtgcgacgtgcaggcaaagattaaacagctgaaagcttttcagcaggaaatctccctgaaccacaataaaattgaacaaataatcgcccagggggaacagctaatcgaaaagagtgagcctttggacgccgcaattatagaggaagaactcgatgagttacgtcggtactgccaggaggtattcgggcgggttgagaggtatcacaagaagctgattagactcccacttcccgatgatgaacacgacctgtctgatagagagctcgagctggaagattcggccgcattatcagacctgcactggcacgaccgctctgcagactccctgctctctccccaaccttcctctaacctgtccctgtccctggcccagcctctgaggagcgaaaggtctgggagagacaccccggcatccgttgatagcattccactcgagtgggaccatgactacgacctgtccagggatctggaatcagccatgagcagggcactgccaagcgaagacgaggagggccaagacgacaaagatttctacctgcgaggcgcagtgggactgtctgatgttatgattccagagtcccctgaagcctatgtaaaactgacagagaacgcaattaaaaacacctctggcgatcactcagctctggagtctcagataagacagctggggaaagccctggatgactctcggttccaaattcagcaaactgagaatatcattcgaagcaaaacgcccaccggacccgagcttgacacttcctacaaaggatacatgaagctgttaggtgagtgctccagctcgatcgatagtgtgaagagactggagcacaaactgaaagaagaggaggaatcactgccaggtttcgtcaatctgcattccactgagacacagacggccggcgtgatcgaccgctgggagctgttgcaggctcaggccttaagtaaagagctgaggatgaaacagaatctgcagaagtggcaacagttcaacagcgacctgaatagcatctgggcctggttgggagatacagaggaagagctggagcaattgcagcgtttggagctcagtacagatatacagacaattgagttacaaatcaaaaaactcaaggagctgcaaaaggcggttgatcatagaaaggccatcatcctgagcattaatctgtgctcaccagagtttacccaggcagactctaaagagagcagggacctacaagatagactgagtcagatgaatggaaggtgggatagagtgtgtagcctcttagaagagtggcgtgggcttttgcaggatgcactgatgcagtgccagggctttcacgagatgtcccatgggctattactcatgctcgagaatattgaccggcggaagaatgagatagtacctatcgactctaacctggacgctgagatactccaggatcaccacaagcagctgatgcaaatcaaacatgaactacttgagagccagttgcgcgtggcgagcctacaggacatgtcttgtcaactgttggtcaatgccgagggtactgactgtctggaagcaaaagagaaagtccatgtaatcggcaaccgtctcaagctgctgctgaaagaggtgtccagacacatcaaggagctcgaaaaactgctggacgtgtcatcatcccagcaggatctgtctagttggagttccgccgatgaattggatactagcggctctgtaagccctaccagcggaaggtctaccccaaatcggcagaagactcctcgcgggaagtgctccctctctcagcctggaccatctgtaagttcaccgcattcaagatcaacaaaggggggctcagattcctccctaagcgagccaggtcccggtcgctcagggaggggttttttgtttcgggtgctgagggccgccctccccctacagctgcttctcttgctattaatcggactcgcgtgcctggtcccaatgagtgaggaggattacagttgcgccctgtccaataacttcgctaggtcgtttcacccaatgttgagatacactaatggcccccccccactctag

SEQ ID NO: 206672 - DNA, 26250 bp, Artificial Sequence
  Description of Artificial Sequence: Synthetic coding sequence
atggccaccagccggggcgccagccggtgcccccgggacatcgccaacgtcatgcagagactgcaggatgaacaagagatcgtccagaagagaacattcaccaagtggatcaatagccatctggcaaagcgtaagcccccgatggtagtagatgatctgttcgaagatatgaaggatggagtaaaactgttggcccttctggaagtgctttctggacagaaactcccttgcgaacagggtcgtcgaatgaaacggatccacgcagtggctaatatagggacggcactcaaatttctggagggaagaaaaagtatgcatcgcggctcacccatcaagctcgtgaatattaactctacggacatcgccgacgggcggcctagcatcgtgctgggactgatgtggacaatcatcctgtacttccagatcgaagaactaacaagcaacctgcctcaactccagtctttgtcttcgtccgcttcctctgttgactcaattgtgtccagcgaaaccccttctccaccctcaaaacggaaggtcaccactaagattcaaggcaatgccaagaaggcattgctgaagtgggtccagtatacagcgggcaagcagaccggtattgaagtaaaggactttggcaaatcttggagaagtggcgtcgcattccattccgtaattcacgcaattagaccagagttggtggacctggagacagttaaggggagatctaatcgggagaatctcgaggacgcctttacaattgccgagaccgaactgggcatacccaggcttctagatccggaagatgtggacgtggacaaacccgatgaaaagtcaattatgacatacgtggctcaattcctcaaacactatcccgacatacataacgcatctaccgatggtcaggaagatgacgagatcctgccgggttttccctcattcgctaactccgttcagaatttcaagcgtgaggatcgggtcatcttcaaggaaatgaaggtgtggattgagcaatttgaacgagatctcacccgcgcacaaatggtcgagtcaaatttgcaggataagtaccagagcttcaaacatttcagggtgcagtatgaaatgaagcgcaagcagattgaacatctgatccagcccctccatcgcgacgggaaactgtccttggaccaagctctagtgaagcaatcatgggatagggttacctccaggttattcgattggcacattcagctggataaaagccttccagctcctctgggtaccatcggcgcctggctgtaccgcgctgaggttgcactcagagaggagatcactgtgcagcaggttcacgaagaaacggccaataccatccaacgcaaattggaacagcataaggacctgctgcaaaacactgatgcacacaagcgggcttttcacgagatctatcgcacacggagcgtcaatgggatccccgtgcctcccgatcagttagaggatatggccgagaggtttcacttcgttagctcgacttcagagctgcacttaatgaaaatggagtttttggagctgaagtaccgtctcctctccttgctggtgctcgcagaatccaaactgaaaagttggattatcaaatatggacgccgagagtctgtggagcagctcttgcagaactacgtgtcatttattgagaatagtaagttctttgaacaatacgaagtcacttaccaaatcttaaaacagaccgccgaaatgtatgtgaaagccgacggatccgtagaagaggccgagaatgtgatgaagttcatgaacgagactactgcccaatggcggaacctgtccgttgaggttagatctgtgagatcaatgctggaggaggttatctctaactgggaccgctatggtaacaccgtcgctagtctgcaggcctggctggaggacgctgaaaagatgttaaaccaatcagagaatgcaaaaaaagactttttccgcaacctgccacactggatccagcaacacactgcgatgaacgacgccggcaactttctgattgaaacatgcgacgagatggtttcccgggacttaaagcaacaactgttgctgttgaatggtcgctggagagaattgtttatggaggtaaaacaatatgcccaggcggacgagatggaccgcatgaagaaagagtataccgattgtgttgtaacgctctcagccttcgcgacagaagctcacaaaaagctctcggaacctctagaggtgagctttatgaatgtgaagcttctgattcaggaccttgaagacattgaacaaagagtccccgtgatggacgcccagtacaagatcattaccaaaactgctcacctcatcaccaaagagtctccacaagaggagggaaaggagatgttcgcaacgatgagcaaactcaaggaacagttaaccaaagtgaaagagtgctactctcctctcctctatgaatcgcagcaactactcattcccctggaagaattggagaaacagatgacctctttctacgatagcctcggaaagattaacgagataatcacagtgctggagcgagaggcccagagcagtgctttgttcaaacagaaacatcaagaactgctggcatgccaggagaactgcaagaagacgctcacgctcatcgagaagggatcccagagtgtgcagaagttcgttaccctcagcaacgtcctgaaacactttgatcagactagactgcaacgccaaatcgctgacatccacgttgcatttcagagcatggtgaaaaaaactggggactggaaaaaacatgttgagaccaatagccggctgatgaagaaattcgaagaatctcgagccgaactcgagaaggtgctgcggatcgcacaggaagggttagaagagaaaggggacccggaggagctcctgcgcaggcataccgaattcttctcccaattagatcagcgagtgctgaatgcattcttgaaggcatgcgatgagctgaccgatatcctgcccgagcaggaacagcagggtctgcaagaagccgtgcgaaagctgcacaagcagtggaaggaccttcaaggcgaggccccataccaccttcttcatctaaagatcgatgtcgaaaagaaccgattcctggccagcgttgaggaatgcaggacagagctcgatcgggaaacgaaactcatgccgcaggagggctctgaaaagattatcaaggaacatagagtgtttttcagcgacaagggaccacatcacctctgtgagaaaaggcttcagcttattgaggagctctgcgtcaaacttccagtgcgggatcctgttagggatactccaggaacctgccatgtcactctaaaagagctgagggctgccatagacagcacataccgcaagctcatggaagatcctgataaatggaaggactataccagccgctttagtgaattttcctcctggatttccaccaacgagacccaactgaaggggatcaaaggagaagctatagacaccgccaaccacggtgaggtaaagcgtgccgtagaggagatcaggaatggggttactaagaggggggaaactttgagctggcttaagagtagacttaaggtccttaccgaggtgtccagtgagaacgaagcccagaaacagggcgacgaattggcaaagctttcctcatcattcaaagccctggtgaccctgctgagcgaggtggagaagatgttatccaacttcggcgactgtgtacagtacaaggagattgtcaagaacagtctcgaggaactgatttccggatctaaggaggtccaggagcaggccgagaaaattttggatactgagaacctctttgaggctcagcagctgttgctccatcatcaacaaaagacaaagcggataagtgccaagaagcgggacgtgcagcagcaaatcgcacaggcacaacagggcgagggcgggttgcctgatcgtgggcacgaggagctgcgcaaactcgagtcgacactcgatggcctggaacgcagtcgggagcggcaggaacgaagaatacaagtgaccctaagaaaatgggagcgttttgagacaaacaaggagactgttgtgcgctacctctttcaaaccggctcttcgcatgagaggttccttagtttcagtagtttggagtccctgtctagcgaattagagcagacaaaggaattctcaaagcgtactgagagcatcgcagtgcaagccgaaaacctggtcaaggaagcatccgagatcccgctaggacctcaaaataagcagctgctacagcagcaggccaagtctatcaaagagcaggtgaaaaagctcgaggataccttggaagaagatataaaaacaatggagatggtgaagacgaagtgggaccacttcgggagcaactttgagacactgtctgtgtggattaccgaaaaagagaaggaactgaatgctttggagacatcctcttctgccatggatatgcagatctcacaaatcaaggtcaccattcaggagatcgagagtaagctctcgtctatcgtcggacttgaagaggaagcccagagctttgcccagttcgttactactggagagtctgcacggatcaaggcaaaattaacacaaatcagacgctatggcgaagaactgagagagcatgcccagtgcctcgagggaacaatcctgggccacttgagccagcagcagaaattcgaagagaatctgcgcaaaatccagcagagcgtaagtgaattcgaggacaagctggctgtacccatcaagatctgttcttccgcgaccgaaacatacaaggtgctgcaggagcatatggatctttgtcaggccctcgagagcctgtctagtgccatcactgccttctcggcgtcggctaggaaggtcgtgaaccgagattcttgcgttcaggaggccgcggccctgcaacaacaatatgaggacatccttagaagagctaaggaaaggcagaccgctctagaaaatctcttggcacattggcagcggctggagaaggaactctcctccttcttaacatggctcgagcggggggaggctaaagccagctccccagagatggatatatcagccgaccgcgtgaaggtggaaggcgagctgcagctcatacaggcctcgtccaggaagtttgtgagccaggctagcttttatagcaaacttctgcagctgaaagagtcactcttctccgtcgcctctaaggacgacgtgaagatgatgaagctgcacctggagcaacttgatgaaagatggcgcgaccttccccagatcatcaataaacgcatcaattttcttcagtctgttgttgccgaacaccagcaattcgacgagttgctgctttccttttcagtgtggatcaaattatttctctccgaattgcagacaaccagcgagattagcattatggaccaccaggtggccctgactaggcataaagaccatgctgcagaggtcgagagcaaaaagggagagctgcaatctctgcaaggtcatctggccaagctaggaagccttggacgcgcagaagacctccatctgctgcaagggaaagccgaagactgcttccagctctttgaagaggcctctcaggtggtcgaaaggcggcagctggcgctgagccacctcgcagagtttctgcagtctcacgcttcgctatctggcatattaaggcagctgcgtcagaccgtcgaggctactaactccatgaataagaatgagagtgacctcatcgagaaggatttaaatgatgctttgcaaaacgccaaagcgctggaatcagctgccgttagcctggatgggatactatctaaagctcagtaccacctgaaaataggcagttccgaacaacggacttcatgccgtgccacggctgaccaactctgtggcgaggtggagaggattcaaaacctgttagggaccaaacaaagcgaagccgatgccctggcagtgctgaaaaaagcattccaggatcagaaagaggagctgcttaagtctattgaggacatcgaggaacgaaccgacaaagagcgcttaaaggaacccaccagacaggctctgcaacagagattgcgggtgtttaaccagctggaggacgagcttaattctcacgaacacgagctgtgttggctgaaagataaggccaagcaaattgcacaaaaggatgtcgccttcgctccagaagtggacagagagatcaatagactagaagtgacttgggatgacacaaagcgactgatacacgaaaatcagggccaatgctgcggcctgatcgatttgatgagggaataccagaatctcaaatcagccgttagtaaggtgctggagaacgcctcatccgtgattgtgacccgcacaacaattaaggaccaggaggacctcaaatgggcattttctaagcacgagaccgcaaaaaataaaatgaactataagcagaaggacctggacaactttacctctaagggtaagcatctgctgagcgagctgaagaagattcacagcagtgacttttccctcgtaaaaacagatatggaatcaacagtcgacaagtggcttgatgtgagtgaaaaattggaggaaaacatggaccgcctgcgggtgagtctgtcgatttgggacgacgtcctgtcaacaagggatgagatcgagggttggtctaacaattgcgttcctcaaatggccgagaacatcagtaacctcgataaccacttgagggcagaggagttgttgaaagaatttgaatcggaggtcaagaataaggctctgaggctggaggaactgcacagcaaagtgaatgatctcaaggaactgacaaaaaatctcgaaaccccccccgacctgcagtttattgaggcagatctgatgcaaaaactggaacacgccaaggagattaccgaagtggctaagggaaccctgaaggacttcactgctcagtcgacacaggtggagaaatttataaatgatatcaccacgtggtttacgaaagtcgaagagagcctgatgaattgcgcacagaacgaaacatgcgaagccctgaaaaaagttaaagatattcagaaagaattacagtctcagcagagcaacattagcagcactcaggaaaacctgaactccctgtgtcgaaagtatcactcagcagagctcgaatcattaggtcgggcgatgactgggctgatcaaaaaacacgaggctgtgagccagctatgttcaaaaacacaggctagccttcaggaatcactcgaaaaacatttcagcgaatctatgcaggaatttcaggaatggttcctgggcgcgaaggcagcagcgaaagagtccagcgaccggaccggagacagcaaggtgctggaggctaagctgcacgatctacaaaatatcctggactcagtttccgatggacagagcaaactggacgcggtgacgcaagaagggcagaccttgtatgcccatctttccaagcagatagtgtcaagcatccaagagcagatcaccaaggctaatgaggaattccaagcattcctcaaacagtgcctcaaggataagcaggccttgcaggattgcgcaagcgaactcgggtcatttgaggaccaacataggaagttgaatctgtggatccacgaaatggaggaacgattcaacacagagaacctgggcgaaagcaagcagcacattcccgagaaaaagaacgaggttcacaaggttgagatgtttctaggcgagttgctcgccgcaagagagagtctggacaagctttcccagagaggtcagttactgtctgaggaaggacacggggccggccaagaggggaggctgtgctcccaattgttgacgtctcatcagaacttattgagaatgaccaaggaaaagctgcgctcctgtcaagtggcactacaggaacacgaggccttagaggaggcattacagagcatgtggttctgggttaaagctatccaggacagactggcttgcgctgagtctacgcttggctcgaaagacaccctggagaaacgtctgagccagattcaggatatacttctcatgaagggcgaaggggaggtaaagttaaacatggccattgggaaaggagaacaggcactgaggtcatccaacaaggagggccagcgtgtcattcaaacccagctggagactttgaaagaagtttgggccgatattatgtcatcatctgtacatgcacagtcaacactcgagtctgtcatctctcaatggaacgactacgtggaacggaagaaccagctggaacagtggatggaaagcgtagatcagaaaattgagcaccccctgcagccccagcctggcctcaaggaaaaatttgtactcctcgatcatctacagtcaatccttagcgaggcagaagatcatacgagggccctccaccggcttatcgccaaatcccgtgagctttacgagaagaccgaggacgagtccttcaaggatacggcccaggaagaactcaagacccaattcaacgatataatgacagtggcaaaggagaaaatgcgcaaggtggaggaaattgtgaaagatcatctgatgtatcttgacgccgtccatgaattcacagactggctccactctgccaaagaagagttacatagatggtctgacatgagtggagatagttctgcaacgcagaaaaaactcagcaaaataaaagaattaattgattcccgggaaatcggagcatcaaggctgagcagagtggagtccttggctccggaggtcaaacaaaatacgacggcttctggatgtgaactgatgcacacagaaatgcaggctcttagagctgattggaaacaatgggaagacagtgtgtttcagacacaaagctgccttgagaatttggtgagtcagatggcattgtctgagcaggagttctcgggacaggtagcacagctggagcaggcccttgagcagttctctgcattgctaaaaacttgggcccaacagttgaccctgcttgagggcaagaatacggatgaagagatcgtcgagtgctggcacaagggccaggagattctggatgccttgcagaaagcagagccacggaccgaagacctgaaatcccagctgaacgaattatgccggttttctagagacttatctacctacagcggaaaggtgtctggactgatcaaggagtataactgtctctgtctgcaggctagcaaaggctgccaaaacaaagagcagattctccagcagcgctttagaaaggccttccgggacttccagcagtggctcgtcaatgcaaaaattaccaccgccaagtgttttgacatccctcagaatatatccgaggtttccacatccctacagaaaatccaggaattcttgagcgagtccgagaacggccaacataagcttaatatgatgcttagtaaaggggagctgctttcaaccctcctgactaaagagaaagccaaggggattcaggccaaagtcacagccgcaaaggaagattggaaaaacttccattccaacttgcaccagaaagagtctgcactagagaatttaaaaattcagatgaaagactttgaagtctctgccgaacctatccaggattggctgtccaagacggaaaagatggtccatgaatcgtcaaataggctctacgacctccctgccaaaagaagggaacaacagaaattacagagtgtcttggaggagattcactgttatgagccccagctcaatcggctcaaggaaaaggcacaacagctgtgggaaggccaggctgcatccaagtcctttagacaccgcgtctctcagctcagcagccagtatctggcactctccaatttaacaaaggaaaaagtgtcacggcttgaccgtattgtcgctgagcacaatcagtttagcttaggaataaaggaactacaggactggatgactgacgcgatccacatgctagactcctactgccacccaacatcagacaaatctgtgctggatagcaggacactgaaactggaggcgttattgagtgttaaacaggagaaagaaatccagatgaagatgatagtgacaagaggcgaatctgttctgcagaatacttcacccgaaggaattccgaccattcagcagcaactgcaatccgttaaggacatgtgggcttccctgctgagtgcaggcatcagatgtaaatctcaactggaaggggccctgagcaaatggacaagctaccaggatggtgttcgccaattttcggggtggatggactccatggaagcgaatctgaatgaatccgagcggcagcacgcagagttacgtgacaagacgactatgctagggaaagccaagcttcttaacgaggaagtcctaagttattcctctctgttagagaccattgaagttaagggggcagggatgacggaacactacgtaacgcaactcgaactgcaggatcttcaggagaggtatcgcgctatccaggaaagggccaaggaggcggttacgaaatcagaaaaacttgtgcgactccaccaggaatatcagagagatctgaaagctttcgaagtttggctgggccaggaacaggaaaagctggatcagtattctgtgctagaaggcgacgcccatacccacgagacgactctgcgggatttgcaagagctgcaggtccactgtgcagaaggccaagcccttctgaactctgtgctgcataccagggaagatgtgatcccctccggtatacctcaggccgaggacagggccctggagagccttcggcaagactggcaggcataccagcaccgcctgtcggaaacacgaactcaattcaataatgtcgttaacaaattacgtttgatggaacagaaattccagcaggtggacgaatggctcaaaacagctgaagaaaaaaagtggcacgaagaggtgactgcataccgggacgaagttgaggaggtgggggccagggctcaggaaatactcgatgagtcccacgttaacagtaggatgggatgtcaagctactcagctgacttcccgataccaggcactactactccaggtgttggaacagatcaagtttctggaggaggagattcaatcgctcgaggagagcgaaagcagtctgtcctcctactctgattggtatggcagcacacataaaaatttcaagaacgttgctactaagatcgataaggttgacacagttatgatgggtaagaagcttaagacattagaggtgctcctgaaagacatggagaagggccacagtctgctgaagagcgcccgcgagaagggggaacgagccgtcaagtatctcgaagaaggcgaagccgagcgactgaggaaggagatacatgatcacatggaacagttgaaggaactcacaagcacagtccggaaggagcacatgaccttggagaaaggtctgcacctggcaaaagagttttctgataagtgtaaggccctgacacagtggattgctgagtaccaggaaatcctgcacgtaccagaagaaccgaaaatggaactctacgaaaagaaagcacagctcagcaaatacaaaagtctccagcagacggtactcagtcatgaaccctctgtgaaaagcgtcagagagaagggtgaggcacttctggaattggtccaggatgtgactctgaaggacaaaatcgaccaattacagtctgattatcaagacctttgctctatcggaaaagctatgatggaggagatcgccgggttcgaagaccggcttaataaccttcagatgaagggagataccctcataggacagtgtgccgatcacttgcaggctaaactgaaacagaatgtgcacgctcatctccagggcacaaaagactcctactccgcaatctgctcaacagcccagcgcatgtaccagagccttgaacacgagctgcaaaaacacgtgagccgccaggatactttgcagcaatgccaagcctggctctcagccgtacagcccgacttggagccgtctccccaacctccgctgagccgcgccgaagcaatcaaacaggttaaacacttccgagctttgcaggagcaggcaagaacctacctggacctcctgtgctctatgtgcgatcttagtaacgccagtgtcaagactacggcaaaggatatccagcagaccgagcaaaccatcgaacagaagctggtccaggcacagaacttaacccagggctgggaagaaattaagcatctgaaatccgagctctggatatacctgcaggatgcagaccagcaactgcagaatatgaaacgaagacacagcgaactggagctgaatatcgctcaaaacatggtgagccaggtaaaagactttgtcaagaagttgcaatcaaagcaagccagcgtcaacactatcatcgaaaaagtgaacaaactgaccaaaaaagaggagtcacctgaacataaggagataaatcatctgaacgatcagtggcttgacctttgcagacagagcaacaacctgtgcctccaaagggaagaagatttacaacggacccgagattaccatgactgcatgaacgttgtggaagtattcctggagaagtttacaactgagtgggataacctcgcgaggtccgacgcggagagcacagcagtccacttagaagctctgaaaaaactcgccctcgccctccaggagcggaaatatgcaatcgaagatctcaaggatcagaagcagaagatgattgaacacctaaatctggatgataaagagctggtgaaggagcaaacttcccacctagagcagcggtggtttcaactggaggacctgatcaaaagaaaaattcaagtgagtgtgaccaacctggaagagctgaacgtggtgcagagccggttccaggaattaatggaatgggctgaagagcagcagcccaacatcgcagaggccctcaagcaatccccgcctcccgacatggcacagaacctactgatggatcacctggccatctgtagcgaactggaagctaaacagatgctactgaaatctctgataaaggatgcagacagagtcatggcagacttgggccttaacgaaaggcaggtgattcagaaggctctcagcgacgcccaaagccatgtgaattgtctgtccgaccttgtgggccagagacggaagtacttaaacaaagcactgagcgaaaagacccagttcttgatggcagtgttccaagccacgtcacaaatccagcaacacgaacgcaaaatcatgttcagagagcacatttgtctactcccagatgatgtttcaaagcaggtgaagacatgtaagtccgcacaggcaagcctcaagacctaccagaatgaggtcactggattgtgggcgcaggggcgcgaattgatgaaagaagttaccgaacaggagaaatctgaggttctcgggaagctgcaggaacttcaatctgtttatgactcagtgctgcagaaatgttcgcatagactgcaagagctcgagaaaaacttggtttccagaaaacattttaaagaagacttcgacaaggcttgccactggcttaaacaggcggacattgtgacttttcccgagattaacctgatgaacgagtcctccgaattacacacacagttggccaaataccagaacatcttagagcagtctcctgaatacgaaaatttactactaacactacagaggaccggacagaccatactgccatcactaaatgaggtggatcattcatacctgtctgagaaactgaacgctttgcctcggcagttcaacgtaattgtcgcactagctaaagacaagttctacaaggtccaggaggctatactggcacgtaaagagtacgcctctcttatcgaactgacaactcagagcctctctgagctggaggcgcaattccttaggatgagcaaagtgcccaccgatctagcagtggaggaggctttgagcctccaagatggatgcagagccatcctggacgaggtagcagggctgggcgaagctgtcgatgaattgaatcagaagaaagaggggttccgttcaaccggccagccctggcaacccgacaaaatgctgcacctcgtaaccctatatcaccgcctgaaaagacagacagagcagcgcgttagtctcttggaagatacgacaagcgcttatcaggagcatgaaaaaatgtgccagcagctggagagacaactgaaatccgtcaaagaggagcaaagcaaagtgaacgaggagacactgcccgctgaagagaaactcaaaatgtaccacagtttggctggaagtctgcaagatagtggtattgtgcttaaaagggtgaccatccatttggaagacctggccccgcatctggacccgctggcgtacgagaaggccagacatcagattcaaagttggcagggcgaactcaagctgctaactagtgctatcggtgagactgtcaccgagtgtgaatccagaatggtgcagagcatcgatttccaaacggagatgtcccggtctctggattggctccgaagggtgaaagccgaattgagcggacccgtctacttagacctgaacctccaagatatacaagaggagattcgtaaaatccagatccaccaagaggaagttcagagctccctgcgaataatgaacgccttgtcacacaaggaaaaggaaaaatttaccaaggccaaagaactaatatccgcggatctggaacactcgctggccgagttaagtgaactcgatggagatatacaggaggccctgcggaccaggcaggcaaccctgacagaaatatactctcaatgccagaggtactaccaggtgtttcaggccgccaacgattggctggaagatgctcaggaactcctgcaattagcgggaaacgggttagacgtcgagagcgccgaggagaacctcaagtctcatatggaattcttttcaaccgaagaccagttccacagcaacctggaagaactgcacagcttagtggccacattagatccactcatcaagcccactggaaaagaggacctggagcagaaggtggcatctctcgagctgagaagccagaggatgtccagggatagtggcgcccaggtggacctgcttcagcgctgcactgcccagtggcatgattatcagaaagcgcgcgaggaagtaattgagctcatgaatgatacagaaaagaaactgagcgagttttccctgctgaagacttcttctagccatgaggccgaggagaaactttcagaacacaaggccctggtaagcgtggtgaacagctttcatgagaaaatcgttgccctggaggaaaaagccagtcagttggaaaaaactggcaatgatgcatcaaaagccacactgtcacggagcatgacgaccgtctggcagcggtggacaaggctacgagctgtcgcacaggaccaggagaagatcctcgaggacgcagtggacgagtggactgggtttaacaataaggttaagaaagctaccgagatgattgaccagctgcaggataagctgcccgggagctccgccgaaaaggcttctaaggcggagttgctgacgctgcttgaatatcacgacacattcgtgctggaactagagcagcagcagtctgctctcggcatgttaagacagcagaccctctccatgctccaggacggcgccgcacccactccgggcgaagaaccgccattgatgcaagagatcacagccatgcaggataggtgtctaaatatgcaggaaaaagtaaaaactaacgggaaactcgtaaaacaggaactgaaggatcgtgagatggtagaaacccagattaactcagtgaagtgctgggtgcaagagacgaaagagtacctcgggaaccctacgatcgagattgacgcacagctggaggagctccagatactgctgaccgaagccaccaaccaccgacagaacattgagaaaatggctgaggagcagaaagaaaagtatctcgggctctataccatccttcccagtgagctgagcctgcagctggccgaggtggctctcgatcttaagattcgtgatcagatccaggacaaaattaaagaagtggaacagtccaaggctacctctcaagagttgtcccgccagatccagaagctagcaaaagacctgacgaccatcttgactaaactcaaagccaagaccgataacgtagtgcaagccaagaccgatcagaaagttctcggggaagaactggatggctgcaactccaagctgatggagctggatgccgcagtacagaagttcctggagcagaacggacagctgggaaaaccgcttgccaagaagatcgggaaattaaccgagctgcatcagcaaactattcggcaagcagagaaccggctgagtaaactgaaccaggccgcaagccacctcgaagagtacaacgagatgcttgagttaatcctgaagtggatcgagaaggccaaggtgctggcccatggaacaatcgcatggaacagcgccagtcagttaagggagcagtacatcctccaccagacactattagaggagtctaaggagatagactcagaattagaggccatgaccgaaaagctgcaatatcttacttccgtgtactgtaccgaaaaaatgtcacagcaggtagccgaactaggacgcgagaccgaagaattacgccaaatgatcaaaattcgacttcaaaatctgcaagacgcggctaaagacatgaaaaaatttgaggccgagctgaaaaagctgcaagccgcactggagcaagcccaggcgaccctgacatccccggaagtggggaggctgagcctaaaagagcagctgtcacacaggcaacacctgctgtccgagatggaatccctgaagccgaaggttcaggccgttcagctgtgccaatccgcgttgagaattcccgaggacgttgtggcttccctgccgctgtgtcacgctgcacttaggcttcaggaggaggcctctagactccagcacaccgctatacagcaatgcaacattatgcaggccgccgtggtgcagtatgaacagtatgaacaggagatgaaacacctgcagcagctcattgaaggtgcgcatcgggagattgaagacaaacctgtggcaacatctaatatacaggaactgcaggctcagatctctaggcatgaggagcttgctcaaaagataaagggctaccaggagcagatcgcaagcctcaacagcaagtgtaaaatgcttactatgaaagccaagcatgccacaatgcttcttaccgtgaccgaggtcgaggggctggctgagggcaccgaagacctagatggggaactgctgcccacaccttccgcgcacccttccgtggtgatgatgacagcagggcgctgccacactcttctgtctccagtgacagaagagagcggggaggaaggcaccaacagtgaaattagcagccctcccgcctgcagaagcccatccccagtggctaacacagatgctagcgtcaatcaggacattgcctattaccaggccttatctgcggagcgactccagaccgatgcggccaagatccatccaagtacctctgcctctcaagagttctatgaaccaggtttggagccgagtgcaactgcaaagctgggggacctccagcggtcttgggagacactgaaaaatgtgatatctgagaaacagcgcacgctttacgaagctctcgaacgacagcagaaataccaggactcgttacaatcaatttcgacaaaaatggaagcaatcgaattgaagctgagtgaatcccccgagcccggtaggtctcctgaaagccaaatggcagagcatcaggcccttatggacgagatcctcatgctccaggatgaaatcaacgagctgcaatcctctctggcggaagaattggtcagcgaaagctgcgaggccgatcccgctgagcagctggccttacaatcaaccctgacagttttggcagaaagaatgtccacaatccgtatgaaggcaagtgggaagaggcagctgctggaagaaaaactgaacgatcagcttgaggaacaaagacaggagcaggcactccaacgctaccggtgcgaagccgatgagctggacagctggctgttaagcaccaaggccactcttgacacagccctctcgccacccaaggagcccatggatatggaggcacaattgatggactgccagaacatgctggttgaaatcgaacagaaagtggtggctttatccgagctatcagtgcacaacgagaatctgctgttagagggcaaggcacacacaaaggatgaagctgagcaactagctgggaaattacgtcgcttgaaagggagcttgttggagctgcagagagccctccatgacaagcagctcaatatgcaggggactgcgcaggaaaaggaagagtctgacgtagacctgaccgcgacacagtctccaggcgttcaggagtggctggcccaagctcggacaacatggacgcaacagaggcagtcttcccttcagcagcaaaaagaactggagcaggaattggccgaacagaaaagtctcctcaggagcgtggcaagccgaggggaggaaatcctcatccagcactctgcagccgaaaccagtggagatgctggagagaaacctgatgtgctgagccaggaactgggtatggagggcgagaaatccagtgctgaggaccagatgagaatgaagtgggaaagcctacaccaggaattcagcactaagcagaagttactgcaaaacgtactggaacaggaacaggagcaggtgctgtacagcaggcctaaccggttgctgtctggcgtcccactgtacaagggagacgtccctactcaggataaaagcgccgttacttctctactcgacggcctgaaccaggcttttgaggaagtcagttcccagagtggtggtgccaaacgccagtccatacacttggaacaaaaattgtatgatggggtgtcagctacgtccacctggctggatgatgtggaagagcgcctcttcgtggccaccgctctgctccctgaggagactgagacatgtctcttcaatcaggagattctcgccaaggacattaaagagatgagtgaggagatggacaagaacaagaatctcttttcccaggccttccccgaaaatggcgataatcgcgacgtcatcgaggataccctgggatgtctgctgggacgcctgtctttgctggattcagtcgtcaatcaacgctgtcatcagatgaaggaaaggctgcagcagattctcaacttccagaacgacctgaaggttcttttcactagtctggcagataacaagtacatcatactgcaaaaactcgcgaacgtattcgagcaacccgtggctgagcagatcgaggcaattcagcaagcagaagatggtctgaaggagttcgacgccgggattatcgaattaaagcgtagaggagacaagttacaggtcgaacagccttcaatgcaggagctctcaaagctacaggatatgtacgatgagttaatgatgatcataggctcgagacgaagtggtctgaatcaaaatctgaccctcaagtcgcagtatgaaagggcgctgcaggacctcgctgacctgctggagaccggacaggaaaagatggcgggggatcaaaagatcatcgttagttctaaggaggagatacagcagttgctggataaacataaagaatattttcagggattggagtctcacatgatcctgactgagacgctgttcagaaagataataagctttgctgtccagaaggagacccagtttcacaccgaactcatggcccaggctagtgctgtgttaaaacgagcccacaaaaggggcgtcgaactcgaatatattttagagacatggagccacctcgacgaggatcagcaggagctttcccgtcagctagaggtggtggagagcagcattccctccgtcggactcgtggaggagaacgaggatcgcctgatcgatagaataacactctaccagcacctgaagtcgtccctcaatgaataccagccaaaactgtatcaggttctggacgacggtaagcgcttgcttatcagcatttcctgctcggaccttgagagccagctaaatcagcttggggaatgctggctctccaataccaataaaatgtccaaagaactgcaccgcctcgaaaccattctgaagcactggacacggtaccagtcagagtcagccgacctaatacactggcttcagtccgctaaggaccggctggagttctggacacagcaatcagtgaccgttccccaagaactcgaaatggtccgagaccatctgaacgcgtttcttgagttttcaaaagaggtggacgcccagtcgagtctaaagtcttccgtcctgtcgactggcaatcagctactaaggcttaagaaagtggataccgccaccctccggtctgaactctctcgtatcgactcccagtggactgacctcctgaccaacatccctgcagtccaggagaaactgcaccagctgcagatggataaactgccaagtaggcacgccatatccgaggtaatgtcctggatttcgttgatggaaaacgtaatacagaaagatgaagataatattaaaaactccatcgggtacaaggccatccatgagtatcttcagaaatacaaaggtttcaagatcgatataaactgcaagcagctcactgttgattttgttaaccagagtgttctacagatcagtagccaagatgtggagtctaagagatctgataaaaccgattttgcagagcaattaggcgcaatgaacaagtcgtggcagattctgcaggggctggtgactgaaaaaattcagctgctggaaggcctccttgaaagttggagtgagtacgagaacaacgtgcagtgcctcaagacctggtttgagacacaagagaagcgtctgaagcagcaacacagaatcggcgatcaggcctctgtgcagaacgccctcaaagactgtcaggaccttgaggacctgatcaaagctaaagaaaaagaagtggaaaaaattgaacaaaacgggctggcacttattcagaataagaaggaagatgtctcttccattgtcatgagcacactgagggagcttgggcagacctgggctaacctggaccacatggttgggcagctaaagattttattaaagtcagttttggaccagtggagcagccataaggtggcctttgacaaaataaattcttaccttatggaagcgagatattcactgtcacgctttcgcctactaactggttcccttgaagcagtgcaggtccaggtcgacaatcttcagaatttgcaggatgatctggagaagcaagagcgtagccttcaaaaatttggctccattaccaatcaactgctgaaagagtgccatccgcccgtcacggaaacacttaccaacacactgaaggaggtaaatatgagatggaataaccttctggaagagatagccgagcagctgcaatcatccaaggccctgctgcagctctggcagagatacaaggactatagtaagcagtgtgccagcacagtgcagcaacaggaggacagaactaacgaattattgaaggccgccactaataaagatatcgccgacgatgaggtcgctacatggatacaagactgcaacgatctgctcaagggacttggtacagtaaaggacagcctgtttttcctgcatgagctgggtgaacagcttaagcagcaggtcgacgcatctgctgcttccgcgatccagagcgatcaactctctttgtctcagcacctctgcgcacttgagcaggcgctgtgtaaacagcagacgtccctgcaagcgggagtgttggactatgaaacattcgctaagtctctggaagctctggaggcatggatagtggaggccgaagagattctgcagggccaggatcccagtcattcgagtgatctatcaactattcaggagcggatggaggagctgaaaggtcagatgcttaagttcagttcgatggcacctgatctcgatcggctgaacgaattaggctaccggctgccccttaatgataaagaaattaagaggatgcagaacctgaaccgccattggtccctgatttcaagccagaccacagaaagattttctaaactgcagtccttcttgctgcaacaccagaccttcctggaaaaatgtgagacatggatggaatttctggtacagactgagcagaagctggcagttgagatctctgggaactaccagcacttacttgagcagcagcgggctcatgaactgttccaagccgagatgtttagccgacagcagatactgcattccattattatcgatgggcagaggctcctggaacaaggacaggtggacgatagagatgagttcaacctgaagctgacattactcagcaaccagtggcagggagtgattcgccgcgcccaacagagaagggggatcattgattctcagatacgccagtggcaacgctaccgtgaaatggcggagaagctgagaaagtggctggtagaagtttcttacctacccatgagcggcctgggtagtgttcctatccctttgcagcaggctaggaccctctttgatgaagtgcagttcaaggaaaaggtgtttctgcgacagcagggaagctacatcctgaccgtcgaagctggcaaacagctccttctatcggcagacagcggagccgaggcagccctgcaggccgaactggcggaaattcaagaaaagtggaagtcagcctcgatgagactggaagaacaaaagaaaaaactcgccttcctgctgaaggattgggagaagtgtgaaaaaggcatcgccgacagcttagaaaagctaagaacatttaagaagaagttatcccagagtttaccagatcaccacgaagaattgcacgctgagcagatgcgctgcaaagaactggaaaatgctgtggggtcctggactgacgatctgacccagctgagcctcctcaaggatacactgtccgcgtacatttctgccgacgacattagcatcctgaatgagcgggtggagcttctgcagcgccaatgggaagaactctgccaccagctttcactgcgaaggcagcagataggggaaaggctgaatgagtgggccgtttttagtgagaaaaataaagagctttgtgagtggctcacacaaatggaatcgaaggtctctcaaaatggggacattctcatcgaagaaatgattgagaagctcaagaaagactaccaggaggaaatcgctatcgcgcaggagaataagatccaactgcagcagatgggggaacggctcgctaaagccagtcatgaaagcaaggcgtccgaaatcgagtacaagctcggcaaggtcaacgatcggtggcagcacctgctagaccttattgctgcgcgagtgaagaagctaaaggagactttggtggctgtccagcagttagacaaaaatatgtcgtctctgcggacttggctggcccacatcgaaagcgagctggccaaaccgatcgtctatgacagctgtaactcagaggaaattcagcggaagctgaacgaacagcaggaactgcagcgggacattgaaaagcattcgacaggggtggcatctgtcctgaacctatgcgaggtgctgctgcatgactgcgacgcctgcgcaactgacgctgagtgtgactccattcagcaggcaactcgaaatctggataggcgctggagaaacatctgcgcaatgtccatggaacgcaggctgaaaatagaggagacttggcggctttggcagaaatttctggacgactatagccggttcgaggactggcttaagtcatcggagcggactgctgcatttccaagtagcagcggagtgatctataccgtggcaaaggaggagctcaaaaagttcgaggccttccaacgccaagtgcatgagtgcttgacacagctggaactgatcaacaaacagtaccgcagactggctagagagaatcgcacggactcagcgtgttctctgaaacaaatggttcacgaaggcaatcaacgctgggacaatcttcaaaagagagtgaccagcattctgaggaggctgaagcactttattggccagcgggaagagttcgagacagccagggattcaatcttagtgtggcttactgaaatggaccttcaactgaccaacatcgagcacttctcagagtgcgatgtgcaggcaaagataaagcagttgaaagccttccagcaggagattagcctcaatcacaacaagatcgagcagatcatcgctcaaggggaacaactgatcgaaaaatcagaacccttggacgctgccatcatcgaagaggaattggacgaacttcgcaggtactgccaggaagtgttcggacgagtggagaggtatcataaaaaattaataaggctcccactgccagatgatgaacacgatttaagtgacagagagctcgaactggaagatagtgccgcactgtcagatctccactggcatgaccggtctgccgattccctgctctctccccaaccgtccagcaacctgagtttatcgttggctcagccacttcgttccgagcggagcggacgcgatactccagctagcgtcgattccatccccttagagtgggatcatgactacgatctttccagagatctggagtctgcaatgagccgtgctcttccctccgaagacgaagaaggccaggacgacaaggatttctatcttaggggagccgtgggtctctctgacgtgatgatccctgaaagcccggaagcatacgtgaagctgacggagaatgccattaaaaacacatcgggagatcacagcgccctggagagtcagatcaggcagctggggaaagcactggacgatagtcgctttcaaatccagcagacagagaacatcatcaggtctaagacacctacaggccctgagcttgacacctcttacaagggctatatgaagctgttgggcgagtgcagcagcagcattgacagcgtgaagcgcctggaacacaagttaaaggaagaagaagagtccttgccaggcttcgttaacctccactcgaccgaaacacagaccgccggggttatcgacagatgggagctcctccaggcccaagcccttagtaaagaactgagaatgaagcagaaccttcagaaatggcagcaatttaatagcgatcttaattctatttgggcgtggctgggcgataccgaggaggaactggagcagctccagcggctcgaacttagtacagatatacagacgatcgaattacagattaaaaaactgaaggaattgcagaaagccgtggaccaccgaaaagccataatcctttctataaacctctgctctcctgaatttacgcaggccgactcaaaggaaagtcgggatcttcaggacagattgagccagatgaatggaaggtgggatagagtatgttcactgctggaagaatggaggggccttctgcaagatgccctaatgcagtgccagggatttcacgaaatgtcacacggcttgctgctgatgcttgaaaacattgaccgccgaaagaacgagatcgtaccgattgacagtaacctggatgcggaaatattgcaggaccaccataagcagttgatgcagatcaaacacgagttgctcgagagtcagttgcgggttgcatctctgcaggacatgtcttgtcagctccttgttaatgctgaaggcaccgactgtctggaggcaaaggaaaaggttcacgtgattggcaacagattgaagctcctgcttaaggaagtgtctagacatatcaaggaacttgagaagctgctggatgtctcatcatcgcagcaagacctgtcttcctggagctcagccgatgagctggacacttctggcagcgtaagccccacaagcggtcggagcaccccaaatcgccagaagacgccaaggggtaagtgctccttgtctcagcccgggccatcagtaagcagcccacactccaggagtaccaagggcgggagcgatagttccctgagtgagccaggcccgggccggagcgggaggggctttctgtttcgagttctgcgggcggcactgccactgcagttgctactccttttgttgatcggcctggcatgtctggtgccaatgtccgaggaagactattcttgtgctctgagcaataatttcgcccggagttttcatcccatgctcagatacacaaacgggccgccaccactgtag

SEQ ID NO: 206673 - DNA, 2859 bp, Artificial Sequence
  Description of Artificial Sequence: Synthetic coding sequence
atggtggtggccgaggacctgagcgccctgcggatggccgaggacagttgcgtggacgcagatctgccagactgtaactgcgacgtgactcgggtaaagaagctgaaggaaactctggttgcggtccagcagttagacaaaaacatgtcctccctgcgcacttggctggcacacatcgagtctgagctagccaagccaatcgtgtacgattcctgcaacagcgaagagatacagcgcaaactgaacgagcagcaagagcttcagagggacatcgaaaaacattcaactggagtggcatctgtccttaacctgtgtgaggtgttgctgcacgactgcgacgcctgtgccactgacgctgaatgcgacagcatacagcaagccactaggaatcttgaccgcaggtggaggaacatctgcgccatgagcatggagcggcgattgaaaatcgaagagacttggaggttatggcaaaagtttttggacgactacagtagatttgaagactggctgaagtcctcagagcgcaccgctgccttccccagttctagcggggtgatctatactgtcgccaaggaagagcttaagaaattcgaggccttccagcggcaggtgcacgagtgcctgacacagctggagctgatcaataagcagtaccgtagactggctcgagagaacaggacagattccgcttgctctctgaagcagatggtgcacgaagggaatcaacggtgggataacctgcaaaagagggtcactagtattctaagaaggcttaaacactttatcgggcagcgagaggaatttgaaactgctagggactccatcctcgtctggctcacggagatggatttacaattgaccaacattgaacatttcagtgagtgcgatgttcaggcgaagatcaaacaactgaaggctttccaacaggagatttccctcaatcacaacaagattgagcagatcatcgctcagggagaacagttaattgaaaagagtgagcccctggatgccgctattatcgaggaggagctcgacgagctgaggagatactgccaggaagtctttggtcgtgtagagaggtatcacaagaagcttatacgtctccccttgccagacgatgaacacgacttgagcgatcgcgagctcgagctcgaagatagtgcagccctttccgacctacattggcatgatcgatcagcggactctctcctgagcccacaaccaagtagtaatctgtccctctctttagcacagccactccgaagtgaacggagcggtagagacacccccgcctcagtcgacagtattcctctcgaatgggatcacgattatgatcttagtagagaccttgaatctgcgatgtctcgagcactgcccagtgaagatgaggagggacaagatgacaaagatttctacctgagaggagcagttgggctctccggcgaccacagcgccctagagtcacaaataaggcaactaggaaaggcattagatgatagccgattccaaattcagcaaacagagaatatcatccgctcgaagacccccactggccccgagctggatacaagctataaaggttacatgaagctcttaggtgaatgtagctcatccatcgatagtgtaaagcgtctggaacacaagttaaaagaggaggaggaaagcctgcctggcttcgttaacctccatagcactgagacacaaaccgccggagtcattgatcgctgggagttacttcaggcacaggcactcagtaaggaactgagaatgaagcagaatctgcagaagtggcagcagtttaactccgatctcaactccatctgggcatggctgggggacacggaggaggaactggaacagctacagcgcttggaactgtctaccgatattcaaaccatcgagcttcagattaaaaagctcaaggagcttcaaaaggctgtggaccaccgcaaagccatcattctctccatcaacctatgttcacccgaattcactcaagccgactccaaagagagtcgcgacttacaagatcggctctcacagatgaacgggcgatgggatcgtgtgtgctcactactggaggaatggagaggcctgctgcaggatgccctgatgcagtgtcaggggttccatgaaatgagccatgggttacttctcatgctggagaatatcgatagaagaaagaatgaaatcgtgccaatcgacagtaatctggacgcggaaatcttgcaggatcaccacaaacagcttatgcagattaaacacgagctgcttgagagtcaattacgggtggctagcctacaagacatgtcatgtcagctactggtgaacgccgaggggaccgactgcctggaggcaaaggaaaaagtccacgtaatcggaaaccgcctcaagctactgttaaaggaagtgagccgtcacatcaaggagctagagaagttactagatgttagcagctctcagcaggacctcagcagctggtctagcgccgatgagttggacactagtggaagtgtgtcacctacatccgggagatctactcctaataggcaaaaaactcctagaggaaaatgtagcttgtctcagccggggccctcggtatcaagcccccacagtcggtcaacaaagggcggctccgattcatcactgtccgaacccggaccaggtcggtctggcagggggttcctcttcagggtcttacgtgcagcactgccattacagttgctccttctgctcctcattggactagcgtgtctggtgcccatgtctgaggaggactattcctgtgccctatcgaacaatttcgcgcggagttttcaccctatgttaaggtataccaacgggcccccaccactgtag

SEQ ID NO: 206674 - DNA, 20475 bp, Artificial Sequence
  Description of Artificial Sequence: Synthetic coding sequence
atggccagcagccccgagctgcccaccgaggacgagcagggcagctggggaatcgatgatctccacatatcactacaagcagagcaggaggatacccagaagaaggccttcacatgctggattaattcacagctagcacgacacactagtccgtctgtcattagtgacctatttacagacattaaaaagggccacgtcctccttgacctgctggaagtcctgtccggacaacagcttccccgggacaaaggcagcaatacttttcaatgccggatcaatatagagcatgctcttacgtttcttaggaatcgtagtatcaagcttataaacatacacgtgactgacattattgacggcaatcctagcattatcctgggtctgatttggaccatcatcctgcatttccacattgagaagctggcccaaaccctgtcatgcaattataatcagcccagtcttgatgacgtaagcgtggtcgattcttctcctgcatcaagtcctccagccaagaagtgttctaaagtgcaggctcgctggcaaatgtccgcaaggaaggcgctcctactgtgggcccaagagcagtgtgccacctacgagtccgtgaatgtaacggacttcaaatccagctggagaaatggcatggccttcctagccattatccatgctcttcggcctgacttgatcgacatgaagagcgtgaagcaccgatcgaataaggataacctcagggaggccttccgcatcgcagagcaggagctcaagatacctcgactgctggagcctgaagatgtggacgtcgtagatccagacgagaaatctatcatgacatacgtggcgcagtttctgcagtattctaaggacgcacctggcacaggggaggaagcgcagggtaaagtcaaagacgctatggggtggctcacgctccagaaggagaaattgcagaaactgctcaaggattccgagaacgacacttacttcaaaaaatataacagtcttctgtccttcatggagagtttcaacgaggaaaagaaatccttcctcgacgtcctaagcatcaaacgggatctggacgaactcgataaggaccacttacagcttagagaggcctgggatggcctcgaccaccagattaatgcatggaagatcaagcttaactacgctctgcccccgcccctgcatcagacagaggcttggctgcaagaggtcgaagagctgatggatgaggacctgagcgcttcacaagaccactctcaggccgtcaccctcattcaggagaaaatgaccctcttcaagagtctgatggacagattcgaacatcacagcaacattctgctgacattcgaaaataaggatgaaaatcatctgccgctggttcctcctaacaagctggaggagatgaagcgcaggatcaacaacattctcgagaaaaagtttatcttgctcctggaattccactattacaagtgtctcgtacttggtttggtggacgaagtcaaaagcaagttagacatttggaatatcaagtatggaagccgagagagcgtagagcttctgctggaagattggcacaaattcatcgaagagaaggagtttttggcacggcttgatacttcttttcagaaatgcggggaaatctacaaaaacctcgcaggagaatgccaaaacattaacaaacagtatatgatggttaaaagtgatgtttgtatgtatcgcaagaacatttataatgttaaatccacccttcagaaagtgctcgcttgctgggcaacttatgtggaaaacctgcggctattgagggcctgcttcgaggagacaaaaaaagaggagattaaagaggtgcccttcgagacactcgctcagtggaacctggaacacgctacccttaacgaggctggaaactttttggtggaggtgagtaatgacgtggtcggaagcagcatttccaaggaactgaggaggctaaacaagcgctggcgcaagctcgtgtcgaagacccagctagagatgaatctgccactgatgatcaaaaagcaagaccagcctacattcgataatagcgggaacatcctgagcaaagaggagaaagccactgttgaattcagcaccgacatgagtgtcgagttacctgaaaactacaatcaaaatatcaaagccggagaaaaacatgagaaggaaaacgaagaattcaccggtcagctgaaagtggctaaggacgtggaaaagttaatcggtcaggtggagatctgggaggcggaagcaaaaagtgtgctggatcaggacgatgtggataccagtatggaggaatccctcaagcacctcattgccaagggtagtatgttcgatgaactaatggcacgttctgaagacatgctccagatggatatacagaatatttcttctcaggaatcttttcaacatgtactgaccaccggcctgcaagccaaaatacaggaagcaaaggagaaagtgcagatcaatgtagttaagctgattgcagccctcaagaaccttaccgacgttagccctgacctggacatacgcctcaaaatggaggagtcacagaaggaactggagagttatatgatgcgcgcccagcagttacttggccaaagggagagccctggggagctaatcagcaaacataaagaagcgctgatcatatcgaatacaaaatcgctcgcaaaatacttaaaggcagtggaggagctgaagaataacgttaccgaggacatcaaaatgagtctggaagaaaagtcaagggatgtctgcgccaagtgggaatcgctgcaccatgagctttctttgtacgttcagcagttaaaaatcgacatagaaaaaggtaagttgagcgataacattctgaagttggagaagcaaatcaataaggagaaaaagctgatcagaagggggcgcacgaaagggctcatcaaagagcacgaggcgtgtttttccgaggagggctgtctgtaccagctcaatcaccacatggaagtgctcagggagctgtgcgaggaactgccaagtcagaagagccagcaggaggttaagcgcctcttaaaggattacgagcagaaaatcgagcggctgctgaagtgtgctagtgagatacacatgaccctgcagcctaccgccggcggtacgagtaaaaatgaggggaccataaccacctccgaaaatcgaggcggggacccacatagcgaagctcccttcgctaaatccgataaccaaccatcaacggagaaagcaatggagcccacaatgaagttcagcctggcctctgtgctgcgccctctccaggaagaatccatcatggagaaggactacagcgcatctattaattcgctcttggagcggtacgatacctacagagatattctcgaacaccaccttcagaacaataaattcagaatcacttctgatttctcatccgaagaagacagatcctcatcctgcctccaagccaagcttactgacctgcaggtgataaaaaatgagactgacgccagatggaaagaatttgagatcatcagtctgaagctggagaaccacgtcaacgatattaagaagcccttcgtgatcaaggagcgagacactctaaaggagagggaacgcgagctgcagatgacgctgaacactaggatggaatctctggaaaccgccttacggttggttcttcctgtggagaaggcttcactcctgctgtgtggctccgaccttcctctccacaaaatggccatacagggctttcacctaatcgatgccgaccgtatctatcagcaccttcgaaacattcaggactccattgccaaacagatcgagatctgtaaccgacttgaggagccaggaaacttcgttctgaaggagctgcatccctttgatctgcacgccatgcagaacataattctgaagtataaaacacaattcgaaggcatgaatcacagggtgcagaggagcgaagatacactgaaggctttagaagactttctggcatccttaaggaccgccaaactgtccgccgaaccagtaaccgacctgagcgctagtgatactcaggtcgcccaggaaaatactctgactgtgaagaataaagaaggtgagattcatcttatgaaggacaaagcaaagcacttagacaagtgtctgaagatgctagatatgagttttaaagatgccgagcgtggagacgacaccagctgcgaaaaccttcttgacgccttcagcataaagctgtctgagacccacggatacggggttcaagaagaatttaccgaggagaataagctactcgaagcgtgtattttcaagaataacgagctccttaaaaacatacaggacgtgcagtcgcagatcagcaagatcggactcaaagatcctacagtaccggcagtgaagcacaggaagaaatctttgattcggttggacaaagtgctagatgagtacgaagaagaaaagcgccacttacaagaaatggcgaacagcctcccccattttaaagatggccgcgaaaagaccgtcaaccagcagtgccaaaataccgtggtactctgggagaacacaaaggcactggtgactgagtgtctcgagcagtgcggtcgagtgcttgaacttctaaagcagtaccagaattttaaaagtatcctgacaaccctaatccagaaggaagaatcagtgatctcgctacaggcaagctatatgggcaaggaaaacctcaagaaaaggatcgccgaaattgaaatcgttaaagaagagtttaatgaacaccttgaagttgtagataagattaaccaggtgtgtaagaacctccagttttatttgaacaaaatgaaaacctttgaggagccacctttcgaaaaggaagccaacattatcgtggaccgttggctcgacatcaacgagaaaacggaagactattacgagaatctagggcgagccctggcactctgggacaagctgttcaatctgaagaatgtgatagatgagtggactgagaaggccctccagaaaatggagctgcaccagctgacagaggaagacagggagagactgaaagaggagcttcaggtgcacgagcagaagaccagtgaattttctcgaagagtagcggagattcaattcctgcttcagagtagcgagataccacttgaattgcaagttatggagtcttcgatattgaataaaatggaacacgtgcagaaatgccttactggggagtctaattgccacgccctctctggctctaccgccgagctgcgggaggatctggatcaggcgaaaactcagatcggcatgactgaatctctgctcaaagcattgtcccccagtgactctctggaaatctttacaaaattagaggaaatccagcagcaaattctgcagcagaagcactccatgatccttttggaaaatcagattgggtgcctcacccctgaactgagcgagttgaagaagcagtacgagagcgtgagtgatttgttcaacacaaagaaaagtgtactacaagatcatttttctaaactgctgaatgaccagtgtaagaattttaatgattggttctcaaatataaaggtcaaccttaaggagtgtttcgaatcatccgagactaaaaagtcagttgaacagaaactgcaaaagttgagtgatttcttgacacttgaaggacgaaattcgaagatcaagcaggttgattccgtgctcaaacatgtgaaaaaacatctccctaaagcgcacgtgaaagaacttatttcatggctggtgggacaagagttcgaactggagaaaatggagagtatctgccaggcccgagcaaaggaactagaagatagtctgcagcaattgcttcggctgcaggacgatcatcggaacctccgcaagtggctgacaaaccaagaagaaaagtggaaggggatggaggagcccggagagaagactgaacttttctgccaagccctcgcgagaaagcgagagcagtttgagagtgtcgcacaactgaacaactccctgaaagaatatggattcactgaagaagaagagataattatggaggcaacatgtctcatggaccggtatcagacactgctcaggcagctttcagagattgaggaggaagacaagcttttgccaacagaagatcagtcgttcaacgacctcgctcacgacgtcatccactggattaaggaaatcaaggaaagtctgatggtgctcaatagttccgagggcaagatgccattagaagaacgcattcagaaaatcaaagagatcatcttgctcaagcctgaaggagacgcacgtatcgagacaataatgaagcaggccgagagctccgaggcccccctggtgcagaaaactttgaccgatatctccaatcaatgggataatacactgcatctcgcctctacctacttatctcaccaagagaagcttctgttggagggggagaaatatctgcagtctaaagaggatctgcgtctgatgctaatagaactgaaaaagaaacaggaggccggcttcgccctgcagcacggcctgcaggaaaagaaggcccagttgaagatttataagaagttcctcaagaaagcacaggacctgacatctttacttaaggagctgaaatctcagggtaattatctgttagagtgtacaaaaaacccatcatttagcgaggagccatggctggaaattaagcacctgcatgagtccctgctgcagcagcttcaagacagtgttcagaatctggacggacatgtgcgagagcatgatagctatcaggtctgtgtgactgacctgaataccacactggataattttagcaaggagttcgtctccttttctgacaagccagtggaccaaattgccgtggaagaaaagttgcaaaagctccaggaactggaaaataggctgagtttgcaagacgggacccttaaaaagatccttgcactcgcaaagtccgtgaagcagaatacatcgagcgtcggacagaaaattattaaggacgacatcaaatctttacaatgtaaacagaaagatcttgagaacaggctggccagcgcaaaacaggaaatggagtgttgcttgaactcaatcttgaaaagcaagcgctccacagagaaaaagggcaagttcaccctgccagggcgcgagaagcaagcaacttctgacgtccaggaaagtacacaagagagtgctgcagtagaaaagctggaagaagactgggagattaacaagaacttcgtcgagaacgtgatggcagttagcaaaaattgccaccacagcatgtacatttttgaaagtattgtgaagaacttcatctccgatgagatgcaagactcggctgtggagatggccatgtcaaagcagctctcccttaacgctcaggagagtatgaagaacaccgaagacgaacgtaaggtgaatgaactgcagaatcagccactggaattggacaccatgctccgtaacgagcaactcgaggaaatagaaaaactgtatacccaactcgaggcaaagaaagcagcaataaaaccgctcgagcagaccgaatgtcttaacaaaaccgagactggagcactggtactccacaacatcgggtacagcgcgcagcatttggacaatctgcttcaggccctgattacactgaagaagaacaaagaatctcagtactgtgtgctacgggacttccaagagtatctggcagctgtcgaaagttccatgaaagctttgctgacagataaagaatccctgaaagtgggccccttggactcagtgacttaccttgacaagataaagaaatttatagctagtattgaaaaggagaaggatagtctcggcaacctgaaaatcaaatgggaaaacctgtcaaatcacgtgacggacatggataaaaagttgctggagtctcagattaagcagctcgagcatgggtgggagcaagtcgagcagcagatccagaagaagtacagccagcaggttgtcgagtacgacgagttcaccactctcatgaacaaggtgcaggatactgaaataagcttacagcagcaacagcagcatctccaactgcggctgaaatccccagaagaaagagccggcaatcagtctatgattgctctgactacagaccttcaggctacaaagcacgggtttagtgtactgaagggacaagctgaactgcagatgaaacggatttggggggagaaggaaaagaagaatttggaggacgggatcaataatctgaagaagcagtgggagaccctggagcctctgcatctcgaagctgagaaccagatcaagaaatgtgatattcgcaataagatgaaggagaccattctttgggctaaaaaccttctcggggaacttaatcccagcataccactgttgcccgatgatatcctcagccagatccgcaagtgtaaagttacacacgatgggattctggcacgccaacagagcgtagaatccctggcagaggaggtgaaggacaaggtgcccagcctgactacatacgagggaagcgatcttaataacactttagaagacctgcggaatcagtatcaaatgctggtcttaaagtcaacccaacgaagtcagcagttggaattcaagctggaggagaggtccaacttttttgccatcattcggaagttccaactgatggtgcaggagtccgaaacactcattatcccgcgcgtagagaccgcagctacagaagcagaattgaaacaccatcatgtaaccctcgaagcttcacagaaagagcttcaggagatcgattctgggatttcaacacatctccaggaactgactaatatctacgaggagctgaatgtgttcgagcggctgttcctggaagaccagttgaagaaccttaaaatccgcacaaatagaatacagaggttcatccagaacacctgtaatgaagttgaacacaagatcaagttctgtagacagtttcacgagaaaacatccgcccttcaagaggaggccgatagtatccagcgcaatgaactgctgctgaaccaggaggtgaacaagggcgtaaaagaggaaatttacaacctcaaagatcggctcaccgctattaagtgctgcattttacaggtgttgaagttgaaaaaggtattcgattatattggcctcaactgggacttctcccagttggaccagctgcagactcaagtatttgagaaagagaaggagttagaagaaaagataaaacagctggatacattcgaagaagagcatggaaagtatcaggccctcctctccaaaatgagggctatcgacctgcagataaaaaagatgacagaagtcgtgctcaaggctccagactcttccccagagtctcgcaggctgaacgctcagatcctttctcagcgaatagaaaaggcaaaatgtttatgtgatgagattattaagaaactgaacgaaaacaagactttcgatgattccttcaaggagaaggaaattcttcaaatcaaattgaacgcggaagaaaacgataagctctacaaggtgttgcaaaatatggtgctggagttaagtcccaaagagttggatgaaaagaactgtcaggacaaactagagacatctctacatgttctgaaccaaatcaaaagccagctccagcagcctctcctgatcaaccttgagattaaacacattcagaatgaaaaggacaactgcgaggctttccaagagcaggtatgggccgagatgtgctccattaaggctgtgaccgctattgaaaagcaacgcgaagaaaattcaagcgaagctagcgacgtagagaccaaacttagggagtttgaggacctgcagatgcaactgaacacttccatcgaccttaggaccaacgtgctgaacgatgcttatgagaatctaactagatataaagaggcggtcacaagggccgtggagtccatcacaagcctggaggccattattatcccctatagggtggacgtgggaaacccagaggagagcctagaaatgcctctcaggaaacaggaggaactggagtctacagtggctcacatccaggatctaacagagaaactgggaatgatctcttcgccagaggccaaactccagctacagtacaccctccaggaactagtgtcaaaaaatagcgctatgaaggaggcctttaaagcccaagagacggaggcggagcgttacctggagaactacaaatgttaccgcaagatggaggaggatatttataccaacctctccaaaatggaaaccgtgctggggcagtcaatgtcatcactgcctctgagttacagggaagcacttgaacgtctagaacaaagtaaagccctagtgtccaacctaatcagcactaaagaggaactgatgaagttgcggcaaatcctacgcctcttgagactccggtgcaccgagaacgacggcatttgcctgctgaagatcgtgtcagccttgtgggaaaagtggctaagtctcttagaagcagcaaaggaatgggaaatgtggtgtgaggaactgaaacaggaatggaaattcgtttcagaggagatagagagggaagctattatcctggataatttacaggaagaattacccgaaatttccaagactaaagaggcggccactactgaagagctgtccgaactgctggactgcctctgccagtacggcgaaaatgtagaaaagcagcaactcctcctaaccttgctgctgcagagaattagaagcattcagaacgtgccagaatccagtggagccgtagagaccgtgccagcattccaggagattacctccatgaaggaaagatgtaataagctgcttcagaaggtccaaaagaacaaggagttggttcagacagaaattcaggagcgccactcattcaccaaagagattatcgccctgaaaaactttttccagcaaaccaccaccagctttcagaacatggcgtttcaggaccatcccgagaagagcgagcagtttgaggaactgcagtctatcctgaaaaaaggaaaactcactttcgagaacatcatggagaagctgcggattaagtattccgaaatgtatacaatagtgccggctgaaatcgaaagtcaggtggaggagtgtcgtaaggccctcgaggatattgacgaaaagattagcaatgaagtactgaaatcttcccctagttatgccatgcggaggaaaatagaggaaattaacaacggactgcataacgttgagaagatgttgcagcagaagtccaagaatattgagaaggctcaggagattcagaaaaaaatgtgggacgagctcgatctttggcattcaaagctgaacgagcttgactccgaagttcaggatatcgtggagcaggatcccggacaggctcaagaatggatggacaatctaatgattccatttcagcagtatcagcaagtgagccaacgggccgagtgcaggacaagccagctcaacaaggcgacagtcaaaatggaggaatactcagatctgctgaaaagtaccgaggcctggatcgaaaataccagccatctgctggccaatcccgcagattatgatagtttgcggaccctgtcccaccacgcaagcacggtgcagatggcattggaggattctgagcagaagcataacctgctccactccattttcatggacctcgaagatctgtctattatatttgagaccgatgagttgacacagtcaattcaggagcttagcaatcaggtcacagccctgcagcaaaagatcatggaatctctcccccaaatccaacgcatggcagatgatgtcgtcgccatcgagtcagaagtcaaaagcatggaaaaaagagtctctaaaataaagacgattctcttatccaaagagatattcgactttagcccggaagaacatcttaaacatggcgaggttatcctggagaacatccgtcccatgaaaaaaactatcgccgaaatcgtgtcttatcaagtggaactcagactgccacagactgggatgaagccattgcccgtcttccagcggacaaaccaacttctgcaagatattaaacttttggaaaatgtgacccaggagcagaacgaactgttgaaggttgtaattaaacaaacaaacgaatgggacgaggaaatcgagaaccttaagcaaatacttaataactacagtgcacagttctccctggaacatatgtctcctgatcaggcagataaattgcctcagctgcaaggcgaaattgagaggatggaaaagcaaatcctctctttgaaccaaaggaaagaagatcttctcgtggacctaaaggccactgtgctcaacctccaccaacacctcaaacaggagcaagagggagttgaacgcgatcggttgcctgctgtgacctccgaggagggcggcgttgctgagcgggatgcatcagaaaggaaactgaatcgacggggaagcatgtcctacttggcagccgtggaggaagaggttgaagaatcatcagtaaaatctgatcacgataaagatatggaagaagacagggcctcctcctctagtgggacaatagtgcaggaggcttacggtaaaatctcaacctccgacaactctatggcccagatactaacccccgactcactgaatactgagcaaggtcctgagtgttcccttcgacccaaccagactgaagaggggactacccctccaatagaagcggataccctggactcctcagacgcacagggcggcctggaaccccgcgtggagaagacgcgacctgagcccactgaagttctgcatgcctgtaagacccaggtggctgagttggagctttggctgcaacaggctaatgtggcagtggagccagagaccctgaacgccgatatgcaacaagtcctcgaacagcagctggtgggctgccaggcaatgctgaccgaaatcgagcataaggtggcctttctgttagaaacctgtaaagaccaagggcttggagacaatggtgctactcagcacgaggcagaggcacttagcctgaagctgaagaccgtaaagtgtaatctggaaaaggttcaaatgatgttacaagagaagcacagtgaagaccagcatccgacaatcttgaaaaagtcctctgagccggaacatcaagaggcccttcagcctgttaacctctctgagctcgagtcgatcgtgactgaacggcctcagttctctaggcaaaaggacttccaacaacagcaagtgcttgagctgaagcccatggaacagaaggactttatcaaatttattgaattcaatgctaaaaaaatgtggccccagtactgtcagcacgataacgataccacccaggagtcatccgcaagataccccacaaccgaggagttgaagacttatacaacccagctggaggatctccggcaggaagcctccaacctgcaaactcaggaaaacatgactgaagaggcatatatcaacctagacaagaaactgtttgagttgttcctaactctctctcagtgtctgagcagtgtggaggagatgttggagatgccccggctttaccgggaggacggatctgggcagcaggtgcattatgaaaccttggcgctcgagctgaagaaactgtatcttgcgcttagcgataagaagggtgaccttttgaaggcaatgacttggccgggggaaaatacgaatttgttactggagtgtttcgacaacttgcaggtgtgtttggagcacacacaggcggcagcagtgtgccgatctaagagcctcaaagcggggttggattacaatcggtcgtaccaaaaggccgacgcttatactgtcgagctggagaacgctgaatcaagggtggcgaaactgagggacgagggagagaggcttcacctcccgtatgccctgctgcaagaagtgtacaaactggaagacgtgctggatagcatgtgggggatgttgcgtgccaggtacacagagctgtctagcccgtttgtgactgagtcacagcaagatgcactgctgcaagggatggttgagctggtaaagataggtaaagaaaagctggcccacggccatctgaaacagaccaagtccaaggtggctttgcaggcacagattgagaaccacaaagtattctttcagaagttagtggctgacatgttactcatacaggcatattctgccaagatcttaccaagcctcctgcagaatcgggagaccttctgggctgagcaagttacagaagtgaagatattggaggaaaagtcccggcagtgcggcatgaaactgcaatcattgctccagaagtgggaggagtttgacgaaaactacgcatcactggagaaggaccttgagatcctgatcagtactctccctagcgtctcactggtcgaggaaacagaagagcgtctggtggagcgaatctctttctaccagcagatcaaacgcaacattggaggtaaacacgctcggctttaccagactttaaatgaggggaagcagctggtagcaagtgtgagttgccccgagctggagggccagatcgcaaagctggaagagcagtggttgtccctcaacaaaaaaatcgaccacgagctccatagactgcaagcgctgctgaagcacctcctacgtagtgctttccttggcgtgtataatcgcgatagcgaccagctgacaaaatggcttgagagctctcagcataccctgaactactggaaggagcagtctctcaatgtctctcaggaccttgacacaattcggtctaacataaataactttttcgagttttcaaaggaggtggacgaaaagtcgagcctcaagaccgctgtgatcagcatcgggaatcagctgttgcatctgaaagagactgacacagctaccttgagggcctccctggcccaattcgagcagaagtggacaatgttgattacacaactccccgatatccaagagaagctgcatcagctgcaaatggaaaaacttccctctcgaaaggctattactgaaatgatctcctggatgaacaatgtggagcaccaaacttccgatgaggacagcgtacattcaccctccagcgcttcccaggtgaagcacctactacagaagcataaagaattccgaatggaaatggactacaagcaatggatcgtcgacttcgttaaccaatcactgttgcaacttagcacctgtgatgtcgaatccaagagatacgaacggacagaattcgccgagcacctgggagagatgaacagacagtggcacagagtacacgggatgttaaacagaaaaatccagcatttggaacagctgttagaatccataactgagagcgagaacaagattcagattcttaacaattggctcgaagctcaggaagagaggctgaaaactctgcaaaagcctgagagcgttattagcgttcagaaactgcttttagattgtcaggacatagaaaaccagcttgccattaagtcaaaggcattggatgagcttaaacaatcttaccttactttggaaagtggagccgtccctctgctagaggacaccgcatccagaattgacgagctgttccaaaagagaagctcggtactgacacaggtgaatcagctcaaaacctctatgcagagcgtccttcaggagtggaaaatttatgatcagctgtacgatgaagtaaatatgatgactatccgattttggtattgcatggagcactccaaaccagtggtgctgtctctggaaaccctgcggtgtcaggtagagaatctgcagagcctccaggatgaggccgagtcttccgagggctcttgggagaagctccaagaggtgattggcaaactgaaggggctgtgtcccagcgtcgccgaaatcatcgaggaaaagtgtcagaacacgcacaagcggtggactcaggtaaatcaggctattgctgaccaattgcagaaggctcagagcctcctgcagctgtggaaagcctatagtaacgcacacggagaagctgcggctcgtcttaaacagcaggaggcaaaattccagcagctagcaaacattagtatgagcggcaacaatctggccgaaatactcccccccgcactgcaggacattaaagagctgcagcacgacgtgcagaaaacaaaagaagcgttcttacagaattcctctgttctggacaggcttccacagcctgctgagagcagtactcacatgctcctgcctgggccccttcatagtctccagagagctgcgtacttggagaagatgctccttgtgaaagcgaacgagttcgaaaatcacgtgctggccctgaccgctcaaagtccagacattgagcatttgaacgaagtctctctgaagttgccactttccgacgtcgccgtaaaaacactgcagaatatgaatagacagtggataagagccactgcaaccgctttggagcggtgcagtgagctgcaaggtattggtctaaatgagaaatttttgtattgttgtgagaaatggatccaactgctagaaaagattgaagaggcgctcaaggtagatgttgccaactcactgcccgaattactggagcagcagaaaacatataagatgcttgaagcggaggtgtctattaatcaaactattgctgactcctacgtgacccagtcactccagctgctggacactacagagattgaaaacagacccgaattcattacagagtttagcaaattaacagaccggtggcaaaacgctgtccaaggcgtccgacagagaaagggagatgtcgacggactgaatgctcatgtcgcacgatgtggaggggcaagcttgaagaagcaagatctgcgatattctctgcacacggcttgcggagcagcactactgtgccgaagcagccacggcgctaataaggagatccattttcagaggagacggacaacttgcgctctgacattagaggctggggagaaattactgctcactaccgacttgaaaaccaaagaatctgtaggccggaggatttcgcaactccaggatagttggaaagacatggaaccgcagctggcagaaatgattaaacaattccaaagcactgttgagacttgggaccagtgcgaaaagaaaattaaggagttgaagagccgactgcaagttctgaaggcccaatcagaggatccccttcctgagctccatgaggacctgcacaacgaaaaggaattgattaaagttgccattcgcaagcaggagattgaagatcggttaaatacatgggtggtgttcaatgagaaaaataaggaactgtgcgcctggttggtgcaaatggaaaacaaggtgctgcagacggccgacatcagcatcgaggaaatgattgagaagcttcagaagcgaactgtaggcagagaagaggtccctgagaggtgggagtgtgagacaatcgtcagtgggcacgggacagaggagtcttgtttcctcagtatccggaaatttcatcagggccgcggactgcatatactgacgtgtcagttgattccccaagattgtatggaggagatcaatctcttcagcgagaacaagctgcagttaaaacagatgggggatcagcttatcaaggctagtaataagtctagggccgctgagattgacgacaaactgaacaagattaacgataggtggcagcatctctttgatgtgattggttcatccatggccgatcagaccaactcacgttggatgttcttccagtggccccggggtatccaacgaactgtgacctggccctgggaccatctgtgctcctgcgccagcaccggacataccggccccttccacagcagcgtgctgcggtgcttcgaacagcatatcgaatttggcatctacaggcgcacctacaaggtgaataaggagcttgggggagacaagaatggccagcggtgtcccattatttaccctcacgggctggtgcagtgtatcagattaggagaacccctgatcttgaaaagggttaagaaattgaaagagaccttcgctttcattcagcagctggataaaaacatgtcaaacttgcgaacctggctggctcgcattgaatcagaattgtcaaaacccgtggtttatgatgtgtgtgacgaccaggagattcagaagcgcctcgccgagcagcaagacctacaaagagacatcgaacagcattccgcgggcgtggagtctgttttcaatatctgcgacgtgctactgcacgactcagacgcatgtgcaaacgaaaccgagtgcgatagcatccagcaaacaacccgctcactagatcggagatggaggaacatttgcgcgatgtcaatggagcgaaggatgaaaattgaagaaacatggagattgtggcagaagttcctagacgattattcccgatttgaagattggttgaagagcgccgaacgcacagccgcctgcccaaactcatctgaggtgttgtacacctctgctaaagaagaactgaagagattcgaaaggcaaatccacgagcgactgactcagttggaacttatcaacaagcagtatcgcagactggcccgagaaaatcgcactgatactgcgtcacgactaaaacaaatggtacatgagggcaatcagaggtgggataatctgcagcgaagggtgaccgccgtacttaggagactacgccacttcacaaaccagagggaggaatttgaaggaactagggaatctattctggtgtggctgaccgaaatggatctgcagctgactaacgttgaacacttttccgaatcagacgcagacgataagatgcgccagctgaacggattccagcaggaaattaccctgaacaccaataaaattgatcagctgatagtgttcggggagcagctgattcagaaatctgaacccttagatgccgtgttaattgaagatgaacttgaggagctccatcggtactgtcaggaaggtctggaagacgaaaaggaagcatctgagaacgaaaccgacatggaagatcctcgtgagatccaaacggactcctggcgcaaacgcggtgaaagcgaggagccgagcagccctcagtcactgtgccatcttgtggcaccaggacacgaacgtagcggatgcgaaacccctgttagcgtagactcaatcccgctagagtgggaccatacgggcgacgtgggagggtcatccagccatgaggaagacgaggaggggccatattactctgcgctaagcggaaaaagcatctcagatggccactcttggcatgtccccgactccccgagctgcccagagcaccattataagcagatggagggagataggaatgttcccccagtccccccagcctccagcactccttataagccaccatatgtttcgctgaactttactggcagcactgcctacgtttgtgcattcgatcgctgggagatgatacaagcccaggagctacataacaagctgaaaattaaacaaaacctgcagcagttaaactcggatatctccgcaattacaacatggttgaaaaaaacggaggctgagttagaaatgcttaagatggcaaagcctccaagcgacatccaggagatcgaattacgagtcaagaggctgcaggagatcctgaaggcatttgatacatacaaggctttggtggtctccgtgaacgtatcttccaaagagttcttgcagaccgagtcaccagagagcacagaattgcagtccaggctgcgacagttgtctttactctgggaggctgcacagggagccgtcgacagttggcgtggcgggctcaggcaatccctaatgcagtgtcaagatttccaccagctgagccagaacttgctactttggctggcgtctgcaaaaaaccgacgccagaaggcgcatgtcactgatcccaaagcagacccaagagcgctcttggagtgtcggagagagctcatgcaactagagaaggagctcgtggaaagacagcctcaagtcgatatgctgcaggagattagtaattctctactgattaaaggacatggtgaggactgtatagaggccgaggagaaggtgcatgtaatcgaaaagaagttaaagcagctgcgcgagcaggtgagccaagatctgatggctttgcagggaactcagaatcccgcctcccccctcccaagcttcgacgaagttgactcaggagaccagcctcctgccacatccgtgcccgcccccagggcaaaatttctgtacccagctgtgcagagcagtgaaaattatcggagaagggggggggatagggagcagggcccccggcaacatacagctacggcccttttgcccctgaagggagggccaggaagtcccactcccgccgccgcacccccagctgctgccgcacctggacttccagcagctttattgcggcgacggctacaattgcatagcggtcagcagctgtgcccagtcttgttaccacacgctgaggtgcatcagtgggctaccccccacatagaagggatagcgggccatagcgccacccccccagcttag

SEQ ID NO: 206675 - DNA, 20658 bp, Artificial Sequence
  Description of Artificial Sequence: Synthetic coding sequence
atggccagcagccccgagctgcccaccgaggacgagcagggcagctgggggattgacgacctacacattagtctacaggccgaacaggaggacactcagaaaaaggccttcacttgttggattaacagccagctcgcaagacacacttccccatccgtgatctcagatctctttactgacatcaaaaagggacacgttctactggacttgctagaagtattgagcggccagcaactgcctagagacaaagggtctaatacgtttcagtgtcgcattaacattgagcacgccctcacgttcctccgaaaccggtctattaagcttatcaatatccacgtgactgacataattgatggaaatccttccattattttagggctgatctggaccatcattcttcacttccacatcgagaagctcgcgcagacactgtcttgcaattacaaccagccttcccttgatgatgtttccgtggtagacagctcgccagcctcgtccccgccagctaagaaatgtagcaaagtccaggcgagatggcagatgagtgcgcgcaaagccctcctcctttgggcgcaggaacagtgtgcaacttacgagtctgtgaacgtaactgatttcaagtcttcttggagaaatggcatggcgtttctggccatcattcatgctctgagacccgatctcattgacatgaagtcagtgaagcaccggagcaataaggacaacctcagggaagcgtttagaatcgccgagcaggagctcaagatccccagactgcttgaaccagaagacgtagatgtggtggatcctgacgagaagtctatcatgacctatgtggcccagtttctacaatattcaaaggacgccccagggacaggtgaagaggcacaggggaaggtcaaggacgcaatgggctggcttactctacagaaggagaagctgcagaagctgctcaaggatagtgaaaatgacacctactttaagaagtataactccttgctgtctttcatggaatctttcaacgaagagaagaagagtttccttgatgttctgtcgattaagcgggaccttgacgagctggataaagaccacctccagttgagggaggcgtgggatggcctggatcaccaaattaatgcctggaaaattaagcttaattacgcattacctcctcctctccaccagaccgaagcatggcttcaggaggtcgaggagttaatggatgaggatctatccgcttctcaggaccattcccaggcagtgaccctgatccaggaaaagatgacactgttcaagtcattgatggatagatttgagcaccatagtaacattctcctgaccttcgagaacaaggacgagaatcacctgcccctggtgccacccaataaactagaggagatgaagagacgaataaataacatcctcgaaaagaaattcatacttttgttggaattccactactacaagtgtctggtcctcggattggttgacgaggtcaaatcgaaactggacatctggaatatcaagtatggatcacgggaaagcgtggagctgctcctagaagactggcacaaatttatcgaggagaaggaattccttgcaaggctggacactagttttcaaaagtgcggcgagatttataagaacttggcgggcgagtgccagaacattaataaacaatacatgatggtgaagtctgacgtgtgtatgtaccgtaaaaatatatataatgtgaaatccaccctgcaaaaggttttggcttgctgggcaacatacgtggagaatctgaggctgttgcgggcctgctttgaagagactaagaaggaggagattaaggaagtgccctttgagacactcgcccagtggaatctggagcatgccacacttaacgaggccggaaacttcctagttgaagtgtccaatgatgtggtggggtcgtccatctccaaagagctgcggcgattgaataagaggtggaggaagctggtaagcaagacccaactcgagatgaacctgcccctaatgatcaagaaacaggatcaacccacattcgataatagcgggaacattctcagtaaagaggaaaaggcaacggtggagttttccaccgacatgagcgtggagctgcccgagaattataatcaaaatattaaagccggggaaaaacacgaaaaggaaaacgaagaatttacaggccagttaaaagtggcaaaagatgtcgaaaagttgattgggcaggttgagatttgggaagctgaggctaaaagcgtgttggaccaagacgacgtggacacatcgatggaagaatccctgaagcaccttatcgccaagggctcaatgtttgatgagctcatggcccggagcgaggacatgctgcagatggacattcagaatatctcatcccaagagtctttccagcacgtgctcacgacgggtctgcaggccaagattcaggaggccaaggaaaaggttcagattaatgtggtcaaattgattgcagctctgaagaacttgacagatgtgtctccagatttggatattagattgaaaatggaagagtctcaaaaggagcttgagtcctacatgatgcgggctcaacagctgctgggtcagcgggaatcgcccggcgagcttatcagtaaacacaaagaagctctgattatatccaacaccaagagcctggcgaagtacttaaaggccgtggaagagctgaagaataatgtgacagaagatattaagatgtcactggaagaaaagagtcgcgatgtgtgcgcaaagtgggagtccttacatcacgagctcagtttgtacgtgcaacagcttaaaatcgatattgagaagggaaagctcagtgataatatcctcaaactggaaaagcaaatcaacaaggaaaagaagctgatcagacgcggccgcacaaagggcctgatcaaggaacacgaagcctgtttttcagaagagggctgcctttatcagcttaatcatcatatggaggtccttagggaactgtgtgaggaactgcctagccagaaaagccaacaggaggtcaagaggctcctcaaggactacgagcagaagatagaaaggttactgaagtgcgcatctgagatccacatgacgttacaacctactgcagggggaacatccaaaaatgaaggtacaatcacaacaagcgaaaatcggggaggagatccccattctgaggctccctttgctaagtccgacaatcagcccagcacggaaaaggccatggagccaacaatgaagttttctctggcttccgtgctgagacccttgcaggaggagagcatcatggagaaggattatagcgcatcaatcaacagcttgctcgaacggtacgatacgtatcgggacattctggaacaccatctgcagaataacaagttcaggataacaagcgactttagctccgaagaggataggtcgagctcctgtctgcaagcgaagcttaccgatttgcaggtgatcaaaaatgagacagacgccagatggaaagaatttgaaattatctcactaaagctcgagaaccacgtgaatgatattaagaagccattcgtcatcaaagagagagacaccctcaaggagcgcgagagagagctacaaatgacccttaacacccgcatggagtcactggaaacggccctccggctcgtccttccagtcgagaaagccagcttgttactgtgtggaagcgacctcccgctgcataaaatggcaattcaaggctttcatctaattgatgcagatagaatatatcagcacctgcgcaacatccaagactctatcgccaagcagatagaaatatgcaatcgcttagaagaaccaggcaacttcgtgctgaaagagctgcacccattcgatctccacgcaatgcaaaacatcatcctcaagtataagacccagtttgaggggatgaaccatagagtccaaaggtccgaggacacattaaaggcactggaagatttcctggcatctctgaggacagctaaactcagcgctgagcctgtgaccgatctaagtgctagcgatacacaggtggcccaggaaaacaccctgaccgtcaagaataaggagggcgagatccacctcatgaaggacaaggccaaacatctggataagtgcctcaaaatgctagatatgagctttaaggacgctgagcggggcgatgatactagctgtgaaaatttgctcgatgccttttcgattaagctatctgaaacgcatggatacggggtacaggaagaattcactgaagaaaacaaactgctagaagcttgcattttcaagaataacgagctgcttaaaaatatccaggatgttcagtcccagatctcaaagatcggcctgaaagaccccaccgtgcccgcagtcaagcaccgcaaaaaatccttgatcaggctagacaaagtgcttgatgaatatgaagaagagaagaggcatctgcaggaaatggccaattccttaccacactttaaggacgggagggagaaaactgtaaaccagcagtgtcagaatactgtggtactttgggaaaacaccaaggctctggtgaccgagtgtctggaacagtgcggtcgggtgttagaactcctgaagcagtaccaaaactttaaatctattctcactacgctgatccagaaagaagagagtgtcatcagtctccaggcctcgtacatgggtaaggaaaatctgaagaaaagaatcgcagaaatagaaatcgtcaaagaagagtttaatgagcacctggaagttgtagataagataaaccaggtttgcaagaacctgcaattctacctgaataaaatgaaaaccttcgaagagcctccattcgagaaagaggctaatatcattgtggatcgatggttggacattaatgagaaaacagaggattactatgagaatctcggcagagccctcgcactgtgggataagctgtttaatctgaagaacgttatcgacgagtggaccgaaaaagcgctacaaaaaatggagttacatcagttgacagaagaggatcgcgagaggctaaaggaggagcttcaggtgcatgaacagaaaactagcgaattctcccgcagggtggctgaaatacagttcttgctccagtcctccgagatcccccttgaactgcaggtgatggaatccagtatcctgaacaagatggaacacgtacaaaaatgtctaactggcgagagcaactgccatgccttatccggctctactgcagagctgcgcgaggatcttgaccaggctaagacccagatcggaatgaccgagtcacttctcaaagccttatcaccaagcgatagtttggagatcttcactaagttggaggaaatccagcaacaaattctgcagcagaaacacagcatgatactgctggagaaccaaatcgggtgcctgactcctgaactctctgaattgaaaaagcagtatgagtccgtgtcagacctcttcaatactaaaaaatcggtactacaagatcactttagcaagcttctgaatgatcaatgcaagaatttcaatgactggttcagcaacattaaagttaatctcaaagagtgcttcgaatcctctgagactaaaaagtctgtagaacaaaagctgcagaaactttcagattttctgactcttgagggaaggaactcaaaaattaaacaggttgatagcgttttaaaacacgtgaaaaagcacctccctaaagcccacgtcaaggagttgatcagctggctcgtcgggcaagaatttgaactggaaaaaatggaaagtatctgccaagcgagggctaaggagttggaagacagtctccagcaattgcttagactccaggacgatcaccgcaatctgcgaaaatggctcaccaaccaagaggagaaatggaaaggcatggaggaaccgggcgaaaagacagaactcttttgccaggcacttgcacgcaaacgagaacaatttgagagtgtggctcagctgaacaactctttaaaagagtatggtttcaccgaggaggaagagattatcatggaggcaacttgcctaatggatagataccagacactactgcgccaactcagcgaaatagaggaagaggataagctcctcccaacagaagatcaatccttcaacgacttggcacatgacgttatacactggatcaaggaaatcaaagagtctctgatggtgttaaactctagtgagggcaagatgcccctggaagaaaggatccaaaagattaaggagattatcctgcttaaacccgagggggacgcccgcatcgaaacaatcatgaaacaggccgagtccagcgaagctccacttgtgcaaaaaaccctgacagacattagtaatcagtgggacaatactttgcatctggcgtccacctatctgagccatcaggagaaactgctgctggaaggagaaaagtatctccagtcaaaagaggatctgagacttatgttgattgagctgaaaaaaaagcaggaagccgggtttgcccttcaacatggattacaggaaaagaaagctcagctgaaaatatataaaaaattcctgaagaaagcccaggaccttactagcctattgaaggaattaaaaagtcagggcaattatctattggaatgcaccaaaaacccaagctttagtgaggaaccttggctcgagatcaaacacttgcatgaatctctcctccagcagctgcaggatagtgtccaaaacctagatgggcacgtgcgcgaacacgatagttatcaggtctgcgtgacagatctaaatactactctggataatttttcgaaagagtttgtgtccttttcagacaagccagtggaccagattgctgtggaggagaagctacagaagcttcaggaactcgaaaaccgcctatccctgcaggatgggacgctcaagaagatcctcgcactagctaaatcagtcaagcaaaacacttctagcgtagggcagaagatcatcaaggatgacataaaatccctacagtgcaagcagaaggacttggaaaatcgactcgcatcggccaaacaggaaatggaatgttgtctcaattctatcttgaagagcaaaaggtccacagaaaagaagggcaagtttaccttgccaggccgtgagaagcaggctaccagcgacgtccaggaatcaactcaagagtccgcagcagtcgagaagctcgaggaggattgggaaatcaacaaagattccgctgtagagatggcaatgtcaaaacagctgtctctgaacgcacaggaatctatgaaaaatacagaagatgagagaaaggtgaacgaattacagaaccagcccctggagctcgacaccatgttaagaaatgaacaactggaagagatcgagaagctgtatacccagctggaggcaaagaaagctgctatcaagcctcttgagcaaactgaatgtctcaacaaaacagaaactggggcccttgtccttcataatattggatactccgcacagcacctcgataatttactgcaagcactcattaccctgaagaagaataaagagagccagtattgtgtgttgagggactttcaggagtacctggccgctgtcgaatctagcatgaaagctcttctcaccgacaaagaatcacttaaagtggggcccttagattccgtgacctacctggataaaatcaaaaaatttatagcgtcgattgaaaaggaaaaagattctcttggaaatctcaagatcaagtgggagaatcttagtaaccatgttacggacatggataagaaattgctggagtcccaaattaagcaattagagcacggttgggaacaagtggagcagcaaatacagaaaaagtactcccagcaggtggttgagtacgatgaatttaccacactgatgaacaaggtgcaggatactgagataagcctccagcagcaacagcagcatctgcagctcagattaaaatctccagaagagagagctggtaaccaaagtatgattgcccttacaacagatcttcaggcaacgaagcacggattttcggtgttgaaggggcaggcggagctacaaatgaaaaggatctggggcgagaaggaaaagaagaatctggaggacggtattaataacctcaaaaaacagtgggaaaccttagaaccgcttcacctcgaggcagagaaccagatcaagaagtgtgatatccgtaataagatgaaagagacaatcctgtgggccaagaatcttctgggtgagttaaatccctcgatccccctactccctgacgacatactgtcccagattcgcaagtgtaaagttacccatgacggaattttggctcgacagcaatcagtagagtcgctggcagaagaagtgaaggataaagtgcctagtctcacaacctatgaaggaagtgacttgaataataccctggaggacctccgtaatcaataccaaatgctcgtgttgaaatccactcagcgttcccagcagttagagtttaagctagaggaaagatccaacttttttgctattattaggaagttccagctcatggtccaggaaagtgagaccctcatcattcctcgagtggagaccgcggccacagaggcagagcttaagcatcatcacgtaaccctcgaagcgtcccaaaaagaactgcaggagattgactctggcatctcaacccatctgcaggaacttacgaacatctacgaggagctcaatgtcttcgagagactcttccttgaagatcagctaaaaaacttaaaaattcggaccaatcgaatacagagattcatccagaatacttgtaacgaggtagagcacaagatcaaattctgcagacagtttcacgagaagacttccgcccttcaggaggaggcagatagtatccaacgaaatgagttgctactcaatcaggaggtgaacaagggagtcaaagaggagatctataaccttaaggaccgcctgacggcaatcaagtgttgcattcttcaagtgctgaagctgaagaaagtgttcgattacataggactaaattgggacttctctcagctggatcagctgcagacacaagtgttcgagaaagaaaaggagctggaagagaaaattaaacagctcgatacatttgaggaagaacacggcaaatatcaggccctactgagcaagatgagggctatcgatctgcaaattaagaaaatgacggaggttgtgctgaaagctcctgattctagccctgaatctaggcgcttaaatgcccagattcttagccaacggatcgaaaaagcaaagtgtctgtgcgacgagattatcaagaagctgaacgagaacaagactttcgatgatagctttaaggagaaggagatcctccaaatcaagctcaatgccgaggagaatgataaattgtataaagttctccagaatatggtgctggagctgagcccaaaagaactggatgaaaagaactgtcaagataaattggaaacatcactccacgttctgaatcagattaaatctcagctccagcagccactgctcattaatctggaaatcaaacacattcagaacgagaaggacaattgtgaagcattccaggaacaggtgtgggctgagatgtgcagtatcaaggccgtcacggctattgaaaaacagcgggaggaaaattctagcgaagccagtgacgtggaaaccaagctgagagagtttgaggacctccagatgcagctgaacacaagcatcgatctaaggaccaatgtcctgaatgatgcgtacgagaatctcacacgctacaaggaggccgttacgagggcagtcgagtcgatcacttctctggaggccattatcatcccctatcgggttgacgtggggaatccggaggaaagcctggaaatgcctctcaggaaacaagaggaactggagagcacagttgctcatatccaggacttaaccgagaagctcggaatgatctcatcacctgaagcaaagctccagctgcaatacacacttcaggagcttgttagtaaaaatagcgcaatgaaagaagcttttaaagcgcaagaaactgaagcggagcgatacctcgagaactataagtgctataggaagatggaggaggacatatacacaaacctatccaagatggagacagtcttgggtcagtcaatgagctcgctccctctcagttaccgtgaagcactggagaggctcgagcagtctaaggcactggtatctaatctcatcagtacaaaggaagagctcatgaaactgaggcaaatcttgcgcttactacgtcttagatgcacggagaatgacggaatctgcttgcttaagatagtgagcgcactgtgggagaagtggctctccttgctcgaagcagctaaggagtgggagatgtggtgcgaagaactcaagcaggaatggaaattcgtgtccgaggaaatagagcgcgaggcaatcatcctggataacctacaggaagagcttcctgaaatcagcaagacgaaggaggctgccactaccgaggagctttctgagttgctcgactgcctgtgccagtatggtgagaacgtcgagaaacagcagttgctgctcactctattattgcagagaatcaggagcattcagaatgtgcctgaaagtagcggagcagtggaaaccgtgcccgcctttcaagagattacaagcatgaaggaacggtgtaataaactgcttcagaaagtgcaaaagaacaaagaacttgttcaaactgagatccaagagcgtcactcattcaccaaagaaataattgctctaaaaaactttttccagcagacaacaaccagcttccagaatatggcgttccaggatcacccagagaaatcggaacagttcgaagagcttcagagtatccttaagaaaggcaaactgacattcgagaatatcatggagaagctgcgaatcaaatatagtgaaatgtacaccatcgtgcctgcagagattgagagccaggtggaagagtgccgtaaggctttagaggacatcgacgagaaaattagtaacgaagtgctcaaatcctcaccatcttacgccatgcgccgtaagattgaggaaataaataatggcctgcataatgtggagaagatgctgcagcagaagtcaaagaatattgaaaaagctcaagagattcagaaaaagatgtgggacgagctggatctgtggcactcaaaactaaacgagctcgactctgaggtccaggacatcgtcgagcaagatccagggcaagctcaggaatggatggacaacttgatgattccatttcagcagtatcagcaggtaagtcagcgggccgagtgtcgcacctcgcagttgaataaggcaactgtaaagatggaagaatacagcgatctcctgaagtctacagaagcgtggatcgaaaacacaagtcatcttctcgcgaaccctgctgactacgactccctgaggacattgtcacatcacgcctccaccgtccaaatggcgcttgaagactccgagcagaagcataatctcctccattctatcttcatggatctagaagacctttccatcattttcgaaactgacgaacttacccaaagcattcaggagctgtcaaaccaagtgacagccctccagcagaaaattatggagtcactgccccagatccagagaatggccgacgacgtggtggccatagagagtgaagtcaagtctatggaaaagcgcgtgagtaaaatcaaaaccatcctgctgtccaaggaaatcttcgacttttcacctgaggaacacctgaaacatggcgaggtgattctggagaatatccggcctatgaagaaaacaatcgccgaaatcgtaagttaccaggtggaactgaggctgccacagacgggcatgaaaccgttacctgtctttcagcggaccaatcaactgttgcaggatatcaaactcctggaaaatgtgactcaagagcagaacgagttgctcaaggtggtaataaagcagacaaatgaatgggacgaggaaatcgagaatctcaagcagatcctgaacaattatagtgctcagttctcactcgagcacatgagtccagatcaggcggataagctaccccagttgcagggcgagatcgaaagaatggaaaagcaaatcctcagtctcaatcagcggaaggaggatctgttggtggatcttaaagcaaccgtcctcaacctgcatcagcacctgaagcaggaacaggaaggggttgagagagacaggcttcctgctgtgacaagcgaggagggaggagttgcggaacgcgacgcctccgagagaaagctgaaccggcgtggcagcatgagctatctggctgctgtggaagaggaagttgaggagtctagcgtgaaatccgacaacggggacgagaaggcggaaccaagccctcagtcctggagctctttatggaagcacgataaggacatggaggaggatcgagcatcttctagctccggtaccatagttcaggaagcgtacggtaaaatcagcacctcagataattccatggcacagattctcacacccgactctctgaatactgagcagggcccggaatgctcattaagacctaaccagacagaagaggggacaaccccgcctattgaggctgacacgctggactcttctgatgcacaggggggactcgagcctcgggtggaaaagaccagaccggaacctacggaagtgctgcacgcttgtaaaacacaggtggcagagctagaactgtggttgcagcaggccaatgtggctgtggagcctgaaaccttgaacgcggatatgcagcaggtgctagagcagcaactggtgggatgccaagctatgctgaccgagatcgagcataaggttgcattcctgctcgaaacatgcaaggaccaggggctgggagacaacggagccacccagcatgaggccgaagctctttccctgaaactgaaaacggtgaagtgcaatctggaaaaagtacagatgatgctgcaggagaagcatagcgaagatcagcatcccacaattttgaaaaaaagttcggagcccgagcaccaggaagcccttcagccggtcaacctcagcgaactggaaagcatcgttacagagcggccacaatttagccggcagaaagatttccaacaacagcaggtcttagaactgaaaccaatggaacaaaaggacttcatcaagttcattgaattcaatgccaagaagatgtggccccaatattgccagcacgataacgacacgactcaagaatcatccgctagtaatcaggctagcagtccggaaaacgatgtccccgattcaattctgagcccacagggccagaatggagataagtggcagtacctgcatcatgagctgtcatctaaaattaaattacctctgccccagctcgtggaaccgcaggtcagtaccaatatggggattttacccagtgtgaccatgtataactttcggtatcctaccactgaagagctcaagacctacaccactcagcttgaagacctaaggcaagaggcttccaacctgcagacacaggaaaacatgaccgaggaagcctatatcaatctcgacaaaaaattattcgagctgttcctgacgctgagtcagtgtttgtcatcagttgaggagatgcttgagatgccacggctataccgagaagacggcagcggacagcaggtgcactacgaaaccctcgccctcgagctgaaaaaactgtatcttgctctctccgacaagaagggggacctgctgaaagcaatgacctggccaggggagaacactaacctgttgctggaatgctttgacaatcttcaggtgtgtttggagcatacacaggctgcagcggtctgtagaagtaaatcccttaaagccggccttgattacaacaggtcttaccagaacgaaatcaagcgactctaccaccaactgatcaagagtaaaacgagtctgcaacaatctctgaatgagatatccggccagtctgtggctgaacagttgcagaaagctgacgcatacaccgtggaattagaaaatgcagagagccgcgttgcgaagctgagggacgagggcgaacggttgcacctgccctatgcactactgcaggaagtctacaaattggaagatgtgctggattcgatgtggggaatgctgcgcgctcgatataccgagctgagtagtccctttgtcaccgaaagtcagcaagatgcactcctgcaaggcatggtggagcttgtgaaaattggtaaggaaaaactcgcccacggacatctgaaacaaacaaaatccaaggttgccttacaggctcagattgaaaatcacaaagtatttttccagaaactggttgctgatatgttactaattcaggcctactctgctaagatcctgccaagcctgttgcagaacagagagacattttgggctgagcaagtgaccgaggttaagattctggaagaaaagtcacgccaatgtggcatgaaactgcagtctttgttgcagaagtgggaagagttcgatgagaattatgcctctctcgaaaaggatctcgagatattaatctctacccttccttcagtgtcactcgtggaggaaactgaagagaggcttgttgaacgcattagcttttatcaacagataaagagaaatattggcggaaagcatgcccgcttataccaaactctgaacgaaggcaaacaactggtcgctagtgttagctgccccgaattggaaggccaaatagctaagctggaggaacagtggctttcactaaacaaaaagatcgaccacgaactgcaccgactgcaggcacttctgaaacatttgctttcctacaatagggatagcgatcagctgactaagtggttggaatcaagccaacacactctcaactattggaaagagcagtctctaaatgtcagtcaggatctcgatacaatacgcagtaacatcaataactttttcgaattcagtaaggaagtcgatgagaagtctagtctcaaaaccgctgtcattagcataggcaatcagctcttgcacctgaaggagactgatacagccactcttagagcctcattggctcaatttgagcagaagtggactatgctgataacccagttgcccgacatacaggaaaagctccatcagctccaaatggagaaactgccttctaggaaagccataaccgagatgatcagctggatgaataatgtcgagcatcagacaagtgatgaggattcagtccactctccttcgagcgctagtcaagtgaaacatttgctgcagaagcataaagagtttcgaatggagatggattacaaacagtggatagtggattttgtcaaccagtcactcctgcagctgagcacgtgcgacgtcgagtccaagcgttacgagagaaccgaattcgccgagcatctcggggaaatgaaccggcagtggcatagagtccacgggatgctaaatcgcaaaattcagcacctggagcagctgctcgagtccatcacggaaagcgaaaacaaaatccaaattctgaataactggttggaggcccaggaggaaaggctcaagacactccagaagccagagagtgtcatttctgtccagaaactgctactggactgccaagatatcgagaaccagctggcaatcaagtcgaaggccctggacgaattgaagcaatcttatctcacactggaatccggagctgtccctctactggaggataccgcctcccgaatcgatgaactgttccagaaacgcagctccgtacttacccaggtgaatcagctgaaaacctctatgcaaagtgtgctgcaggagtggaagatctacgatcagctgtatgacgaggttaatatgatgactatcaggttctggtactgtatggaacattccaaacctgtggtcttgtctctcgagacactaagatgccaggtggagaacctgcaaagccttcaggacgaagcagagagctcagagggaagctgggagaagctgcaggaggtcatcggtaaactcaagggcttgtgtccctccgtggccgaaatcatcgaagagaaatgccaaaacacacataaacgctggacacaggtgaatcaagcaattgctgaccaacttcagaaggctcagagtctgcttcagctgtggaaggcatacagtaacgctcatggcgaagccgcagccaggctaaagcagcaggaagccaagtttcaacagctggcgaatatcagcatgagcggtaataacctcgccgaaatccttccccctgctctgcaggacattaaagaactccagcacgacgttcaaaagaccaaagaggcattcctccagaattcttccgtccttgaccggctaccccagcctgccgagtcctctactcacatgctcctgcccggaccgctacacagtctgcagcgagccgcatacctggagaaaatgctgctcgtgaaggccaacgagtttgaattcgtgctctctcaatttaaagacttcggggttaggctcgagtctctaaaaggactaatcatgcatgaggaagagaacctcgaccgactgcatcagcaggagaaagagaatccggacagcttcctgaaccatgtcctggccttgaccgcgcagtcccctgacatcgagcacctgaacgaggtttctttaaagctgcccctgagcgacgtggccgttaagaccctacaaaacatgaaccgccagtggattcgagccacagcgactgcacttgaaaggtgttcggaactacagggtattggcttgaatgagaaattcctgtactgttgcgagaagtggatacagcttttagaaaagatcgaggaggcgctgaaggtagatgtggcaaattctttaccagagctgctggaacagcagaagacatataagatgttggaagctgaagtgtccatcaatcagactatcgctgattcctacgtgacccagtcactgcagctactggacaccaccgagatcgaaaacaggccggaattcataaccgagttctcgaagctaactgaccggtggcagaacgctgtgcagggggtacgccagcggaaaggggatgtggacggcttggtccgtcagtggcaagacttcactacaagtgtagagaatctgtttaggttccttaccgataccagtcaccttctgtccgccgtcaagggtcaagaaagattttctctttaccagaccaggagtctgattcatgaactcaaaaacaaagaaatccactttcagaggaggcgcactacatgcgcactgacgctcgaggctggtgaaaagctgcttctgacaacggacctgaagacaaaagagagcgttggcaggagaatcagtcagctgcaggattcgtggaaagatatggagcctcagctggccgagatgattaaacaattccagtccaccgtggaaacttgggaccagtgcgaaaaaaagataaaggagctgaaaagccggcttcaggtgttgaaagcccagtccgaagaccccctccccgagcttcacgaagacctgcacaacgagaaagaactaattaaagaacttgagcaatccctcgcatcctggacgcaaaacctgaaagagctgcagactatgaaggccgatctcaccagacacgtgcttgtcgaggacgttatggttcttaaggaacagattgaacatctccatcgccagtgggaagacttgtgccttagggtggcaattagaaagcaggaaatcgaagatagactgaacacctgggtggtgttcaacgaaaagaacaaggaactatgtgcctggctagtgcagatggaaaataaagtacttcagacagctgatatctcaatcgaagagatgatagagaagttgcagaaagattgcatggaggagattaacctcttcagcgagaacaagctgcagttgaaacagatgggcgaccagcttattaaagccagtaataaatctagggctgcggagatagacgacaagctgaacaagatcaatgaccggtggcaacacctctttgatgtgatcgggagtcgcgtgaaaaaactcaaggagacatttgcattcatacagcagctggataagaacatgtcaaatcttcgcacatggttagccaggattgagtcagaactcagtaaacccgtggtttacgacgtgtgcgacgaccaagagatacagaaacgcttggccgagcagcaggacctccaacgtgacattgagcagcacagtgctggcgtcgaatctgtctttaatatttgtgacgtcttgcttcacgacagcgacgcttgcgcaaatgagaccgaatgtgattctatccagcagacgaccagatcccttgataggaggtggagaaatatttgcgctatgagtatggagcggagaatgaaaatcgaagagacgtggagactatggcaaaagtttttggacgattattctaggttcgaggactggctcaagtcggccgagcgaacagcagcatgtccgaactcgagtgaggtcctctacacttcagcaaaagaggaattgaaacggttcgaagcatttcaaaggcaaatccatgaacggctgactcagctggagctgattaataagcagtatcgcagactcgcgagggaaaatcgaactgatacagcttccagactcaagcagatggttcatgaagggaatcagaggtgggacaatttgcaacggcgtgtcaccgcagtgctgcgtcgtttacgccattttaccaatcagcgtgaggaatttgagggtaccagagaaagcattttggtgtggttaactgaaatggacctgcaactgacgaacgtggagcatttctctgaatcagacgcggatgataaaatgcgtcaacttaacggttttcagcaggaaattacactaaataccaataaaatagaccagttgattgtctttggagaacagctcatacagaagtctgaacctcttgacgccgtcctcattgaagacgagctggaagaactgcaccggtactgccaggaagtcttcggaagagtgtcccgatttcatcgacggctgacaagctgtaccccgggattggaggatgaaaaagaggcctccgagaacgagaccgacatggaggatccccgggagatccagactgactcttggcggaaaaggggggagtccgaagagcccagcagtccacagtctttgtgtcatctcgttgcaccaggacatgaacgttctggctgtgaaacaccggttagtgtggattctattccgctcgagtgggatcataccggggatgtgggcggcagttcctcccatgaggaagatgaagagggaccgtactattcggctctttctggcaagagcatctcagatggccatagctggcacgtgccagatagtcctagctgtccagagcaccactataaacagatggagggtgaccgaaacgttcctcctgtgcctcctgctagcagcaccccttataagcctccttacggaaagctgttgctgccgccagggaccgacgggggtaaggaaggcccaagagtgctgaatggaaatccacagcaggaggacgggggactggcaggcataacagagcagcagtcaggggcttttgatcgctgggagatgatccaggctcaagagctgcataataaactcaaaatcaaacagaacctgcagcaactgaacagcgacatcagtgctattacaacttggctgaaaaagaccgaagccgagctggaaatgctgaagatggccaagccgccgagtgacatccaagagattgaattgagagtgaagcgcctccaggaaattctgaaggcctttgatacctataaagcgctggtggtgagcgtcaatgtgagttccaaagagttccttcagaccgagagtcctgaaagtaccgaactgcagagccggctgaggcagcttagtctcctttgggaggcggcccagggcgctgtggattcctggagaggcggcttgcggcagtctcttatgcagtgtcaggacttccaccagctgtctcaaaatctgctgttgtggcttgcctcggccaaaaaccggagacagaaggctcatgtgaccgacccaaaggccgacccacgggctctgctggagtgcaggagggaattgatgcagttagaaaaagaactggttgaaagacagccacaggtggacatgctgcaagagatttctaactccctgctgataaaaggccacggagaggattgcatcgaagcggaggaaaaggtacacgtgatcgagaagaagctgaaacagctgcgcgagcaggtctctcaggacctcatggccctccaagggacccagaaccccgctagcccacttccgtcattcgacgaagtcgacagcggggatcaacccccagcaacttccgtccctgccccacgggctaaacagtttcgcgcggtgaggacaacagaaggggaagaagagacggagagcagggtgcctggtagcacacgcccccagcgttctttcctgtcccgcgtggtgcgcgccgcgctgcctctgcagctgctgctcctgctattattgctgctggcctgcctgctgccatctagcgaagaagattattcctgcacccaggcaaataacttcgccaggagcttttatcctatgcttagatataccaacgggcctcctcccacatag

SEQ ID NO: 206676 - DNA, 804 bp, Artificial Sequence
  Description of Artificial Sequence: Synthetic coding sequence
atggccagcagccccgagctgcccaccgaggacgagcagggcagctggggcatcgatgaccttcacatttccctgcaggccgagcaggaggacactcagaaaaaggccttcacatgttggatcaacagccagctcgctcgccacacatccccctccgtcatctcagatctgttcactgacattaagaagggccatgtattgctcgatcttctggaggtgctgtctggacagcagcttcccagagataaagggtctaatacatttcaatgccggatcaacatcgagcacgccttgaccttcttgagaaacaggtcgattaagcttattaacattcatgtgactgacataatagacggcaatcccagtatcatccttggtctgatctggactattatacttcatttccacattgagaagctcgctcagaccctttcttgcaattataaccagccaagtcttgacgatgtctcagttgtggatagttcaccagcatcctctcctcctgccaagaaatgctccaaggttcaggcccggtggcagatgagcgcaaggaaagctcttctgctttgggcccaggagcagtgcgcaacctacgaaagtgtgaatgtgaccgacttcaagtcatcttggaggaacggaatggcctttttagcaatcatccacgctctacggccagacctgattgacatgaaatctgtcaagcacaggtcaaataaagataacttacgcgaggctttcagaattgctgagcaggagctgaaaatccccagactgctcgaaccagaagcctacaaaaatttctag

SEQ ID NO: 206677 - DNA, 9813 bp, Artificial Sequence
  Description of Artificial Sequence: Synthetic coding sequence
atggagaagctgcggatcaagtacagcgagatgtacaccatcgtgcctgcggagattgagtcccaggttgaagagtgcagaaaggcgctggaagacatcgatgagaagatctcgaacgaggtgctgaaaagtagcccttcatacgcaatgagaaggaaaatagaggagattaacaatggcctgcacaatgtggagaaaatgctgcagcagaagagcaagaacattgaaaaggctcaagaaatacagaaaaagatgtgggatgagctcgacctctggcactccaagttgaacgagcttgatagcgaagtgcaagatattgtcgaacaggaccctggacaggctcaggagtggatggataatctgatgattcctttccagcagtatcagcaggtttcccagcgtgctgaatgcaggacgagccagctgaacaaggctacggttaaaatggaggagtacagcgatttactgaaatccaccgaggcatggatcgaaaatacctcacatttattagccaaccctgccgactatgactccctgcggaccttgagccaccacgcgtccaccgtgcaggacagtaaatgcttcaggagcggaccacggccaaacatttatgtatcctactacgtgaccgtcatccagatggcactggaggacagtgagcaaaagcataatcttttgcactccatctttatggacttggaggacctttcaatcatcttcgagaccgacgaacttacccagagcatccaggaactgagcaatcaggtgacggcactgcaacaaaaaatcatggaatcgctcccccagattcagcggatggcagatgacgtggtggctattgagtctgaggttaaaagcatggagaaacgcgtgtcgaagattaagaccatcctcctctccaaggaaatcttcgacttttcccctgaggaacacctgaagcacggcgaggtgatccttgaaaacattagaccgatgaaaaaaacgatcgccgaaattgttagctaccaagtggagctgaggctcccgcagaccggcatgaagccacttcccgtctttcaaagaactaaccagctgctacaggacattaaacttttggagaatgtgacccaggaacagaacgaactcctgaaagtcgtgataaagcagacaaatgaatgggatgaggagattgaaaacctgaagcagatcctaaacaactacagcgcccagttcagcctggagcacatgtccccagaccaggctgacaaactgccccagctgcagggcgaaattgaaagaatggagaagcagatcttatctttaaaccagcgaaaggaggacctgctggtcgacctgaaagccaccgtgttaaacctgcaccagcatctgaagcaggagcaggagggtgtagagcgggatcgcctgcctgctgtcacgagcgaggaaggtggagtagccgaaagggacgccagcgagaggaagctgaatcgccggggaagtatgtcttatcttgcggccgtggaagaggaggttgaagaaagtagtgtgaagagtgacaacggtgacgagaaggcagaacctagcccccaaagctggtcttcattatggaaacatgacaaggatatggaagaagacagagcttccagctcgtcaggaaccatcgtgcaggaagcttacgggaagatttccacctcagacaactctatggcccagatcctgacccctgactccttgaatactgagcagggaccagagtgcagtctacggcccaatcagacagaggaaggcaccacgccacctatagaggcagacaccttggactcttccgatgcacagggaggtctggaacctcgagtcgaaaagactaggcctgagcccaccgaggttctgcatgcatgcaaaacccaagttgcagagctggaactgtggctccaacaggctaacgtcgctgtagagccggaaaccttgaacgccgatatgcagcaggtactggagcagcagctcgtaggctgtcaggccatgctgaccgaaattgaacacaaagtagcattcttgctggaaacctgtaaagaccaggggctgggtgacaatggagcgacgcagcacgaggccgaggccttatctctcaagctcaaaactgtgaaatgtaacttagagaaggtgcaaatgatgctgcaggaaaagcacagtgaggatcagcatccaaccattctcaaaaaaagctctgaacccgagcatcaggaagctctccaaccagtgaacctgtcagagcttgagagcatcgtcacggagcgtccccaattcagcaggcagaaggacttccagcagcagcaagtgctagagttgaaacctatggagcagaaggacttcatcaaatttatcgagtttaacgcaaagaagatgtggccccagtactgccagcacgataacgacacaacgcaggagagtagcgcgagtaatcaggcctcctctccagagaatgacgttcccgactccatcctctcacctcaaggccagaatggcgacaagtggcagtatctccatcacgagctatcaagtaagataaagctccccctgccgcagcttgtcgagccccaagtgagtaccaatatggggatcttgccttcagtcacgatgtataactttcggtatcccaccacagaggaactgaagacatacactacccaactggaggatttaagacaagaagcctctaaccttcagacccaggaaaacatgaccgaagaagcttacattaatctggataagaaactgttcgagctctttctaaccctttctcagtgcctttcatctgtggaggaaatgcttgagatgccacggctttaccgggaagacggaagcggacaacaggtgcattatgaaaccctcgccctcgagctcaagaagctatatctggctttgagcgataagaagggcgatctgcttaaggcaatgacctggccaggcgagaacacaaatcttcttctggagtgttttgataatctgcaggtatgtctggaacacacccaggctgctgctgtgtgccggtccaagagccttaaggcagggctcgactacaacaggagctaccagaatgagattaagcgcctataccatcagctaatcaagagtaagacgagcctgcagcagtctctgaatgagatatccggtcagtctgtggccgaacagctgcagaaggccgacgcctataccgtggagttagaaaacgcagaaagcagagtcgctaaactgcgtgacgagggggaaagactgcacctcccttacgctctgctgcaggaagtctataagttggaagacgtcctggacagcatgtgggggatgctccgggcgcggtacacagagctctcctctccctttgtgaccgagtcccagcaggatgcgttgctgcagggaatggtagagctagtcaagatcggaaaggagaaactggcacatggacacttgaagcaaaccaaaagcaaggtagcactacaagcacaaattgagaatcataaggtattcttccagaaattggtggccgacatgcttcttattcaggcatattctgcgaaaatccttccttcgctccttcagaatcgcgagaccttttgggcagagcaggtgacagaggtgaaaattctcgaggagaaaagtcgccaatgtgggatgaaacttcagagtctcctgcagaagtgggaagaattcgacgagaactacgcctccctggagaaggatttggagattcttataagtacactgccatctgtgagtcttgtggaggagaccgaggagagactcgtggaacgcatctccttttatcaacaaatcaagaggaacatcggagggaaacatgcccggctgtatcagacacttaacgaaggcaagcagttagtggcatcagtgtcatgtcctgagctggaaggccagatcgcgaaactggaggagcaatggttgagtctgaacaaaaaaatcgaccacgagctacataggttgcaggctctgttaaaacacttactgagttacaatcgcgattctgatcagctgacgaaatggctagagagctctcagcacacgctgaactactggaaagagcagtcactcaacgttagtcaagatctggatacaataaggtccaacattaacaactttttcgaatttagcaaagaggttgatgagaagtcatcgctcaagacggccgtgataagtatcggaaaccaacttttacacctgaaggaaaccgatactgcaacgttacgagcaagtctggcccagtttgaacaaaagtggacaatgctcattacacagctcccagacatacaggaaaagctgcaccagctgcagatggaaaagctaccttctcgaaaggctatcactgaaatgatttcctggatgaataacgtggagcatcaaacaagcgacgaagactctgtgcattctccttcaagtgcaagtcaggtcaagcacctgttacagaaacacaaagaatttcgtatggagatggactataagcagtggatagtcgatttcgtgaaccagtctctcctgcaactctcaacttgtgacgttgagtcaaagaggtacgagaggaccgagttcgctgaacatctgggtgaaatgaatagacagtggcatcgggtccacgggatgcttaaccggaagatccagcatctagaacagctgttagagagtatcactgagtcagagaacaagattcagattctgaataactggctcgaggcccaggaggagcgtctaaagactctgcaaaagccagaaagcgtgatcagcgtacagaagctgcttttggattgccaggacatcgagaaccagctcgctatcaagtcgaaggcactagacgaactcaagcagagctacctaacccttgaatccggcgccgtccccctcctggaggataccgcaagcaggattgacgagcttttccagaaaagatcttccgtgttgactcaagtaaatcaactcaagacatccatgcagtctgtcctccaggaatggaagatatacgaccagctgtacgacgaggtcaatatgatgaccattcgcttttggtactgcatggaacattccaaacccgtcgttttatctctggagacattgcgttgtcaggttgagaacctgcaaagcctccaggatgaggctgaatcgagcgaggggagctgggagaagctccaggaggttattggcaagcttaagggcttatgtccctctgtggcagagattattgaggagaagtgtcagaacacgcacaagcgttggacgcaagtaaaccaagctatagccgatcagttgcagaaggcccagtccctcctccaactgtggaaggcctattcaaacgcccacggagaggctgccgcaagattaaaacagcaagaagccaagttccagcagcttgctaacatcagcatgagtggaaacaacttggcagagatacttccccctgccctgcaagacattaaggagttgcaacatgatgttcagaagaccaaagaggcgttccttcagaacagcagcgtgctggatcggctgccccagcctgccgaatctagtactcacatgctgttgcctggtcctctgcactctctgcagcgcgccgcctatctggaaaaaatgctgctggtaaaggctaacgagtttgaatttgtgctaagccagtttaaagatttcggcgtccgcttagagagcctcaaaggcctcatcatgcatgaggaggagaacctagaccggctccaccagcaagaaaaagagaaccctgactctttcttgaatcatgtgctggcactcaccgcccagagcccagacatcgagcacctcaatgaagtgtccctgaagctgccacttagcgatgtagcagtgaagactctgcaaaacatgaatcgtcagtggatccgagccaccgctacagccctggagagatgttcagaactgcagggcatcggtctgaacgaaaagtttttatattgctgtgagaaatggatccagttgctggagaaaattgaagaggccctcaaggttgatgttgccaacagtttgcctgaactgctcgaacagcagaaaacatataaaatgctggaggcagaagtgagcattaatcaaacaattgctgattcttacgttacgcagtcactgcagttgctggacacaactgagattgaaaacagacctgagtttatcacagaatttagcaaactgacagaccgctggcagaatgcggtacaaggcgtcagacagcggaagggcgacgtcgacggcctggttaggcagtggcaagacttcaccacatccgtggagaaccttttcaggtttctaactgatacaagtcatctgttgagcgccgttaagggccaagaacggttttcattgtatcagacccggtctttaatacatgaactgaagaacaaggagatccatttccagagacgcagaaccacatgtgccttgaccctggaagcaggagagaagctgctgttgacaactgatttgaagactaaagagtccgtgggtaggcgcatctcccagcttcaagactcgtggaaggacatggagccccagctggctgagatgataaaacagtttcagagtaccgtcgaaacgtgggaccagtgcgaaaagaagattaaggaactcaagtcacggttgcaggtcctaaaggcgcagtctgaggaccctctgccagaattgcatgaagatctacataatgagaaagagctgatcaaggagctggaacagagtctcgcaagctggacgcaaaacctgaaagaattgcagactatgaaagccgatcttactcggcacgtcctggtggaggatgtgatggtgttgaaagagcagattgagcacttgcacaggcagtgggaagacctctgtttgcgggtggccatccgaaagcaggaaatcgaagataggctgaacacgtgggtggttttcaacgagaagaacaaggaactctgtgcttggttggtgcagatggagaacaaagtgctccagactgcagacatctccatcgaggaaatgatagaaaagcttcagaaagattgcatggaagagatcaatctattttccgagaacaagttacagctgaagcagatgggggatcagcttattaaggcctccaacaaatccagggccgccgagattgatgataaactgaataaaattaacgatcgttggcagcatcttttcgacgtgattggctcacgtgtgaagaagctgaaggagacgtttgccttcatccagcaactggataagaacatgtctaaccttaggacatggttagcccgcatcgaaagcgaactctccaaacccgtggtgtatgatgtatgcgacgaccaggaaattcaaaaacgcctggccgaacaacaggatctgcagagagacatcgagcagcattcagccggggtagaaagtgtgttcaatatatgtgatgtcctgctccatgactccgatgcctgcgccaatgagaccgaatgcgattccatacagcagacaacccgctccttggatagaaggtggcgaaatatctgcgcgatgtctatggaacgcagaatgaagatcgaagaaacatggagactgtggcagaagtttctagatgattattctcggttcgaggactggttgaagtcagcggaacggaccgccgcctgtccgaactccagtgaagtgctctatacttctgccaaggaagagctgaagcgcttcgaggcctttcagaggcagattcacgagagattgacacagctggagctgattaataaacagtaccgtagacttgccagggagaaccgcacagataccgcctctaggctcaagcagatggtgcatgaaggaaaccagagatgggataacctgcaacgacgggtgactgccgtgctgcgccgattgcgccactttactaatcagcgggaggaatttgaggggactagagagagtattctggtctggctcacggagatggatctccaattgaccaacgttgagcatttcagcgagtccgatgctgacgacaagatgcggcaactgaatggatttcagcaggaaattacccttaacactaataagatagaccagctcatagtgtttggagagcagttgatccaaaagtctgagccattggatgccgttctgattgaggatgaattggaagagctgcacagatattgccaagaggtgtttggccgggttagtaggttccaccgcaggctcaccagctgtacacccggtctggaagacgagaaggaggcctccgagaacgagactgacatggaggatccgagggagattcaaaccgatagttggaggaaaagaggggaaagcgaggaaccttcatccccacagtctctgtgccaccttgtcgcacccggccacgagcggtccgggtgcgagacgccagtgagcgtcgattccataccactggagtgggatcataccggagatgtcggcggcagtagcagccatgaagaggacgaagaggggccctattattctgccctgtctggaaagagtattagcgatggccatagctggcacgtgccggactctccatcctgtcctgagcaccactacaaacagatggaaggagatcgcaatgtgcctcccgtcccaccagcaagcagtaccccatataagccgccttatgggaaactactgttgccacctggaacggatggggggaaggaaggtccacgcgtactaaacggtaacccgcaacaagaagacggtgggctcgcggggatcacagagcagcagtctggcgcattcgatcggtgggagatgattcaggcgcaggaactgcacaataaactgaaaatcaaacagaacctgcagcagctgaattcagatatcagcgccatcacaacctggctgaaaaaaaccgaggccgagttggaaatgctcaaaatggccaaaccaccatcagacatacaagagattgagctgcgagtcaaaagactacaggaaattctgaaggcgttcgacacttacaaagcactggtggttagcgtaaatgtgagcagcaaagagttcctgcagacagagtcccctgagagcacagagctgcagtcaagacttcggcagctaagtctcctgtgggaagccgctcagggcgcagtcgattcttggcgggggggactgcggcaaagtctgatgcaatgccaagatttccaccagctttcacagaatcttctgctgtggttggccagcgccaagaaccggagacagaaagcccacgtcaccgacccgaaagcggatccgcgagctctcctagaatgccggcgcgaattgatgcagctggagaaggagttggtcgagcggcagccccaggttgatatgttgcaggagatctccaactctctgctgatcaaaggacacggagaggattgcattgaagcagaagaaaaggtgcacgttattgaaaaaaagctgaaacagctgcgggagcaagttagccaggacctcatggctttacaagggacccaaaatcctgccagtcctctgccctcattcgatgaagtggatagtggggatcagcctccggcaacctccgtcccggcaccccgcgctaaacagtttcgggcagtcagaacgaccgagggagaggaagaaactgaatcgcgggtccctggttctacaaggccacagcgttccttcctcagccgggtggtccgcgctgcgctgcctctgcagctcctgctgctgctgctgttgttgctcgcctgtctgttaccaagctcagaggaggattattcatgtacccaggctaataactttgcccgcagcttctatcccatgcttcgttacacaaacggtccaccccctacctag

SEQ ID NO: 206678 - DNA, 20724 bp, Artificial Sequence
  Description of Artificial Sequence: Synthetic coding sequence
atggccagcagccccgagctgcccaccgaggacgagcagggcagctgggggatcgatgacctgcacatctcactgcaggctgaacaagaggacacacaaaagaaggcatttacctgctggatcaacagccagctcgcccggcacacaagcccctccgtgattagtgacctgttcaccgatataaaaaagggccacgttctgctcgatcttctcgaggtactctcaggccagcagctgcctcgagacaagggatcgaacacctttcagtgccggataaacatcgaacacgccttgacatttctgcggaataggtcaatcaagctgattaacatccatgtcactgacattattgacgggaatccttccataattctcggactcatctggacaatcatcctccatttccatattgagaaactcgctcagaccctctcttgcaactataaccagccaagcctcgacgatgtatcggtggttgattcatctccggcctcgtctccccctgctaagaagtgcagcaaggtacaggcacggtggcagatgtcagccaggaaggcattattgctgtgggcccaagaacagtgtgccacttacgaaagtgtgaacgtaaccgattttaaaagttcttggcgtaacggcatggcgttcctagcgatcattcatgcattgaggccagatttgattgatatgaagtcagtaaagcacagaagcaacaaagataatctgcgtgaggcatttcgcatagctgaacaggagctgaaaattccaagacttctggaaccggaggacgttgacgtcgtggaccccgatgagaagagtatcatgacatatgtcgcacagttcctacaatatagcaaggatgccccgggcaccggcgaagaagcacagggcaaggtgaaagacgcgatgggatggcttactctgcagaaagagaaactccagaagctcctcaaggactctgagaacgatacatatttcaaaaagtataactctttgctcagcttcatggagtcattcaacgaggagaagaagagttttctggacgtccttagcatcaaaagggatttggatgagctagataaagaccacctgcaactcagggaggcatgggacgggctagaccatcagataaatgcatggaagattaaactaaattatgcccttccccctccgttgcaccagaccgaggcatggctgcaagaagtggaagagcttatggacgaggatctgtccgccagccaggaccatagtcaggcggtgacgcttattcaggaaaagatgaccctgttcaagtctctcatggaccgcttcgaacatcactcgaatatcctgctgacttttgaaaacaaagacgaaaaccatctgccactggtgccacccaacaagctcgaggaaatgaagcgccggataaacaatatactggaaaagaagtttatcctacttctggaattccactactacaaatgtcttgtcctgggtttggttgacgaagtgaaatcaaaacttgacatatggaacattaagtacggatctcgagaaagtgttgaactcctgcttgaggactggcacaaattcatcgaggaaaaagaatttctggcccggctggacacctcttttcagaagtgcggtgagatctataagaatcttgccggggaatgccagaacatcaacaaacagtacatgatggtgaagtcagacgtgtgcatgtacagaaaaaacatatacaacgtgaagagtacattgcagaaagtcctcgcctgttgggcgacatatgtcgagaacctgaggctgcttagagcctgctttgaagagacaaagaaagaggagattaaagaagttccttttgaaaccttggctcagtggaatctcgagcacgcaactcttaatgaggccgggaatttcctcgtggaagtttccaatgatgtggtgggctcgagcatttcaaaggaacttaggcgcctgaataaacggtggagaaagctcgtgtctaagactcagttggagatgaacttaccactgatgatcaaaaagcaggatcaacctacctttgataattctggaaacatactgtccaaggaagaaaaagctacagtcgaattctctactgatatgagtgtcgagcttccagagaattacaatcagaacatcaaagccggcgaaaaacacgagaaggagaatgaggaattcaccggccagttgaaagtggccaaggacgtcgaaaaattgatcggccaggttgaaatctgggaagctgaagcaaagtccgtccttgatcaggatgacgtagacaccagcatggaggaatccctcaagcacctcatcgcgaagggctccatgtttgatgaactgatggcacggtccgaggacatgcttcagatggatattcagaatatctcatcccaggagtccttccaacacgtcctgaccaccggcctgcaggctaagattcaagaggccaaagagaaggtacagatcaatgtcgtgaagctcatcgccgcgttgaagaacctgactgacgtgtcccctgacctggacattagactgaagatggaagagtcccagaaggaactcgagtcctacatgatgcgagcacagcagctcctggggcaaagggagtcccctggcgagttaatcagtaagcacaaggaggccctcattattagcaacacaaagtctcttgcaaagtacctgaaagctgtagaagagctgaagaacaatgttaccgaggatatcaagatgtcccttgaggagaaatcccgcgatgtttgtgctaaatgggagtccctgcatcacgagctgtctctttatgtgcagcagctgaaaatcgacatcgagaaaggtaagctgtccgacaacatactgaagctcgaaaagcagataaacaaagagaagaaactcatacgtagaggcagaacaaaggggttaatcaaagaacacgaagcatgcttttctgaggagggctgtctgtatcagctgaaccaccacatggaggtcctgcgcgaactgtgtgaggagcttccaagccaaaagagccagcaggaggtcaagcgcctcttgaaagactacgagcagaagatcgagcggctgcttaaatgcgcttcagagatccacatgactttacaacctaccgccggcggtaccagtaagaatgaagggaccatcacaacgagtgagaataggggaggcgatccacattcagaagccccattcgccaagtccgacaaccagccgtcaacggaaaaagctatggaaccgacaatgaaattcagtctcgccagcgtactcagacctctccaagaggaatcgataatggaaaaagattactcagcaagcatcaattcactactcgaacggtacgatacttaccgagatatccttgagcaccacctgcagaataacaagtttcgaatcacctccgacttttcttccgaagaggatagaagcagttcatgcctgcaggcgaagcttactgaccttcaggtaattaagaacgagacggatgccaggtggaaagaattcgaaataatcagcctgaagcttgaaaaccacgttaacgatattaagaaacccttcgtgatcaaggagcgggacacactgaaggagcgtgagcgagagcttcagatgacactgaacacccgcatggagagtcttgagacagctttgaggctcgtgctgccagtggagaaagcatctttactgctctgcggaagtgatctgcctctacataagatggcgatacagggctttcacttgatcgatgctgaccgtatttatcagcacctccggaacatacaggatagtattgcaaagcagatcgagatatgtaatagactcgaagagccaggaaacttcgtgcttaaggagctgcacccattcgatctgcatgcaatgcaaaatattatcctgaagtacaagacgcagtttgaaggcatgaatcatcgggtccagcggagcgaggatactctgaaagctctggaggattttctggcctcattgcggaccgccaagttatcggctgagcccgtcaccgacttgtccgcttcggatacccaagttgcgcaggagaacacgttgaccgtgaagaacaaggagggtgaaatccatctaatgaaggataaggccaaacacctggacaagtgtctgaagatgctcgatatgtcctttaaagatgctgaacgaggagatgatacatcatgcgaaaacttgctggatgctttctccattaagttgagcgaaacccatggttacggagtgcaggaggagttcacggaagaaaataaactgctggaggcctgtattttcaaaaacaacgaacttctgaagaatattcaggacgtccagtcacagatatctaagataggcctgaaggacccaacggttcctgccgtcaaacataggaagaaaagtctcataagactggacaaggtcttggacgagtacgaggaagagaaaaggcatctgcaggagatggctaatagcctaccgcacttcaaagacgggcgcgagaaaactgtcaaccagcagtgccagaatacagtagttctgtgggagaacacaaaggcccttgtgaccgaatgccttgaacagtgcggccgtgttctggagctgcttaaacagtaccaaaacttcaaatcaatcctgaccacactgatccaaaaggaggagagcgtcatctctctgcaggcctcctacatgggcaaagagaacctgaagaagaggattgcagaaatagagatcgtcaaagaggaatttaatgaacacctagaggttgtcgacaaaatcaatcaagtttgcaaaaacctccagttctacctgaacaaaatgaaaactttcgaggagcctccgtttgaaaaggaagctaatatcattgtggaccgatggctggacattaatgaaaaaactgaggactactacgagaacctgggtagagctttggctctatgggataaactgttcaatctcaaaaacgtgattgatgagtggacagaaaaggcattgcaaaagatggaattacaccagctgactgaggaggaccgtgaaaggctgaaggaggaattgcaggtgcacgagcagaagactagtgagttcagtcgaagagtagctgagatccagtttttactgcagagctccgagattcccctagagctgcaggtcatggaatcctcgatcctgaataagatggaacacgtgcaaaaatgtttaaccggcgagtccaactgtcatgccctgtctggatctacagccgaactgcgggaagatttggatcaagctaagactcagattggtatgacagaaagcctgcttaaggctctgtctccgtctgatagcctggagatcttcactaagctggaagagatccagcagcagatactgcagcagaaacattccatgattttgctggagaaccagatcggctgtcttacacccgaattgtctgagcttaagaagcaatacgaaagcgtttcggacctttttaacaccaaaaagagcgtgcttcaggatcacttctctaagctgctgaatgaccagtgtaagaattttaatgattggttcagtaatatcaaggtaaaccttaaggagtgcttcgagagctcagagacgaagaagtcagtggaacaaaaacttcagaaactgagtgattttttaaccttggaaggacgtaacagtaagatcaagcaggtggactctgttctcaagcatgtgaaaaaacacttaccaaaggcacacgtgaaggaattaatctcctggctggtcggtcaggagttcgagctggaaaaaatggaaagcatatgtcaagcccgagccaaggaattggaggactcattacaacagctcctgagactgcaggacgaccaccgaaacctgaggaaatggctgactaatcaggaggagaagtggaagggtatggaggaacccggcgagaagaccgagctcttctgtcaggctctcgctcggaagcgggagcagtttgagagcgtggcgcagctgaacaacagcctgaaggaatatggctttaccgaggaggaagagattatcatggaggccacttgcctgatggatcgctaccagacacttctcaggcagctgagcgagatcgaggaagaggataagctgctcccaactgaggatcagtcctttaacgatttggctcatgacgttatccactggatcaaggagattaaggagagcctaatggtcctcaatagcagcgaaggaaagatgccactcgaggaaaggattcagaagataaaagagatcattttgttaaaaccagaaggtgacgctaggatcgaaacaatcatgaaacaggccgaatctagcgaagcgccgcttgttcagaaaacgctcacggacatttcgaatcaatgggacaacaccctgcatcttgccagtacgtacctttcacatcaggagaagctgctgctggaaggagaaaaatacttgcaatcaaaggaggatctgcgacttatgcttatagagctgaagaagaaacaggaagccggctttgcactgcagcatggcctgcaggagaagaaggcccagctgaagatttataagaagttcctcaagaaggcccaggatctgacttcacttctgaaagaactgaagtctcagggtaactatctgctggagtgtacgaagaaccctagcttctcagaggagccttggctagagatcaagcacctccatgaaagcctgctccagcagctccaagactcagtgcagaatttggacggccatgtgcgtgagcacgactcttaccaagtgtgtgtcacagatctgaacaccacattagacaacttttcgaaggaattcgtcagtttctcagataagcccgtcgaccagattgctgtggaagaaaagctccagaagctgcaggaactagagaatcgcttgagcctccaagatggaacactgaaaaaaattctggccctggcgaagagcgtaaagcagaatacttcctccgtcggtcagaagattattaaagatgacataaagagcctccagtgcaaacagaaggacctggaaaatcgattagcgagtgccaagcaagaaatggagtgttgcttgaacagcatacttaagagcaagagatccaccgagaagaagggtaaattcactctccccggtcgcgaaaagcaagccaccagtgacgtgcaggaaagcacacaggagagcgctgcggtggaaaagctggaagaggattgggagattaataaggactctgcagtcgagatggcaatgagtaagcagttgagtctcaacgcccaggagagcatgaagaacacggaggacgagcggaaagtaaatgagctacaaaaccagcctctcgagctggatacaatgttgcgaaatgaacagttggaagaaatcgaaaagctctatactcagctagaagcgaaaaaggccgccatcaaaccactggaacagactgaatgcctgaataagaccgagaccggtgctttggtcctgcacaatatcggctactcggcacagcacctcgataatcttctgcaggcacttataaccctgaagaagaataaggaaagccaatactgcgttctgagggactttcaggaatatttggccgcagttgaaagtagcatgaaggccctgcttacagacaaggagagcctcaaggttggtcccttagactccgtgacgtacctcgacaagatcaaaaaattcatagcaagcatcgagaaggaaaaagatagcctcggcaacctcaagatcaagtgggaaaacttatcaaaccatgtgaccgacatggataagaagttactggagagccagatcaaacagctcgaacacgggtgggagcaggtggagcagcagattcagaaaaagtattcacagcaggtggtggagtatgacgagttcacgacacttatgaataaggtacaggacacagagattagtctgcagcaacagcagcaacatctgcagcttcgcctcaaatcaccagaggagagggcaggaaaccagagcatgattgctctaactacagatttacaagctacaaaacacggtttcagcgtgctcaaggggcaggcggagctgcaaatgaagcggatctggggtgagaaggaaaagaagaatctagaggatgggattaacaacctgaagaaacagtgggagacactggaacctctccacctggaggccgagaaccagattaagaaatgcgacatcagaaataagatgaaggaaacaatcctatgggctaagaacctgctcggagagttaaatccatccatccctctcttgcctgacgacatcctttcccagattagaaaatgtaaagttactcacgacggaatcctggccagacagcagagcgtagagagtctagctgaagaggtcaaggataaggtaccaagcctgactacgtatgaaggatccgatttaaacaacacgctggaggatctcaggaatcagtaccagatgctcgtgctcaagagtactcagcgatcacagcagttggagttcaaactggaagaacggtcaaacttctttgccatcatacgcaaattccagcttatggtccaggaaagcgagactcttattattccaagggtggagaccgccgcaaccgaggcagaactcaaacaccaccatgtgaccctggaagcttcccagaaagagttgcaggagattgacagtggcatcagcacacacctgcaggagcttacgaatatctatgaagagttgaatgtcttcgaacgtctatttttggaagaccaactgaaaaatctgaagatacgcaccaacagaatacagcgctttatccagaacacgtgcaatgaagtggagcataaaatcaagttctgccggcaattccatgaaaagaccagcgctttacaagaggaggctgactctattcaacgcaatgagctgctgctgaaccaagaagtcaacaagggcgtgaaagaggagatctataatctcaaggataggctgacggcgataaaatgctgcatcttgcaggtactgaaacttaagaaggttttcgactacattggactgaattgggattttagccagctggaccagctgcagacacaagtgtttgagaaggagaaggaactggaggaaaagattaaacagctggacactttcgaagaggaacacggcaagtatcaggctctgctctccaagatgcgagcaattgaccttcagatcaagaagatgaccgaagtggtacttaaggcgccagacagtagtcccgaaagccgtcgtctcaacgctcaaatcctgtcacagcggatcgaaaaggctaaatgtctctgcgacgagattatcaagaagctgaacgaaaataagacatttgacgacagctttaaagagaaggaaatcctgcaaatcaaattaaacgctgaggaaaacgacaagctgtataaggttctgcagaacatggtattggaactctcacctaaggagctagatgagaagaactgtcaagacaaattggaaacgtctctgcatgttctgaaccagattaagtctcaacttcagcagccactgctcatcaacctcgaaattaaacatattcagaacgaaaaggataattgcgaggcttttcaggaacaggtgtgggcagagatgtgtagtatcaaagccgtcaccgcaatagagaagcaacgagaagagaattcctcggaagcttccgatgtggagaccaaactgagggagtttgaggatctgcagatgcaactaaatacgtcaattgacctcagaactaacgtgctgaacgacgcttatgaaaatctgactcgatataaagaagcagtcacgagagctgtcgaatccataacctccttagaagcgataataatcccttaccgcgtagacgttggaaacccagaggaaagtctggagatgcccctcagaaagcaggaagagctggagtccactgtggcccatattcaggacttgactgagaaactcggcatgatctcctctcccgaagcgaagctccagctacagtacactctgcaggaattggtgagtaagaatagtgctatgaaggaggcctttaaagcacaggagactgaggcggaacgctacctagagaattacaagtgttacagaaagatggaagaggatatttacacaaacctctctaaaatggaaactgtgctcggacagtccatgagttccctccctctgagttatcgcgaagccctggaaaggctcgagcagtcaaaagccctggtgagcaacctgatctctaccaaggaggagctaatgaaattgagacagatcctccggcttctgcggctcagatgtactgagaatgacgggatttgtcttcttaaaattgtttcagccttgtgggagaaatggttaagtttgcttgaggctgcaaaagagtgggaaatgtggtgcgaagaactgaagcaagagtggaagtttgtgagcgaagagatcgaacgggaagcaattattcttgacaatcttcaggaagagctacccgaaatctctaagactaaggaagcagcgacaaccgaggaactcagtgagcttctggattgcctgtgccagtacggtgagaatgttgaaaaacagcagctcctgctgaccttgttgctgcagcgtatcaggagcatacagaatgtccccgagtcatcaggcgctgtggagaccgtccccgccttccaggaaataacctccatgaaagagcgctgtaacaagctgctgcaaaaagtacagaaaaataaagagctggtgcagaccgaaatccaagagagacattcattcactaaagagattatcgctctcaagaatttctttcagcagaccactacctcatttcaaaatatggccttccaggaccatcctgagaagtcagaacagttcgaggagttgcaaagtatattaaaaaaaggcaagctgacatttgagaacattatggagaagctaagaattaaatactctgagatgtacacaattgttccagccgagatcgagagccaagtggaggagtgtcggaaggctctcgaggatattgacgaaaaaatctccaatgaagtgctgaagagctccccctcctatgccatgcgaagaaagatcgaggagattaacaacggcctgcacaacgtggaaaagatgttacagcagaagtccaagaacatcgaaaaggcccaggaaattcagaagaaaatgtgggacgaattggacctgtggcatagcaaactgaacgaattggatagcgaagtgcaggacattgtcgaacaagatccaggacaagcgcaggagtggatggacaacctcatgattcctttccagcagtatcaacaagtgtcgcagagagccgagtgtaggacgtcacagctgaacaaagctaccgtgaaaatggaagagtactccgacctgctcaagtccacggaagcctggatcgagaacacatcccacctacttgctaatcctgcagattacgattctctccgaaccctgagccaccacgcttccaccgtccagatggctttagaagacagtgagcagaaacacaacctgctacacagcatattcatggaccttgaggatctctctattatatttgagactgatgagctgacccagtccattcaggagttgtctaaccaggtcaccgccctgcagcagaagatcatggagagcctgccacagatccagcgaatggctgatgacgtagtggcaattgagtccgaggtaaaaagcatggagaaacgcgtgtcgaaaattaagaccattttgctgtccaaggagatctttgacttcagccctgaagaacacctgaaacacggagaggtgattctcgaaaatattcgccccatgaaaaagacaatcgcagagatcgtgtcgtatcaggtggaactgcgcctgccacagactggtatgaaaccattaccagtgtttcagcgcaccaatcagctgctgcaggacatcaagctacttgaaaacgtgactcaggaacagaacgaattattgaaggtagtcattaagcagactaacgagtgggatgaagaaatcgaaaatctgaaacagatcctaaataactatagcgcccagttctccctcgagcatatgtctcctgatcaggctgacaaattgccccagctccagggagagatcgagagaatggagaagcagatcctgagcttgaatcagcgcaaggaggatcttctcgtcgacctgaaagctacagtattaaatctgcaccagcacctcaaacaggagcaggagggggtggaaagagatagactgccagctgttacctctgaagaggggggagtagctgaaagggacgcgtcggagcggaagctcaataggcggggctctatgagctatctggctgcagttgaggaggaagtagaagagtcaagcgttaaatctgataatggtgatgagaaagcagagccatcaccccaatcttggtcttctctttggaaacacgataaggatatggaagaggaccgcgctagtagttccagtggaacaattgtccaggaagcctacggaaagatctctacgtcggataactcaatggcacagattctgacccctgactcccttaatactgagcaggggcctgagtgctcactgaggccaaatcaaaccgaagaagggaccactcctccaatcgaggccgatactctggactcatctgacgcacaagggggactcgagccgagggtagaaaaaacaagacctgagccgaccgaagtgctacatgcctgcaagactcaggtagcagagcttgagctttggcttcagcaggcgaatgtggccgtagagccagagacccttaacgccgacatgcagcaggtgcttgaacagcagcttgttggttgccaggccatgctcactgagattgaacacaaggtcgcttttctactagaaacatgcaaggatcaggggctgggcgataacggagccacacagcacgaggccgaggccctgtccctgaaattgaagaccgttaagtgtaatctggagaaggtgcagatgatgcttcaggaaaaacactcggaggatcagcaccctaccattctcaagaaaagctctgaaccagaacaccaggaggccctgcaacccgtgaacctctcagaactcgagtccatcgtaactgagcgccctcagttttctcgccagaaagattttcaacagcaacaagtgctggagctgaaaccaatggagcagaaagatttcattaaattcattgaattcaacgccaaaaaaatgtggccacagtattgtcaacacgacaatgacacgacccaggagtcgtcggccagcaatcaggcttcctcccctgagaacgacgttcccgactcaattctgagccctcaagggcagaacggtgataaatggcagtacctccaccatgagctatcttccaagattaagctcccgctaccgcagctcgtagaaccccaggtttctaccaacatgggaattctcccttctgtaaccatgtacaactttaggtatccaacaaccgaggaactaaaaacatatacaacacagctcgaagatctcagacaagaggcttctaatttacagacgcaagaaaacatgacagaagaggcatacattaacctcgataagaagctgttcgaactctttctgaccctgtctcagtgtctctccagtgtcgaggaaatgctggagatgcctcggttgtaccgtgaagatggcagcgggcagcaggtgcattatgaaacactcgctctggagctgaaaaaactgtacctggctttgtctgataaaaagggcgatctcctgaaggcaatgacctggccaggcgaaaacaccaacttgctcctagagtgtttcgataatcttcaggtttgtctcgaacacacacaggcagccgcagtttgtcggagtaaatctctgaaagcgggcctggactacaatcgtagttatcagaacgaaatcaagcgtttgtatcatcagctgattaagtctaagacaagtttgcagcagtctttgaacgaaatctcgggtcagtcagtggctgaacagctccagaaagccgacgcttacactgtggaactggaaaacgcagaatctcgagtggctaaacttagagacgaaggcgagaggctacacttgccctacgcgttactgcaagaggtctataagttggaggacgttctggattctatgtggggaatgctgcgggctcgctacactgagttatctagcccatttgttaccgaatctcagcaagatgcactgctccagggaatggtggagctcgttaagattggcaaagagaagctggcacatggtcacctaaaacagaccaaatcaaaagtcgcactgcaggctcaaatcgagaaccataaagtgttctttcagaagctcgtcgcagacatgctgttgattcaggcctactctgccaagattcttccatccctactgcagaatcgggagactttttgggctgagcaggtcacggaggtgaagatcctagaagaaaagtcgaggcagtgcggcatgaagctgcagtctttactacaaaagtgggaggagttcgatgaaaattacgcatccctggaaaaagacctcgaaattttaatttcgaccctacctagtgtgtctctggttgaagagactgaggagaggcttgtggagagaatatccttttaccagcagatcaaaagaaacataggcggaaaacatgctcgcctttatcaaacgcttaacgaggggaaacaactcgtcgcaagcgtgagctgtcccgaacttgagggccagattgctaaactggaggagcagtggctctctctaaataagaaaatagaccacgagctacacaggctccaggccttgttgaagcacctgctctcctataatcgggactccgaccagctcaccaagtggctggaatcttctcaacacacacttaactactggaaggaacagagcctcaacgtatctcaggatttggataccatcagatccaatattaataatttctttgagttttcgaaggaggtcgatgagaaaagcagcctgaagacagccgtcatctctataggtaatcaattgcttcatcttaaggagaccgataccgcgaccttgcgggcatctctggctcaattcgagcaaaagtggacaatgctgattactcagctccctgacatccaggagaaactgcatcagctgcagatggaaaaactcccctcacgtaaagcaatcaccgagatgatctcatggatgaacaacgtcgagcatcagaccagcgacgaagactccgtacactcaccaagcagtgctagtcaggtgaaacaccttctgcaaaaacacaaggagttcaggatggagatggattacaagcagtggattgtcgactttgtcaaccagtccctacttcaactgtccacctgcgatgtggagagtaagaggtatgagcggaccgagttcgctgaacacctgggcgaaatgaatcgccagtggcacagagttcatggcatgctaaatcgcaagatccagcatctagagcagcttttggagagcattaccgaatctgagaataaaatccaaatcctgaacaattggcttgaggcgcaggaagagcggctcaagaccttgcagaaaccagaatccgtgattagcgtccagaagctactgctggactgccaggacatcgagaaccagctggccatcaagtccaaagctctggacgagctgaaacaatcctaccttactctagagtcgggggctgtaccattgctagaggacaccgcgagcagaatagatgagcttttccagaagaggtcctccgttctgacccaggtgaatcagctcaagacttccatgcagagtgtccttcaagagtggaagatatacgaccaactgtatgatgaagtgaacatgatgactatcaggttctggtattgtatggagcattcaaagccagtggtgctctcattggaaaccctgcggtgtcaggtggagaatttacaatctctgcaggatgaggccgaaagctctgaaggcagctgggagaaactgcaggaagtgatcggcaagcttaaagggttgtgcccctcagtagcagagattattgaagaaaaatgtcagaatactcataagcggtggacacaggtcaatcaagccatcgcagaccaactccagaaagcacagtcgttgctgcagctttggaaggcttactcaaacgcccacggagaggcagccgcgagactgaagcagcaagaggccaagttccagcaactagctaatatctccatgtcaggaaacaatttagccgaaatccttccccctgctcttcaggatattaaggagctgcagcacgacgtccagaagaccaaggaggctttcctgcagaatagctcagtcctcgatcggttacctcagcctgcagagtcaagcacacacatgttactgcctggccccctgcactcccttcagagagctgcatacctggaaaaaatgctgttagtgaaggccaatgaattcgagttcgtcctttcccagtttaaggattttggggtacggcttgagtcactcaagggcctgattatgcacgaagaagagaacttagataggctccaccagcaagagaaggagaacccggacagctttctgaatcatgtgctggccctaaccgctcaatcccctgatatcgagcatctgaatgaggtcagcctaaaactccctctaagcgacgtggccgtaaagactctgcagaacatgaaccgccagtggatacgcgccacagccacagcactggagagatgttctgaacttcagggcatcggccttaacgagaaatttttatactgctgcgagaagtggatccagctactagagaaaatcgaagaagcgctgaaggtggatgtggcgaacagcctccccgagttactggagcagcaaaagacctataaaatgctggaggccgaggtgtccatcaatcagactatagctgactcctacgtaactcagtccctacagctcctggacaccactgaaatagaaaatcgcccagaatttatcaccgagttcagtaaacttacagataggtggcagaacgctgtccagggagttagacagcgaaaaggcgatgtggacggcctggttcgtcagtggcaggactttaccacgagcgtggagaacctattccgctttcttaccgacacatctcacttactctcagctgttaagggccaggaacgtttttccttataccagaccaggagcctgatccacgagcttaagaacaaagaaatccactttcagcgcagaagaaccacctgcgccctcactctggaggcaggagagaaactgttgcttacaacggacctgaagactaaagaatctgtcggacgcaggatctctcagctgcaggactcatggaaggacatggagccgcagctggctgagatgatcaagcagttccagtcaactgtagagacctgggatcagtgtgagaaaaaaatcaaggagctgaagagccgactgcaggtgctcaaagcacaatccgaagaccctctgccagagctgcacgaggatctgcataacgaaaaggagctcatcaaggagctggaacagagcttggctagttggacccagaatctcaaggaactccagaccatgaaggccgacctgacccgccacgtactagtggaagacgtgatggtattgaaggagcagattgagcatttgcatagacaatgggaagatctgtgcctgcgggtagccattaggaaacaggaaattgaggacagactcaatacgtgggtagtgttcaatgaaaagaacaaagagctgtgtgcatggttggtgcagatggaaaacaaagtgctccaaaccgcagacattagcattgaggaaatgatagaaaagttgcagaaagattgtatggaggaaatcaatcttttcagtgagaacaaactgcagttaaagcagatgggtgaccagctgatcaaggcttcaaataagtctagggccgctgagatcgatgataaactgaacaagataaatgacagatggcagcacttattcgatgtaataggttccagggtgaagaagctgaaagagaccttcgcctttatccaacagttagacaaaaatatgtcaaatttgagaacatggttagcccggatagaaagtgagctgagcaaacctgtggtttatgacgtctgtgacgaccaagaaatccagaagcgcctcgctgaacaacaggatctccagcgagacatagagcagcactccgcaggagtggagtctgtttttaatatctgtgacgtcctcttgcacgactcagatgcctgtgcaaatgaaaccgagtgcgactccatccagcagaccacaaggtcacttgaccgtcgatggcggaatatctgtgcaatgagcatggagcgccgcatgaagattgaggaaacttggagactatggcagaagtttctggacgactactctcgatttgaagactggttgaagagtgccgaaagaacagctgcgtgcccaaatagctccgaagttctctacaccagcgctaaggaagagctcaagagattcgaggcttttcagagacagatccatgagcggcttacacagttagaattgataaacaaacagtatcggcgactcgctagggagaatagaaccgataccgcaagccggctgaagcagatggtgcatgagggtaatcagcgttgggataacttgcagcgtagagtgacagcagttttgaggcggttgagacacttcactaaccagcgggaggaattcgagggcaccagagaaagcatccttgtgtggctgacagagatggatctacaattgacaaatgtggagcacttttctgaaagcgatgctgacgacaagatgcgccagctgaacggattccagcaggagatcactctgaatacaaacaaaatcgaccagcttattgttttcggcgagcaattgatccagaagagcgagcccctggacgcagtacttattgaagacgagttggaagaactccatagatattgccaggaggtgtttgggcgcgtgtctaggtttcacagacgcttgacatcctgcacgccaggtcttgaggatgagaaggaagcttcagaaaacgaaaccgacatggaggacccccgagaaatccagacagattcatggaggaagcggggtgaatcagaggagccaagctctcctcagtcactctgtcacctcgttgcccctggacatgagcggagcggctgcgaaacacccgtcagcgttgactccatccctctggagtgggaccacactggggacgtcggcggctcaagttcccacgaggaggacgaggagggtccatactattccgcactgagcgatgtggagattcccgaaaatcccgaagcgtacctgaagatgactactaaaactctaaaggccagctctgggaagtcgatttctgacggccacagctggcatgtgcctgattcaccatcctgccctgagcatcactataagcagatggaaggggatcgaaatgtgccgcctgtcccccccgcctctagtacaccttacaagcctccttacggcaagctgcttttgccgccaggcacagacggcggaaaggaggggcctagagtgctgaacggcaatccacagcaggaagacggagggttggccggcatcaccgagcaacaatccggcgcatttgaccgttgggaaatgattcaggcccaggaactgcacaataagttaaaaattaagcagaatttgcagcagctcaattccgacatctccgccattactacctggctcaagaagaccgaagcagaattggagatgctgaagatggctaagccaccatccgatatccaggagatagagctcagggtgaaacggttacaggaaattctgaaggcattcgacacctataaggctctcgtcgttagcgtgaatgtttcgagcaaagaattcctccagactgaatctccagagtctacagagctacagtccagacttagacagttgtcccttctgtgggaggctgctcaaggagctgttgacagttggcgtgggggtcttagacagtccctgatgcagtgccaggactttcaccagctcagccagaacctgttgctatggctcgcctccgccaagaaccggaggcagaaagcccacgtgaccgatcctaaggctgaccctcgggcactattggaatgtaggcgtgaactgatgcaactggaaaaagagcttgttgagcggcaacctcaggtcgatatgctgcaagaaatcagtaattctctcctgatcaagggacatggcgaggattgcatcgaggctgaggagaaagtgcacgtgatcgagaaaaaactgaagcagctgcgtgagcaggtttctcaggatcttatggctctacagggcacgcaaaatcctgccagccccctgcctagctttgacgaagtggacagtggcgaccagcccccagctacatctgttccagcccctagggccaaatttcgagcggtgcgcacaaccgagggcgaagaagaaactgaaagccgtgtgcctgggagtacaagaccacagcgaagctttttgtcaagagtggtccgagccgctctgccactgcagctcctcctgctcctcctgctattactagcatgcctattaccctcttctgaagaggattattcttgcacacaggccaacaattttgccagatccttctaccccatgttaagatataccaacggcccaccacctacatag

SEQ ID NO: 206679 - DNA, 9813 bp, Artificial Sequence
  Description of Artificial Sequence: Synthetic coding sequence
atggagaagctgcggatcaagtacagcgagatgtacaccatcgtgcccgccgagatcgagtcgcaggtggaagagtgtcggaaggccctggaggatattgacgaaaagatatccaacgaggtgctgaaaagttctccttcttacgccatgcggcggaaaattgaagagatcaacaacggactgcataatgtggaaaaaatgctgcagcagaagagcaagaatattgagaaggctcaggagatccagaagaagatgtgggacgagctggacctgtggcattccaaactgaatgaactggatagcgaggttcaagacatagtggaacaggaccctgggcaagcgcaggaatggatggacaatttaatgatcccttttcagcaataccagcaggtttctcaacgggccgagtgtagaacctcccagctcaataaggccactgtcaaaatggaagagtactctgatctccttaaatctactgaagcttggattgagaataccagtcatctgctggcaaatccagccgattacgactcactgagaacactatctcaccacgcgtcgacggtgcaggattccaagtgtttcaggagtggcccccggcccaacatctatgtgtcatattatgtcaccgtcattcagatggcacttgaagactccgaacagaagcacaatctcttgcattctatcttcatggacctcgaagatttgtccataatcttcgagacagatgagctgacccagtccattcaggagctgtccaatcaggtcacagccctgcagcagaaaattatggagtcccttcctcagatccagaggatggcagacgacgtggtcgcgatcgaaagcgaagtcaagagtatggagaagcgcgtgtctaaaataaagaccatcttgttatccaaagagatcttcgatttctcacccgaagaacatcttaagcacggcgaggtcatcttggagaatattaggcctatgaagaagactatagctgagattgtgtcttatcaagtagagttgaggctcccacaaaccgggatgaaacctttaccggtattccagcggaccaaccagctcttacaagatattaagttactagagaacgtcactcaggagcaaaacgagctgcttaaggtagtgatcaagcagaccaacgaatgggacgaggaaatagaaaacctcaagcagattctgaataactacagcgcccagttttccctggagcatatgtctccagaccaagccgataaactgccccagctccagggggagattgagcgaatggaaaagcagatcctttccttaaaccaacggaaggaagacctcctggtggacctcaaagctaccgtactgaacctgcaccagcacctgaaacaggaacaggaaggcgtggaacgcgacaggttgccagctgtgacctctgaagaaggtggggtcgcggaaagggacgcctcagagaggaaactgaatagacgcgggagtatgagctatctggcagcagttgaggaagaagtggaggaaagcagcgtgaagtcagataatggagacgaaaaggccgagccctccccacagagctggagttccttatggaagcacgataaggacatggaggaagaccgagcgtcctctagctctggcacgatagtccaggaggcctatggcaaaatttctacaagtgataactcaatggcccaaattctcactcctgatagcctgaacacggagcagggaccggaatgtagcctgcgccctaatcagaccgaggagggaactactccccccattgaggctgatacccttgactcctctgatgcccagggtggacttgaacctcgggtcgagaaaacaagacccgagcccactgaagtgcttcatgcatgtaagactcaagtcgccgagttggaactttggctccagcaggccaatgtcgctgtcgagcctgaaacactgaacgcagacatgcaacaagttctagaacaacagttggtcgggtgtcaggccatgctaacagaaatcgagcataaagtggccttcctactggagacttgtaaggatcagggattaggagacaacggcgcgacccaacacgaggcagaagcactctcacttaaactcaagactgtaaagtgtaatctggagaaagttcagatgatgttacaggaaaaacatagcgaggaccaacaccctacaatcctgaaaaaatccagtgaacccgagcaccaggaggcactgcagcctgtgaatctcagtgaactggagtccatcgtgactgagaggccccagttcagtagacagaaagattttcagcagcagcaggtgctggaactgaagccaatggagcagaaggatttcattaagtttatcgagttcaacgcgaagaagatgtggcctcagtattgccaacacgataatgacacaactcaagagtctagcgcttccaaccaagcgtcttccccggaaaacgacgttccagactccatactatcacctcagggccagaacggtgacaaatggcagtacttgcaccacgaactgagttctaaaattaagctgccccttccacaattggtcgaaccccaagttagtaccaatatgggaatccttccctcagtgactatgtataacttccggtatcccactacggaggagctcaaaacttatacaactcagctcgaggatctgcgccaggaagcatcgaaccttcagacgcaggagaatatgactgaggaagcttatatcaatcttgataaaaaactgttcgagttattcttaactctgtcccagtgcttgtcctccgtcgaggaaatgctagaaatgccaagactttacagggaagacggtagcggccagcaggtgcactacgaaacactggccctcgaattaaaaaagctgtacctggcccttagcgacaagaaaggagacctgctcaaagcgatgacatggcctggagagaatacaaatctgctgctggaatgtttcgataatctgcaagtttgcctcgagcacacccaggcagccgccgtatgtcgttcgaaatccctgaaagcaggcttagattacaatagaagctaccagaatgaaataaagcgcctgtatcatcaactgataaagtctaaaacttcgctgcaacaaagtctgaatgaaatctcaggtcaatctgtcgctgagcaactccaaaaggcagatgcctacaccgtagaacttgagaacgcagaaagcagggtggctaaactgcgggacgagggggaacggcttcacctgccatacgcgttattgcaagaagtctacaaactcgaggatgtcctcgactcgatgtggggcatgttgagagcccgctatactgaactgtccagccctttcgtgaccgagagccagcaagatgctttacttcaggggatggtcgagttggtcaaaattggaaaagaaaaactcgcacatggacacctgaagcaaacaaagtcaaaggtggccctgcaggcgcagatcgaaaatcataaagtgttcttccagaaactggtggccgatatgctcctgatccaggcatacagcgccaaaattttgccgtccctgttgcagaacagggaaacgttttgggccgaacaggttactgaagtcaaaatccttgaggaaaagagccggcaatgcggaatgaagttgcagtcactgctgcagaaatgggaggagttcgatgaaaactacgcctctctggaaaaagacctggaaattttaattagtactttaccaagcgtcagcctggtggaggagactgaggagcggttggtcgagaggatcagcttctatcaacagattaagcggaacattggtggaaagcatgctcggctataccagacactgaacgagggtaaacagctggtcgcatcagtcagctgtcctgaactcgaaggtcagatcgccaaactggaggagcagtggctctcactgaataagaaaatcgaccacgagcttcataggctgcaggcattactgaaacatctcctcagttacaatcgggatagtgatcagctgacaaagtggctcgaaagcagccaacacactctgaattactggaaagagcagtcactgaacgtgtcccaggatctggacacaatacggagcaatatcaataacttctttgagttctctaaggaggttgacgaaaagtcttcattgaaaacagcggtaatttctatcggaaaccagctgctgcacctgaaggagaccgacacagcaacgctacgagcctctctcgcccagttcgagcagaagtggactatgctcataacccaactgccagatatacaagagaaattgcaccaactgcagatggaaaagctcccctccaggaaggccatcaccgagatgatatcatggatgaacaacgtggagcatcagacgagtgacgaagactcggtgcacagcccgagttctgcaagccaggttaaacacctactccagaaacacaaggaatttcgtatggagatggattataaacagtggatcgtggattttgttaatcagagcttgcttcagctcagtacgtgcgacgtcgagagcaagcggtacgaaaggaccgagtttgcagaacacctgggggagatgaacaggcagtggcacagggtccacgggatgctgaataggaagattcaacatttggaacagctgcttgagtcaatcacagagtctgaaaataagattcaaatccttaacaactggttggaagcacaggaagagcgcctgaagacactgcaaaaacccgaaagcgtgatcagtgtccaaaagctgttgctcgactgccaggatatcgaaaaccagctggccatcaagtccaaggcgctcgatgaactaaaacagtcctacctcactctagagagcggcgccgtgccccttctggaggataccgcctctcgaatagacgaactgttccagaagcgaagttcagtcttgacccaggtcaatcagctcaagacttccatgcagtcagttctgcaggaatggaagatctacgatcagttatacgatgaggtgaatatgatgactatccgcttttggtattgcatggaacacagtaaacccgtggtgctaagcctagagaccctccgatgccaggtggaaaacttacagagcctccaggatgaggccgagtcctcagagggcagctgggagaagctccaagaggtcattgggaagttgaagggtttatgtccttccgtcgcggagattatagaggaaaagtgtcaaaatacccacaaacggtggacacaggtgaaccaggctatagctgatcagctacagaaagctcaaagcctcctccaactgtggaaggcctatagtaatgcccacggagaggccgcggcccgcctaaagcagcaagaggctaaattccaacaacttgccaacatctctatgtccggcaacaacctggccgagattttaccacccgccctccaggacattaaggagctgcaacacgacgtgcagaagactaaagaggctttcttgcagaatagtagcgtgctggatcggctgccacagcctgcggaaagttctacacatatgctactcccggggccccttcatagcctccagagagcggcatatcttgaaaaaatgctgctggtgaaagccaacgaatttgaatttgtgctaagtcagttcaaggattttggagtcagacttgagtctctaaagggtttaatcatgcatgaagaggaaaatctcgatcggttgcaccagcaagagaaagaaaacccagatagttttctgaaccacgtcttggccttaacggcacaatctcccgatattgaacatctgaatgaggtctcgctgaaactgccgctgtctgatgttgcggttaaaacactccagaatatgaacagacagtggatcagagcaaccgctaccgcactggagcgctgctcagagttacagggcatcgggttaaacgagaagtttctgtattgctgtgagaagtggatccaactgctcgaaaagattgaggaggctttgaaggtggacgtggccaactcactgcctgaacttttggaacagcagaagacttacaaaatgctggaagccgaggtgtcaattaatcaaaccatcgctgactcgtacgtgacccagtcgctgcagttactcgatacaaccgagatagagaaccgacctgagtttattacggaattcagcaagctcacagaccgctggcagaatgccgtgcaaggggtaagacagcgaaagggagatgttgatgggctggtgagacagtggcaggactttactacgagtgtggagaatctcttccggttcctcaccgatacttctcatttgctctctgcagttaagggccaggaaaggttctctctgtatcagacacgcagtctcatccacgaactgaagaacaaggagattcacttccagcggaggagaaccacatgcgccctgactctagaagcgggagagaagttgctgctcactaccgacttgaagactaaagagtcagtaggaagaaggataagtcagctgcaagactcttggaaagatatggagccgcagctcgccgaaatgataaaacagttccagagtacggtagagacttgggaccagtgcgaaaagaagatcaaggagctcaagagccggctgcaggtccttaaggcgcagagcgaggaccccctccccgagctgcacgaggatcttcacaatgaaaaagaactgattaaggaactcgaacagtcgctcgccagttggacccagaacctcaaggaacttcaaaccatgaaggcagacctaacgagacacgtactcgttgaggacgtgatggttctcaaggagcagatcgagcatttgcaccggcagtgggaagacctctgcctgagggtggccatccgaaaacaggagattgaagatcgactgaatacttgggtcgtgtttaacgagaaaaataaagaactgtgcgcctggctggtgcagatggaaaataaggttctgcaaaccgcagacatcagtattgaagaaatgatcgagaagttgcagaaagactgcatggaggaaatcaacctcttttcagagaataagctgcaactgaaacaaatgggcgaccaactgatcaaagcatccaacaagagcagggcggctgagatcgacgataaacttaacaagatcaatgaccggtggcaacacctctttgacgtcatagggtcgagagttaaaaaactgaaggaaacctttgcttttattcagcagcttgataaaaatatgtcaaaccttcgtacatggcttgccagaattgaatccgaactgtcaaaaccggtggtatacgatgtgtgcgatgatcaggagatccagaagcgcctagctgagcagcaagatcttcaacgcgacattgaacagcactctgcgggcgttgagagcgtgtttaatatctgcgacgtgctgctccacgactctgacgcttgcgcaaacgagacggagtgtgattcgatccagcagacaacacgtagccttgatcgacggtggagaaatatatgtgcgatgtccatggaaagacggatgaaaatagaggagacctggaggctgtggcagaagtttctggacgattattccaggttcgaagactggctgaaaagcgcagagagaacagcagcttgccctaattctagcgaagtgctgtacacaagcgccaaggaggaacttaagcggttcgaagcgttccagcggcagatccacgagaggcttacccagctcgagctgataaacaagcagtaccggaggctagctagagaaaataggactgacacagcatcccggctgaagcagatggttcacgaggggaatcagcggtgggacaatctccaaagacgagtaactgccgtgctgagaagattgcggcattttacaaaccaacgcgaggagttcgagggtacgcgcgaatcgattctggtttggctcaccgagatggaccttcaactgactaacgtggaacactttagcgaatctgatgcagatgataaaatgagacagctgaacggattccagcaggaaatcacactgaacactaacaaaattgatcaactgatcgtgttcggggagcagctgatacagaagtccgagcctttggatgctgtgctcattgaggatgaattagaggaactccatcgctactgccaggaagtatttggtagggtgtcccggttccatcggaggcttaccagctgtacaccaggtctagaggacgaaaaggaggcaagtgagaacgaaaccgacatggaagacccacgggagattcagacagacagctggagaaaacgaggggaatcagaggaaccaagttccccccaatccctgtgccacttagttgcgcctggccacgagagatccggttgtgaaacgcctgtcagtgtggactccatccctctggaatgggaccatactggcgatgtcgggggatcctcttctcatgaggaagatgaagagggcccatactacagcgccctgtcaggaaagtcaatttctgacggtcattcatggcacgtgccggattctccatcttgtcctgagcatcattacaagcaaatggagggggatcgtaacgtcccgcccgtgcctcctgcgtcatccacaccatataagcccccttatggcaagctccttttaccccccggaaccgacggagggaaagaaggacctagagtccttaatgggaacccccagcaggaggacggcggccttgcaggcatcactgaacaacagtctggggcattcgaccgttgggaaatgattcaggctcaagagctgcacaataaactgaagattaaacagaatctccagcagttaaactcagacatttctgccattacaacttggctaaagaaaaccgaagcggagttggaaatgttaaagatggccaaacccccaagtgacattcaagaaatcgaattgagggtgaaacggcttcaggagattttgaaagcttttgatacgtataaggccttggttgtgtcagtaaacgtcagctctaaagagttcctacagacagagtctcctgaatccacagagctccagtcccgcctaaggcagctgtccctcttatgggaagcagctcagggggctgtggactcctggcgaggaggcctcaggcagagtctgatgcagtgtcaggattttcaccagctgtcacaaaatctgctcctttggctggccagcgctaagaaccggcgtcagaaggcgcacgtgaccgaccccaaggccgacccccgagcactcttggagtgtagacgagagctgatgcaactggagaaggaacttgtggaacgtcagccccaggtggacatgctccaggaaatatctaacagcctgctgattaaaggacacggagaggactgcatcgaggcagaggagaaagttcatgtcatcgaaaagaagctcaagcagttgcgcgaacaggtgagtcaggatctaatggccctgcaaggtacacagaacccagcatccccactaccctcctttgatgaagtggactccggggaccagccaccagctacatccgtgcccgcgccacgggcgaaacagtttcgcgccgtacgcactacagaaggtgaggaagagaccgagtcacgcgtgccagggtctacgcgaccccagcggagcttcttgagccgcgtcgtaagagccgcactgccattgcagctcttattgttgttgctgctactgctggcctgcctgctcccgtcaagcgaggaggactactcatgtactcaggccaataactttgcccgttcattctatccaatgcttcggtacacaaacgggcccccgcctacctag

SEQ ID NO: 206680 - DNA, 1290 bp, Artificial Sequence
  Description of Artificial Sequence: Synthetic coding sequence
atggagggcgaccggaacgtgccccccgtgccccccgccagcagcacgccctataaaccaccctacggaaaactccttctcccccctggaaccgatggcgggaaggagggcccccgcgtcctcaatggcaatccccagcaggaagacggagggctggcagggattactgaacagcagagcggcgcctttgatcgttgggaaatgattcaggcacaggagttgcataataagctgaaaatcaaacagaatctgcagcagttgaatagcgatatcagtgccattactacctggctcaaaaagaccgaggccgagctggagatgctgaagatggccaaacctcctagcgacatccaggaaattgagcttcgtgtcaagcgacttcaagaaatactcaaagcattcgacacttataaagccctggtagtctccgttaatgtctcttcaaaagagtttctgcagacggagtctccagaatcaacagagctccagtcacggctcaggcagttgagcttgctgtgggaagccgcccagggggccgtggacagttggagaggggggctccgccagtcattaatgcaatgtcagggctcgaagacacgacctcgttcagatgtgctgtttttcaaagacttccatcagctttcacagaaccttctgctctggctagccagtgccaagaataggcgccaaaaggctcatgtaacagatccaaaggctgacccacgggctctcctggaatgtagacgcgagctaatgcagctggagaaggaactagttgagcgtcaacctcaggttgatatgctccaggagatctccaatagcctgctcattaaagggcatggagaggactgcattgaagccgaagaaaaagtgcatgtgatcgaaaagaaactcaagcagctcagagagcaggtgtcccaagatctgatggctcttcagggaacccagaaccctgcaagtcccttgcccagcttcgatgaggtggactccggagaccagcctccagccacatctgtgcctgccccaagggcaaaatttagggccgtacgcaccacggagggcgaggaggaaaccgagagtcgagttcccgggtcaacaagacctcagaggtcattcctttcgcgagttgtgcgggccgccctgcccttgcagctgctccttctgctgcttctgctccttgcctgccttctgccatcttctgaggaagactactcatgtactcaggctaataattttgcacggagtttctatccaatgttgcgctataccaatggccctccacctacatag
